United States Patent 9,587,003 (MODIFIED POLYNUCLEOTIDES FOR THE PRODUCTION OF ONCOLOGY-RELATED PROTEINS AND PEPTIDES) - sequence listing, part 9

SEQ ID NO: 13802 - DNA, 17673 bp, Artificial Sequence
  Description of Artificial Sequence: Synthetic coding sequence
atggagaaggaagagactactagggagctgctgctccctaactggcaagggtctggttctcacggcctcaccatcgctcaaagagacgatggagtgtttgttcaggaagtaacgcagaatagccccgctgcaagaacgggtgtagttaaagagggcgatcagattgtgggggccaccatttactttgacaacctgcagagcggggaggtaacacagctgttgaataccatgggtcatcacactgtgggacttaaacttcatcggaaaggtgaccggagccccgagcctgggcagacttggacccgggaagtttttagcagttgttctagcgaggtggtgttgtcgggagacgacgaggaatatcaacgcatctacactacaaagatcaaaccaaggctcaaaagcgaagacggcgtggagggagacttaggggagacgcagagcagaaccatcaccgtcactcgacgcgtaactgcttataccgtggatgtcacaggtagagagggagccaaggatattgacatatcctcaccagagtttaagataaagattcctagacacgaactgaccgaaatatccaatgtggatgtcgaaacccaatcaggtaaaactgtgataaggctcccctccggatcgggtgcggccagtccaactggttccgctgtggatataagggctggcgcgataagcgcgtccggtcccgaactgcaaggcgccggacattccaagctgcaggtaaccatgcctggcattaaggtgggagggagtggggtgaacgtcaatgcaaaaggcctggatctcggaggtagaggcggagtccaggtgcctgcagttgatatctcgtccagcctaggaggtcgtgctgtcgaggtacagggaccgtccctggaatccggtgatcatggaaagattaaatttcctaccatgaaagtgccaaagtttggggtttctacagggcgggaaggccaaacccccaaagctggtctgcgagtatctgctcccgaggtgagtgtgggtcataaaggcggcaaaccaggcctaacgatccaggcccctcagcttgaggtttcagtgcctagcgctaacatcgagggcctggagggaaagctcaagggacctcagataactgggccgtctctggaaggcgacttaggcctaaagggagcaaaaccgcaaggacacattggggtggatgcctcagccccccagatcggtgggtcaatcaccggcccctctgtggaggttcaggcgccagacattgatgtccagggccccggtagcaaacttaatgtccccaagatgaaggttcctaaattctcagtttcgggggctaagggcgaggaaactggcatcgatgtcacgctgccaacaggggaagttaccgtgccaggggtctccggggacgtatcgctgcccgaaatagctactgggggcttagaaggcaaaatgaagggaaccaaagtcaagacccccgaaatgatcattcagaagccaaaaatatccatgcaggatgtggacctgtctctcggctcccccaaattaaaaggcgacattaaggtaagcgctcccggggtccagggagacgtaaagggacctcaggtggcccttaagggcagccgagtcgatatcgagacccccaacctcgagggtacccttactggcccacgtctcggcagcccttcagggaaaacgggcacttgtcgcattagcatgtccgaggtggatttaaatgtggccgcacctaaggtgaaaggaggcgtggacgttactttgcccagggtcgagggtaaggtgaaggttccggaggtggacgttcggggacctaaagttgacgtctccgcaccggatgtggaggcacacggtcctgagtggaacctgaagatgcccaagatgaaaatgcctactttttcaactccaggcgcgaaaggcgaaggcccggacgtccatatgacgttgcccaaaggcgatatctccattagcgggcccaaggtgaatgtagaagctccggacgtcaacctggaggggctaggcggcaagctgaaggggcctgacgtcaagctccccgacatgagtgtgaagactccgaaaatttctatgcctgacgtggatctgcacgtgaaggggactaaggtcaagggggagtatgatgtgacggtgccgaagctggaaggggaactcaagggccctaaggtggatatcgatgctcctgacgtggacgtgcatgggcccgactggcacctgaagatgccaaagatgaaaatgcctaagttcagcgtccctggctttaaggctgagggccccgaggtagacgtgaacctcccgaaggctgatgtggacattagtggccctaaaattgatgtgacagctcccgatgtgtcaattgaggagccagaagggaaactgaagggtccaaaattcaagatgccagagatgaacatcaaagtacctaagataagcatgcccgatgttgacctgcatctgaagggtcccaatgtaaagggagaatacgatgtgacaatgccaaaggtggaaagtgagataaaagtgccggatgtggaactgaagagcgcaaagatggacatagatgtacctgatgttgaggtccagggcccagattggcacctgaaaatgccaaagatgaaaatgcctaaattttcgatgccgggcttcaaagcagaaggtcctgaagtcgatgtaaacctgcccaaagccgatgtagatatcagcggaccgaaagtgggcgtggaagtgccagacgttaacattgagggtccagaaggcaagctcaaagggcctaaatttaagatgcccgaaatgaacatcaaggcccctaaaatttcaatgcccgatgtcgacctgcacatgaaaggccccaaagtgaagggcgagtatgacatgacagtcccgaaattagagggagacttaaagggccctaaggtcgatgttagcgctcccgacgtagagatgcaagggccagattggaatctgaaaatgccaaagatcaaaatgccaaagttttctatgccgagccttaaaggagagggtcctgagtttgacgtgaatctgagcaaggccaacgtagacatatcagccccaaaggtggatactaacgcacccgatctttcgctggaggggcccgaagggaagttaaagggccccaaatttaagatgccagagatgcactttcgggcacctaaaatgagcctccccgacgtcgacctggaccttaaggggccaaagatgaaggggaacgttgacatctctgccccaaagatcgaaggcgaaatgcaggtgccggacgtcgatattcgggggcctaaggttgatatcaaagctcctgatgtggaaggccagggtctagattggagcctgaaaatcccgaagatgaaaatgcccaaattctcgatgcctagcctgaagggagaaggtcctgaagtggatgtgaatctgccgaaggccgatgtagtggtgagtggacctaaggtcgacatcgaggctccagacgtgtccctcgaggggcccgaggggaaactcaagggccccaagtttaagatgccggaaatgcactttaaaactcccaagatctccatgccagacgttgacctacatcttaagggcccaaaagtcaagggtgatgtcgacgtatcagtccctaaagttgaaggggagatgaaagtgcctgacgttgaaatcaagggacccaagatggatatcgacgcacctgacgtcgaggttcagggccccgattggcatctcaagatgccaaaaatgaagatgcccaaattcagcatgccaggcttcaagggagaaggcagagaggttgatgtaaatctgccaaaggccgatatagatgtttctggaccaaaggtggacgtggaggttccagatgtgtcattagaaggcccagagggaaaactcaaaggaccgaagtttaaaatgcctgaaatgcacttcaaggctcctaagatctctatgcccgacgtcgacttaaacctcaagggccctaagctaaaaggcgatgtggatgtctccctgcccgaggtggaaggagagatgaaggtcccagacgtggatatcaagggacccaaagtcgacataagtgctcccgatgtcgacgtccacggccccgattggcacttgaagatgccaaaagtcaaaatgcccaaattcagcatgcctggctttaagggtgaaggacctgaggtagacgtgaaacttcccaaagccgacgttgacgtctccggtccaaagatggacgcggaggtgccagacgtgaacatcgaaggaccagacgcaaaactgaaaggcccaaaatttaagatgcctgagatgtcgatcaagcctcagaagatctccattccggacgttggtctgcacttgaaggggcccaagatgaaaggcgattatgatgtgacagttccaaaggtggaaggcgagattaaagcccctgacgtagatataaaggggccaaaagtggacataaacgcaccggacgtggaggttcacgggcctgactggcacctcaaaatgcctaaagtcaaaatgcccaaattctcaatgccagggtttaaaggggagggcccagaggtcgacatgaatctgcctaaagctgacctgggggtgtccggtcctaaagtggacatcgacgtgcccgatgtgaacttggaggctcctgaaggaaagctcaaggggcccaagttcaagatgcctagtatgaacatccaaacacacaagatctcaatgcctgatgtggggctgaacctgaaagctcccaaattgaaaacagacgttgatgtctcactgccgaaggtagaaggggacctgaaaggtcccgaaatagacgtgaaggcccctaagatggatgtgaacgtcggggatatcgatatcgagggaccagagggaaagctgaaggggccgaagtttaagatgcccgagatgcattttaaggcccctaagattagtatgcccgatgtcgatctccacctcaaagggccgaaggtcaaaggcgatatggatgtgtccgtgcctaaggtcgaaggagaaatgaaggtgccggatgtggatatcaaaggccccaaggttgatattgatgcacctgatgtggaagtacatgaccctgactggcatctgaaaatgcccaaaatgaagatgccaaagtttagtatgccggggtttaaggctgaaggccccgaagtcgacgttaatcttccgaaggcagacattgatgtttctggcccttctgtggatacggatgcccccgatttggacattgaaggcccagaagggaagctaaagggaagtaagttcaagatgccaaagctgaatatcaaagccccgaaagtctctatgccagatgttgatctgaatttgaagggcccgaaactaaagggcgagattgatgcttccgtgccggaattggagggagatcttcggggcccccaggtagacgtaaagggcccttttgtggaggccgaagtacctgatgttgatcttgaatgtccagatgctaaactgaagggccccaaatttaagatgcctgaaatgcacttcaaagctcccaaaattagcatgcctgacgtcgacctgcacttgaaaggacccaaggttaaaggagatgcggatgtctccgtcccaaagctggagggggatctgacagggccctcagtcggcgtggaagtacccgacgtcgagctcgagtgccccgacgcaaagctcaaaggcccgaagttcaagatgcccgacatgcactttaaggcccctaagatctccatgccagatgtggacctccatcttaagggtcccaaagtaaaaggagacgttgatgtgagcgtgcccaagctcgagggggacctgacaggcccatctgtcggggtcgaggtcccagacgtagaactggagtgcccagacgctaaactgaaaggccccaagtttaaaatgccggagatgcacttcaagacgccaaaaatatctatgcctgacgtggatcttcatctgaagggaccaaaagtcaaaggagacatggacgttagtgtccccaaggtggagggcgaaatgaaggttcctgacgtcgatattaaaggaccaaagatggatatcgacgcacctgacgtggacgtgcacggccctgactggcacctcaaaatgccgaagatgaagatgcccaagttttcgatgcccggcttcaaggctgaagggcccgaggtggacgtgaacctaccgaaagccgacgttgtggtgagcggacccaaagtagacgtggaggtccccgatgtttctcttgaaggaccggaggggaagcttaagggccctaaactgaaaatgccggaaatgcacttcaaggcccccaagattagcatgccagacgtagatctgcatctgaagggtcctaaggtgaagggcgacgtcgacgttagcctcccgaagctcgagggtgatcttaccgggccatctgtggatgtggaagttcctgatgtggaactcgaatgccctgacgcaaagctgaaaggcccgaagttcaaaatgccggaaatgcattttaaaacgccaaagattagtatgccagacgtcaatctcaatctcaagggacccaaagttaagggtgacatggatgtttctgtgcccaaagtcgagggcgagatgaaggtccctgacgtggatatcaggggccctaaagtggacatagacgctcctgacgtcgacgtccacggaccggattggcatttgaaaatgccgaagatgaagatgcctaagttctcaatgcccggatttaagggggaagggcccgaagtcgatgtgaatctgcctaaagccgacgttgacgtcagcggccctaaggtcgatgttgaagtgccggacgtatccctcgagggcccagaaggaaaactcaaggggcctaaatttaagatgcccgaaatgcacttcaaaacaccaaagataagcatgcccgacgtggattttaacctgaagggaccaaaaattaagggcgacgtcgacgtctccgcgcctaagttagagggcgagctcaaggggcccgagctggacgtaaaaggaccaaaactggatgccgacatgcccgaagtcgctgtggagggccctaacggcaagtggaaaacgccaaaattcaaaatgcccgacatgcacttcaaggcacccaaaatcagcatgcccgacttggacctgcatcttaagagcccaaaggccaagggagaggtggatgtggacgttccaaagctcgagggcgatcttaaggggccgcatgttgatgtgtctggacccgatatcgatatcgagggccctgagggcaagctgaaagggcccaaattcaaaatgcccgacatgcacttcaaagctcccaacatctcaatgccagacgtggacctgaatctgaaaggacccaaaataaagggagatgtggatgtgagtgtgccggaggtcgaagggaaactggaggtaccagacatgaatatcaggggcccgaaggtcgatgtcaacgcccctgatgtgcaggctcctgattggcatttgaaaatgcccaaaatgaagatgccaaaattttcaatgccaggcttcaaggctgagggaccggaggtggacgtcaacctgcctaaggctgatgtggacatctcaggccccaaagtagatattgaaggtcccgatgttaatatcgaaggcccagaagggaagctaaagggaccaaagctcaagatgcctgaaatgaatatcaaagctcccaaaataagcatgcctgattttgacctacatctcaaaggacctaaggtcaaaggcgatgtcgacgtaagcctccctaaagttgaaggagacttaaagggccctgaggtcgacatcaaggggcctaaagtcgatattaatgccccagatgtcggcgtccaggggcccgattggcatttgaagatgccaaaagtcaagatgcccaaattttctatgccagggttcaagggcgagggacctgatggcgatgtcaagctgcccaaggcagacatcgacgtgagcggacccaaggtggatattgaggggcctgatgtaaatatcgagggacccgaaggaaagctgaagggacctaaatttaaaatgcctgaaatgaatataaaagctcccaaaatctcgatgccggatattgatctgaacctcaagggtcctaaggtgaagggcgacgttgacgtgagcttacctaaagtcgagggagacctgaagggaccggaggtcgatattaaggggccgaaggttgatatcgacgcgccagacgtcgacgtccacggccccgactggcatctgaagatgcccaaaatcaaaatgcccaaaatttctatgcctggctttaagggggagggtcctgatgtcgatgtcaatctgccaaaggcggatatcgacgtttctggacctaaggtagacgtggagtgtccagacgtgaacatagagggtcccgaagggaaatggaagagtcccaaattcaagatgcccgaaatgcacttcaaaacccccaagatttctatgcccgatattgatctgaatcttacagggcccaaaattaagggcgatgtcgatgtcactggtccaaaggtagagggcgatcttaagggtccagaggttgatctgaagggcccaaaggtggatatcgacgttcccgatgtaaacgtgcagggccccgattggcatctgaagatgcccaaaatgaagatgcctaaattttcaatgcctgggtttaaagcggaagggcccgaggtagacgtgaatctgcccaaggctgatgtagacgtgagcgggcctaaggtggacgttgaaggcccggacgtgaatatcgagggccctgaaggaaaacttaaaggacccaaatttaagatgcctgaaatgaacattaaagcccccaaaataccaatgcccgacttcgacctgcatcttaagggaccaaaagtcaagggtgacgtagatatcagcctgcccaaggtcgagggcgacttgaaggggccggaggttgacattaggggcccacaagttgatatagatgtgccagatgtgggggtgcagggccccgactggcaccttaagatgcctaaagtcaagatgcctaagttttcgatgccaggattcaagggggagggacctgatgtggacgtgaatctgcccaaggccgatttagacgtgtccggccccaaagtcgatattgatgttcctgatgtaaacattgagggccccgaaggcaaactcaaaggtcctaagtttaaaatgccagagatgaatataaaagcgcccaagatttctatgcctgacatcgatttgaacctaaaggggccgaaagtgaaaggggacatggatgtgtcgcttcccaaggtggaaggcgatatgaaagtccccgatgtcgatattaagggacccaaagttgatatcaatgcaccggacgtcgacgttcaaggccctgattggcacttgaaaatgccgaaaatcaaaatgcccaaaatttcaatgcctgggtttaagggcgaaggcccagaagtagacgtaaatctgcctaaagccgatctcgatgtgagcggaccaaaggttgacgttgatgtgccagatgttaatatcgaaggtcccgacgcaaaactgaagggcccaaagttcaagatgcccgaaatgaatattaaggcccccaagatctccatgcccgacttggacctgaacctaaaggggccaaaaatgaagggcgaggttgatgtgtctctggcaaacgttgagggcgaccttaagggacctgcgctggatataaagggccccaaaatcgatgtggatgcccccgatatcgatattcacggccctgacgccaagctgaagggccccaagctcaagatgcccgacatgcatgtgaacatgcctaagatatcaatgcctgaaattgacctgaacctgaaggggagtaagctgaaaggagacgtcgatgtaagcggtccgaagctagagggcgatatcaaagctcccagcctggatataaaaggacctgaagttgacgtctccggcccaaaactcaacattgagggcaagtcaaaaaagtctagattcaagctgcctaaatttaacttcagcgggagcaaagtgcagaccccggaggtggacgttaaagggaagaagccagacatcgatataactggacctaaagtggacatcaatgcgcccgatgtggaggtgcaagggaaagtgaagggctctaagttcaagatgccattcttgagtattagcagccccaaggtgtccatgccagatgtcgagttgaatctgaagagccccaaggttaagggagatctggacatcgccggccctaatctggaaggcgatttcaagggcccaaaagtcgatatcaaagcacctgaggtgaatctgaacgctccagacgtggatgttcacgggcctgactggaacctcaaaatgccaaagatgaagatgccaaaattctccgtcagcggtctgaaagcagaggggccagatgtggccgtggacctgccaaagggcgatattaacatcgaaggaccatcaatgaacattgagggaccggacctaaacgttgagggtcctgaaggaggcctgaaggggccaaagtttaaaatgccagacatgaacataaaagctcctaagatctctatgcccgacatcgatctcaacctgaaaggaccaaaagtgaaaggcgatgtcgacatctccctgcccaagctggagggcgacctcaaggggcctgaggtagacatcaagggtcctaaggtcgatattaatgccccagatgtagatgtccatgggccagactggcacttgaagatgccgaaagtgaagatgcctaagttttccatgccggggttcaagggggagggaccagaagtggacgtgacactgcccaaggctgacattgatatcagtggccccaacgttgacgttgatgtgcccgacgtgaacatcgagggtccagatgccaagttgaaggggcctaagtttaaaatgcctgaaatgaacatcaaagcacctaagatatccatgccggacttcgatttgaacttgaagggccccaaaatgaaaggagacgtggtagtgtctcttcccaaggtcgagggggatctcaagggcccagaggtcgacattaaggggccaaaagttgacatagatacgccggacattaacattgagggatctgaaggcaagttcaagggccccaaatttaagattccggaaatgcatttaaaggccccaaaaatttccatgcccgatattgatctgaacttgaagggcccaaaagtgaaaggcgatgttgacgtgtctttgccaaagatggaaggggatttgaaaggcccagaggtcgacattaaaggccccaaggtcgacattaacgcacctgatgtggatgtgcaggggcccgattggcacctcaagatgcctaaagtgaagatgccaaaattttctatgcctggattcaaaggtgagggccctgatgtcgacgtgaatctgcctaaggctgacttggatgtcagcggccccaaagtcgacatcgatgtcccagatgtgaacattgaagggcctgaagggaagctgaagggaccaaaattcaaaatgccagaaatgaacatcaaggcccctaagatatccatgccagacattgatttgaacctgaagggaccaaaagtgaagggagatatggacgtgagtttaccaaaggtggagggagacatgcaggtgcctgacttggatatcaaggggccgaaggtggatattaatgcacctgacgtcgatgtgcgggggccggattggcacttgaaaatgccaaaaattaagatgcccaagatttccatgcccggcttcaagggcgagggccccgaagtcgacgtcaacttgccaaaggccgacctggatgtgtcagggcctaaagtagatgtggatgttcctgacgtcaatattgaaggaccagatgcaaagcttaaaggccctaaatttaagatgccagagatgaacattaaagcgcctaaaatatcgatgccagattttgacttgcacctaaaaggtcctaaggtgaaaggagacgtggacgtctctttaccaaagatggaaggggatctaaaagcacccgaggttgacataaagggtcccaaggtggacatcgacgcccccgatgtggacgtccatggacccgactggcacttgaaaatgcccaaggtcaagatgcctaaattctcaatgcctggctttaaaggggaaggacctgaagtggacgtgaacctgcccaaggctgacattgacgtgtctggccctaaagtcgacatcgatacaccagacattgatatccatggccctgaaggcaagctcaagggaccgaagttcaaaatgcccgatctgcacttaaaagctcctaaaatctccatgccggaggtcgatctaaacctgaagggtccgaagatgaagggcgacgtggacgtgtctctgcctaaggtcgaaggggatctcaaggggcccgaggtcgatatcaaaggcccgaaagttgacatcgatgtgcccgacgtcgacgtacaaggcccagattggcatctcaagatgccaaaggtgaagatgccaaaattctctatgccaggatttaagggcgaaggacccgatgttgacgtgaacctgcctaaggcagatctagacgtgagtggacctaaggtggatatcgatgtccccgacgtgaacattgagggccccgacgctaaactcaaaggccctaagttcaagatgcccgagatgaacattaaggccccaaaaattagcatgcccgacttcgacctgcacctgaaaggccctaaggtgaaaggggatgtggacgtctcactgcccaaagtggagggcgacctgaaggggcctgaggtggatataaagggccctaaggtggatatcgacgcccctgacgtggacgtgcacggcccggattggcatttgaagatgccaaaagtaaagatgcctaaattttctatgcccggattcaagggtgaaggcccggatgtagatgtgacacttccaaaagcggatatagagatatcgggcccgaaagtcgatattgatgctcctgacgtgtccatcgaggggccagacgcaaaactgaagggacctaagttcaagatgcccgagatgaacattaaagctcccaagatttcaatgcctgacatcgatttcaatctgaaaggtccgaaggtgaagggagacgttgacgtgagtctgcccaaggttgaaggagatctgaaaggacccgagatcgatatcaaaggcccatccctggatatcgacacccccgacgtgaatatcgaaggtccggaaggaaagttaaaagggcccaaattcaagatgccagagatgaatattaaggcgccaaaaatttcaatgcccgactttgatttgcaccttaagggacccaaggtgaagggggacgtcgacgttagtttgccaaaggtcgagtctgacctgaaaggccccgaagtagatatcgaaggtcctgagggcaagcttaaaggccccaagtttaaaatgcccgacgtccacttcaagtctccacagatttcgatgagtgacatcgatcttaatctgaagggtcccaagatcaagggcgacatggatatttctgtgcccaagttggaaggggacctgaaaggtcctaaagtcgacgtcaaggggccaaaagtgggtattgatacacctgatatcgacatacatggtcctgagggcaaactgaagggccctaagttcaaaatgccagatctccacctaaaggctccgaaaatcagcatgcctgaggtggacctgaacttgaaaggtcccaaggtgaagggcgacatggacatctcgctgccaaaggttgagggagacctgaagggacctgaagtggatattagggaccctaaggtcgacattgacgtgccggatgtcgacgtgcagggacctgactggcatctaaagatgccaaaggtgaagatgcctaagttttccatgcctggttttaagggcgagggcccagacgtggacgtcaatctgcctaaagcagatattgatgtctccggtccaaaggtcgatgtggatgttcccgatgttaatatcgagggcccagacgctaaactcaaaggtcctaagttcaaaatgccagagatgagtataaaagcgcctaaaattagcatgcccgatatcgatctcaacttgaaagggccgaaagttaagggcgatgtggacgttacacttcctaaggttgagggcgatttgaaaggtcccgaggctgatattaaagggcctaaagtggacatcaatacgcctgatgtggacgtgcatggcccggactggcatctgaagatgcccaaggtgaagatgccaaagttttccatgcccgggtttaaaggagaggggcccgacgtcgacgtgtccttgcccaaggcagatatagacgttagcggacctaaggttgacgtcgacattcctgatgtgaacatcgagggccctgatgctaagctgaaaggtccaaagttcaaaatgccggaaatcaacattaaagcacccaaaatatccatccccgacgtggatctcgacttgaagggcccaaaggtaaagggtgatttcgacgtgtcggtgcctaaagtggaaggaactctgaaaggacccgaagtggatttgaaaggccccaggctcgactttgagggacctgacgctaaactgtctggaccatctctgaagatgcctagtctggaaataagtgctcctaaagtcaccgcaccagacgtagatctgcacttgaaagcccccaaaatcggctttagcggacccaagctagagggaggagaggtggacctaaaaggccccaaagtggaggccccaagcctggatgttcacatggactctccggacataaatatagaagggcctgatgttaaaattccgaaattcaaaaagccaaagtttggctttggagcaaaatcccccaaagcagacattaaatctccttctcttgatgtgactgtgccagaagccgaactgaacctcgagacccccgaaatctctgtgggtggcaagggtaagaaatcgaagttcaaaatgccaaaaattcacatgagcggcccaaaaatcaaagccaaaaagcaggggttcgatttaaatgtccctggaggggagatcgatgcttctctgaaagcccccgatgtcgacgtcaatattgccggccccgacgcagcactcaaagtggatgtaaagtcaccaaagactaaaaagactatgtttggtaagatgtacttccctgacgttgaattcgacatcaagtctcccaagtttaaagccgaggccccactgccgtctccaaaactggaaggggagttacaggcacccgatctggagctgagtctgcctgccatccacgtcgaaggcttagatatcaaagcaaaggcacctaaggtgaagatgcctgacgtcgacatatctgtacccaaaattgagggtgacttaaaaggtccgaaggtacaggccaaccttggtgcaccagatataaatatcgagggtctcgacgccaaagtcaagaccccaagttttggcatcagcgccccccaggtgtctatacctgacgtgaacgtaaatctaaagggtccaaagataaagggcgacgtaccctccgtgggccttgaaggccctgacgttgatctgcagggcccggaggcaaaaataaaattcccaaaattcagcatgccaaagattgggatacctggggtgaaaatggaaggcggaggtgcggaggtccatgcccaactcccttctctggaaggggatcttagaggccccgacgtgaaactggaagggcctgatgtcagcctaaagggtcctggcgttgacctgcccagcgttaatctgtctatgcctaaggtgtctggcccagatctggacctgaacttaaagggcccctcactcaaaggagatctggacgcctctgtgccctcgatgaaggtccatgcccccgggctgaacctgagcggggtcggcggtaagatgcaggtgggtggagatggcgtgaaggttccaggaattgatgccaccactaagctgaatgtaggcgcccccgacgttaccttgcggggcccctctcttcaaggcgatctggcagtgagcggcgatattaaatgtcctaaggtgtctgtgggtgcacccgacctgagtttggaagcaagcgagggaagtataaaactgcccaagatgaagctccctcagttcggcatcagcacaccaggatccgatctacacgtaaatgctaaaggaccgcaagtcagcggcgagttgaagggtccaggagtcgatgttaatctcaaggggcctcgaatctctgcgcccaatgtggattttaatctggaaggtcctaaagtgaaaggctcattgggagcgacgggagaaataaaagggccaacggtaggaggcggactaccaggaatcggtgtacagggcctggaaggcaacttacagatgccggggataaaatcctccggatgcgacgtcaatttgcccggtgtaaacgtcaagctaccaactggccagatatccggacccgaaatcaaggggggattaaaaggatccgaggtgggtttccatggtgcagcccctgatatatcagtcaaaggacccgcctttaatatggcaagtcccgagtcagacttcgggattaatctcaagggccctaagatcaaagggggagctgatgtttccgggggtgtctctgcaccagacattagtctcggggaaggacatctgagcgtgaaaggctctggaggtgaatggaaggggccacaggtcagtagtgctctcaacctggacacatctaaatttgccggtgggctgcacttcagcggccctaaagttgagggtggggtaaaaggaggacaaataggcttgcaggcccccggactgtctgtcagcgggccacagggccacctcgaaagtgggtctgggaaggtcacatttcccaagatgaaaattcccaaatttacattttctggacgagaactcgtgggaagagagatgggagtcgatgtgcactttccaaaagcggaagctagtatccaggctggtgccggcgatggagagtgggaggagtccgaggtgaagctgaaaaagtctaagatcaagatgccaaaattcaatttcagcaaacctaagggtaaagggggagtcactggttctccggaggcttccatctccggatcaaaaggagatcttaaatctagcaaagcctctctggggtccttggagggagaggcagaggcagaggcatcatctcctaagggaaaatttagcctcttcaaaagcaagaagccccggcaccggtctaactctttttctgatgagagagaattctctggtccatctaccccgactgggacacttgagttcgaaggaggcgaggtgtctctggaagggggaaaggtgaaggggaagcacggtaaacttaagtttggtactttcggaggattaggcagcaagagtaagggacactacgaagtgacaggtagtgacgacgagaccggtaaacttcagggctctggtgtgtccctggcctccaagaaatccaggctgtcaagtagcagcagtaacgacagcggtaacaaggtgggaatccaactgccggaggtggagctgagcgtgtcgacaaaaaaggaatag

SEQ ID NO: 13803 - DNA, 372 bp, Artificial Sequence
  Description of Artificial Sequence: Synthetic coding sequence
atggagaaggaagagaccacccgggagctgcttctgcccaactggcagggctcgggctctcatggtctgaccattgcccaacgtgacgacggggtctttgtgcaagaggtgacccagaattccccagccgctagaactggcgtggtgaaagaaggcgatcagatcgtaggggcaacaatctacttcgacaaccttcagtccggcgaagttacccagctgttgaatactatgggccaccataccgtaggccttaaattgcataggaaaggagatcgatcacccgaacccggacaaacatggactagggaggtattcagtagctgttcctccgaggtcgtcctcagcggtgacgatgaagagtaccagcgatag

SEQ ID NO: 13804 - DNA, 435 bp, Artificial Sequence
  Description of Artificial Sequence: Synthetic coding sequence
atggaaaaggaggagaccactagagagttgctgctgcccaattggcaagggtcaggaagccacggattgactatcgctcaaagagacgacggcgtgttcgtccaggaagtcacgcagaattctcccgctgccaggacgggagtagtaaaggaaggagaccagatcgtgggggcaacaatctatttcgataacctccagtctggcgaggtgacccagctcctcaacaccatgggccatcacacagtgggcctgaagttgcaccgtaagggggaccgttcgcctgaacccggacagacttggacacgagaagtcttttccagctgttcctcagaggttgtcctcagcggggatgacgaggagtaccagcgcatttacacaaccaaaattaagccgaggctgaagtccgaggatggggttgagggtgatttaggatag

SEQ ID NO: 13805 - DNA, 261 bp, Artificial Sequence
  Description of Artificial Sequence: Synthetic coding sequence
atggagaaggaagaaaccactagggagctcttactcccaaactggcagggcagtggctctcatgggctcactattgcccagcgggacgacggcgtgtttgtgcaggaggtgacccagaacagccctgccgcgcgtactggcgttgttaaagaaggcgaccagattgtcggtgccacaatctactttgataatctgcagagcggcgaggtgacccaacttctgaacacaatggggcaccataccgtgggtctgaagctgtag

SEQ ID NO: 13806 - DNA, 366 bp, Artificial Sequence
  Description of Artificial Sequence: Synthetic coding sequence
atggagaaagaagaaacgacacgggagctgcttctgcccaactggcagggcagtggctcgcacggactcacgatagcacagcgcgatgacggcgtcttcgtccaggaagtgactcagaacagccccgcggctaggaccggtgtggtaaaagagggggatcagatcgtgggtgcgacaatttactttgacaatctccaaagcggggaggtcacacaactgctgaataccatggggcaccacaccgtagggttaaaattgcataggaaaggcgatagatctcctgaaccaggccaaacctggaccagggaggtgttttcctcatgctcctccgaggttgtgttaaataccccgcaaccctctgcctag

SEQ ID NO: 13807 - DNA, 2904 bp, Artificial Sequence
  Description of Artificial Sequence: Synthetic coding sequence
atggctaaggggttttatatcagcaaatccctaggcatcctggggattctactcggggtggcagctgtttgtaccattatcgccctctctgtggtgtattctcaagagaagaataagaacgcaaacagctctcccgtggcatccacgaccccctcagctagcgccacgacaaatccggcctctgcaactacgctagaccagagcaaagcctggaaccgctaccgactgccaaatacattgaaacccgattcctatagagtaacacttagaccctacctgactcctaatgatcgcgggttatacgttttcaaagggagcagtaccgtacgctttacatgtaaagaggcaacggacgttatcatcatccacagcaaaaaactgaactatactctgagtcagggccacagagtggtgctccggggcgtgggtggctcccagcctcctgatatcgataaaacggagctggtagaaccgactgagtatctggtagtgcaccttaagggctcactggtaaaggattcacagtatgagatggactccgaattcgagggcgagctggctgatgaccttgccgggttctatagatccgaatatatggaggggaacgtcaggaaagtagttgccactactcaaatgcaggcagccgacgcccggaaaagcttcccatgcttcgatgagcctgcaatgaaagctgaattcaatatcaccctgattcacccaaaagacctaacggccctgtccaacatgttgcctaaagggccgtctacacctctgcccgaagacccaaattggaatgttaccgagttccacactacccctaagatgagtacatatttgctcgcttttattgtttcagagtttgattacgtggagaagcaagcctctaacggcgtgctgatacggatttgggcccgaccatccgcaattgctgccggacatggggattatgcccttaatgttacagggccaatccttaacttctttgcgggacactacgataccccctaccccctgcctaagtctgaccaaataggactgccggattttaacgcaggagctatggagaattggggcctggtcacataccgagaaaattcactgttgttcgacccacttagcagctcatcatcaaacaaggagagggtcgttactgttatcgctcacgaactggcccaccagtggtttggcaatctagttaccatcgagtggtggaatgatctctggctgaatgagggattcgcatcgtatgtcgaatacttgggggccgattacgcagaaccaacctggaaccttaaggatcttatggtgctcaacgacgtttatcgtgtgatggccgttgatgctttagcatcttcgcatcctctgtcaacccctgcgtccgaaattaacacccctgcccagatctctgaactgttcgacgcgataagctattctaagggagcttccgtgcttcgcatgttatcctctttcctgtcagaggacgtatttaaacagggtttagcttcttatttgcacaccttcgcgtatcagaacacaatctatctaaatctgtgggaccatcttcaggaggctgtgaataaccgctctatacagctcccaacaactgttagagatattatgaaccggtggacattgcaaatgggattccccgtgattacagtggatacctctacaggtactctgtcacaggagcattttctcctcgaccctgacagtaacgtaactaggccttctgaattcaattacgtttggatcgttcccattacatccatcagggacgggaggcagcagcaggactattggctcatcgatgtgcgcgcacagaatgatcttttctctacatctggaaatgaatgggtgttgctgaatctcaatgtgaccggttattatcgcgtcaattacgatgaagagaactggcgcaagattcaaacccagctccaacgtgaccatagcgcaattccagtcatcaacagagcacagatcatcaacgatgcattcaatttagcctccgctcacaaagtaccagtcaccttggctcttaataatactctgtttctgatcgaagagaggcagtatatgccatgggaggcagcgctcagttccttaagctacttcaaattaatgttcgacaggagtgaagtttacggcccaatgaagaactacttaaaaaagcaggttactccactgttcattcactttagaaacaatactaataattggcgcgaaattcccgagaatttaatggatcagtattccgaggtgaatgctatcagtacagcatgttctaacggagtcccagagtgcgaagagatggtctctggcctgtttaagcagtggatggaaaaccctaataataatccaatacatccaaacctccgatctaccgtctactgtaacgctatcgcccagggcggtgaagaggagtgggattttgcttgggagcagttcaggaacgcaaccctcgtgaacgaggcagacaagctccgcgccgctctggcttgcagcaaagagctatggatccttaaccgttacctgtcttatactctaaatcctgacctcatccgaaagcaggatgccaccagcacaatcatctcaattaccaataacgtcattggtcaaggcctcgtgtgggacttcgtccagagcaactggaaaaagttgttcaacgattacggcggcggttccttttcatttagcaatctgatccaggccgttacacgccggttctccacagaatacgagctgcagcagctggagcagttcaagaaagacaacgaagaaacaggcttcgggagtgggacaagagccctggagcaggcattagaaaagacaaaggccaatattaagtgggtgaaagagaacaaagaggtggtcctgcagtggtttactgaaaactctaagtag

SEQ ID NO: 13808 - DNA, 312 bp, Artificial Sequence
  Description of Artificial Sequence: Synthetic coding sequence
atggcaaagggcttctatatttccaagagtctgggaatcctgggaattctattgggcgtggccgccgtgtgcactattattgccctttctgtcgtctatagccaggagaaaaataagaacgcaaacagttccccagtggcctcaactacacctagcgccagtgccaccactaaccccgcctcagccacgacactggatcagtcaaaggcgtggaaccgatacagactgccaaataccctcaaacccgacagttacagggtaaccctccgcccctaccttacaccaaacgatagaggcctgtatgtgttctag

SEQ ID NO: 13809 - DNA, 186 bp, Artificial Sequence
  Description of Artificial Sequence: Synthetic coding sequence
atggctaagggtttttatatctcgaagagtctgggcatcctggggatccttctaggagtggccgccgtgtgtacaattattgccctttccgttgtgtattcgcaggagaagaacaaaaatgccaacagtagccctgtggcatctactacgcccagcgcttcagccaccactaacccagcttcatag

SEQ ID NO: 13810 - DNA, 381 bp, Artificial Sequence
  Description of Artificial Sequence: Synthetic coding sequence
atgaatcagaataccgataagatctcggggtctggatctaactccgatatgatggagaattctaaagaagaaggaacttcctctagcgagaaatccaagtcttcaggatcgagccgatcgaaacgtaagccctccattgtgactaagtatgtggagagcgatgatgaaaagcctctcgatgacgaaaccgtgaacgaggacgctagcaacgagaacagcgaaaacgacattaccatgcagtctcttcctaaggggactgtaattgtgcaaccagaacccgtactcaacgaagataaagacgactttaaggggcctgaatttcggtctcgaagcaagatgaaaacagagaatcttaagaagcggggcggtaaatacaaatag

SEQ ID NO: 13811 - DNA, 7479 bp, Artificial Sequence
  Description of Artificial Sequence: Synthetic coding sequence
atgacagccgaaccgatgtctgaatcaaaattgaatacgttggtgcaaaagttacacgactttcttgcccacagttctgaagagtctgaggagacttccagcccaccaagactcgcaatgaatcaaaacaccgataagataagtggaagtgggagcaattcagatatgatggagaactcgaaggaggagggtaccagtagctccgagaaatctaagtcctcaggctccagtcggtcaaaacgaaaaccctccatagtgacaaagtatgtcgaaagtgatgacgagaaacccctggacgatgagacagttaacgaagacgctagtaatgagaactccgagaacgacataacaatgcagtccttaccaaaaggaaccgtcatcgttcagcctgagcccgttctgaatgaggataaggatgactttaagggaccagaattccggagcaggtcaaaaatgaaaacagaaaatctcaaaaagaggggtgaagacggtcttcacgggatcgtgtcgtgtaccgcatgtggccaacaggtcaatcacttccagaaggactctatttatcgccacccaagccttcaggttctgatctgtaagaactgctttaagtactacatgtctgacgatatctctcgcgacagtgacggaatggatgagcaatgccgctggtgcgcagagggtggaaacctgatttgctgtgacttctgccacaacgccttttgcaagaagtgtatcctgcgcaatctgggcaggaaagaactttcaacaatcatggacgagaataatcagtggtattgttacatatgtcacccagagccactgttggatttggtgactgcctgtaactccgtgtttgaaaacctggaacagctgctccagcaaaataagaaaaaaattaaagtggacagcgagaaatccaacaaggtgtacgagcacacaagtagattttcccctaagaaaaccagttcaaactgtaacggggaagaaaaaaagctggatgactcctgcagcggctcagtcacgtattcctactccgcgctgattgttcccaaggagatgattaagaaagccaagaagctcatagaaacaacagccaacatgaactccagctacgtaaaatttctaaagcaagccaccgacaattcagagatatccagcgccacaaaattgcgccagttaaaggccttcaagtcggtgctggcagacatcaaaaaagcacacctggctctggaagaggatctgaattcggaattcagggccatggacgccgtgaacaaggaaaaaaacaccaaagagcataaagtcatagatgccaaattcgagacaaaggcacgcaaaggcgagaaaccatgcgctcttgaaaagaaagatatcagcaagtccgaagccaagctgtcacgtaaacaggtcgacagtgagcacatgcaccaaaacgtccctactgaggagcaacggacaaacaaatccaccggaggggaacacaagaagtcagaccggaaggaggagccacagtacgaacctgcgaacaccagtgaagacctggacatggacatcgtgtccgtgccatctagcgtgccagaggacatatttgaaaatcttgagacagccatggaggtgcagagctctgtagatcatcagggggacgggtcttccggaactgagcaggaggtggagtcgtcatccgtgaagttaaatatctcatcaaaggacaaccggggaggcattaaaagtaagacgaccgctaaggtaaccaaggaactgtacgttaagctgacacccgtaagcctgtcaaattcccctatcaagggggctgactgccaagaagtgccgcaggataaggacggatataagtcctgcgggttaaaccctaagttagagaaatgcggcctcgggcaggaaaatagtgacaacgaacatcttgtcgaaaatgaggtgagtttacttctggaggagagtgacctgaggcggtctccccgtgtcaagactacccctctcagacggccaacagagactaatcccgttacatcaaactcagatgaggagtgtaatgaaaccgtaaaggaaaagcaaaaactctccgtgcctgtgcgaaaaaaagacaaaagaaatagttccgatagcgctattgataatcctaagcccaataaattgcccaaatctaaacaaagcgagacggtggaccaaaacagcgatagcgatgaaatgctggccatacttaaggaggttagtagaatgtcccactctagcagcagtgatactgatatcaatgagatccataccaatcacaagactctgtatgacctaaaaacacaggccggcaaagatgacaagggtaaaagaaaacggaaatcaagcacttcaggctctgactttgacactaaaaaagggaaaagtgctaaatcctctattatttcaaaaaaaaaaaggcagacccagtctgagtccagcaactacgacagtgaattggagaaggagataaagtctatgtcaaagatcggagcggctaggactactaagaagaggatccccaacacaaaagatttcgacagcagcgaggacgaaaagcacagtaagaagggaatggacaaccagggtcacaaaaatttgaagaccagtcaggaggggagttccgatgacgcagagaggaagcaggagagagagaccttcagtagtgcggaaggaaccgtggacaaagacacgaccattatggagctgcgcgatcggcttccaaaaaagcagcaggcatctgcttctacagacggtgtcgataaactgagcgggaaagagcagtcatttacttccctggaggtccggaaagtggcggagaccaaggagaagagcaaacacttgaagacaaagacatgcaagaaagtgcaggacggattgtctgatatcgcagaaaaatttctgaaaaaggatcagtccgatgagacatccgaagacgacaaaaagcagtcaaagaaagggactgaagagaagaaaaaaccatctgattttaagaaaaaagttatcaagatggaacagcaatacgagagttcatccgacgggaccgaaaagctccccgaaagagaggaaatctgccactttccaaagggcatcaaacagattaagaatggtacaaccgacggcgagaaaaagtcgaagaaaatccgcgacaagacatctaaaaagaaagacgaattgagtgactatgcggaaaaaagcacaggcaagggagatagctgtgattcgtctgaggacaaaaagtcaaaaaatggagcatacggtcgcgaaaagaagcggtgcaaattactgggtaagagttctcgaaaacggcaggactgctcaagcagtgatacagaaaagtacagtatgaaagaggatggatgcaactccagtgacaagaggcttaagagaattgagctgcgggaacgccgaaacctatcatctaagagaaacactaaagagatacagagtgggtctagtagttcggacgccgaggaaagtagtgaagataataaaaagaaaaagcagcggacttccagcaagaagaaagcagtgattgtaaaggagaagaagagaaacagtttacgcacttccactaaacggaagcaggccgacattacttcaagttcctcatcggacatcgaggatgacgaccaaaatagcattggtgagggcagtagcgacgaacagaaaatcaaacctgtaaccgaaaacctagtcctgtcctcgcataccgggttctgccaatccagcggcgacgaggccttgtccaaatccgtacccgtcacagttgacgacgacgatgatgacaacgatccggaaaaccgcatcgccaaaaagatgctgctggaggagatcaaggcaaacctgagtagtgacgaggacggttccagtgacgacgagcctgaagagggaaagaagagaactggcaagcagaacgaggagaatccaggggacgaggaggcaaagaaccaggtgaattcagagagtgactccgatagcgaggagtctaagaagccgcgatacaggcatagactgttacggcataagctgaccgtgtccgacggcgagagcggggaggagaagaagaccaagcccaaagaacacaaggaggtgaaggggaggaaccgccgcaaggtaagcagtgaggactctgaagactccgacttccaggagagcggagtatccgaggaagtgtccgagtctgaggacgagcagcggccccggacccggagcgctaagaaggcagaactagaggagaatcagaggagctataagcagaaaaagaagcggcgccgcatcaaagtgcaggaggattcaagctcggagaacaagtcaaatagcgaagaagaagaggaggaaaaagaagaagaagaagaggaggaagaggaggaggaggaagaagaggaggatgagaatgatgacagcaagagtcctgggaagggcaggaagaaaataaggaaaattctcaaggacgacaagcttcgtacggagacacagaacgcactgaaagaggaggaggagcggaggaaacggatcgccgaaagggaaagggagcgcgaaaaactacgcgaagtcattgagatcgaagacgcaagccctactaagtgtcctattactaccaagctggtactggatgaggacgaggagactaaagagccacttgtgcaggtccaccggaacatggtgatcaagctcaaaccacaccaggtggatggcgtgcagttcatgtgggattgctgctgcgagtctgtaaaaaaaacaaaaaagtcaccaggatccgggtgcattttggctcactgcatggggttgggaaagacgctccaagtggtcagcttcctccacaccgtgctgctgtgcgacaaacttgacttttccaccgcgcttgttgtctgcccactgaacacagccctgaactggatgaacgagtttgaaaagtggcaagagggcctcaaggacgacgagaaactggaagtctctgagctggccaccgtaaagagaccacaggaaaggagctacatgctgcagcggtggcaagaggatgggggggtgatgatcattgggtacgagatgtatcggaatttagcccagggaaggaacgtgaaaagccggaagctgaaggagatttttaataaagccctggtggatccggggcccgacttcgtggtatgcgatgagggccacattctaaaaaatgaggctagcgcagtgtcgaaggcaatgaacagcattcgaagtcgccggcggatcattctcacaggaacaccccttcagaacaatttgatcgagtaccattgtatggttaactttattaaggagaacttgctcgggagtatcaaggaatttcgaaaccgatttataaacccaatacaaaatggtcagtgtgcagacagcaccatggtggatgttcgcgtcatgaagaagcgtgctcacatactgtatgagatgttggccggctgcgtgcaaaggaaggattatacagcgctcacaaaatttctcccccccaagcacgaatacgtgctggccgtgcggatgaccagcattcaatgtaaactgtaccaatattacctggatcaccttacaggtgtggggaataacagcgaggggggcaggggcaaggctggagccaagctgtttcaggactttcagatgttatccagaatttggacccatccctggtgcctgcaactcgattatatctcaaaagagaacaagggatactttgacgaagacagcatggatgagttcattgcttcggattcagacgagacttctatgagccttagctctgacgactacacaaaaaaaaaaaagaaaggtaaaaaagggaagaaagactcctcctctagtggatcaggatccgacaatgatgtggaggtaatcaaggtttggaacagccggagcaggggaggaggtgaagggaacgtggacgagacgggcaataacccttccgtctcactaaaattggaggaatctaaggctactagtagctctaacccttcgtctcctgcgccagactggtacaaagatttcgtgactgatgccgacgcagaagttctggagcacagtggcaagatggtgttgctttttgaaatcctgaggatggcagaagaaatcggcgacaaggtgctggtcttttctcagagtctgattagcctcgacttgatcgaggactttcttgagctggccagcagggagaaaaccgaagataaagacaaacctctgatctataagggagagggaaagtggctcagaaacatcgactactatcggctagatggatccacaactgcacaatctagaaagaaatgggcagaagagttcaacgacgagaccaacgtgagaggcagactgtttatcatcagtaccaaagccggctcgctcggcattaacctagtcgcagctaaccgcgtgatcattttcgacgcatcatggaacccctcgtacgatatccagagcatcttccgcgtctatcgattcggccagaccaagccagtctacgtgtacaggtttcttgcccaggggaccatggaagataagatttatgaccgccaggtcaccaagcagtcattgtctttccgagtggttgaccagcagcaagtcgaacggcatttcacaatgaacgaacttactgaattatacaccttcgagcccgatctgctcgatgacccaaattctgagaaaaagaagaagcgggataccccaatgttgcccaaagacaccatactagcagagctgctgcaaatccataaggaacatatcgtgggctatcacgaacatgactctctgcttgaccacaaggaagaagaagaattaaccgaagaggagcgtaaggccgcctgggctgaatatgaggcagagaaaaaaggactgactatgagattcaatattccgacagggacaaatctccctccggtctcttttaacagccagactccgtatattccattcaatctgggagccctgtccgccatgagtaatcagcagttggaggacttgataaaccagggccgcgaaaaggtggtggaagcaaccaattccgtgaccgcagtgaggatacagccgctggaggatatcatatccgcagtttggaaggagaatatgaatctgtccgaggcacaagtgcaggccttagccctaagccgtcaggcatcacaggagctcgacgtgaagcgccgtgaggcgatctataacgatgtgctgacaaagcagcagatgttaatatcatgcgtacaaaggattctgatgaataggcggttacagcagcagtataaccagcagcagcagcagcaaatgacttatcagcaggccactttggggcatttgatgatgcccaagccgcctaatctcattatgaatccttcaaactaccaacagatcgacatgcgtgggatgtatcagcccgtggctggcggaatgcagcccccacccttgcagcgagcgccacctccgatgcgatcgaagaaccccggaccgtctcaaggcaaatctatgtag

SEQ ID NO: 13812 - DNA, 7365 bp, Artificial Sequence
  Description of Artificial Sequence: Synthetic coding sequence
atgacagctgagccaatgtctgagtctaaactgaacacacttgtgcagaagttgcacgactttttagcccatagttctgaagaaagcgaggaaacttcaagccccccacgactcgctatgaaccagaacactgacaaaatcagtgggtctgggtcaaacagtgatatgatggagaactccaaggaagagggcactagttcttccgaaaagtccaagtcttccggatctagcaggagtaagcggaaacccagcattgttacaaagtatgttgaaagtgacgacgaaaaaccgctggacgatgaaaccgtgaacgaggatgcctctaacgaaaattcagagaacgacatcacaatgcagtcccttcctaaagaggacggcctgcatggtatcgtcagttgcacagcatgtggccagcaggtcaatcactttcaaaaagattccatttatcggcatcccagtctccaagtgctgatttgcaaaaattgttttaaatactacatgtctgacgatatctccagggacagcgacgggatggatgagcagtgccgatggtgcgccgagggcggcaacctgatttgctgcgatttctgccataatgcgttttgcaagaaatgtattctaagaaatttaggccgaaaggagctcagtacaattatggacgagaacaatcagtggtactgctacatttgtcatccggaaccattgctggaccttgtgacagcctgtaactctgtgttcgagaatcttgagcagcttttacagcaaaacaagaagaaaataaaagtggactctgaaaagtcaaacaaggtttacgagcacacatctagatttagtcctaagaaaacctcctccaactgcaatggtgaggaaaaaaaacttgatgatagttgcagcggtagcgtgacctattcctactccgccctcattgtaccaaaggagatgataaagaaagcaaagaagcttatcgagacgactgcaaacatgaacagctcgtatgttaaattcctgaagcaggccaccgacaactcagaaatcagtagtgcaactaagctgcgacaattgaaggcttttaagtccgttctcgccgatatcaaaaaggcgcatttagccctcgaagaggacctcaactccgagttcagggcgatggacgccgtcaataaggagaagaacacgaaagagcataaagtcatagacgcaaaatttgaaactaaggcgagaaagggtgagaagccctgcgctctggaaaaaaaagacatcagtaagagtgaggccaaactgagcaggaagcaggtcgacagcgaacacatgcaccagaatgtccccacagaagagcaacgcactaataagagtaccgggggggaacacaaaaagtccgacaggaaggaggaaccccagtacgaacccgccaatacatcggaagatctggacatggatatcgtgtcagtaccctcctccgtacctgaggacattttcgaaaatctcgaaacggctatggaggtgcagtcatctgtcgaccaccagggggacggctcctctggcacagagcaggaggttgagtcatcttccgtgaagctgaatatcagtagtaaagacaataggggagggataaagtcgaaaaccaccgctaaggtgaccaaagaactgtatgttaagctgacacctgtttccctttccaattcgcccattaagggagccgactgccaggaggtaccccaagacaaagatggatacaagagttgcggcctgaacccaaagctggagaagtgtggccttggccaagaaaacagcgacaatgagcaccttgtggagaacgaggtctctctgctgctggaagagtcagacctgcgtagatctcccagagtcaagaccacgcccctccgacggccaacagaaactaaccctgtgactagcaattccgatgaggagtgtaatgaaacagtgaaggaaaagcagaagctcagcgtgccggtccggaagaaggacaagcgcaattcaagtgacagcgccatcgataatcctaaacctaataaactgcctaaaagcaaacaaagcgaaaccgtagatcagaacagcgattctgatgagatgcttgccattctcaaagaggtcagcaggatgtcccatagttcgtcctcagataccgatattaacgaaattcataccaatcacaagacactatacgatctgaagacacaagcaggtaaggatgataaaggaaaacgaaaacgcaaatcaagcacttccggcagcgactttgataccaagaagggcaagtccgcgaaatctagcattatttctaagaagaaacgtcagacccaatccgaaagctctaattacgacagcgagctggagaaggaaattaaatcaatgagtaagatcggagccgcacgcaccaccaagaagaggattcccaacacaaaggatttcgattcctccgaagacgaaaaacattctaaaaagggtatggataaccaaggtcataaaaatttgaagaccagccaggaggggtctagcgatgacgcagagcgcaagcaagagcgggagaccttctcgagtgctgaaggcacagtcgacaaggataccactatcatggagctccgtgataggctgccgaagaagcagcaagcctcagcttcaacagacggcgtggataaattatcaggcaaggagcagtcttttacaagtctggaggtgcggaaggtcgctgaaactaaagaaaagtcaaaacacctgaagactaaaacatgcaagaaagtgcaagacgggctttccgatatcgcggaaaagtttttgaagaaagaccaaagcgacgagaccagcgaagacgacaagaaacaaagtaaaaaggggactgaggaaaagaagaagccaagcgattttaagaaaaaggtgataaagatggagcaacagtacgagagttcctctgacggtactgagaagttgcctgaacgcgaggagatttgccattttcccaaaggtatcaagcagattaaaaatgggaccacagacggcgaaaaaaagtcaaaaaaaattagagacaaaacaagtaaaaagaaggacgagcttagtgactacgctgagaaatcaactggtaagggcgacagttgcgattcctcagaagacaaaaagtctaaaaatggggcctatggccgcgaaaagaagaggtgcaagctcctgggtaaaagttcaagaaaacggcaggattgcagttccagtgacacggaaaagtattcgatgaaggaggatggctgcaatagctctgacaagcggctgaagcgaattgagctgagagagcggagaaacctgtcgtccaagagaaacaccaaggagattcagtccgggtcgtccagctccgatgcagaggaatcaagcgaggataataaaaagaaaaagcagcggacgagctctaaaaagaaggctgtgatcgtgaaggagaagaagcggaactctcttagaacatccactaaacgaaagcaggcggacataacatccagcagttcctcagacatcgaagatgatgatcagaattctataggagagggatcatctgatgaacagaagataaagcctgttacagagaatctggtcctgtcatctcacactggcttctgtcagtcttcaggcgacgaggccctgagcaaatccgtgcccgttaccgtagacgatgacgatgacgacaacgacccagagaaccgtatcgccaaaaagatgctccttgaggagataaaagcgaacttgtcatctgatgaggatggctcaagcgatgatgaacccgaggagggaaaaaagcgaaccgggaaacagaacgaagagaatcctggagacgaggaggcaaaaaaccaggtgaatagcgagtctgattccgatagcgaggagtctaagaagccgaggtacagacaccggctcctcaggcataaattaaccgttagcgatggagagagcggagaagaaaagaagaccaagcctaaggagcataaagaggttaaaggccgtaacaggcgcaaggtatcttcagaggactccgaggacagtgacttccaagagtctggggtgtccgaagaagtgagcgagagcgaggatgagcagcgcccgcgtacccgcagcgccaaaaaagctgagcttgaagaaaaccaacgttcttataagcagaagaaaaaaaggaggcgcattaaggtgcaagaagattcatcctccgagaacaagtcgaacagtgaagaagaggaggaggagaaagaggaggaagaagaagaggaagaggaagaggaggaggaggaagaagacgaaaatgacgattcaaaaagccccggtaagggccgcaaaaagatcagaaagattttaaaggatgacaaattgcggaccgagacccaaaacgccttaaaggaggaggaggagagacgtaaacgcatcgcagagcgggagcgggaacgagagaaattgcgcgaggttatcgagatcgaggacgcgtcccccactaagtgccccatcaccactaaactcgtgctggatgaagatgaggagacaaaggagcccttagtccaggtgcacagaaatatggtcatcaagctcaagcctcaccaggtcgatggcgtgcaattcatgtgggactgttgctgcgaatcggtcaaaaaaaccaaaaaatctcccggctccggatgcatcctggcgcactgtatggggttaggcaaaacactgcaggtcgtgagcttcctccatacggtgctcttgtgtgataaactggacttttccacagctctcgtcgtttgtcctttgaacacagcattaaattggatgaatgagttcgagaagtggcaagaaggacttaaagacgatgaaaagctggaggtctccgagctagctaccgtcaagaggccacaggagcgatcatatatgctgcagcgctggcaggaggatggcggggttatgattattgggtacgaaatgtatcgtaatttagcccaggggcgaaacgtcaagagcagaaagctgaaggaaattttcaacaaggcgttggtcgatccagggcccgacttcgtggtatgcgatgaggggcatattctgaaaaacgaggcatcggctgtgtctaaggcaatgaatagtattcggagcagaaggagaatcatcctcactggcacgcctctccagaataacctcatcgaatatcattgcatggtgaatttcataaaggaaaaccttctcggttccataaaagagttccgcaaccgattcataaatccaatacaaaatggacagtgcgctgattctaccatggtcgatgtgcgtgttatgaagaaacgcgcccacattctgtatgaaatgctcgctggctgtgttcagcgtaaggattatacagctttgaccaagttcttgccacccaagcacgaatatgttttggcagtgaggatgaccagcatacagtgcaagctctatcagtactaccttgatcacttaactggcgtggggaataatagcgagggtgggcgggggaaagccggcgccaagctgtttcaggactttcagatgctcagcagaatatggacccacccctggtgcctgcagctagattatatctcgaaagagaacaagggttacttcgatgaggactctatggatgagtttatcgccagcgactccgacgaaacttctatgagtctcagcagcgatgactacacgaaaaagaagaaaaagggcaagaaggggaaaaaggattcaagttcatctggatccggcagtgataatgatgtggaggtaatcaaagtctggaatagccggtcccgcggagggggggagggtaatgtagacgagacagggaacaacccgtcagtttccctgaagctggaagaatccaaggcaactagctccagtaatccaagcagcccagctcctgattggtacaaggatttcgtgactgacgccgatgcggaagtgctcgagcactctgggaaaatggtcttattattcgagatcttgcggatggcggaagagattggcgacaaggtgttggtgttttcacagtccctaattagtctggaccttatcgaagattttctagaactggcgtcccgggagaaaacagaggataaggacaaaccactgatatacaagggagaggggaagtggctgcggaatatcgattattatcgcctagacggatcaaccacagcgcaatcacgcaagaaatgggccgaagaatttaatgacgaaacaaatgttagagggcgattatttatcatatctacgaaggccgggtcactcggtatcaatctcgtcgccgccaaccgcgtgatcatcttcgatgcaagctggaatccttcatatgatatccaatctatcttcagggtgtatcggtttgggcagacaaaacctgtgtacgtttacaggttcctggcacagggaaccatggaagataagatctacgataggcaggtcactaagcagtcactctcctttcgcgtggtggaccagcaacaagtggaaaggcatttcacaatgaacgagttgacagaactgtatacattcgaaccagatctgctggatgaccccaattccgaaaaaaagaagaagagggacactccaatgttaccgaaagacaccatcctcgcggagctgctgcagatccataaagagcacattgtcggctaccacgaacacgacagtttattggatcacaaagaggaggaggagctgacagaggaggaacggaaagccgcgtgggctgaatacgaagctgagaaaaagggactgactatgaggtttaacatcccaacaggcactaatctgccacccgtctcctttaattcccaaacgccatatataccatttaatttgggagcactaagtgccatgagtaaccaacagcttgaagacctcatcaaccaaggccgcgagaaggtggtcgaggccacgaattctgtgaccgctgtaaggatccagcctctggaagacattatcagtgctgtctggaaggaaaacatgaatttgagcgaagcccaggtgcaggctctcgcactctcaaggcaagctagccaggaactggacgttaaaaggagagaagccatctacaatgacgtgctcaccaagcagcagatgctcatttcatgcgtccaacgaatcttgatgaatcgacgtctccagcagcagtacaaccagcaacagcaacagcaaatgacatatcagcaggccacattgggccaccttatgatgcctaagcctccaaatttgattatgaatccgagtaattatcagcaaatcgacatgagaggaatgtaccagccagtcgctggagggatgcagccaccaccactacagagagcaccaccccctatgcgtagtaagaaccctggaccatcccaggggaagtccatgtag

SEQ ID NO: 13813 - DNA, 369 bp, Artificial Sequence
  Description of Artificial Sequence: Synthetic coding sequence
atcaactataatcgtgacaagatcagcgggagcggcagcaactctgatatgatggaaaacagcaaggaagagggcactagctcctccgaaaaatccaaatctagtggcagttctaggtctaaaaggaaaccatccatcgtgacaaaatatgtggaaagtgacgatgagaagcctctggatgatgagaccgtaaatgaggacgccagcaacgagaatagcgaaaacgacatcactatgcagtcccttccaaaaggcactgtgatcgtgcaacccgaacccgtgctaaatgaagacaaggacgatttcaaaggccctgagtttcgatcaagatcaaagatgaaaactgaaaatttgaagaaacgcggctag

SEQ ID NO: 13814 - DNA, 4038 bp, Artificial Sequence
  Description of Artificial Sequence: Synthetic coding sequence
atgtcagagtccaagttgaatacacttgtccagaagttgcatgactttcttgcgcattcatcagaagaatctgaagagacaagttcgcctccccgactggctatgaatcagaataccgataaaatttcaggctcaggttccaactcggacatgatggaaaacagtaaagaggaaggcacgtcgtcttccgagaaatctaagtcctccgggtcatcccgcagtaagcgcaagccttctatcgtcactaagtacgtggagagcgacgatgaaaagccattggacgatgagacagtgaacgaagatgcctccaacgagaattcagaaaacgacataaccatgcagagcctgcccaaagacggactccatgggatcgtctcatgcacggcatgcggtcaacaggtgaatcactttcaaaaggattctatttatcggcatccatcccttcaggtattgatttgtaaaaactgcttcaaatactacatgagcgacgacatttcacgggattctgacgggatggacgagcagtgccgatggtgtgctgagggagggaatttaatctgctgcgacttctgccacaacgctttttgtaaaaaatgcattctaagaaatctcgggaggaaggagttgagcacaatcatggacgaaaataatcagtggtactgttatatctgtcatccggaaccgctcctggacctcgtcacagcctgcaattctgtgttcgaaaacctcgaacagctgctccagcagaataaaaagaagatcaaggtcgattccgaaaagtcgaacaaggtctatgagcataccagtcgcttctcgccaaagaaaactagcagcaactgcaacggtgaggagaaaaagctggacgactcttgcagtggttccgtaacctactcatactctgccctgattgttcccaaagagatgatcaagaaagcaaaaaagctgatcgaaactacagctaacatgaacagctcttacgtgaaatttctcaagcaggcaacggacaacagcgagatttcaagcgcgactaaactcagacagctgaaagctttcaagagtgtcctggccgatatcaaaaaagcacacttagccctggaagaagacctgaatagtgagtttagagctatggacgcagtcaataaagaaaaaaacaccaaggagcacaaagtgattgatgccaagtttgaaaccaaggcgcgcaaaggcgagaaaccgtgcgccctggagaaaaaagatatctccaagagcgaggccaagctgagccgcaagcaggtagacagcgaacacatgcaccagaacgttccgaccgaggagcaacgtacgaataaaagtacaggcggggagcataagaagtctgaccggaaagaagagccccagtacgaacccgccaacacgtctgaagacctcgacatggatattgtatctgtgccaagttcagtgcctgaggacatctttgaaaatctggagaccgccatggaggttcagtcatctgttgaccaccagggagatggctcttccggcactgaacaggaggttgagtcaagcagcgtcaaactgaacatctcttcgaaggacaatcgtggcggggccgactgtcaggaggtgcctcaagacaaggatggttacaagagctgtgggcttaaccccaagttagagaagtgcggcctgggacaagaaaactcagacaacgagcacctcgtggaaaatgaggtgtctcttctgcttgaggaatcagacctgaggagatcgccccgggtcaagactacgcccctgcggaggccaactgagaccaaccccgttacttccaacagcgatgaggaatgtaacgagactgtgaaggagaagcaaaagctaagtgttccggtccggaaaaaggataaacgaaacagctccgattctgctatcgataaccccaaacccaataaactgcccaaaagcaaacagagcgagaccgtggaccagaactctgactcggacgaaatgctcgctatactgaaggaggtctcacgtatgagtcactcgtctagtagtgatacagacataaacgagattcataccaaccataagaccctgtatgacctcaaaacacaggcgggcaaggatgacaaaggtaaacgcaagaggaagtcttctaccagtggatcggactttgacacaaaaaaagggaaaagcgctaagagttccattatcagcaagaagaagcggcagacacaaagtgaaagctccaactatgacagtgagctcgagaaggagattaagtccatgtccaaaattggggccgcaaggacgaccaaaaagcggatccccaataccaaagactttgattcatccgaggatgagaagcactcaaagaagggcatggacaaccagggtcacaagaatctgaagactagccaggaggggagttctgatgacgccgaacgtaaacaggaacgagaaacattcagttctgccgaggggacagtggataaggataccactattatggagctgagagatcgtctgccaaagaagcagcaagccagcgcctctaccgacggcgttgacaagctgtccggaaaggagcaatcatttacttctctcgaagtccgtaaagtggccgagacaaaggaaaaaagtaaacatttaaaaacaaagacgtgcaaaaaagtgcaggacgggctgtcagatatcgccgagaaatttctgaaaaaggaccagagtgatgagacgtctgaggatgacaaaaaacagagtaaaaaggggactgaggagaaaaaaaagccttctgacttcaagaagaaagttattaagatggaacagcagtacgagtcttcctcagacggaactgagaaactcccagaacgggaagagatttgccactttccgaaagggatcaagcagatcaagaacggcaccaccgacggggaaaagaaatcgaagaaaatacgggacaaaacaagcaaaaaaaaagatgagttgtcggactacgccgaaaagtccacaggtaaaggagactcctgcgattccagcgaggacaagaagtctaagaacggggcctatggccgagaaaagaagagatgcaaactcctgggcaagagttcccggaagcggcaggattgctcaagctcggacaccgagaagtattcaatgaaagaagatggctgcaatagttccgacaaacgcctgaagcggattgagcttcgagagcgtaggaatctgtcatctaaacggaatacaaaagaaattcagtctggttcctcttcttcggacgcagaagagagcagtgaggacaacaaaaagaaaaagcagcgcacttcttcgaaaaaaaaggccgttatcgtgaaggaaaagaagagaaacagtctccgtaccagtaccaagcgcaagcaagccgatatcactagcagtagcagctctgacatcgaggacgatgaccaaaactctatcggagaaggaagctctgatgagcagaagatcaagccggtcactgagaatcttgtcttaagttcccacaccggattctgtcagagctctggcgatgaagctctttccaagagcgtcccagtgaccgtggatgatgacgacgacgataacgatccagaaaaccgtatagcaaagaaaatgctgcttgaggagattaaggcaaacttgtcgagtgatgaggacggctcatccgacgatgagcccgaagaaggcaaaaaacggacagggaaacaaaacgaggaaaacccgggcgacgaagaggcaaagaaccaggtgaactctgaatccgactcagattccgaagagagtaagaagcctagatatcgtcaccggcttctgcgccataagctcaccgtgtcagatggtgaatctggcgaggaaaagaaaacaaaacctaaggaacataaggaggtaaagggccgaaatagacggaaagtgagcagcgaggactcggaagacagcgactttcaggaatccggcgtgagcgaagaggtgagcgagtccgaagacgaacagaggcctaggacccgcagtgccaagaaggcagagctcgaagaaaaccaacggtcttag

SEQ ID NO: 13815 - DNA, 483 bp, Artificial Sequence
  Description of Artificial Sequence: Synthetic coding sequence
taaccagacttcgttgtctgcgacgagggccatattctgaagaacgaggccagtgccgtgtcaaaggcaatgaacagcattaggagccggcgcagaatcattctgacaggcactccactacaaaacaatctgatagagtatcactgtatggtgaacttcattaaggagaacctgctagggtccataaaagagttccgtaatagattcattaacccaatacagaacggccagtgcgctgatagtaccatggttgatgtacgcgtgatgaaaaagcgggcccacatattgtatgagatgctggcaggttgcgtgcaacgaaaagactacacagcgctgacaaagtttctgcccccaaagcatgaatatgtgctcgctgtgcgcatgacatccatccagtgtaaactgtatcagtattacctggaccacctcacagtactgcaccttaacaagatgggaatgctgaaaagcatcaagtacttctag

SEQ ID NO: 13816 - DNA, 2514 bp, Artificial Sequence
  Description of Artificial Sequence: Synthetic coding sequence
atgaatcatttggagggctctgcggaggtggaggtgaccgatgaggctgctggcggggaggttaatgagtcagtggaggccgatctggaacaccccgaagtggaagaagaacaacaacagccgcctcaacaacagcactatgtggggcggcaccagcgcggccgagccttggaggacctgcgcgcacagctcgggcaagaggaagaagagcggggagaatgcttagccaggtctgccagcacagaatcaggcttccacaaccatactgacactgcagagggagatgtgatcgctgctgccagagacggttacgatgccgagcgggcccaggatcccgaagacgagagcgcttatgcagttcagtacagacctgaggcagaagagtacaccgaacaggccgaagctgagcatgccgaggcgacacaccggcgcgctctgcccaaccacctgcatttccacagcctggaacatgaggaggctatgaacgcggcttacagcggttatgtgtatactcacagattgtttcaccggggtgaggatgagccctactccgagccatatgcagattatgggggactgcaggagcacgtgtatgaggaaatcggcgacgcgcccgagctcgatgctcgggatggcctgcggctctatgagcaagaacgcgatgaggccgccgcctatagacaggaggccttgggtgcgaggctccatcattatgacgaaaggtcagacggagagtctgatagccccgagaaggaggcagaatttgcaccttacccgcgcatggattcctacgagcaggaggaggacattgaccaaatcgtggcagaagtgaagcagtcgatgtctagccaaagccttgataaggccgccgaggacatgccggaggctgaacaggatctcgaacgaccgcccacccctgccgggggtagacctgacagtcccgggctgcaagctcctgctgggcagcagagggccgtcgggcccgccggaggtggcgaggcaggacagcgatacagcaaggagaagagggatgctatctctctggccattaaagatattaaggaggcaatcgaggaagtgaaaactcgaaccattcggtctccctacaccccagatgagcccaaagaacccatctgggtaatgagacaagacatatccccgacccgggattgtgatgaccaacggccaatggacggggatagcccttcacccgggagcagtagccctctgggcgccgaatccagctccacaagtctgcacccgtcagaccctgttgaagcatccaccaataaagaaagccgcaaaagcctggcaagttttcctacctacgtggaggtccccggtccgtgtgaccctgaagatctgattgacggcattattttcgccgctaactatctcggctcaacgcagctgctgtccgataagacaccaagtaagaacgttcgcatgatgcaagcacaggaggcagtttctcggattaaaatggctcagaagctcgctaagtcccgaaaaaaggcccccgagggtgagtcccagcccatgactgaggtagacttattcatttcaacacagaggatcaaagttctgaatgccgacactcaggagacaatgatggaccatcccctcaggacgatctcctacatagccgatatcgggaacattgttgtactcatggcccggcgtagaatgccacggtcaaattcgcaagagaacgtggaggccagtcatccttctcaggacggaaaacgccagtacaaaatgatatgccacgtgttcgaatcagaagatgcccaactcattgcccagtctattggtcaggctttctcagtagcataccaagagtttctgcgtgccaatggcattaatcccgaggatctgagtcagaaggaatattccgatctccttaacacgcaggacatgtacaacgacgacctgattcatttctctaaaagtgaaaattgcaaagatgtgttcattgagaagcaaaagggtgaaattttaggtgtcgtcatcgttgagtctggctgggggtctatcctgcctaccgtcatcattgccaatatgatgcatggcgggcctgccgaaaaatccggcaaactgaatatcggcgatcagatcatgtcaatcaacggaacctcgttggttgggctcccattatccacatgtcaatcgattatcaaaggcctaaagaaccagagcagggtcaagctgaatattgtgcggtgtccgccagtaaccaccgtgctgatacggcggccagacctgcggtatcagcttggcttctcggtgcaaaacggaatcatctgtagtttaatgcgcggaggcatcgcagaacgaggaggagtccgggtcggccacagaataattgaaatcaatggccagagtgtcgtggctaccccccatgagaaaattgtgcatatcctctcaaatgcagttggcgagattcatatgaaaacaatgcccgccgccatgtatcgactgctgaccgcccaggaacaaccggtttacatctag

SEQ ID NO: 13817 - DNA, 2469 bp, Artificial Sequence
  Description of Artificial Sequence: Synthetic coding sequence
atggccgctgcggtggtggtagcggaaggagacagtgattctagaccaggccaggagctcttggtggcatggaataccgttagcacaggtttagtccctccagccgccctgggactagtgtcttctcggacatccggtgccgtgccacccaaggaagaggagctgcgggccgctgttgaggttctgcgcggccacggcctgcacagcgttttagaggagtggtttgtggaagtgctgcagaatgacctgcaggcaaatatttcccccgaattctggaacgccatctctcagtgtgagaactcagctgatgagcctcaatgtctgcttcttctgcttgacgccttcggcctgcttgaatcacgtctggatccataccttaggagcttggagctgctggagaagtggacgcgactaggactgctcatgggcacaggtgcccagggtcttcgcgaggaggtgcacactatgctgcgaggggtgttatttttcagcacacctaggacctttcaggaaatgatccagcggctatatgggtgttttctcagagtctacatgcaatccaagcggaagggagagggtggtacagacccagagcttgagggagaactcgattcaagatacgcccgacgtcgctactaccggctgctccaaagtcctctgtgtgctggttgttccagcgacaagcagcaatgctggtgtcggcaggctctggagcagtttcatcaactgtcccaggttcttcaccgactgtctcttttggaaagagtgtctgctgaagccgtcactactactttacatcaagtcacccgagagcggatggaggacagatgcaggggcgagtacgagcgcagttttctcagggagttccacaaatggattgagcgagtcgttggatggttaggaaaggtctttctgcaggacggccccgctcggccagcttcgccagaggcgggaaatacattaaggaggtggaggtgccacgtgcagaggttcttttatcgcatatacgctagcctcagaatcgaggagctcttctccatcgtgcgtgatttcccagacagccggccagcgatcgaggaccttaaatattgcttagagcgtaccgatcagcgtcagcaattacttgtctccctcaaggcggcccttgagacccgtttgctgcatcctggcgtgaacacctgcgacattatcaccctgtatatctctgctattaaagctctgcgggtgctcgatcccagtatggtcatccttgaagtcgcctgcgagcccatcagacgctaccttcgtactagggaggacacggtgcgtcagattgtggctggacttacgggggactcggacggcactggcgacttggctgtcgagctttcaaaaacagatccagctagcctggaaactggacaagattccgaagacgatagtggggaacccgaggattgggtacctgacccagtagatgccgaccctggtaaaagctcgtccaaaagaagatcctctgatataataagcctgctcgtgtccatttatggttctaaggacctcttcatcaacgagtaccgtagccttctcgctgaccgattactgcaccagttctcgttcagcccggaacgtgaaattcgtaatgtggaactgcttaagcttaggttcggcgaggcccccatgcatttctgcgaggttatgctcaaagatatggctgatagtcgccgaatcaacgcaaatatccgcgaggaggacgagaagagaccagccgaagagcagcccccgttcggggtctacgcggtaattctgagcagcgagttctggcctccattcaaagacgagaaactggaagtgccagaggacatacgagcagccttggaggcatattgcaagaaatatgagcaactgaaagctatgcgcactctctcttggaagcataccctgggattagtgaccatggacgtcgaactggctgacagaaccctcagtgtggccgtgaccccagtccaagccgtgattttgctgtactttcaggatcaggcctcttggaccctggaggagctgagtaaagccgttaaaatgcccgtggctctccttcgccgtcggatgtccgtttggctgcagcaaggggttttgagggaggaaccaccaggcacctttagcgtcatagaggaggagcgcccccaagatcgcgacaatatggtccttattgacagcgatgatgagagcgattccggcatggctagccaggctgatcagaaagaggaggagctgctgttattctggacgtatattcaggccatgctgacgaacctggagagcctctcactggatcgcatttataacatgctgaggatgtttgttgtgaccggaccggctttggccgagattgacctgcaggagctgcaaggctacctccagaaaaaggtgcgagaccagcagctggtgtactccgccggagtataccggctcccaaagaactgctcctag

SEQ ID NO: 13818 - DNA, 4863 bp, Artificial Sequence
  Description of Artificial Sequence: Synthetic coding sequence
atgggggccatcgggttgttgtggttactgccacttctcctgagcaccgccgcagtcgggtccggcatggggacaggacagcgcgccggcagtccggcagcaggcccacccctccagcccagagagccgttaagctacagtcggctgcagcgtaagagtctggctgtcgatttcgttgtcccttctttgttcagggtctacgctagggatttgcttcttcccccttctagtagcgaactgaaagctgggcgtcccgaggcaagaggctccctggcattggattgtgccccactactaaggttacttggccctgcaccaggagtaagctggaccgccggtagtccagcacctgctgaggccaggacactgagccgggtactgaaagggggcagtgtaagaaagttgaggcgagccaaacagctggtcctggaactcggcgaggaagctatcctggaggggtgcgttgggccacccggggaggccgccgtgggacttcttcagtttaatctctccgagctatttagttggtggatccggcagggcgaaggccgactgcggatccgtctgatgccagagaaaaaagcgagcgaagtgggaagagaagggcggctctccgctgctatccgggcctcccaaccacggctgctctttcagattttcgggaccgggcattccagcctggagagtcctacgaatatgccttcaccgtcccctgattactttacatggaatctgacatggattatgaaggatagcttcccctttctgtctcaccggtcgcgatatgggttagaatgtagtttcgacttcccatgtgagctggaatactctccgccactccatgatttgagaaatcaatcatggtcttggcgccggatacctagcgaggaggcatcgcagatggacttgctagatggcccaggcgcggagcgaagtaaggagatgcctcgtgggtccttccttctgttaaatacttccgcagattccaaacatactatcctctctccctggatgcgtagcagctctgagcattgcactctcgctgtcagcgtgcatcgccacttgcagccctccgggcgctacatcgcccagctcctgccacacaatgaggcagcgcgggaaatcctgctgatgccaacacccggcaaacacggttggacagtgctgcagggtagaattggcagacctgataaccctttccgggtagcactggaatacatatcctcagggaacagatctcttagcgctgtggactttttcgctcttaaaaactgttcagaaggtacctcaccaggttctaagatggcactccagtcctctttcacatgctggaacggaaccgtacttcagctgggccaggcttgtgacttccaccaagattgtgcccaaggggaagacgaatcgcaaatgtgccgcaagctgccagtgggcttctactgcaacttcgaggacggattttgcggatggacacaaggaaccctttcgccgcatacgcctcagtggcaggttcgcacgctcaaagatgctcgattccaggatcaccaggaccacgccctgctgctctctacaacggatgttcctgcatccgagtcagccacagtgacttccgctacttttcctgcacccataaaaagctcgccctgtgagctgcgaatgagctggttaatccggggggtactgagggggaacgtgagcctggtgctcgtggaaaataaaacaggaaaggagcaggggaggatggtgtggcacgtggctgcctatgagggcttgtccctgtggcagtggatggtgttacccctactggacgttagtgaccgattttggctccagatggtggcttggtggggccaggggagtcgcgccattgtggcgttcgacaacatttccatatccctcgactgttatctgactatctctggagaagacaagattctgcaaaacactgctccaaagagccgtaatctgtttgagagaaaccctaacaaagaactgaagcccggagaaaattcccccaggcagacacccattttcgaccctaccgttcactggctctttactacttgcggtgcaagcgggccgcacggccctacacaagcacagtgcaacaacgcttatcagaattctaatttatcggtcgaggtgggatctgaaggaccattgaagggcatacagatctggaaagttcctgcaaccgacacatacagcatcagcggatacggtgctgccggaggaaagggaggcaaaaatacaatgatgagatcacatggcgtcagcgtactaggcatctttaatctggaaaaggatgacatgctttatatcctggtgggtcagcaaggagaggatgcctgtccctcaactaaccagctgattcaaaaggtttgtattggagagaataatgtgatcgaggaggagattcgtgtcaatcggagtgtgcacgaatgggccgggggggggggcggagggggcggcgccacatacgtgtttaagatgaaggacggagtgccagttcctctcatcatagcagccggggggggaggccgggcttacggcgcaaaaacagatacctttcaccctgaacgcctggagaataatagcagcgtgctcggactgaatgggaatagcggcgctgctggtggtggtggtggttggaatgataacaccagtcttctctgggccggaaaaagtctgcaagaaggcgcaaccggcggccatagttgccctcaggctatgaagaagtgggggtgggaaactcggggcggttttggtggcggtgggggcgggtgctcttctggcgggggcggggggggctatataggaggaaatgcagctagtaacaacgacccagagatggacggggaggatggcgtctcgttcatctctcctctggggatcctctacacccctgccctgaaggtgatggaaggacacggggaggtgaacataaagcattacctgaattgctctcactgcgaggtcgacgaatgtcacatggaccctgagagccacaaagttatttgcttctgcgaccacgggactgtgctcgccgaagacggggtttcttgcatcgtttcacccaccccagagccgcacctgcctctctccctgattctctccgtggtgacatcggccctggtcgcggccctggtgctcgctttctcaggcatcatgatagtgtatcgccggaaacaccaggaactgcaggctatgcaaatggaattgcagagccctgagtacaagctgtcaaaactgagaacaagtacgattatgacggactataaccccaattattgcttcgcggggaaaacgtcaagtatcagtgacttgaaggaagtcccccgcaagaatataacactcatcagggggcttggccacggtgcctttggggaggtttacgaaggccaggtttcagggatgccgaatgatccatcccccctccaggttgcggtgaaaacattgcccgaggtgtgcagtgagcaggacgaattggacttcctgatggaagccctgatcatttcaaagtttaaccaccagaatatagtgagatgtatcggagtctctctacagagcctcccacgctttatcctactcgaactcatggccgggggcgacctcaagtcatttttaagagagactcggccaaggcccagccagcccagctccctagctatgctggatttgttgcacgtcgctcgggacatcgcgtgcggttgtcagtacctggaggagaatcattttatccatcgagatatagccgcacgaaactgtttgttgacctgtcccgggcccggccgggtcgcgaagatcggggactttgggatggcgcgggacatctaccgggcatcctattacaggaaagggggctgtgctatgctacctgttaagtggatgccccctgaagccttcatggaaggaatcttcacaagcaaaaccgatacatggtcttttggcgtgctgttatgggagatatttagcctcggttatatgccatacccatcgaagtccaaccaagaagtgctggaatttgtgacaagtggcggacgtatggatccaccaaagaactgtccggggcccgtataccggatcatgacacagtgctggcagcaccagcctgaagataggcctaacttcgcaatcatactagagcgaattgagtattgcactcaggaccctgacgtcattaacactgccctgcctattgaatatgggccattggttgaagaggaggagaaggtacccgttcggccaaaggacccagagggagtccctcccttgttagtctcccagcaagccaaacgggaggaggaacgttcccctgccgctccccctcctcttccaacaacgtcctctggaaaggccgccaagaagcccactgccgctgagatttccgtgcgggttccaagaggccctgccgtggaggggggacatgtaaacatggctttcagtcaatcgaaccccccatccgagctgcacaaagtccacggctcgcggaataagcccacttccctatggaatcccacctacggcagctggtttaccgagaagcccacaaaaaaaaacaatcccatcgctaaaaaggagcctcacgaccggggcaatctggggttagagggatcctgcaccgtgccccccaatgtcgccaccgggagacttcccggtgcctcactgctccttgagcctagcagcctcacagcaaacatgaaggaggtccccttgttccgcctccggcacttcccgtgcggaaatgtgaattatggataccagcagcagggcctgccactggaagcagctaccgcacccggtgcaggccattatgaggacacgatacttaagtccaagaatagcatgaaccaacccggcccgtag

SEQ ID NO: 13819 - DNA, 1353 bp, Artificial Sequence
  Description of Artificial Sequence: Synthetic coding sequence
atgggcgcaattggactactgtggcttctaccactcctgctgagcacagcagcagtgggttccggtatgggtacgggacagcgggctggtagtccagccgctggacctcctctgcaacctcgggaacctctgagctactctcgcctccaacgtaaaagtttagcggtggactttgtggttccttctctgtttcgggtgtatgcacgagatttactgctacccccgtcaagttcggagttgaaagccgggagaccggaagcccgtggctctttggcgctggactgcgcacccctgctgcgattattgggacccgcacctggagttagttggacggccggaagccctgctccagcagaagcgaggactctttctagagtgctgaagggtggatcggtgcggaagctcaggcgggctaagcagctggtgctcgaactcggtgaggaggcaatcctagagggctgcgtggggccacctggagaggcggccgtggggttactgcagttcaacctatcagagctgttctcttggtggatccgacagggtgaaggacgtcttagaatccggcttatgccggaaaagaaggcgtccgaagttggtagagagggcagactgtcggccgccatcagagcctctcaaccaagacttctcttccagatttttgggactgggcactcctcactggaatctcccactaatatgcctagcccttctcccgattattttacttggaatttgacttggatcatgaaggacagctttcctttcttatctcataggtccagatatggcaaggagaggtctcccgcggcaccaccccctctcccaactactagttcggggaaagccgctaaaaagccgacagctgccgagattagcgtccgcgtgccacgaggaccagctgtcgagggtggccacgtgaatatggcctttagtcagtcaaatccaccatccgaacttcataaagtgcatggatcccggaacaaacctacctccctgtggaaccccacatacggctcatggttcacagagaagccgacaaagaagaacaacccaatagccaaaaaggagcctcatgaccgaggaaaccttgggctggagggaagttgtacagtcccaccgaacgtcgcgaccggcagactaccaggcgcttccctgctgcttgaaccatcaagcctcactgccaatatgaaggaggttccactatttagattgagacatttcccttgcggcaacgtgaattacggataccagcaacagggattgccgctggaagctgccactgctccaggagccggacattacgaggacaccattctgaagagtaaaaactccatgaatcagccaggaccctag

SEQ ID NO: 13820 - DNA, 1935 bp, Artificial Sequence
  Description of Artificial Sequence: Synthetic coding sequence
atggaagtccaacttggcctgggccgggtgtacccaagacctccttctaagacctatcgaggtgcattccaaaaccttttccagtccgtgcgcgaggtcattcagaatccagggcccaggcatcctgaagccgcttctgctgccccccccggggcttcactcctgctgttacagcagcagcagcaacagcagcaacaacagcagcaacagcagcagcagcagcagcaacagcagcagcaggagacttcccctagacagcaacagcaacaacagggcgaggacggcagcccgcaagctcacaggagaggaccaacaggttacctggtgcttgatgaagaacagcagccgtcgcaaccccagagcgcgctagaatgtcatcctgaaaggggatgcgtccccgaaccaggggccgcagtggctgcatcaaagggactcccccagcagctgcccgctccgccagatgaagatgactccgctgccccctccacattgtccctgctcggccccacctttcctgggttgtcctcatgttcggccgacctcaaggatatcttatctgaggccagtacaatgcaactgctgcagcagcaacaacaggaggcggtgagcgaaggaagctcttctggaagggctagagaggctagcggcgcacctacatcctctaaagacaactacctgggtggtacctccaccatatcagataacgctaaagagctctgtaaggccgtgtctgttagcatgggtcttggggtggaagctctggaacatctgtcacccggcgaacagctgcgcggggattgtatgtacgctcccctgctgggagttccgccggcagtgcgcccaaccccatgcgcaccgttggctgaatgcaagggaagtctcctcgacgattccgcaggaaagtccacagaggacaccgccgagtactctccatttaaaggaggatataccaagggcttagaaggggaatccttgggctgtagcggtagcgccgctgctggctcttccggaactctagagttgccttcaacactcagcctgtataaatctggcgctttagatgaggccgccgcgtatcagagtcgggactattacaactttccactggcccttgccgggccacctcccccaccacccccgcctcaccctcatgcaaggattaaattagagaatcccctggactatgggtctgcctgggcagctgccgctgctcagtgtcgatacggggatttggcaagtcttcacggagctggtgctgctggaccaggatcaggcagtccgtctgctgctgcctcctcctcttggcacacacttttcactgctgaggaaggccagctgtacggtccgtgcggaggaggagggggaggcggggggggcggcgggggtggaggaggcggcggcggagggggcggcggcggggaggccggtgccgttgctccttacggctacacacgtcctccgcaggggctggccggacaggaatccgactttacagctcctgatgtctggtatccgggtggaatggtaagtcgcgtgccctatcctagtcctacctgtgtgaagtccgaaatgggaccgtggatggacagttatagcggaccttatggagatatgcgactggagaccgcccgtgatcacgtgttgcccatcgactattattttccaccccagaagacatgtctcatctgcggagatgaagccagcggctgtcactacggcgcactgacctgtggttcctgcaaagtgttctttaaacgggccgctgaaggcaaacagaaatacctctgtgcaagcaggaatgattgcactattgataagttccggaggaagaattgtccttcttgccgccttagaaaatgctacgaggcaggcatgacactcggggagaagttcagagtggggaattgtaaacacctgaaaatgactagaccatag

SEQ ID NO: 13821 - DNA, 1803 bp, Artificial Sequence
  Description of Artificial Sequence: Synthetic coding sequence
atggaagtccagctgggcctggggagggtttaccctcgaccccctagcaagacatatcgaggcgcctttcagaatctcttccaatcagtgcgcgaggtaattcagaatccaggtcctaggcacccagaagctgcttcggcagcaccaccgggagcctctctgcttctcttgcagcagcagcagcagcagcagcagcaacagcagcagcagcaacagcagcagcagcagcaacagcaacaggaaacttcacctcgtcagcagcaacagcagcaaggggaagacggctccccacaagcccatcgccgtggccctacagggtacctcgtgctggatgaggaacaacagccatctcaaccccagtccgctctggagtgtcaccctgaacgcggctgcgtgcccgagccaggcgcagctgtggctgccagcaaagggttacctcagcagcttccagcccctcccgatgaagacgactctgccgcaccatcgactttatctctcttgggaccaacgttccctggtctctcttcctgctcagccgacttaaaggatattctttccgaggctagtacaatgcagctgcttcagcagcagcagcaggaggccgtgtctgagggctcctcttccggcagagccagggaggcctctggcgccccgacgagcagcaaggataattatcttggcgggacgtccactataagcgacaacgcaaaagagctctgcaaagccgtcagtgtttccatgggattaggcgtggaggcgctggaacacctaagccccggggagcagttgaggggggattgcatgtatgcccctttgttaggtgtgcctcccgcagtgcggccgactccttgtgccccacttgccgagtgcaaggggagcctcttggacgattccgccggaaagagtactgaagacacagccgaatattctccatttaaagggggctatactaagggcctggaaggcgagagccttggctgctcaggctctgccgcagccgggagctctggtacgctagaattgccaagcacacttagcctgtataagagcggcgcattggacgaggcagctgcctaccaatcgcgggactactacaatttcccattggcattggccggccctcctcccccacccccgccaccccatccgcacgcccggatcaagctggaaaaccccctcgactatggcagtgcttgggctgccgccgctgcacagtgcaggtacggggacctggcgagcctccatggagctggtgcggctggaccgggttcgggtagtcctagcgccgcagcctctagcagttggcacaccctgtttactgctgaggagggccagctgtacggcccgtgtggaggtggtggtggcgggggaggcggcggtggcggagggggcggcggtgggggcggaggggggggaggagaggccggtgccgtggctccttacgggtacacacgtccaccccagggactggcggggcaggagtccgatttcacggcaccagatgtgtggtatcctggggggatggtgtcgagagtcccatacccctccccaacctgcgtgaaaagcgagatgggcccctggatggacagttatagcgggccttacggggatatgagactcgaaaccgcaagagaccatgtgttgccaatcgactattatttccctccacagaaaacgtgcctcatctgtggggacgaggcatcagggtgccactacggtgcactgacctgtgggagttgcaaggtcttctttaagagagccgccgagggattcttcagaatgaataaactcaaggagagttag

SEQ ID NO: 13822 - DNA, 444 bp, Artificial Sequence
  Description of Artificial Sequence: Synthetic coding sequence
atggtcatgggcctcggcgttctgttactggtctttgtactgggactaggcctgacaccaccgaccctggcccaggacaacagccggtatacacatttcctgacacagcactacgacgccaagccacaggggcgggacgatcggtattgtgagtctatcatgcggcggcgaggcctgacctcaccttgcaaggacatcaacacctttattcacggaaataagcgaagtataaaggccatctgtgagaacaagaacgggaatcctcacagagaaaaccttaggattagtaaaagttccttccaggttacaacctgtaagcttcatggaggttccccttggcctccgtgtcagtatagagctaccgccgggttccggaatgtggtcgtcgcgtgtgaaaatggattacccgtgcacctggaccaaagcatatttcgacgaccatag

SEQ ID NO: 13823 - DNA, 444 bp, Artificial Sequence
  Description of Artificial Sequence: Synthetic coding sequence
atggtgatgggtctcggagtgttattactggtgttcgtgctgggcctggggctgactcctcctaccctcgctcaggataattctcggtatacacattttttgactcagcactatgatgcaaagccacagggtcgagatgatcggtattgcgagtccatcatgagacggcgtggcctgacatccccatgcaaggacattaacactttcatccatgggaacaaacgcagcattaaggccatctgcgaaaacaaaaacggcaaccctcatagggagaacttgaggatctcaaagagttctttccaggtgacaacctgcaaactgcacgggggctctccctggccgccatgtcaatacagggcaacagccggatttaggaatgttgtggtggcctgtgagaatggactcccggtccacttggatcaatccatttttcggcgaccttag

SEQ ID NO: 13824 - DNA, 1494 bp, Artificial Sequence
  Description of Artificial Sequence: Synthetic coding sequence
atgaccgtgtttctttcattcgcattcctggcagccatactcacccatatcggatgtagcaaccagaggcggagccccgagaactccggaaggcgctataataggattcagcatggtcagtgtgcgtatacattcatcctgccggaacacgatggcaactgtcgtgaatcgacaacagaccagtacaacacaaatgcactgcaaagagacgcgccacacgtggagccagatttcagctcccaaaagctgcaacacctcgagcacgtgatggagaactacacccaatggctacagaaattagaaaattatatcgtggagaatatgaaaagcgagatggcacagattcagcagaatgccgttcagaaccatacggcgactatgttggagatcggcacatccttgctctcacagacagccgaacagacaaggaagctcacagacgttgagacacaagtgctaaatcagacttcacgtctggagatacagctcctggagaacagtctatctacttacaaacttgaaaaacagctgctacagcagacaaatgaaatcctgaagattcacgagaagaattcgctgttggagcataagattctcgagatggaaggaaagcataaagaggagcttgacactctgaaagaagaaaaagagaatctccagggactcgtcacacgtcaaacctacataattcaagaactggaaaaacaactcaaccgggccaccaccaacaacagcgtactccagaaacagcagctggaacttatggacacagtccacaacctggttaacctgtgtaccaaggaggtcctgctaaaaggcggcaagagggaagaggagaagccttttagggactgtgccgatgtgtaccaggcaggcttcaacaagtcaggcatctacacaatctacataaataacatgcccgaacccaaaaaggtgttttgcaacatggatgtgaatgggggaggctggactgtaattcagcatcgggaagatggtagtctggattttcaaaggggttggaaggaatacaagatggggtttggcaacccgtctggtgagtactggctaggaaatgagttcattttcgctatcacaagccagcggcagtacatgctgcgcatagaactgatggactgggaggggaacagggcctactcccaatacgaccggtttcatatcgggaacgaaaaacaaaactatcgcctctatctgaaagggcatacaggaactgcgggcaaacagtctagcctgatactacatggagccgacttttctacaaaggatgccgataatgataattgcatgtgcaagtgcgccctgatgttgacgggcggatggtggtttgacgcttgtggcccttctaaccttaatggcatgttctacaccgcggggcagaatcacggtaaactcaacggaatcaaatggcattatttcaagggaccctcgtattccctgaggtctactacaatgatgatcagacctctagacttttag

SEQ ID NO: 13825 - DNA, 459 bp, Artificial Sequence
  Description of Artificial Sequence: Synthetic coding sequence
actgtttcaaatcttctggagcataagatattggagatggaaggcaaacacaaggaggaattagataccctcaaagaagaaaaagaaaatctgcagggacttgttacaagacagacttacattatccaggagctggagaaacaactcaatcgcgccaccaccaacaatagcgttttgcagaaacaacagttggagttgatggacactgtgcacaacttagtcaatttgtgtacaaaggaaggagtgctgctcaaaggggggaaacgcgaggaagaaaagccttttcgggactgtgccgacgtctatcaggctggctttaacaaatctggcatctatacaatctacattaataatatgccggagcctaagaaggtgttctgcaatatggacgttaacgggggaggctggaccgtgattcaacaccgggaggacgggtcattggatttccaacggggctag

SEQ ID NO: 13826 - DNA, 1497 bp, Artificial Sequence
  Description of Artificial Sequence: Synthetic coding sequence
atgaccgtgttcctctcctttgcatttctcgcagcaattctgactcacatcgggtgtagtaatcagaggcgcagccccgaaaactccggccgcagatacaacagaattcagcacgggcagtgcgcctacactttcatattgcccgagcacgacggcaattgcagagagagcaccacggaccaatataacaccaatgcccttcagcgggacgcgcctcacgtggagcctgacttttcttcacagaaacttcagcacttagagcatgtcatggagaactacactcagtggttgcagaaactcgagaattacatcgtggaaaacatgaagtctgagatggcccagattcagcagaacgctgtgcagaatcatacagcaactatgcttgaaattggcaccagtttgctttctcagaccgccgaacagactcgaaagttgacggacgttgaaacccaagtcctgaaccagacgtcccgcctagaaatccagctgctggagaatagcctgtctacatataaactagagaagcagcttctgcagcaaacaaatgaaattctcaaaatccacgaaaagaactctcttttggagcataagatcctcgagatggagggtaagcacaaagaggaactcgacacgcttaaggaagagaaagaaaatcttcaggggctggtgacgagacagacatacattatccaggagttagagaagcagcttaatagagccactacaaataacagcgtgctgcagaagcaacagctggagcttatggataccgtccacaacctcgttaatctctgtaccaaagaaggcgtgctgctcaagggtggcaagcgggaggaggagaagcccttcagggactgtgcggacgtttatcaggccggcttcaataagtccggaatctataccatttatattaataatatgcccgagccaaaaaaggtgttttgtaacatggatgtgaatggggggggatggaccgtgattcagcaccgggaggatggctccctagattttcagagaggttggaaagagtacaaaatgggtttcggtaacccttcaggtgaatattggttagggaatgagtttattttcgccatcacctcacagcggcaatatatgttacggatcgagctgatggattgggaggggaatcgcgcttattcccaatacgataggttccacattggtaatgagaagcaaaattatcgcctctatctcaaaggccatacagggactgccgggaagcagtcctctcttatcctgcatggcgcggatttcagcaccaaggacgcagataacgacaactgtatgtgtaagtgcgccttgatgctaacagggggatggtggttcgatgcttgtggtccctcaaacctgaacggtatgttctatacggccggccagaatcacgggaagttgaatggcatcaagtggcactacttcaagggcccatcatactctcttcgctcaacaacaatgatgatacggcccttggatttctag

SEQ ID NO: 13827 - DNA, 894 bp, Artificial Sequence
  Description of Artificial Sequence: Synthetic coding sequence
atggaaggaaagcataaggaagaactggacacgttgaaagaagaaaaggaaaacctgcaaggccttgttacgcgacagacctatattatccaggaactagaaaaacaactgaacagggcaaccaccaacaatagcgttttgcagaaacagcagctggaactgatggacacagtgcacaatctggtgaatctttgcactaaggaggtgctcctgaagggggggaagagggaggaggagaaacctttcagggactgcgccgacgtctaccaggccggatttaataagtcagggatatatactatttacattaacaacatgccagaaccaaagaaagtgttttgcaacatggacgttaatggcgggggatggaccgtcatccagcacagggaggatgggagcctcgattttcagcgaggctggaaggaatacaagatgggcttcggcaacccaagcggagagtattggctgggaaatgagttcatcttcgccatcacttctcaacggcagtacatgcttcgtatagagctcatggactgggagggaaacagagcctatagccagtatgaccggttccacataggaaacgagaagcagaattacagactctatctgaagggacatacaggcacagcagggaaacaatccagcctcatactgcatggagccgacttctctaccaaagacgcagacaatgataattgcatgtgcaagtgtgctctgatgctcacgggcggctggtggttcgatgcatgcggcccaagcaacctgaacggtatgttctatactgccggccaaaaccacggtaagctcaacggtattaagtggcactattttaaaggcccctcctattcgctgaggtctacaacgatgatgatcaggccacttgatttttag

SEQ ID NO: 13828 - DNA, 897 bp, Artificial Sequence
  Description of Artificial Sequence: Synthetic coding sequence
atggagggaaaacataaagaagaactggatactctgaaagaagagaaagagaatttgcagggcctcgtgacaagacaaacctacattatccaggaattagagaagcaattgaatcgcgccacaacaaacaatagcgtgctacagaaacagcagctcgaactgatggatacagtccacaatcttgtgaatctgtgtactaaagagggagtgctgctcaaggggggcaagcgagaggaagagaaaccattcagagactgtgccgacgtgtaccaggccgggtttaataagtcggggatttatactatttacatcaacaacatgcctgagccaaagaaagtcttctgcaacatggatgttaacggtggcggatggaccgtgatacagcaccgggaagatgggagtttggacttccagcgcggatggaaagaatataaaatggggttcggcaaccccagtggagagtactggcttggaaacgaatttattttcgccattacatcgcaacggcagtatatgttacggatcgagctaatggattgggaaggaaacagagcatatagtcagtacgacagatttcatataggcaatgaaaagcaaaactaccgactatacctgaaggggcacaccggaaccgcgggcaaacagagctctctgatccttcacggagccgacttctccaccaaggacgctgacaacgataactgcatgtgcaagtgcgcactgatgctgactggcggctggtggttcgatgcttgcgggcccagtaatcttaacggaatgttctataccgccgggcagaaccatgggaaacttaacggcataaaatggcactacttcaagggcccatcctacagcctgaggtcaacaaccatgatgattcgcccgcttgacttctag

SEQ ID NO: 13829 - DNA, 1491 bp, Artificial Sequence
  Description of Artificial Sequence: Synthetic coding sequence
atgtggcagatcgtgtttttcacacttagctgcgacctggtgctggctgctgcatataacaatttccgtaagagcatggactcaatcggaaaaaaacagtaccaagtgcaacatggttcatgttcttacacatttctgctgccagagatggataactgtcggtcatcatcatccccgtacgtgagcaatgccgtgcagagggatgcgcctctagagtacgatgattccgtgcaacgacttcaggtcctcgagaatatcatggagaacaacacacagtggctgatgaagctggagaattacatacaagataatatgaagaaggaaatggttgagattcagcagaacgctgtgcagaatcagacagctgtcatgattgagatcgggaccaatttactgaaccagacagcagaacagacacggaagcttactgacgtggaggcgcaggttttaaaccaaaccacacgacttgagctccaactacttgagcacagtctcagcacaaataaattagaaaagcagatcttagaccaaactagtgagatcaataagctacaagacaagaactctttcttggagaagaaagtgctggcaatggaggacaagcatattattcagctccagagtataaaagaagagaaggatcagcttcaggtcctggtttctaagcagaattcaatcatagaggagctggaaaaaaaaatcgtaacagcaaccgtaaataatagcgttctgcaaaagcagcagcacgatctgatggagactgttaataatctcttaacaatgatgtccacatcgaacagtgctaaggaccccactgtcgcaaaagaagaacagatctcattcagagactgcgcagaagtgttcaagtcgggacatacgacaaacggtatatatacgctcaccttccccaactccacggaagagatcaaggcttactgtgatatggaagctggtggcggagggtggacaataattcagcggagagaagacggctccgtggattttcagcggacttggaaagagtacaaagtaggtttcggaaatccctcaggtgagtactggcttgggaatgaattcgtgtctcagctgacaaaccagcagcgttacgtgctgaagattcatttgaaagattgggagggcaatgaggcctatagtctgtacgagcatttctatttgtccagcgaagaactcaactacagaattcatctcaagggcctgactggcaccgcaggtaaaatctctagcatctctcagcctggcaatgactttagcacaaaggatggggataatgataaatgtatatgcaagtgcagtcagatgctgacgggcgggtggtggtttgatgcatgcggtcccagtaatctgaatgggatgtattatccacagagacagaatacaaacaagttcaatggtattaaatggtattactggaagggcagcggttactcattgaaagctactactatgatgattagacctgcagacttttag

SEQ ID NO: 13830 - DNA, 1488 bp, Artificial Sequence
  Description of Artificial Sequence: Synthetic coding sequence
atgtggcagattgtgttctttacactgagttgcgacctcgtgcttgccgccgcctataacaattttagaaagagcatggactccatcggcaagaaacaatatcaggtacaacacgggtcctgttcctacacctttctgctccccgaaatggataactgtcgtagctcttcctctccatatgtaagcaatgcagtacaaagagatgcccccctggaatacgatgatagcgttcagcggttacaagtccttgaaaacataatggaaaataacacgcaatggctcatgaagctcgaaaactacatccaggacaatatgaaaaaggaaatggtagagatacagcaaaacgccgtgcaaaaccagacagcggtcatgattgagatcggcaccaacctgcttaatcagactgctgagcagacacggaaacttactgatgtagaagcacaagttttaaaccaaaccaccagattagagcttcagctcctggaacattcactaagcacaaataagctggagaaacagatcctggaccaaacttctgaaattaataaactccaagacaaaaactcatttcttgagaagaaggtgttggctatggaggataagcacatcatccagctgcagtcaattaaggaggaaaaagaccagctgcaggtcctggtgagcaaacagaattccatcatagaggaactggaaaaaaaaattgtgaccgcaactgttaataattccgtgcttcaaaaacagcagcacgacctcatggaaactgtcaacaacctgctgaccatgatgagtacatctaacagcaaggatcccaccgtagccaaagaagagcagattagctttagagactgtgctgaagtcttcaaatctgggcacacaaccaacggcatctacactcttacgttccctaattcaactgaggagattaaggcgtactgcgacatggaggcaggtggtggcgggtggaccattattcaacgacgcgaggacggtagcgtcgatttccagagaacctggaaagaatacaaagtgggcttcggaaacccgtccggcgaatactggctcggtaatgaatttgtgtctcagctcaccaatcagcagcggtatgtgctcaagattcatctgaaggattgggaggggaacgaggcatactccctttacgagcatttttacttatcatctgaggaactgaactatcgcatacacttgaagggactgactggcacagcgggaaagatttcctcaatcagccagcccggaaatgacttctcaactaaggatggcgataacgacaagtgtatctgtaagtgttctcagatgctgacaggcggttggtggtttgacgcttgcggccctagcaatctcaacggcatgtactacccccaaaggcaaaacacgaacaagttcaatggtattaaatggtattattggaaaggaagtggttacagcctaaaagctaccactatgatgatcagaccggctgatttctag

SEQ ID NO: 13831 - DNA, 1335 bp, Artificial Sequence
  Description of Artificial Sequence: Synthetic coding sequence
atgtggcagattgtgtttttcactttaagttgcgatctggtcctggccgccgcctacaataactttcgcaagtcaatggacagtattggcaagaaacagtatcaggttcagcatggaagttgctcatacaccttcttgctccccgaaatggacaattgtcggagctcatctagtccttacgtgtccaacgcagttcaaagagacgccccactagaatacgacgattcagttcagagactccaagtgctggagaatatcatggaaaacaacacgcagtggctgatgaaagtcttaaatcagaccacacgactggaactgcagttactggagcatagtctcagtacgaacaaattggaaaaacagatcctcgatcagaccagcgagattaataagcttcaggacaaaaattcgttcctggagaagaaggtgctcgccatggaggataagcatatcatacagctgcaaagcataaaggaggagaaagaccaattgcaggtactggtgagtaagcagaactccatcattgaggagctagaaaaaaaaatcgttaccgccaccgttaataatagcgtcctgcagaaacagcagcatgatctaatggagacagtgaacaacctgctaaccatgatgagtaccagcaactcggcaaaagaccctacagtggccaaggaggagcagattagcttccgagactgcgctgaggtcttcaaaagcggacatactacaaatggcatatatactctgacgttccctaactccacggaagaaatcaaagcctactgcgatatggaggctgggggtgggggctggaccattatccaacgcagagaagacgggtccgtggattttcagaggacatggaaggagtacaaggtggggtttggaaacccctccggcgaatactggctagggaatgagttcgtatcacagctgactaaccaacaacgttacgttctgaaaattcatctcaaggactgggagggcaatgaggcgtattcactgtacgagcatttctatctatcctcagaagagctgaattacagaatccacctgaagggcttaacaggtacagcgggtaagatttctagcatctctcagccagggaatgacttcagcacaaaagatggggacaatgataagtgcatttgtaagtgttctcagatgcttactggcggttggtggtttgatgcgtgtggcccgagcaatctgaatggaatgtactacccacagcgtcagaataccaacaagtttaacggcatcaagtggtactactggaaaggctctggctactccctcaaagcgactactatgatgatccggcccgcagacttctag

SEQ ID NO: 13832 - DNA, 1221 bp, Artificial Sequence
  Description of Artificial Sequence: Synthetic coding sequence
atgagtggcgcacctaccgccggcgccgctctcatgctttgcgctgcgaccgccgtgctgctcagcgcacagggcggtcccgtacaaagcaagtccccacgatttgcctcctgggatgagatgaacgtactcgcacacggcctgctgcagcttggacagggcttgcgtgagcacgcagagcgcactcggagccagctgagcgctctggagcgccgactgagcgcctgtggatccgcgtgccaaggcacagaaggcagtactgacttgcccttggccccggaatctcgggtagatccggaagtgctacactcattgcagactcagctaaaggcccagaatagtcgcattcagcagctgtttcataaggtagcgcagcagcagagacacctggaaaagcaacacttacggattcaacatctccagtctcagttcggtcttcttgatcacaagcatcttgaccacgaggtagccaagcccgcaagacgcaagaggctcccggaaatggcccagcctgtggacccagcgcataatgttagccgtctccaccgactccctagggactgccaagaactgtttcaggtgggtgagagacaatccgggcttttcgagatacagccccagggctctcctccctttctggtaaattgtaagatgacaagcgatggagggtggaccgttatccagcggcgtcacgacggtagcgttgatttcaaccggccttgggaggcctacaaggccggctttggcgacccacatggcgaattctggctcggactcgagaaagtgcattctataactggggaccgtaactcccggcttgcagtccaattgcgggattgggacggcaacgccgaactgctccaattctcagtccatttgggaggagaagacacagcgtacagtctccagctgaccgctccagtagccggacagcttggcgcgaccaccgttccaccatcgggcctgagcgttccgttttccacatgggaccaggaccacgatctccgccgagacaaaaattgcgcaaaaagcttgagcgggggctggtggttcggaacttgttcccacagtaacctaaatgggcaatatttccgatctataccccagcagagacagaagctaaagaagggcatcttctggaagacttggagagggcgatactaccctttgcaggctacaacaatgctaatccagcccatggcagcagaggccgcatcctag

SEQ ID NO: 13833 - DNA, 1107 bp, Artificial Sequence
  Description of Artificial Sequence: Synthetic coding sequence
atgagtggggcacctaccgccggagccgcacttatgctgtgtgcagcaacagctgtgcttctgtccgctcaggggggtccagtgcagtctaaaagtccgcgctttgcgtcgtgggatgagatgaatgtgctggcccacggactcctgcagttgggccaaggactgcgcgagcatgccgaacggacacgcagtcagctgtccgcacttgaaaggaggttgtctgcctgtggaagtgcctgccagggtactgagggcagtacagatctgccactcgcgccagagagccgcgtggatcctgaggtgctgcatagtctccagacacagctgaaggcccagaattctcgaatccagcagctcttccataaagtggctcaacaacagcgacatttggagaaacagcatctgcgcatccagcatctgcagagccaatttggcttgttagaccacaagcacctggaccacgaagtggccaagcctgccagaaggaagcgactccctgaaatggcccaacctgtggatcccgctcacaacgtgtcaagattgcaccacgggggctggaccgtcattcagagacgccatgacggttcagttgattttaataggccatgggaagcgtataaggccggcttcggggaccctcatggtgaattttggttgggtttggagaaggtgcacagtattacgggtgatcgcaactcacgccttgcagtgcagctcagagattgggacggcaacgccgagcttctgcagtttagcgtacatctaggtggcgaagatactgcttactcactccagctgacagctccagtagcaggccagttgggagctaccaccgtacctccttcgggactttccgtacctttttctacttgggatcaggaccacgatttgagacgtgacaaaaattgtgccaaatccctctccggtggttggtggttcggcacttgctctcattccaatctgaacgggcaatatttcagatcgattccgcagcagaggcaaaagctgaagaagggcatattctggaagacatggagaggtcggtattatcccttacaggcgaccaccatgctcatccagcctatggcagcagaggccgcctcctag

SEQ ID NO: 13834 - DNA, 720 bp, Artificial Sequence
  Description of Artificial Sequence: Synthetic coding sequence
atggcgcaacctgtggacccggctcataatgtgtcacgactacaccgcctgcctagggactgccaagagctgttccaggtgggcgagaggcaaagcggactgtttgagatacagccccagggctcccctcctttcctagttaactgcaaaatgacctccgatgggggttggaccgtgatccagcggagacacgacgggagtgtggatttcaatcggccctgggaagcctacaaagcgggctttggcgaccctcatggggagttttggctggggctggaaaaggtccattccatcaccggcgacaggaattctagacttgctgtgcagcttcgtgactgggatggtaatgcagagctgctgcagttttctgtgcacctgggcggagaagacactgcttattctttgcaactgacagctccggtcgcaggccaactcggcgccactaccgtgcctcccagcggcttgagtgtgcctttctctacctgggaccaggaccatgacctccggcgagataagaactgcgccaaaagcctttctgggggctggtggttcgggacttgtagtcattcgaacctgaatggccaatatttccgctcgatcccccaacagagacagaagttgaaaaaggggatcttttggaagacttggcggggacgctactatccgctccaggcaactaccatgctgattcagcccatggcagcagaagccgcctcgtag

SEQ ID NO: 13835 - DNA, 837 bp, Artificial Sequence
  Description of Artificial Sequence: Synthetic coding sequence
atggagccaagggcagccgatggatgctttttgggtgacgtgggtttttgggtcgagagaacacctgtgcatgaggctgcgcagcggggcgagagcctccaactacagcaactcatcgaaagcggggcttgcgtaaatcaagttaccgtggactctattacaccgttacacgctgcatccctccagggtcaggcccgatgtgtacagttattgctcgccgctggcgctcaggtggatgctcggaacatagatgggtcaacacctctgtgtgatgcctgtgctagcggaagtatagagtgtgtcaaactcttgctcagttacggagccaaagtcaacccccctctctacacagcatcacctctgcacgaggcgtgtatgagcggctcatctgaatgcgtgcgtctcctgatagacgttggggctaatttagaggcccacgattgtcactttggcactcctctacatgttgcatgcgccagggagcatcttgactgcgtgaaggtgctgctgaacgctggcgccaatgttaatgcggccaagctccacgagacagcactccaccatgctgccaaggtcaaaaatgtagacctcatcgaaatgctgatcgagtttggcggaaatatttatgccagggataatagaggaaaaaaaccctctgattatacatggtcttcttccgctcctgcgaagtgtttcgagtactacgagaaaacgcccctgaccctgagccagctctgcagagtcaatctgcgcaaagccacaggagttcggggcctcgagaaaattgcaaagctgaacatcccaccccgcctgattgactacctcagctataactag

SEQ ID NO: 13836 - DNA, 396 bp, Artificial Sequence
  Description of Artificial Sequence: Synthetic coding sequence
atggagaagatacctgtgagtgcattccttcttctcgtggctctgtcctataccttagcccgggacaccaccgtgaaaccaggtgccaaaaaagacacaaaggatagccggccaaaattacctcagaccttgtcaaggggctggggggaccagttaatttggactcagacttacgaagaagctttatataaaagcaagacctctaataagccacttatgatcatccaccaccttgacgaatgccctcactcacaggccctcaagaaggtgttcgctgaaaacaaagagatccagaagttggccgaacagtttgttctcctaaacttggtgtatgaaaccaccgacaagcatttatcccccgacgggcagtatgtgccacggataatgttcgtctag

SEQ ID NO: 13837 - DNA, 528 bp, Artificial Sequence
  Description of Artificial Sequence: Synthetic coding sequence
atggaaaaaattcccgtgagcgcattccttctgcttgtggcactcagctataccctggccagagatacaacagttaagcctggcgctaagaaagatacaaaggatagccgcccgaagctcccacagaccctaagccggggctggggggaccagctcatatggacccaaacctatgaagaggccctctacaagtccaagacttcgaacaaacccctgatgattatccaccacctcgacgaatgccctcatagccaggccctgaagaaggtgttcgcagaaaataaagaaattcagaaactggcggagcagttcgtcctgctcaatctggtctatgagacaaccgacaaacacctgtcacccgatgggcagtacgtgccaaggatcatgtttgtagatccctcgctgaccgtccgtgcagacatcactgggcgctactccaacaggttatacgcctatgagcccgcggacaccgctctcctcttagacaacatgaaaaaggcgttgaaactactgaaaacagaactgtag

SEQ ID NO: 13838 - DNA, 588 bp, Artificial Sequence
  Description of Artificial Sequence: Synthetic coding sequence
atgtctaactataccgacgccgaaagtagctttagcaagcaggagatcataagggttgcgatggagaagattcccgtctctgccttcttgttactcgtcgcgctctcttacactttggcccgtgacacaactgttaaacccggagccaagaaggacactaaagattcccgtcctaaacttccacagactctttccaggggatggggggatcaattaatctggacccagacctacgaggaagctttatacaaatctaagaccagtaataagcccctaatgatcatccaccacctagacgagtgcccccactctcaggctctcaagaaggtcttcgccgaaaataaagagatacagaagctcgccgagcaatttgttctcttgaatctggtgtacgagactactgataaacacctgtcccccgacggccagtacgttcctagaatcatgtttgtggatccttctctgacggtgcgagctgatatcaccgggcgatacagcaaccgactttacgcatatgagcctgcagatacggccctgctgctcgataacatgaagaaagcactcaaacttttgaagaccgaactgtag

SEQ ID NO: 13839 - DNA, 1251 bp, Artificial Sequence
  Description of Artificial Sequence: Synthetic coding sequence
atgtggccaaccagacggcttgtaaccatcaagagatcaggtgtggacggtccgcactttcccttgtccctgtccacttgtctgttcggacgatatgaaaatgagtcactgcagaacggccgaaagagtacagagttccctcggaaaattcgggagcaggagcccgcacgtagagttagtcgcagttccttcagctccgaccccgacgaatcggaagggatacccctgaaacggcgccgtgtcagtttcggcggccatttgaggccggaattatttgacgagaatctaccccccaacacccccctgaaaagaggtgaagcaccaacaaagcgcaaatctctggtgatgcacaccccgccagtactaaaaaagatcattaaagagcagccacagccatccggaaagcaggagtccggatccgaaatacacgttgaggttaaggctcagtcactggtgataagtccacctgcgcctagcccccgaaagacccctgtcgcttccgatcaacggcgacgctcatgcaaaactgcgcccgcatcgtcgtcgaagtcccaaaccgaggtaccaaagcgcggggggaggaaaagcgggaatcttccctccaaacgcgtgagcatctctaggtctcagcacgacattcttcaaatgatctgtagcaagagaagatctggagcatcagaggctaacctgatcgtggcaaaaagctgggccgatgtggtgaaactgggggctaagcagactcaaactaaagtaattaaacatggcccacagagaagcatgaataagcgccagcggcggcctgccaccccaaagaagccagtgggggaggtccatagtcagttctccactggacacgctaactccccttgcaccataatcatcggcaaggcccacacagagaaggttcacgtaccagccagaccttatcgggtcctgaataactttatttctaaccaaaagatggatttcaaagaggatctctcgggcattgcagaaatgttcaaaacaccggtaaaagaacaacctcagctgactagtacttgtcatatcgccatatccaattccgagaatctgctgggaaaacaattccaaggcacagacagcggtgaggagccgttgctgccaaccagtgaatctttcggaggcaatgtcttcttctccgctcagaacgccgcgaaacagccgtctgataagtgctcggcttcaccccctcttcggagacaatgcattagggagaacgggaacgtttag

SEQ ID NO: 13840 - DNA, 8691 bp, Artificial Sequence
  Description of Artificial Sequence: Synthetic coding sequence
atgtggcccactaggagactggtgaccatcaagcgttcaggtgtcgacggcccccattttccattgagtttgtctacttgcctttttgggcgcggtatcgagtgcgacattcgcattcagctacccgtcgtatcaaagcagcactgcaaaattgagattcatgagcaggaagctattttgcataactttagctcaactaatcccacacaggtaaatggtagcgtgatcgacgagccggtgcgcctgaagcacggtgatgtcattaccattatcgaccgatcattccgatacgaaaatgagtctctccagaatgggagaaagtcgaccgaatttcctagaaagattagggaacaggaaccagcgcgaagggtttcacgcagctcttttagctccgacccagacgagtccgagggaattccacttaaacggcgtcgggtctcctttggcgggcatttgcggcctgaacttttcgatgagaaccttcccccaaacacgccacttaaacggggtgaggcgcccacgaaacgcaagtctttagtaatgcatacccctcctgtactgaaaaagatcattaaagaacagccacagccatctggcaaacaggagtccggctctgagatacatgtcgaagttaaggctcaatctcttgttatatctcccccagccccatctccgagaaagactcctgtggctagcgatcagcgccgaaggtcttgcaaaacagcaccagcgagctcctcgaagagccagacggaggttcccaagagagggggcaggaaatctggcaatctgccaagcaagagggtaagcatctcccgttctcagcacgacatcctgcagatgatctgtagcaaacgccgatccggtgcgagtgaagccaacctgattgtggcaaaatcttgggctgacgttgtgaaactgggagcgaaacagactcagactaaggttatcaagcatgggccccaacggtcaatgaacaaaagacagagacggcccgcaactccaaagaagcctgtgggagaagtgcactctcagttcagcaccggccacgctaactctccttgtactatcatcataggtaaggcccatactgagaaggttcacgtgccagcacgcccctacagggtgctgaataactttatttcaaaccagaagatggatttcaaggaagacctatcagggatcgccgaaatgtttaagacccctgtcaaggagcagccacagcttaccagtacatgtcatatcgcaatttctaattcggaaaacttactgggtaagcagttccagggcacagactccggagaagaacctctcctgcccacatcagagtcttttggcggcaatgtatttttcagcgctcagaatgctgcaaaacaacccagcgacaagtgcagcgcctcccctccactgcggagacagtgtattagagaaaatggcaacgtagccaagaccccacggaacacctacaaaatgacctctcttgagaccaaaacctctgatactgagaccgaaccctctaagactgtctctactgcaaatcgatcagggagaagcaccgaattccgtaacatacagaagctgcctgtggaatcaaagagtgaagagacaaatactgaaattgtcgagtgtatcctcaagagagggcagaaagctaccctgctccagcagagacgcgaaggagagatgaaagagatcgagcgaccatttgagacctacaaggaaaacatcgagctaaaggaaaacgatgaaaagatgaaggccatgaagcggtccagaacttggggtcaaaagtgcgctccaatgtctgacctcaccgacctgaaaagcctgccagacacagaactaatgaaggacacggctcgcggccagaacctgctgcagactcaggaccatgcaaaggcaccaaaaagcgagaagggcaagatcacgaaaatgccttgtcaaagcctacagcctgagcctatcaatactccaacccataccaagcagcagctgaaggctagcctgggcaaagtcggtgtgaaggaagagctgctcgccgtgggaaaattcacacggacgtccggagagaccactcacactcatcgagaacccgctggcgacggaaaatcaattcgtacattcaaagagtcccccaagcagattctggatccagcagcccgggtcacaggaatgaagaaatggcctcggacacctaaagaggaagcgcagtcgctcgaggaccttgccggctttaaagagctgttccagacccccggcccctctgaagaaagtatgaccgatgagaagacaaccaagattgcctgtaagagtccccccccggaaagcgtcgacacaccaaccagcactaaacagtggcctaagagatctcttaggaaggccgacgtggaggaggagtttctcgcgctgagaaagctcacaccctcagcgggtaaggctatgcttacccccaaaccggcaggtggcgatgaaaaggatattaaggcatttatgggtaccccggtgcagaaactagatttggcaggaaccctgccgggcagcaagcgccagctgcaaactccaaaagagaaagctcaagctcttgaggacctggcgggtttcaaagagctgttccagacccccggacacactgaagaactggtggcggcggggaaaacaacaaagataccgtgtgattctcctcagtcagacccagttgatacccccaccagtactaagcagaggcccaagcgctccatacggaaggccgatgtcgagggagagttacttgcttgtagaaatctgatgcctagtgctgggaaagccatgcacacacccaaaccatcagtcggtgaggagaaggatatcatcatatttgttggaacaccagtgcagaaactggacttgaccgagaatctaaccggctccaagagacggcctcagacccccaaagaggaggctcaggctctggaggaccttacagggttcaaagaattgttccagactccaggacatacagaggaggccgtggccgccgggaaaacaacaaagatgccctgcgagagttccccacctgagagtgcagacacgcccacttctacgcgccgacagccgaaaactcccttagaaaagcgggatgtacagaaagaactgtctgctctgaagaaactgactcagacttccggtgaaacaacgcataccgataaggttccaggcggcgaggacaagtccattaacgctttcagggaaaccgccaagcagaaattggaccccgctgcatccgtcaccggtagcaaaagacaccctaagacaaaagaaaaagctcaaccacttgaggacctggctggactgaaggaactttttcagacgcctgtgtgtacagacaagcccacgacccacgaaaagactacgaagatcgcatgccggtcccaacccgatcccgtggatacccccacttcatcaaaaccgcagagcaagcgatccctgaggaaagttgatgtcgaggaagagttctttgcccttcgtaaaaggacgccctctgccggcaaagcgatgcatactcctaagcctgctgtttccggcgagaagaacatctatgccttcatgggaacaccggtccagaaactagatctgaccgagaatttaaccggtagtaaacgaaggctgcaaacgcccaaagaaaaggcccaggctctggaagacctggcggggttcaaagagctctttcagaccaggggccatacagaagagagcatgacaaacgacaagaccgctaaggtcgcctgtaagagttcacaacctgacccggacaagaatcccgcaagtagcaagaggcgtctgaagacgtccctgggcaaagtcggtgttaaggaggagctccttgctgtcgggaagctaacacagacatccggagaaacaactcatacacatacggagcccacaggggacgggaagagtatgaaggcattcatggagtcccccaaacagattctggattcggctgcttcacttaccggttcgaaacgtcagctcagaactccaaaaggtaagtccgaagttcctgaagatctagccgggtttatagagctgtttcagactcctagccacaccaaggagagcatgaccaatgaaaaaacaaccaaagtgagctaccgggcctcccagcccgacttggtagataccccaactagctctaagcctcagccgaaaaggagtctgcggaaagcggacaccgaggaggaatttctcgcattccgcaagcaaactccatccgccggcaaggctatgcacacacctaaacccgccgtgggcgaggaaaaagatattaatactttcctggggacccctgtgcaaaagctggaccaaccaggaaatcttccagggagcaataggcgactccaaaccagaaaggagaaggcccaggcccttgaagaacttactggattcagggagctgtttcaaacaccatgtactgataacccaacaactgatgagaagaccacaaagaagatcttgtgcaaaagtccacagagcgacccagccgatactcctactaacacaaaacagcggcctaaacgaagcctgaagaaagctgacgtggaggaggagtttctcgcctttcgaaaattgactccatcggcaggtaaagccatgcacactcccaaggccgcagttggagaggagaaggatatcaatactttcgtaggaacacctgtcgagaagctggatcttcttgggaatctgcctgggtccaagaggaggccccaaactcctaaggaaaaagcaaaggctctggaggatctcgccggattcaaggaactgttccagacaccgggacacacagaagagtctatgacagatgacaaaatcaccgaggtaagttgcaaatccccccagcccgatcccgtgaagactcctacaagctccaagcagaggttgaagatctccctcggcaaggtgggcgtcaaggaggaggtcttacctgttgggaaactgacccagacatctggtaaaactacacagacgcaccgtgaaacagcaggcgatggcaagagcataaaggccttcaaggagagtgccaagcagatgctcgatccagcaaactatggcaccgggatggaacgctggcccaggactcctaaagaggaggctcagagtcttgaggacctggcaggctttaaggagctgtttcagactccggatcatactgaagagagcacaactgacgacaagacgaccaagattgcctgtaagtcaccccccccagaatccatggacacccctacatcgaccaggcgtcgtccaaagacaccccttggcaagcgcgatatcgtggaggagctgagcgccctgaagcaactgacccaaaccacccacactgataaagtgcccggcgacgaagacaaggggattaatgtctttagggaaaccgctaagcagaagctggatccagcggccagcgttactggttccaaaaggcaacctcgcacaccaaaaggaaaggcccagccactggaggatcttgcaggcctcaaggagctgtttcagacccctatttgtaccgacaaacctacgacccacgaaaaaacaaccaaaatcgcttgtagatccccccaacccgatccggttggaactccaactattttcaaaccgcaatcaaagaggtctctgcgcaaagccgacgtcgaagaggaatctctggcactgagaaagcggaccccctccgtgggaaaggcgatggacacccccaaacctgcgggcggcgatgagaaggatatgaaggcttttatgggaactcctgtgcaaaagctcgatttgccagggaacctgcctggcagtaagcgctggccacaaacaccaaaagaaaaggcccaagccctggaagacctggcgggattcaaagagctgtttcagacaccggggaccgacaagccaacaaccgatgaaaagactaccaagatcgcctgcaaatcccctcagccagatcccgtcgatacccctgcctctacgaaacaacgccctaagcggaacttacgtaaggctgacgtcgaggaagaatttctcgcgctccgcaagaggacgcctagcgccggaaaggcgatggatacaccgaaacctgcggtatcggacgaaaaaaatatcaacaccttcgtggaaacccctgtgcaaaaactagacctgctgggtaacttacctggctccaagcggcagccccaaacccccaaagaaaaggctgaggcactggaagacctagtcggtttcaaggagctgtttcaaacacccgggcatacggaagaatccatgactgacgacaaaatcactgaggtttcatgcaaatcccctcaacctgagagctttaagaccagtaggtccagcaagcaaagactgaagattccactggtcaaagtcgatatgaaggaggagcctctcgctgtgagtaagttaacccggacctccggagaaactactcagactcacaccgaacctacaggggatagcaagtccattaaagcctttaaagagtcgccaaagcagattctcgaccccgctgcttctgtgacaggctctcgacggcagctgaggaccagaaaggaaaaggcaagagcactggaagatctcgtcgacttcaaggaactcttctccgccccaggtcacacggaggaaagtatgactattgacaagaataccaagattccctgcaaaagtcctcccccagagctgacagacacggccacatcaaccaaaaggtgtccaaagactcgtccccggaaagaagttaaagaggagctcagcgccgttgagcgactcacccagactagcgggcaatctacacatacacacaaagagccagcatccggcgacgaggggatcaaggtccttaaacagagagccaagaaaaagcccaacccggtagaggaagaaccctcaaggcgcagaccacgtgcacccaaagaaaaagcccaacctctcgaggacctggccggcttcacagaactgagcgaaacttcaggtcacactcaggaatcactcaccgcggggaaggccaccaaaatcccttgtgagagtccaccactggaggtggtcgacaccaccgcctccaccaagcggcaccttcgaaccagagtacagaaggtgcaggtgaaggaggaaccatcagcagttaaattcactcaaacttcgggagagaccaccgacgccgacaaagagcccgctggggaagacaagggaattaaggcactgaaggaatccgcgaaacagacacctgcacccgcggcatcagtcactggatcccggcgaagaccaagagcccccagggagtctgcccaggcaattgaagacttggcggggttcaaagaccccgctgctggacacactgaggagagtatgaccgacgacaaaaccactaaaatcccatgcaagtccagtcccgagctggaagatacggcaaccagttccaagaggagaccccgcaccagagctcagaaggtggaagtgaaggaggagctgctggctgtcggcaagctgactcagacaagcggagagacgacacacacagacaaggagcccgtgggtgaagggaagggtacaaaagcttttaagcagcccgcgaaacggaagcttgacgctgaggatgtcatcgggtctcgccgtcaaccccgggcccctaaagaaaaggcccagccactggaagacctagcttcttttcaggagctgtcccagacgcccggccacaccgaagagttggccaatggcgctgccgattcattcacctcggctccaaaacagaccccagattcggggaagcccctaaagataagtagacgagttttgagggcgcctaaagtggagccagtcggcgacgtcgtctctacaagggaccccgtgaaatcacaatccaaatctaataccagcttgcctcctctccccttcaaaaggggcggtgggaaggacgggagtgtcaccgggacaaagaggttgcgctgtatgcccgctcccgaggagattgtcgaggagctgcccgcatcgaagaaacagcgggtggcgccacgcgcccgaggaaaaagctccgagccagtggtgattatgaagagaagcttacgtacaagtgcaaagaggatagaacccgctgaggagctcaatagcaacgatatgaagactaacaaagaggagcataagcttcaggacagcgtgcccgagaataagggaatatcactgagatcgaggagacagaacaagacagaggccgaacagcagataaccgaagtattcgtgttggccgagaggatagagattaatcgtaatgagaaaaaacctatgaagactagtcccgagatggatatccagaaccccgacgatggcgcaaggaagccgatcccacgagataaggttactgagaacaaacgctgtctcagatccgctcgacagaatgaatctagccaaccgaaagtagcggaggagagcggaggacagaaatcagcaaaggtcctgatgcagaaccagaagggaaagggtgaagccggcaattcagactctatgtgtctccggtcgaggaaaaccaagagtcagccagccgcctcaacattagagagcaagagcgtgcaaagggtgaccagaagtgtgaagaggtgtgctgaaaacccaaagaaggccgaagataacgtatgtgtcaagaaaattcggaccagaagccatcgggacagcgaagacatctag

SEQ ID NO: 13841 - DNA, 9771 bp, Artificial Sequence
  Description of Artificial Sequence: Synthetic coding sequence
atgtggccaactaggcgactggtgacaataaagaggtcaggggtggatggaccccattttcctctctccctaagtacctgtctgttcggccgggggatcgaatgcgatatccggattcagcttcctgtggtgtcaaaacaacactgcaagatcgaaattcacgagcaggaagccatcctgcacaactttagttccaccaatccaactcaggtcaatggctccgtcatagatgaaccagtgaggcttaagcatggggatgtcataacgataatcgaccgctctttcagatacgagaatgagtcgcttcagaacggccgtaaatccaccgagtttcccagaaaaattcgggagcaggagcctgctcgcagggtgtcaaggtcttccttctcttcagaccccgacgaaaaggcccaagattctaaagcttacagcaagatcaccgagggcaaagtctcaggtaatccacaggtgcacattaaaaacgtcaaggaggactcaacggctgacgactccaaggactctgtagcccagggaaccacaaatgtgcactcttctgaacatgcaggtcgtaacggccgcaatgcagctgaccctatttctggggacttcaaggagatctcaagtgtcaaattagtatctcgctatggggaactcaagtcagtgccgacaactcagtgcctggataatagtaagaagaatgagagtccattctggaaactctatgaatctgtgaagaaggaactcgatgttaagtcccagaaagaaaatgtgctgcaatactgcagaaaaagcgggttgcagacagattatgctacagaaaaagaaagtgccgatggcctacagggggaaacacagcttctcgtgtcacgcaaaagccgtccgaaatccggggggtctgggcacgcggttgcagaaccagcctcaccggaacaggagctggaccagaacaagggaaaaggaagggacgtggaatccgtacagaccccaagcaaggccgtgggcgctagttttcctctgtacgaacctgccaaaatgaaaaccccagtgcagtacagccaacaacagaattctccccaaaagcataaaaacaaggacctgtataccactggacggcgcgagtctgttaatttgggtaagtctgaaggattcaaagctggggacaaaacactgaccccacgcaagctgtctacccgtaatcgaactcctgccaaagtggaggatgctgccgacagcgcaactaagccagaaaacttgagctcaaagacccgcggatccatccccaccgatgttgaggtcctgcctactgaaaccgagatccacaacgagccatttctcacactgtggctaacgcaggtcgagcggaagatccaaaaagactctctgtcaaagcccgaaaagctaggcacaaccgctggccagatgtgcagcggcctgcctgggctgtcctcagtggatatcaacaactttggtgattccatcaatgaatccgagggaatcccattaaaacggcgcagggtctcatttggtggtcaccttcgaccagagctgtttgatgagaaccttccccctaatacacccctgaagcgcggggaggcaccaacaaagagaaaatctttagtgatgcataccccacccgtgctcaagaaaattatcaaggaacaacctcagccttccgggaagcaggagtcaggctcggagatccacgttgaagttaaggctcagtctttggtgatctccccaccggccccgtccccccggaaaaccccggtggcttctgatcagcggcgtcggagctgcaagactgctcctgccagctccagtaaaagtcaaacggaggttcccaagagaggaggcagaaaatccggaaacctgccctccaagcgcgtttctatttctcgcagccagcacgatatcctccagatgatctgtagtaaaaggcgcagcggagcttctgaagccaaccttatcgtcgccaaatcatgggctgatgttgtgaagcttggtgctaaacagacgcagactaaggtcatcaaacatggcccccagcggtccatgaataaacggcagaggaggccagccacgccgaagaagcctgttggggaggttcactcccagttctcaactggccatgccaactcaccttgcactatcatcatcggcaaggcccacaccgagaaggtgcacgtccccgccaggccttacagagtgctgaacaactttatctcaaaccagaagatggacttcaaagaggacctgagcggtatcgccgaaatgtttaaaacacctgtcaaagaacagcctcagctgaccagcacatgccacatcgccatttccaactctgagaatcttctggggaaacagtttcaggggacagattccggggaggagcccctgcttcccacctccgaaagcttcggtggtaacgtcttcttcagcgcccaaaacgctgccaaacagccatccgacaagtgttctgctagcccacctctgcgacgccaatgcattcgggagaacggtaatgtagccaagacaccccggaacacatataaaatgacgtcactcgaaacaaagacttctgacactgagactgaaccatccaagacagtgagtactgcaaacaggtccggacggagtaccgaatttagaaacatccagaaactgcccgttgagtccaaaagtgaggagaccaatacagagatagtcgaatgtatcctgaaacgagggcagaaggcgaccctcctgcaacagcggagagaaggcgagatgaaagaaattgagagacctttcgaaacatataaagagaatatcgaactgaaagagaacgatgagaagatgaaagccatgaagcgtagtagaacgtggggacagaaatgtgcgcctatgagcgacctcacagacctgaagtctctgcctgacactgagctcatgaaggacacggcccgcggacagaatctgctgcagacccaggatcatgctaaagcccccaaaagcgaaaaggggaagataacgaagatgccgtgtcagagtctgcaacccgaacccattaacacccccacccatacgaaacagcagctgaaggcatccctgggcaaagtgggagtaaaggaggagctgttagcggtgggcaagttcacacggacaagcggcgagaccactcacactcaccgggagccagcaggggatggcaaaagcattaggacattcaaagagtcccccaagcagatcctcgaccctgctgcccgagtgactggtatgaaaaagtggcctagaacacctaaagaggaggcccaaagcttagaggatctggccggattcaaagagctcttccagacaccaggcccctctgaagagtctatgaccgatgaaaaaaccactaaaattgcgtgtaaatccccccccccggagtcagtagatacgccaacatccaccaaacagtggccaaagcgctcgctgcgcaaagctgacgtggaagaagaattcctggcgctacgaaagttaaccccatcagccggcaaggctatgttaacaccaaaacctgctggcggggatgagaaggacataaaagcatttatgggcaccccggttcaaaaattggaccttgcagggacgctgcccggctccaagcggcaacttcagacacctaaagaaaaggctcaggcactggaagaccttgcaggattcaaagagctgttccagacccccggacacacagaggaactcgtggccgccggtaaaacgaccaaaattccgtgcgattcccctcagagtgacccagtggataccccgacaagcaccaaacagagacccaaacggtcgattcgtaaggcagacgtggagggtgaactgctggcctgccgcaacctcatgccgagcgccgggaaggctatgcacaccccgaaaccttcagttggtgaggagaaggacataatcatctttgtggggacaccagtgcagaaactcgatttgacagagaacttgactgggagtaagcggcggcctcagacacccaaggaggaggcacaggcccttgaggacttaacgggttttaaagagcttttccaaaccccgggacacaccgaagaagcagtggctgcaggaaagacaacaaaaatgccttgtgaatcttcaccaccagagtctgccgatactcccacaagtacccggagacagcctaaaactccgctcgagaagagagatgtgcagaaagagctctccgctctgaaaaaactgacccagacgtcgggcgaaacaacacataccgacaaggtgcctgggggagaggataaaagcatcaatgcattcagggagacggctaagcagaaactggacccagcagcctcagtgaccgggtctaagagacatcccaaaacaaaagaaaaagcgcaacccctggaggatctggctgggctcaaagagctctttcagactcctgtgtgcaccgacaagcctactacacacgaaaagaccactaaaatcgcctgtcgatcacaaccggatcctgtggatacccccacatctagcaagccacagtccaaaaggagtttgcggaaggtggatgttgaagaggaattttttgccctgcgcaaaaggaccccttctgccggcaaagcaatgcacacaccaaaaccagctgtgagcggtgagaagaacatctacgccttcatgggaacaccggtccaaaagttagatctgaccgagaacctgacaggaagtaagaggaggttgcaaacccctaaggaaaaagctcaagccctggaagatctcgctgggtttaaggagctgttccagacacgaggccacactgaagaatctatgactaacgataagacagccaaagtcgcatgtaagagctcccaaccagaccccgataaaaatcctgcctcatctaagaggagattgaaaaccagtctgggcaaagtaggagttaaggaggaactgttggcagtgggtaaattgacccagaccagcggcgaaacaactcatacccacacagagcccactggagatggaaagagcatgaaagcgtttatggaatcccccaagcagattctggactctgcggctagccttaccggtagcaagcgacaactacggacccctaagggaaaaagtgaggtccccgaagacttagctgggttcatcgagctttttcagacgccctcccacactaaggagagcatgacaaacgaaaagacaacaaaagttagctacagagcctctcagcccgacctggtggacacccccacaagtagtaagcctcaaccgaagcggtctctgcggaaagcggacactgaagaggaattccttgcctttaggaagcaaacaccaagcgctgggaaggctatgcatacgcccaagcctgccgttggcgaagagaaagacattaacaccttcctcggcaccccagtgcaaaaactggaccagcccggcaacctgccaggatccaatagacgtctgcaaacacggaaagagaaggcgcaagctctggaggagctcaccgggtttcgcgagctgttccaaaccccatgcaccgacaatccaacaacagatgagaagaccacgaagaaaatattatgcaagagtcctcagagtgaccctgcagacacaccgactaatactaaacagagaccaaagaggtccctgaagaaggcagatgtcgaggaagaattcctcgctttccgaaagcttaccccctcagctgggaaggccatgcacacacctaaagccgctgtgggggaagagaaagatatcaacacattcgtcggcacccccgtggagaagctcgatctcctgggcaaccttccaggtagtaaacgcagaccccagacccccaaggagaaggctaaagcccttgaggacctagctggcttcaaggagctgttccagacacccgggcacacagaggagagtatgaccgatgacaaaattaccgaagtttcctgcaagtctccacagcccgaccctgtcaagacacccaccagcagcaagcaaaggctaaagatttctctcggaaaggtgggtgtgaaggaagaagtgctccctgtcgggaagctgacgcagacctcaggtaagaccactcaaacccatagagagacagccggcgatggcaagtccattaaggcatttaaagagtcggccaaacagatgctggacccggccaactacggaactggaatggagagatggccccgtactcccaaagaagaagctcaatcactggaggatctggccggatttaaggagctatttcagacgcctgatcatacagaggaatcaacaactgacgacaaaacgactaagatcgcctgtaagtcccccccaccggagtctatggataccccgactagtacgcgcaggagacccaagacaccgctaggaaaacgggatattgtggaagagctatctgcgttgaaacagctgacgcaaaccacccacaccgacaaggtgccaggtgacgaagataaaggcatcaatgtattccgtgagacagcgaaacaaaaactggatcccgccgccagcgtgacaggtagcaaacgccagcctcgcacccccaagggcaaagctcagccactcgaggaccttgcaggcctgaaagagctttttcagacgcccatttgcaccgataagccaaccacccatgagaagacaaccaagatcgcttgtaggagccctcagccagatccagtcgggactcctaccatcttcaaaccacagtccaagcgatcccttagaaaagcagacgtcgaggaggagagtctcgccctcaggaaaagaacaccctccgtcggcaaggccatggatacccccaagcccgctggaggtgatgagaaagatatgaaagcttttatgggaactccagtgcagaaacttgatctccctggaaacctccccggcagcaagagatggccacagacccccaaagagaaggcccaggcactggaagacctggctggcttcaaggaattgttccagactcccgggacagataagcctaccactgatgagaagacaacaaagatagcctgtaagtcaccccagcccgacccagttgacaccccagctagcaccaagcagagacctaagaggaatttgaggaaggctgacgtggaagaagagttccttgcactcagaaaacgcactccctccgcaggtaaagccatggatacaccaaaaccggccgtcagcgacgagaagaacattaacaccttcgtggagaccccagttcagaagctggatctgctcggtaacctccccggctccaaacgccagccccagacgccaaaggagaaggcagaagctcttgaagacctcgtggggtttaaagagctgttccagacccccggtcatacagaggaatcaatgaccgacgataagattaccgaagtgagttgtaagtccccacagcctgaatcatttaagacttcaagatcttccaagcagcggctgaagattcccctagtgaaggtggacatgaaagaggaaccgttggctgtgtctaagctgaccaggacaagcggagaaacaactcagacccacacagagcccaccggcgatagtaaatcaatcaaagcattcaaggagtcaccaaagcagatcctcgaccccgctgccagcgtgacagggtccaggcggcagctacggacaagaaaagaaaaagcccgcgctctcgaggatcttgtagacttcaaggaactattttccgcccctggacatacagaggaatcgatgactatcgataagaacacgaagataccctgcaagagcccgccacctgaattaactgatactgctacaagtaccaagcgttgtcccaaaacccggcccaggaaggaagtgaaggaagaactgagcgccgttgagcgcctcacccagacttcagggcagagcactcatacacacaaagaacctgcaagcggagatgagggaatcaaagtgctcaaacagcgtgccaagaagaagccgaatcccgtggaggaggagcctagtaggcgacgaccaagagctcctaaagagaaagcgcaacctctggaagaccttgctggattcaccgagctgtcagagactagtggacacacccaggagtctctcaccgccggtaaggcaacaaagattccctgcgaaagcccaccactggaagttgtcgacaccactgccagcaccaaaagacaccttaggacccgggtacagaaggtccaagtgaaggaagagccgtccgcagtgaagttcacccagacaagcggtgagaccacggacgcagacaaagagcctgcgggggaggacaaagggatcaaggcgttaaaggagtccgctaaacagacccctgcccccgctgcttctgtgaccgggtccaggcgccgaccacgcgccccacgcgagtcagcacaggccatcgaagatctcgccggctttaaggatcccgccgccggacataccgaggaaagtatgaccgacgataaaacaactaagataccatgcaagagctcgccagagcttgaggacacagcgacatcgtcaaagcggcgacctagaaccagggcgcagaaggtggaggtaaaggaagaactgcttgcagttggaaagctcacacaaacttctggcgaaacgacccatacagacaaagagccagtgggcgagggcaagggcaccaaagcctttaaacagcccgcaaagaggaaactagacgcggaggacgtgatcggttctcggagacagcctagggccccgaaggagaaagcccagcctctggaggacctagcatccttccaagaactttcccaaacaccagggcacacggaagaattggctaacggtgccgctgatagctttacaagcgcaccgaaacagacaccagacagtggcaagccgctgaaaatttcgcgccgcgtgttacgggcacctaaggttgaaccggttggagacgtggtgtccactagggatcctgttaaatcccagagtaagtctaacaccagtcttccacccctgccatttaaaagagggggcgggaaggacggcagcgtgactggaaccaagcgcttgagatgcatgcctgcacccgaggagatcgttgaggagctcccagccagcaagaaacaacgggtggcgccaagagccagaggcaaatccagcgaacccgtcgtcattatgaagcgttctctgaggaccagcgcgaaacggattgaaccagctgaggaactaaacagcaatgatatgaaaaccaataaggaggaacacaaactgcaggattcagtgcccgaaaataagggaatcagcctgcgttccaggagacagaataagactgaagccgagcagcagattacagaagtcttcgttctcgccgagagaattgagatcaatcggaacgagaagaagccaatgaagaccagcccagagatggacatccaaaatcctgacgatggagcgagaaagccaataccgagagataaagtgacagaaaataagcggtgcctgcgtagcgccaggcagaacgagagtagccaaccgaaagttgctgaagaatcaggtggacagaaatccgctaaggtgctgatgcagaaccagaaaggtaaaggcgaagccggtaattctgattcaatgtgcctgcggtctagaaaaaccaaaagccagcccgcggccagcaccctcgaatcaaagagtgtccagcgggtcactaggtccgttaaacggtgtgccgagaatccaaaaaaggcggaagacaatgtctgtgtcaaaaagattagaacaaggagccatcgcgactctgaggatatttag

SEQ ID NO: 13842 - DNA, 9768 bp, Artificial Sequence
  Description of Artificial Sequence: Synthetic coding sequence
atgtggccaactaggagactggtcactatcaagcgatcaggggtcgatgggccccatttcccgctgtctctgtctacgtgtctcttcgggagaggcatcgagtgcgatatccgtatccaattgccagttgtaagcaagcagcactgcaaaatcgagattcatgagcaagaggccatactgcacaatttttcgagtacgaaccctactcaggttaatggatctgtcattgacgaacctgtgaggctgaaacacggagacgtgataaccatcattgatagatcttttaggtacgaaaacgagagtcttcagaatggcaggaaaagtaccgagtttccgcggaagattcgggagcaggagccggcccgccgggtcagtaggtccagtttttcatctgacccagatgaaaaagcgcaggactctaaagcctactcaaagattactgagggtaaggtgtcaggtaacccgcaagtgcacatcaagaatgttaaggaggattccaccgcagacgactcgaaagattcagtggcccaggggactaccaacgtacatagcagtgagcacgcaggacgaaatggtcggaacgccgccgatccgatttcaggcgattttaaggaaatttcttcagtcaagcttgtgtccaggtacggcgagttgaaatctgtccccacgacgcagtgtctagacaatagtaagaagaacgagtctccattttggaaactgtacgagtctgtgaagaaggaactggacgttaagtcccagaaggaaaatgtactgcagtattgccggaaatccggactccagactgactatgccaccgaaaaagagtccgccgacggtttacaaggggagacccaactgctcgtcagtagaaagtcaagaccaaagtccggaggcagcggccacgctgttgccgagcctgcctctccagaacaggaattggatcaaaataagggtaagggccgcgatgtggagtcagtccagacgccctctaaagcagtgggggctagcttccctctgtacgagcccgccaagatgaagactcctgttcagtatagccagcaacagaatagcccacaaaaacataaaaacaaggatctgtacacaacaggccggcgcgagtccgtgaacttgggaaagtcagaggggtttaaggctggcgataaaactctaaccccaaggaagctgtccacgcgaaatcgcactcctgctaaggttgaggatgccgcagactcggccacgaagccggaaaacctgtcctccaaaacacgcggtagtattcctacagatgtggaggtgcttcctacagaaaccgaaatacacaacgaaccattccttacactatggctcacacaggttgaacggaagatccagaaggactccctgtcaaagcccgagaaactgggaacaacagctggccagatgtgcagcggactgcctgggttgtcttccgtcgatattaacaactttggggacagcattaatgaaagtgagggtatcccactaaaacgccgtagggtttctttcggcggccatctacggcctgaactgtttgacgagaatcttccacccaataccccactcaagaggggggaagcgccgacaaaaaggaagagcctggttatgcacacaccgccagtactgaaaaaaattattaaggaacagccccaacccagcggcaagcaggagtcaggatccgaaatccacgtagaggtaaaagcccagtccctcgtcatcagcccacctgcgcccagcccccggaagacacctgttgccagcgatcaaaggcggagaagctgcaagactgccccagcttcgtcctctaagagtcaaaccgaagtccctaaacggggcggcgaaagggttgcaacatgtttgcagagggtctcaatttcgcggtctcagcatgacattcttcagatgatatgctcaaaaagaaggagcggagcatctgaagccaacctgatcgtcgctaaaagctgggctgacgttgtcaagctaggtgcaaagcaaactcagacgaaggtcataaagcatggcccacaacgcagtatgaataaacgacagcgaaggcccgccactccaaagaaaccggttggagaggtccactcacagttctctaccggacacgctaattcgccgtgtacaatcatcattggaaaggcccatacggagaaagttcacgttcccgccagaccctaccgggttctgaacaatttcatttcaaatcaaaaaatggactttaaggaggatctgagcggcatcgccgagatgtttaagacacctgtaaaggagcagccccagctcacttctacttgccacatagcgattagcaattctgaaaatttgcttggcaagcagttccagggaactgactctggcgaagagccccttctgcccacttctgaatcattcggggggaacgtgttcttcagtgctcagaacgccgccaagcagccaagtgacaaatgcagcgcatcacctcccctgagacggcagtgtatccgcgaaaatggcaacgtggccaagactcccagaaacacatacaagatgacctcactggagactaaaacaagcgataccgagacagagcctagcaagacagtcagcaccgctaatcgcagtgggcgttctaccgaatttagaaatatccagaaactccctgtggaatctaagtccgaagagaccaacacagaaatcgtcgagtgtatcctgaaacgtggccaaaaagccactctgctgcagcagcgacgcgagggagaaatgaaggagatcgaaagaccttttgagacttataaagagaacattgaactaaaagagaatgacgaaaagatgaaggctatgaagagatcaagaacttgggggcagaaatgcgccccaatgtccgacctcaccgatctaaagagccttccagataccgagctgatgaaggacacagcccgggggcagaatttgctgcagacccaggatcatgctaaggcacctaaaagcgagaaggggaaaattaccaaaatgccctgtcagtccctgcagcccgaacccatcaatactcccacacacaccaaacagcagttaaaggccagcctaggcaaggtcggcgtgaaagaggagctgcttgcagtcggcaagttcacgagaacttccggagaaaccactcacacccaccgtgaacccgccggtgacggaaaatctattcgcacttttaaggagagtccaaaacagattttagatcctgccgccagggtcactggtatgaaaaaatggccgcgtaccccgaaggaggaggcccagagcttggaagatctcgccgggttcaaggaactatttcagacaccggggccgagcgaggagtccatgactgacgaaaagacaactaaaatcgcttgcaaatctcctccccccgagtctgtcgatacacccacgtctacaaagcagtggcctaagcggtctctcagaaaggctgacgttgaggaagagttcctggctttacgcaagttgacaccttctgccggaaaggccatgctgactcctaagcccgccggcggagatgaaaaagatattaaagcattcatggggactcccgtccagaaactggaccttgccggaacactgcctggttcaaagcggcaacttcagactcctaaagaaaaggctcaggctctggaagatctggcaggatttaaggagctgtttcagactcctgggcatacggaggagctggtggcggctggaaaaactactaaaataccatgtgacagtccacagtccgatcccgtggacactcccacctctactaaacagcgccccaaaagaagcatacggaaggcagacgtggagggcgagctcttggcatgcaggaacctgatgccatctgccgggaaggctatgcatacacccaaaccctcggttggagaggaaaaggacatcattattttcgtaggtaccccggtgcagaagttagacctgaccgaaaatttgacagggtccaagcgaagacctcaaactcccaaggaggaggcgcaagctttggaggatctgaccgggtttaaagaattgttccagacgccgggtcatacggaggaggccgtggctgccggaaaaaccactaagatgccttgcgagtctagtccgcccgagtcagctgatacacccaccagtaccagaagacaaccaaaaacacctttggagaagagagatgtgcagaaggaattgagcgctctcaagaagctgacacaaactagtggagaaacaacacatactgacaaggtacccggtggggaagacaagtccattaatgcattccgcgagaccgcaaagcaaaaactggacccagcagcttcagtgacagggtctaaacgccaccccaagactaaggaaaaagcacagcccctggaggacctggccggcctgaaagagctgttccagacacctgtgtgcacggacaaaccaacaactcacgagaagaccacgaagatcgcatgtcgctcccaaccagatccagtcgacactccaacgtcttccaagcctcagtcaaagcggtctctgcgaaaggtcgatgtcgaggaggaatttttcgctctgcgcaagagaaccccatctgctggcaaggcaatgcatacacccaaaccagcagttagtggggagaaaaacatctacgcatttatgggtaccccagtccaaaaactggatttgacggagaacctgacaggttctaaacgacgactccaaacaccaaaagagaaagctcaggcgctcgaggacctggccggattcaaggaactattccaaactagaggccatactgaggagtccatgactaacgacaaaaccgcaaaagtggcttgtaagtcttcacagcctgacccagacaaaaatcctgccagtagcaaacgccggttgaagaccagtctaggtaaggtgggcgtgaaggaggaactgcttgcagtaggaaagctcacgcagacaagtggggagaccacacacactcatactgaacccacaggggacggtaagtctatgaaagcatttatggagagtcccaagcagattctggattccgcagcttccctgaccgggtccaagagacagctgaggacgcccaagggaaagagtgaagttcccgaggatctggctgggttcatcgaattgttccagacaccgtctcatacaaaggaatctatgacaaatgagaaaaccaccaaagtctcgtatcgcgccagtcagcctgacttagtcgatactccaacatcctctaaaccccagccaaagaggtcactcagaaaagctgataccgaggaagagttcctggcttttaggaagcagactcctagtgccggcaaagccatgcatacgcctaaacctgccgtgggcgaggagaaagacattaacactttcctcggcacaccggtgcagaaattggaccagccaggcaacttgcccggaagcaaccgacgcctccagactagaaaggagaaagcccaagccctggaagagttgaccggattccgggagttatttcagaccccttgcacagataaccccacgactgatgaaaagacaaccaaaaagatactgtgcaaatcaccccagagcgatccagccgacacccccactaacactaagcagcgcccaaagcggtctttgaagaaggctgacgtggaggaagaattcttggcatttcgcaagttgactccatccgctggcaaggcaatgcataccccaaaagccgccgtgggagaagaaaaggatatcaataccttcgttggaaccccagttgagaagctggacctgctcggaaatctgccaggctcaaaaaggaggccacagacacccaaggagaaagctaaagcccttgaagacctcgcaggtttcaaagaattgtttcagaccccaggtcacactgaagagagtatgaccgatgacaagattacagaagtgtcctgcaagtcgcctcagcccgaccctgtgaagacccccaccagttcgaagcagcgactgaaaatttctctagggaaagttggagtcaaagaggaagtgttgcccgtcggaaagctgactcagactagcggtaagaccacccagacacacagggagacagcaggagacggtaaatctatcaaggccttcaaggagtctgctaagcagatgctcgatcctgctaactatggtacgggaatggagcgctggccccgcactccaaaggaggaggctcaaagtctggaggatctcgcaggctttaaggagctcttccagacccccgatcacactgaagaatctaccacggacgacaagaccaccaagattgcctgtaaatcccctcctccagaatcaatggacactccaacctcaacacggcgccggccgaaaaccccactgggcaaacgggatatagtggaggagctctctgccctcaagcagttgacccagactacccacacggataaagtacctggagacgaggacaagggaataaacgtttttagggaaactgccaaacagaagctcgatccagccgccagtgttaccggatccaagcggcagccaaggacgcccaaagggaaagcccagccactcgaggacctcgcaggccttaaagagctcttccagaccccgatatgtaccgataaacctaccacccatgagaagaccacaaaaattgcgtgccggtcccctcagccagatccagtcggcacccctaccatatttaaaccccagagcaagagatctctccggaaagccgatgtggaggaagaatcactcgcacttcggaaaaggactcctagcgtcggaaaagcaatggacacccccaaacctgctggcggagatgaaaaggacatgaaggccttcatggggacacccgtgcaaaagctcgatttgcctggtaacctgcccgggtcaaagagatggccccagacccctaaagagaaggcccaggcgctggaagacctggcaggtttcaaagagctctttcaaactccgggaacagataagccaacgactgatgagaagacaacaaaaatcgcctgtaagtctccacagcctgacccagtggatacacctgcttccacaaaacaaaggccaaaacggaatcttcgcaaagcggatgttgaggaggaatttctcgctctgcggaagcggaccccttcagccggtaaggccatggacactcctaagcctgctgtatcagatgagaagaatatcaatacattcgtcgaaacaccagtccaaaaactggacctgttaggaaacctacctggatctaagcgtcaaccacagactccaaaagaaaaggctgaggccctagaagacctcgttggcttcaaggagttgttccagacccccggacacacagaggagagcatgaccgacgataagattacagaggtgtcatgcaagtctccccagcccgaatcctttaaaacatctcggtcatcaaagcagcggttaaagattcctctggtaaaggttgacatgaaggaagaacctctcgccgtgtcaaaactaacccggacctcaggcgaaactacgcaaactcataccgagccaaccggtgactcaaaaagcattaaggccttcaaagagtcccccaagcaaatactggacccagcagcctctgtcacagggtcgaggcggcagctaagaacacggaaagagaaggcccgggccttggaggacttggtggattttaaagaactgttctccgcaccaggtcacacagaggagtctatgacgatagacaagaacaccaaaatcccctgtaaaagtcccccgcctgaattgacggacaccgcaactagtactaaaaggtgcccgaagactcgacctagaaaagaggtaaaggaggagctgtctgccgtcgagcggctgacgcagaccagcggtcaatctactcacactcacaaagagcctgcctcaggcgacgaggggattaaggtgttgaagcaacgggcgaagaagaaaccaaatccggttgaagaagaaccatcccgccggcgacctagggccccgaaggagaaggcccagcccctggaagatctcgccggatttactgaactgagcgagacatccggccatacccaagaatccctaacggccggcaaagccactaaaattccatgtgagtctcctcctctagaagtggtggatacaaccgcgtccaccaaacgccacctgcgcacacgcgtgcagaaggtgcaagttaaggaagagcccagcgccgtgaagtttacgcagacatccggcgagactaccgacgcagacaaagagcctgctggagaggacaaaggaataaaggcactgaaggagtccgccaagcagactccggctccggcagcctcggtaacaggaagccgacgcagaccacgggcccccagggagagcgcccaagctatagaagacctagccggctttaaggatcctgctgccggccacaccgaggagagcatgaccgatgacaaaacgacaaagatcccttgcaagtcctcacctgaactcgaagacactgctaccagttctaaaagacgcccacgtacacgtgctcaaaaggtcgaggtgaaggaggaactgttggccgtggggaagctgacacagacctctggtgagactactcacacggacaaagaaccagtcggggaaggaaagggaaccaaagccttcaagcaaccagccaagcgtaaactggacgctgaagacgtgataggaagcaggcggcagcctcgagctcccaaggaaaaggctcaaccgctggaagatctggcctccttccaggagctatctcagacgcctggacacacagaggagctcgccaacggggctgccgactcatttacatccgcacctaaacagacacctgactccgggaagcctctgaagatctcacggagagtgctgagagccccaaaagtggagccagtcggggacgtggtgtcaactagagatcccgttaagagccagagcaagtctaacacaagcctacctcctttgcctttcaagcggggtggaggcaaagacggcagcgttacgggcactaagcgtttgcggtgtatgcccgcgccagaagaaattgtcgaagaactgcctgccagtaagaagcagcgcgtcgcacccagagcccggggtaagtctagtgaacctgttgtcatcatgaagaggtccctgagaacctctgccaagaggatcgaaccggcagaggagctgaactctaacgatatgaagactaataaggaagaacataagttgcaagattcagtgccagagaacaagggaattagcctacgtagtaggcgacagaacaagacggaggcagagcagcagatcaccgaggtttttgtgctcgctgagagaattgagataaatcgtaacgaaaagaagcccatgaagacaagtcccgaaatggatattcagaatcctgacgatggggcacgcaaacctatccctagggacaaggttactgagaacaaacgttgtcttcgctcagcacgccagaacgaatcctcgcagccaaaagtggcagaagagtccgggggacagaagtccgcgaaagtgctgatgcagaaccaaaaaggcaagggtgaagccggcaacagcgatagtatgtgtctccggagtaggaaaaccaagtcccagccagcggctagtactctggaaagcaaatccgttcagagagtcacccggagcgttaagcgttgtgccgagaatcctaagaaggctgaggacaatgtgtgtgtgaaaaagattaggaccagatcccatagggattcggaagatatctag

SEQ ID NO: 13843 - DNA, 141 bp, Artificial Sequence
  Description of Artificial Sequence: Synthetic coding sequence
atgtggcctaccagaagactggtgaccatcaagcggagcggagtagacggcccgcatttcccccttagtctcagcacatgtctctttggacgacggaaatgtgtgcttcagtgcaccgagtgctccaaaacggctatttag

SEQ ID NO: 13844 - DNA, 1557 bp, Artificial Sequence
  Description of Artificial Sequence: Synthetic coding sequence
atgttgcgggtggtgtcctggaatataaatggtatcaggagacctctgcaaggagtagcaaaccaggagcctagcaattgtgccgccgtggccgtagggcgcattctggatgagctggatgctgacatcgtgtgcctgcaggagaccaaggtgacacgggacgcccttactgagccgctcgctattgtggagggttacaattcgtatttcagcttttctaggaaccggtccggatactccggagtcgctacgttttgcaaggacaacgctacacccgtcgcagcagaggagggactgagtgggctgttcgctacccagaacggagatgtgggatgctacggaaatatggatgagttcacgcaggaagagttgagagccctggattctgagggccgcgctctcctgacacagcataaaattaggacctgggagggaaaagagaaaacgttaacgcttatcaatgtgtactgccctcacgccgatcccggccgtcccgagcgtctggtcttcaagatgagattttaccgcttgctccagatccgggctgaggctctgctggcagcagggtctcatgtgattatccttggagatttaaataccgcgcatcgacccattgatcactgggacgctgtgaatttggaatgttttgaagaggatccgggacggaagtggatggatagcctactcagcaatcttggttgccagtctgcctcacacgttggccccttcattgattcataccgatgttttcagcctaagcaggaaggggcctttacatgctggagtgcggttacaggcgctagacatctgaattacgggtctcgattggattatgtgctgggagaccgaacgctagtgatcgacacgtttcaagccagttttcttctgcctgaggtgatggggagcgaccactgtcccgtgggagcagtcctctcagtaagcagtgtgcccgcaaaacagtgcccaccactgtgtacaagatttcttcccgagtttgccggtacccagcttaagatactgaggtttctggtgcccctggaacaatctccagtcctggaacagagcaccttgcagcacaataaccagactcgggtacaaacctgccagaataaagcccaggtgcggtccacgaggcctcagccttcccaggtgggcagtagccgagggcaaaagaatcttaagagctacttccagcccagtccgtcctgcccacaggccagccccgacattgaactaccaagcttaccccttatgagtgccctgatgacacctaaaactcccgaagagaaggccgtggcaaaggtagttaagggccaagctaagacctcagaagcaaaggatgagaaggaacttaggacttccttctggaaatcagtgctggccggacctctcaggactcccctttgcggcggtcatagagagccctgcgtcatgaggaccgtgaagaagccaggcccaaacctagggcgaagattttacatgtgcgctaggccccgcggacccccaacagatccttcttcccgctgcaattttttcctttggagcaggccgagctag

SEQ ID NO: 13845 - DNA, 1191 bp, Artificial Sequence
  Description of Artificial Sequence: Synthetic coding sequence
atgcctagagtcaaggctgcccaagcaggccggcagagctcggctaagaggcacttggccgaacaattcgcagtgggcgagatcatcacagatatggctaaaaaggagtggaaggtaggtctcccaatagggcagggcggatttggctgcatttacctagcagacatgaactcaagtgagtcagtgggttcagatgctccttgtgtggtcaaagtggaaccctcagacaacggccctttgttcaccgaactcaagttctaccaacgagccgcaaagccagaacagattcagaaatggataagaactcgcaaactgaaatatttgggggtaccgaaatactggggaagtggattgcacgacaaaaacgggaaatcgtatcgctttatgatcatggaccggttcgggtctgacttgcaaaagatctatgaagcgaatgctaaaaggttttctaggaagacagtgctgcaactgtctctgaggatactggatatacttgaatacattcacgagcatgaatacgttcacggcgacatcaaggcaagcaaccttttgctgaattacaagaacccagatcaggtttacctggtggactatggtctggcatatcgctactgccccgagggcgttcacaaggagtacaaggaggaccccaagcgatgccatgatggcactatagaatttacttctatcgatgcccataacggcgtggctcccagccgtcggggcgatctagaaatcctgggatattgcatgattcagtggctaacagggcatctgccttgggaggacaacctgaaggaccccaagtacgtcagggacagcaaaatccgataccgagagaacatcgccagtctgatggacaagtgttttcccgagaagaacaaacccggtgagatcgccaagtacatggagaccgtgaagctgttggattataccgaaaagccactgtatgagaacctcagggatatcttgctccagggattaaaggctattggatccaaggatgacggaaagcttgacctctccgtggtggagaatggaggattaaaagccaaaaccatcactaagaagcggaagaaggaaatcgaagaatctaaagaacctggagtcgaagacacagaatggtctaacactcagaccgaggaggccattcagacccgctcacgaacgagaaaaagagtgcagaaatag

SEQ ID NO: 13846 - DNA, 957 bp, Artificial Sequence
  Description of Artificial Sequence: Synthetic coding sequence
atgccaaagcgcggaaaaaaaggtgctgtggccgaggatggagatgagcttcgaactgaacctgaagccaagaagtcaaagactgctgcgaagaagaacgacaaagaagccgcaggtgagggccccgccctttacgaagatccccccgaccagaaaacctctccatctggaaagcctgccacactgaaaatttgttcctggaatgtggacggcctccgcgcctggattaaaaagaagggactggattgggtgaaggaggaggctcccgatatcttgtgtttacaggaaactaaatgcagcgaaaacaagttgcctgcggagctccaggagctaccggggctcagccaccagtattggagcgcccccagcgacaaagaaggctatagtggggtcgggctcctgtcacggcagtgtcccttaaaagtgtcttacggcatcggcgacgaggagcatgatcaggaaggtcgggtaattgtcgcggagtttgatagcttcgtgctggtgactgcctacgtgcctaatgccgggaggggtctagttaggttagagtatagacagagatgggatgaagcgtttaggaaatttctgaaaggcctcgcctcacggaaacctttggtgctgtgtggggatctgaacgtggctcacgaagagatcgaccttcggaatcccaagggaaataaaaaaaacgcaggcttcactccacaagaacggcagggatttggagagctgctgcaggccgtaccgttggcagactccttccgacacctctatcccaataccccttatgcttacaccttttggacttatatgatgaacgcaaggtccaagaatgtgggttggcgcctggattactttcttctgtcccactccctgctgcccgctctttgcgacagcaagatccggagtaaggcactgggtagcgatcactgtcccattaccctatacctcgctctctag

SEQ ID NO: 13847 - DNA, 792 bp, Artificial Sequence
  Description of Artificial Sequence: Synthetic coding sequence
atgccaaaaaggggaaagaaaggagccgttgctgaggacggtgacgaactgcggactgagccggaggccaagaaatcgaagaccgccgctaaaaaaaacgacaaggaagctgctggggaggggccggctttgtatgaagacccccccgatcagaaaactagtcccagcgggaagcccgcaaccctgaagatttgctcatggaatgtggacggcctcagagcttggatcaaaaaaaagggcctagactgggtgaaagaggaggcacctgacatactgtgtctgcaggaaacaaagtgttcagagaacaagctcccggcagaattgcaggaacttccaggtctgagtcaccagtattggagcgctccttccgacaaagagggttactccggagtcggcctactgtccaggcagtgtccgctgaaggtttcctatggcataggcgatgaggagcacgaccaagaggggcgcgttatcgtggcagaatttgattcttttgtcctcgtgaccgcctatgtgcctaatgctggacggggcctcgtgaggcttgagtatcggcagcggtgggatgaggctttcagaaaatttctgaaggggttggcctccaggaagccactggtcctgtgcggagacctgaacgtagcacacgaggagatcgatctcagaaatcccaaaggcaacaagaagaatgcaggcttcaccccacaggagcggcagggctttggtgagttgctccaggccgtgccacttgcagacagctttcggcacctttatcctaacacgccatacgcctag

SEQ ID NO: 13848 - DNA, 957 bp, Artificial Sequence
  Description of Artificial Sequence: Synthetic coding sequence
atgccaaaacgcggtaagaagggggcagtcgccgaagacggagatgagcttcgcacagagcctgaagcgaaaaaaagcaaaaccgcagcgaagaagaacgataaggaggcagccggagaaggaccagcgttgtatgaggatcctccagatcagaaaaccagccctagcggcaaaccagcgacgctcaagatctgttcctggaatgtggacggtcttagggcctggataaaaaagaagggcttggattgggtcaaagaagaggctcctgacatcctgtgcctgcaagaaactaagtgctccgagaataaattacctgccgagttgcaagagctgcccgggctgtctcaccagtattggtcagcaccaagcgacaaggaaggatattccggtgtcggcctcctctcaagacaatgtcctctcaaggtcagttacggtattggcgacgaggagcacgaccaggagggtcgagtcattgtggccgaattcgattcctttgtacttgtgacagcatacgtcccaaatgctgggcgcggacttgtccgcctcgagtaccgccagcggtgggatgaggcttttaggaagtttttgaaggggcttgcctctcggaagccccttgtgctgtgcggggacctgaatgtggcacacgaagagatagatctgcgaaatcccaagggcaacaagaagaacgcgggttttacaccccaggagcggcagggctttggggagttgcttcaagctgtcccactggccgactcttttaggcacctgtatcctaacactccatacgcctataccttctggacatatatgatgaacgcaagatccaaaaacgtaggatggcggctggattatttcttattgtctcatagtctgctgccggcactgtgtgactcaaagatcagaagcaaggcacttggtagtgatcactgcccaattacactgtatctagccctgtag

SEQ ID NO: 13849 - DNA, 525 bp, Artificial Sequence
  Description of Artificial Sequence: Synthetic coding sequence
atgccaaaaaggggcaagaaaggtgccgtggcagaagacggagatgagctacgaaccgaaccagaagccaaaaagtctaagacggccgcgaaaaagaatgacaaagaggccgctggcgaaggacctgccttgtatgaggatcctcccgaccagaaaacctccccatctggcaaacccgcgaccctcaaaatctgttcttggaatgtggatggcttgcgagcttggattaagaagaaagggctggactgggtgaaagaagaagcccccgatattctttgtcttcaagaaaccaaatgctctgaaaacaagctcccagcggagttgcaggagttgcctgggcttagccaccagtactggtctgctccgagcgacaaggaaggctacagtggagtaggactgctgagccgtcagtgtccactgaaggtgtcatatggaatcggcgacgaagaacatgaccaagagggtcgagtcatagtagcggaattcgatagcttcgtgctcgtaaccgcttacgtcccaaattag

SEQ ID NO: 13850 - DNA, 327 bp, Artificial Sequence
  Description of Artificial Sequence: Synthetic coding sequence
atgcccaagagggggaagaaaggtgcagttgcagaagatggggatgagctgcggaccgaacccgaggccaagaagtcgaaaaccgcggcaaagaagaatgataaggaggccgcgggtgaaggtcccgcactgtacgaggatccaccagatcagaaaacaagcccatccggcaagcccgctacactcaagatctgcagctggaatgtggacggcctgagggcttggattaaaaaaaaaggtcttgactgggtcaaagaagaggcacccgatatactatgtctgcaggagaccaagtgttctgagaacaagttgcctgcggagttgtag

SEQ ID NO: 13851 - DNA, 441 bp, Artificial Sequence
  Description of Artificial Sequence: Synthetic coding sequence
atgcccaagagagggaagaagggcgcagtcgccgaagacggggatgagcttagaactgagcccgaggccaaaaaatcaaaaactgcagcaaaaaagaatgacaaggaagctgctggcgaagggcctgctctctatgaggaccctcccgatcagaaaacaagtcctagcggaaaaccggcaactttaaagatttgcagctggaatgttgacggacttcgtgcatggataaaaaaaaagggcctggactgggtcaaagaggaggcacccgacattctgtgccttcaagagacaaaatgctctgagaataagctcccagcagagctgcaggaactccctggcttgtcccatcagtactggagcgctccatctgataaggaagggtacagcggagtgggcctgctcagtcgccagtgtcccctgaaggtctcttacggcatttag

SEQ ID NO: 13852 - DNA, 975 bp, Artificial Sequence
  Description of Artificial Sequence: Synthetic coding sequence
atgtttcgctgtgggggacttgccgccggggccttgaaacagaagttggtgccactggtaaggaccgtgtgtgtgagatccccgcggcagcgcaatagactgcccggtaacctgtttcagaggtggcacgtgcccctggagttacagatgacccggcagatggccagttctggagcttccggaggaaaaatagataattccgtgctggtcctaatcgtcgggctgtcaaccgtgggcgcaggggcttacgcctacaagacgatgaaggaggatgaaaagaggtataatgaacgaatctctggcttaggacttactcctgaacagaaacaaaagaaagctgccctaagtgcctccgagggagaggaagtgcctcaggataaggcaccttcacacgtcccgtttctcctcataggcggaggaaccgctgcgttcgcggccgcccgctccatccgggcaagagatccgggcgctagggttcttatcgtgagcgaagacccggagttgccctacatgcggccaccactttccaaagagctttggttctcggacgaccccaacgtgactaaaactctgcgcttcaagcagtggaatggaaaagaaaggtctatctatttccagcccccttccttttatgtgtctgcccaggatctgccccacatcgagaacggtggcgtagccgtgttgacgggaaaaaaagtcgtccaactggatgttagggacaacatggtgaaactcaacgacgggtcccagattacctatgagaaatgtctaattgccacaggtggcaccccacgttctctctccgccattgaccgggccggggccgaagtgaagtcccgcacaacgttattccggaaaataggggacttccggtccctggaaaaaatttcccgcgaagttaagagtattaccatcattggcggaggattcctcgggagcgaactcgcttgtgcactcggaaggaaagatatctag

SEQ ID NO: 13853 - DNA, 1842 bp, Artificial Sequence
  Description of Artificial Sequence: Synthetic coding sequence
atgttcagatgtggtggcctagccgcaggcgccttaaagcaaaaacttgtgcctctcgtgcgcacagtgtgcgttcgctcaccccgtcagaggaacaggctccctggtaacctgttccagagatggcacgtgccacttgagttgcaaatgaccaggcagatggcgtcttcgggtgcctctggcgggaagatcgacaacagtgtgttggtgctgattgtggggctgagtacagtgggcgccggtgcctacgcctacaaaaccatgaaggaggatgaaaagagatacaacgaaagaatttcaggcctggggttaacacctgagcagaagcagaaaaaagcagccttgtccgcctccgagggggaagaggttcctcaagataaagcccctagccacgtgccatttctgttgattggaggaggtacagctgcctttgcggcagcacgctctattcgcgcgagggatcctggtgccagggtactgatcgtgtctgaggatccagaacttccatacatgcgaccgcctctcagcaaggagctctggttcagcgacgaccctaatgtcacgaaaacccttcggttcaaacaatggaatggaaaagagcgctcaatctattttcaacctccctccttctatgtgtccgctcaggatctgccacacatcgagaacggaggcgtggccgttctgacgggaaaaaaagtggtccagctggacgtccgagacaacatggtcaaactgaatgacggatctcagataacatatgagaaatgcttgatagctaccggcgggacacctcgttccctgtctgcaatcgatagagccggtgcggaggtgaaaagccgcaccactctgttccgcaagattggtgacttccgtagccttgaaaagatctcacgagaggttaagagcatcaccatcattggcggaggctttctcggctcggaacttgcttgcgctttgggccgcaaggcaagagctctggggacagaggtgatacagctctttccagagaaaggcaatatgggaaaaatacttccagagtacctgagcaactggaccatggaaaaggtaagaagagaaggggtgaaggtcatgcctaacgcgattgtgcagtctgtcggcgtgagctccggaaagcttctgatcaagctaaaagacggacgcaaggttgagaccgaccacattgttgccgcagtgggacttgagcctaatgtggagctggccaagaccgggggactggaaattgatagtgatttcggcggcttccgggtcaacgccgagcttcaggctcgaagtaatatctgggtcgccggggacgccgcatgcttctacgacattaagctgggaagaagacgcgtcgaacatcacgatcatgctgtcgtgtccggtagactggccggggagaacatgactggcgctgcaaagccctactggcaccaaagcatgttttggtcagatctggggcctgacgtaggttatgaagctatcgggcttgttgattcttctctacctaccgtaggagtcttcgccaaggctacagcacaggataaccccaaaagcgcgaccgagcaatctggaacgggaatacgcagcgagagcgaaacagaatcagaggcaagcgagattaccatccctcctagtacaccagctgtgccgcaagcccccgtgcaaggagaagattacggcaagggagtgatattctacctgcgcgacaaagtggtcgttggtatcgtgctatggaatatcttcaataggatgcccatcgcgcgtaagataattaaggatggggagcagcacgaggatctcaacgaagtggccaagttgttcaatatccacgaggattag

SEQ ID NO: 13854 - DNA, 1830 bp, Artificial Sequence
  Description of Artificial Sequence: Synthetic coding sequence
atgttcagatgcggcggcctggccgctggcgcgctaaagcagaagttagtaccattagtaaggactgtttgtgtcagatctccaaggcagcgtaacagattaccagtggtccagtctcatcacctgggatcacccagccggtcactggcatctactggagcgtccggcaaagacggctctaatctggtctactttctgatcgttggggccaccgttaccggcgccggggtgtactacgcatataagacaatgaaggaggacgagaaaaggtacaatgaaagaatatctggtttggggctgactcccgagcagaagcagaagaaagccgctttgagtgcctccgagggcgaagaggtcccccaggataaggccccctctcacgtgccgttcctgcttataggcgggggcacagcggcctttgccgccgctcgatctattagagctcgcgatccaggtgcccgggtcctgatcgttagcgaggacccggaattaccttacatgcgtcccccattgagcaaggaactgtggttcagcgatgaccctaacgtgactaagaccttgcgatttaagcagtggaacggcaaagagaggtctatatactttcagccaccctctttctacgtgagtgcccaggacctgccgcacatcgaaaacggaggagtcgcagtccttacaggcaaaaaggtggtgcaactggacgtccgcgataacatggttaaacttaacgatggcagtcagatcacatacgagaagtgccttatagctacgggggggacccctagaagcctctctgccatcgacagggccggagccgaagtgaagtctcgcacgaccctgttcagaaagatcggagattttcgctctctcgagaaaatatcccgtgaggttaaatcaataacaataatcggggggggatttttgggatctgagttggcctgtgccctgggccggaaagctcgggctctgggtacagaggtgatccaactgttccctgaaaagggcaacatgggaaagatcctgccagagtacctgagtaattggaccatggaaaaagtgcgaagagaaggcgtaaaggtcatgcccaacgcgatcgttcagagcgtaggagtttcctccgggaaactccttatcaagttaaaggacgggcggaaggtagagaccgaccacatcgtggctgccgtcgggctcgaacccaacgtggaactggccaagaccggaggtctggagatcgactctgactttggaggctttcgagttaacgctgagctccaggctaggagtaacatttgggtagccggtgatgcggcctgtttttacgacatcaaactggggcgtcggcgtgtcgagcatcacgaccacgccgtggtgtctggacgtctggcaggcgaaaatatgaccggagctgccaagccatattggcatcagagtatgttttggtctgacttgggaccagacgtcggttacgaggctattggcttggtggatagtagcctgcccactgtcggagtatttgctaaggccacagcccaggacaaccctaagtccgccacagaacagagcggcacaggtataaggtccgagagtgaaacggagagtgaagctagtgagataacgatccctccgagcacgccggccgttccccaagcccctgtgcagggggaggattatggaaagggcgtgatcttctacctgagggacaaggttgtggtgggtattgtgctgtggaacatcttcaaccgcatgccaatagcccgtaaaattatcaaggacggcgagcaacacgaagacttaaatgaggttgcaaagcttttcaatatccacgaggactag

SEQ ID NO: 13855 - DNA, 981 bp, Artificial Sequence
  Description of Artificial Sequence: Synthetic coding sequence
atgttcagatgtggtggccttgctgccggcgcactaaaacagaagcttgttcccctggtccggactgtatgcgtgagaagcccacgacagaggaacagacttcctgctagggccttagggaccgaagtgattcagctcttccccgagaaggggaacatggggaagatactcccagagtatctgtctaactggacaatggaaaaggtccggcgtgagggggtcaaggtcatgccaaacgcaatcgtgcagtccgtgggagtgtcttcaggaaaacttcttatcaagctgaaggacgggagaaaagtggagactgatcatatagtcgcagccgtaggacttgagcctaacgtggaattggcgaagactggcggactcgaaatcgacagtgattttgggggatttcgggtgaatgccgagttgcaggcccgcagtaatatatgggtggccggggacgccgcatgcttctacgatatcaagctcggcagaaggcgtgtggaacaccacgaccacgccgtggtctcaggaaggctggccggcgaaaacatgactggcgctgcaaagccctattggcatcaatcaatgttttggtcagatcttgggccagatgtcggatatgaggctattggcctggtggattcttctctgcctaccgtgggtgtgttcgccaaagctaccgcccaggacaatcctaagtctgctactgaacaatcaggcaccggcatccggtctgaaagcgaaacagagagcgaggcgtcggaaatcaccatcccacccagcactcctgcagtcccacaggctcccgtgcagggagaagactatggcaaaggagtcattttctacttacgggacaaggtggtcgtgggaatcgttctgtggaatatcttcaaccgaatgccgatcgctcgcaaaatcatcaaggatggggaacagcatgaggacctgaacgaagtcgcgaagcttttcaacatccacgaagattag

SEQ ID NO: 13856 - DNA, 786 bp, Artificial Sequence
  Description of Artificial Sequence: Synthetic coding sequence
atggaaaaagtgagaagggaaggcgtgaaggtgatgcctaatgcaatagttcagagcgttggagtctcttccggaaagcttcttataaaactgaaagatgggcggaaggtggagactgaccacatagttgcagccgtcggactggaaccgaacgtggagctcgccaaaacgggaggattagagatcgactcagactttggcgggtttcgcgtgaacgctgagttgcaagcacggtctaatatctgggtggcaggggacgccgcctgcttctacgacatcaagttaggccgtcggcgagtggagcaccacgaccatgcagtggtgagcggacgcctggctggcgagaacatgaccggggcagctaaaccatactggcaccagagtatgttctggagtgatttgggacccgatgttggctacgaggcgattgggctggttgacagcagtctacctaccgtgggcgtgttcgccaaggctaccgctcaggataatcctaagagtgcgactgagcaatccggaaccggcatccgatctgagagcgagaccgagagtgaggccagtgaaataacaattccaccatctactcccgctgtgccacaagccccggtccaaggagaagactacggcaaaggggttatcttctacctcagagacaaggtggtcgtcgggatcgttctgtggaacatcttcaaccgaatgcctattgctaggaagattatcaaggacggcgaacagcatgaagacctcaatgaggttgctaaactcttcaatatccatgaggattag

SEQ ID NO: 13857 - DNA, 825 bp, Artificial Sequence
  Description of Artificial Sequence: Synthetic coding sequence
atgggcaagatccttccagaatacttgtccaattggacaatggaaaaagtgcgacgcgagggggtcaaggtcatgcccaacgctatcgtgcaatcggtcggcgtttccagtgggaagttattgattaagttaaaggatgggcggaaagtagaaacagaccacattgtcgctgcagtggggctagagccaaatgtggagttggccaaaacaggggggctagaaatcgactccgattttggcggattcagagtcaatgccgaacttcaggcgcgatctaatatctgggtggctggggatgcagcctgcttttatgatattaaactgggaaggcgcagggtcgagcatcacgatcacgcagttgtgtcaggacgactggcgggcgaaaacatgacaggcgctgcaaaaccatattggcaccagagtatgttttggagcgacttaggacctgacgtcggatatgaagcaatcggcctcgtcgatagttccctgcctacggtgggcgtttttgccaaggcaaccgcccaagataacccaaagtctgccaccgagcaatcaggtaccggaatccgctcagagtcagaaacggagtctgaggcttccgagattaccattcccccatcaaccccagctgtcccgcaagcaccagtgcagggcgaggattatggaaagggagttatcttttaccttcgggataaggtggtggtcggcatcgtgctttggaacatctttaacaggatgcccattgctcgaaagatcataaaagatggggaacagcacgaggatttaaacgaggtggcaaagctgtttaacattcatgaagactag

SEQ ID NO: 13858 - DNA, 714 bp, Artificial Sequence
  Description of Artificial Sequence: Synthetic coding sequence
atgaaggaggatgaaaagcgatataatgaacgcattagcggcctcggactaacccccgaacaaaagcaaaagaaggctgcactgtccgcttcagagggagaggaagtgccccaggataaggctcctagccatgtgccgtttctcctcattggtgggggtactgcggctttcgccgcagcccgcagcataagggcccgggaccccggggctcgcgtcctgattgtgtcggaggaccccgagctgccatacatgagaccgcctttgtccaaagaactctggttctccgacgacccaaatgtcacaaagaccctcaggtttaaacagtggaatggaaaagaaaggtccatttactttcaacctccaagtttctatgtgtctgcacaggacctcccccatattgagaacgggggggtggcagtcctcacagggaagaaagtggtccagctggacgtacgggataatatggtcaagctgaatgatggcagccaaatcacttatgaaaaatgcctcatagccacaggagggactccacgctctctttccgcaatcgatcgtgcaggcgctgaggtgaaatcaagaaccacgttatttcgtaaaatcggggattttcgaagtttggagaaaattagcagagaggtgaagtccatcactatcattggcggagggtttctggggtccgaactcgcgtgtgctcttgggcgcaaggatatctag

SEQ ID NO: 13859 - DNA, 1017 bp, Artificial Sequence
  Description of Artificial Sequence: Synthetic coding sequence
atggatgccaaggctcgaaactgtttgttgcagcacagggaggcgctagaaaaagacataaagacatcctatataatggatcatatgatctctgacggttttctgaccatctctgaagaggaaaaagtaagaaatgagcctacccagcagcaacgggccgcaatgctgatcaaaatgatccttaaaaaagacaatgacagctatgtctccttctataacgcacttctgcatgaggggtataaggacttggccgcccttttacatgacggtataccagtggtctcctcatcatccggcaaggacagcgtgtccgggataaccagctatgtgcggacagtgctttgtgaagggggagtgccccagcggcctgtagtgttcgtgacaagaaagaaattagttaacgcaatccaacagaagctgagtaaactgaaaggggagcctggttgggtcactatccacggcatggctggttgtgggaagagtgtgctagccgccgaggccgtgcgggaccactcactcctggaaggctgttttcctggaggggtgcattgggtgtccgtggggaagcaagataagagcggactgctcatgaagctccagaatctctgcacacgattagaccaggatgaatcatttagtcaacgtctgcctttgaacattgaagaggcaaaagatcggctgcggatcctcatgctccggaagcatcctcggtccctgctgatcctggacgatgtgtgggatagttgggtcctgaaggcctttgacagtcaatgccagatactgctgacaacacgagacaaaagcgtaacagattccgtaatgggcccgaagtatgtcgtcccagttgaaagttcgctgggaaaggaaaaagggctggaaatcctgagcctcttcgtcaatatgaaaaaagcagatttacccgagcaggcacactccatcatcaaggaatgcaaagtcgtggaaaggtgtcattgggggatcttaaccgacttacttcacaaatggaatcaaagttag

SEQ ID NO: 13860 - DNA, 3492 bp, Artificial Sequence
  Description of Artificial Sequence: Synthetic coding sequence
atggatgccaaggcccggaactgcttgctgcagcaccgcgaagccctggagaaggatattaaaacctcatacataatggatcatatgatttccgatggttttttgacgatcagtgaggaagaaaaggtgcgcaacgagccgacccagcaacagcgcgccgccatgctgatcaagatgatcttgaagaaagacaatgattcatacgtgtccttctataacgctttgctacacgagggatacaaggacctggcagcactgctgcatgatggaatccctgtggtctcctcttcctccggaaaagacagcgtgagtggcatcacttcatatgtgagaactgttctctgcgaaggaggcgtcccgcagagacccgtggtgttcgtgaccaggaagaaattagtcaacgccattcagcaaaagctttcgaaactcaaaggcgaaccagggtgggtcaccatccatgggatggctggatgcggaaaaagcgtcctcgccgccgaagcagtacgagaccactccctgcttgagggctgtttccctggaggagtgcattgggtatcggtagggaagcaggataagtctggcttgctgatgaagttacagaatctgtgtactagactggaccaagacgagagcttctctcagcgactgcctctgaatatcgaggaagccaaagatcggcttcgcatcttaatgctacgcaagcatccaagaagccttctgatactcgatgacgtctgggattcatgggtgttgaaggcatttgactcccagtgccagattctcctcaccacgagagacaagagcgtgactgatagtgtgatggggcctaagtacgtcgtgccggtcgaaagttcccttggcaaagagaagggcctcgaaattcttagtctgttcgtcaacatgaaaaaagcagacctgcccgagcaggcccactcaatcatcaaagaatgcaaggggagcccccttgtggtgagcctgatcggtgccctgttgagggacttccccaacaggtgggaatactacctgaagcagttgcagaataaacagttcaagcgcatcaggaaaagctcatcgtacgactacgaggctctggacgaagcgatgtcaatcagcgttgaaatgcttcgggaggacatcaaggattactacactgatttgtctatactgcagaaagacgtaaaggtgcctacgaaggtgctttgtatactgtgggacatggaaaccgaggaagtcgaggatattctccaagaatttgtgaataagagccttttattttgtgatagaaacggcaaatcctttagatactacctacacgatctgcaagtggatttcctcacggaaaaaaactgcagccagcttcaagacctgcataaaaaaataatcacccagttccagagataccaccagccacacacgctgtcacccgaccaagaagactgcatgtactggtataattttttggcctatcatatggcatcagcaaagatgcacaaagaattgtgtgcactaatgtttagtttggactggattaaagcgaaaactgagctggtcggtccagcacatctgatacacgagttcgttgaatatcgtcatatcttggacgaaaaggactgcgctgttagcgagaattttcaggaatttctatccctaaatggtcatctgttgggccgtcagccctttccaaacattgtgcaacttggcttgtgtgagcctgaaaccagtgaggtctaccaacaggcaaaactgcaggcaaagcaagaggttgacaatgggatgctgtatctggaatggatcaacaagaaaaacatcacaaatctcagtaggctggtcgttcggccccacacggatgcagtctatcatgcatgcttctctgaagacggccagcggatagcaagttgtggcgctgacaaaacactgcaggtatttaaggcagaaacgggagaaaagctactagagattaaagctcacgaagatgaagtcctctgctgcgccttttcaacggacgatagatttatcgccacttgctcagtggataaaaaggtcaaaatctggaatagcatgaccggcgagctggtacacacatatgatgaacattcggagcaagttaactgttgccactttacgaattcctctcaccacctgttactggctactggtagctctgattgcttcctaaaactgtgggatctgaaccagaaggagtgccgtaacaccatgttcggtcataccaatagcgtaaatcattgtcgctttagcccggacgacaagcttctggcttcctgttccgcggatggtaccctaaagttgtgggacgccacttctgctaacgaacggaagtccattaacgtgaagcagtttttcctgaatttggaagacccccaggaagacatggaggttatcgtgaagtgctgctcttggtctgcagacggcgccagaataatggtggccgctaaaaataagatctttctttggaacacggactctaggtccaaagtcgcggattgccgggggcatcttagctgggtgcacggcgtcatgttctcacccgacggttcgagcttcttgaccagtagtgacgaccaaacaattcgcctttgggaaacaaaaaaggtgtgtaagaatagtgcagtcatgctgaagcaggaagtagatgtggtgtttcaggagaacgaagtcatggtgttggccgtagaccatatccggcgtttgcagctgataaatggccggacggggcagatcgattatttgactgaggctcaggtatcttgctgttgtctgtctccacaccttcaatatatcgcttttggcgacgagaatggcgctatcgagatcctcgagctggtaaataatagaatcttccagagtaggttccagcacaagaaaacagtttggcatattcagtttaccgctgacgaaaagactctcatttcctcttctgacgatgctgagatccaagtgtggaattggcaactggataaatgcatcttcctccgcggacatcaggagactgttaaagattttcggttacttaagaacagcagacttttgagttggtcatttgacgggactgtcaaggtttggaacatcattaccgggaacaaggagaaagacttcgtgtgtcaccagggcactgtactttcatgtgatatttcccacgatgccactaaattctcatcaacgagcgctgacaagaccgccaagatttggaatgtgtctaacggggagctcctgcacctttgcgctcctctttcagaagaaggggcggcaactcatggaggatgggtgaccgatctgtgcttctctcctgatggcaaaatgctaattagcgctggcggatacatcaagtggtggaatgtagtaactggtgaaagtagccaaactttctataccaatgggaccaacctaaagaaaatacacgtgtctcccgatttcaaaacatatgtaactgtggacaatctcgggatactttacattctgcagacgctcgagtag

SEQ ID NO: 13861 - DNA, 3618 bp, Artificial Sequence
  Description of Artificial Sequence: Synthetic coding sequence
atggacgccaaagcaagaaattgcttgttacagcatagagaggcgctggaaaaagatattaaaaccagttacattatggatcatatgattagtgacggctttctgacaattagcgaggaagaaaaggtccgcaatgagccaacacaacagcagcgggcagcaatgctcattaagatgatccttaagaaagataacgacagctatgtgtccttttacaatgccctgctgcacgaaggttataaagacctagcagctcttctacatgacggaatccccgtggtgtcatcaagttcgggaaaggatagtgtcagcggcatcacctcttacgttcggacagttctttgcgaagggggtgtccctcaaagacccgtggtcttcgtgacccggaagaaactggtaaatgcaatccagcaaaagttaagcaaactgaaaggtgagcccgggtgggtaacgatccatggcatggcaggatgtggaaagagtgtgctcgcagcagaggccgtgagggatcacagtctgcttgagggatgcttcccaggaggcgtgcattgggtgtcagtaggtaagcaggataaatctggcctgctgatgaaacttcaaaacctctgtacaagactggatcaggacgagtctttcagccagcggctaccactcaatattgaagaggctaaggatagactgcgcattctcatgctccgtaaacatccacggagtctccttatactggacgatgtgtgggactcatgggttctgaaggcctttgactcacagtgtcagatactcctgacgacgcgggacaaatctgttactgactcagtaatgggcccgaaatacgtggtacccgtggagagctcactagggaaagagaaaggtctggagatcctctcactatttgtgaatatgaaaaaggctgatctgcccgagcaggctcattctatcattaaagaatgtaaaggaagcccactggtggtctcacttataggcgctctcctccgagactttcccaaccggtgggaatactacctgaagcaactgcagaataagcagtttaagagaatcaggaagagttcttcgtacgattacgaagctctggacgaagcaatgtcgatctctgtcgagatgctccgtgaagacatcaaagactattatacagatcttagcattctccaaaaggacgtcaaagtccccacaaaggttctctgtattctgtgggatatggaaaccgaggaagtcgaggatattcttcaggaatttgtcaataagagtctgttgttctgtgatcggaacggtaagagctttcgatattatctacacgatttacaggtcgatttcctgaccgagaaaaactgctcacaattgcaggatttgcacaagaaaatcattacacagtttcagagatatcaccagccgcacacactgtcacctgaccaggaggattgcatgtactggtataacttcctcgcataccacatggccagcgcgaaaatgcacaaggaactgtgcgccctgatgttttcactagattggattaaggccaaaacagaactggtgggcccagcgcatctgatccatgaatttgtcgaataccggcatattcttgatgaaaaggattgtgctgtctctgaaaattttcaggagttcctgtccttgaacggccacttactcggcaggcagccttttccaaacatcgttcaactgggcttatgtgagcctgagacttccgaggtgtaccagcaggccaagttacaggccaagcaggaggttgacaatggaatgctgtacctggagtggattaataaaaaaaacattactaatctgagccggctcgtggtccgtccacatacggacgccgtttaccacgcctgttttagcgaggatgggcagagaatcgctagctgcggcgcggataagactctgcaagtctttaaggccgagaccggcgagaaactgcttgagatcaaagcccatgaggacgaggtgctttgttgtgctttcagcactgacgatagattcattgctacatgtagtgttgataaaaaggttaagatctggaattccatgaccggggagctggtgcacacgtacgacgagcatagcgagcaggtcaactgctgccactttactaattcaagtcatcacctgcttctcgctacaggcagctccgattgttttcttaagctgtgggatctgaatcagaaggaatgcagaaatacaatgttcggtcacacaaactcagtgaatcactgtcgattcagtccagacgataaactgctggcctcttgctccgccgacgggactctcaagttatgggatgccacttctgccaacgagagaaagtccataaacgtcaagcaatttttcctcaatctagaagatccacaggaggacatggaggtgatagtaaaatgctgctcatggtctgcagacggagctcgtatcatggtggcagcaaaaaacaagatatttttgtggaacaccgacagccggtccaaagtggccgattgtcgggggcatttatcatgggttcacggcgtgatgttttctcccgacgggtctagctttttgacaagctccgacgaccagaccattcgtctgtgggagacaaagaaagtttgcaaaaactctgctgtgatgctcaaacaggaagtagacgtcgtgtttcaagagaacgaagtcatggtactggccgtggatcacattcgccggctccaactcatcaacgggcgaacaggccaaatcgattacctgaccgaggctcaggtctcctgttgttgcctttcaccacacctccagtacatagcgtttggcgacgagaatggagccatagagatcctcgaattggtcaataacagaatctttcagtcacgctttcaacataagaagacagtgtggcacattcagttcactgctgacgaaaaaacactgatttccagttccgatgatgccgaaattcaggtctggaactggcagctagacaaatgtatttttctgcgggggcaccaggagacggttaaagacttccgcttattaaaaaattcgagactactaagctggtcattcgatgggaccgtaaaggtgtggaacattatcactggaaacaaggagaaagatttcgtctgccaccagggcactgtcttgtcttgtgacatcagccatgatgctaccaagttctccagcacatcggccgacaaaacagctaagatctggtcatttgacttactcctgcccttgcatgagctgcgaggccataatggatgcgtaaggtgcagcgccttttccgttgatagtactctgctggcaactggtgatgataacggagagattaggatttggaatgtcagtaacggcgaactgctgcacctatgtgctcctctgtctgaggaaggtgcagccacgcacggcggatgggtgacggacctgtgctttagtcctgacggtaaaatgctgatatcagcaggaggatatattaagtggtggaatgtcgtaaccggcgaaagctcacagactttctatacgaacgggaccaaccttaagaagatccacgtatccccagacttcaagacctatgtgacagtggacaatctggggatactgtacattctgcagactctggagtag

SEQ ID NO: 13862 - DNA, 3585 bp, Artificial Sequence
  Description of Artificial Sequence: Synthetic coding sequence
atggacgcaaaggcaagaaactgcctgctccagcaccgtgaggctctcgagaaagacattaagacttcatacatcatggaccacatgatctccgatggctttctgactatatccgaagaggaaaaggttcggaatgagcctacgcagcaacagcgagcggctatgttaattaagatgatcttgaagaaagataatgactcctacgtatctttctataacgcattgctgcacgagggatacaaagacttagccgcactcttgcatgacggaattccggttgtgtcttctagcagcgtacggaccgttttgtgcgaaggcggcgtcccgcagcgtcccgtggtgttcgtgaccagaaagaagttagttaacgctatccagcagaaattgagtaaactaaagggtgagcctggctgggtaactattcacggtatggctggatgcgggaagtcagttctggccgctgaggccgtgcgcgatcattcattgctggaaggatgtttcccaggaggcgtccattgggtgtcagtggggaagcaggataaatccggactactgatgaaactacaaaatctgtgcactagattagaccaggacgagtcattttctcagaggctgcctttaaacattgaagaggccaaggatagactccgaatcctgatgcttagaaagcacccccgctccctcttgatcttggacgatgtttgggattcctgggtgctgaaggctttcgattcacaatgccagatactcctaacgacccgcgacaaaagcgtcaccgatagtgtcatgggccccaagtacgtcgtccccgtcgaaagttctttggggaaagaaaaagggctggagatcttgtctctgttcgtaaacatgaagaaagctgatttgcccgaacaggcacacagcattattaaggagtgcaaagggtcacccctggtcgtctcccttatcggcgcccttctgagggatttcccaaaccgctgggagtactatctaaagcagctgcagaataagcagtttaagagaattcgcaaatcgtcctcctatgactacgaggcattggacgaggcaatgtccatctctgtggagatgctgcgcgaggacattaaggactattataccgatctttcaatcttgcaaaaggatgtgaaagtgccaactaaggttttgtgcatcctgtgggacatggagacggaagaagtagaagatatactgcaggagtttgtcaacaagagtttattgttttgcgatcggaatggcaagagctttaggtattatctgcacgacctgcaagttgatttcctaactgaaaaaaattgtagtcagcttcaggatttgcataagaagatcattacgcagttccagagataccatcagccacatacactcagcccagaccaggaggactgcatgtattggtataacttcctcgcttatcatatggcttctgcgaagatgcataaagagctttgtgctctgatgttctctctcgactggatcaaggccaaaaccgagttggttgggccggcacacttaatccatgaattcgtcgaataccgtcacatcctggacgagaaggactgtgctgtgtctgagaattttcaagaattcctctcactgaacgggcatctgctggggagacaaccatttccaaatatcgttcagctgggcctgtgcgagccggaaacttcagaagtctatcaacaggcgaagttacaagcaaaacaagaagtagataacgggatgctgtatctcgaatggataaacaagaagaatattacaaatctaagcaggctggtggtgaggccgcacacagacgcagtgtatcacgcatgtttctctgaggacgggcagagaatcgccagctgtggagctgacaaaaccctacaagtctttaaagctgagacaggagagaagctactggaaataaaagcccatgaagatgaagtgctgtgttgtgccttttcaaccgacgaccgctttatcgcgacgtgttccgtggacaagaaagtaaaaatatggaactccatgaccggagaattagtccatacctacgatgagcactccgaacaggtgaattgttgccacttcacaaactcctcacaccacttactgctggctaccggttcttccgactgtttcctgaaactgtgggacctgaaccagaaagaatgcagaaacactatgttcggccataccaatagtgtcaaccactgtcgatttagtcctgacgataagctcctcgccagttgtagcgccgatggcacattgaagctgtgggacgcgactagcgccaacgaacggaagagcataaatgttaagcagttctttctaaacctggaagatccccaagaggacatggaagtgatcgttaaatgttgcagctggtctgctgacggcgcccggattatggtggcagccaaaaataagatctttctatggaatacagatagtagatcaaaggttgcggattgcaggggacacctcagttgggtgcatggagtgatgttttcaccggacggttcatctttcctcacaagttctgacgaccagaccataaggctgtgggagacaaagaaagtatgcaaaaactctgcggttatgttaaagcaagaagttgatgtcgtctttcaggaaaatgaagtgatggtgctcgccgtcgaccacatacgaagactgcagctgatcaatggtaggaccggacagatcgactacctcacagaggcccaggtgtcatgttgctgtctgagcccacaccttcagtatatcgcctttggtgatgagaatggcgccatagagatcctcgagctggttaacaacaggatcttccaaagcagatttcaacataagaaaaccgtgtggcatatccaattcacagctgatgaaaagactctcatctccagctcagacgacgccgagatccaggtgtggaactggcaacttgacaaatgtattttcctacgcggtcaccaagagactgtgaaagactttcggctcctgaagaattcacggctcctatcctggtccttcgatggcaccgtgaaggtgtggaatatcattaccggtaacaaagagaaggactttgtgtgccatcagggcacagtgttatcctgcgacatttcccacgatgccaccaaattctctagtactagcgctgacaagaccgccaagatctggagcttcgatcttctccttcccctgcacgagctgagaggccataacggttgcgtccggtgcagcgctttttcagtggactccactttgctggccaccggagatgacaacggtgaaattaggatctggaacgtgagtaacggcgaacttcttcatctttgtgccccactgtcggaagaaggagcagctactcatgggggatgggtgaccgatctgtgttttagtccagacggcaagatgctcatatccgccggcggttacatcaagtggtggaatgtggttactggcgagagttctcagacattttacacaaatggcaccaatcttaaaaaaattcacgtctccccagacttcaaaacatatgtgaccgtcgacaatttgggcatcctgtatattttgcaaacccttgagtag

SEQ ID NO: 13863 - DNA, 3618 bp, Artificial Sequence
  Description of Artificial Sequence: Synthetic coding sequence
atggatgcaaaggccagaaattgccttcttcaacacagggaagctttagagaaggacattaaaactagctacattatggaccatatgatctctgatggattcctcacaatatcagaagaggagaaggtaagaaacgagccaactcagcagcagcgggctgctatgctcatcaagatgattctgaagaaagacaacgactcctacgtgtcgttttacaatgccctgctgcatgagggctacaaagacctggccgcccttctgcatgacggcatcccagttgtatctagcagctctgggaaagatagcgtttcagggattacatcctacgtgcggaccgtcctatgtgaaggcggggtacctcagagacccgtggtctttgtcacccgcaaaaaactggtgaatgccatacagcaaaaacttagtaagcttaaaggcgagccgggatgggtgacaatccacgggatggcaggttgtgggaagtctgtgctggccgccgaagccgtccgtgaccattcattgctggaaggatgttttcctgggggtgtacactgggtctctgttgggaagcaggacaagagtggcttactgatgaagcttcagaacctgtgcacccgactcgaccaggacgaaagcttcagccagaggctgccccttaatatcgaagaggccaaggacagattgcggattctcatgcttagaaaacacccaagatccctccttatcctggacgacgtgtgggatagttgggtgctgaaggcatttgactctcaatgccaaatcctactaaccacaagggacaaatcagttacagatagtgtcatggggccgaaatatgtggtgcctgttgaatccagcttaggaaaagagaaaggtcttgaaatcctgtctttgttcgtgaatatgaagaaagccgacctgcctgaacaggcacacagcattattaaggaatgcaaagggagcccgctggtagtaagtctcatcggcgcactcttgcgagacttccctaataggtgggaatactacctgaagcaattgcagaataaacagttcaagaggataagaaagtctagctcctacgattacgaggcactggacgaagcaatgtcaataagcgtggagatgcttcgcgaggatataaaagattactacacggacctgtctattttgcagaaggacgtcaaagtgccaacaaaggttctgtgcattctttgggacatggagacagaggaggtggaagatatactccaagagttcgtaaataagtccctccttttttgtgacagaaacgggaagtctttcagatattacctccacgacctgcaggtggacttcttaacggaaaagaattgttcgcagttgcaggatctgcataagaaaatcattactcagtttcaaagataccatcaacctcataccttaagccccgatcaggaagattgcatgtattggtacaacttccttgcctatcacatggcttctgctaagatgcacaaagaactatgtgctctaatgttttccctcgactggattaaggctaagacagaactggtggggcctgcgcacttaatccacgagtttgtcgagtatagacacatacttgatgagaaagattgcgctgtgagcgagaattttcaggaattcctctctttgaacgggcacctgctgggccgacaaccttttccgaacatcgttcagttaggactttgcgagccagagacttctgaggtttaccagcaggccaaactacaggctaaacaggaggttgacaatggcatgctttatctggaatggattaacaagaagaacatcaccaacctgtcacgccttgtggtcaggccacacacggatgcagtctaccacgcctgtttctccgaagacggccaaagaatcgcaagctgtggggccgataagactttgcaggtttttaaggctgaaacaggtgaaaagttgctagagattaaagcacacgaggatgaggtgttatgctgcgcgttctctaccgatgatcgatttattgcaacgtgctctgtcgacaagaaggtgaaaatttggaactcaatgaccggggagttagtccacacctatgatgagcactccgaacaggttaactgctgccacttcaccaatagctcccaccatttactcttggctactggatcttctgactgtttcctgaaactctgggatctgaatcagaaagagtgccgcaacactatgttcgggcacacaaactctgttaaccactgtcgattctctccagacgataaacttctggcttcctgctctgccgacgggactctgaagttatgggatgccacctcagcaaatgagcgtaagtcaataaatgtgaagcagttttttctcaacctggaagatcctcaggaagacatggaggtgatagttaaatgttgttcgtggtctgctgatggggccagaatcatggtagccgccaaaaacaagatattcctgtggaatacagattctaggagcaaggtggcagactgtagagggcatctctcttgggtgcacggggtgatgtttagccccgatggatccagcttcctgacgagcagtgatgaccaaacaatacgcctctgggagaccaagaaagtgtgtaagaactctgctgtaatgctcaagcaggaagtcgatgtcgtctttcaggaaaatgaggttatggtgttagccgtcgaccacattcgccgcttacagctcataaatggacggacaggccagatcgactacctgactgaggcccaagtttcgtgttgttgtttgagcccacacctacagtacattgccttcggagacgaaaacggcgctatagaaattctcgagctggtaaataaccgaatcttccagtccaggtttcagcacaaaaagactgtctggcatattcagtttaccgctgacgagaaaaccctcatatcatcctcagatgatgcagagattcaagtttggaactggcagctggacaagtgtatcttcctgcgcgggcaccaggagactgtgaaggattttaggctcctcaagaactccaggctgctctcttggtcatttgatgggacggtcaaggtgtggaacatcattacgggcaacaaggagaaggacttcgtgtgccatcagggcactgtgctttcatgcgatatcagccatgacgctactaagttcagctcaacaagcgccgacaaaacagccaaaatctggtcatttgatctgctcctgccgttgcatgagctaagaggccacaatggttgcgtaaggtgtagtgcattcagtgtagacagcacactacttgctacaggggatgataatggagagatccggatctggaatgtgtccaacggtgaactgctgcacttgtgcgcccctctgagcgaggagggagccgccacccacggcgggtgggtcaccgatctttgtttttccccggacggcaagatgctgataagcgcaggcggttacatcaaatggtggaacgtggtcactggggaaagctcccaaacgttctatacaaacggcacaaacctcaagaaaatacatgtgtcgcctgactttaagacctacgtgacggttgacaatttggggatactgtacattctgcagaccctggagtag

SEQ ID NO: 13864 - DNA, 3492 bp, Artificial Sequence
  Description of Artificial Sequence: Synthetic coding sequence
atggacgccaaggcccgcaattgcctcctgcagcatcgggaggccctggaaaaggacatcaagacatcatatataatggaccatatgatctctgacggctttttaaccatctcagaggaggaaaaagtgcgaaatgaacctacacaacagcagagagccgctatgcttatcaaaatgatattgaagaaggacaatgactcttacgtctctttttataacgcactgctccatgaaggttataaggacctggcagctctactccacgacggaatcccagtcgtgtcgtcttcatcaggtaaggattctgtgtctggtatcacttcgtatgtgcgcaccgtgttgtgcgaagggggggtcccgcagaggccagtggtgtttgtgacccgcaaaaagttggtgaatgccatccagcaaaagctgagcaagctgaaaggcgaacccggctgggtgaccattcacggtatggccgggtgcgggaagagcgttttagctgccgaggccgtaagggaccacagtcttctcgagggatgcttccccggaggagtacactgggtgtctgtgggcaagcaagacaagtccggccttctgatgaagctgcaaaatctgtgtacaaggttggatcaggacgaatccttcagccagcggctacctctgaatattgaggaagctaaggaccggctgagaatcctgatgcttcgaaagcatccccgctccctcttgatcctggacgatgtgtgggacagctgggttctgaaggccttcgactcccagtgccagatactgctgacgacccgtgataagtcagtgacggactccgtcatgggacctaagtatgtagtccccgtagaaagctcactgggaaaggaaaaaggtcttgaaattctgtctttgtttgtgaacatgaagaaagctgacttacctgagcaggcccacagtatcattaaagaatgcaaggggtcccctttggtcgtgtccctgatcggtgctcttctccgagactttcccaaccgctgggagtattacctgaagcagctgcagaacaagcaatttaaaaggatcaggaaaagcagtagctatgattatgaggcccttgatgaggccatgtccattagtgttgagatgctgcgcgaggatataaaggactactatacggatctctctatactccagaaggacgtaaaagtccccaccaaagtgttgtgcatcctgtgggacatggagacggaggaggtcgaggatattctccaggaatttgtcaataaaagtcttcttttttgtgatcggaatggcaagtccttcagatattacttgcacgacctccaggtggatttcctcacagagaaaaactgttcccagctgcaggacttacataagaaaataattactcaattccagcgataccatcaaccgcacacactctctcccgaccaggaagattgtatgtactggtacaattttttggcctaccatatggcttccgcgaagatgcacaaggagctgtgtgctcttatgtttagcctggattggatcaaagctaaaactgagctggtgggccctgctcacctcatccacgagtttgtcgagtacagacacattctggacgaaaaggactgcgccgttagcgagaacttccaggaatttctctctcttaatgggcatttactgggaagacagccattccccaatattgtgcaactcggactctgcgagcctgaaacttccgaagtgtatcaacaggccaaattacaggcgaagcaggaggtcgataacgggatgctgtacctggaatggataaacaagaagaatatcactaatctgagtcgactggtggtccgcccacacaccgatgctgtgtatcacgcttgcttttctgaggatggacagagaatagcttcctgcggtgcggacaaaaccctgcaggttttcaaagcagaaacaggagaaaaactgcttgagatcaaggcacatgaggacgaagtgctgtgttgtgcattttctactgatgatcgttttattgctacatgcagcgtagataagaaagtaaagatctggaacagcatgacgggagagctcgtacacacctatgacgaacactccgagcaagtcaattgttgtcactttacaaactcctctcatcatttgctgctggcaaccgggtcgagcgactgcttcctgaaactgtgggacctgaatcagaaagagtgtcgtaataccatgtttggacacaccaacagcgtaaaccattgtcgcttctcacccgacgacaagcttcttgcaagctgttccgccgatggtaccctaaagctgtgggatgctactagtgctaacgaaagaaagagtatcaatgtcaagcagttcttcctcaacctagaagatcctcaggaagacatggaagtaatcgtaaaatgctgcagctggtccgctgatggcgccaggattatggtagctgccaagaacaagattttcctgtggaatactgactccagaagcaaggtggctgactgtaggggacacctcagttgggttcatggcgtaatgttctctccagacggttcctcatttctgacatcttcagacgaccagacgatacggctatgggagacaaagaaggtatgcaaaaatagtgcagtaatgctgaagcaggaagtggatgtcgtgttccaggagaacgaggtcatggtcctggctgtcgaccacatccgtcggcttcaactgatcaacggacgaacaggacaaatcgactatctaactgaggcgcaggtttcctgctgttgcttatccccccatctgcagtatattgcctttggtgacgagaacggagctattgagatactcgaactcgtcaacaatcgtatcttccagtcccggtttcagcacaaaaagacagtgtggcacatccagttcacagcagacgaaaagactctgataagctctagcgatgatgctgagattcaagtgtggaactggcaactggataagtgcatttttctgagaggacatcaagaaacagtgaaggactttagacttctgaagaactccaggctgctgagctggtctttcgacggaaccgtcaaagtgtggaatatcattaccggcaataaggagaaagatttcgtgtgtcaccaggggactgtgctaagttgcgacatctcccacgatgcaaccaagttctcttcaacatcagccgacaagacagctaagatctggaatgtttccaacggtgaactgcttcacctttgtgcaccccttagcgaggaaggcgctgccacccacgggggatgggtgaccgacctgtgcttctcgccagatggtaagatgctgatctccgcagggggctacattaaatggtggaacgtcgtgaccggcgagagtagccagacattctacaccaacggaactaacctcaagaagatccatgtcagtcccgattttaagacgtatgtgacagtggacaatttgggtatcctgtacatcctgcagacgcttgagtag

SEQ ID NO: 13865 - DNA, 3714 bp, Artificial Sequence
  Description of Artificial Sequence: Synthetic coding sequence
atggacgcgaaagcccggaactgtttgctacagcatagggaagcgctggaaaaggacattaagacctcttacatcatggatcacatgatctccgacggcttcctgacgatttccgaggaggagaaggtgcgcaatgagccgacccagcagcagcgcgccgctatgctgatcaaaatgatcctcaaaaaggacaatgatagttacgtgagcttttacaacgccctgttgcacgaagggtataaggacctggccgctctcctccacgacgggatcccggtcgtgagttcctcgtcagttcgcacagtgttgtgcgaaggcggcgttccgcagaggcctgtagtctttgttacacggaaaaagttggtgaacgccatccagcagaagctgtccaagctcaaaggagagcccggttgggtcactatccacggaatggcagggtgcggcaagagcgttctggccgctgaggctgtgcgagaccacagtctgctggagggctgcttccccggcggtgtacactgggtatccgtggggaagcaggacaagtccggcctgctgatgaaactgcagaacttatgtacccggttagaccaagacgaaagtttctctcagcggttaccgctgaacatcgaggaggcgaaagacaggctaaggatactcatgttacgcaagcacccacgaagcctcctgatcttggacgatgtttgggattcatgggttcttaaagcattcgatagccagtgccagattctgcttactacccgcgataagtctgtcacagacagtgtgatgggtcctaagtatgtcgtccctgtggagtcctctctgggcaaggagaagggcctcgagattctctccttgtttgtcaatatgaaaaaagcggatctgccggagcaggcgcattcaatcattaaggagtgtaaaggcagtccgctggtggtgagtctgattggcgcactactgcgtgactttcccaatcgctgggagtactacctgaagcagctccagaataaacaattcaaaaggatccgcaagtctagctcttacgactacgaggctctggacgaggccatgagcatctcagtagagatgctgcgggaggacatcaaagattattacaccgatctgtctatactgcagaaagatgttaaggtgcccacaaaggtcctctgcatactgtgggatatggagaccgaggaggtagaggatatccttcaagagttcgtgaataaaagcctgctcttttgcgataggaatgggaaatcatttcgctactacctccacgatttacaggtggacttcctgaccgagaaaaactgcagccagctgcaagaccttcacaagaaaatcatcacgcagttccagagataccaccaaccacataccctgagtccagaccaggaagactgcatgtactggtataatttcctcgcataccacatggcgtctgctaaaatgcacaaagaattgtgtgctctgatgttctctctggattggatcaaggctaagactgaattggtcggccccgcacaccttatccatgaattcgttgaatacagacatatcctggacgaaaaagactgcgctgtcagtgagaatttccaggaatttctgtccctgaatggacatctgctgggcagacagccctttccgaatatcgttcaattaggcctttgcgagcccgaaacaagcgaggtctaccagcaggcaaagttgcaggccaagcaggaggtcgataatggaatgctgtacctagagtggattaacaagaaaaacatcaccaatctctcaagactggtcgtcagaccccacaccgatgccgtctaccatgcctgcttcagtgaggatggtcagcgaattgcatcctgcggggcggataagacgctccaagtgttcaaagctgaaaccggagagaaattgctcgagatcaaggcccatgaagacgaagtcctctgctgcgcattctccacggacgaccgcttcatcgccacttgcagcgtcgacaaaaaagtcaaaatctggaacagtatgactggagaactggtgcatacttatgacgagcactctgagcaagtcaactgctgtcactttaccaattcctcacaccacctgttgctggctacaggcagtagtgattgcttcctgaaactctgggacctcaatcaaaaagaatgtaggaatacaatgtttggccacacaaattcagtgaaccattgccgctttagccctgacgataaacttctcgccagctgcagcgccgacggaacccttaagctctgggacgcaaccagcgcaaatgagagaaagagtatcaacgtgaagcagttttttttgaacctcgaggatccacaggaggatatggaagtgatcgtcaagtgctgtagctggtcagcagatggagcccgtataatggtggcagccaagaacaagatattcctctttgatattcacacgagtggcctgctgggagaaatccacacaggacatcacagtactattcaatattgtgatttcagtccacagaaccatctggcggtcgtggcactctctcagtattgtgtggagttatggaatactgactccaggagtaaggtggctgattgtcgcggtcacctatcttgggttcatggcgtgatgtttagccccgacggcagttcctttctcacttcgagcgacgatcagaccatccggctctgggagactaagaaagtctgcaaaaacagtgcagtgatgctgaaacaggaagtcgatgtggtgtttcaggaaaacgaagttatggtgctggcagtggaccatatccgcagattgcagctgatcaatggcagaaccggccagatagactacttgacagaggcccaggtgtcgtgttgttgtctctcgcctcatctccagtacatcgcctttggcgacgaaaatggcgctatagaaattttggagctggttaataaccggattttccagagtcgcttccaacacaagaaaactgtttggcacattcaatttacagctgacgaaaagacacttatttccagctccgacgatgctgaaattcaagtttggaattggcagctggacaaatgcatctttcttcgcggccatcaagagacagtgaaggacttccgcctgctgaagaacagcagactcttatcttggagtttcgacggaacggttaaagtgtggaatatcataaccggcaataaggagaaagacttcgtttgtcaccagggaacagtgctgtcatgtgacatctctcatgacgcgacgaagtttagctccaccagcgccgacaagacagccaaaatttggtccttcgacctcctgctaccacttcatgagctgaggggacacaacggctgtgtcagatgtagcgccttcagcgtggattcgacgctcctcgccactggggacgataatggcgaaattaggatatggaacgttagtaacggagagttactgcacttgtgtgctccgttgtcagaagagggtgcagccacccacggaggttgggtgacagacctgtgtttcagccctgatggcaaaatgttgattagtgccggcggatatataaagtggtggaacgtcgtcacaggggagtcttcacagaccttctacactaacggcaccaatttaaaaaaaattcacgtctcacctgacttcaaaacttacgttactgtcgacaatctgggaatcctatacattctgcagacgctggagtag

SEQ ID NO: 13866 - DNA, 3747 bp, Artificial Sequence
  Description of Artificial Sequence: Synthetic coding sequence
atggacgcaaaggcccgcaactgcctgctccaacatagagaagcattggagaaagatatcaaaacaagttacatcatggaccacatgattagcgacggtttcctgaccatcagcgaagaagagaaagtccgaaacgagccaactcaacagcaacgggccgctatgctcattaagatgatactgaaaaaagacaacgactcttacgtgagtttttataacgcgctccttcatgaaggatacaaggacctggccgcgctgttacatgatggcatccccgtcgtgtcttcctcgtcgggtaaggattcagttagcggcatcacatcctacgtcagaaccgtactgtgcgagggcggcgtgccgcagcgtcccgttgtatttgtgacccgcaagaagctagtgaacgctatccagcagaagctctccaagctgaaaggcgaacctggctgggttacaatccatggcatggcgggctgcggtaagtcagtgctggccgccgaggccgtccgtgatcattccttgttggaggggtgttttcccggcggggttcattgggtgtcagtgggcaagcaagacaagtccgggctgttaatgaaactgcagaatctctgcacccgtctggatcaggacgagagcttcagccagagactacctctgaatatcgaagaggccaaggaccggctgaggatcttgatgctgagaaaacacccccggtccctcctgatcctcgatgacgtgtgggacagctgggtcttaaaagcctttgattcccaatgccaaattctgctcaccactagagacaaatcggtcaccgactcagtgatggggcctaagtatgttgttcccgtcgagtccagtcttggtaaagaaaaaggcctggagattctgagcctctttgtgaatatgaaaaaagctgatctccccgaacaggctcactcgataatcaaggaatgcaaaggctcaccactggtggtgtccctgattggcgcacttctccgggactttcccaaccggtgggagtattatttaaagcaacttcagaataagcaatttaaacggatacgcaagtcatcctcctacgattatgaagcattagacgaggctatgagcatctctgtggaaatgctgagggaggacatcaaagattactacactgatctctccattctacagaaggacgtaaaggtaccaactaaagtgttatgcattctatgggatatggagacggaagaggtagaagacatcttacaagagttcgtcaacaaaagcttgctattctgtgataggaacggaaaatcttttcggtattatttacatgatctgcaagtggactttctgactgagaagaattgctcccaactgcaggacctccataagaaaatcatcactcagttccagcgctatcaccagccacacacgctgtctccagaccaggaagactgtatgtattggtacaacttcctggcctatcacatggccagcgcaaagatgcacaaagaattgtgcgccctgatgtttagccttgactggatcaaggctaagactgaattggtcggtccagcccacctgatacatgagttcgtcgaatacagacatatactggatgagaaggactgcgctgtttccgagaatttccaggagtttcttagcctaaatgggcacttgcttgggagacagccattccctaatatcgttcagttaggactgtgcgagcctgaaacatccgaagtgtaccagcaggccaagctgcaggcaaagcaggaagtggataatggaatgctctacctggaatggattaataaaaagaatatcaccaatctctcgagactcgtagttcgccctcacacagacgcagtttaccacgcttgcttctccgaggacggccaacggatcgcttcatgcggggcagataaaacattacaggtttttaaggctgagaccggagaaaaattactggagattaaagctcatgaagacgaggtattatgttgtgcatttagcactgacgatcggttcatcgccacctgttctgtggataagaaagttaagatctggaattccatgactggcgagctggttcacacctacgacgagcattctgagcaggtcaactgttgtcatttcaccaattcttcccatcatctcctcctggctacaggctcttctgactgtttcttaaaactgtgggatctgaaccagaaggaatgcagaaatacaatgtttggacataccaatagcgtgaaccattgcagattcagtcctgatgacaagctgctggccagttgttcagctgatggaaccttaaaactttgggacgcaacctccgcgaatgagaggaaatctattaacgttaagcagtttttcctgaacctagaagacccccaggaagacatggaagtcatcgtgaaatgctgcagctggtccgctgacggagctcggataatggtggcagctaaaaataagatcttcttattcgatattcatacatctggtctgctgggagaaatccacacgggtcaccacagcacaattcaatactgcgacttctcaccccagaaccatctggccgttgtcgctttaagccagtactgtgtggaactgtggaatactgactcaaggtctaaagtagcagactgtcgtggccacctgtcttgggtacacggtgtgatgttttcacccgacggctcttcgtttcttacctccagtgacgatcagacaatccgcctgtgggaaacgaaaaaggtgtgcaagaattccgctgtgatgttgaaacaggaggtggacgtcgtgttccaggaaaatgaggtgatggtactcgccgtcgatcatattcgtaggctgcaacttataaacggacgaacaggccagatcgactacttaacagaggcccaggtctcttgctgctgcctgagtcctcatttgcaatatattgccttcggtgatgaaaacggggccatcgaaattcttgaactggtgaacaaccgtatctttcagagtagatttcaacataagaaaaccgtctggcacatacagttcacggccgatgaaaaaaccctgatcagctcatcagacgatgctgagatccaagtgtggaattggcagctggacaagtgtatatttctccgtggccaccaggagaccgtcaaggattttcgcctgcttaaaaattcgagactgctgtcttggtcattcgatggcaccgtaaaggtgtggaacataatcacaggtaataaagagaaagacttcgtttgccatcagggaactgtgctgtcatgcgacatctcgcatgacgcaacaaagtttagcagtacctcggccgataagaccgcaaagatctggagctttgatctcttgcttcctctccatgagttgaggggacacaacgggtgcgttcggtgcagcgctttcagcgtggatagtaccctcctggccacaggggatgacaacggcgaaatacgcatctggaacgtgtctaacggtgagctgcttcacttgtgcgcccctctttccgaagaaggcgccgctacccatgggggctgggtaacggatctttgtttttccccagatggcaaaatgctgatcagcgctggaggatacatcaagtggtggaacgtggtgactggagaatcaagtcaaacattctacaccaatgggacaaatcttaaaaagatccacgtaagcccagacttcaaaacctacgtgaccgtggacaatctcggcatactgtacatccttcagactctggagtag

SEQ ID NO: 13867 - DNA, 1017 bp, Artificial Sequence
  Description of Artificial Sequence: Synthetic coding sequence
atggacgcaaaggcgcgcaactgcctgcttcagcacagggaggcgttagagaaagacatcaaaacctcttacattatggatcatatgatctccgatggtttcctcacgattagcgaagaagaaaaagtgcggaacgagccgacacaacaacagcgcgcggccatgttgatcaaaatgatcctgaaaaaagacaacgactcttacgtgagtttctataatgctcttctgcatgagggctataaagacctcgcggccctgttgcacgatgggatccctgtcgtgtcctcctcttccgggaaggatagcgtgagcggaatcacctcttacgtgagaacggtcctgtgcgagggcggggtgccgcaaagaccagtcgtgtttgtaactaggaagaagctagtgaacgccatccagcaaaaactgtcgaagctcaagggtgaaccagggtgggtaacaatccacggaatggctggttgtggcaaatcggtgttggcagccgaagcggtcagagaccattccctcctggaaggttgttttcctggtggggtgcattgggtttcagtgggtaaacaggacaagagtgggctcctgatgaagctgcagaatctgtgcacccggcttgaccaggacgaaagttttagtcagaggctgcccctgaatatcgaagaggccaaagatcgactgcggatactgatgcttcgcaagcacccgcggtcattgcttatcttggatgatgtgtgggattcttgggttctcaaggcttttgacagtcaatgccagatcctgctgaccacacgcgacaagtctgtgacagacagtgttatgggcccaaaatatgttgtccctgtcgagagctccctgggtaaggagaaagggttagaaatcctgtctctatttgtgaacatgaagaaggccgatttgcccgaacaggcacacagtattataaaggaatgtaaagtagtggaacgatgccactggggcatcctgacagacttgctccataagtggaaccaatcttag

SEQ ID NO: 13868 - DNA, 2025 bp, Artificial Sequence
  Description of Artificial Sequence: Synthetic coding sequence
atgccctcatacaccgtgactgtcgctactggatcacagtggtttgctggtacggacgactatatctatctgtctttggttggctctgcaggctgttccgagaagcacttacttgacaagcccttttacaacgatttcgaaagaggtgccgtggatagctatgatgtgacagttgacgaagaattgggcgaaattcagctcgttcggattgagaagcgcaaatattggctgaacgacgattggtaccttaagtacatcacactaaagaccccccacggcgattatattgagttcccatgctatagatggattaccggagatgtggaagtggtgctgagggacggcagagccaagttggcaagggatgaccagatccacatcttgaagcagcaccggcgcaaagaactcgaaacaaggcagaaacagtaccgctggatggaatggaatcctggtttccccttgtcaattgatgcgaagtgtcataaggacctgccacgggacatacagtttgattccgagaaaggcgttgacttcgttctgaactactcaaaggccatggaaaacctgttcattaaccgatttatgcatatgtttcagtcgtcctggaatgattttgcagattttgaaaagatattcgtaaaaatctcaaataccattagtgagagagtgatgaatcactggcaagaggatctcatgttcggctatcagtttctgaacggctgtaatcccgtgcttatcaggcgatgcaccgaactgcctgaaaaactccctgtgacaacagaaatggttgaatgttccttggaacgacagctctcccttgagcaggaggtgcaacagggcaacatttttatcgtggacttcgaactattagacggtatcgacgcgaacaagactgacccatgtaccctccagttcctggccgctcccatatgtcttctgtacaagaacctggccaacaaaatcgtgcctattgccatccaactaaatcagattcccggcgatgagaaccccatcttccttcctagcgatgctaagtacgattggcttctggcaaaaatatgggttagaagctccgactttcacgtgcaccagactattacccacctgttgagaacccatctggtgtcagaggtcttcgggatcgcaatgtataggcagctgcctgccgtgcaccctatttttaaactgctggtggcccacgttcgcttcactattgccatcaataccaaagcacgtgaacagttgatttgcgagtgcggactctttgataaagcaaatgctaccggtggcgggggacatgtgcagatggtacagcgcgccatgaaggaccttacgtacgcatcactctgtttcccagaggcaataaaagcacgggggatggaaagtaaggaggacataccctactacttttatcgagacgatggtctactggtgtgggaagccatacgcacatttacagccgaggttgttgacatctattacgagggagatcaagtcgttgaagaggatccagagctccaggattttgtcaatgacgtttacgtctatgggatgaggggccggaaatcctctggttttccgaagtccgtgaagtcacgggaacagctcagcgaatacttgaccgtggtgatatttacggcctcagcccagcacgccgctgtgaactttggccagtacgactggtgctcctggatccccaatgcaccccccaccatgcgagccccaccacctaccgctaaaggtgttgtgacaattgagcaaattgtcgacacgctccccgacagaggccggtcctgttggcatctcggtgcagtatgggcgctcagccaattccaggagaatgagctgtttcttggcatgtaccccgaggagcactttatcgagaagccagtgaaagaagcgatggctcgattcaggaagaacttggaagctattgtgtcggttatcgcagagcgaaacaaaaagaaacagttgccctactactatttatcacccgacaggatcccgaacagtgttgcgatctag

SEQ ID NO: 13869 - DNA, 1854 bp, Artificial Sequence
  Description of Artificial Sequence: Synthetic coding sequence
atgcccagttataccgtgaccgtcgcaacagggtctcagtggttcgcggggaccgacgactatatatatctttcacttgttgggtccgctgggtgtagcgagaagcatcttctcgacaagcctttttacaacgatttcgaaaggggagccgttgactcttatgacgttacagtggacgaagaactcggggaaattcaattggtccgcattgagaagcgtaagtactggttaaacgatgattggtatctcaaatacatcaccttaaagaccccacatggagactacatcgaattcccctgctatagatggatcacgggggatgtggaggtcgtcctgcgagacggtcgggctaaacttgccagggatgaccagattcacattctcaagcaacacaggagaaaggaactggagactcgccagaagcagtaccggtggatggagtggaatcccggcttccctcttagtatcgatgcaaaatgccataaggacttaccacgggatattcagttcgactccgaaaaaggcgtagactttgtacttaactattccaaggcaatggagaatctatttatcaatcgattcatgcacatgttccagtcttcctggaatgatttcgcagactttgagaagatctttgtgaaaatctcaaatactatctctgaacgcgtcatgaaccattggcaagaggatcttatgtttgggtaccagttccttaacggctgcaaccctgtcctgatcagacgatgtaccgagctgcctgaaaagttacccgtgacaaccgagatggtcgagtgttcccttgaaaggcagttgagcctcgaacaggaggttcaacagggcaatatctttatcgtggatttcgaactgcttgacggcatcgacgccaacaagacggatccatgcacattgcagtttctggcggctccaatttgcctgctgtataaaaatcttgcaaataagattgtcccgattgccatccaactgaaccagattcccggagatgagaaccctatttttcttccttcagacgctaaatatgattggctcctcgcaaagatatgggtgcggtcctcggattttcatgtgcaccagaccataacacatctgttgcggacccatttggtcagtgaggtgtttggcattgccatgtatcgccagcttcccgctgtgcatcctatcttcaaattacttgttgctcacgtgagattcaccatcgctatcaatactaaggctcgcgaacagttaatctgtgagtgtggtttatttgacaaggccaacgccactggcggcggaggccacgtgcaaatggtccaaagagccatgaaggatctgacttacgccagcctgtgttttcctgaggccatcaaagcccggggaatggagtctaaggaagatataccctactatttctatcgggatgatggtctacttgtgtgggaggccatcagaaccttcaccgcggaagtggtggatatctactacgagggagaccaggtggtggaggaagacccagagctgcaggattttgtgaatgacgtgtatgtttacggcatgcgtggacgcaaaagcagcggtttccctaagagcgtgaagtcccgggagcaattatcagaatatctcacagtggtgattttcactgcctccgcccagcacgccgcggtgaacttcgggcagttgttcctggggatgtacccagaggagcattttattgaaaaacctgtcaaggaggcaatggcacggttcagaaagaacctcgaggcaattgtgtcagtgatcgccgagagaaataaaaaaaagcagctaccttattattacctctctccagatcggattccaaactccgtggcaatttag

SEQ ID NO: 13870 - DNA, 2511 bp, Artificial Sequence
  Description of Artificial Sequence: Synthetic coding sequence
atgcacgcccagcggcagttcgtggtcgccgccgtgcgcgcagaagtacggagacacgaggtggccaagcaagcacttaaccgtctcagaaaactcgctgagcgcgtagacgacccagaattgcaagacagcatccaagcatcactggattctatacgggaagctgttatcaattctcaggagtggaccctctcccgttccatacctgaactacgcttgggcgtcctgggggacgcgcgcagcggcaagagcagcctcattcacagattcctgaccggatcgtaccaagtactggaaaagaccgagagtgagcagtataagaaggagatgctcgtggacggccagacacacctcgttctgattcgggaggaggccggtgcccccgatgccaagttctctggctgggcagacgctgtcatttttgttttcagtctggaggatgagaactccttccaagccgttagtcgcctgcacgggcagctgtcttctctgagaggcgaaggcagaggtggcttggctctggcactcgtcggcacacaagataggatttccgcttccagtccgcgagtcgtgggcgacgcccgagccagagccttatgcgcagatatgaagagatgttcgtattatgagacctgtgctacatatggtctcaatgtggatagagttttccaggaagtcgcacagaaagtcgtaacattacgcaagcaacagcaattactggccgcctgtaaatctttaccatccagcccctctcactccgccgcatcgactccagtggccggccaggccagcaacgggggtcacactagtgattacagctcaagcctgcctagctcccccaatgtgggccaccgtgaattgcgagcagaggctgccgcagtggcgggcttgtcgacccctgggagcctgcatcgtgccgcaaaacggcggacgtccctcttcgccaacagaagaggctcggactcagagaagagatctctggactctagaggcgagaccacgggttctggcagggcaatcccaatcaagcaaagctttttgcttaaaagaagcggaaatagcctgaataaggaatggaaaaaaaaatacgtgacactgagttcgaacggcttcctgctctaccacccaagcattaacgactacattcattccacacacgggaaggagatggatctgcttcgcaccaccgtgaaagtgcccggaaaaagacctccccgggccattagcgcttttggaccctccgcatctataaacggcttggtcaaagatatgtccaccgtgcagatgggggagggactggaggccaccaccccgatgccatcccccagcccctcaccttcctcactgcagccaccccccgaccagacaagcaagcacttactcaagcccgaccgcaacctcgcccgcgctctttccactgactgcaccccttcaggcgatttgtcacctctaagccgggagccccctccatctcccatggtgaagaagcagcggaggaagaagttaaccactccctccaaaactgagggaagcgcaggtcaggccgaggaggagaatttcgaatttctcatcgtaagtagcacaggccagacttggcatttcgaagccgcatcctttgaggaacgagacgcctgggtccaagcaattgagtcacagattctggcatctctgcagtgctgcgaatcatcaaaagtcaaacttagaaccgactcacagtctgaggccgtggcaatccaggccatccgaaatgctaagggcaacagtatttgcgtggattgtggagcacccaatcccacatgggccagtctgaaccttggagcactgatttgtattgaatgtagcggtattcaccgcaatctcggaacgcacctgtcccgtgtgcgaagcctggacttggacgattggccaagagaattgacactggttctgactgcgatcgggaacgacaccgccaacagggtctgggagtccgatactcgcggacgcgcaaagccttccagagattcgagccgcgaagaaagggagtcttggatccgtgccaagtacgaacagctgttgtttctggccccgctttccaccagcgaagaacccttagggcgccagctttgggctgctgtacaggcacaagacgtggccacggtactcttactactggcccacgcgaggcatggacctttggacacctctgtggaagacccccaactgcgatcgcctctgcatttagcggcggaactagctcacgtggtcattacgcagcttctgctgtggtatggcgccgacgtggcagcaagagatgcccaggggaggaccgcccttttctatgcgcgccaggccgggtcgcagctatgcgcagacattctgctgcaacatggttgtcctggagagggtggtagtgcagcaacaactccatcagcagctacaaccccatccataacagccacaccaagtcccagaaggagaagttccgccgcatcggtcggaagggctgatgcacctgtagcacttgtgtag

SEQ ID NO: 13871 - DNA, 3579 bp, Artificial Sequence
  Description of Artificial Sequence: Synthetic coding sequence
atgagcaggggggccggtgcactgcaacgacggaccacgacatatttaatttcgttaacgctggtgaagttagagagcgtacctcctcctccaccttccccaagcgccgccgccgccggggccgctggggcacggggttcggaaactggagatccgggttctccacggggggctgaagaacccggcaagaagcgccatgagcgactttttcataggcaagacgcgttatggattagcaccagctccgccggaaccgggggagcggaacctcctgcgctttcgcccgccccagcctcaccagcaaggcctgtgagcccagcaccaggtcgcaggttgtccctctgggcagtgcctccggggccgccactgagcggggggctgtcccccgacccaaaaccgggaggggcacccactagctcaagaaggcccctgctgtctagtccaagttggggcgggcctgagcccgaaggccgcgccggcgggggcattccaggatcttccagtccccatcccggaacgggctcccggcggttgaaggtggcccctcctcctcctgcacctaaaccatgtaagactgtgaccactagcggagccaaagccgggggaggtaaaggcgcaggaagccggctgtcctggccagagtccgaaggcaaaccaagggtaaaaggatctaagtcgtctgccggaactggagcttcagtcagcgcagccgctacagccgcggccgcggggggaggcgggagtactgcatctacctcgggtggtgtaggggcaggcgctggtgctagggggaaactgagccctcgaaaaggcaaaagcaaaacactggacaactctgatctgcatccagggcctccagctggctctcctccccccttaacactgccaccgaccccttcacctgccacagccgtgaccgccgcctctgcccagcctcccggtcctgcccctcccatcaccttggagccccccgcccccggcctgaagaggggccgagagggggggagagcaagcacccgggaccgcaagatgctcaaatttatttctggcatatttaccaaatcaacaggcgggcccccaggctctggtcccttgccaggtcctccctcacttagttctgggagcggcagtagagaactgctcggcgcggaactgcgagcctcacctaaggccgtgatcaactcccaggagtggactttgagcagaagcatccccgaacttaggcttggcgtgcttggagatgcccgcagtgggaaatcttctttgattcaccgattcttgacaggctcgtatcaggtactggagaagacagagtccgagcaatataagaaagagatgttggtggacggtcagacacacctcgtgctgatacgcgaagaggctggtgcccctgatgccaagtttagcgggtgggctgacgccgtcatttttgtcttctctctggaagacgaaaatagctttcaggccgtgagcaggctgcatggacagctctcttctttgagaggagaaggtcgcgggggtttggccttggcactggtgggcacccaggacaggattagtgcttcctccccacgcgttgttggtgacgcgcgtgcgagggcgctgtgtgcggatatgaagcgctgctcatactacgaaacgtgtgccacttacggccttaatgtagacagagtgttccaggaggtggcgcagaaggtggtaactctgaggaaacagcagcaactgctggcggcttgtaagtccctcccctcttctccatcacactccgccgcctcgactcccgtggctggccaagcgtcaaatggcgggcatacaagtgactactcctctagtttgccgagctcacctaatgtgggtcatagagaactgcgcgccgaggcagcggccgtggctgggctctctaccccaggcagcctacatcgagctgccaaacggcgaacctccctctttgccaatagaaggggaagcgacagtgagaagagatcactggatagtaggggcgaaacaacaggaagtgggcgcgccatcccgataaaacaaagtttcctattaaagaggagtggcaattcactgaataaggagtggaagaagaaatatgtgaccctgagttcaaacggcttcctcttatatcatcccagcataaacgactacattcattctacacacggaaaagaaatggatttgctgcgcactaccgtgaaggtgcccggcaaacggcccccaagagcgatttcagccttcggtccatctgcaagtatcaacggactcgtcaaggacatgtcaacagtacaaatgggggaagggttagaagcgacaacccccatgccttcccctagcccatcccctagttccctgcagcccccgcccgaccagacctcaaaacacctgctgaaacccgacaggaacctggcccgtgcactgagcacagactgcacaccatccggagaccttagtcccttgtcaagagagccaccgccttctccaatggtcaaaaaacagaggcgaaaaaagctgacgacaccctccaagactgagggtagcgctggacaggcggaagccaagcgcaaaatgtggaaattgaaatcattcggctcactacgtaacatatacaaagccgaagaaaatttcgagttcctcatcgtgtcaagcacgggtcagacttggcacttcgaggcggcatctttcgaagaacgagacgcatgggtgcaggctatcgagagccaaatactggcttccctgcaatgctgtgaaagctctaaggtgaagcttaggaccgacagtcagagtgaagctgtggccatccaggctatccgaaacgctaagggaaactctatttgtgtcgattgtggggcccctaaccctacttgggccagtttaaacctaggcgcactgatttgcatcgaatgtagtggaatccaccggaatcttggcactcacttaagccgcgtacgatccctcgacctcgatgattggccccgcgaactgaccctggtgctcactgccattgggaatgacacagccaaccgtgtgtgggagtctgacacccgggggagggctaagcccagcagggactcctctagggaggaacgcgagtcctggatacgcgctaaatacgagcagctgctgttcttagccccactgtcaacatcagaagagcctttaggacggcaactttgggccgcagtacaggctcaagacgtggctaccgtcctcttgttgctcgctcatgcaaggcatggccctctcgatactagcgtggaagatccccaactgcgtagtcctctgcatttagctgcagagctcgctcacgttgtgatcacccagttattgctatggtacggtgccgacgtcgccgcccgtgatgcccagggaagaacagctctgttctacgcgaggcaagctgggagccagctctgcgccgacattctgctccagcacggctgtccaggcgaaggcgggagcgcggctacaacgcctagcgccgctacaacaccttccatcaccgcaacaccttcacctcgcaggaggtcctccgcagccagcgttggaagagcggacgcacctgtagcactggtgtag

SEQ ID NO: 13872 - DNA, 1185 bp, Artificial Sequence
  Description of Artificial Sequence: Synthetic coding sequence
atggactcccagggccgaaaggttgtggtttgtgataacggtacaggattcgtgaaatgcggatatgccggaagtaatttcccggagcatatcttccccgctcttgtcggacgccccatcatcaggagtaccaccaaagtcggtaacatcgagataaaagacttaatggtgggcgatgaggccagcgaactgaggagcatgctcgaggtgaattatcctatggagaacggcattgtacgaaattgggacgatatgaaacacctttgggattacacctttgggccagaaaagctgaatatcgatacacggaactgtaaaattctccttacagagcctccaatgaaccccactaaaaatcgagaaaagatcgtagaggtcatgttcgagacttaccagtttagcggggtgtatgtggccattcaggccgtgttaactttgtatgcgcaggggcttctcaccggagtggtggtggattctggtgacggcgtgactcacatttgcccggtttatgaagggttctctctcccccatctcactcgtcgcttggatatcgcggggcgggacattacacggtacctgatcaagcttttgttgcttaggggttacgctttcaatcactccgctgactttgagaccgtcaggatgatcaaggaaaagttatgttacgtcggatacaatatcgagcaggagcagaaactggcacttgagaccaccgtcctggtcgagagctatacactccctgacggacgtattatcaaggtgggaggcgaacgctttgaggccccggaggcactctttcagccgcatctgattaacgtggaaggggtgggcgtcgctgagctcctgttcaatactattcaggcagctgatattgatacaaggagcgaattctataagcatatcgtactgtcaggtggatccacaatgtatcccggacttccctcccgcctcgagcgagagctgaagcaactctacctcgaacgcgttttgaaaggggatgtggagaagctttcaaaattcaagatccggatcgaggatcccccacggcggaagcacatggtcttcctggggggggccgttcttgcagatatcatgaaggataaggataatttttggatgactagacaagaataccaggaaaaaggagtgcgggttctggagaaacttggggttacggtgaggtag

SEQ ID NO: 13873 - DNA, 1200 bp, Artificial Sequence
  Description of Artificial Sequence: Synthetic coding sequence
atggattctcagggcaggaaggtcgtggtatgcgacaacgggacagggtttgtaaagtgtggctacgccggttctaatttccccgagcacatctttccggccctcgttgggcggcctattatccgatcaactaccaaggtcggaaacatcgagataaaaaataataagaaaatggaccttatggtcggagatgaggcgagtgagctccggtcgatgctcgaagtgaattatcccatggagaacggcatcgtccgcaactgggatgacatgaaacacctctgggattatacttttggccccgagaagctcaacatcgacactcgtaattgcaaaattctactcacagagcctcctatgaaccctactaagaacagagaaaaaatagtggaagttatgttcgagacataccaattctcaggggtgtatgtcgcaatccaggctgtgctgaccctgtacgcccagggtctgctgaccggagtagtggtagattccggtgatggtgtcacacacatttgccccgtgtatgaagggttctccctccctcacctcacccgccggctggacattgccggcagagacataacccgctatcttattaagcttctattactgagaggctatgctttcaaccacagcgctgattttgagactgtgaggatgatcaaagaaaaactgtgctacgtgggatacaacatcgaacaagaacaaaaactcgccctggagacgacggtactggtggaatcctatacacttcctgatgggcgcataatcaaagtgggcggtgaaaggtttgaggcacccgaagcacttttccagccacacctgattaatgtagaaggcgtgggagtggccgagctgttatttaacacgattcaggcggcagacatcgacactcggagtgagttttataagcatatcgtgctgtctggaggtagtaccatgtaccccggcctgccatcaaggctggaacgcgagctcaagcagctgtatctcgaaagagtcctgaagggcgatgtcgagaaactgagcaagtttaagatccggattgaggacccgccaaggaggaaacacatggtctttctgggcggggcggtcctcgctgatattatgaaagacaaagataacttctggatgaccagacaggaataccaggagaaaggtgtccgcgttctcgagaagctgggcgtgaccgttcgctag

SEQ ID NO: 13874 - DNA, 1020 bp, Artificial Sequence
  Description of Artificial Sequence: Synthetic coding sequence
atggttggcgacgaggcatcggagctgcgttcaatgctggaagtaaactatccgatggagaatggcattgtgagaaactgggatgacatgaaacacttgtgggactacaccttcggtcctgagaagctgaacatagatacacgaaactgtaagatactccttacagagcctcccatgaaccccacgaaaaaccgagaaaaaatagtggaagtcatgtttgagacctaccagttcagcggcgtgtacgtggccattcaggccgttctgaccttgtacgcccaggggctgttaactggcgtggttgtagactcaggtgatggggtgacccatatttgtcccgtatatgagggcttcagtttaccccacctgacccgccgcctggacatcgccgggagggacatcaccaggtacttgataaaattgttgctgctccggggctatgccttcaaccattctgcagactttgaaacagtcagaatgatcaaagagaagctgtgctatgtgggctataacatagaacaggagcagaaattagctttggagacaacggtcctcgtggagtcctataccttacccgatggaaggattataaaggtgggtggagagcgtttcgaggcccccgaagcactgttccaaccccatctgattaatgtggagggagtcggcgtggcggagcttctctttaatacgattcaagccgcagacatcgatactaggtcagagttttacaaacacattgtgctcagcggagggagcacaatgtaccccggcctgccctctaggctagagcgggagctaaagcagctttacctggagagagttctcaaaggcgatgttgagaagctctcaaagtttaagatcagaatcgaggacccacccaggaggaagcatatggtcttcctcggaggcgccgtgctggcggacatcatgaaggataaggacaacttttggatgacacggcaagaataccaggaaaagggcgtgcgcgtacttgaaaaattaggcgttactgttaggtag

SEQ ID NO: 13875 - DNA, 918 bp, Artificial Sequence
  Description of Artificial Sequence: Synthetic coding sequence
atggtgggggacgaagcttccgaactccggagtatgcttgaggtgaattaccccatggagaacgggatcgttcgcaattgggacgacatgaaacatctatgggactacaccttcgggcctgaaaaattgaatatcgacacgcgcaactgtaaaatccttctcaccgagcctcccatgaatcccaccaagaaccgagaaaagatcgtggaggtaatgttcgagacataccagttcagtggagtctacgtagctattcaggccgtgctgactctttacgcccagggcctcctgacgggggtggtggtggattctggggacggcgtgacccacatctgtcctgtctatgagggattcagtctcccgcacctcacaagacgacttgatatcgctggtcgcgatatcactcggtacctgatcaaactgctgctcctcaggggttatgccttcaaccactcggcggacttcgagacggtccgcatgatcaaggaaaagctctgctatgtcggatacaatatagaacaagagcagaagttagccttggagacaacggtgttggttgagagttacacgttgccagacgggcgtatcatcaaggtgggcggggagaggtttgaagcacctgaggccctcttccagccacatctcatcaacgttgaaggagtgggagtggctgaactcctcttcaacaccattcaggcggctgatattgacactcgatccgagttctacaagcacatcgtgttgtccggtggatctaccatgtacccaggcctcccctctaggctggagagggagttaaaacagctgtatctggagagggtactcaagggggatgtggagaagctttctgtgagcatctcaaagtccacgattaccaatatcctcctgaaaggctacacagtggtatgcgagtcctag

SEQ ID NO: 13876 - DNA, 1257 bp, Artificial Sequence
  Description of Artificial Sequence: Synthetic coding sequence
atggctggtcggttgccggcctgtgtggtggactgcgggacaggctacaccaagttaggctacgctggaaacactgagccccagttcatcatcccatcgtgcattgccattaaggagagcgccaaggtgggtgaccaagcacaacggagggtgatgaaaggcgtggatgacctggatttctttataggcgatgaggccatagaaaaaccaacgtacgccaccaagtggccgatacgacacggtattgtagaggactgggatttaatggagaggtttatggaacaagtcatctttaaatatctgcgggctgaacccgaagatcattactttctgcttactgaacctccactgaatacacctgaaaaccgggaatacaccgcggaaatcatgttcgaatcctttaacgtgcccggtttatacattgcggttcaagctgttctcgctctggccgcgtcatggacctcacgacaggttggagagcgtaccctcaccggaactgtaatagatagtggagatggcgtcacacatgtgattcccgtagctgagggatacgtgatcgggagctgcatcaaacacatccctattgcaggccgggatattacgtacttcatacagcagctgctccgtgatcgcgaggtggggatcccccctgagcagtcactggagaccgccaaggccgtaaaggagcggtatagttatgtctgtcccgacctcgtgaaggaatttaacaagtacgataccgacggatcgaaatggataaaacagtataccggaattaacgccatcagtaagaaggaattctccatcgatgtggggtacgaacgttttcttgggccggagattttcttccacccagaattcgcgaatccagacttcacccaacccatcagcgaagtggtagatgaagtgatccagaactgtcccattgacgttcgccgacccctgtataagaatatagtgttgtccggggggagcactatgtttagagatttcgggcgacgtctgcagcgtgacctgaagagaaccgtcgacgcacggctgaagctatctgaggaactgagcggcggtaggctgaaacccaagccaattgacgttcaggttatcacgcatcatatgcaacgatatgccgtgtggttcggcgggagtatgctggcctcgacccctgaattctaccaggtttgccacactaagaaggattacgaagaaatcgggccctccatatgtaggcataatcccgtgttcggtgtgatgtcatag

SEQ ID NO: 13877 - DNA, 1104 bp, Artificial Sequence
  Description of Artificial Sequence: Synthetic coding sequence
atgaagggcgtagatgatctcgacttctttattggagacgaggccatcgagaaacctacctacgcaaccaagtggccaatcaggcacgggattgttgaagattgggacttgatggagcgcttcatggagcaggttatcttcaagtatctcagagcggaaccagaggaccactatttcctgttaacggaacccccactgaacactccggaaaacagagagtatacagccgagatcatgtttgaaagctttaacgtaccagggctatatatcgcggtgcaggccgtgctcgcactggctgcaagttggacaagccgacaagtgggtgagaggactctgaccgggaccgtgatagactccggcgatggtgtcacccacgtaattccagtggccgaggggtatgtcattggcagctgcattaagcacatcccaatagccggaagagacatcacatacttcattcagcaactgctgagagatcgcgaggtcggaattccaccagagcaaagcctcgaaacggccaaggccgtgaaggaaagatattcgtacgtctgtcccgatctggtgaaggaattcaataaatacgacacagatgggagcaaatggatcaagcaatacacaggaatcaacgccatttccaagaaggagttctccatcgatgtcggttatgaacgattccttggccccgagatctttttccatccagagtttgccaacccggattttacgcagcccatttctgaagtggtcgatgaggtcattcagaactgtccaatcgatgtgcggcggccgctttataaaaacattgtactgagtggtggttccacaatgttcagagatttcgggaggcggctccagagagatctcaaaaggaccgtcgatgcccggttaaaattatccgaggaactctcagggggcagattgaaaccaaagcccatcgatgtgcaagtaattacacatcacatgcaacggtatgccgtgtggtttgggggctccatgcttgcgagcacacccgaattctatcaggtatgtcacaccaaaaaagactacgaggagataggaccttctatctgcagacataatcccgtctttggcgtgatgtcctag

SEQ ID NO: 13878 - DNA, 1071 bp, Artificial Sequence
  Description of Artificial Sequence: Synthetic coding sequence
atgctggagattcagaatcactctctgagttccttaccatggcccatcaggcacggtattgtcgaggattgggacctgatggaacgattcatggaacaggtcattttcaaatacctgcgggccgagccagaagaccattacttcctgctgacagagcctccgctcaataccccagaaaatcgcgagtataccgcagagatcatgtttgaaagttttaacgtgcctgggctttatattgcagtgcaagcagtgttagctctcgctgcctcctggacgagccgtcaagttggagagagaactcttacaggcacggttatcgacagcggggacggcgtcacccacgtgattcccgtggccgagggatatgtgatcggctcttgcatcaagcatattcccatcgctggacgcgatataacctactttatccagcagctcctgcgggacagagaggtgggtattcctccagagcagagccttgagacggctaaggcggtgaaggagcgctatagctatgtgtgcccggatctcgtaaaagaattcaataaatacgacactgacggttccaagtggatcaagcagtacaccgggattaacgccatttctaagaaagaattctccattgatgtgggctacgagaggttcctgggtcccgagattttctttcatccagagtttgccaacccagacttcacacagccgatctcggaggtggtagacgaagtgatacagaattgccctattgacgtgaggaggccgctgtataagaacattgtgttgtctggcggttcgaccatgtttcgggactttggccgtcgcctgcaacgggatcttaaaaggaccgtcgatgcaaggctaaagctgtcagaagagctttccggcgggagactgaagcccaaacccatcgatgtgcaggtgatcacacatcacatgcaacgatacgcagtttggttcggcgggtcgatgctcgcctcgacaccagagttttaccaggtttgtcacacaaagaaggactatgaagagattgggccttccatttgccgacataatcctgtcttcggtgtgatgtcttag

SEQ ID NO: 13879 - DNA, 870 bp, Artificial Sequence
  Description of Artificial Sequence: Synthetic coding sequence
atgttcgaatcatttaacgtcccgggcctttatattgcggttcaggccgtcctggctctggcggcgagttggacctcccggcaggtgggtgagcgaaccctgacaggcactgtgattgattcaggagacggagtcacccacgtcattccagtcgctgagggttacgtgatcggttcctgtataaagcatattccgatcgcaggccgcgacattacttattttatccagcagctgctgcgtgatagggaggttggcattccccctgagcaaagcctggagacagctaaagctgtgaaagaacggtatagttacgtgtgcccagacctagtaaaagaattcaataagtatgataccgacggctcgaagtggattaaacagtacacaggaattaacgccatctccaaaaaggaattctcgatcgatgtcggctatgagagattcctcggacctgagatcttctttcaccctgaatttgccaatccggacttcacacagcccatctcggaggttgttgacgaggtgatacagaactgtcctatcgacgtgagaaggccactgtacaagaacattgttcttagtggtggtagcaccatgtttagagatttcggacgacgactacaacgcgacctaaaaagaacagtggatgcgcgcctcaaactgtcggaagaactgtcaggcggtcgccttaaaccgaagccaatcgatgttcaggtgattactcaccatatgcagcgatatgctgtgtggttcggtggcagtatgttggcctctactccagaattttatcaggtctgtcacaccaagaaagactacgaggagattggcccctccatatgcaggcacaacccagtgtttggggtcatgtcctag

SEQ ID NO: 13880 - DNA, 1749 bp, Artificial Sequence
  Description of Artificial Sequence: Synthetic coding sequence
attgatattgagtccatggataccgataaagacgaccctcacggacgattggaatacaccgaacaccaggggcggatcaagaatgcgcgcgaggcccactcccagatcgaaaaaagacgacgggacaagatgaactcctttatcgatgaactggcttcactggtccccacttgtaatgcaatgtcccgaaaattggataagcttacagttctcagaatggcggtgcagcacatgaaaacactcaggggtgcaacaaatccatataccgaagcaaactataaacctaccttcctctccgacgacgagctgaagcacctaattctccgcgccgccgatggattcctcttcgtcgtggggtgtgatcgtggcaaaattctgtttgtttccgagagtgtatttaagatcctgaactactcgcagaacgacttgattgggcagagtctattcgactatctgcaccccaaggatatagcgaaggtcaaggaacagttatcttcaagcgatacagcacccagggagcgcctgatcgatgccaaaacaggcttgcccgttaaaaccgatatcaccccaggtccttcccgcctgtgttccggagcacgacgcagttttttttgccggatgaagtgcaaccggcctagcgtgaaggtggaggataaagacttcccaagtacttgctccaaaaagaaggccgacagaaaaagtttctgcactattcactctacagggtacctcaagtcatggccacctaccaaaatgggcctggacgaagacaacgaacccgataacgaggggtgcaatctgtcctgcctcgtcgctatcggtagattacattcccatgtggttcctcagcctgttaatggcgagatcagggtcaaatcaatggagtacgtgagccgtcacgccatcgatggcaaattcgtctttgtggaccagagagccaccgctatcctggcctatctgcctcaggagctcctgggaacatcctgctacgaatactttcaccaagacgatattggccacctggctgaatgtcacagacaggttctccagacccgcgaaaagatcacgacgaactgttataagtttaagattaaggatggatcctttataaccctcaggtcccgatggttctccttcatgaatccatggaccaaggaggtggaatacattgtctctactaataccgtcgtcctggctaacgtgttagaggggggggaccctacatttccacagctgaccgcttccccccactctatggactcgatgctgccttctggtgaaggtgggccaaaacgcactcatccaactgtgcccggcatccctggaggcacaagagctggggccggcaaaatcggtcgcatgatcgccgaggaaattatggaaatacaccgcatccggggatcttctccaagcagctgcggcagctctcccctgaacataacaagtacacctccccctgatgcttcatcccccggcggtaaaaagattctgaacgggggtacaccagacattccgagctccggtcttctttccggccaagcccaagaaaatccaggttacccctattcagattcaagcagcatactgggggagaatcctcacatcggaatcgacatgatcgacaatgaccagggcagtagttctccaagcaatgacgaggccgcaatggccgtaatcatgtctctactggaggcagacgccgggcttggcggacctgttgacttttccgatctgccctggcctctgtag

SEQ ID NO: 13881 - DNA, 1527 bp, Artificial Sequence
  Description of Artificial Sequence: Synthetic coding sequence
atggccgatcagagaatggacatatccagcactatttcagatttcatgtccccaggccccacagatctgctgtcgtcttccctgggaacctctggtgtcgattgcaatagaaaacgtaagggaagctcaacagattaccaggagagcatggatacggataaggatgatccccacgggcgactggagtacaccgagcatcaaggtcgtattaagaatgctcgggaagcacactcccagatagagaaaagaagacgagataaaatgaacagctttatcgacgaactggcctccctagtgcctacctgcaacgcaatgtcacgcaagctcgataaactgacagtattgcgaatggccgtgcagcacatgaaaacactgcgaggcgcaaccaacccttacacggaggccaactataagcctacctttttaagcgacgacgaactgaaacacctgattcttagagctgccgatggatttctgttcgtcgtgggctgcgaccgcggcaagatcctgttcgtaagtgagagcgtgttcaagattctaaactattcacagaatgatctgattggacagtctctcttcgattatttgcatcctaaggacatcgccaaggtaaaggaacaactgagctctagcgataccgccccccgtgaaaggttgatcgatgccaagaccgggcttcccgtcaaaaccgacataacccccggtccatcaaggctgtgcagcggagccaggcgcagctttttctgccgaatgaagtgtaatcggccatcagtcaaagtggaagacaaggacttcccctccacctgcagcaagaagaaagtgctgcagacccgcgagaaaattaccaccaactgctacaagttcaagattaaggacggatcatttattacccttagatctagatggttttcatttatgaacccatggactaaagaagtggagtatatcgtgtccacaaacactgttgtcctggccaacgtgctcgagggaggggacccaacattccctcaactcaccgcctctccccactccatggactcaatgctgccctcaggagaaggaggtcctaagagaacgcatcctactgtcccaggtataccgggcggtacgcgggctggggccgggaaaatcggcagaatgatagccgaggaaatcatggagatccaccggattcgcggctcttccccatccagctgtggctcctcccctcttaatattacatccaccccacctcctgatgcgtcatcaccgggcggtaagaagatcctgaacggcgggacccccgacattcctagctctgggctcttaagtgggcaggctcaagaaaacccaggatacccttactcagatagctcatccattctgggggagaacccacacattggcatagacatgattgataacgatcaggggagttcttctccgagtaacgatgaggccgccatggccgtgattatgtcactgctggaagctgacgccggtctgggaggccccgtggatttcagcgacctgccatggcctttatag

SEQ ID NO: 13882 - DNA, 1878 bp, Artificial Sequence
  Description of Artificial Sequence: Synthetic coding sequence
atggctgaccagagaatggatatttcatctacaatatcagactttatgtctccaggcccaacggatctgctgtcgagttctcttggcacctctggcgtcgactgcaacaggaaaagaaagggttcttccaccgactaccaggaatctatggatacggataaggacgaccctcatggacggctggagtacacagaacatcaaggtcggattaagaacgctcgggaggcccacagtcaaattgagaaacgcagacgtgataagatgaactcattcatcgatgaattggctagtctggtcccgacttgtaatgctatgagccgcaagctcgataagcttacagttcttagaatggctgtgcagcacatgaaaactttacggggagctaccaatccttacacggaggctaactacaaacctaccttcttatctgacgacgaactcaaacatcttattctcagagccgccgatgggtttctcttcgtcgtgggatgtgacaggggcaaaatcctgttcgtgagcgagtccgtgtttaagatcctgaactatagtcaaaacgatcttatcggacagtcacttttcgattatcttcaccctaaagacatcgccaaagttaaagaacagctgagttccagtgacacagcgccccgcgagaggctcattgatgccaagaccgggctccctgttaaaactgacattacgcctgggccctcccggttatgtagtggtgctcgcagaagttttttctgccgaatgaagtgcaacagaccctccgtgaaagttgaagataaagattttccttcaacgtgctccaaaaagaaagaccgcaaaagtttctgtactatccattcaacgggatacttaaagtcctggccccctacaaagatgggcttggacgaagacaatgaacctgacaatgaaggttgcaatctttcatgcctggtagcgatcggccgcttgcattctcacgtggttccacagccagtgaacggggagatccgggtgaagtcaatggaatacgtgtcccgacacgccattgatgggaagtttgtgttcgtggaccagagggccacagcaatcctcgcatatctgcctcaggagctgctgggaacatcatgctatgagtacttccaccaggacgacatcggtcacctggccgagtgccaccgacaggtgctgcagacccgcgaaaaaataacgactaattgttacaagttcaagattaaagatgggtcattcatcactctgcgcagtcgctggtttagcttcatgaacccatggacgaaagaggtcgagtatattgtttccacaaatactgtggtactcgctaacgtgttggaggggggcgatcctactttccctcagcttaccgcttctccccactctatggattctatgctcccttcaggagaaggtggaccgaaaaggacccaccccacagtgcctggcatcccagggggcacccgggcaggtgccggaaaaattggaagaatgattgcggaggagatcatggagatacacagaattcggggctcttccccaagcagctgcgggtccagcccgcttaacattacatcaacccctccccctgacgcatcctcccccggtggcaaaaagatccttaatggagggactcccgatattcctagtagcggcttgctcagtggacaggcccaagaaaatcccgggtatccctattctgattcttcatctatcctgggggaaaaccctcatatcggtatcgatatgatagataatgatcagggtagtagcagcccgtctaatgacgaggccgccatggccgtgataatgagccttctagaggccgatgcaggacttggggggcccgtcgatttcagcgacctcccctggccactctag

SEQ ID NO: 13883 - DNA, 1581 bp, Artificial Sequence
  Description of Artificial Sequence: Synthetic coding sequence
atggccgaccagaggatggacatctcctccacgattagtgacttcatgtcccctggccccaccgacctgctgtctagctcactgggaacctctggcgtggactgtaatagaaagcggaaggggagcagtaccgactaccaggaatctatggataccgacaaggacgacccccacggcagacttgagtatactgagcaccaggggcggatcaaaaacgccagggaagcccactcacaaatcgagaagaggaggcgggataagatgaacagctttatcgacgagctggcctccctggtgccaacgtgcaatgccatgtccagaaaactggacaaattgacagtcttgagaatggcggtgcagcacatgaagaccctgcggggagctactaacccctacactgaggccaactacaagcctacgttcttaagcgatgacgaactgaagcacctgatactgcgcgctgcagacggcttcctgtttgtcgttggatgcgacaggggtaagattctcttcgtctctgagagcgtcttcaagattctcaattactctcagaacgatttgatcggccagtcactgtttgactacctgcacccaaaggatatcgccaaggtcaaggaacagctgagctcaagcgataccgccccccgggagcggctgattgatgcaaagactggccttccagtgaaaaccgacattacaccaggccctagtaggttatgcagcggagctcgacggtcatttttttgccgaatgaagtgtaaccggccctccgttaaagtggaggataaagacttcccatctacctgcagcaagaaaaaggccgaccgcaagtcgttttgtaccattcattcaacaggttatctaaaatcatggcctcccacaaaaatgggactcgacgaagacaacgaaccagacaacgagggatgtaacctctcctgccttgtcgcgattggtcgcctacattcccatgtagtcccccaacctgttaatggggagatcagggtgaaatcaatggaatatgtctcccggcacgccattgatggtaagttcgtgttcgtggatcaacgtgcaaccgccatactggcctacttgccccaagagctgctgggaacatcatgttacgaatactttcaccaagatgatatcgggcacttggccgaatgtcacaggcaggtcctccagacgcgcgagaaaatcactactaattgttacaaattcaagattaaggacggctcatttattactttgcgctccaggtggttttcattcatgaacccatggaccaaagaagtggagtacatcgttagcacaaataccgtcgtgttgtcgagagtggacacggggcatttaggacaggtcgagtggtgtactgtgctctcacgcccagatagtcgttttttgatcgccggcatgtttactgaacccacctcatggaaggccggtacccaaccgtcacactctagtcagcaccctccgacagcatggacggcatgctgtcctttggagaaggtggctcagagaggacccaccccgctgttccagggctttcaaggtgaaccaggactagggcaggagaagtag

SEQ ID NO: 13884 - DNA, 1878 bp, Artificial Sequence
  Description of Artificial Sequence: Synthetic coding sequence
atggcagatcagcgaatggatatatcttccacaatctccgactttatgtcacccggtccgacagacctcctctcctcttccctgggaaccagtggagtggattgtaatcggaagagaaagggaagtagcactgactaccaggaaagcatggacactgacaaggacgaccctcatggacggctcgagtatacggagcatcaaggtcggatcaaaaatgctcgggaagcccatagccagatcgaaaagcggaggagggacaaaatgaactcctttatcgatgagcttgctagtctagttcccacatgtaatgccatgtccagaaaattagataaattaaccgtgctacgcatggccgtgcagcacatgaaaactctgcgaggagctacgaatccgtataccgaggctaactacaagcccacattcctgagtgacgacgaactgaaacatttgatcctgcgcgccgcagacggcttcctgttcgttgtcggatgcgacaggggcaaaatcctgtttgtgagtgagtcagttttcaagatcctcaactattcccaaaacgacctgatcgggcaatccctatttgactacttgcacccaaaagatattgcaaaagtcaaagagcaattgtcttcgagcgacaccgccccgagggaacgactgatcgatgctaaaaccgggttaccagtgaagactgacattacccccgggccgagccggctgtgcagcggcgcccggagatcttttttttgccgcatgaaatgcaatcgcccatcggtgaaagtggaggacaaagatttccccagcacatgcagcaaaaagaaggataggaagtctttttgtaccattcattcaaccggatacctgaagtcttggcctccgaccaaaatgggactcgacgaggacaatgaacctgacaatgagggctgtaatttgtcctgcctcgtggctataggccgcttacatagccacgtagtcccccagcccgtcaatggggaaatccgcgttaagagcatggagtatgttagtcgacacgcaatcgacggtaagtttgtctttgtggaccaacgggccaccgctatcttggcatacctgccacaggagctgctgggcacgtcatgctacgagtactttcatcaagatgatattggccacttggccgaatgtcaccggcaggtcttgcagaccagagagaagataacaaccaactgttacaaatttaagatcaaagatgggtccttcatcacactgcgaagtcgatggttttctttcatgaatccatggacaaaggaggttgagtatatcgtgagcacaaatacggtggtgctggctaacgtgctggagggtggtgatccaaccttcccccaactaacagcctccccccacagcatggactccatgctgcctagtggagagggcggcccaaagcggacccacccgactgttcccggaattcccggcggaacgcgcgcaggcgccggtaagataggtcgcatgatcgccgaggagattatggaaattcaccgcataagggggtcttccccatcttcatgcgggagctcacccctgaatataacgtccacacctcctcccgatgcatctagccctggaggcaagaagattctgaacggtggtacccccgacatccccagttctgggctgctctcaggacaggcccaggagaatcccggctatccgtactctgactctagcagcatcttaggcgaaaacccacacatcgggattgacatgatcgataatgaccagggcagttcatccccttctaacgacgaggccgcgatggccgtgatcatgagtctgttggaggcagacgctggcctggggggccctgtagactttagcgatctaccttggccactatag

SEQ ID NO: 13885 - DNA, 1752 bp, Artificial Sequence
  Description of Artificial Sequence: Synthetic coding sequence
atgattaacatcgagagtatggacaccgataaagatgatccccatggtagattggagtacaccgaacatcagggcagaattaagaatgcgagagaggcccacagtcagatcgaaaaacgacgtcgcgataagatgaattcgttcatagacgagcttgcttccctcgttcctacatgtaatgccatgagcagaaaactggataaactcacagtcctgcggatggccgtacagcacatgaagaccctcagaggagccacaaatccatacaccgaggccaattacaaacctacatttctttccgatgacgagttaaagcacctcattctaagggccgctgacggattcctgtttgtggtaggttgcgatcggggtaagatcttgtttgtgagcgagtctgttttcaagatactgaactattcacagaacgacttgattggccaaagcctcttcgactacctacatcccaaagacatcgccaaggtgaaagagcaactctcgtcttcggacactgctccccgggaacggttgatagacgctaaaactggcctccctgtaaagactgacattactcccggcccttcacgactttgttccggtgctcgccgatcctttttttgtaggatgaagtgcaaccggccctctgtcaaggtggaagacaaggactttcccagtacctgtagcaaaaaaaaggccgacaggaagtctttttgtactattcactcaactggatatctaaaaagttggccacctactaaaatgggcctcgatgaagacaacgagcctgacaacgagggctgtaatctgagttgcttggtagccatcggaagactccacagccatgtggtgccccagcccgtcaacggagaaatacgggttaaaagtatggaatacgtgagccggcatgctattgatggtaaattcgtgttcgtggatcagagagccactgccattctggcttacctgccacaggagttgctgggtacctcttgctatgaatactttcaccaggatgacattgggcatttggccgaatgtcatagacaggtgctgcagacccgggagaagattactacaaactgctataaatttaagatcaaggacgggagtttcatcaccctgcgttctaggtggttttccttcatgaatccttggaccaaggaagtggagtacattgtatcaactaatacggtcgttctcgcgaacgtactggagggtggcgaccctactttcccccaattgacagcatcaccccacagcatggactctatgctgccatccggggagggcggccctaaaagaacccaccctaccgtccctggcatcccggggggcacacgggccggggctggcaagatagggaggatgattgcagaggaaatcatggaaattcatagaatccgtggatcttcaccatcaagctgtggatcaagtccattgaacattaccagtactccgccccctgacgcgtcctccccaggagggaagaagatcttaaatggaggaacaccagatatccctagcagtggccttctctcgggccaggcccaggagaaccccggctacccttacagtgattctagctcaattctaggtgagaacccccatattggcatcgacatgatcgataacgatcaaggtagctccagcccctctaatgatgaggctgcaatggccgtgatcatgagtttgcttgaagctgatgctgggctgggaggaccagtggacttctcagacctcccctggccactctag

SEQ ID NO: 13886 - DNA, 1881 bp, Artificial Sequence
  Description of Artificial Sequence: Synthetic coding sequence
atggccgatcagcgcatggacatcagtagcactatatcagattttatgtctccaggacccacagacctgctctcctccagccttggcacttcgggtgtagactgcaataggaagcgcaaaggtagcagcacggattatcaggaatcaatggacacagacaaagatgatccgcacgggaggctggagtataccgagcatcagggtagaataaagaacgctagggaagcccacagccagatagagaagcgacggcgcgataagatgaacagctttattgatgagctagccagtctggtcccaacatgtaatgctatgtccagaaaactcgacaaattgaccgtactccggatggcagtgcagcatatgaaaacactgcggggggcaacaaatccatacaccgaggccaattacaagcctacgtttttgtcagacgatgaactaaaacaccttatcctgagagctgccgacggcttcctgtttgtagtgggatgtgatcggggcaagattttgtttgtaagcgaaagcgtattcaaaattttaaattactctcagaatgacctcatcgggcagtcactcttcgactacttgcacccaaaggatatcgccaaagtgaaggagcagctgagttctagcgacactgcccctcgcgagcgcctcattgatgccaaaactggcttgcctgttaagaccgatatcacacctgggccctcccgcctttgttccggtgcgagacgcagctttttttgcaggatgaaatgtaaccggcccagcgttaaggttgaggataaggattttccaagtacctgctcgaagaagaaggcggaccggaagagcttctgtacaatacatagcacgggatatctgaaaagttggccccctacaaaaatggggttagacgaggacaacgagccagataatgaaggatgtaatctctcctgtctcgtcgccatcggcaggctacattcacacgtagtgccccaaccagttaacggagaaatcagggtcaaaagcatggaatatgtgtctagacacgcaattgacggaaagtttgtattcgtggatcagcgtgctaccgccatcttggcttatttacctcaagagctgctcggcacatcttgttatgagtacttccaccaggacgacattgggcatctggctgaatgtcacaggcaggtgctccagacgagagagaaaataacaaccaactgttacaagttcaagattaaggacggtagtttcattactctgaggagccggtggttttctttcatgaacccgtggactaaggaggtggagtatattgtgtcaaccaatactgttgtccttgccaatgttctagagggcggggatcctacgttcccacaattgaccgcatctccgcattccatggatagtatgctgcctagcggcgaggggggccctaagcggacccacccgaccgttcctgggatcccaggtggcacccgcgctggggctggaaaaattgggcgaatgatcgcagaggaaataatggagattcacagaatcaggggatcgtcccccagcagttgcggatcaagcccccttaacatcaccagcacaccaccccctgacgccagcagtcctggcggcaaaaagatcctaaatggtggaaccccagacattccttcgtccggcctgctgagcggacaggcccaggagaatccagggtatccctattctgacagctccagcatcctgggagagaacccacacatcggtatagacatgatcgacaacgatcagggctcatccagcccttctaacgatgaggccgcaatggccgtgatcatgtcgctgctcgaagctgacgcaggtctgggagggccggtggacttcagtgatctgccgtggcccctttag

SEQ ID NO: 13887 - DNA, 1749 bp, Artificial Sequence
  Description of Artificial Sequence: Synthetic coding sequence
atgataaatatagagagtatggataccgataaggatgatcctcacggacgcctggagtacacagagcaccagggccgcattaaaaacgctcgcgaggcccactcccaaattgaaaagcgcagacgggataagatgaattcatttatcgacgaactggctagtcttgtgccaacgtgcaatgcaatgtctcgaaaactagacaagttaactgtgctacgcatggcggtacagcacatgaaaacactgcgtggtgcaactaatccatatacggaagccaactacaaaccaactttcctgtcggatgacgaactcaaacacctcatcctgcgggccgccgatggcttcctctttgtggtggggtgcgaccgcggcaagatcctgtttgtgtcagaatctgttttcaagatcctcaattattctcagaacgatcttatagggcagtcactgtttgattacctgcaccccaaagatattgccaaagtgaaggaacaactgagttcttctgatacagcccctagggagcgcttgatcgacgcaaaaaccgggttacccgtgaaaaccgatatcactcctggcccgagccgactttgctctggagcccggaggagttttttctgccgcatgaaatgcaaccggccttccgttaaagtagaggacaaagacttcccctcaacctgctctaaaaagaaggacagaaaatctttttgcacgattcactcaaccggctacctgaaatcctggccacccacaaagatgggcctcgatgaggataatgagcccgataatgaaggctgtaacctgagttgcttagtggctattggccgactacactctcatgtggtaccccagcctgttaatggagagatccgagtaaagtctatggaatacgtttcaaggcacgctatagacggcaagttcgtctttgtcgaccaacgtgccaccgccatcttagcctacctgcctcaagaactcttgggcaccagctgctacgaatacttccatcaggacgatattggacatctggctgagtgtcatcgccaagttcttcagactcgcgagaagattactacgaattgttacaagttcaagattaaagatggctcgttcatcaccctgcgcagccgctggttctctttcatgaacccttggacgaaagaggtcgaatacattgtttccactaatactgtggtgttggccaatgtgctcgaaggtggggatccaacatttccccaattgactgcctcaccacactccatggattccatgctgcctagtggagaaggcggtcccaaacggactcaccctactgtgcctggcatcccaggcggaacccgcgcaggagctggcaagattggccgcatgatcgcggaggagatcatggagatccataggattaggggtagttcaccttcctcctgcggatcctccccattgaacattacttctaccccaccccccgacgctagctcgccggggggcaagaagatcctcaacgggggcactccggacataccgtcgtccgggctcctaagtggacaggctcaggagaatccgggttacccttattccgacagtagctccattctaggagaaaatccacacatagggatcgacatgatagacaatgaccaaggttcttctagtccgtccaacgatgaggccgcgatggccgtgattatgtcactgctggaggccgacgctggcctcggggggcccgtggatttctcagatttgccatggccactgtag

SEQ ID NO: 13888 - DNA, 219 bp, Artificial Sequence
  Description of Artificial Sequence: Synthetic coding sequence
atgattaatattgaatctatggacaccgacaaggatgatccccacggccgtctggagtacaccgagcaccaaggcaggattaaaaacgccagagaggcgcattcgcaaatcgagaagaggagaagggacaaaatgaattctttcatcgatgagctggcttcattggtgccaacctgcaacgctatgagccggaagcttgataaattaaccgtcctatag

SEQ ID NO: 13889 - DNA, 231 bp, Artificial Sequence
  Description of Artificial Sequence: Synthetic coding sequence
atggccgatcaaaggatggacattagttccacaatctccgacttcatgagccctggtccaacagatttactaagctcctcccttggcacctccggcgtggattgcaacaggaaaaggaagggcagctccactgactatcaggaatccatggataccgataaagatgaccctcatggtcggctcgagtacaccgagcatcagggccgcattaaaaacgctcgcgaggcctag

SEQ ID NO: 13890 - DNA, 72 bp, Artificial Sequence
  Description of Artificial Sequence: Synthetic coding sequence
atggcagaccagagaatggacatatccagcaccattagcgatttcatgagccccggtcccacagatctgtag

SEQ ID NO: 13891 - DNA, 408 bp, Artificial Sequence
  Description of Artificial Sequence: Synthetic coding sequence
atggccgatcaaagaatggacatttcttccaccattagcgattttatgagcccgggtcccaccgatctccttagctcttccctagggactagcggcgtggattgcaaccgaaaacggaaaggctcgtccacagattatcaggagagtatggataccgataaggacgatccccacggacggcttgagtacaccgaacaccagggtcgaattaagaatgcaagagaggctcactctcagatcgagaagaggagaagggataagatgaatagctttatcgacgagctggctagcttggtaccaacatgtaatgccatgtcccggaagctcgataagctcaccgtgctcagaatggccgttcagcacatgaagactctgcgtggtgccacaaacccctacaccgaagcctag

SEQ ID NO: 13892 - DNA, 141 bp, Artificial Sequence
  Description of Artificial Sequence: Synthetic coding sequence
atgattaatattgaatccatggatacggacaaggatgacccacacggaagattagaatacacagagcatcaagggcggatcaaaaatgcccgcgaagcacactcacaaatcgaaaaaagacggagagacaagatgaattag

SEQ ID NO: 13893 - DNA, 426 bp, Artificial Sequence
  Description of Artificial Sequence: Synthetic coding sequence
atgattaacatcgaatcaatggacacagacaaggacgacccgcacggacgactggagtacacagagcaccagggccgtattaagaatgcgcgggaggctcacagtcagattgaaaagagacgccgggacaagatgaatagctttatagatgagcttgcttcccttgttccaacatgcaatgccatgagccgtaagctggataagctaactgtgttgcggatggcagttcaacatatgaaaactttgcgcggggccaccaatccctacacagaagccaactataaacccaccttcctgtccgatgacgaactgaagcatcttatcctccgtgcagccgatggcttcctgtttgtcgtcgggtgcgacagggggaagatcctcttcgtttccgagagcgtctttaagatccttaactacagtcagtag

SEQ ID NO: 13894 - DNA, 306 bp, Artificial Sequence
  Description of Artificial Sequence: Synthetic coding sequence
atggcagaccaacgcatggacataagttccacgatttctgactttatgagccccgggcccactgatcttctgagcagcagcttaggcacttctggtgtcgattgcaatcggaagcgtaagggttcaagcacggactatcaggagtccatggacaccgacaaggacgatcctcacgggcgactggagtacaccgagcaccagggcagaattaagaacgctagagaggctcactcacagatcgagaagaggcgcagagacaaaatgaattcattcatcgacgagctcgccagtcttgtgccaacctag

SEQ ID NO: 13895 - DNA, 180 bp, Artificial Sequence
  Description of Artificial Sequence: Synthetic coding sequence
atggccgaccaacgtatggacatttccagcacgatatccgattttatgtccccaggtcctaccgacctgctatccagctcactaggaaccagcggggtagattgcaaccggaagaggaaaggctccagcactgattatcaagagagtatggacaccgacaaagacgatccgcatggatag

SEQ ID NO: 13896 - DNA, 1683 bp, Artificial Sequence
  Description of Artificial Sequence: Synthetic coding sequence
atggaacccctgcagcagcagcagcagcagcagcaacagcaacagaaacagccccatttggcccccctgcagatggatgcacgcgaaaagcaaggccagcagatgagggaagcgcaatttttgtatgcccagaagttagtaacccagccgaccctgttgtcagccaccgctggtagaccttctggcagcaccccactcggcccactcgctagggtccccccgaccgccgcagttgcacaggtgttcgaacgcggcaatatgaactctgaaccagaggaagaggacggcgggttagaagacgaagatggagacgatgaggtagccgaagtcgctgagaaggagacccaggcagctagcaagtacttccacgtccagaaggtcgctcgtcaagaccctcgagtcgcaccgatgtccaacctgctccccgcccctggcctgccgccccacgggcagcaggctaaagaggaccacacaaaagatgctagtaaggcctcaccaagtgtgagcacagctggccagccgaattggaacctggacgaacagttgaagcagaacgggggccttgcctggagcgacgatgccgacggcggccggggtagagaaatcagtcgcgactttgctaagctgtatgaattggacggcgacccagaaaggaaagagttcctggatgatctgtttgttttcatgcaaaagcgtggaactcccattaatagaattcccataatggccaaacaaatactagacctgtacatgctgtacaaacttgtgacggagaaagggggcctggtggagattattaacaagaaaatatggagggagataacaaaggggctgaacctgcccacctccattactagtgcagctttcactctcagaactcagtatatgaaatacctgtacgcttatgagtgtgagaagaaagcactctcctcccccgccgagttgcaggccgctattgatggcaatagacgcgagggacgacggccatcttactcttcttcactgtttggctacagtccggccgccgccaccgcagccgctgctgctggcgcccccgctcttctcagcccaccaaagatccgattcccaatactgggcctggggtcctcaagtggcaccaatacgtcttctcctcgcatttctccagccactacactacggaagggcgacggagcgcccgtgacgacagtgccagttcctaataggttggcagtgcctgttactcttgcttcacagcaggctgggactaggacagcagccctggagcaacttagggagagattggagtcaggcgagcctgctgaaaaaaaagcctctagactgtcagaagaggaacagaggctggtacagcaggcgttccaaagaaatttttttagtatggccagacaactcccgatgaagatcagaattaatggtagagaagatagagctgaagcctcagcagccgccctgaatctgactacctcttctataggttcaatcaatatgagtgttgacattgatggtactacctatgccggagttctttttgctcaaaagcccgtggtgcacctgattactgggtctgccccccagtctctgggcagttccgccagctccagcagtagttcccactgcagcccttccccgacctcatccaggggaacaccgagtgccgagccatctaccagctggtctctgtag

SEQ ID NO: 13897 - DNA, 1335 bp, Artificial Sequence
  Description of Artificial Sequence: Synthetic coding sequence
atggaaccactccagcaacagcagcaacagcagcaacagcaacagaaacagccccacctcgccccgttgcagatggatgcccgtgagaagcagggccagcaaatgcgagaagctcagttcctgtacgctcagaaactggtcacacagccgacactgctgagcgctacagccggaaggccatccggatccactcccctcggtccgttagctcgggtcccacccacggccgccgttgctcaagttttcgagcgcggcaacatgaacagcgagccagaggaggaggatgggggtctcgaagatgaagatggtgacgatgaagtggccgaagtcgcggagaaagagactcaggccgccagtaagtacttccacgtccagaaagtcgcaaggcaggaccccagagtggctcccatgtccaatctgctcccggcccccgggctgccgccccacggccagcaggcaaaggaggatcacacaaaggatgcatccaaggcttccccctctgtgtcaactgccggccagcctaactggaaccttgacgaacagctaaagcagaatggggggctggcatggtccgatgacgccgacggcggcaggggcagagaaatcagcagagattttgccaagctctacgagttggacggggaccctgagagaaaagaattcttggatgacctttttgtctttatgcagaagcgtggcacacctatcaatcgaatcccgattatggcaaagcagattctggatctgtatatgctctataagctcgtcactgaaaaaggcggcttagttgagattattaataagaaaatttggagagaaatcaccaaggggcttaacctgcccacaagtataacaagcgctgccttcactttgagaacacaatacatgaaatacctgtatgcctacgagtgcgaaaagaaagcactttcaagccctgctgagcttcaggccgcgatagacggcaaccgacgggagggacgccggcccagctactctagcagtctgttcggctattccccggcagctgccaccgccgccgcagctgctggtgctccagccttgttgtcaccaccaaaaattcgctttccaatacttggattaggctcgtcctcaggcacaaatacctcaagccctaggatctctccagcaacaaccctccgcaagggcgatggtgccccagtcacgacagtccctgtgcctaacagactcgcagtacccgtcactctggcctcccaacaggctggaaccagaacagccgccctggagcaactaagggaacggcttgaaagtggtgagcctgcagaaaaaaaagcttcggggacttggtgccaatag

SEQ ID NO: 13898 - DNA, 1413 bp, Artificial Sequence
  Description of Artificial Sequence: Synthetic coding sequence
atggagccattgcaacagcagcaacagcaacagcagcagcagcagaagcaaccccacctcgcccctcttcagatggacgctagagagaagcagggacagcagatgagagaggcacagttcctttacgcccaaaagctcgtaacccagccaacgttactgtccgccaccgcaggcagaccctctgggtccacacccctgggccctctggcgcgggtgccgcccactgctgctgtggctcaggtgtttgaaaggggtaacatgaatagcgaacccgaagaggaagatggggggctcgaggatgaggacggtgacgatgaggtggcagaggttgctgaaaaggaaactcaagcagccagcaagtatttccatgttcagaaggtcgcgaggcaggacccacgggtggcacccatgagcaacttgctcccggcacctggcttgccccctcatggccagcaggcaaaggaagaccatactaaagacgcttccaaagccagcccttccgtgtctaccgccggccagcccaattggaatctggatgagcaactgaagcagaacggtgggttagcatggtctgacgacgcggacgggggaaggggccgcgagatttcccgcgacttcgctaaactttatgaactcgacggagatccagaaagaaaagaatttcttgatgacctctttgtgttcatgcagaaaagagggaccccaatcaaccggatccctattatggccaaacagatcctggacctttatatgctgtacaaattggtcactgagaagggagggctcgtggagattataaataaaaagatatggcgggagattacaaagggtctgaatctgcccaccagtattacttccgcagccttcacattgagaactcagtatatgaaatacttatatgcatatgaatgtgaaaagaaagctttatcttccccagcagaactgcaggcagcaattgacggcaacagaagggagggcagaaggccctcttacagttcgtcactttttggctattcccccgcagccgctacagccgcggcagcggccggcgctccggctcttttatcaccccccaaaatcaggtttccgatccttggactcggtagctcttccggcaccaacacttcatcacctagaatttcccctgctactaccctgcgtaagggtgacggggcccccgtcacaaccgtacccgtgccaaacaggctggccgtccctgtaaccttggcgtcacagcaggccggcactagaactgcggccctggagcagctgcgagagcgactggagtccggagagccagcggagaaaaaggcctctagactcagcgaggaagagcaaagactggtgcagcaggcgtttcagcgtaacttcttcagcatggccagacaactgtctatcctctacgtgttctag

SEQ ID NO: 13899 - DNA, 7935 bp, Artificial Sequence
  Description of Artificial Sequence: Synthetic coding sequence
atgggtgagcacgggctcgagctggctagtatgattcccgccttgcgtgagctggggtcagccaccccagaagagtacaacaccgtcgtgcagaaaccccggcagattctctgccaattcattgaccggatactcactgatgtgaacgtggtcgctgtcgagttagtgaagaaaacagattctcaacccacatcagtcatgctgctggactttattcagcacatcatgaagagctcccccttgatgtttgtgaatgtcagtgggtctcatgaggccaaagggtcctgtatcgaattcagtaactggatcattacaaggctgctgcgcatcgccgcaacaccttcttgtcacctgttacacaagaagatatgtgaagtgatctgtagcctcctcttcctgtttaaaagcaagtctccggcaatttttggcgtgctcaccaaagaactgcttcagctctttgaggaccttgtctatctccacagacggaacgttatggggcacgcagtggagtggccagtggttatgagtcggttcctctctcagctagatgagcacatgggctacttgcaatccgcaccattacagctcatgtctatgcaaaacttggaattcatcgaggtcaccctcttaatggttctcacacgcataatcgcgattgtgtttttccggcgccaggaattgctgttgtggcagatagggtgtgtgcttttggaatacggaagccccaagatcaagtccctggctatttctttccttacagagttattccagctgggcggtttgccggctcagcccgctagcacctttttctcctccttcctggaattactgaagcaccttgtggagatggacaccgaccaattgaaactctacgaggagccactgagcaaactcattaagaccctatttccattcgaagcggaagcatatcgtaatatcgaaccggtgtacctaaacatgttactcgaaaaattgtgtgttatgtttgaagatggcgtcctgatgcgcttgaagagcgatctgctgaaggccgctttgtgtcacctgctgcaatacttcctaaaattcgtacccgccgggtatgagtctgctctgcaggttcgaaaggtgtatgtgcgcaacatttgcaaggctctgctagatgtccttggcatcgaggtggacgcagagtacctgttgggacccctatacgccgccctcaaaatggagtcaatggaaattatagaagagatccaatgtcagacacagcaagaaaatctgagcagcaactcagacggtatatcccctaaaaggcgtaggctttccagctccctgaatccaagtaagcgcgccccaaagcagaccgaagagatcaagcatgtggacatgaaccagaaaagcatactttggtccgccctgaagcagaaggctgagagcctgcagatctctctcgaatactccgggctgaaaaatcccgtgattgagatgttagaaggtattgccgtagtactgcaactcaccgctctttgcaccgtacattgttcccatcagaacatgaattgccgcacctttaaagactgtcaacacaaatctaaaaaaaagccctcagtggtaatcacctggatgtcacttgatttttataccaaagttctcaagtcctgtaggtccctgctggaatctgttcagaagctggatctggaggccaccatcgataaggtggttaagatctatgacgctctgatctatatgcaggtgaatagctcattcgaggaccacatcctcgaagatctctgtggtatgctgtctttgccttggatttactctcactctgacgacggctgccttaagctgaccactttcgccgctaacctgctaacactcagctgcaggattagcgacagctattcgccccaggctcagtcacggtgcgtcttcctgctcactctgttccctcgaaggatttttctggagtggagaactgcagtctacaattgggctctccagagttcacacgaagttatccgagctagctgtgtatccggattctttattctgctgcagcagcagaattcctgtaaccgggtgcccaagatcctgatcgataaggtcaaggacgatagtgatatagtgaagaaagaatttgcatctatcctgggacaattagtgtgcaccttacacggaatgttctatctaacgtctagccttacagagccgttttccgagcatggacatgtggatttattctgtagaaacctgaaggcaaccagccaacatgaatgctcttcaagccagctgaaagcctccgtatgcaagccgtttctgtttttgctgaaaaagaagatcccttcccccgtgaagcttgcgttcatcgataacctacatcatttgtgtaaacacctagattttcgggaggacgagaccgacgtgaaagccgtgctggggacactcctgaatctaatggaagacccggataaagacgtgagagtcgctttctccggtaacatcaagcacattttggagagcctggactccgaagatgggtttatcaaagaactttttgtgcttaggatgaaggaggcctacacacatgcccagatttctaggaacaatgagctgaaagacacactaattttgactacgggcgacatcggccgggccgctaaaggtgaccttgtaccattcgcgctccttcacctgctgcactgcctactttctaaaagtgcctccgtcagtggcgcagcctacactgagatcagagcgttagtggccgcgaaaagtgtaaagctccagtcgttttttagtcagtacaagaagcccatatgccagtttttggtggagagcctgcattcatcccagatgacagctctgcccaataccccctgtcaaaatgcagatgtaaggaaacaggacgtggctcatcagcgagaaatggctctgaacactctatctgaaattgccaatgtgtttgactttcctgacctcaatagattcctaaccaggacgttgcaggtgctcctgcccgaccttgctgccaaagcctctcctgctgcatcagcattaataagaacacttggtaaacagttgaacgtgaatcgcagagagatcctaattaataattttaagtacatctttagtcacctggtgtgttcctgctccaaggacgagcttgagcgcgccctgcattatctgaagaacgaaactgaaatcgagctggggagcctcttgcggcaggacttccaaggtctacacaacgagctcctgctcagaattggcgagcattaccagcaggtgttcaatgggctgagcatactggccagcttcgccagttctgatgacccataccaggggccaagagacattataagccccgagctgatggccgactatctccaacccaagctcttgggaatcttagctttctttaatatgcagctgctaagttcttccgtgggcattgaggataagaaaatggctctaaacagcctcatgtccttaatgaagttgatggggcccaagcacgtgagctctgttcgagtgaagatgatgacaacccttagaacagggttgagatttaaggatgacttccccgaattgtgttgtagggcctgggactgctttgtcagatgtttagaccatgcgtgcctcggttctcttcttagtcatgtcatcgtggcattgttgcctctgattcacattcagcctaaggagaccgcggctatcttccattacttaattattgagaatagggatgccgttcaggactttctacatgaaatatattttctccctgatcacccagagttgaaaaagattaaagcagtactgcaggagtatcgcaaggagacttccgagagtacggacctgcagactaccctccaactgtcaatgaaggccattcaacatgagaatgttgacgtcagaatacacgcactgacttcacttaaagagacattgtacaaaaatcaggagaaactgataaagtatgcgacggactcagaaacggtcgaacctattattagccaattagtgactgtactcctgaagggctgccaggacgcaaattctcaggccagactcctttgcggcgaatgtttgggagagcttggggccatcgatccaggtagattggatttcagtactacagagacccaggggaaggatttcaccttcgtaacgggcgtggaggactccagctttgcctacggcttattgatggagcttactcgggcatacttggcctacgccgacaattcacgcgctcaggattcagcagcatacgctattcaggagctgctgagcatttatgattgtagggaaatggagactaacggcccaggccaccagctttggaggcggtttccagagcatgtgcgcgaaatcctggaacctcacctgaacacccgctacaaatcctcccagaagagcacagattggtctggtgtgaaaaagccaatttacctgtccaagctgggaagcaactttgcagagtggtcagccagctgggcaggctatctcatcaccaaggtcaggcacgatctcgcgtccaaaatctttacttgctgttccattatgatgaaacacgatttcaaagtgacgatttacctgttgccccatattctcgtctatgtactcctcggctgtaatcaagaagatcagcaagaagtttacgctgaaatcatggcagtgcttaaacatgacgatcagcacacgatcaatacacaggatattgcgtccgatctttgtcagttatccacccagacagttttctccatgctcgatcacttgacacagtgggctcgccataagttccaggccctcaaggctgaaaagtgccctcacagcaaatcgaaccggaataaagtggactcaatggtttccactgtggactatgaggactatcaatctgtaacacggtttcttgacctgatccctcaggataccctggcagtggcctcgtttcgtagtaaagcatacactagggcagtaatgcacttcgagagctttattacagaaaagaaacagaacatacaggaacatctcggcttcctccagaagctgtacgctgctatgcacgagccggacggagtggcaggggtctctgctatccgcaaagcagagccatcactgaaggaacagatattagaacacgagtcattgggattattaagagatgccacggcgtgttacgacagagcgattcagttggaacctgatcagatcattcattaccacggcgtggtgaagtcaatgttgggcttgggtcagctttctactgtgatcacacaagttaacggcgttcatgctaaccgcagcgagtggacagacgagttaaatacataccgcgtcgaagctgcttggaagctctcacagtgggatctcgttgagaattatctagccgcagatgggaagagcacaacttggtccgtcagattagggcagttgctactctctgccaagaagcgcgatataaccgctttctatgacagcctgaagctggtgcgagccgagcagattgtgcccctctcagccgcgtcgttcgaacggggaagctaccagaggggttatgagtacatcgtaaggctacacatgctgtgtgaactcgaacacagtataaaacccctatttcagcacagccccggggatagctcccaggaggactcactcaactgggttgcgcgcttagagatgactcagaattcataccgcgctaaagagcctattctcgccctgcgcagggctcttctgtctttaaataaaagacctgattataatgagatggtgggggagtgttggctgcaatcagccagggtcgcacggaaggctgggcatcaccaaacggcatacaatgctttgcttaatgctggggagtcacgtctggcggagctgtatgtcgaacgggctaagtggttatggagtaagggcgacgtgcatcaggctctcatcgtgctccagaaaggcgtggagctctgtttccctgagaacgaaacacccccggaagggaagaacatgttgatccacgggagggccatgctgctggtggggcggtttatggaggagacggccaatttcgaatctaacgcaattatgaagaagtacaaagatgtgacagcgtgcctccctgaatgggaggacggccatttttatcttgccaaatactatgataagctgatgcctatggtcacagacaataagatggaaaagcagggggatctcatcagatatatcgtgcttcacttcggaaggtcccttcagtatgggaaccagttcatctaccagtcaatgcctcgcatgctcactctttggctcgattatggtacaaaggcctatgagtgggaaaaggccgggaggtctgaccgcgtccagatgcggaatgacttagggaagattaacaaagtgataaccgagcatactaactacctcgcaccttatcagtttctgaccgccttctcgcaactgatttcacgaatctgtcactcacacgacgaggtatttgtggttctgatggaaatcatcgccaaggtcttcctggcttatcctcagcaggccatgtggatgatgaccgcagtgagcaaaagctcttaccccatgcgcgtgaacaggtgtaaggagatcctgaataaagctatacacatgaagaaatctctggagaaatttgtaggtgatgctactcgcctgaccgacaaactcctcgagttatgcaataagcctgtggatggctccagcagtacccttagtatgtcaacccatttcaagatgctgaaaaaacttgtagaagaggctacctttagcgaaattcttatccctttacaaagcgtaatgatacctacactgccttccatcctgggtacccatgcaaaccatgcttcacatgaacctttcccaggacactgggcatatatcgcagggtttgacgatatggtcgagatactcgctagtcttcagaagccaaaaaagatttccctcaaaggctctgacggaaagttctatatcatgatgtgcaagcctaaagacgatctgcgcaaagattgcagactgatggaatttaattcactgatcaacaagtgcctgcgcaaggacgccgagagccgtcgtagagaactgcacatccggacttacgccgtcatcccccttaacgatgagtgcggcatcatcgaatgggtcaacaatacggccgggttaagacctattttgactaagctctataaagagaaaggagtgtacatgacaggcaaagagctgcgacagtgtatgctccccaagagtgctgccctgagtgaaaaacttaaggtttttagggagtttctactgccaaggcacccaccgatattccacgagtggtttttgcgcaccttccccgaccccacttcttggtactcatctcggtctgcatactgccggagcaccgcggtgatgtccatggttggttatatcttgggattaggggaccggcatggcgagaatattctattcgactcactgacaggcgagtgcgttcacgtggactttaattgtttattcaataagggcgagacatttgaggtacctgagatcgtcccatttaggctcactcataacatggtaaacggtatgggacctatggggaccgagggcctctttcggagggcttgcgaggttactatgcgcctgatgcgtgaccagagggaacccctgatgagtgtgctcaagaccttcctgcacgaccccctggtggagtggtcaaaacctgtgaagggacactccaaagctcccctgaacgaaacgggagaggtcgttaacgagaaggccaagacgcacgtcctcgacattgaacaaagactgcagggtgtcattaagacacgcaatcgggttactggacttcctctgtccatagagggacatgtgcactacctcatccaggaagctacagacgaaaatctgttgtgccagatgtacctcggttggactccctacatgtag

SEQ ID NO: 13900 - DNA, 7743 bp, Artificial Sequence
  Description of Artificial Sequence: Synthetic coding sequence
atgggggagcacggtctggagctcgcatctatgatacccgctttgagggagcttgggagtgcgacaccggaggaatacaatacagtcgtgcagaagccgagacagatactttgccagttcatagataggattctgacagacgtcaatgttgtcgcagtggagctcgttaagaaaacggacagccagccaacatcggtcatgttactcgatttcattcagcacataatgaaatcttccccactcatgtttgtaaacgtgagtggatcacatgaagctaaaggttcctgtattgaattttcaaattggattataacccgtctcctgcggattgcagccaccccctcctgccatctcttacacaaaaaaatttgcgaagtcatttgtagcctactattcctctttaagagtaagagtcccgccatctttggtgttctcaccaaggagctgctgcaattgttcgaagatctggtgtacctgcatcgaagaaacgtgatgggtcatgcagttgagtggcccgtcgtcatgagtaggttcctgtctcagctggatgagcacatgggctacctgcaatctgctccactacaactcatgtcaatgcagaacctcgagttcatcgaggtaacactcctcatggtgcttacaagaattattgctatcgtcttcttcagacggcaagagctgcttttgtggcagatcgggtgtgtgcttctggagtatggctctccaaagatcaagtctctcgccatctccttcttaacagagctgttccagcttgggggactccctgcacagcccgcatccaccttcttttcgagcttcctggagctgttaaagcatcttgttgagatggatacagaccagttgaaactatacgaagaaccactcagtaagctgataaaaacactgtttcccttcgaagcagaggcatacagaaacatcgagcccgtgtatttgaatatgctcctcgaaaagctgtgcgtgatgtttgaggatggtgttttaatgagacttaagtccgatttgttgaaggccgccctatgtcacctgctccagtacttcctgaaattcgtcccagcagggtatgaatcagcactgcaggtgagaaaggtctacgtccgaaatatttgtaaggccctcctggacgtgctcggcatcgaggtggatgccgagtaccttttgggcccactatatgccgcccttaaaatggagtcaatggagattatcgaggaaatccagtgccagactcagcaggagaacttgtcttcaaacagtgacgggattagccctaaaaggcggcgactctcctcctcgctgaatcccagcaagcgagctccaaaacagacggaagaccggacttttaaagattgtcagcacaagagtaaaaagaagcccagtgtggttataacgtggatgtctctcgacttctatacaaaggtcctgaaatcatgtcgatcgctgctcgagtcagttcaaaagttagacctcgaagccacgattgacaaggtcgtgaaaatctatgacgctctgatctacatgcaggtaaattctagtttcgaggaccacatcttagaagatttatgtggtatgctcagcctaccttggatttactctcactcagacgatggctgcctgaagctcactacctttgccgctaatctgctcacactgtcttgccgtatctcagacagttattcaccccaggcccagtcacgatgtgtctttctgcttacccttttcccacgacgcatattcttggaatggcgcactgccgtctataattgggctctgcagtcttcccacgaggtcatccgggctagctgtgtttctggtttcttcattctcctgcagcagcagaacagttgtaaccgcgtccccaagatattgattgataaagtgaaggacgacagtgacatcgtgaagaaggaattcgcaagcatcctgggccaattggtatgcacacttcatgggatgttttaccttacctcctctcttaccgaacccttttcagagcacggccacgttgatctgttttgtcgcaacttaaaagccacgtcacagcacgaatgttcatcttcccagctgaaggcgagtgtctgcaaacccttcctgtttttacttaagaaaaagatccctagccctgtgaagttagccttcattgataacctccaccatctttgtaagcacctcgacttccgcgaagatgagaccgacgtcaaggcagtgcttggcactctgctgaatctgatggaagaccccgacaaggatgtgcgtgtagcattttcagggaacatcaaacacatcctcgaatctctggattctgaagatggctttattaaggagctgttcgttctgcgtatgaaagaggcatacactcacgcccagatttctcgcaacaacgagctaaaggacacattgatcctcacaactggagacataggccgtgctgccaaaggagacctggtgccgttcgcgctgcttcacctgctacactgcctcttatcaaaatctgcgagtgtatctggagcggcctacacagaaatccgggctctggtcgcagccaagtccgtgaaattgcagagctttttttcacagtacaagaagcccatctgtcagttccttgtcgaatccttgcactcctctcagatgacggcgctgccgaataccccttgtcagaatgccgatgtacgcaaacaggacgtggcacaccagcgggagatggctcttaacaccctcagcgagatagcaaatgtcttcgactttcctgatttgaaccgttttctgacaagaacactgcaggttcttcttcctgatctggccgctaaagcttcccccgctgcctcagcgctgataaggactttgggtaagcagctgaatgtgaataggcgcgagattttgataaacaacttcaagtacattttttcccacttggtgtgtagctgctccaaagacgaactggaaagggcgttacattacttaaagaatgaaacagagatagaattaggctccctcttgaggcaagatttccagggactacacaacgagctgctgttgagaatcggggaacattaccagcaagtgttcaacgggctgagcatactcgcgtcatttgcctctagcgacgatccctaccaggggccaagggacattatttctcctgaactgatggccgattatcttcaacctaagttactgggcattctcgcattttttaacatgcagctgctctccagctccgtggggatcgaggacaagaagatggctctgaattcattaatgtccctaatgaaacttatgggccctaagcacgtctcctcagtgagggtgaagatgatgactacactacggaccgggctcaggtttaaggatgattttcctgaactgtgctgccgggcttgggattgtttcgtccggtgccttgatcatgcttgcttaggaagcttactctcacacgtaattgtcgccctgttaccccttattcacattcaacctaaagagacggcggccatcttccattacctgatcatcgaaaatagagatgccgtgcaggactttctccatgaaatctactttcttcccgaccatccggaactgaaaaagataaaggccgtcctccaagagtacagaaaagagaccagcgagagtacagacctgcagaccacactgcaactatctatgaaggccatacagcatgaaaatgtggatgtgcgcatccatgcactgacatctttaaaagagacactttacaaaaaccaagagaagcttattaagtacgcaacagatagtgagaccgtagaacctatcatcagtcagttggtgacagtgttgcttaaagggtgccaagatgccaacagccaagctagactgttgtgcggtgagtgtctaggagagctgggcgctatcgatcccggccgccttgatttcagtactactgagacacagggaaaggactttacctttgtaaccggggttgaggattctagttttgcctacggtctgcttatggaactgactcgggcgtatttggcgtatgctgacaacagccgcgctcaggattcggctgcttacgccattcaggagcttctgtcaatctatgattgtcgcgagatggaaactaatggccctgggcaccaattatggcggagatttccggagcacgtccgggaaattctggagccacatctgaatactcgttacaagtctagtcagaaaagtacggattggtcgggagtgaaaaaaccgatatatctgtccaaactgggatccaattttgctgaatggagtgcatcatgggccgggtacctcatcacaaaggtaaggcatgatctggcgtccaagatctttacttgctgctctattatgatgaaacatgacttcaaagtcaccatctacctgctcccgcacattctcgtctatgtactcctcggctgtaatcaggaggaccagcaggaggtgtacgccgaaatcatggccgtgctgaaacatgacgatcagcatactatcaacacccaagatatagctagcgatctctgccagctcagcacccagacagtgttcagcatgttagatcacctgactcagtgggcccggcataagtttcaggcgctgaaggcggagaagtgtccgcacagcaagtcaaacaggaacaaggtggattcaatggtttctacagtcgattacgaagactatcaatctgtgacccgctttctcgatctcattccacaggacaccctcgcggttgcgtcttttagaagcaaagcctatacaagagcagtgatgcacttcgaaagctttattactgaaaaaaagcagaatatacaagaacacctgggtttcctgcagaaactgtacgccgcaatgcacgagcctgacggagtcgcgggggtatctgccatcagaaaggccgagccatcactcaaagagcaaatcctggagcatgagtcgttggggctccttcgagacgccacagcttgttacgatcgggcaattcagctagagcctgaccaaattatccactaccacggcgtggttaaaagtatgttggggctggggcaactgagcacagtgatcacacaggtgaacggggtgcacgctaatcgaagtgagtggacagacgagttaaacacttatagggtggaggccgcttggaaactgtctcagtgggacttagtcgagaactacctggctgccgatggaaaaagcaccacctggagtgtacgcttgggacagctccttctgagtgcaaagaagagggacattacagcgttctatgattctctaaaactggtgcgcgccgaacagatcgtgccgctttcagccgctagtttcgagcggggttcctaccagcgtggttatgaatatatcgtgcgcttgcatatgctgtgcgaactcgagcactccattaagcccctatttcagcactctcctggcgatagctcacaagaagacagcctcaattgggtcgcccgccttgagatgactcagaacagttaccgagctaaggagccaatcttagccttacgccgcgcattgctatccctgaataagcgaccagattataacgaaatggtgggggagtgctggcttcaatcagcaagagtggctcgcaaagcagggcatcaccagaccgcttacaacgctttgctgaacgctggcgaatcacgactggcagaactctacgtggagcgcgccaagtggctgtggtccaagggagatgttcaccaggcgctcatcgtcctccagaagggcgtggaactctgctttcccgagaacgagacaccacccgaaggaaagaacatgcttattcacggccgggcgatgctgcttgtcggccgattcatggaggaaaccgccaacttcgagtccaatgcaatcatgaaaaaatataaggatgtgacggcttgtctgccagagtgggaggatggacatttttacctggccaaatactacgacaaactgatgcccatggttactgacaataaaatggaaaaacagggcgatcttattcggtatattgtcctgcacttcggacgctcactgcagtacggcaaccagttcatttatcagtccatgcctcgaatgctgactctctggctggactacggcactaaggcttacgagtgggaaaaggccggtcggagcgaccgggtacaaatgaggaatgatctcggaaaaatcaacaaagtgattactgagcacactaactacctggccccatatcaattcctgaccgcgttttctcagctgatatctcgcatttgtcactctcatgacgaagtttttgtcgtgctgatggagattattgctaaggtatttttggcttacccccagcaggcaatgtggatgatgaccgccgtcagcaagtcgtcttatcctatgcgagtgaacagatgcaaagaaattttgaataaggccatccatatgaaaaagagtttggagaagtttgtgggagatgctactcgattaacggataaacttcttgagctctgtaacaaacctgtggatggctcttcaagtactttgagcatgtcaactcacttcaagatgctgaaaaaactggtcgaggaagcaactttctcggaaatcctgatccctctgcaatcggtgatgatccccaccctgccgtccatattaggaacccatgcgaatcatgcatcacacgaaccatttcctggacactgggcatatatcgccggtttcgacgatatggtggaaatcctggcctcgcttcagaaaccaaaaaaaatttccctgaaaggatccgatgggaagttctatatcatgatgtgcaaaccaaaggatgacctccgaaaggattgtcgacttatggaatttaatagcctgattaacaagtgcctaagaaaggatgcggagtcgcgtcggcgcgaactgcacattagaacttatgctgtaattcccctgaatgacgagtgcggcatcatcgaatgggtcaacaatacagcagggcttcggcccatccttactaagctatataaggagaaaggcgtctacatgactggcaaggagctgaggcagtgtatgctaccaaagtccgccgccctgtctgaaaaattgaaagtctttagggagttcctgttgcctcgccacccccctatattccatgaatggttcctgcggacctttccagacccaacatcttggtattccagccgctcggcctactgccgcagtactgccgtgatgtcaatggtgggatacatcctgggactgggagatcggcacggagagaatatcctgtttgactcactcaccggggagtgtgttcacgtcgacttcaattgcctgttcaataagggggaaaccttcgaagtgccagaaattgtcccctttaggcttacacataatatggtgaatggaatgggcccgatgggaaccgagggcttgttccggcgtgcatgtgaagttactatgagactgatgagagatcagagggagcctctcatgagcgtgctgaagacttttctgcacgaccccttagtcgagtggtctaaacctgtgaagggccactctaaagctccgctgaacgaaactggcgaggtggttaatgagaaagctaagacccatgtgctggacatcgagcaacggctccagggcgtgattaagactcggaaccgggtgacaggtctcccgctgtctattgaaggacatgtgcattatctgatccaggaggctactgacgaaaatctgctgtgccagatgtacctcggatggactccgtatatgtag

SEQ ID NO: 13901 - DNA, 9171 bp, Artificial Sequence
  Description of Artificial Sequence: Synthetic coding sequence
atgagtctggtgttgaatgacctgcttatctgttgcagacagctggagcatgacagggcaaccgagcgtaagaaggaggtggaaaaatttaaacgcctgatccgtgacccagagactattaaacatctcgaccgccactccgactctaagcagggcaaatatctgaactgggacgccgtatttagatttttgcaaaagtatatccaaaaggagaccgagtgtttgcgtatcgcaaaaccaaacgtctcagctagtacccaggctagtcgacagaaaaagatgcaggaaattagctcactcgtgaagtattttataaaatgcgctaacagaagggccccgcggcttaagtgccaggagcttctgaactacatcatggacactgtaaaagatagttctaacggcgctatctacggcgccgattgtagcaatatattacttaaagatattttatcagtgcgcaagtactggtgcgagataagtcagcaacaatggctggagctgtttagcgtgtattttagactctatctgaaaccaagccaggatgtgcacagagtgctggtagcccgtatcatccatgcagtgactaaaggatgctgttcgcagactgatggccttaacagcaagtttttggatttcttttcgaaggctattcaatgtgcaaggcaggagaagtcgagcagtgggttgaaccatatcctggctgcactcaccattttccttaagacactggccgttaactttcgaattcgcgtgtgtgagttgggggacgaaattctccccacactgctgtacatctggacacagcacaggttgaatgacagtctcaaagaggtgatcatcgagctcttccaactgcagatctatatacatcaccccaagggcgccaagacacaggaaaagggggcatatgagagcaccaagtggcgtagcattctgtacaacctctatgacctcctcgtgaacgagataagtcatatcggcagcaggggcaagtactcctccggcttcagaaatatcgctgtgaaggagaaccttatagaactgatggcggatatatgtcaccaggtgttcaacgaagacaccaggagcttagagatttcacaaagctatactaccacacagagggaatcctcagactattccgtgccttgtaagcgcaagaaaatcgagcttggctgggaagttattaaagatcacctccagaagtcccaaaatgattttgatctggttccttggctccagatagccacccagctgatcagcaagtatccagcctctctaccgaattgcgagctgtcccccttactgatgatcttatcacaacttctgccacagcagcgccatggtgagcggacaccctacgtgctacgatgtttgactgaagtggccctttgtcaggataaacgaagtaacctagaaagtagccagaaatccgacctgcttaagttgtggaataagatctggtgcatcacttttcgcggcatctctagcgagcaaattcaggccgagaattttggcctgctgggcgcaatcattcagggctctctcgtagaggtagaccgcgaattctggaaactgtttacaggctccgcttgccgtccttcctgccctgcggtgtgttgccttacacttgctctcaccacctctatagtacctggaactgtcaagatggggattgagcagaacatgtgcgaagtcaataggtctttctcactgaaggagagcatcatgaagtggctgcttttttatcaactcgagggggatctggaaaatagcacagaggtgccacccattctccacagtaattttcctcatctggtgcttgaaaagatcttagtcagtttgacaatgaaaaattgcaaagcggcaatgaactttttccagagtgtcccagaatgtgagcaccaccagaaggataaagaggagctaagcttcagcgaggtggaggagctctttctgcaaactacttttgataagatggacttccttacgatcgtgcgcgagtgtggcattgaaaaacaccagagctcaattgggttctctgtgcaccagaatttgaaagagagcctcgacaggtgcttattggggctgtcggagcagttgctcaacaattactcctccgagattacaaactcggagacattggtgcggtgttcacgtttgctggtgggcgtgctaggctgttattgttacatgggcgtcatcgcagaagaggaggcctataagtccgagctgttccaaaaggctaagagtctgatgcaatgcgctggggagagcatcactctgtttaagaacaagactaatgaagagtttcgaatcggatctcttcgaaacatgatgcaattatgcactcgctgcctgtcaaattgtacgaaaaagagccctaataagattgccagtggcttctttcttcgactcctcacgtctaagctcatgaatgacattgctgacatctgcaaatccttggcttcatttatcaaaaaaccattcgatcgcggtgaggtggaaagtatggaagacgataccaacggcaacttgatggaagtggaggatcagagcagtatgaacctattcaacgattaccctgatagcagcgtctccgatgctaacgagcccggggagtctcaaagcactattggggctatcaacccattggccgaggagtacctgtctaagcaagatttgctctttctggatatgctaaaattcctctgcttatgtgtgaccacagctcagactaacacagtgtcatttcgagcagctgatattcggcggaagcttctgatgttaatcgactctagcactctggaacccaccaagagccttcatctacacatgtacctaatgcttctaaaagaattacctggcgaggagtaccccctccccatggaggatgtccttgagctactgaagccactctctaatgtatgctctctgtatcgtcgggatcaggatgtgtgcaaaactatcctgaatcatgttctgcacgttgtcaaaaacctcggacaaagtaatatggattctgagaatacacgtgacgcccaaggccagtttctgaccgttatcggagctttttggcacctaacgaaggagaggaaatacattttttctgtacgcatggctctcgtaaactgtttgaagacacttctggaggctgatccctacagtaaatgggctatcttaaatgtaatggggaaggatttccccgtaaacgaggttttcactcaatttctggctgacaatcatcatcaagtgagaatgttggctgcggagagtatcaaccgcctgttccaagacaccaagggggactccagcaggttgcttaaagctctccctctgaagctgcaacagactgcattcgaaaacgcatacctgaaggcccaggagggcatgcgtgaaatgagtcattctgcagaaaacccagagaccttggatgaaatatataataggaaatcggtactcctgaccctgatcgctgtggtgctctcctgtagccccatttgtgagaagcaggctctcttcgcgctgtgcaagtccgtcaaagagaacggactcgaaccgcatcttgtgaagaaagtcctagaaaaagtgagtgaaacctttggctatcgtcgcctggaggattttatggctagccacttagactatctggtgctggaatggctgaatttacaggacacagaatataaccttagttcatttcctttcatccttttaaattataccaacatcgaggacttttacagaagctgttacaaggtactcattccccatctggttatccgcagccatttcgacgaagttaagagcatcgcaaaccaaatccaagaggactggaagtccctcctgacggactgcttccctaaaatcttagtgaatatcctcccatacttcgcttatgaaggcacaagagatagcggcatggctcagcaacgagagaccgctacaaaggtctacgatatgctcaaatcagagaaccttttgggaaaacagatcgatcatctcttcatatcaaaccttccggagatagtagtagagctcttgatgacgctccacgaaccggcaaatagctccgcatcacagagcaccgacctgtgtgatttcagcggtgacctggatcccgccccgaatccacctcacttcccgagtcacgtgatcaaggccacgtttgcatatatcagcaactgtcacaagaccaagctgaaatccattctcgaaatactctctaaaagtcctgactcctaccagaagatcctgctcgcgatttgcgaacaggctgcagagacaaacaacgtctacaaaaagcatcggatcctaaaaatctatcacttgttcgtttcactgctgctgaaggatattaaatctggactgggcggtgcttgggcctttgttctgcgggacgttatttacactctgatccattacattaaccagcggccaagctgtattatggacgtctcccttcgctcgttttctctttgttgtgatctgctgtcacaggtatgtcagaccgccgtcacctactgtaaagacgctctggagaatcacttgcatgttatcgtcggcaccctgattccactagtttacgaacaggtagaagtccagaaacaggtgctcgatcttttaaagtacctagtgatcgataacaaggataacgaaaacctgtatattacgatcaagctcttggacccatttccagaccatgtggtttttaaggatcttagaattacgcagcagaagattaaatattccaggggtcccttctcactactggaggagattaaccacttcctgagcgtttcagtctacgacgctctcccgcttacacgcctggagggccttaaagatttacggcgtcagctggagcttcataaagatcagatggtagacattatgcgggcgtcccaggataaccctcaagatggcattatggtaaagctggtcgtaaatctgttgcaactgtcgaaaatggcaatcaatcataccggtgaaaaagaggtgctcgaagccgtgggctcctgccttggagaagtcgggcccatcgactttagcacaatcgcaattcagcacagcaaagatgcttcctacaccaaggccctcaagttgtttgaggataaggagctccagtggacatttatcatgttgacttatttgaacaacacactggtggaggattgtgttaaagtgcggagcgcagctgtcacctgtctgaaaaatatcttggccaccaaaactggccatagcttctgggaaatttataagatgacaaccgaccctatgttagcctatcttcagccattcaggacatctaggaaaaagtttctggaagtgcctaggttcgataaagagaaccccttcgaaggtctagacgacataaatctttggatcccactctccgagaaccacgacatttggatcaagacactcacatgcgcttttctagattccggcggcactaagtgtgagatcctgcaactcctaaagccgatgtgcgaagttaagactgacttctgtcagaccgtgttaccgtacctgattcatgatattctcctgcaggatactaatgagagctggcggaacctgctgtccacccacgtccagggcttcttcacaagctgcctacgacacttttctcagacatctaggtccacgaccccagctaacctcgattccgagtcagagcacttctttagatgctgcctcgacaaaaaatcacagcgtaccatgctggccgtcgtggactatatgcggcgccagaagcgcccgagtagcggcactatattcaatgacgccttttggctcgatctgaactacctggaggtcgcaaaagtcgcgcaatcatgcgcagcccacttcacggccttgctgtatgctgagatttatgcagacaaaaaatccatggacgatcaggagaaacgcagtctggcattcgaagaaggctctcagaacaccactatttcctccctgtcagaaaaatctaaggaggagaccggaatttccctccaggacttacttctcgagatttacagatctattggggagcctgacagtctgtacggctgcggcggtggtaaaatgttacagccgatcactagactgaggacctacgagcatgaagccatgtggggcaaagcccttgtgacatatgacctggagaccgccattcccagtagtacccgccaggccggtattatccaagccttgcagaatctcgggttgtgtcatatcctcagcgtgtatctgaaaggtctggactacgagaacaaagactggtgtcctgagcttgaggaactgcactaccaagcagcgtggaggaacatgcagtgggatcattgcacatccgtgtccaaggaggttgagggaaccagttaccacgagtctctgtataacgcacttcagagtctgcgagaccgtgagttctctacattttatgagtcattaaaatacgctcgcgtgaaagaagtggaggagatgtgcaagagatcactcgaatcagtgtactcactgtacccgacccttagcaggttgcaggctatcggagagcttgaatccattggcgaacttttttctcggtcagtcacccacaggcagttatctgaggtgtacattaaatggcagaagcatagtcaactcctgaaggactccgacttctcttttcaagagcctatcatggcactccgaaccgtcatcctagaaatccttatggagaaagaaatggacaacagtcagcgagagtgcataaaagatattcttactaaacatctagtagaattgtctatcctggcacgaactttcaagaatacgcagctccctgagagggcaatctttcagattaaacagtataactcagtgtcttgtggagtctcagagtggcagttggaagaggctcaggtattctgggccaagaaagaacagagcctggccttgtccatactgaagcaaatgatcaaaaaacttgacgcctcttgcgccgccaataacccgtcactgaaactgacctatacagaatgtctcagggtttgcgggaactggctcgcggagacatgtcttgagaaccctgccgtgataatgcaaacttacttggaaaaggcggtggaggtggccggcaattacgatggagaatcgtccgatgaactgcggaacggcaagatgaaagccttcctgtccttggccaggttttcggacactcagtaccagagaattgagaattacatgaagtcatcggagttcgagaacaaacaggccttgctgaaacgcgctaaagaagaggtaggcctgttacgggagcacaagatccagacgaacagatacacggtgaaggtccaacgcgagttggagctggatgaactggccctgcgcgcccttaaggaagatcgcaagaggtttctctgcaaggccgtggagaattatatcaattgcctgttgtccggcgaggaacatgacatgtgggtgtttcgactgtgtagcctctggctagaaaacagtggagtgtctgaggtgaacggcatgatgaaacgagacggcatgaaaattccaacatataagttcctgcccctcatgtaccaactcgccgccaggatgggcaccaagatgatggggggcctggggttccacgaggtgctgaacaatcttatctctaggatctcaatggaccatccgcaccataccttgtttattattcttgctctggctaacgcaaaccgcgatgaattcctgacaaagccggaggtagctagacgctccaggataaccaagaacgtccctaagcagagctcccagttggatgaggaccgcactgaagcagcaaataggatcatttgcacaataagatccaggcgaccccagatggttcgcagtgtagaggccctctgtgacgcatatatcattctggccaatttagatgccacccagtggaagactcaaaggaaaggcattaatatccccgccgaccagccaattactaaactgaaaaatcttgaggacgttgtggtccctacaatggaaatcaaggtcgaccatacaggcgagtatggcaatctggtgactattcagtcttttaaagcagagtttcggctagccgggggggttaacctccctaaaattatcgattgcgtggggtcagacggaaaagagaggcgacagttagtgaagggacgggatgaccttcgacaggatgcggtgatgcaacaagtttttcagatgtgcaacacactgctgcagagaaatacagagacacgaaagaggaaactcactatttgtacatacaaagttgtccccctgagccagaggtcaggtgtcttggaatggtgtaccggcactgtgcctattggcgaatttcttgtgaacaatgaggatggcgcacacaaacgatatagacctaatgacttttcagcctttcagtgccagaaaaaaatgatggaagtacagaaaaagtccttcgaggagaagtatgaggtgttcatggatgtctgccagaacttccagcccgtgtttaggtacttctgtatggaaaagtttcttgatcccgccatatggtttgagaaacgcttggcttataccaggtctgtggctacttcaagcatcgtaggttatatactgggtctgggggaccgccatgtgcaaaacatcctcataaacgagcagtctgcagagctcgttcacattgacctgggcgtggccttcgaacaaggtaaaatactgccgacccccgaaaccgttccctttagactgacacgggatatcgtggatgggatgggtatcactggggtcgaaggcgtttttcgccgatgttgtgagaaaacaatggaggtcatgagaaactctcaggagactttactgacaatagtggaggtcctgctgtacgatcctctgttcgattggacgatgaatcccctgaaggctctgtacctccaacagagaccggaggatgagaccgagctgcacccgacgttgaatgcggacgatcaggagtgcaaacggaaccttagtgacattgaccaaagtttcaacaaagttgccgagcgtgtgctgatgagactgcaggaaaagctgaagggggtcgaagaaggcacagtgctgagtgtaggagggcaggtcaatctgctgatccagcaggcgatcgatcccaaaaatttatctcgactgtttcctggctggaaagcatgggtgtag

SEQ ID NO: 13902 - DNA, 417 bp, Artificial Sequence
  Description of Artificial Sequence: Synthetic coding sequence
atgactctgcacgaacctgccaactcaagtgcatcccagtctacagatctctgtgacttcagcggagatcttgaccccgctccaaatcctccccactttccatcgcacgtcataaaagctacattcgcttacatcagtaattgtcataaaaccaagctgaagagtatcctggaaatcctgtccaaaagtcccgattcctaccagaaaattctactggccatctgcgagcaggcagccgaaaccaacaatgtgtataaaaaacatcgcatcctcaaaatctaccatctgttcgtgtctttactattgaaagacattaagagcggattaggcggggcctgggctttcgtgctgcgcgatgtgatctacacacttatccattacattaatcagcgcaaactaactatcttctctcaatag

SEQ ID NO: 13903 - DNA, 9171 bp, Artificial Sequence
  Description of Artificial Sequence: Synthetic coding sequence
atgtcgctggtgctgaacgatctgctcatctgctgcagacaacttgagcatgacagagcaaccgagaggaaaaaagaagtggagaagtttaagcgactgatccgcgatccagagacaatcaagcatctggacaggcacagcgacagtaagcaaggtaagtaccttaactgggacgctgtatttcgcttcttacagaagtacatacagaaggagactgagtgcctgaggattgccaaacctaacgtgagtgcaagcacccaggcaagtagacagaagaaaatgcaggagatctcctcactcgtcaagtactttatcaagtgcgccaaccgccgggctccacgcctcaaatgccaggagctgctgaattatattatggacacggtcaaggacagtagcaacggcgctatatacggagctgactgctctaacatcctcctgaaggacatcctgtcggtgcgcaaatactggtgcgaaatttcacagcagcagtggcttgagttgtttagcgtatattttagactgtatctgaagccaagtcaagatgttcatcgggtgctggtcgctagaatcatccacgctgtgaccaaaggatgctgcagtcagaccgacggactgaattccaagttcttggatttcttctctaaggctatccagtgtgcgagacaggaaaagagttcatctgggcttaaccacatcctggccgcactgactatcttcctgaagacactggccgtcaactttcggatccgggtctgtgagctgggggatgagattctgcccacacttctctatatttggacgcagcatagattgaatgactccctaaaagaggtgatcatagagctgttccagctacagatctacatccaccatcccaagggagccaaaacccaggagaaaggagcgtacgagagcactaagtggcgcagcatcttgtacaacctgtacgacctgcttgtgaacgaaatctcgcacattggcagtagaggcaagtatagctccggcttcaggaacattgccgttaaagaaaacttgattgagcttatggctgatatttgccatcaggtttttaatgaggacacccgatcgctggagatctctcaaagttatacgactacccaacgcgaaagtagtgactacagtgtgccttgcaaaaggaagaagatagagttaggctgggaggtaatcaaggaccaccttcagaagagccaaaacgacttcgatctggttccttggttacaaattgcaacacaacttattagcaaatatccagccagcctccctaattgtgagctgtccccactcctcatgattctgtcgcagctgctgccacagcaacgccatggggaacgtacaccatatgtcttgcgatgtcttactgaagtcgcactctgccaggacaagcgatcaaatctggagtcctcgcaaaagtccgatttgctgaagctgtggaataagatctggtgcattacattccgcggcattagctcagaacagattcaggccgaaaactttggtctgctcggtgccatcattcaaggctcgctcgtggaggtggacagagagttttggaaactcttcacagggtccgcctgtcggccatcctgcccggctgtttgttgtcttaccctcgcactgacaactagcatagttccaggcaccgtaaaaatgggcatcgaacaaaatatgtgcgaagtgaacaggagcttcagcctgaaagagagcatcatgaagtggctgctgttctaccaattggagggcgatctggagaactcgaccgaagtccctcctatcctgcattccaattttcctcatctggtcctcgagaagatccttgtatccctgaccatgaagaattgtaaggctgctatgaacttttttcagagtgtaccagagtgcgaacaccaccagaaggacaaggaagagctgtcattcagcgaggtcgaagaactcttcttacagactaccttcgataagatggactttttgacgattgtccgcgagtgcggcattgagaagcaccagtcttctataggattcagcgtgcatcagaatctgaaggagtccctggacaggtgccttcttggtctctcggaacagttgctcaataattacagtagcgaaatcactaactctgagactcttgtgcgatgttctaggctgctcgtcggagtgctagggtgttactgctacatgggtgtgattgctgaggaggaggcttacaagtccgaacttttccagaaggccaagtctctgatgcagtgcgccggtgagtccattacactcttcaaaaacaagaccaacgaagaatttagaattggttccctccggaatatgatgcaattgtgtacccgctgcttgagtaattgcacgaagaaaagtcctaataagatagcaagcgggttttttctgaggctgcttacgagcaagctcatgaatgatattgctgacatttgtaagagcctggctagcttcataaaaaagccttttgacaggggagaggtcgaatcaatggaagacgatacgaatggaaatctaatggaggtggaagatcagagttctatgaacctttttaatgactatccggatagcagtgtgagcgacgctaacgaacccggcgagtcgcagtcgaccataggcgctatcaaccctctggccgaagagtacctgtccaaacaggacctgctgttcttagacatgctgaagttcctgtgtttatgtgtgacaaccgcccagaccaacaccgtctcattccgcgccgctgatatcagaagaaagctgcttatgctgatcgattcttctactctggaacccaccaaatcccttcacttgcacatgtatctgatgctcctgaaagagttgcccggcgaggagtatccactacctatggaggacgtcctggaactgctgaagcccctgtctaatgtgtgttctctttacagaagggatcaggatgtgtgtaaaaccattctcaaccacgttttgcatgtcgttaagaatctgggtcagagtaacatggatagcgaaaacaccagggatgcgcagggtcaattcctcactgtgatcggtgcgttctggcatctgaccaaggaacgcaagtatatcttttctgtgcggatggccctcgtgaattgcctcaagactctgctggaggccgacccatattcgaaatgggccattctgaatgtcatgggcaaggattttcccgtaaacgaagtgtttactcagttcttagctgacaaccatcatcaagtgagaatgctggcggccgagtccatcaatcggttattccaggataccaagggagacagtagcaggttactgaaggcactacctctgaagctgcaacagaccgcatttgagaatgcatacctgaaggcccaggaaggcatgagggagatgtcccactctgccgagaatcccgaaactctggatgagatctacaatcgcaaatccgtattattgactctgatcgccgtggtcctgtcatgtagtcccatctgcgagaagcaggccctctttgccctgtgcaagagcgtcaaagaaaatgggctcgagccgcaccttgttaagaaagtgcttgagaaggtgagcgaaacgttcggttaccggcggcttgaggacttcatggcatctcatctggactacctggttcttgagtggcttaacctccaggatacagagtacaacctgtcctcattcccgtttatcctgcttaactataccaatatcgaggatttttatcgttcctgttataaggttttgataccgcatcttgtgattcggagccactttgacgaggtgaaatccattgctaaccagattcaggaggactggaagtctcttttaaccgattgctttccaaaaatactcgttaacatcctgccctacttcgcatatgaaggaacacgggattccggcatggcgcagcagcgcgagaccgctacaaaggtgtatgacatgctaaaatcagagaacttactgggaaagcagattgaccacttgttcattagcaacctcccagaaattgtggtggaattgctgatgaccctgcatgagcccgccaattcctctgcttcacagtcaacagacttgtgcgactttagcggagatttggaccccgctcctaacccgccacatttccctagtcatgtaatcaaagctactttcgcatatatctctaattgtcacaagactaagctgaagagtatcttagagatcctttccaagtcccctgactcttatcaaaaaatactcctcgctatatgcgagcaggcagccgaaaccaacaacgtgtacaagaagcatcgcattttaaagatctaccatctatttgttagtttactgctgaaggacatcaaatctggattgggcggtgcctgggcattcgtgttgagggacgtaatttacaccttaatccactatataaaccaaagaccttcatgtatcatggatgtgtctctcagaagcttcagcctgtgttgtgatttgctgagtcaagtgtgccaaactgctgttacctactgcaaggacgcgctggagaatcatctccatgtgattgtaggaaccctgattcctttggtgtatgagcaggtggaggtgcagaagcaagttctggatctgctgaagtatttggttattgataacaaggataacgagaacctgtacataactatcaaattgctggatccttttccggaccacgtagtttttaaggacctgagaattacccagcagaaaataaaatattctcgcggaccctttagtctgctggaggagattaaccacttcctctcagttagcgtctacgatgcactgcccctcactcgactggagggattgaaggatctgaggcgacaactagagctgcataaggaccagatggtggatatcatgcgggcaagccaagacaacccgcaggacggaatcatggttaagctcgtcgtgaacctattgcagctctccaagatggccatcaaccacacaggagaaaaagaggtgctggaagctgtgggcagctgcctgggtgaggtgggcccaatagacttctcaactatcgctattcagcactctaaagatgcgtcatacaccaaggccctgaaactcttcgaagacaaggagctgcaatggacgttcataatgttaacttacctaaacaatacgctggtggaagattgcgtcaaggtcaggtccgcagcagtaacttgtctcaaaaacatcttagccacaaagacaggacattctttttgggaaatctacaagatgactacggacccaatgctggcctatctgcaaccattcaggaccagtcgtaagaaattcttggaagttcccaggttcgacaaggaaaaccccttcgaggggcttgatgatattaacctttggatccccctctccgagaaccacgatatatggattaagaccttgacctgtgcttttcttgactcgggaggtaccaagtgcgagattcttcaactgctgaagcccatgtgcgaggttaaaacagatttctgtcaaacagtgctcccctacctgatacatgacattctacttcaggataccaacgaatcttggagaaatttattatcaactcacgtccaaggcttcttcacgtcatgcctgaggcattttagtcaaactagcaggtctacgacccctgctaatctggattccgagtctgagcacttcttcaggtgttgtctggacaagaaatcccaacggaccatgctggcagtggtggactatatgcggagacagaagagacctagttcgggtaccatttttaacgatgctttttggctcgacctgaattatctggaggtcgcgaaggtggctcagagttgcgctgctcatttcacagctctgctctatgctgagatatatgcagataagaagagcatggatgatcaggagaaaagatctctggcctttgaagaggggagtcagaatacaactatctcctcactcagtgagaaaagtaaggaggaaaccggcataagcctgcaggacttactgttagagatatatagatctattggtgagcccgacagtctctatggctgcggcggagggaagatgctccagcctattacccgcctacggacatacgagcacgaggcgatgtgggggaaagccctggtgacttacgatctggaaactgcaattccctcctcaaccagacaagccgggataattcaggctctgcagaatttgggcctgtgtcatatattgtctgtgtatctgaaaggtttggactacgagaataaagattggtgtccagaactcgaggagctgcactaccaggccgcctggagaaatatgcagtgggatcactgtacaagtgttagtaaggaggtggaaggcacctcataccacgagagcctgtacaatgccctgcaaagtctccgggatagggaatttagtactttttatgaaagcttgaagtacgcccgcgtcaaggaggtggaagagatgtgtaaaagaagtcttgaaagtgtgtacagcctttaccctacgttgtctcgtcttcaggctataggggagctcgaatcgatcggcgagctgtttagccgcagtgtgacacaccgacagcttagtgaggtgtacattaagtggcagaagcattcacagctgctgaaagactctgacttttcattccaagagcccattatggccctgcgtaccgtaatacttgaaatacttatggagaaggagatggacaactcgcaaagggaatgtatcaaagacattctaaccaagcaccttgttgaactctcaatcttagctagaactttcaagaacacccaactgccagagagagccatcttccagataaaacaatacaacagcgtgtcctgtggagtctctgagtggcaacttgaagaagcccaagttttttgggcaaagaaggagcagtctttggcactgtctatcctgaagcagatgataaagaagctggacgccagctgcgctgctaataatcctagcttgaagctcacttataccgagtgtctgcgcgtgtgtgggaattggctggctgaaacatgcctcgagaaccctgctgtgatcatgcagacctacttagaaaaagccgtggaggtggccgggaactacgacggagagagctcagatgagttgaggaacggaaagatgaaagccttcctaagtttggcaaggttctctgacacacagtaccaaagaatcgaaaactatatgaaatcctcggaatttgagaacaagcaggctctgctgaagcgggccaaagaagaagtgggccttcttagagaacacaaaattcagactaatcggtacaccgtgaaagtacaacgcgagctggaactcgatgagctcgcattgcgggctttgaaagaagaccgaaaaaggttcctatgcaaggccgtggagaactacatcaattgtcttctatctggggaagagcatgacatgtgggtttttaggctgtgttcactgtggctcgagaattccggggtcagcgaagtgaacggcatgatgaaaagggacggtatgaagatacccacatacaagttcctgcccctgatgtaccaactagcagcgagaatgggaactaagatgatgggcggccttggtttccacgaagtgttaaataatctgatttctagaatcagcatggatcatccacaccacactctcttcataatcctcgccttggctaacgccaatcgcgacgaattcctaaccaaacccgaggtagcccgccggagtagaatcacaaaaaatgtgcccaagcagtcttcgcagctggacgaggatagaactgaagcagccaaccgcattatttgtaccatacgaagccgccgcccccagatggtacgctctgtagaggccctgtgcgacgcatatattatcttagcgaatctggacgcgacccagtggaagacacaacgcaagggtatcaacattcctgccgatcagcccattacgaaactcaagaacttggaagatgtggtagtgcctaccatggaaatcaaggtggatcacactggggagtacgggaatttggtcaccattcagtcctttaaggcggaatttaggctcgctggcggcgtgaacctgccaaaaatcattgattgcgtcggctccgacggcaaagaacggcgccagcttgtgaaagggagggacgatctgcgccaggatgccgttatgcagcaggtttttcaaatgtgtaacactcttctgcaacgtaacaccgaaaccaggaaacgcaaacttaccatttgtacatataaggtcgtgccgctttctcagaggtcaggggtgttagagtggtgcacaggtaccgtgccaattggtgagttcctagttaataacgaggatggcgcccataagaggtacaggcctaatgactttagtgctttccagtgccagaagaaaatgatggaagtgcaaaagaagtcgttcgaagaaaaatatgaagtctttatggacgtgtgtcagaatttccagccggtgttccgctacttttgtatggagaagtttctggaccccgccatctggtttgaaaagcgtttggcgtacacccgaagtgtcgccacctcaagtattgttggctacatcctggggctgggcgataggcacgtccagaatatccttataaatgaacagagtgcagagctcgttcatatcgatctaggcgttgccttcgagcagggtaagattctgcccacccctgagacagttccattccgactaacgcgtgacatagtggatggaatggggattacaggcgtggagggggtcttcaggaggtgctgcgagaagaccatggaggtcatgaggaattctcaagagaccttgctgaccattgttgaagtgctcctgtatgaccccctatttgactggactatgaaccccctgaaggcattgtatttacagcagaggccagaagacgagaccgagttacaccctaccctaaacgcagatgatcaggaatgcaagcgcaaccttagtgacatagaccagtcttttaataaagtggccgagcgggtgctgatgaggctccaagagaagctgaagggagttgaagaaggcaccgtgcttagtgtggggggacaggtcaatcttcttattcaacaagcgattgaccctaagaacttgtctagactgttccccggttggaaggcctgggtgtag

SEQ ID NO: 13904 - DNA, 4110 bp, Artificial Sequence
  Description of Artificial Sequence: Synthetic coding sequence
atgtccctggtgcttaacgacctacttatttgctgccggcagctcgagcacgaccgcgctaccgagagaaagaaagaagtggaaaaattcaaaaggctcatccgagacccagaaactatcaagcatcttgaccgccattccgacagtaaacaaggaaaatacctcaactgggacgctgtgtttaggtttctgcagaaatatattcagaaggagaccgagtgtctcagaattgcaaaaccgaatgtaagcgcctcaacccaagctagcagacagaaaaaaatgcaggaaatttcttccctggtcaaatacttcataaagtgcgccaaccgtagggctccacgtcttaagtgccaggagttgcttaattacatcatggataccgttaaggatagttctaatggggctatatacggggcagattgttccaatatcctcctgaaagacatcctgagtgtgaggaagtactggtgcgagatctcgcaacaacaatggctggaattgtttagcgtgtactttcgcctatatctgaagccaagccaggatgtccacagagtgttagtggcacgcatcattcatgccgtcactaagggttgctgtagccagactgatgggctcaatagcaagttcttagatttcttcagcaaggctattcagtgtgcccggcaggagaagtcgtcatcaggacttaaccacattctggctgccttgacaatatttcttaaaaccctggccgtgaactttcggatccgcgtgtgtgagctcggagacgagattttgccaacactgctttatatttggacccagcataggttgaacgattccctgaaggaggtcatcatcgagctcttccagctgcagatctatatccaccaccctaaaggagctaagactcaggaaaaaggagcttatgaaagcacaaaatggcgctccattctctataatctgtatgacctcctggtgaacgaaatatctcacatagggtcccggggcaagtatagctcgggattcagaaatatagctgtgaaggagaatctgatcgaattaatggcggacatctgccatcaggtgttcaatgaggatacacggtcgttggaaatttcacagtcttataccacaacccagcgcgagtctagcgactattctgttccctgcaagcggaaaaaaattgagctgggatgggaggtaatcaaagatcatttgcaaaaatcccaaaacgacttcgacctggtgccatggctgcaaattgcgactcaattgataagcaagtaccccgcgtccctgccgaattgtgaactgtctccactgctgatgatcctcagtcagctcctgccccagcaaagacacggagagcggacaccatacgttctgagatgcttaacagaggtggccctgtgccaggataaaagatcgaacttagaatcgtctcagaaaagcgatctcttgaaactctggaataagatttggtgtatcacttttaggggcataagctcagagcagatccaagccgagaactttgggcttctgggtgcaattattcaggggagtcttgtggaagtcgatagagaattttggaagctgtttactggcagtgcttgtagaccttcatgccctgctgtttgctgcctcacccttgcactgaccacatccatcgttcccggaacagttaagatgggaatcgaacagaacatgtgcgaagtcaataggagtttctccctcaaagagagcatcatgaagtggttgctcttttatcagctggaaggagacctggagaattcgactgaggtcccacctatccttcattccaacttcccccatctcgtcctggagaagatcttggtaagtctcactatgaaaaactgcaaggctgctatgaatttctttcagagcgtacccgaatgtgagcatcatcagaaggacaaagaggagctatccttcagtgaggtagaagagctgttcctgcagacaaccttcgacaaaatggactttttgactattgttcgtgagtgcgggattgagaaacaccagtctagcatcggattttcggtgcaccaaaatctaaaagagtctctagaccggtgcctgctgggcctgtccgaacagctcctgaataattacagttctgagatcactaatagtgagacgctggtgagatgcagtcggttgctcgtcggagtattggggtgttattgttacatgggcgtgattgccgaagaggaagcctacaaaagcgaactcttccagaaagcaaagtcactgatgcaatgtgcaggcgagtccatcacactgttcaaaaacaagactaatgaggagttccggatcggcagcctaaggaatatgatgcaattatgcacacgctgcctgagtaattgcacaaaaaaaagccctaataaaattgcctctggttttttcctgagactattgacctctaaactgatgaacgatatcgccgacatttgcaagagcctggcatctttcatcaaaaagccatttgacagaggggaggtagaatcaatggaggacgacactaacggaaatctcatggaggtggaagaccagtcctccatgaacctatttaacgattacccagattcctccgtttccgacgcaaacgagcctggcgagagtcagtccactattggagccatcaacccactggctgaggagtacctatctaagcaggatttgcttttcctcgatatgttgaaatttctctgtctgtgcgttaccacagcgcagactaatactgtgtcatttagagcagccgatattaggcgcaaactcctgatgttgatcgattcgtccacccttgaacctacaaagtctctacatctgcacatgtacctgatgcttcttaaggaactgccaggcgaagaataccccctccctatggaggacgtgctggaactgttaaaaccattgtccaacgtctgcagcctctatcggcgagaccaggacgtgtgtaaaaccattcttaaccatgtgctgcatgtggtcaaaaatctgggccagagtaatatggactccgagaatacccgggatgcccagggccagtttctgaccgtgatcggggctttttggcacctgacaaaagaacgtaaatatattttttccgttaggatggccctggtcaattgcctaaaaaccctactcgaggcagatccctattcaaagtgggctattctgaacgtgatgggcaaggactttcctgttaacgaagtgttcacacagttcctggctgacaaccaccaccaggtgcgtatgctggctgcagagtccattaacagattgtttcaggacacaaaaggcgattctagccggttactgaaagccctacccttgaaactgcagcagaccgcattcgaaaatgcgtatctgaaagcccaggaaggtatgagggagatgtctcactctgctgagaaccccgagacattggacgagatctataaccgaaaaagtgtgctcttgaccctcatcgctgtggtgctctcctgtagcccaatttgcgaaaagcaagctttattcgctctctgtaagagtgtcaaggagaatggccttgagccccacctagtcaaaaaagtgctagagaaagtgagcgagacgttcggttataggaggttggaggacttcatggcctcgcacctagattatctggtgctggaatggctgaatcttcaggacaccgaatacaatctttcttcttttcccttcattttgctgaattacaccaacatcgaggacttttacagaagctgctataaagtgctgatacctcatcttgtgattcgatcccacttcgatgaggtaaagtcaattgctaaccagattcaagaggactggaagtccctattgacagattgcttccctaagatcctggtcaacatcctaccatacttcgcctacgaggggaccagagacagtggcatggctcagcaacgagagaccgcgaccaaggtttatgatatgctgaagtcagagaacttgttgggaaaacagatcgaccacctgttcatttccaatctgcccgaaattgtggtggagctgctaatgacactgcacgagcccgccaactcaagcgcttctcagtctactgacctgtgcgatttctcatag

SEQ ID NO: 13905 - DNA, 282 bp, Artificial Sequence
  Description of Artificial Sequence: Synthetic coding sequence
atgagcctggtgctcaatgatttgctgatttgttgccgccaactggagcacgatagagcgacagagcgcaagaaagaagtggagaagttcaagagactgatcagggaccccgaaaccatcaagcacctcgataggcactccgatagcaaacagggaaagtacctcaattgggacgccgtgttcagatttctgcagaaatatattcagaaagagacggagtgtctcagaatagcaaaaccgaacgtgtcggcatcaactcaggccagccggcaaaaaaaatag

SEQ ID NO: 13906 - DNA, 921 bp, Artificial Sequence
  Description of Artificial Sequence: Synthetic coding sequence
atggagtccatatttcatgagaagcagccctcaggtaacatggatgactctgggtttttcagtatccaagttatcagtaatgcactcaaggtttggggattggagttaatactatttaactcacctgaatatcaacgcctgagaatcgatcccatcaacgaacggagtttcatttgtaattacaaagaacattggtttactgtcagaaaactggggaagcagtggtttaatctgaattccttactgactggacccgagctcatttccgatacttacctcgcactgttcctggctcagctacaacaagaaggctattccatttttgttgtgaagggggacctgccagattgtgaggctgaccagcttctacaaatgatccgggtgcagcagatgcatcggcctaagctgataggcgaggaattagcgcagctgaaggaacagcgagtgcataaaacggacctggaacgagttctggaggcaaatgacgggtccggcatgctggacgaggacgaggaggacctacagcgcgcactggcactctctcgacaggagatagacatggaggacgaggaggcagatttgaggcgggccattcagctgtcaatgcagggctcaagcagaaacattagtcaagacatgacacagactagcggcacaaatctcacctccgaagagcttcgcaaacgcagggaggcttacttcgaaaagcagcaacaaaaacagcagcaacagcaacagcagcagcagcagggtgacctcagcggccagagttctcatccttgcgagcggcccgccacgagcagcggcgccctgggctcggatctgggcgacgccatgtctgaagaggacatgctccaagccgccgtgaccatgtctctggagaccgtgaggaacgatttgaagaccgagggcaagaagtag

SEQ ID NO: 13907 - DNA, 1110 bp, Artificial Sequence
  Description of Artificial Sequence: Synthetic coding sequence
atggagagcattttccacgagaaacaggagggttcgctgtgtgcacagcactgcttgaataatttactccaaggcgagtatttcagtccggtggaactgtcgagtattgcccatcagcttgacgaagaagagcgcatgcgcatggcggaaggcggagttacgagtgaagactaccgaaccttcttacaacagcctagcggaaacatggatgactccggatttttctcaattcaggtcatcagtaacgctctaaaagtatggggtcttgaacttatcctctttaattctcccgaatatcagcgcctccgtatcgaccctattaacgagagatcttttatttgtaattataaggagcactggtttaccgttagaaagctcgggaagcaatggttcaacctgaattcattactgactggacccgaactaattagtgatacataccttgctctcttcctggcccaactgcaacaagaaggatatagcatcttcgtagtgaagggcgatctgccagattgcgaagcagatcagttgctgcagatgatccgagtacaacagatgcatagaccaaagctgatcggtgaagaactcgcccagctcaaggagcagagggtccataagacagacctggaacgcgttctggaggcaaatgatggatccggcatgttagacgaggatgaggaggacctccagcgggccctcgcactcagccgccaggaaatcgacatggaggacgaggaagcagacctcaggcgggccattcagctcagcatgcaagggtccagccggaacatcagccaggacatgactcaaacatctggaacaaatttgacatccgaggagctgagaaagaggagggaggcctatttcgaaaaagaccagcattttcatattcttaagcagcaacagaagcaacagcagcagcagcaacagcaacagcagggcgatttgagcggccagagcagccacccctgtgagagacctgccacctcaagcggtgccctgggcagcgacctcggcgatgccatgtcagaagaagacatgctacaggccgccgtgacaatgtctctcgagaccgtccgaaacgacctgaagactgaggggaaaaagtag

SEQ ID NO: 13908 - DNA, 1086 bp, Artificial Sequence
  Description of Artificial Sequence: Synthetic coding sequence
atggaatcgatatttcatgagaagcaagagggcagcctgtgcgcacagcactgtctcaataacctcttacagggggaatatttctctcccgtcgagctatcttctatcgcccaccagctcgatgaagaggaacgaatgcggatggcagagggcggtgtgactagtgaagactataggaccttcttgcaacaaccgtctggaaacatggacgacagcggctttttttcaatccaggtcattagtaatgcactaaaagtctggggtctagaattaatcctgttcaactctccagagtatcaacgcttgcggattgaccctatcaacgaaaggtctttcatatgcaactacaaggaacattggttcacagtgcgcaagttggggaagcagtggtttaacctcaattctctgctgactggaccggagctgatctccgacacttacctggccttatttttggcccagttgcagcaggagggctacagtattttcgtggtgaagggggatctgccagattgtgaagctgatcagctgcttcagatgattcgggtccagcagatgcatagaccaaagttgattggggaggaactggcccaactcaaagagcaacgcgtgcataaaacagatctagagagagtgttggaggcaaatgacgggagcggcatgttagacgaagacgaagaagatctgcagagggcactggccctgagcaggcaggagatcgatatggaagatgaggaggcagatctcagaagagcaatccagctctccatgcagggcagctctaggaatatttcgcaagacatgacccagaccagcggcacaaatctgacgtccgaggaacttaggaagcgccgcgaagcttatttcgaaaagcaacaacaaaagcagcaacagcagcagcaacagcagcagcagggcgacttgagtggacagtcatcacatccgtgtgaaaggcctgcaaccagttccggcgccctcggatctgacctgggggacgcaatgtctgaggaggatatgctccaggctgcagtgactatgagtctagaaaccgtccggaacgatcttaagacagaaggtaagaagtag

SEQ ID NO: 13909 - DNA, 1101 bp, Artificial Sequence
  Description of Artificial Sequence: Synthetic coding sequence
atggagtcaatttttcacgaaaagcaggagggctccttgtgtgcgcagcattgtctgaacaatttattgcagggagaatactttagtccagtcgagctctccagtattgcgcaccagctcgatgaagaggagaggatgcggatggctgagggcggtgtgacaagtgaggactaccgtacattcctccagcagccatcgggcaacatggatgactctgggtttttctctattcaggttatttctaatgctctgaaagtgtgggggcttgagctgatcctgtttaattctcccgagtatcagcgactccgaatagacccaattaatgaacgatccttcatttgtaattataaagaacattggtttaccgtgcgaaaattaggtaagcagtggtttaatctgaactctcttctcaccgggcctgagctgatttcagacacttacttagctctgttcctggcccagctccagcaagaggggtattccattttcgttgtcaaaggcgacctccccgattgcgaggctgaccagctactgcagatgatccgagtccagcagatgcatagacccaaattaatcggcgaagagctcgcccagctaaaggagcagcgggtgcataaaacagatctagagagagtcctcgaggctaacgatgggtcagggatgctcgacgaagatgaagaagatttgcaaagagctctggcactttcacggcaggagatcgacatggaagatgaggaggcagacctcaggcgagctatccagctctcaatgcaggggtcatctcgcaacataagtcaggatatgacccagactagcggaaccaacctgacctccgaagaattgagaaagaggcgagaggcctatttcgagaatgattactttgattctcaacagcagaaacagcagcagcagcaacagcagcagcaacagggagatctctcgggacagtcaagccacccttgcgagagaccagctacctcttccggagctctggggagtgacctcggcgacgccatgtcagaggaagacatgctgcaagccgcggttactatgagcctggagacagtacgcaatgacttgaaaacagagggaaagaagtag

SEQ ID NO: 13910 - DNA, 1065 bp, Artificial Sequence
  Description of Artificial Sequence: Synthetic coding sequence
atggagagtattttccatgagaagcaggaggggagcttgtgcgcccagcattgtctgaacaatcttcttcagggagagtacttttctcccgtggagctgagttctatcgcgcatcagttggatgaagaggaacgcatgagaatggccgaagggggagtaaccagcgaagattaccggactttcttacaagtgatcagtaatgctttgaaggtgtggggcctagaactcatcctgttcaacagcccagagtatcagagattgcgtatcgacccaatcaacgaacgttccttcatctgtaattacaaggaacattggtttaccgtgaggaagcttggaaagcaatggttcaacctaaattctttgctcactggcccagagctgattagcgatacctacttggcattgtttctcgcgcagctccagcaggaaggatattccatctttgtggtgaaaggagacttgcccgattgcgaagctgatcagttgctgcaaatgatccgggtgcaacagatgcatcggccaaaacttatcggcgaagaactcgcccagctgaaggaacagcgggtacacaaaaccgacctcgaacgtgttctggaggctaacgacggttccggaatgctagatgaagacgaggaggatctgcagcgtgctttggccctctcccggcaggagattgacatggaagatgaggaggccgacctgaggagggccattcagctgagcatgcagggtagttcccgaaacatttcccaggatatgacacagacatctgggacgaatcttactagcgaggaactgaggaaaagacgcgaggcctactttgagaaggaccagcattttcatattctaaaacagcagcaaaagcaacaacagcagcagcagcagcagcagcagggtgatctcagtgggcagagttctcatccatgcgaacgcccagccacatctagtggagccctgggttctgacctgggagatgctatgagcgaggaagatatgctacaggccgccgtgacaatgagcctggagaccgtcagaaatgacttgaagactgagggaaaaaaatag

SEQ ID NO: 13911 - DNA, 1113 bp, Artificial Sequence
  Description of Artificial Sequence: Synthetic coding sequence
atggagagtatatttcacgagaagcaagagggctctttatgtgcgcagcattgcctgaacaatctgctacagggggaatactttagtcctgtggagctcagcagtatcgcacaccagcttgatgaagaggaacgaatgaggatggcagaagggggggttacttctgaagactatagaacctttttgcagcagccatctggcaacatggacgactcaggctttttctcgatccaggtcatcagcaatgccttgaaggtttggggtttggagctcattctgtttaatagtcctgagtaccagcgattgagaattgaccctattaatgaacgcagctttatttgcaattataaggagcactggtttactgtgcgcaagctaggaaaacaatggttcaacttgaacagtctactgaccgggccggagctgatctcagatacatatctcgccctgtttcttgctcagctgcaacaggaaggctattcaatattcgtggtcaaaggggatctccccgattgcgaagctgatcaactgctgcaaatgattcgggtccaacagatgcaccgtccaaagctgataggcgaggagctggcgcagctaaaagagcaacgcgttcacaagacggaccttgagcgcgttcttgaagccaatgatggctccggcatgttagatgaggacgaagaggatctgcagagagccctggccctgagcagacaggagatcgacatggaagacgaagaggctgatctccggagggcgattcagctgtcgatgcagggatcctcaagaaacatctctcaggacatgacccagacctctggcaccaacttaacgagtgaggagctgcgtaaaagacgcgaagcatacttcgagaagacagagtccaggtcggttgcgcaggctcagcagcagaaacagcaacaacagcaacagcagcagcaacagggcgacctctcagggcagagtagccatccatgcgagcggcctgccacatcctccggagctctgggtagcgacctaggggacgccatgagtgaagaggacatgctgcaggccgcagtgacaatgagtctcgaaactgtgaggaatgatctcaagactgaaggcaagaaatag

SEQ ID NO: 13912 - DNA, 1041 bp, Artificial Sequence
  Description of Artificial Sequence: Synthetic coding sequence
atggagtccatctttcacgagaaacaagaaggctcactgtgcgcccagcactgcctaaacaatctgctgcagggggaatatttctctcctgttgagctgtcttccatagcccatcagctggacgaggaggagaggatgcgcatggccgagggaggggttacatctgaggattatcgaaccttcctgcaggtgatttctaacgccctgaaggtgtgggggttagaactgatcctgtttaatagccccgagtatcaaagacttcgtattgatccaataaacgagagatcgtttatttgtaattacaaagaacactggtttaccgttcgaaagctgggtaagcagtggtttaatctaaactccttactcaccgggcccgagctgatatctgacacttacctggctttgtttcttgcccagctgcaacaggagggttacagtatttttgtcgtgaagggagatctgcctgattgcgaagcagaccagctattgcagatgatcagagtccaacagatgcacagaccaaagctgataggagaagagcttgcccagctgaaggaacaacgcgtccataagactgatctggaaagagtgttagaagccaatgacggatctggcatgctcgatgaggacgaagaggatctacagagggcactggccctcagccgccaggagattgacatggaagacgaggaggccgacctgaggcgggctatacaactatctatgcaaggttcttctagaaacatttctcaagacatgactcagacgagcgggaccaatcttacttcagaggagctccgaaagcgtcgggaggcgtattttgagaagcagcaacagaaacagcagcagcagcagcagcagcagcagcagggcgacctgagcggtcagtccagtcacccttgtgaacgacccgcaacatcctcaggagcgcttggctccgatctgggggatgcgatgtcagaagaggacatgctccaggctgccgtgaccatgagtctcgaaacagttcgaaacgatctgaagaccgaggggaaaaaatag

SEQ ID NO: 13913 - DNA, 1095 bp, Artificial Sequence
  Description of Artificial Sequence: Synthetic coding sequence
atggaatcgatttttcacgaaaaacaggagggaagtctgtgcgcccagcactgtctcaataacctgctgcaaggtgagtacttttcaccagtggagctgtcctccatcgcacaccagctcgacgaggaggagcggatgcggatggccgagggcggggtcaccagtgaggattatcgtacgttcctgcaacagccatccgggaatatggacgactcggggtttttctcaatccaggtcatctccaacgctctgaaggtttggggcttagaactgatccttttcaactccccagaataccagagactgcgcatcgaccccatcaatgagagatcctttatatgcaactataaggagcactggttcacagtgcgaaaattaggcaagcaatggtttaatctgaatagcttgctgactggtcctgaactcatctccgacacttatctcgctctctttctggcacaactgcagcaggaaggatatagcattttcgtcgtgaagggcgacctgccagactgcgaagccgaccagttactgcaaatgattcgggtgcagcagatgcaccgcccaaaactgattggcgaggagctggcccagctgaaggagcagagggtgcataaaacagatctggaaagggtcctggaagcaaacgacgggtcagggatgctcgatgaagacgaagaagatttgcagagggcacttgccctcagccgtcaggaaattgatatggaggacgaggaagccgatctgaggagggctatccagctcagcatgcaaggcagctcgcgaaacattagtcaggatatgacccagacgagtggcacgaacctgactagtgaggaattgcggaagcgcagagaggcttatttcgagaagcagcagcaaaaacagcaacagcagcagcagcagcagcagcaaggagacctgagcggccaaagttcccacccatgtgagcgacccgcaacatcttccggagccctgggctccgacctgggcaaggcttgctcaccattcattatgttcgccactttcaccctgtacttaacgtatgagctgcacgtgattttcgccctacattatagctcctttccattgtag

SEQ ID NO: 13914 - DNA, 1119 bp, Artificial Sequence
  Description of Artificial Sequence: Synthetic coding sequence
atggagtcaatttttcacgagaagcaggaagggtctctatgcgcacaacactgtctgaacaacttactgcagggggagtatttctctcctgtggagttatcaagcattgcccatcaactggatgaggaagagcgcatgcgcatggctgaaggcggcgtaaccagtgaggactataggacctttctgcagcaaccttctggaaatatggacgacagcggattcttcagcattcaggttattagtaatgcattgaaagtctggggccttgagctgattctcttcaattctcccgagtaccagcggctacgaattgaccccattaatgagaggagcttcatatgtaattacaaggagcattggttcaccgtcaggaagttggggaagcagtggttcaatcttaatagcctgctgacagggcccgagcttatctctgacacttatctggctctgttccttgctcagttgcaacaggaaggatactctatctttgtcgtgaaaggcgacctgccagactgtgaagccgatcagcttttacagatgatcagagtgcagcagatgcaccgccctaagctcattggagaggagctggcacagctaaaagagcagagagttcacaagaccgacctcgaacgggtcctcgaggcaaatgatggttccgggatgttggacgaagacgaggaagacctgcagagagccttggcactaagtcgccaggaaatagatatggaagacgaggaagctgacctcaggagggccattcagttgtccatgcagggcagcagtaggaacatatctcaggatatgacccaaacgagcggcacaaatctgaccagtgaggagcttagaaaaaggagggaggcatacttcgagaagttcgggagaccgcgaagggcggactgccttaggcaacagcagaagcaacagcagcagcaacaacagcagcaacaaggggatttgtccggccagtcatctcatccttgtgagaggccggccacgtcatcgggggctctgggctcagatctcggtgacgctatgtccgaggaggatatgttacaggcggccgttaccatgtcgctcgagaccgtgcgcaacgatttaaaaactgaaggcaaaaagtag

SEQ ID NO: 13915 - DNA, 1128 bp, Artificial Sequence
  Description of Artificial Sequence: Synthetic coding sequence
gactccgttagcaagaaaaaacaggaagggagcttatgtgcccaacactgcttaaacaatcttctccagggtgaatacttcagtcctgttgagctctcctccattgcacaccagctggacgaggaggaaagaatgcggatggccgagggcggcgtgactagtgaggactaccgtaccttccttcaacagcccagcggcaatatggacgacagtggttttttctccattcaggtgatcagcaatgcactaaaggtgtgggggcttgaacttattctctttaactccccagagtaccagcggctcagaattgatccaatcaacgagcgcagtttcatctgcaactacaaagagcactggttcacagtaaggaaactggggaagcaatggttcaacctgaattcactcctcaccggccccgagctgatcagcgatacataccttgcccttttcctcgcacaattgcagcaggagggttactccatattcgttgtgaagggtgacctccccgattgtgaggccgaccagttactgcagatgatccgagttcagcagatgcaccgacccaagctcattggtgaggaactagcccagcttaaggagcagagggtgcacaagaccgatctagagagagtgttggaagcaaatgacggttcaggaatgctagacgaagatgaagaggacctgcagagggctttggctctgtcaaggcaggagattgacatggaagacgaggaggccgatctccgccgggcgattcagctttccatgcagggctcgagtcggaatatcagtcaggatatgactcaaaccagtggtactaacctaaccagtgaggaactgaggaagagacgggaagcttacttcgagaagaaattcacagccaatcggaccgaccagcacttccacattctgaagcaacaacaaaagcagcagcagcagcaacaacaacagcagcaaggggacctgagcggccaatccagtcatccatgtgagcggcctgccacctcttccggcgcactgggaagcgatctcggggacgctatgagcgaggaggacatgcttcaagcagccgtgaccatgagcctggaaaccgtgcggaatgaccttaagacggaaggtaaaaaatag

SEQ ID NO: 13916 - DNA, 1125 bp, Artificial Sequence
  Description of Artificial Sequence: Synthetic coding sequence
atggagagcatcttccatgaaaagcaggagggttcgctgtgcgctcagcactgtctgaacaatctgttacagggagagtacttttccccagtggagctcagttcaatcgcccatcaacttgacgaagaagaacgaatgcgaatggctgagggaggggtcacatctgaggactaccggactttcctacaacagccctctggaaatatggacgactcaggatttttttcaatccaagtgatctcaaatgcattgaaagtttggggcctcgaattgatcctgtttaacagccccgagtatcagcggttgcgaatcgaccccattaatgaacgaagcttcatttgcaactataaggagcactggttcaccgtacgcaaactgggtaagcagtggttcaatctgaactcactgctaaccggacccgaactcatttccgatacctacctcgctctgtttctggcacagctacagcaggaaggatactcaatctttgtggtgaagggcgacctccctgattgtgaggcggatcagctcctgcagatgatccgtgtacaacagatgcatcggcctaagcttatcggcgaggagctggcccagttgaaagaacaacgagtccataagacagacttagaacgagttctggaagccaacgatggcagtggtatgttagacgaggatgaggaggaccttcagagagctctagcactgagtcggcaagagatcgatatggaggacgaggaagccgatttgcggcgggccatccagttatccatgcaggggagtagtaggaatatatcccaagatatgacacagactagcggaacaaacctgacatcagaagaactaagaaagagacgcgaggcttactttgaaaaggtatttttcaaaaacctacagcagatcggccgtgcacgtcagcaacagaagcagcagcagcagcagcagcagcaacagcagggcgatctgtcagggcagtcctcccatccgtgtgagaggccagccacaagctccggggcactcggtagcgacctgggcgatgccatgtccgaggaggacatgctacaggctgccgttaccatgagcctagagaccgtcaggaacgatctgaagacagagggcaaaaagtag

SEQ ID NO: 13917 - DNA, 1113 bp, Artificial Sequence
  Description of Artificial Sequence: Synthetic coding sequence
atggagtccatcttccatgagaaacaggagggcagcttgtgcgctcaacactgtctgaataatctccttcagggagagtacttcagcccagtcgaactgtcaagcatagcgcaccaattggacgaggaggagcggatgcggatggccgaagggggagtgacctcagaggattaccggacctttcttcagcagcccagtggaaacatggacgactctggcttcttttcaatccaggtgatcagcaacgccctcaaggtgtgggggttggagctcatactgtttaacagtccagagtaccagcggctgcgcatagacccaatcaacgagaggtcttttatctgcaattacaaggagcactggttcacagtgcgcaagttagggaagcagtggttcaatttgaattctcttctcacaggaccagaactcatctctgacacgtacttagctctctttttggctcagctgcagcaggaaggatactctatcttcgtcgtcaaaggggatctaccagattgtgaagccgatcagctactgcagatgatccgcgtgcagcaaatgcatcgaccaaaactgatcggggaggagctcgctcaacttaaggaacagcgggtccacaagactgatctcgaacgcgtactggaggcgaatgacgggtctggtatgcttgacgaggacgaagaggatcttcagagagcgttggccctcagccgccaggaaattgatatggaggacgaggaagccgacctccgtcgggccatccagctttccatgcagggcagtagcagaaatatctcccaggatatgactcagacttctgggacgaacctcactagcgaagagctccggaaacgaagggaggcatatttcgaaaaaatctacttcaccttcgagtgtttcagacagcagcaaaaacagcagcagcagcaacagcaacagcagcagggcgacttgagtggacagtcctctcatccgtgcgagcggccagcaacctctagcggcgcactggggtccgaccttggcgacgccatgagcgaagaagatatgctacaggctgcagttacaatgagcctcgagacagttcggaatgatctcaagaccgaaggcaaaaaatag

SEQ ID NO: 13918 - DNA, 1134 bp, Artificial Sequence
  Description of Artificial Sequence: Synthetic coding sequence
atggagtccatctttcatgaaaagcaggagggctctttatgcgcacagcactgcttgaacaatctgctacaaggtgagtattttagtcccgtcgagctgtccagcatcgcgcaccaactcgacgaggaagaacgtatgagaatggcagagggtggggtgacgtccgaggattaccggactttccttcagcaaccaagtggcaacatggatgatagcgggtttttctcaatccaggtgatttcaaacgcactgaaggtatggggcttagaactgatcctgtttaactccccagagtaccagcggctgcgaattgacccgataaatgagcgatcatttatctgcaactacaaggagcactggtttacagtgcggaagcttggaaagcagtggttcaatctgaatagcctgttgaccggccccgaacttatctctgacacctacctagcactcttcctggcacaattgcagcaggagggttacagcatctttgtggtgaagggagatttgcccgactgtgaggcagaccagttgcttcagatgatccgagtgcaacagatgcacaggccaaaactcatcggtgaagaactggctcagttgaaggagcaacgagtccataaaactgatttagagcgcgtgctagaggccaacgacggttctggaatgttggacgaagatgaagaagatctgcagcgagcgctggcccttagtcgccaagagattgatatggaggatgaggaagccgacctcaggcgtgctattcagctaagtatgcaagggtcctccaggaacatctctcaggatatgactcagacatccggaacaaatttaaccagtgaagaactcagaaagcgacgtgaagcatacttcgagaaggtgttctttaaaaacctgcagcaaaaccagcacttccatatcctcaagcagcaacaaaaacagcagcagcagcagcaacagcagcagcagggcgacctctctggacaatcatcacacccttgtgagagacccgctaccagctctggcgccctgggtagcgacctgggggatgccatgtcggaagaggatatgctgcaggctgccgtgaccatgtcattggagacagtccgtaacgaccttaagacagaaggcaaaaagtag

SEQ ID NO: 13919 - DNA, 549 bp, Artificial Sequence
  Description of Artificial Sequence: Synthetic coding sequence
atgatacgcgtgcagcaaatgcaccgaccaaaattgataggagaggaactcgcacaacttaaggagcagagagtccataagacagacctggagcgcgtattggaggcgaatgacgggtctgggatgctggacgaggatgaggaggacctccaaagggccctcgctctttcccggcaggagatagacatggaggacgaggaagcggacctgagaagggccatccagttgtctatgcagggctcgagtcgcaacatctcccaggatatgacacaaactagcggaacaaatctgacctctgaggaactgaggaaacgccgggaggcctatttcgagaagcaacagcagaagcaacaacagcagcagcagcagcagcaacagggcgatctgtcaggacaatcttcccacccctgtgaaaggcctgccacatcgtctggggccctgggttctgatctgggcgatgcaatgtcagaagaagacatgctccaagccgcagtgaccatgtccctcgagaccgtccgtaacgatctcaagacagaaggcaagaagtag

SEQ ID NO: 13920 - DNA, 3306 bp, Artificial Sequence
  Description of Artificial Sequence: Synthetic coding sequence
atgagcgctaaggccattagtgaacagactggaaaggaacttctgtataagttcatttgtacaacctccgctatacagaatcgatttaagtacgcgagagtgacacctgacaccgactgggctcgacttctccaggatcacccctggctcctgtcgcaaaaccttgtggttaagcccgaccagctcatcaaacggaggggcaagttgggactggtaggcgtaaatctgaccttagacggtgtcaagagttggctgaagccacgacttggccaagaagcgacagttgggaaagccacaggctttctgaaaaacttcctcattgaacccttcgttccccattcccaggctgaggagttttacgtgtgcatatacgccaccagagagggggattatgtgctgtttcatcacgagggtggcgttgacgtcggcgacgtggacgccaaagcccaaaagctgctcgtaggcgtagatgagaagctcaaccccgaggatataaaaaagcacctgctcgtgcatgctcctgaggacaagaaggaaatattggcctcgtttatctccgggctattcaacttttacgaggatctctactttacctatctcgaaatcaatcctttagtagtgaccaaggacggcgtatatgttctagatctcgcagccaaggtcgacgctacagcagattatatttgcaaggtcaaatggggggacatcgaatttcctcccccgttcggccgagaagcttatcccgaggaggcgtatatagccgaccttgatgcaaagtccggagctagccttaagcttaccctgctgaatccaaagggccgcatctggacaatggtagctggcggcggagcctcagtcgtgtattcagacacaatctgcgatttggggggtgtcaacgagctcgccaattatggagaatacagtggcgcccctagcgaacagcagacgtatgattatgcgaagaccattcttagcctgatgacgcgtgagaaacatccagacggcaaaattcttattatcggtggctcaattgccaactttaccaatgtggcagccaccttcaaaggcatcgtgagggccatccgggattaccaagggccactcaaggaacatgaagtcaccatcttcgtgaggcggggtggaccaaattatcaggaaggactacgcgtgatgggggaagtcggaaagacaacgggcatccccatccatgtgtttggaacggaaacacacatgaccgcgattgtcgggatggctttaggacaccggcctattccaaatcaaccgcccaccgcagcccacacagcgaattttctgctcaatgcctctggctctaccagtactccagctccgtctcgtacagcctcgttctccgagtcaagggctgatgaggtcgctcccgccaagaaagcaaagccagctatgccccaggacagtgtaccctctccccggtcactccagggtaaaagcaccaccctgttctcaagacacacaaaagcgatcgtctggggcatgcagactcgcgccgtacaaggcatgctcgattttgattacgtctgctctcgagatgagccctctgtggctgctatggtgtacccatttacgggcgaccacaagcaaaagttttattgggggcacaaggagatattaatacctgtgttcaagaacatggctgacgccatgagaaagcaccccgaggttgatgtcttgatcaactttgctagcctgaggtctgcatacgacagtacaatggagaccatgaattatgcccaaatccgaactattgctataattgctgaaggcatacctgaggctttaacaaggaaattaattaaaaaggccgaccaaaagggcgtcaccatcattggaccagccacagtgggcgggattaagcctgggtgctttaagataggtaatacaggtggcatgcttgacaatatcctggctagcaagctctataggcccggtagcgtagcctacgtttcccgcagtggaggaatgtcgaatgaactcaacaatatcattagtagaaccactgacggggtatacgagggtgtggccattggtggggatcggtacccgggcagcactttcatggatcatgttctgagataccaagatacgcccggggtgaagatgatcgtggtgcttggggaaattggcggtacggaggagtacaaaatatgcaggggcatcaaagagggaagactgacaaaaccaatcgtctgttggtgtataggcacttgcgcaactatgttctctagcgaggtacagtttggacatgccggcgcatgcgcaaatcaggcctccgagactgccgtggccaaaaatcaggccctaaaggaggccggcgttttcgtgccaaggtccttcgacgagttaggggagatcatccagtctgtgtacgaagacctggttgcaaatggcgttatcgtgcccgcccaggaagtgcccccgccgaccgtgcccatggattactcctgggccagagaactcggtttgattcgcaagcccgcttcattcatgaccagtatctgcgacgaacgtggacaggaactgatatatgctggaatgccaatcaccgaggtcttcaaggaagagatgggcattggtggcgtgctgggtctgctgtggttccaaaaacgcctgcccaagtattcatgtcagtttattgaaatgtgtctgatggttacagccgaccacgggcctgccgtctctggagcacacaatactattatttgcgcaagagccggaaaagatcttgttagtagcctgacttccgggcttctgacaattggcgatcgattcggcggcgctttggatgcagccgcaaagatgttttcaaaagctttcgacagtggcattatcccaatggaatttgtgaataagatgaaaaaggagggcaagttgatcatggggattggtcatagggttaaaagcatcaacaatcctgacatgcgagtgcaaattctaaaggactatgtgcgccagcactttccagcgactcctctgcttgattacgcacttgaggtggagaaaatcacaacatctaaaaaacccaacctgatcctgaacgtcgacggactgataggagtggccttcgtggacatgttacggaattgcggatccttcacccgcgaggaggcggacgaatacattgatatcggggcactcaacgggatcttcgttctggggcgttccatggggtttatcggccactacctggaccagaaaaggctcaagcaaggcttatatcgtcatccctgggacgatatctcctacgttttgcccgagcacatgtccatgtag

SEQ ID NO: 13921 - DNA, 3276 bp, Artificial Sequence
  Description of Artificial Sequence: Synthetic coding sequence
atgagcgccaaagccatttctgaacagactggaaaggaacttttgtacaagttcatctgtacaaccagtgcaatccagaatcggttcaagtacgcgcgagtgacgcctgataccgattgggccaggctcctgcaggatcacccatggcttctctctcagaatcttgttgttaaacctgaccagctgattaaacggcgcgggaagctcgggctggtcggcgtaaacctgaccttggacggcgtcaagtcttggctgaaacctagactgggccaggaggccactgtgggcaaggccaccgggttcctgaagaactttcttatcgagcctttcgtgccacactcccaggcagaagagttctatgtttgcatctacgcgactcgcgagggggactatgtgttattccaccatgaggggggggtcgatgttggcgatgtagacgccaaagcccaaaagctgctcgtcggtgtggatgagaagctgaatccagaggacattaaaaagcacctcttagtccatgcacccgaggacaagaaagagatactggcctcgttcattagcgggttgttcaacttctatgaggacctgtattttacgtacctggaaatcaatccactggtggtgactaaagacggggtgtatgtcctggatctcgcggcgaaggtggatgctaccgctgactatatctgtaaggttaagtggggagatattgaatttccacccccgtttggaagagaagcctacccagaggaggcgtacatcgctgaccttgacgcaaagtcaggagcttcactgaaattgactctcctgaaccccaagggcaggatctggaccatggtagccggcgggggcgcctcagtagtgtattcggacactatctgcgatcttgggggtgttaacgagctggcaaattatggtgaatactccggagccccatcggaacagcagacttatgattacgccaagacaatcctatccctgatgactagagagaagcaccccgacggcaagattttaatcatcggaggttcaatcgctaacttcactaacgttgctgcaaccttcaagggtatcgtgagggctatcagggactatcaggggccactgaaggagcacgaggtgaccatctttgtacgaagagggggtccaaattaccaagagggcctgagagttatgggagaagtgggcaagacaacaggaatccctatacatgttttcgggaccgagactcacatgactgctattgtgggtatggccctcggccacaggccaataccaaatcaacccccaactgccgcacatacagctaacttcttgttgaatgcatcaggcagtacaagtacccctgcgcctagccgaaccgcatccttcagcgaaagccgcgctgatgaagtggcacccgccaaaaaagcgaaacctgctatgccgcaaggcaaaagtaccacactgttctcacggcatacaaaggcgattgtctggggtatgcagacccgagccgttcagggaatgttggatttcgactatgtctgtagccgggatgagccctcggtggccgctatggtttacccattcactggcgatcataagcagaaattctactggggacacaaggagattttgattcccgtgttcaaaaacatggctgacgctatgagaaagcatcctgaggtggacgtgctaattaacttcgctagcctcaggagcgcatatgactccactatggaaactatgaattatgcccagattaggacaatcgccattatcgctgagggaattcctgaagccttgacaaggaaactaattaagaaagcagaccagaagggggttaccatcatcggccccgccactgtaggtggaattaagccaggatgctttaagataggtaacactggggggatgcttgataacattcttgccagcaagctgtataggccaggctcagtcgcgtacgtgagccgcagcggaggtatgtccaacgagttgaacaacatcatttcaagaacaactgacggcgtgtatgagggcgtcgcaataggaggggaccggtatccaggatcaacttttatggatcacgttctgcggtatcaggacactccgggggtaaagatgatcgtcgtactgggggagattggaggcacggaggaatataagatctgcagaggcatcaaggagggccgcctgaccaagcccattgtctgttggtgcatcggcacatgtgctacaatgttttcttccgaagtccagtttggccatgccggcgcctgcgccaaccaagcaagcgagaccgctgttgcgaagaatcaggccctaaaagaagccggcgtttttgtcccccgatcgttcgatgagctaggggagattattcagagtgtatacgaagatctcgttgctaatggcgtgatcgtaccagcgcaggaagtgcccccccccactgtgccaatggactacagttgggctcgggagctcggcctcattcggaagcccgcctcgtttatgacaagtatatgcgacgaacgaggtcaggagctgatttatgcaggaatgccaattacagaggttttcaaggaggaaatgggaatcggcggcgtgctgggcttactatggtttcagaaaaggctccctaagtacagttgccagttcatcgagatgtgcctgatggtaacagcagatcatggacccgccgtctccggcgcacataacaccatcatatgtgctcgcgctggaaaagatttggtgagttctcttacgtccggactgctgaccattggtgatcggtttggaggggctctggatgcagccgccaagatgttcagtaaggcttttgattccggaatcattccaatggagtttgttaacaagatgaagaaggaggggaagttaataatgggcattggacatagggtaaagagcattaacaatcccgacatgagagtacaaattctgaaagactatgtgcgtcagcatttcccggccacacctctgctagactatgcactggaagtggagaagatcaccacctcgaagaaaccaaatctcatcctgaacgtggatggactgattggagtggccttcgtggatatgctgcgcaattgtggcagtttcacacgggaagaggcggatgagtacatcgacattggggcgctgaacgggattttcgtgctggggagaagtatgggatttattgggcactacttggaccagaagagactcaaacagggcctttataggcacccttgggatgacattagttatgttctcccggaacacatgtccatgtag

SEQ ID NO: 13922 - DNA, 3276 bp, Artificial Sequence
  Description of Artificial Sequence: Synthetic coding sequence
atgagtgccaaggccatctccgagcagacggggaaggagctcttgtataagttcatatgcaccacgtccgctatacagaataggtttaaatacgccagggttacaccagataccgattgggctcgactgttgcaggatcacccttggctgctgtctcaaaatttggtagtcaaacctgatcagttgattaagcggaggggcaagctggggctcgttggcgttaatctgacgttagacggggttaaaagctggctgaagccaaggctcggccaggaagcaactgtaggaaaagccacaggctttttgaaaaattttcttatcgagccattcgtgccacattcccaagccgaagagttctacgtctgtatttacgctaccagggaaggtgattacgtcctgtttcatcatgagggtggggtggatgtaggcgatgtagacgcaaaggctcagaagctgctggtcggcgtcgacgagaaacttaaccctgaggacattaaaaaacacctgctggtgcatgccccagaagacaagaaggaaatcctcgccagctttattagtggactattcaatttttatgaggacctgtacttcacctatctggaaattaatcccctcgtcgtcacaaaggacggcgtttacgtgctcgacctggccgcgaaggtcgatgcgacagcagactatatttgtaaagtgaaatggggcgatatcgaattccctcctccttttggcagggaggcctatcctgaggaagcatatattgccgacctggatgccaagtcaggggcctcattgaaactaaccctcctgaatcctaaaggacggatctggacaatggtggccggcggcggcgcctctgtggtgtacagtgacaccatatgtgacctgggcggcgtgaatgaactggctaactacggggagtactcaggtgccccttcggaacaacagacgtacgactacgccaaaactattctgtcgcttatgacccgggagaagcaccctgacggaaaaatcctgattattggaggatcaattgcaaatttcacaaacgtggctgccacctttaaaggtattgtgagggcaatacgcgattaccaaggtccgttgaaagaacacgaagtcaccatattcgtgcggcgcggcggaccgaattatcaagagggcctgcgggtaatgggtgaggtggggaagactacaggcatcccaatccatgtgttcgggactgaaactcatatgactgccatcgtagggatggcactaggtcacaggcccattccgaatcagcctccgacagcggcgcatactgccaactttctgctgaatgccagtggttccaccagtacgccagcccccagcagaactgccagtttctcagagtccagagcagacgaggtggcaccagccaagaaggctaagcctgcgatgccccaggggaagtccacaaccctgtttagccgccataccaaggccattgtctggggtatgcagaccagagctgtacagggcatgctagattttgactacgtgtgttccagggacgagccctccgtcgccgcgatggtctacccgttcacaggtgaccacaaacagaaattttactggggccacaaagagatactaatccctgtgttcaagaacatggccgatgccatgagaaagcatcctgaggtggatgtgcttattaacttcgcctcacttcgttctgcttatgacagcacaatggagactatgaactacgcacagattcgaacgattgctatcatagcagaaggcatccctgaggcactcactcgaaagctgattaaaaaggctgaccagaagggtgtaaccatcatcggacctgcaaccgtgggaggtatcaagccgggctgtttcaaaatcggcaacaccggtggcatgcttgataacattttagcatccaagttgtatcggcccgggtccgtggcctacgtgtcacgaagcgggggcatgtccaacgagctgaacaacattatttcgagaaccacagacggagtgtacgagggagttgccatcgggggcgaccgctaccctgggtccacattcatggatcacgtgctgaggtaccaagacacacctggcgtcaagatgatagttgtgctcggagagatcggcggcacagaggagtacaagatctgcagaggcatcaaggaaggccgacttaccaagcccattgtgtgctggtgtattggaacttgcgcaacaatgttctcgtctgaggtgcagttcggtcacgcaggagcgtgtgctaatcaggcaagcgaaacagcagtagctaagaatcaagcactgaaagaggcgggagtgttcgtgcctagatctttcgacgagctcggcgaaattattcaaagcgtgtatgaagacctcgtcgccaatggcgtgatcgttccagctcaggaggtaccaccacctaccgtacccatggattatagctgggccagagaactgggtctcatccgaaagcccgcgtccttcatgacttctatctgcgacgagaggggccaggaactcatctatgctggaatgcccatcaccgaagtgttcaaagaggaaatggggattggaggcgttctgggcctgctctggttccagaagcgcctgcctaagtattcatgtcaatttattgagatgtgtctcatggttaccgctgatcatggtcctgcggtttctggcgcacacaacacaattatatgtgcaagagcaggaaaggatctggtctcctcactaacttccggcctattaactatcggggaccgctttggaggagccctggacgccgctgccaagatgtttagcaaggccttcgacagcggaatcatccccatggaattcgttaataaaatgaagaaagaaggtaaactgatcatgggaatcggtcatagagtgaagtccataaacaacccagacatgcgtgtccagatactgaaggattatgtgcgccaacatttcccagctaccccactcctggactatgctctggaggttgaaaagataaccacttccaagaaacccaaccttatcctcaacgttgatggcctgatcggggttgccttcgtcgacatgctcagaaactgcgggtcctttacacgggaagaagcagatgaatatattgatattggggccctgaacgggatctttgtgctgggaaggagtatgggcttcatcggccactatctggatcaaaagaggctgaagcaggggttgtaccggcacccgtgggatgacatttcctacgtgcttccggagcatatgtctatgtag

SEQ ID NO: 13923 - DNA, 3468 bp, Artificial Sequence
  Description of Artificial Sequence: Synthetic coding sequence
atgggggcaggaaaaagtcccgctggcccaggccaaaagccagatccaggtaagcttcccgctgctggggtcttaagaatcttaagaggctcctctggcctatggaagaaacgcagagcaaggactagtgctgagactggaagagctgggctgagcgcggcaatgagcgccaaagccatcagtgagcagacaggtaaggaactcctctataagtttatttgcacaacctcggccatccagaacagatttaagtacgccagagttactcctgacaccgactgggctcgactgcttcaggatcatccctggcttctttcgcagaacctcgttgttaagcccgatcaattgattaaacgccgcggaaaactgggcttggtaggggtgaatctcacattagacggcgttaaaagttggctgaagcccagactaggccaggaggctacggtcggcaaggccactgggttccttaaaaacttcctgattgaaccattcgtgccacattcacaggcggaagagttctacgtgtgcatctacgctactcgcgaaggggactatgtgttgttccatcatgagggtggcgttgatgtaggcgacgttgatgccaaggcccagaaactgctagtaggagtggacgaaaaattaaacccagaagatatcaagaaacacctgttagttcatgctcctgaagacaagaaagaaatcctggcaagcttcatcagcgggctttttaacttctacgaagatttgtattttacctacttggaaatcaatcctctggtggttaccaaagatggggtgtatgtgttagacctggcggccaaggtggacgcaactgccgactacatttgcaaagtcaaatggggagacatcgagtttcctcctccatttgggagggaagcttaccctgaagaggcctacatagctgatctggacgccaagtctggcgcgtcactgaagcttaccttgctgaatccaaagggaaggatttggacaatggtggctggaggaggagccagcgtcgtttacagcgatacgatttgtgatctcggaggcgtcaacgaactggcaaactatggcgaatattctggcgccccgagcgagcagcagacatacgactatgcgaagaccattctgtccctgatgacgagagaaaagcaccctgacgggaagatcctgataatcggaggaagtatcgcaaacttcacgaatgtcgccgcaacctttaagggcattgttagagcgattcgagactaccaggggcccttgaaagagcatgaagtcacaatcttcgtgaggaggggtgggccaaactatcaggagggcctccgagtcatgggggaagtcggaaaaacgactggcatcccaattcacgtgtttgggactgagactcacatgaccgctatcgtgggcatggccctgggccaccgtccaattccgaatcagcccccaaccgcagcccacactgcgaattttctgttgaatgcctctggcagcacatccactcctgccccaagcagaaccgcaagtttctctgagagtcgtgctgatgaggtggcgcccgcgaagaaagcaaagcctgctatgcctcaggacagcgttccatcccctagatccctgcagggcaaatctacaacattgttttctcgacacactaaagccatagtgtgggggatgcagactagagcagtccagggaatgctggactttgactacgtctgctcccgagatgaaccaagtgtggccgctatggtatacccctttacgggggaccataaacagaagttctactggggccacaaggaaatcctgatccccgtcttcaaaaatatggcagatgccatgcgtaaacacccagaagtagacgtgcttatcaactttgctagtcttaggtctgcgtatgatagcaccatggagaccatgaattacgcccagatcagaaccattgccattatcgccgaaggaatccctgaggcactcacacgcaagctcattaaaaaggctgatcagaaaggggttaccatcattggcccagcaactgtcggcggaatcaaacccgggtgcttcaaaatcgggaatacgggagggatgctcgacaatatcctcgcatcaaagctgtaccgccctgggagcgtagcttatgtctccagaagcggcggtatgtctaatgaactgaataatatcatcagcaggactactgacggcgtttatgagggggttgcaatcggcggtgaccgatatcccggaagcacctttatggaccatgtgctgcgatatcaagacacacctggggtgaagatgatagtcgtgctaggggagatcggaggaactgaagaatataagatctgtcggggaataaaggagggccggctaacgaagccaatagtgtgttggtgcattggtacctgtgctactatgttttcctcggaggtgcagttcggccacgcgggtgcctgcgctaaccaggctagcgaaacggccgtcgccaaaaaccaagccttgaaggaagcaggcgtgttcgtcccccggtctttcgacgagcttggggagattatccagagtgtgtacgaggacctggtggctaacggggtcatcgtaccagcacaggaagtgcctccccctaccgtgcctatggactacagctgggccagagagcttggcctgatcaggaaaccggcttcattcatgacaagtatctgcgatgaacgcggtcaagagcttatttatgctggcatgccgattaccgaggtcttcaaagaggagatgggcatcggaggagtcctgggtctcctctggttccaaaagcgcctgccaaagtactcctgccaattcatagaaatgtgcctaatggtcaccgccgatcacggccctgctgtgtcaggcgcccacaatacaataatttgtgcccgggctgggaaggatctcgtaagtagtttgacatccggcctgctgacaatcggagacaggtttgggggagccttggatgctgcagcgaaaatgttttccaaagcatttgactcaggcatcatacccatggaatttgtaaacaagatgaagaaagagggtaaactcatcatggggattggtcatcgagtgaagtccattaacaacccagatatgcgcgtgcagatccttaaagattacgtgagacaacacttcccggccactcccctgctcgattacgctctggaagtggaaaagatcacaacaagcaagaagcccaatctcatcctgaacgtcgatggacttattggtgtagcttttgtagatatgctgaggaactgtggctctttcacacgagaggaggctgatgagtatatcgatatcggagctttaaacggcatctttgtcttagggagaagcatgggttttattggccactacctcgaccagaagcgcctcaaacaggggctgtatagacatccttgggacgacatttcgtacgtgttgccggagcacatgtcgatgtag

SEQ ID NO: 13924 - DNA, 2493 bp, Artificial Sequence
  Description of Artificial Sequence: Synthetic coding sequence
atgtccgcaaaagccattagcgagcaaacagggaaggaactgctgtacaaatttatctgtactacgtctgccattcagaaccgcttcaagtacgcccgggtaacaccagatacagattgggcacgacttctgcaggatcacccctggctgctttctcaaaatttggtagtcaaacctgatcaactgatcaagcggcgcggcaaattgggactggttggcgtgaaccttacccttgatggcgtgaagtcatggctgaaacctcgtctgggccaggaagccacgggcatcgtgcgggcaatccgcgattatcagggcccgctgaaagagcatgaggtgactatatttgtccgccgaggaggccccaattaccaagaaggactgcgagtgatgggcgaggtggggaaaacaacaggaatccccattcacgtttttggcaccgagacacatatgaccgccattgtggggatggcattagggcatcgccctatcccgaatcagcctcctacagcggcccacactgctaactttctactgaacgccagcggcagcaccagcaccccagctccctcgcgcactgcaagtttttccgaatcacgggccgacgaggtcgcacctgctaagaaagctaagcctgccatgccacagggcaagtctacaactttgttctcacgccacacaaaggccatcgtatggggaatgcagacacgtgctgtccagggaatgctggactttgattacgtctgctctcgggatgaacccagcgtggcggccatggtgtacccgttcactggcgaccacaagcagaagttctactggggacataaggagatccttatcccagtctttaagaacatggcggatgccatgaggaaacacccggaggtagatgtacttataaacttcgcaagcctcagatcagcatatgatagtaccatggagacaatgaactacgcccagatccgcacaattgcgatcatcgccgaggggattcctgaggcccttaccaggaaactgattaagaaagcagaccaaaaaggggtgaccattattggccccgccaccgtaggaggaatcaaacccggctgctttaagattggcaatacgggcggtatgctggacaatatacttgcatccaaattgtaccgacccggctccgtcgcttatgtgtcacgcagtggcggcatgagcaatgaactgaataatattatcagccggaccaccgatggggtgtatgagggcgtcgccattggcggcgacagataccctggttcaacattcatggaccacgtgttgcgctaccaagacacacctggagtgaagatgatcgtggtcttgggggagatcgggggtacagaggagtataagatctgtcggggaatcaaagaaggccgtttgactaaacctatcgtgtgttggtgtatcggaacgtgtgccacaatgtttagtagcgaggttcagttcggccacgctggcgcctgtgccaatcaagcttccgaaacggctgttgcgaagaatcaggcgctgaaagaagccggggtttttgtcccgcgatcttttgatgagttgggcgagatcattcagagcgtctatgaggatctagttgctaatggcgttatcgtccctgcccaggaagtgccgccaccaaccgtgccgatggactattcctgggcccgggagctgggtttgattcgaaagcctgcaagtttcatgactagtatctgtgacgagcggggacaagagcttatctacgccggcatgcctatcaccgaagtgttcaaagaggagatggggattgggggagtgcttggcctgctgtggtttcagaagcgactgcccaagtacagctgtcaatttatagaaatgtgtctgatggtgacggccgatcacggcccagccgtgagtggagctcacaacacgattatctgtgcccgcgcaggaaaagacctagtgtccagcctgacaagcggcctgttgaccattggggaccgctttggtggtgcattggatgcggccgctaaaatgtttagcaaggcctttgacagtgggataatcccaatggaattcgtgaacaagatgaaaaaagagggtaagcttattatggggatcgggcatcgcgttaagagcattaataaccccgatatgagagtccaaatcctgaaggactatgtgaggcagcactttcccgctacgcctttgctggattacgccctcgaggtcgaaaagataactacaagtaagaaaccaaacctgattcttaatgtggacgggctcattggtgttgcctttgtcgatatgctgcgcaattgtggatcctttacacgagaagaagccgacgaatacatcgatatcggtgccctgaacgggatcttcgtactgggcaggtcgatgggcttcatcggacactatttggaccagaaaagactgaagcagggtctatatcgacacccttgggacgacataagttacgttttgcccgaacacatgtccatgtag

SEQ ID NO: 13925 - DNA, 1512 bp, Artificial Sequence
  Description of Artificial Sequence: Synthetic coding sequence
atgagctccatcctcgaggagagaatcctcggtgccgatacctccgttgacctcgaggaaacagggcgggtgctgtccatcggggatgggatcgccagagtccacggtttgcggaacgtgcaggccgaggagatggtggaattctcttcaggcctgaagggaatgtcgttaaacctcgagccagacaacgtcggtgtggttgttttcggcaatgacaaattgattaaggaaggcgatatagttaagcgaacaggtgctattgtcgacgtgcccgtgggggaggagctattgggaagagtggtcgatgctctgggcaatgcgatagacggcaaaggacccattggatccaagacaagacgcagagtgggtttgaaggctcctggaattattccacgcatctccgtacgtgaacccatgcagaccggcattaaggcagtggatagcctcgtccctatagggcgggggcagagggagctcatcattggagatcgacaaaccggtaagaccagcatcgcgatcgacaccattattaaccagaaaagatttaacgacggaagcgacgagaagaagaagctgtattgtatctatgtggccataggccagaaacgctccacagtggcacaactggttaagcgcctgacagatgccgacgctatgaaatacaccattgttgtcagcgcaaccgccagcgatgcagctcctctccagtacctcgccccatattcaggttgcagtatgggagaatattttagagacaacggaaaacacgccctcatcatctatgacgatctttcaaaacaggctgtggcctatcggcagatgtctctgctacttagaaggcctcctggccgcgaagcttatccaggcgatgtcttctacctgcatagccggctactcgaacgagctgcaaagatgaatgacgcgttcgggggaggctctctcaccgctctgcctgttattgagactcaagccggcgatgtgtctgcttatatccctacaaacgttatctccatcaccgacggccagatttttctggagaccgaactgttttataagggaatccgacctgcaattaacgtgggactttccgtttctcgggtcggctccgctgcccagactcgcgcaatgaaacaggtggctgggacaatgaaattagagttggcacagtaccgcgaagtagctgcgttcgctcagtttggttctgatctcgatgcagcaacgcaacaacttttgtccaggggcgtccgactcactgagctcctgaagcagggccagtatagccccatggctatcgaagagcaggtggcagtcatttatgcgggagtgcgcggctatttggataagctcgagcccagcaaaataactaagtttgaaaacgcatttttgtcacacgtggtgtctcagcatcaggctcttttgggcaccattcgggccgatggaaagatctccgaacagtcagatgctaagctcaaagaaatcgtcaccaattttttagcaggatttgaggcttag

SEQ ID NO: 13926 - DNA, 177 bp, Artificial Sequence
  Description of Artificial Sequence: Synthetic coding sequence
atgctgtccgtgagagtggctgctgcagtggtgcgagccctcccgaggcgagctgggttggtctcccggaacgccctaggctcaagctttatagccgccagaaacttccacgcgagcaatacgcatttgcagaagacaggcaaattgctgttcctatcactcaggaggacgtactag

SEQ ID NO: 13927 - DNA, 1596 bp, Artificial Sequence
  Description of Artificial Sequence: Synthetic coding sequence
atgctgtcagtgagggtggcagccgccgtggtgagggccttgcctaggcgagcaggcttggtctcgcgcaacgccctagggtcgagtttcatagccgctcggaacttccacgccagcaacacccacctccagaagaccggaactgccgagatgtcttcgatcctggaagaacggatcctgggggcagatacaagcgtggatctggaggagaccggcagagtattgtccatcggggacggaatagctcgtgttcatggcttgaggaacgtgcaggctgaggagatggttgagttctcgagtggtctgaagggaatgtccctgaatttggaacctgacaatgtcggcgtcgtggtttttgggaacgacaaactgatcaaggagggggatattgttaaaagaaccggagccattgtggacggtccaatcggctcgaaaacgcgaagaagggttgggctgaaggctccagggatcatcccccggataagcgtgagggaacccatgcagactggtataaaggcggtcgattcgttggttccaattggtcggggccaaagagagctcatcattggagaccggcaaaccggaaaaacctcaattgcaattgacactatcataaaccagaagcgctttaacgatggctcagatgaaaaaaagaaactctactgtatttatgttgctatcggccagaaacgttctaccgtggcccagctcgttaaacgcctcaccgacgcagatgctatgaaatataccattgtggtgtcggctactgccagcgacgccgctcctctgcagtacctggccccatattccggctgctccatgggtgagtattttcgggataatggtaaacacgccctcattatttacgacgatctgagtaaacaggccgtggcgtaccggcaaatgtctttgctgcttcgacgtccgcctgggcgggaggcatacccaggtgatgtcttttacctccactccagacttcttgagagagcggcaaagatgaatgacgctttcggcggcggctcactcacagctctccctgttatcgagactcaggcaggggacgtaagcgcctacattcctactaatgtaatttcgataaccgacgggcagatcttcttggagaccgagcttttctataaaggtatccgccctgcaattaatgtcgggctttccgtatcacgcgttgggtccgccgctcaaacccgggctatgaaacaagtcgctggcactatgaagctcgagttggctcagtacagggaggtggctgcctttgcccagtttgggagcgacctagatgccgcaacgcagcagttgctgtcacgcggcgtgcgtttaactgaactgttgaagcaggggcaatactcaccaatggctattgaggaacaggtggccgtgatctacgccggagtaaggggctatctggataaactggagcctagcaagattacaaagttcgaaaatgcctttctgtctcacgtggtgagtcaacaccaagccctcctgggcactatccgggcagacggcaagatttctgaacagtccgacgcaaaactgaaagaaatcgtcaccaattttctcgccggctttgaggcatag

SEQ ID NO: 13928 - DNA, 1662 bp, Artificial Sequence
  Description of Artificial Sequence: Synthetic coding sequence
atgttgtctgtccgcgttgccgcagctgtcgtgcgggcattgcctcgtcgagccggactcgtgtcccgtaacgccctgggcagctctttcattgccgctcggaattttcacgcgtccaacactcatttacagaagactggtacggcagagatgtcttctatcttggaggagcgaatcctcggcgcggacaccagcgttgatttggaggaaactggacgcgtgctgagtatcggagacggaattgctcgagtccacgggctgcgaaacgtgcaagccgaagagatggtggagttctcttctgggctcaaggggatgagtttaaacctggaacccgacaatgtgggggtcgtcgtgttcggcaatgataagctgatcaaggaaggggacattgtcaagaggacgggggccattgtggatgtgccagtgggcgaagaactcctgggacgcgtcgtggacgcattaggcaatgcaatcgacggcaagggtcctatcggatctaaaacaagacgacgggtggggcttaaagctcccgggataattccacgcatctccgtccgggaacctatgcaaacaggcattaaagcagtggattctctcgtccccataggacgggggcagcgtgaactgatcattggggaccgacagaccggaaaaaccagcattgccatagataccattattaaccagaaacgctttaatgacgggagcgacgagaagaagaaactctattgcatatacgtggcaataggccaaaagcgatctacagtggcacaattggtgaagcggttaacagatgccgatgcgatgaaatacacaatcgtggtttccgctactgcctcagacgccgctccactgcagtatctcgctccctattccggttgttctatgggagaatactttcgcgacaatggcaaacatgcactgatcatttatgacgacttgtcgaagcaagccgtggcataccgacaaatgtccctgctgcttcggaggccacccggccgagaagcctaccccggcgatgtgttttacctccactcaaggcttctcgagcgcgcggcaaaaatgaatgacgcttttggtggggggtcgctgaccgcattaccggtgatcgagacacaggcaggggatgtgtcagcatatatcccgacaaatgtgatatcaatcacggatggacaaatcttcctcgagaccgaactgttctataagggcatcaggccggctataaacgtcggactatcagtgagtcgggtcggtagcgcagcccagaccagagctatgaagcaggtggccggtactatgaagctcgagcttgcacagtatagggaagtcgcagcattcgcccagttcggttcggacctggatgccgccactcagcagctgttgtcccgcggtgtgaggttgactgagctcttgaagcagggccagtatagcccaatggccatcgaggagcaggtggccgtgatatatgctggcgttaggggatatctggacaaactggagccatcaaaaatcacgaaatttgaaaatgccttcctctctcacgtcgtgagtcagcatcaggccctgctgggaactatccgcgccgatgggaagatctccgaacagtccgacgcaaaattgaaggagattgtgactaacttcttggcgggatttgaggcttag

SEQ ID NO: 13929 - DNA, 1662 bp, Artificial Sequence
  Description of Artificial Sequence: Synthetic coding sequence
atgctgtcagtgagagttgctgccgcggtcgtaagggcacttccaaggcgggccggattagtgtcgcgcaacgcactgggaagttctttcatagccgctaggaacttccacgcaagcaacacccatcttcagaagaccggcactgccgagatgagttccatactggaagagagaatccttggagccgacacttcagttgatctcgaagaaacaggccgcgttctatcgataggtgacggaattgctcgcgtgcacggtttgagaaatgtccaggctgaggagatggtggagttcagctccgggttgaaaggcatgtccctgaatctcgagcctgacaatgtcggtgtggtcgtttttggcaacgataaactcatcaaggagggagatatagtcaagcggaccggggccatcgttgacgtacccgtcggagaagagctgctaggtagagtggttgatgcactgggcaacgccatcgacgggaaaggtccgatcggatctaagacaaggaggcgagtaggcttgaaggctcctggaattatccctcgcattagcgttcgcgagcctatgcaaacagggatcaaagcggtggatagcttagtgccaatagggcgaggccagcgtgagctgatcatcggagatcgccagaccggtaagacgtctatcgctatcgacactattattaaccagaagaggtttaatgatggctccgacgaaaagaagaagctatactgcatctatgttgctatcggacaaaagcgaagcacagtggctcagctcgtaaagcgcctgaccgacgcggatgccatgaagtacacaattgtagtttctgctacagcctctgatgctgcccctctccagtatctagccccttactcagggtgttccatgggcgaatatttccgggacaatgggaaacacgcgctgatcatttacgacgatctgtctaagcaagcggtggcatatcgacagatgtctctgctgctaaggagacctccaggaagggaggcatatcccggagatgtgttctatctgcattctagactcctggagcgggccgccaaaatgaatgatgcgtttgggggggggagcctgaccgccctgccagtgatcgagactcaggccggcgacgtctccgcttatatcccgactaatgtgatcagcatcactgatggccagattttcctagagacagaactattctacaagggcattcgtcctgcaatcaatgtgggactttccgtctcgcgggttgggagtgctgcacaaactcgggcgatgaaacaagtggcaggaactatgaagctcgagcttgcacagtaccgggaggtggctgcgtttgctcagtttggttctgacctggatgccgctacccaacagctgctgtcaagaggggttcgccttacagagctgcttaagcagggtcaatattctccaatggcaattgaagaacaggtcgctgtgatctatgccggagtgcgaggatatctggacaaactggagccttcgaagataacaaaattcgagaacgctttcctgtcccatgtcgtaagtcagcaccaagcgctcctgggtactatcagggcggacggcaaaatctctgaacagagcgatgctaagctgaaagaaatcgtaacaaacttcctggcaggattcgaagcttag

SEQ ID NO: 13930 - DNA, 1512 bp, Artificial Sequence
  Description of Artificial Sequence: Synthetic coding sequence
atgagttctatcttggaagagcggattctgggggccgacacctcagtcgacctggaggagaccgggcgggtcttatcaatcggagacggaatcgccagagtccatggcttaaggaatgtccaggcagaggaaatggtggaatttagctcaggcctcaaagggatgagcctcaatttagagcctgataatgtgggcgtcgtggtgttcggcaacgacaagttaattaaagagggagacattgtgaaaagaacaggcgcaatagtcgatgtgcccgtaggggaggagctgttgggccgtgtcgtggatgcccttggcaatgcgatcgacggaaaagggcctattggcagcaaaacacgcagacgggtgggcctcaaggctccaggcatcattccacggatctcagtgagagagcctatgcaaaccggcatcaaagctgttgatagcctcgttcctattggcagagggcagcgggagctaatcatcggcgaccggcagaccgggaaaacctcaattgcgatcgataccattatcaatcagaagcggtttaacgacggctcagacgaaaagaagaaattgtactgcatctacgtggccattggtcaaaaacgcagcaccgtggcccagcttgtgaaacggctgactgacgccgacgctatgaagtacacgatcgtggtgagcgcgactgcatccgacgcagcacccctgcagtacttagcgccttacagcggctgttctatgggagagtacttccgagacaatggcaaacacgcactgataatttacgacgacttgtctaaacaggcggtcgcctataggcagatgtccctcttgctgcggagaccacctggaagagaggcttacccgggagacgtcttttacctccacagccggttgctggaacgagctgcaaagatgaatgatgcatttggcggagggtcactgactgcactgcctgtaatcgagacacaggcgggagacgtctccgcttatataccaactaatgtgatttccattaccgacggacagattttcctggagactgaactgttctacaagggaatcagacccgccatcaatgtggggctgtccgtgtctagggtgggatcagcggcccagaccagagcaatgaaacaggtggcaggcactatgaaacttgagctggctcaatatagagaagtggccgcctttgcccagtttggtagcgacctggatgctgcgacacagcaactgttgtctagaggtgtgcgcttgaccgaactgctaaagcagggccagtattccccaatggcaattgaagaacaagtggctgtgatttacgccggtgtccgcggttatcttgataaacttgagccatcgaagataactaagttcgaaaatgccttcctttcccatgtcgtgtcacagcatcaggcactcttgggcaccatcagagccgacggcaagattagcgagcagtcagacgccaagcttaaagagattgttactaacttcttggctggattcgaggcctag

SEQ ID NO: 13931 - DNA, 3843 bp, Artificial Sequence
  Description of Artificial Sequence: Synthetic coding sequence
atggacctcgaaggagaccgtaacggaggagcaaagaagaagaattttttcaagcttaacaataaatctgagaaggataaaaaggagaagaaacccacggtgtcagtattctcaatgttccgctacagcaactggctggacaagctttacatggtggtgggtaccttggccgccataatccacggagcgggcttgccactcatgatgttagtttttggcgaaatgacagacatattcgcaaatgcgggaaacctcgaggatctcatgagcaacatcaccaacagatcagacattaatgatacaggattctttatgaatctggaggaagacatgaccaggtacgcttattattacagcggaattggggcgggcgtgctagtggcagcctacatccaagttagcttttggtgcctggcagcgggcagacagatacacaaaatccgtaaacagttctttcatgccatcatgagacaggagatcgggtggttcgacgtgcatgatgtcggcgagctcaataccagacttacggacgatgtatcgaagattaacgaaggaatcggcgacaaaatcggtatgttctttcagtctatggcaactttctttacgggctttattgtggggtttacacgaggctggaaactgaccctcgttattctggctatatctcccgttttaggcctgtctgcagctgtgtgggcaaaaatactctcctcctttactgataaggaactgctggcttacgccaaggccggagccgtggccgaagaggtcctagctgccatcagaacagtaatcgctttcgggggtcagaagaaggaactggaaagatacaacaagaatctagaagaggctaaaagaattggaatcaagaaagcgattacagctaacatcagtataggagctgccttcctgttgatatacgcttcttacgccctggcattttggtacggtaccacccttgtgttgagtggagaatactcaatcggacaggtgctgactgtgtttttctctgtattgatcggagctttcagcgttggccaagcctctccaagtatcgaggccttcgctaacgcaaggggtgctgcctacgaaattttcaagattatagacaataaaccatctatcgactcatatagtaaatccgggcacaagcctgacaacataaagggcaatctcgaatttcgcaacgtgcatttctcttatccctcaagaaaagaggttaagatattaaaaggcctgaatttgaaggtgcagtccgggcaaacagtcgcactcgtcggaaattcagggtgcggcaaaagtaccactgtacagctgatgcaacgtttatacgatccgactgagggaatggttagtgtggacggtcaggacattagaaccatcaatgtaaggttccttagggaaattatcggtgtggtgtcacaggaacctgtgttgtttgcgaccactatcgcagagaatattagatatggaagagagaacgtgacaatggacgagatcgagaaggcagttaaggaggcaaacgcctatgatttcataatgaaacttccccacaagtttgacactctggtgggagagagaggtgcccagctgtctgggggtcagaagcagcgcattgcaattgcacgggcattagtcaggaatccgaagatattgttgctggatgaagcaacctccgctctagataccgagagcgaagccgtggttcaagtcgctctcgataaggccagaaagggccgcactaccattgtaatcgcccacaggctgagtactgtgcgcaatgccgacgttatcgctggcttcgatgatggagtgattgtggaaaagggcaaccacgacgagttgatgaaggagaagggcatatactttaaactagtgaccatgcaaaccgccggaaatgaagtggagctggaaaacgccgcagacgagagcaagagtgagatagacgccctggaaatgtccagtaacgactcccgcagctcactcatcagaaaacggagcactagacgctccgtgcggggatcccaggcccaggatcgcaaactttccacgaaggaggctctggacgagagtataccgccagtgtccttctggcggatcatgaaactgaaccttacagaatggccatacttcgtggtgggtgtattttgcgccattataaacggtggcttacagcctgccttcgctatcatattctccaaaattatcggcgtgttcacaagaatagatgatcccgaaactaagagacaaaattccaacctgttttctcttctgtttctcgctctcggcattatctcatttatcaccttttttctccagggcttcaccttcggaaaggcaggcgagatcctgaccaagcgacttcgctacatggtattcaggagtatgctacgccaggacgtgtcatggttcgacgacccaaagaacactaccggagccttgacaacccgtttggccaatgacgctgcccaagtcaaaggcgccattggtagtcgccttgctgttatcacacaaaatatcgcaaacctgggaactggaattatcattagctttatttacgggtggcagctcactctgctgcttcttgcaatcgtccccatcatcgccatagcaggagtggtggaaatgaaaatgttatcgggacaggccctgaaagacaagaaagagctcgagggtagcgggaaaatagccacggaagctatcgagaattttagaaccgtagtctcgctgacacaggagcagaagtttgaacatatgtacgcccaatctctccaagtgccttatcgaaacagcctgcgaaaagctcatatatttggaattaccttttcctttactcaggcaatgatgtatttcagttatgctggctgtttccgcttcggggcctacctcgtggcgcacaaactcatgtcctttgaggacgttctgcttgtgttctcggccgtggtttttggggcaatggccgtgggccaggtctcctcttttgccccagactacgctaaagcaaagatatccgctgcgcatatcataatgataatcgagaagactcctttgatcgattcttactccaccgagggtttgatgcccaatacactcgagggcaatgttacctttggggaagtcgtgttcaactatccaacccggcccgacattcctgtcctccagggtctctcacttgaggtaaagaaaggacaaacactcgcattggtggggtcttcgggctgcggaaaaagtacggtggtgcaactcctggagcgtttctacgacccactcgctgggaaggtactgttagacggcaaagaaatcaaacggttgaacgtgcagtggcttagggcccacctggggatcgtaagccaggagcctattctgttcgactgcagcattgccgagaatatagcgtatggggacaactcccgtgttgtcagtcaggaagaaatcgttcgagcagccaaggaagcaaacatccacgcttttatcgaaagcctcccaaataagtattctacgaaggtgggcgataaagggacacagctgtcgggcgggcagaagcaacgcatcgccattgccagggctcttgtgcgccagccacatatacttctcttagacgaggctacgtctgccctcgacactgagagtgagaaggtagttcaggaggcactggacaaggcccgagagggtcggacttgcattgttattgcacaccgtttatctacaatccagaacgcagacctaatcgtggtatttcagaacggaagggtcaaggaacacgggacccatcagcagttgctggcacaaaaagggatctacttctcaatggtcagcgtccaggcagggaccaagagacaatag

SEQ ID NO: 13932 - DNA, 69 bp, Artificial Sequence
  Description of Artificial Sequence: Synthetic coding sequence
atggacctcgaaggagaccgaaatggcggggcaaagaaaaagaactttttcaagttgaacaataaatag

SEQ ID NO: 13933 - DNA, 147 bp, Artificial Sequence
  Description of Artificial Sequence: Synthetic coding sequence
atggatcttgagggggatcgaaacgggggggctaaaaaaaagaatttttttaagttgaataacaagagcgagaaagacaaaaaggaaaaaaaacctactgtctcagttttttctatgttcaggtactcgaactggctcgacaagtag

SEQ ID NO: 13934 - DNA, 3186 bp, Artificial Sequence
  Description of Artificial Sequence: Synthetic coding sequence
gcacttagtcctgttatgggcgtctccgccgggtactggccaaagatcctgagcagttttaccgacaaggagcttctggcctacgcgaaagctggcgctgttgccgaagaagtgcttgccgcgatccggacggtcatcgccttcgggggccagaaaaaggagctcgagcgctataataagaatctcgaagaagccaagcggatcgggatcaagaaggccatcacagcaaacataagcattggggctgcatttctcctgatttatgcgagctacgctttggccttctggtacggcacaaccctggtgttgtcaggcgagtactcaatcggccaggttcttaccgtctttttctccgtgctgatcggcgcgttcagcgtcgggcaagcctcaccttcaatcgaggctttcgcaaatgctcgaggcgctgcctatgaaatctttaagataatagacaacaaacccagtatagacagttattcaaagtcaggacacaaacccgataacatcaagggaaacttggagtttagaaacgtgcatttctcctacccttccaggaaagaggtgaaaattctcaagggcctgaaccttaaggtccagtctggccaaaccgttgccctggtcgggaactccgggtgcggcaaaagcacgacggtccagctcatgcagagactttacgaccccaccgagggcatggtgagtgtcgacggtcaagatatcaggaccatcaatgtgcgctttctgagggagataataggggtggtgtctcaggagcctgtcctgttcgcaacaaccattgcagagaatatacggtacggaagggaaaatgtgaccatggatgaaatagaaaaggccgtcaaggaagccaacgcatatgacttcatcatgaagcttccccataagtttgacacgctggtcggtgagaggggcgctcagttaagtggaggccagaagcagaggatcgccattgcgagagcactcgtccgcaacccaaaaatcctcctactcgatgaagctactagtgctttggatacagagtcggaggcggtcgttcaagtcgccttggataaagccaggaagggccgcaccacaatcgtgattgcccaccgcctgtcaacagtacgcaatgccgacgtaatcgccggatttgatgatggcgtaatcgtggaaaaggggaatcatgacgagctgatgaaagagaagggtatctattttaagctcgtgaccatgcagaccgctggcaatgaggtcgagctagaaaacgccgccgatgagtcaaagtctgaaatcgacgctctcgagatgtcatctaatgacagtaggagctcactgattagaaagcgatctactcgccgcagcgtgcgcggctcacaggcacaggacagaaagctgagcacaaaggaggctttagatgagagcatcccccctgtctcgttctggcgcattatgaagcttaacctcaccgagtggccctatttcgtggtaggggtgttctgtgccatcattaacggaggcttacagccagcctttgcgatcattttctctaaaatcattggagtattcactcggatagatgaccctgaaacaaaacgacagaatagtaacctgttctctctcctgtttcttgcgctcggaatcatctctttcatcacgttctttctacagggatttacttttgggaaggcaggggagatcctcaccaagaggcttaggtatatggtattcaggtccatgctcagacaggatgtctcctggtttgatgatcctaaaaatacgaccggcgccctgaccactcgactcgccaacgacgccgcacaggttaaaggcgcaatcggatctaggctggctgttatcacgcagaacatcgccaaccttggaacaggcataataatcagcttcatttacggatggcagctgactctgctcctcttggctattgttcccattattgcgattgccggtgttgtcgaaatgaaaatgctctcagggcaagctctgaaggataaaaaggagttagaaggcagtggtaaaatcgccacagaggcgattgagaatttcaggactgttgtgagcctcacccaggagcaaaagttcgaacacatgtatgcccagtccctgcaggtgccctatcgtaactctctacgcaaagcacacatatttggaattacattctcatttactcaggcaatgatgtacttctcctatgccggatgtttccggtttggtgcctacctggtggctcataaacttatgtctttcgaggatgtgctgctcgtcttctctgcagttgtttttggcgcaatggctgtgggccaggttagctccttcgcccctgattacgccaaagcaaagatcagcgccgcacacattattatgattatcgaaaaaaccccgcttatcgattcctactccactgaaggattaatgccaaacaccctcgaaggtaacgtgacttttggggaggtggtttttaactaccctactcggccagacatccctgtgctgcaagggctttctctggaagttaagaagggtcagacactggccttagtgggttcttccggttgcgggaaaagcaccgtggtgcaattgttggagcgcttctatgatcctctggctggcaaggttctgctggatggaaaagagattaagcggcttaatgtccagtggcttcgagcacatctcggaatcgtaagccaagaaccgatactcttcgactgctcaatcgcagagaatatcgcttacggggacaatagtcgggtggtctcccaggaagaaatcgtacgggccgcgaaggaggccaacatccatgctttcatagaaagcctcccaaataagtactcaacaaaggtgggagataaaggcactcagttgtctggaggacagaagcagagaatagccatcgccagagctttggtgagacagccccatatcctactgctggacgaggctacctccgcgttggatacagagagcgaaaaagtcgtccaggaagcgctagataaagcaagggagggtcgaacctgcatcgtgatcgcccaccgcctgagcacaattcagaacgccgatcttattgtggtgtttcagaatggacgcgttaaagagcacggaacccaccagcaactgctggcccagaaaggcatatacttctcaatggtgagcgtgcaggcaggtacgaaacggcagtag

SEQ ID NO: 13935 - DNA, 3651 bp, Artificial Sequence
  Description of Artificial Sequence: Synthetic coding sequence
atggatttggagggagacagaaatggaggggccaaaaaaaagaatttcttcaaacttaataacaagagcgagaaggacaagaaggagaagaaacctaccgtgagcgtcttcagcatgtttcggtacagcaactggttagataagctctacatggtagttggcactctcgccgctataatacatggcgccggtttaccgctcatgatgctggttttcggggagatgaccgacatcttcgcaaatgccggaaacctggaggatctgatgtccaatataacgaaccggtcagatatcaatgacacgggattctttatgaatctggaggaggatatgacctctgacgtgagcaagattaacgaggggattggtgacaagattggcatgttctttcagtctatggctacattttttacaggttttattgtaggattcactcggggatggaaactgactctcgttattctggccattagccctgttctgggcctgtcagccgctgtttgggcaaagattctgtcctcgttcacggataaggaactgttagcgtatgccaaagcaggggcggtggccgaggaggtgttggcggccatccggaccgtcattgcctttggcggccagaagaaagagctagagaggtacaacaaaaatctcgaggaggctaagcgtatcggtatcaagaaggccattacggccaatatctcaatcggagcggcctttctgctgatttacgcctcctatgcactagcattctggtacgggaccactctggttctgagcggcgaatatagcatcggtcaggtgctgacagtgtttttctcggttctgataggagccttcagcgtgggccaggcctccccaagcatcgaggccttcgccaatgcacgaggggctgcctatgagatcttcaagataatcgataacaaacccagcattgattcctacagtaagtctggccataagccagataacattaaaggaaatctagagttcaggaatgtgcatttctcctacccaagtagaaaagaggtgaaaatcctcaaaggccttaaccttaaggtccagagcggccaaactgtagcactcgtaggcaattccggatgcgggaaaagcaccaccgtccaactgatgcaaagactctatgaccctactgaaggcatggtctccgtggatggacaagatatcaggactattaatgtgcgctttctgcgggagattatcggcgtcgtctcccaggaacccgttctgttcgctacaacaatagctgagaacatccgctatggcagggagaatgttactatggacgaaatcgaaaaggctgttaaagaggccaacgcgtacgactttattatgaagctgccccacaagtttgatacccttgtaggggagcgcggcgcccaactcagcggcggccagaaacagcggattgctattgccagagcgctggtgagaaacccaaaaatcctcttgctagacgaagctaccagcgcccttgacactgagagtgaggcggtcgtacaggtggcacttgataaagctcggaaggggagaacaaccatcgtcatagctcaccgcctatccacagtgagaaacgccgacgtgatagcaggcttcgacgacggcgtaattgtggagaagggaaatcacgatgaactcatgaaggaaaaaggtatctatttcaaattggtaactatgcaaacagccggcaatgaagtcgagctggagaatgctgcagatgagtctaagtcagagatcgatgctctcgagatgagttccaacgactcgcgcagttctcttatccgtaagcgaagcacccgacgatcagtaagaggctcacaggcccaggatcgcaagctcagcactaaggaagccttggacgagagtatccccccggtatctttttggcgtattatgaaactgaacctgactgagtggccttatttcgtggtaggagtgttttgtgcaatcataaatggtggccttcagcctgcctttgccataatcttcagtaaaattatcggcgtcttcaccagaatagatgatcctgagaccaaacggcaaaatagcaacctgttttcactcctctttctggcacttggaattatttctttcattactttcttcctgcagggcttcacatttggaaaagccggggagattcttaccaagaggctgcgttatatggtctttaggtcgatgctgcggcaggacgtgtcttggttcgacgatcctaaaaacacgaccggtgctctgacaacaaggctggctaatgacgcagctcaggtaaagggggcaattgggagccgcctagctgtgatcactcaaaacatcgctaacctgggcaccggaatcatcatttccttcatctacggatggcagttgacattattactgctggcgattgtacctatcatagctatcgcaggggttgtcgaaatgaagatgctgtctgggcaagcgctgaaagataagaaggagctggaggggagtggaaaaattgcgacagaagcgattgaaaactttagaaccgttgtcagcctcacgcaggaacagaagttcgagcacatgtacgcacagagcctccaggtgccatatcggaactccctacggaaagcgcatatattcggcattaccttcagctttacacaagccatgatgtatttctcatacgctggatgcttcaggttcggggcatacctggttgctcataagttgatgagctttgaagacgtgctgctcgtattctcagcggtggtgtttggcgccatggcagttgggcaggtgagttcattcgcaccagattatgctaaagctaagatttccgccgcccacattattatgatcatcgaaaaaacacccttgattgactcttattccaccgaaggactaatgcccaatacacttgaaggcaatgttacttttggggaagtggttttcaattatcctactcgaccggatattccggtgttacagggactctcgttagaagttaagaaaggacaaacactggccctggttggttcatctggctgcggcaagtcaactgttgtccagttgctggagagattctacgaccctctggccgggaaggtcttactggatgggaaggaaattaaaagactgaacgtgcaatggctgcgcgcccacttgggcatcgttagtcaggagcctatcctgtttgactgctcaatcgcggagaacatcgcatatggtgacaactctcgcgtcgtgagccaggaagaaattgtgagagcggctaaagaagccaatatccacgcttttatagaaagcctccctaacaagtactctacgaaagtcggggacaagggtactcaattatccggggggcagaaacagagaattgccatagccagggctctggttcgccagccacacattttattgttggatgaagctacctctgcgcttgatactgaatccgagaaagtggttcaagaagctctggataaagcacgtgagggacggacgtgcatcgtaatcgcccacagattatcgaccattcagaacgctgacctcattgtagtgtttcagaacggacgcgttaaggagcacgggactcaccagcagctgctcgcacagaagggtatttactttagcatggtgtctgtgcaggctgggacaaagcgacaatag

SEQ ID NO: 13936 - DNA, 4401 bp, Artificial Sequence
  Description of Artificial Sequence: Synthetic coding sequence
atggccctgagggggttctgcagcgccgacggatcagatcccctgtgggactggaacgtcacatggaatacatccaaccctgacttcacgaaatgttttcagaatactgttctagtgtgggtgccgtgcttctacctgtgggcctgttttccattttactttttgtacctgtctcgtcacgacagggggtatattcagatgacacccttgaacaaaactaagacagccttgggcttcctcctctggattgtctgttgggctgacctgttttactccttttgggagcgttcacgtggtatttttctggcaccggtgtttctcgtttctccaaccctgttagggatcaccatgcttttggcgaccttcctgatacagctcgagcggcggaagggcgtacagtctagcggtatcatgttgactttctggctggtagcacttgtgtgcgccctggcaattctacggtcaaagatcatgactgcacttaaggaggatgcccaggtagacctgtttagagatataacgttctatgtttatttttctctcctgctgatccagttggttctcagctgtttctcagatagatcccctctcttttcagagaccatccatgatcctaacccctgccctgaaagctctgcgtcttttctgtccaggattaccttttggtggataactggcctgatcgtgaggggttatcgccagcccctggaaggatccgatttgtggtcattgaacaaggaggacacttccgagcaggtcgtgcctgtcctggtcaagaactggaaaaaggagtgtgcaaagactcgcaagcagccagttaaggtcgtgtacagtagcaaggacccagcccagccaaaagaaagttcaaaggtggacgccaacgaggaggtggaggctcttatcgttaaatctcctcagaaagaatggaacccgagtctgtttaaggtcctgtataaaacttttggaccctatttcttaatgtcttttttttttaaggcaatccacgatctgatgatgttttccgggccccaaatcctgaagctgctcataaagtttgtcaatgacacgaaggcccctgattggcagggctatttctataccgtgctcttgttcgtcacggcatgcctccagaccctcgtgctccaccagtactttcatatctgctttgtatctggcatgcgtatcaagaccgctgtgatcggcgcagtctatagaaaggcccttgtgatcaccaatagcgcccggaagtcctcaaccgtgggggaaatagtgaaccttatgagtgtagatgcgcagagattcatggacctggccacatacattaatatgatctggtccgctcctctccaggtgattctagccctctacttgctgtggcttaatctgggacccagcgtgctggctggcgttgccgtcatggtattgatggtccctgtaaatgccgtgatggcaatgaaaactaaaacatatcaagtggcgcacatgaaatccaaagacaatcggatcaaacttatgaatgagatccttaatgggattaaagtactgaagctttatgcatgggagttggcctttaaggataaagttctcgcaatcagacaagaggaactgaaggtgctgaaaaaaagcgcttacctatccgctgttggaacctttacttgggtctgcactccttttctagtggctctttgtacttttgccgtgtatgtaactatcgacgaaaacaacatcctggacgcccagaccgcgttcgtgtctctcgctctattcaacatattaaggtttccactcaacattcttcccatggtgatatccagcattgtgcaagcaagcgtttccttaaagcgcttgcgtatatttttgtcacacgaggagcttgaaccagactcgatagagagacgcccagtcaaagatggcggtggaaccaatagcattacagtgcgcaatgcgacctttacctgggctagatccgacccaccaactttgaacggaatcacattttccatccccgagggagcgttagttgctgtggtcggccaggtgggatgcgggaagagtagcctgctgtccgctctcctcgcagaaatggataaagtggaagggcacgtcgctattaagggttcagtcgcatacgtgcctcagcaggcgtggatccagaacgattctctgcgagagaatattctcttcggatgtcagctggaagagccctactaccgctcagtcattcaggcgtgcgcattgcttccggatctggagattttaccgtctggggataggacggagatcggcgaaaagggtgtcaatctgtccggaggacaaaaacagcgagtttccctggcccgagccgtgtacagtaacgcagacatttatctgttcgatgacccactgagtgccgtagacgcacatgtgggcaagcatatcttcgagaatgtaattggaccaaagggcatgctgaagaacaaaactagaattttagtgactcactctatgagttacctaccccaagtggacgtcattattgtcatgtccggtggaaagatatccgagatgggatcgtatcaggaactgctggctcgggacggggccttcgctgagttcctcaggacctacgcttcaaccgaacaggaacaggatgcagaggaaaatggcgtcactggtgtcagtgggccagggaaggaggcgaagcagatggaaaacggtatgctggtgactgacagcgcaggaaaacaactccagcgtcaactctcctccagcagctcatatagtggagatatcagcagacaccataacagtacagccgagttgcagaaagccgaggccaagaaagaagaaacctggaagctaatggaagctgacaaggctcagacgggacaggtgaagctgtctgtctactgggactacatgaaagccataggactgttcatctcttttttatccatcttcctcttcatgtgtaaccacgtgtcagccctcgcttctaactattggctaagcttatggacggacgacccgatagtgaacggaacacaggagcacaccaaagtaagactttctgtgtacggagccttggggattagccaggggatagcagtgttcggctactccatggccgtgagtatcgggggaatcctggcgagccggtgccttcatgtcgacttgctgcactcaatattacgctcgcctatgtcttttttcgagaggacaccaagcggaaacttggtgaatcgcttttccaaagagctcgatacagtggactccatgatacctgaggtcataaaaatgtttatgggaagcttattcaatgtaattggagcctgtatcgtgatcttgcttgccacacccattgccgccatcataatcccaccactgggtctaatttatttctttgtccagagattttacgtggccagtagcaggcagcttaaacggctggaatctgtgtctcgatcgcctgtgtactctcatttcaatgaaactctcttaggagtgagcgtgattcgggcctttgaagagcaggagcggtttatccatcagagtgatctcaaagtggacgagaaccagaaagcatattacccctcgatcgtcgcaaatcgctggctggcggtgcgcttggaatgcgttggcaactgcattgtgcttttcgctgctctgttcgccgttatcagccgccacagtctaagcgccggcctggtggggctgagtgtgtcttactctttgcaagtgaccacctacttaaattggttagtgaggatgtccagtgagatggaaaccaacattgtcgcagtcgagcgtctgaaggagtacagcgagacagaaaaagaagcaccatggcaaattcaagaaacggctccaccgagctcttggccgcaggtgggtcgggtggagttccggaactattgccttcgataccgcgaagaccttgactttgttttgaggcacataaacgtgactattaatggcggagagaaagtgggcatcgttgggagaaccggggccggcaagtcatcgctgacactcggcctattcagaatcaacgagagcgccgaaggcgaaataattatcgatggcatcaacatagctaagattggattgcacgatctgaggtttaaaattacgatcattccccaggatcccgttttattctccggcagcctgaggatgaacctggaccctttcagtcagtacagtgacgaagaggtgtggacaagtctcgagctcgcccacctgaaggactttgtgagcgccctgcctgacaagttggaccacgaatgcgcggaaggcggtgaaaatttgagagtgattgtcctcgataaaggtgagatccaggagtacggggctccttctgacctactgcaacaaaggggcttattttattcaatggcaaaagatgccgggctggtgtag

SEQ ID NO: 13937 - DNA, 4428 bp, Artificial Sequence
  Description of Artificial Sequence: Synthetic coding sequence
atggccttgcgcggattttgtagtgcagatggctcggatcccctgtgggattggaacgttacctggaacacctcgaatcctgactttacaaaatgtttccaaaatactgtcttggtttgggtcccctgtttttacctctgggcatgttttcctttttacttcttatatctgtccagacacgataggggatacatccagatgactccattaaacaaaacaaaaacggccctggggttcctgctctggatcgtgtgctgggctgacctgttctacagcttttgggaaaggagtaggggcattttcctggcccccgtgttcttggtgtctcccactttgttgggaattactatgctgctggctacgtttctcattcaactggaacgtaggaagggggtccagtcatcgggcataatgctgactttctggcttgtggccctcgtgtgtgccctcgcaatcctccgaagcaagataatgactgcactgaaagaggatgctcaagtggacttgtttcgcgacattaccttttatgtctatttcagcctgctgttgattcaactggtcctgagctgtttttctgatagatctcctcttttctctgaaaccatccacgaccctaatccctgtcctgagtcatccgcctccttcctgtctaggattactttctggtggatcaccggactgatcgtgcgtggctatcggcagcccctagaagggtcggacctctggtctctgaacaaggaggataccagcgagcaggtcgtgcccgtccttgtcaaaaattggaagaaagagtgtgctaaaacccggaaacaacctgtgaaggtggtctactcctccaaggatcctgcccaaccgaaagagagcagtaaggtagatgcgaacgaggaagtggaggcgctaattgtgaaaagcccccagaaggagtggaaccctagcctgttcaaagtactctacaagacctttggcccatactttctaatgagttttttctttaaagccattcacgacttaatgatgtttagcggcccccagatcttaaagcttctcattaagtttgtgaacgacaccaaggcccccgactggcagggttatttttatacagtcttgctgtttgtgacagcctgcctgcagaccctggtgctgcaccagtatttccacatctgtttcgtgagtggcatgcgaatcaagacagcagtcatcggagcagtctatcgaaaagcacttgtaattacaaattctgccaggaaaagctccacggttggcgagattgtgaatctgatgtccgtggacgctcagcgttttatggatctcgccacctatattaatatgatctggagcgcgccacttcaagtcatccttgccctctacctgctttggttgaatctaggaccttctgttcttgcgggagtggctgttatggtattgatggtcccagttaatgcagtgatggctatgaagaccaagacctaccaggttgcccatatgaagagcaaagacaaccgtatcaagctaatgaacgaaattcttaatgggatcaaggtgttgaagctgtacgcctgggagctcgccttcaaggacaaggtgctggccattcggcaggaggagctcaaggtgctaaaaaagtcagcatacctgagcgccgtgggcacattcacctgggtgtgtacgccattcctcgtggccctctgtacatttgccgtatatgtaacaatcgacgaaaacaacattcttgacgcacagacggcctttgtgagtctagccctgttcaatatattaaggtttcccctgaatattctgcctatggtgatctcatccattgtgcaggcgtcagtaagcctcaaacggttgaggatatttctgtctcacgaggagctcgagccagacagtatcgaaagaaggccagtcaaggatggtggtggaacaaactctatcacggtgagaaacgctacatttacatgggccaggagcgatccgcccacactgaacggcatcacgtttagtattcccgagggagcattggtcgctgtcgtgggccaagtcgggtgcggtaagagctctctgctttctgccctactcgcagagatggataaggttgaagggcacgtggcaataaaaggatcagtggcctacgtgccacaacaggcttggatccagaacgactcccttagggaaaacattctgtttgggtgtcagcttgaggagccttattaccgttctgtgattcaggcctgtgctctgcttcctgatcttgagattttgccttcaggggacaggacggaaatcggtgagaaaacgcgcatacttgtgacacacagtatgtcttacttgcctcaggtggacgtgatcattgtcatgagtgggggcaagatctcagagatgggctcttaccaggagttgctggctagagacggcgcgttcgccgaattcttgcgtacctacgcttctactgagcaagagcaggatgccgaggaaaatggagttactggcgtgtcagggcccggcaaggaggccaaacagatggaaaatggaatgctcgtcaccgactccgccgggaagcagctgcagcgacagttgtcctcctcctcatcgtacagcggcgacattagtcgccaccacaacagtaccgccgagctgcagaaggctgaggcaaaaaaggaggagacctggaaattgatggaagcagacaaagcccagaccggccaagtaaaactgtcagtgtactgggactacatgaaggcaataggcctctttatcagctttctgtcaatctttctgtttatgtgtaatcacgttagtgcgctggctagcaattactggcttagcttgtggaccgatgaccctatagtcaatgggacacaagagcatactaaggtgcgtctgtctgtttacggcgctctgggcatctcccaaggtatcgccgtctttggatacagtatggccgtttcaattgggggcatcctggccagccgctgcttgcatgtagatttgctccattctatcctcaggagcccaatgtctttctttgagaggactccctccggcaaccttgtgaatcggtttagcaaagagctggacactgtggactccatgatacccgaggtgattaagatgttcatgggatccttgttcaacgtgattggtgcctgtattgtgatcctactggccactcccattgctgctattataatccccccgctgggactcatctattttttcgtgcagcggttttatgtggctagcagcagacagttaaagcggctggagtcggtcagtcggtctccggtgtatagtcattttaacgagacgctgctgggagtctccgtgatcagagctttcgaagagcaggagcgattcatccaccagtctgacctcaaggtcgatgaaaatcagaaggcttactacccgagtattgtagcgaatcggtggttggctgtgaggctagagtgcgtcggcaactgcattgtcctgttcgccgccttattcgccgtgattagcagacactcactgagtgcaggtctggttgggttgagcgtaagctatagcctccaagtcaccacctacctgaattggctagtgcgcatgtcaagcgaaatggaaactaacattgtcgcagttgagcgtttgaaggagtatagcgaaacagagaaggaagccccatggcagatccaggagacggctccgcctagtagctggccgcaggtaggtcgagtggagtttaggaactattgtctgcgctacagagaggatctggattttgtgctccggcacatcaacgtcactatcaacgggggggagaaagttggcatagttggacgcacaggcgctggcaagtcctcacttaccctcggtcttttccggataaatgaatctgccgaaggggaaattattatagacggtataaatattgcaaaaatcggtctccacgacttacgattcaaaataaccataatcccgcaggacccggtcttgttttctggatctctgcgcatgaatttggacccattttctcagtactccgatgaggaggtatggacgtcccttgagctggcccatctgaaggattttgtgtctgcactccctgataaattggaccatgagtgcgctgaaggtggcgagaacctgtctgttggtcagaggcagctggtatgtttggctcgggcccttctccgcaaaacgaagatcctcgtactcgacgaggccactgctgccgtcgatctcgagaccgatgaccttatccagagtaccatccgcacccagtttgaggactgtacagtgttaaccatcgcccatcgcctcaacaccattatggactacactcgtgtgatcgtactagacaaaggagaaatacaggaatatggcgccccgagcgacctgttgcagcaacgcggtcttttctatagtatggccaaggacgcgggccttgtctag

SEQ ID NO: 13938 - DNA, 4251 bp, Artificial Sequence
  Description of Artificial Sequence: Synthetic coding sequence
atggccctgcgcggcttttgttcagccgacggtagcgaccctttgtgggattggaatgtgacttggaacacaagcaacccggactttaccaaatgcttccagaatacagtcttagtctgggttccatgcttctatctatgggcttgtttccccttctatttcctctacctgtccaggcatgatcgcggatatatccagatgacaccgctcaataaaaccaaaaccgcccttggcttcttgctgtggatagtctgttgggcggacttgttctactccttttgggagaggtccagagggattttcctggctccagtgtttctggtttccccaacgctgcttggcattacgatgctcctggctacctttttaatccaactggagcgccgaaaaggcgttcagagctcaggtatcatgctgactttctggctggtggcgcttgtttgtgccttagccatactccgaagcaaaatcatgaccgccctcaaagaggacgcgcaagtggacctgtttcgcgacataaccttctacgtatatttttccctcttattgatccaattggtcttgtcatgtttctcagatcgaagcccactgttttccgagacaatccacgatcccaatccgtgtcctgagagctctgctagcttcctgagtagaataacattttggtggatcaccggccttattgtacgaggatacagacagcctctcgaaggtagcgatctctggtccctgaataaggaagatacaagcgagcaagtggtgcctgtgctcgtgaagaattggaagaaggagtgtgcaaagaccaggaaacagccagttaaggtggtgtacagcagtaaggatccagcccagcccaaagaaagctcaaaggttgacgcaaacgaggaggtcgaagcgctgattgtgaaatcgccccagaaggaatggaacccctccttgtttaaagttttatacaaaacctttggcccatacttccttatgtcgtttttttttaaggcgattcacgatttgatgatgttttctggacctcagattctgaagctcctgatcaaattcgtcaatgatacaaaggcccccgactggcaggggtatttttacacagtgctgttgttcgttactgcttgtctgcagaccctcgtgctgcaccagtatttccatatctgtttcgtgtctgggatgaggattaaaaccgccgtcatcggagccgtgtaccggaaggcgctagtgattacaaattcagcccgaaagtcatctactgtgggcgaaatcgttaacctcatgtcggtggacgcccagcggttcatggacttggcgacatatataaatatgatttggtcagccccactgcaagtaatactagcgctgtacctcctttggctgaatctcgggccaagcgtcctcgctggagtggcggtcatggtcctaatggtccctgtcaatgcggtcatggctatgaaaacaaaaacgtatcaggtagcacacatgaagtctaaggacaaccgcatcaagcttatgaatgaaatcctcaacggcatcaaagtcttaaagctctatgcttgggaactggcctttaaggataaggtgttggcaatcagacaagaagagctcaaagttcttaaaaaatctgcgtacctgagtgcggtaggcacttttacctgggtctgcacgcccttccttgtggccttatgcacattcgcagtctacgtgaccatcgacgagaacaacatcctggacgcccagaccgccttcgtgagcttggccctgtttaacatcttgagatttcctctcaacatcctgccaatggtcatatcctcaatcgtacaagcctccgtcagcctgaagaggctaaggatctttctcagccatgaagaactcgaaccggattcaatagaaaggcgccccgtaaaagatggaggcggaacaaattctattacagtaaggaacgccactttcacctgggcccgaagcgatccacctacattaaacggaataacttttagcataccggagggagccctggttgctgttgtgggccaggtcggttgcggcaagtcctcccttctgtccgccctgcttgccgagatggacaaagtggagggccacgtagccatcaagacgagaatcctagttacacactccatgtcttacctcccccaggtggacgtaatcattgtgatgtccggagggaagatctcagagatggggagctatcaggagcttcttgcccgggacggtgcattcgcagagttcttacgcacctacgcctctacagagcaggagcaggacgctgaggaaaatggtgtgaccggcgtgtctggaccaggtaaagaagccaaacagatggagaatggaatgctggtgacagattccgcggggaaacagctccagcgacagttgtcgtcttcatcctcttactctggcgacatctcccgtcatcacaacagtacggccgagctccagaaagccgaagctaaaaaggaggaaacatggaaattaatggaggccgataaggcccagactggccaagtgaagctgagcgtgtattgggactatatgaaggccattggattgtttatcagctttttatctatcttcttgttcatgtgcaaccatgtgagcgcgctggcctccaactactggctttcgctttggacagatgatcctatcgtcaacggcactcaggagcatactaaggtgaggctctcagtctatggagcactcggaatctctcagggcatcgcagtgttcggctactccatggccgtgagcatcggtggcatcctggcgagcaggtgtcttcatgtggatcttctgcattcaatccttcgtagccctatgagcttctttgagaggaccccctcaggcaacctggttaaccggttctccaaggagctggacactgtcgactctatgattcccgaagtaattaagatgttcatgggttccctgtttaatgtgataggcgcatgcatcgttattctattagcaacacccatagccgctatcatcatcccacctctaggactgatctatttcttcgtccaacgcttctacgttgcttcttcgcgacagctgaaacggctggaatccgtgagccggagccctgtgtactctcactttaatgagaccctcctcggggtgagtgtcatccgcgcctttgaagagcaagagcgattcattcatcaatcggatttaaaggtcgacgagaatcagaaggcctactacccttccattgtagccaaccgttggctcgccgtgagactcgaatgcgtcggaaactgtattgtcctgtttgccgccctgttcgccgtgatcagccgccattccctctccgccggtttggttggactgtccgtaagctacagcttacaggttaccacatacctcaactggctcgttagaatgtcctctgagatggagaccaacatcgtggctgtggagagactcaaagaatacagcgagacggagaaagaggctccctggcagatccaggagactgctcctccctcgagctggccacaggtggggcgggtcgaattcagaaattattgcctgcgctatcgagaggacctggactttgtgcttcggcacatcaacgtgaccatcaacgggggagagaaagttggaatagttggccgcaccggggccggaaaaagcagtctgacactggggctttttcggataaacgaatcagccgagggcgagatcatcattgatgggataaacatcgcgaagattggcctgcatgacctgaggtttaagatcaccattattcctcaggatccggtcctgttcagcggatccctgagaatgaatcttgaccctttctctcagtacagcgacgaagaggtgtggacctccctcgagctggcccatttgaaggatttcgtgagtgcattgcccgataagcttgaccacgagtgtgccgagggaggggaaaacctatccgtgggacaacgtcagttagtgtgcctggccagagcactgctgcgcaaaaccaaaatcctcgttctcgacgaggccacggctgccgtcgatctcgagacggacgacctgatacagtcgacaattcggacacagtttgaagattgtacggtcttaactatcgcccatagactgaataccattatggattacactcgggtgatcgtccttgataaaggggagatacaggagtatggtgcaccctctgacctgctgcagcaaaggggactgttctactcgatggcaaaggatgccggtcttgtgtag

SEQ ID NO: 13939 - DNA, 4419 bp, Artificial Sequence
  Description of Artificial Sequence: Synthetic coding sequence
atggccctcaggggcttttgttccgcagatggatcagaccctctctgggattggaatgtcacgtggaatacatctaaccctgactttactaagtgtttccagaatactgtgctggtatgggtgccatgcttttatctttgggcatgtttccctttctactttctctatctcagtcggcatgatagaggctacattcagatgacccctctcaataaaacaaaaaccgcactggggtttttactgtggatcgtgtgctgggcagacctgttctactctttttgggagcgttctcggggcatctttctggcacccgtcttcttggttagtcccacccttctgggtattaccatgctgcttgctacatttctgatccagctcgagcgccgaaaaggggttcagtcaagtggcatcatgctaaccttttggctggtcgccctggtttgtgcattggccatcttacgcagcaaaattatgactgccctcaaggaggatgcccaggtcgaccttttcagagatatcacattctatgtctatttttctctgctgttgatccaacttgtgctgtcatgcttctcagataggagccccctgttctcagagacaattcacgatcctaatccttgtcctgagagcagtgcaagtttcttaagtcggattaccttctggtggattactggacttatcgtgcggggctaccggcagccactggagggcagcgatctatggagtcttaacaaggaggatacatccgaacaggttgtgcccgtacttgtgaaaaactggaagaaggaatgcgcaaagactagaaagcagcccgtaaaagtcgtctacagtagtaaggaccctgctcagcctaaggagagctctaaagttgatgcgaacgaagaggtggaagcattaattgtgaagtctccccagaaagaatggaacccctccctctttaaagtgttatataagacatttggcccatacttccttatgtctttctttttcaaagctatccacgatctgatgatgttcagcggcccccagattctgaagctcttgataaagtttgttaatgacacgaaggcacctgattggcagggatacttctatactgtgttattgtttgtcacagcgtgtcttcaaacactggtactgcatcagtatttccatatttgcttcgtcagcggtatgagaatcaaaaccgccgtgattggggccgtctatagaaaagctttggttataaccaatagcgctcgaaaatcctccaccgtcggagagatcgtgaacctcatgagcgtagatgctcagaggtttatggatttggccacatatataaatatgatctggtccgcgccacttcaagtcatactagctctctatctactttggctgaaccttggcccctcagtgctagccggtgtcgctgtaatggtgctcatggtgcctgtcaacgcagttatggccatgaaaaccaagacatatcaggtcgcccatatgaagtccaaggacaaccgtattaagctgatgaacgagattctgaatggcatcaaagtactgaaactgtatgcgtgggagctggccttcaaagacaaagttctcgccatccgccaggaggaactgaaagtgctgaagaagagcgcctacttgtccgcagtggggacctttacatgggtttgtactccctttttggtagctttatgcacattcgcagtctatgtgaccattgatgagaataacattctcgacgcccaaaccgcatttgtgtccctggctctgttcaatatcttgcggtttccgctcaacatcctgccgatggttatctcatccatagtgcaggcttccgtgtctctgaagcggcttaggattttcttatctcatgaagagctggagccggactcaattgagaggcggccagtcaaagacggtggggggaccaatagcatcactgtccggaatgccaccttcacttgggctagatctgaccctcctaccctcaacggtatcacgttctccatcccagaaggcgccctagtagccgtcgtcgggcaggtggggtgcggcaaatcctcactcctttcggctctactggccgaaatggataaagtcgagggccacgttgccatcaagggcgttaacttgagcggtggccagaagcagcgcgtttcactcgctagagccgtctacagtaacgcagatatctacctcttcgacgacccattatccgcggtagacgcccatgtgggaaagcacatatttgagaacgtgattgggccaaagggtatgctgaaaaacaagactaggattttggttacccactccatgtcgtacctgccccaagtggacgtcattattgtgatgtccggcggaaagatcagcgaaatgggctcttaccaggagctactagctcgagacggtgcctttgccgagtttctgaggacatacgctagtactgaacaggagcaggacgccgaggagaatggcgtgacaggagttagcgggccaggcaaggaggcaaaacagatggagaacggcatgctggttaccgattccgctggcaagcagctgcagcgacagctgagctcttctagcagctatagcggggacatctcaaggcaccacaactcaactgctgagctgcaaaaggccgaagccaagaaagaggagacttggaagctgatggaagccgataaggcacagacaggccaagtcaaactttccgtgtactgggactatatgaaggctatcgggctcttcatttcctttctctccatctttctgttcatgtgtaatcatgtgtcagctctggcttcaaactactggctgtctctgtggactgacgacccaatcgttaacggcactcaggaacataccaaggtgagactaagcgtctacggagcgctggggatcagccaaggcatcgctgtgttcggttactctatggctgtctccatcggagggatcttggcctcacgctgcctccacgtcgacctcctgcactccatcctgcgatccccgatgtccttctttgaacggacccccagcgggaacctagtgaatagattttcgaaggagctcgatacagtggatagcatgatacccgaggtgataaaaatgttcatgggttcactgttcaatgttattggagcgtgtatcgtgatccttctggctacaccaatcgctgccattataatccctcccctggggctaatttatttcttcgtacagcgtttctacgtagcatctagcaggcagttgaaaagactcgagtccgtctcgcgctcaccagtctacagtcatttcaatgagaccctgctcggggtgagtgtgatcagggcttttgaggaacaagaacggttcattcatcagtccgatcttaaggtggacgagaaccagaaggcttattatccctcaatcgttgcaaataggtggctcgctgttcgtctcgaatgcgtgggtaattgtatagtgctatttgccgccctgttcgccgtgatctccagacactccctcagcgccggactagtcgggcttagtgtcagctacagcctgcaggtgaccacatatctgaactggctggtgcgcatgtcatccgaaatggagactaacatagtcgctgtggaacgcctgaaagaatactccgaaaccgagaaggaagccccatggcagatacaggagacggcccccccttcctcttggccccaggtgggtagagtggaattccgtaattactgtttgaggtaccgcgaagacctcgattttgtactgcggcacataaacgtaaccattaatgggggcgaaaaagtgggaatcgtcggtaggacgggcgcaggtaaatcatcactcaccttaggcctgtttcggataaacgaaagcgctgagggggagatcattattgacggtattaatatcgctaagatcggcttacatgacctgcggttcaaaataaccatcatcccccaggaccccgtgctgtttagcggctctctgcgcatgaatctcgacccgtttagccaatatagtgatgaggaagtgtggacctctctggaacttgctcacctcaaagattttgtatccgcactgcctgataagctagatcatgagtgcgccgaaggaggagaaaatctaagcgttgggcagcgtcagttagtgtgccttgcgcgagctctcctacgaaaaaccaagattttggtgctcgacgaggccacagctgctgtcgatcttgaaaccgatgatctcattcagtccactatcaggacccagttcgaggactgtaccgtgttgaccattgctcaccgtttaaacactatcatggattatacaagagtaatcgttctggacaaaggcgagatccaagagtatggagccccttcagacttactgcaacagagggggctcttttattcaatggctaaggacgctgggctcgtctag

SEQ ID NO: 13940 - DNA, 4626 bp, Artificial Sequence
  Description of Artificial Sequence: Synthetic coding sequence
atggctctgagaggattctgctcagctgatggatccgaccctctctgggactggaacgtgacctggaacactagcaaccctgacttcacaaaatgcttccagaacacagtgcttgtttgggtgccgtgcttctacctgtgggcctgcttcccgttctacttcctttacctctcacgtcacgataggggctatatacagatgacgccactcaacaagactaagacagccctaggcttcctgctgtggatcgtgtgttgggccgacctgttctactctttctgggagcgctctcgcggcatcttcctggcacctgtgtttttggtatctcctaccctgctggggatcaccatgttactagcgactttccttattcagttggaacgaagaaagggcgtgcaatcttctggaattatgctgaccttctggctggtcgccctggtgtgcgctcttgccattctcagatctaagatcatgacagccctcaaggaagacgctcaggttgacctgttcagagatatcacattttacgtatattttagtctccttctgattcagctggtgctgtcatgcttttcggacagatctcctctattctctgaaactattcatgatccgaatccatgcccagagtcttctgcatctttcctatccagaattaccttctggtggatcactggtttgatcgttagagggtataggcagcctctggaagggtctgacctctggagcctcaataaggaggacacctctgagcaagtggtgccggtcttggttaagaattggaagaaggaatgtgccaagacaagaaaacagcctgttaaggttgtgtatagttccaaggaccctgcacaacccaaggagagttccaaggtcgacgcaaatgaggaagtagaagccttgatcgtcaagagtcctcaaaaggagtggaatccttccctgttcaaagttctctacaagaccttcgggccctattttctgatgagcttctttttcaaagctatccatgatctaatgatgttttccggtccgcagattctgaagctcttaatcaagttcgtgaacgacactaaggctccagattggcagggctacttctataccgtcctgctgttcgtgacagcttgtctgcagacactggtgttacaccaatattttcacatctgtttcgtctctggcatgcgaataaagacagccgtcatcggcgccgtatataggaaggccctggttattactaattctgcccgcaagtcttccacagtcggggagattgtgaatctaatgtcggtggatgcccagcgcttcatggacctggccacatatatcaacatgatttggtccgctcccctccaagtcatactggctctgtatctcctgtggctgaacctggggcctagcgttctcgcaggcgtcgccgtgatggtgctgatggtgcctgttaacgccgtgatggcgatgaagaccaagacctaccaagtcgcacacatgaaaagcaaggacaatagaatcaaattaatgaacgagatactgaatgggatcaaggtgctgaaactttacgcctgggaacttgcctttaaggacaaagtgctcgccatacgccaggaagagctcaaggtgttgaagaaatcggcttacttgtccgctgtcggaactttcacatgggtttgcacaccattcctcgtggccctttgtactttcgccgtgtacgtaaccattgacgaaaacaatatattggatgcgcagactgcctttgttagcctcgcgttgtttaatatactgaggttccccctgaatatactgcctatggtgatttctagtattgtgcaagcttctgtgagtctgaagcgcctaagaatctttttaagccatgaagaactcgaaccagattcaatcgagcgaaggcccgtaaaggatggtgggggcacaaattccataaccgttcgcaatgcgacgtttacctgggcacggtcagacccacctacgctaaatggcatcaccttctcgatcccagagggcgctcttgtggcggttgtgggtcaagtcggttgtggcaaaagttccctgctgagcgctctgctcgccgagatggataaggtggagggacatgttgcgatcaaaggttccgtcgcatacgttccccaacaggcgtggatccagaatgacagcctccgcgagaatatcctgttcggatgccaacttgaggaaccctattatcggtcagtgatacaggcttgcgccctgctccccgatttggagattcttcctagcggcgacagaaccgagattggagaaaaaggcgtgaacttgagcgggggtcaaaagcagagggtcagcctcgctcgggccgtatacagtaatgcggatatctacttgttcgatgaccctttgtccgctgtggacgctcacgttggcaagcacattttcgaaaacgtcataggtcctaaaggcatgctcaagaacaagactcgcatattagtcactcactctatgagctatctcccccaggtagacgtgatcatcgtgatgagcggtggcaagataagcgaaatgggaagctatcaggaactgctcgcaagggatggcgcattcgccgaattcctgcgaacctacgcgtcaaccgagcaggagcaggatgcagaggagaacggcagcactgtcatggatgaggaagaagcaggagtgactggtgtgtcaggacctggcaaggaggccaagcagatggaaaatggcatgctcgtaaccgactctgccggaaaacagctacaacgtcaattaagctcctcttcctcctactctggagatattagtcgccatcacaactctaccgccgaactgcaaaaggcagaggcaaagaaagaagagacatggaagctcatggaagccgataaggctcaaacgggacaagtaaagctttcagtctactgggattacatgaaggcgatcggtttattcatctcattcctcagcatcttcctgttcatgtgtaaccacgtgtctgccctagctagcaactactggctctctctgtggacggatgaccctattgttaacggcactcaggaacataccaaggtccgcttatccgtatacggggctcttggtatctcccaggggattgccgtgttcggctactccatggccgtctctattggcggaatcctcgcaagccggtgtctccacgttgacctgctacatagtatcctacgctctcccatgtcgtttttcgaacgcacaccatctggaaatctggtgaaccgctttagtaaggaactggatactgttgattcaatgatcccggaagttattaaaatgtttatggggtcactctttaatgtgattggggcctgcatcgtaatccttcttgcaaccccgatcgccgccatcatcatccctccattgggcctgatttacttcttcgttcagagattttacgtcgcctcctcccgccaactgaagcggctggaaagcgtgtctcgctccccagtgtattcccattttaatgaaaccttgttgggcgtgtcagtgatccgagccttcgaagagcaggaacgcttcatacaccagtcagacttgaaggttgacgagaaccagaaagcctactatcctagcatcgtggctaaccgctggctagccgtcagactggagtgcgtggggaattgcatcgtattatttgccgccctgttcgccgtgatcagtcgccacagcctgtctgcaggtctggtgggtttgtcagttagctatagcctgcaggtcaccacttatctcaactggctggtacgaatgagttcagagatggagacaaatatcgtagcagtagagaggttgaaagaatactccgaaaccgagaaggaggcaccctggcagatccaggaaactgcccccccgagctcatggccccaggtcggtcgagttgagttccgaaattactgtcttcggtaccgcgaagatctggactttgtgctcaggcacattaatgttactattaatggtggagagaaggtgggcatcgtgggcagaaccggggcagggaaatcttcactgacactgggattatttcgaattaacgagtctgcagagggcgagatcattatagatggtatcaatatagccaagatcgggcttcacgatctaagattcaagatcaccatcatcccacaggatccagtcctcttctctggttccttgagaatgaatctggatcccttctcgcagtacagcgatgaagaagtgtggacctcactggaactcgcccatctgaaagatttcgtttctgcactgcctgacaaactcgatcatgaatgcgccgagggcggcgagaacctttccgtcggacagaggcaactcgtctgccttgcccgtgccctactgcgcaagacaaagattttggtgctagacgaggcaaccgctgccgttgacttagaaacagatgatctaatccagtctacaatcagaactcaatttgaagattgcaccgtgctaaccattgcgcatcgtctgaatacaatcatggattatacacgtgtcatcgtccttgacaagggagagattcaggagtatggagcaccttccgatctgctgcaacagcgcggccttttctactccatggccaaggacgccgggctagtgtag

SEQ ID NO: 13941 - DNA, 4596 bp, Artificial Sequence
  Description of Artificial Sequence: Synthetic coding sequence
atggcactgagaggattctgttcggctgatggctccgacccactctgggactggaatgtcacttggaacacgagcaatccagacttcaccaagtgctttcagaacactgtccttgtctgggtcccttgcttttacctgtgggcgtgcttcccgttttattttctatacctgagcagacatgatagggggtatatccagatgactccgttaaacaagaccaaaaccgcactcgggttcctgctttggattgtgtgttgggctgacctgttctattctttttgggaacgcagcagaggaatatttctggcacccgtgttcttggtgagcccgactttgcttggcatcactatgctactggcaacatttctgattcagttagagcgccgaaaaggagttcagagcagtgggatcatgctgaccttctggctggtggctttggtgtgtgctctggctatcttacggagcaagatcatgaccgccctgaaggaagacgcacaggtggacttgtttcgggatatcacgttttatgtgtattttagcctcctgctcattcagttagtgctctcttgcttcagcgaccgctcccccctgttttctgagactatccacgaccctaatccctgcccagagagttcagcaagtttcttgagccgcataactttctggtggatcactgggctcattgtaagaggctacaggcaaccgctcgagggcagcgacctctggtctctgaataaagaggatacgtccgagcaagttgtacccgtcctggtgaaaaattggaagaaggagtgtgcgaaaactagaaagcaacctgtcaaagtagtgtacagcagcaaagaccccgcacagccaaaggagtcaagtaaggtggatgcaaacgaggaagtcgaggccctcatcgttaagagcccacagaaggaatggaacccaagcttgtttaaggtcctctacaaaacctttggcccatacttcctgatgtccttcttcttcaaggccatccacgatctgatgatgttcagcggcccccagatcctgaaattattgattaaatttgtgaacgataccaaagcgcctgattggcaggggtatttctataccgtactgctgttcgtgaccgcctgccttcagaccctggtcctgcaccaatactttcacatctgcttcgtctctggcatgaggattaagacagctgtgatcggagccgtctataggaaggcactcgtcattaccaactcggcaagaaaaagcagcacagttggcgaaatcgtgaatctgatgagcgtcgatgcccaaagatttatggatctggctacctatatcaacatgatttggtctgcacccttacaggtcattctcgctctctacctcctgtggctgaacctgggacctagcgtgctcgctggggtagctgtcatggttctgatggtgccagtcaatgccgtaatggctatgaagaccaagacgtatcaggtggcccatatgaaatccaaagataatcgtattaagctcatgaacgaaatcttaaacggtattaaggtgctgaaactgtacgcctgggagctggcctttaaggataaagttttagccataaggcaggaggagctgaaggtcctgaaaaagagtgcatatctgtctgctgtgggaacttttacttgggtgtgtacaccgtttctggtggcactctgtacgttcgcagtttatgttacgattgacgagaacaacatcctggacgctcagaccgccttcgtaagcctcgccctttttaatatcctgagattcccactgaatattcttccgatggtgatttcatctattgtgcaggcgagcgtctctcttaagagacttagaatcttcctgagccacgaggaactcgagcccgattccattgagcggagaccagtgaaggatggaggtggcacaaatagcatcactgtgaggaacgctacttttacgtgggctcggagtgaccctcctactctcaatggtatcacattctccatcccagaaggtgcactggttgctgtagtgggccaggtcgggtgcggaaaaagctctttacttagtgctctgctggctgaaatggacaaggtggagggccacgttgccattaaaggatccgtcgcatacgtgccccaacaagcttggattcagaatgacagcctgagagagaacatcttgttcggctgtcagctagaggagccatattaccgcagcgtaattcaggcttgtgcgctcttgcccgacttggaaatcctgcctagtggagatcgcactgaaattggggaaaaaggcgtgaatttaagcggaggtcagaagcagagggtttcattggcccgcgcagtctactctaacgccgatatttacctatttgatgatcccctctccgccgtggatgctcacgtgggcaagcacatttttgaaaatgttattggaccaaagggcatgcttaaaaacaaaacaaggattctggtaacccattcaatgtcctacctacctcaggttgacgttataatcgtaatgtctggaggaaagatttctgagatgggatcttatcaggaacttctagcccgggacggtgcttttgcagaattcttgaggacctacgctagtaccgaacaagaacaagacgctgaggagaatggagtcacaggagtttcagggccagggaaggaggccaagcagatggaaaatgggatgcttgtgactgacagtgccggcaaacaactgcagcgtcagctctcttcaagttcatcttacagtggggacatcagccggcaccataacagtaccgccgaactgcagaaagctgaagcaaagaaggaagagacatggaaactgatggaagccgataaggctcagacgggccaggtgaagctatctgtgtactgggactacatgaaggccatcggcctatttatttcttttttgtccatctttctgttcatgtgcaaccacgtaagtgccctcgccagcaactattggctcagcctgtggactgatgatcccattgttaacggcacccaggaacataccaaggtgcggctcagtgtctatggcgcactcgggatatctcaggggatcgccgtgtttggatacagcatggccgtgagcattggcgggatcctcgcctcacggtgcctgcacgttgacctgctgcattccatactccggagccctatgtccttttttgaacggaccccaagcgggaacctggttaacaggttctcaaaagagttggatacggtggacagcatgattccagaagtgataaagatgtttatgggttccctctttaacgttataggggcttgtatagtcatactcttggcgacaccgatcgccgcgattataatcccaccactcggcctcatctacttctttgtacagcggttctacgtagccagtagccggcagcttaaacgactagaatcagttagtcggtctccagtttatagccattttaatgaaactttactcggggtcagcgtgatcagggcattcgaggagcaggagagattcattcaccagagcgacctgaaagtggacgagaaccagaaagcatattaccccagcatcgtagccaacagatggttggcggtgaggcttgagtgcgtgggaaattgtattgttctctttgctgccctgtttgctgtcatcagtcgacactcactctcggctggcctcgtgggtctgtctgtcagctactccctgcaagtgactacctatctaaattggctggttagaatgagcagtgagatggaaaccaatatagttgcagttgagagacttaaggagtactcagagacagagaaggaggctccgtggcagattcaagagacagcccctccaagtagttggccccaggttggacgagtggaattcaggaattactgcttgcgttaccgcgaggacctggacttcgttttgaggcacatcaacgtcactatcaatggcggtgagaaggtgggcattgttgggcggacaggggctggaaaatcctcattgacactgggcctcttccgcatcaatgaaagcgcagagggggaaattattattgacggtataaatatagcaaagataggcctacatgatctgcgtttcaagatcacaatcattccgcaagaccctgtccttttcagcgggtctctccgcatgaatttagatcccttctctcagtactccgacgaagaagtgtggacgagtctggagctggcgcacttaaaagacttcgtgtcagccctgccggataagcttgaccacgagtgcgcagagggaggggagaatctgtcggtcgggcaacgtcagctggtatgcctcgcccgcgcactactgcggaagacaaaaattctggttcttgacgaagccacagcagcagtggacctggagacagatgatctgatccagagcacaataagaactcagttcgaagactgtactgtgttgacgatcgcccatcggcttaacactataatggactatacgagagtcatcgtccttgataagggcgaaatccaggaatatggcgctccgtcggatctgctgcagcaacgtggcctgttttactctatggccaaggacgccggtctggtgtag

SEQ ID NO: 13942 - DNA, 3648 bp, Artificial Sequence
  Description of Artificial Sequence: Synthetic coding sequence
atgtcttttttcttcaaggcaatacatgatctaatgatgtttagtggcccccagattttaaaactgttaataaagttcgttaacgatactaaggcgccagattggcaaggatacttttatacagtgttactgttcgttacggcatgtctgcagacgctcgtactgcatcagtacttccatatttgctttgtctccgggatgaggatcaaaaccgcagtcatcggcgccgtctaccggaaggccctggtgatcaccaattccgcacggaagtctagcaccgtgggagagatcgtgaatctgatgagcgttgacgctcagcgatttatggatctggcaacctatattaacatgatatggtctgcgcctcttcaggtaatcctcgctttgtacctgctttggttaaacctcggaccttccgtactcgcaggagtcgccgttatggtactgatggtccctgttaatgctgtcatggccatgaagaccaagacctatcaagtcgctcacatgaagtcaaaagataataggatcaagctgatgaatgaaatactcaacggtatcaaggtgctcaagctgtatgcttgggagctcgccttcaaggataaggtactggctattagacaggaggagcttaaagttcttaaaaaatctgcctaccttagcgccgtgggaacattcacctgggtgtgcacgccgttcctggtcgccctatgtacattcgccgtgtacgttacgattgatgagaacaacattctcgacgcccagacggctttcgtatctttggccctcttcaatattctgcgcttccctctgaatatcctgcccatggtgatctcaagtattgtgcaggccagcgtgtcgctaaagcgactacgcatctttctgagtcatgaagagctcgaacccgactcaatcgagaggagacccgtgaaagacggaggtggcacaaacagcataactgtgcgcaatgctacattcacatgggccaggtctgatccccctactctgaatggtataaccttcagcatccctgagggagccctggttgcagtggtggggcaggtgggttgtgggaaaagtagtctgctgtctgctctgttggcagaaatggacaaggttgaaggacatgtggccatcaagggatccgtggcatacgtgccacagcaagcttggatccagaatgactctctgcgagagaacattctcttcggatgccagctcgaagagccctactatcggagtgtgatacaggcctgcgcactgttgccagacctcgaaatccttccatctggcgatcggactgaaattggggagaagggggttaatctttccggtggccagaagcagcgagtttctctggcacgcgccgtctactccaacgctgatatatatttattcgacgaccccttaagcgctgtggacgctcatgtgggaaaacacatttttgagaatgtgatcggcccgaaaggtatgttaaagaacaaaacgcggatactagtgacccattcaatgtcatatttaccacaagttgacgtgattattgtgatgagcggcggaaagatatctgagatggggagctatcaggagttactggcacgcgacggggcgttcgcggagtttcttagaacatatgcttcaactgagcaggagcaggatgcagaagaaaatgggagtacggtaatggatgaggaggaagcaggagtcaccggagtgtcagggccaggtaaagaggccaagcagatggaaaacgggatgctggtaactgattccgctggaaagcagcttcagagacagctgtcaagcagttcctcttatagcggtgacatctcccgacatcacaatagtaccgcggagttacagaaagcagaggcaaagaaagaggaaacatggaagctcatggaagccgacaaggcccagacggggcaggtgaagctttctgtgtactgggattacatgaaggcaatcggcctctttatctcctttctgtcaatcttcctgttcatgtgtaaccacgtaagtgctctcgctagtaactattggctgtcactttggaccgatgatcctatcgtcaacgggacccaggagcacaccaaagtgcgtctcagcgtgtacggagcgttaggtatctcccagggcatcgctgtctttggttactccatggcagtgagcatcggtggcatcctcgcctccagatgtttgcacgtcgacctactgcatagcatcctgcgttctccgatgagcttctttgagcgcacacccagcggaaatttagttaaccggttttccaaggagctggataccgtggactccatgatcccggaagtgatcaagatgtttatggggtccctatttaacgtgattggcgcttgtatcgttatactgctggcaaccccaatcgccgcaattatcatcccccccctgggcctgatctattttttcgtacaacgtttttatgtggctagtagccgccagctaaagagattggagagcgtgagtcgaagcccagtgtatagccattttaacgagacccttctgggcgtatcagtaatccgggccttcgaggaacaggaaaggttcattcaccagagtgacttaaaggtggatgagaaccagaaagcttactatcctagtatagtagcaaatcgctggctagccgttcgcctagagtgtgttgggaattgcattgtactatttgcagccctcttcgcagtcataagccggcatagcctttccgctggccttgtagggttgtccgtgagttacagccttcaggtgaccacatatttgaactggctggtgcggatgtcctccgagatggaaacgaacattgttgctgtggagcgcctgaaggaatacagcgagaccgagaaggaagccccttggcaaatacaggagaccgccccaccaagcagctggccacaagtaggtcgcgtggaattccgaaattactgtttgaggtatagggaggatctggattttgttctgcgacatattaacgtaaccattaacggtggggagaaggttggtatagtcgggcgcacaggcgcgggcaagtcatcgctgaccctgggtctgtttcgaattaacgaatctgctgagggcgaaattatcattgacggaattaacattgcaaaaataggactccatgatctccgcttcaaaataaccattattccccaggatcctgttctcttcagcggcagccttcgaatgaacttagatcctttctcccagtactcggacgaagaggtgtggacctcactcgaactggcccacttgaaggactttgtgtcagccttgccggacaagttagaccacgagtgtgccgaagggggagagaatctgtcagtcggccagaggcaactggtctgcctggccagggcacttctcagaaaaaccaaaatattggtgcttgatgaagctactgccgccgtggatctcgagaccgacgatttaattcagagcacaatccgtacccaattcgaggattgcacagtgttgaccatcgcccatcggcttaatacaattatggattacaccagggtaatcgtgctggataaaggcgaaatacaggaatacggcgctccctccgacctccttcaacagcgcggcttgttctattcaatggccaaagatgccggactggtatag

SEQ ID NO: 13943 - DNA, 1968 bp, Artificial Sequence
  Description of Artificial Sequence: Synthetic coding sequence
atgtccagctcaaacgtggaagtattcatcccagtcagccagggcaatacaaatgggtttccggcaaccgcaagtaatgacctgaaggccttcacagagggcgcagtactatcctttcataatatctgttaccgcgtcaaactgaaatctggctttctcccttgtagaaagccagttgaaaaagagatcctgagcaacatcaatggaatcatgaaacctggattaaatgcaattctggggccaaccggcgggggtaagtctagccttttggacgtgctggctgcccggaaggaccctagcggcctgagtggtgacgtgctcattaacggggcaccccggcccgccaattttaagtgcaacagcggatatgtcgttcaggacgatgtggtgatggggacccttaccgtgagagaaaacctgcaattctccgccgccctcagactggcaaccacaatgacaaaccacgagaaaaacgagcggattaacagagtcatccaggaactggggctggataaagtcgcggattccaaagtcggcactcaatttattagaggggtatctggtggagaacgtaaacggacttctatcggaatggaacttattactgatccctctattttgttcctagatgagcccactactggcctggacagcagtacggccaatgccgtgctgctgctgctaaaaaggatgtcaaagcagggacggaccatcattttcagtattcatcagccacggtatagcattttcaagctgtttgactccttgaccttgttagcttctggtcggttgatgtttcacggtcccgcccaagaggctcttggctatttcgagtccgccgggtaccactgtgaagcttacaataatccggcagatttctttctggacataatcaatggtgatagtacagctgtggccttgaaccgcgaagaagacttcaaagcgaccgagatcatcgaacctagcaaacaggacaagcccctgatcgagaagctcgcggagatttatgtgaactcttcattctacaaggaaacaaaggcagagctccaccagctttccgggggcgagaaaaagaaaaagattaccgtgttcaaggagatctcctacaccacctcattttgtcaccagttgaggtgggtgagtaagcgatccttcaagaatctactagggaaccctcaagcttctatagcacagattatcgttacagtagtactgggattagtgattggagccatttacttcgggctcaagaacgactcaaccggcatccagaatagagctggtgtgctgtttttcctgaccacgaaccagtgcttctctagcgttagtgctgtggagctatttgttgtggagaagaaattgtttatacatgaatacattagcggctactatagagttagcagctatttcctgggtaaactactctctgatttactcccaatgcgaatgctcccaagcatcatattcacgtgcatcgtgtatttcatgctgggattgaaaccaaaggccgacgctttctttgtcatgatgttcacgttaatgatggtggcctactccgcatcatcaatggcccttgctatagcggccggccagtccgttgtttctgtagcgaccctcttaatgaccatctgctttgtcttcatgatgattttttctggactcttggttaatctcacaacgatcgccagttggttatcctggttgcagtactttagcatcccaaggtatggctttaccgctctacagcataatgagttcctgggacagaacttctgcccagggctgaatgccacaggcaataacccctgtaactacgcaacatgtactggagaggaatacttggtcaagcaggggattgacctgtcaccatgggggctttggaagaaccacgtcgccctggcttgtatgattgtgatctttctgactattgcttacctgaagctgctattcctgaaaaaatacagctag

SEQ ID NO: 13944 - DNA, 1836 bp, Artificial Sequence
  Description of Artificial Sequence: Synthetic coding sequence
atgagtagttctaatgtggaggtcttcattcctgtttcacaaggtaataccaacgggtttcccgcaactgcgagcaacgatctgaaagcatttaccgagggagctgtcctttctttccacaatatttgctatagagtcaaacttaagagtgggtttctgccctgtagaaagcccgtagaaaaagaaatactctctaacatcaatggcattatgaagccgggccttaacgccattttggggcctaccggcggtggaaagagcagcctgctggatgtcctggccgccaggaaggatccgagcggcctgtcgggggacgtgctgattaacggggcaccaaggcctgctaacttcaagtgtaacagtgggtatgtggtgcaagatgatgttgtaatgggcacactcacggtgagagagaatctgcaatttagcgctgcacttcgcctcgccaccaccatgactaatcatgaaaagaatgaacgaataaatcgcgtgattcaggagctgggcttagataaagtcgcggacagtaaagtaggaacacagttcatccgaggcgtaagcgggggagagagaaaaagaaccagcattgggatggaactgatcactgaccctagcattctctttctagacgaaccaacaaccgggctggactcctccacagctaatgccgtcctgcttcttttgaaacgcatgagtaagcagggcaggactatcattttctccatccatcagccccgctactcaatattcaaactttttgactccctcaccctccttgcctccgggaggttgatgttccatgggcctgcccaggaagcactggggtacttcgaatcggctggctaccattgcgaggcatacaataatcccgctgacttctttttagatatcattaacggcgattccaccgccgtcgctttgaatcgagaggaagatttcaaagcaacagagataatagagcctagcaagcaagataaacctctcattgagaagctggccgaaatctatgtgaacagctctttttacaaggaaactaaagctgagctccatcagctgtcgggtggcgagaagaaaaagaaaatcaccgtgttcaaggagatctcttataccacgtctttttgtcaccagttacggtgggtgtcaaagcgcagcttcaagaatctcctcggaaacccgcaagcttctatcgcccagattatcgttacagttgtcctcggactcgttataggtgcgatctacttcggcctgaagaacgacagtactggtattcaaaaccgtgcaggtgtgcttttttttttgacaaccaaccaatgctttagctccgtgtccgcagtcgaactctttgtggttgagaagaaattgtttatccatgagtacatttctggctattaccgtgtttccagctatttcctggggaaactgctctctgacctgttaccaatgcgtatgttgccttctatcatcttcacatgtattgtctacttcatgctgggtctgaaaccaaaggccgatgcttttttcgttatgatgttcacactaatgatggtggcatattccgcatcctccatggccctcgcgattgctgccggccagtcggtagtctcagtggctacactgctgatgacaatttgttttgtgtttatgatggtttgttggtcgataagtcagcctcttcatcttggctgtcatgggtttagtacatcagccttccatgacatggatctcaggctgtgttctataatgaacttttgggacaagacttctgcgcaggattctatgcaacaggaaacgatactggttacaatgcaacatgtgctggccaagaacatttggtag

SEQ ID NO: 13945 - DNA, 1212 bp, Artificial Sequence
  Description of Artificial Sequence: Synthetic coding sequence
atggaccgtagcaaggaaaactgtatctcaggaccagtcaaagccacggccccagtgggagggccgaagcgcgtgttggttactcagcaattcccctgtcagaaccctctgcctgtgaacagtggccaagctcaaagagtcctatgcccgtctaacagttctcagcggatccctttgcaggcccagaagctggtgtcctcacataaacccgttcagaaccaaaagcagaagcagctgcaggccacctctgtgccacatccagtctcgagacctcttaataacactcagaaatcaaaacaaccacttccgagtgctcccgagaacaacccggaagaagagctagcgtccaagcagaaaaacgaggagagtaagaagaggcagtgggcccttgaggacttcgagatcggaaggcctctcggcaaggggaaatttggtaacgtctatcttgcaagagaaaagcaaagcaaattcattctcgcactcaaagtactatttaaggctcagttagagaaggctggggtagaacatcagctcaggcgggaggtggaaatccagtcccaccttcggcaccctaacatactccggctctacgggtacttccacgacgccactcgagtgtaccttatcttggagtacgcccccctcggcacagtgtacagggagctgcagaagctctctaaatttgatgagcaacgcacggcgacctatatcaccgaactggctaatgcattgtcttattgtcactccaagcgggtgatacatagggacatcaagccagagaatcttcttttgggatccgctggagagctgaagatcgctgacttcggctggtccgtacacgccccatcaagccggcgaactacactgtgtggtaccctggactacttgcccccagagatgattgaaggccgcatgcacgacgagaaagttgacctttggagcctgggagttctatgctacgaatttctggtcgggaagccacctttcgaggccaatacttatcaagagacctataagcgaatcagtcgagtcgagtttacgtttcctgattttgtaactgagggcgcccgcgatctgattagccgactgctcaagcataacccctctcaacgcccgatgttacgtgaggtcttggaacatccgtggataactgctaattcaagcaaacctagtaactgtcaaaataaggagtcagcctcgaagcagtcatag

SEQ ID NO: 13946 - DNA, 1212 bp, Artificial Sequence
  Description of Artificial Sequence: Synthetic coding sequence
atggataggagtaaggagaattgtatctccggtcctgtgaaggcaaccgcacccgtcggaggccccaagcgggtcctcgtcacccagcaatttccttgccaaaacccgttacctgtcaatagcgggcaggcacagagggtgctatgtccctctaatagtagccagcgcatccctctgcaggcgcagaagctggtgagctcccataagccagtgcaaaaccagaaacaaaagcagttgcaagcaactagtgttccccacccagtgagcaggcccctgaacaatactcagaaaagtaaacagcccctgccatcagcacccgaaaataaccccgaggaagagctggcgtcaaagcagaagaatgaagaaagtaagaaaagacagtgggccttggaggacttcgaaatcggccggcccctggggaagggcaagtttgggaatgtgtacctggcccgggaaaagcaaagcaagtttattcttgcgcttaaagtgctatttaaagcacagcttgaaaaagcgggcgtggaacaccaattgcggcgggaagtggagatccaaagtcacctccgtcatcccaatatcctgcgcctgtatggttatttccacgacgccacaagggtatacctgatcctggagtacgcccctctgggaacagtataccgtgagctgcagaaactcagtaagtttgatgaacagcgaactgctacctacattaccgaactcgcgaatgccctgtcatattgtcacagcaagcgggttatccacagggatatcaagcctgagaatcttttacttggaagcgcgggagagctgaagattgccgactttggctggagtgttcacgctccttcctctaggcgcacaacattgtgcggaaccctggattaccttcctccggaaatgatagagggtcggatgcacgacgaaaaggtcgacctttggagtttgggcgtgctgtgttacgagtttttggtgggcaagccccctttcgaagccaatacctatcaagagacatataagagaattagcagggttgaattcaccttccctgatttcgtgaccgagggcgctagagatctcatatctcggctgttaaagcataacccatcccaaaggccaatgcttcgagaagtcctggaacacccttggatcacagccaactcaagtaagccgtctaactgtcagaacaaagagagcgcgagtaagcagagctag

SEQ ID NO: 13947 - DNA, 1212 bp, Artificial Sequence
  Description of Artificial Sequence: Synthetic coding sequence
atggatcgatcaaaggagaactgcatttctggccccgtcaaggccaccgcaccggttgggggtccaaaaagagtgctcgtaacacagcagttcccttgccagaaccctctaccagtgaattccggacaggctcagcgagtgctttgcccaagcaacagctctcagcgcatccctctgcaagcacagaagctggtgagctctcacaagcccgttcagaaccaaaaacagaagcagcttcaggccactagtgtcccccaccctgtgagtaggcccctgaataacacccagaagtccaaacaaccgctcccttctgccccagagaacaatcccgaggaggaactggcctcaaagcaaaagaatgaggaatcaaagaagagacaatgggcccttgaagacttcgagatcggtaggccactcggaaaaggcaagtttggaaatgtatacctggcccgggagaaacagagtaaatttatcttggctctgaaggtgttgttcaaagcccagcttgagaaagctggggtggagcatcagctgaggagagaagttgaaatccaaagccacctcagacaccccaatatcctgcgactgtatggatatttccacgacgctaccagggtgtatctgatcctggagtacgctcctctcggcacagtctatagggaacttcaaaaactaagcaagttcgacgaacagagaaccgcgacatacataactgagcttgctaacgcgctgagctattgtcactccaaacgggtgattcacagagatattaaacctgagaatctgctcttgggctcagccggcgaactaaagatcgctgattttggctggtccgttcacgccccaagtagtcgacgtaccacactctgtggaaccctggactatcttccgccagaaatgattgagggcaggatgcatgacgaaaaagtggacctgtggtctctgggcgtgttatgctacgaatttttggtgggtaaacccccattcgaagcaaacacatatcaagaaacctataaaagaatttctcgtgtcgagttcaccttcccagacttcgtgactgaaggcgctcgggatctaatttcacgcctgttgaagcacaatcccagtcagcggcccatgctccgcgaggttctggaacacccgtggattactgccaactcatctaaacccagtaactgccaaaataaggaaagtgccagcaaacagtcatag

SEQ ID NO: 13948 - DNA, 1044 bp, Artificial Sequence
  Description of Artificial Sequence: Synthetic coding sequence
atggatcggtctaaagagaattgcatctcggggccagtcaaggccactgcgccagttggcggccccaagcgagtcctcgtgacccagcaatttccctgtcagaatccgctccctgtgaatagcggccaggcacagagagttttgtgcccatccaatagcagtcagaggatccctctccaggcccagaagctcgtgtcatcccataaaccggtgcaaaaccagaagcagaagcagctgcaagcgacaagcgtaccccaccccgtgtcccgccccctgaataacactcagaagtctaagcagcctctgcccagcgcccctgagaataatcccgaggaggagcttgcgtccaaacaaaagaacgaggagtccaaaaaacgccagtgggctctggaagacttcgagattggccggccgttaggaaaggggaagttcggcaacgtgtaccttgctcgggagaagcagtccaagttcattctagctctcaaggttctgttcaaggctcagctggaaaaagccggagtggaacaccagctgagaagggaggtcgagatccagtctcatctgaggcacccaaacatccttcggctgtatgggtattttcacgatgccacacgcgtgtatctgattctcgaatacgctccactgggaacggtgtatcgcgagctccagaagctaagcaagtttgacgaacaaagaacagccacatatattaccgagttagcaaacgctctctcatactgccattccaagcgcgttattcatagagacatcaagccagagaatctgctacttggatctgctggggagctgaagatcgctgactttgggtggtccgtgcatgcccccagtagccgacgcacgacgctgtgtggaacccttgattatcttcctcctgagatgatagagggacggatgcacgacgaaaaggtggatctctggtctctcggcgtgttatgttacgaatttttggtgggcaaacctcccttcgaggctaacacttatcaggagacatacaaacgcatatcccgagtgcgacgcaattag

SEQ ID NO: 13949 - DNA, 1212 bp, Artificial Sequence
  Description of Artificial Sequence: Synthetic coding sequence
atggacagatctaaagagaattgtatctccggccccgttaaagccacagccccggtcgggggcccaaaaagagtgctggttactcagcagtttccttgccaaaatcctctccccgtgaattctggtcaagctcagagggtcttatgtccctccaattcttcccaacggattcctctgcaggcccagaaattagtgtcttctcacaaaccggtgcaaaaccagaagcagaagcaattgcaggctacgagtgtgcctcatcccgtaagtcgaccgcttaataacacacagaaatctaaacagcctctgccttcagctcctgagaataaccctgaggaagagctagctagcaaacagaagaatgaagaatctaaaaagaggcagtgggcccttgaggacttcgagataggacggccactgggaaagggcaaatttggcaatgtctatctagcccgggagaagcagagtaaatttatcctcgccttaaaggttctttttaaagcacagttggagaaagccggcgtagagcaccagcttcggcgggaagtggaaattcagtcccatctccggcaccccaatatactgagactgtacggctatttccacgacgccacccgagtttacctcatcctggagtacgcacctctgggcacggtctatcgggagctccagaaacttagtaaattcgacgagcagaggacagctacgtacatcacagaactcgctaacgccctgagttactgtcattctaaacgggtgatccatagagatattaagcccgaaaatctgttgctggggtcagctggagagcttaagattgcggatttcggctggagcgtgcacgccccaagcagccggcgtactaccctgtgcggtacgctagactacctgccccccgagatgattgagggacgaatgcatgacgagaaggtggatctatggagtttgggcgtgctgtgttacgagttccttgtcggaaagccccccttcgaggccaatacctaccaagagacatataagcgaatcagccgggtggaattcacctttccagatttcgtgacagaaggcgcccgagatctgatcagccggctactgaagcacaatccatcgcagagaccaatgttacgggaggtgctcgaacatccctggatcaccgccaactccagcaaacctagtaactgtcagaataaggaatcagcctccaaacagtcctag

SEQ ID NO: 13950 - DNA, 1212 bp, Artificial Sequence
  Description of Artificial Sequence: Synthetic coding sequence
atggataggagtaaagaaaactgcatctctggtcccgtgaaggcaacagcccccgtgggcggaccgaagcgcgttttggtcacacagcagttcccgtgtcaaaatcctctacctgtgaactcaggccaggctcagcgagtgctctgcccgtcaaattcgagccagagaattccacttcaagcacagaaattggtgtcatcccataaaccagtgcagaaccaaaagcagaaacagctgcaggccacgagcgttccacatccagtgtcaagacctctgaacaatacccagaagagcaagcagcccttgccatctgcccccgagaataacccagaggaggaactggctagcaaacagaagaatgaagagagcaaaaaacggcagtgggccctcgaagacttcgaaattggcagacccctggggaagggcaagttcggtaatgtctatcttgcccgcgagaagcagtctaagtttatcttagcactcaaggtcctgtttaaagcacagttggaaaaggccggcgttgaacaccagttgaggcgagaagtggagattcaatctcacctccgacacccaaatattctgagattgtacggctacttccacgacgcgacacgcgtgtacctgattctggagtatgccccactgggtaccgtgtaccgggagctgcagaagctaagcaagtttgatgaacaaagaacagctacttacatcactgagctggcaaatgctctctcctattgccatagcaagagagtgatacacagggatataaaacctgagaacctactactggggagcgctggggagctcaaaatcgcagactttggatggtctgtgcatgccccaagttcccggagaacgactctatgcggaacgctagactatttacctcccgagatgattgaaggccgcatgcacgacgagaaggtggacctgtggagcttgggtgtattatgctacgagttcctggtggggaaaccacccttcgaggcaaatacctaccaggaaacttataagagaatctcgagagtagaattcacgtttcccgatttcgtgacagagggagctcgcgatctgattagtaggctgttgaaacacaatccttctcagcgacccatgctgcgggaggtcctggaacacccatggattaccgctaactcctctaaaccctcaaattgccagaacaaagagtctgcttctaaacagtcttag

SEQ ID NO: 13951 - DNA, 1212 bp, Artificial Sequence
  Description of Artificial Sequence: Synthetic coding sequence
atggatcgctctaaggagaactgtatttccggacctgtgaaagcaacggcacccgttggcggacctaagagagtcctggtgacccagcagttcccatgccagaaccccttgcctgtgaacagcgggcaggcccagagagtgctgtgcccctctaactccagccagcgcataccactgcaggctcaaaagctcgttagctctcacaaaccggtccagaaccagaagcagaagcagctccaggcaacctctgtcccacacccagtttcaagaccattgaacaatactcagaaaagcaagcagcccctcccaagtgcccctgagaataatccagaggaggagctggcttccaaacagaagaatgaggagagtaagaagagacaatgggcgctggaagatttcgaaattggccgtccactgggaaagggcaagtttggcaacgtatacctggctcgagaaaagcagtctaagttcatactcgcactcaaagtgcttttcaaggctcagctcgagaaagctggagttgagcatcaactgcgacgggaggtggagatacaatcccatctcagacacccaaatatcctgaggttgtatgggtacttccacgacgctaccagggtatatttgatcttggagtacgccccactggggacagtgtaccgcgaactgcagaaactttcaaaattcgacgagcagagaactgctacttatatcacagaactggctaatgccctgtcatattgccactccaagcgcgtgattcatcgcgacatcaaacccgagaatctgcttctgggttccgcaggagagctcaagatcgcggacttcgggtggagcgtccacgctccttctagtagaaggacgaccctgtgcggaaccctagattacctccccccagaaatgatcgaaggcagaatgcatgacgaaaaagtggatctgtggtccctgggagtcctgtgctacgaattcctggtgggtaaaccccctttcgaggctaatacatatcaggagacctataagaggatttctagggtggagtttaccttccctgacttcgtaaccgagggcgcccgggacttaatttctcgtctgctgaaacataacccatcccagaggcccatgctccgggaagtcctggagcacccttggatcacagctaactcatctaagccctccaactgtcagaacaaggagagtgcctccaagcaatcttag

SEQ ID NO: 13952 - DNA, 1212 bp, Artificial Sequence
  Description of Artificial Sequence: Synthetic coding sequence
atggaccggtctaaggaaaactgcatctccggcccagttaaagccactgcgccagtcggcggtccaaagcgcgtgctcgttacacaacaattcccctgccagaacccactgcccgtgaacagcggacaggcacagcgcgtgctgtgcccttctaattctagccagagaattccccttcaagctcagaaactcgtatcttcacacaagccggtgcagaaccaaaaacagaagcaactgcaagccacctctgtcccccaccctgtcagccgccctctgaataatacccagaagtctaagcaacccctgcctagcgcaccagagaacaatcctgaggaagagttggccagcaagcagaagaatgaggaatcaaagaagcgacagtgggctctcgaagattttgagatcggccgaccacttgggaaaggaaaatttggaaacgtctatctggctcgcgagaagcagagtaaattcatcttggcactcaaagtgctgtttaaggcgcagctagagaaggccggcgtggagcaccaactgcggcgggaagttgagattcagtcccatctccggcaccccaatattctgcgcctctatggttatttccatgatgcgacccgcgtgtatctgattctggaatacgcccctcttgggacagtttatcgggagcttcagaaattgagcaagttcgatgaacagaggactgccacgtacatcactgaactcgccaacgccttaagctactgtcatagtaaacgagtaattcaccgagatatcaaacccgaaaatctccttttgggatcggcaggggaattaaagattgcagatttcggctggagcgtgcatgctcctagcagcaggcgcactaccttatgcggtaccttggattacctcccccccgaaatgatcgagggccggatgcacgacgaaaaagtggatttgtggagcttgggagtcctgtgctatgagtttctggttggcaagccccccttcgaggcgaatacataccaggagacttataagcggatctctcgcgtggagttcacattcccagattttgtgaccgaaggtgcccgcgacctcatcagcagactgctaaaacacaaccctagccagcgccccatgctcagggaagtgctggaacacccctggatcaccgctaacagttccaaaccttctaattgtcagaacaaggagtcggcttccaaacagtcttag

SEQ ID NO: 13953 - DNA, 1212 bp, Artificial Sequence
  Description of Artificial Sequence: Synthetic coding sequence
atggatcgctctaaagagaattgcatttctggccccgtcaaggccacagctccggtaggcggtccaaagcgcgtgctggtcacacagcagttcccatgtcagaatcctttacctgtaaattctggacaggcgcagagggtgttatgtccaagcaattcctcacagcgaattccccttcaggctcaaaaactggtttctagtcataagccagttcagaaccagaagcagaaacagcttcaggctaccagcgtcccacatcccgtctctcgaccacttaataatacacaaaaaagcaagcagccattacctagtgcgccagagaacaatccagaagaagaacttgcatcaaaacagaagaacgaggaatctaaaaaaaggcagtgggctcttgaggacttcgagatcggtaggccccttgggaaaggtaagttcggcaacgtctacctggccagagagaaacagtctaagtttattttagctttgaaagtactatttaaagcccaattagagaaagctggtgttgaacaccagttgaggcgcgaggttgagatccagtcccatctgcgacatcccaacatactgcgcttatacggctacttccacgacgccacgagagtatacttaatcctcgagtatgcccccctggggactgtgtaccgcgagctgcagaagttatcaaaatttgacgagcagagaaccgcgacctacatcactgaactggcaaatgcgctgagctactgtcatagcaaacgagtaatacaccgggacataaaaccagagaacctgctgcttggatcagctggggagttaaaaatcgccgacttcggctggtctgtgcatgccccaagctccaggaggaccacactgtgcggcacactagattatttaccacctgaaatgatcgaggggagaatgcatgatgaaaaagtggacctttggtctctcggcgttctgtgctacgagttcctggtcggcaagccaccttttgaggcaaatacttatcaggaaacatataagcgcataagtagagtcgagttcaccttcccagatttcgtaacagaaggtgcccgggacttaatcagccgtttattgaagcacaacccttcccagagacccatgctccgcgaggtgcttgaacacccttggatcacggcgaattcaagtaaaccctctaattgtcagaataaagagtctgcaagcaagcagagctag

SEQ ID NO: 13954 - DNA, 570 bp, Artificial Sequence
  Description of Artificial Sequence: Synthetic coding sequence
atggaccgatccaaagaaaattgtatctcagggcctgtcaaggccactgctcccgttgggggacccaaaagggtactggtgactcaacagttcccttgccaaaaccctctcccggtaaacagtggacaggcacagcgcgtcctgtgtccaagtaactcttctcaacgtatcccactgcaagcacagaaactggtttcttcacataaacccgtgcagaatcagaaacagaagcagctccaggccacctcagtgccccaccccgtgagtaggccgctgaacaatacacagaagagcaaacagccgctgccttctgccccagagaacaaccctgaagaagaactcgccagtaaacagaagaatgaagagagcaaaaagcggcaatgggccctggaagattttgaaattggtaggcctctggggaaaggcaaattcgggaacgtgtaccttgcccgtgaaaagcagagcaagttcatcttagccttgaaagtgctgtttaaggctcaactggagaaagcgggcgttgagcaccagttaaggagagaagtggaaatccaaagtcacttgcgctag

SEQ ID NO: 13955 - DNA, 444 bp, Artificial Sequence
  Description of Artificial Sequence: Synthetic coding sequence
atggatcgatccaaggaaaactgtatttccggccctgtgaaagccacagcccccgtcggtgggccgaaacgcgtcttagtgacccagcagttcccttgccagaatcccctgccagtcaattccggccaggcacagcgagtgttgtgccccagtaactcatctcaaagaataccactgcaagctcaaaaacttgtaagctctcacaaaccagttcaaaaccaaaagcaaaagcagcttcaagctacatcagtgcctcatcctgtaagccgccctcttaacaacacccagaaatccaagcaaccgttgcctagtgctcccgaaaataaccctgaggaggaactggcatccaagcaaaaaaatgaagagtccaagaagagacaatgggccctggaggatttcgaaattggccgacctttggggaaggggaagttcggaaatgtgtag

SEQ ID NO: 13956 - DNA, 816 bp, Artificial Sequence
  Description of Artificial Sequence: Synthetic coding sequence
atggaccgatcgaaagaaaattgcatcagtgggccagtcaaagctactgccccagttggagggccaaagagggtcttagtcacacagcaatttccctgccaaaacccccttcccgttaatagcggtcaagcccagcgggtgctgtgccctagtaattcctcacagcgtatccctttacaggctcagaagcttgtcagctcacacaagcccgtgcagaatcagaaacagaaacagctgcaggccactagcgttccccacccggtatcgagacccctcaataacacccagaagtctaaacagccgctgccaagtgctcccgaaaacaatccagaggaggaactcgcctctaaacagaagaatgaggagagtaagaagagacagtgggcactcgaggattttgagataggcagacccctcggaaagggaaagtttgggaacgtctacttggcacgcgaaaagcagtccaagtttatcctcgccctaaaggtgttgttcaaggcacagctggagaaggccggcgtggaacaccaattgcggcgagaggtcgagatccagagtcaccttcgtcaccctaatattttgcgcctctatgggtactttcacgacgctacgagggtctacctgatcttggagtatgcccccctcggaactgtttatcgggagctgcagaaactctcaaagttcgacgagcaacgaactgcgacctatatcacagagttagcgaatgctctttcctattgccatagcaagcgggtgatacaccgggatatcaagccagagaacttgctgttaggcagcgctggagaactcaagtag

SEQ ID NO: 13957 - DNA, 240 bp, Artificial Sequence
  Description of Artificial Sequence: Synthetic coding sequence
atggatcgaagcaaggagaactgcatctccgggcccgtgaaagcaactgcccccgtgggcgggcccaagcgggtcctggtaactcagcagtttccgtgccaaaaccccctgcctgttaacagtggacaggcccaaagagtcctgtgtcctagcaattcttcccaacgcatcccgctccaggcccagaaactggtttcctcccataaaccagttcaaaatcagaaacagaaacagctgtag

SEQ ID NO: 13958 - DNA, 321 bp, Artificial Sequence
  Description of Artificial Sequence: Synthetic coding sequence
atggaccgaagcaaagagaattgtatttcaggcccagtcaaagctactgccccagtcggagggccgaaacgcgtcctcgtgacacagcagtttccttgccagaatcccctgcctgtcaattctggccaagcccaacgagtactttgcccaagtaacagtagtcaaagaatccctctccaagcacagaagctggtgtcaagtcataagcccgtccagaaccagaagcaaaaacaactgcaggccacttcggttccccaccctgtaagccgccctcttaataacactcaaaaatctaaacaacccttgccaagcgcaccctag

SEQ ID NO: 13959 - DNA, 1035 bp, Artificial Sequence
  Description of Artificial Sequence: Synthetic coding sequence
atggcccagaaggagaatagctacccatggccatatggcaggcagacagcccccagtggcttaagcaccctgccccaacgtgttttaagaaaggagcccgtcaccccttccgccctagtattaatgagccgatccaatgtccagcccaccgcagctcccgggcagaaagtcatggaaaacagcagtggaactcccgacattctgaccagacactttactatcgacgactttgagatcgggaggcctctggggaagggcaagttcgggaacgtgtacctcgccagagagaagaaatcgcacttcatcgtggccctgaaagtgctgttcaaaagtcaaattgaaaaagaaggggttgagcatcagctccgccgggagatagagatacaagctcatctccatcacccaaatattctgcggctgtataattacttttacgacagacgtaggatttatttgatactggagtatgcaccacggggcgaattatataaggagttacagaagtcctgcacatttgacgaacagcgtacagctaccattatggaggagctagccgacgccctgatgtattgccacgggaaaaaggtgattcatagagacattaagccagagaatttgctgcttggactgaaaggagaactcaaaatcgccgacttcgggtggtccgtgcatgcgcccagtcttcggagaaagaccatgtgcggaaccctggattatctgcctccagagatgattgaagggcgcatgcacaacgaaaaggtagacctgtggtgcatcggggtgctgtgttatgagttgctggtgggcaaccccccatttgagtctgcttctcacaacgaaacctaccgcaggatcgtcaaggttgaccttaaattccccgcaagtgtgccgatgggagcccaggacctgatctcaaaattgctacggcacaatccttcggagagactgccactggcgcaagtctcagcacacccttgggttcgggcgaatagccgccgggtcctcccgccatcagctctgcagtctgtggcttag

SEQ ID NO: 13960 - DNA, 912 bp, Artificial Sequence
  Description of Artificial Sequence: Synthetic coding sequence
atgtcccgatccaatgtgcagcccactgcggccccaggccagaaagtcatggagaactcatctggcacccctgacattctgacccgccatttcactatcgacgactttgagattgggaggcccctgggcaagggaaagtttggaaacgtctatctcgctcgtgaaaaaaagagtcacttcattgttgctctgaaggtgctgttcaaatcccagatcgaaaaggagggcgtggaacaccagctccgacgggagatcgaaattcaggctcacctgcaccatcctaatattttaagactgtacaactacttttacgaccggcgcaggatttatttaatccttgagtacgcgccccggggagaattgtacaaggaactccaaaagagttgcacctttgacgagcaacgtaccgccactattatggaagagttggccgatgccttgatgtattgtcacggcaagaaagtgattcatcgtgacatcaagccagagaatttactactgggtctcaaaggggagctcaaaattgccgacttcggctggtccgtgcacgccccgagcctgcgacggaaaaccatgtgtggcaccctggactacctccccccagagatgatcgaaggtcgcatgcataatgaaaaggtggacctatggtgtattggcgtgctgtgctatgagctgcttgtgggaaatccacccttcgagagtgcctcccataacgagacctaccgacgtattgttaaagtggacttgaagttccccgcaagcgtgcccatgggtgcacaggatctaattagcaagctgttgaggcacaatccatccgaaagacttccactcgcccaggttagcgctcatccgtgggttcgagctaattcccgccgagtgcttcctccaagtgccctgcaatccgtcgcttag

SEQ ID NO: 13961 - DNA, 1035 bp, Artificial Sequence
  Description of Artificial Sequence: Synthetic coding sequence
atggcacagaaggaaaactcatatccatggccctatggaagacagactgcacctagcgggctttctactctgccccagcgggtgctcaggaaagagccagtgacgcccagcgccttagttctgatgtcacggagcaacgtgcagccaaccgccgctccaggccagaaagtgatggagaacagcagtggcacaccagatatcctcacacgccacttcactattgacgattttgaaatcggtcggccgctggggaaaggcaaattcggaaatgtgtacctggcaagggagaaaaagagccacttcatcgtggcgctcaaagttctattcaagtctcagattgagaaggaaggagtggaacatcaactgcgaagagaaatcgaaattcaggcccatctgcaccatccaaatatccttcggctttataactatttctacgaccgcaggcgcatctatttgattctcgaatacgcccctagaggcgaactctataaggaactgcagaaaagctgcaccttcgatgaacagcggacagcaaccattatggaggagctcgccgacgccctcatgtactgccatggaaagaaagtcattcaccgcgatatcaaacccgaaaacctgctgctgggcctgaaaggggagctcaagatcgcggatttcggatggtctgtgcacgcaccctccctgcgcaggaagacgatgtgcggaactctcgattacctcccccctgagatgatcgagggtcgcatgcacaacgaaaaggtggacctgtggtgcatcggggtcctttgctacgaactgttggtggggaatccaccttttgagagcgcttcacacaacgagacgtacagacgcatagtaaaagtcgacctcaaattcccagcctcagtgcccatgggtgctcaagatttaattagtaaacttttacgccacaaccctagcgagagattgccgctggctcaggtcagcgcacatccgtgggtgcgtgcaaactcacggcgagtcctgccaccttccgccctgcagagcgtagcttag

SEQ ID NO: 13962 - DNA, 930 bp, Artificial Sequence
  Description of Artificial Sequence: Synthetic coding sequence
atgtctagcccccgcgcggtggtccagcttgggaaagcacagcctgctggagaggagcttgccacggctaatcagaccgcccaacaaccaagcagccccgctatgcgcagattaaccgtggacgactttgaaattgggcggccgcttggtaagggcaaatttggaaatgtgtatttggctcggctgaaagagtctcactttatagtggccctgaaagttttgttcaagagccagatcgagaaagaggggctcgaacaccagctgcgtagggaaatcgagattcaagcacacttgcagcatcccaacattttgagactgtataactactttcatgacgcccggagagtgtatctgattctggaatatgccccacgtggcgagctgtacaaagaactccagaagagtgaaaagcttgacgagcaacgtacagctactattattgaggaactcgccgacgcactgacatactgccatgacaaaaaggttatacaccgcgatatcaaacctgagaacttacttttgggctttagaggggaagtgaagatcgcggattttggttggagtgtccacactcccagcctccgtagaaagacaatgtgtggcacactggactatcttccaccggagatgattgagggtcgcacctatgatgaaaaggtggatctgtggtgtattggggtattgtgctacgaactgctggtgggatacccacccttcgagtctgcctcccatagtgagacttacaggcgcatcctgaaggtagacgtgagattcccactctccatgccgttgggggcacgtgatctaatcagcagactgctcaggtaccagcccctcgagcgcctccctttagctcaaattttgaagcacccttgggtacaggctcattctaggcgggttctgccaccatgtgcccagatggcttcttag

SEQ ID NO: 13963 - DNA, 873 bp, Artificial Sequence
  Description of Artificial Sequence: Synthetic coding sequence
atggcaactgccaatcagaccgcccagcagccgagctcccccgctatgcggaggctgacagtggacgattttgaaatcgggaggccgcttggcaaggggaagttcgggaacgtatatctggccagactgaaggaatcacacttcatcgtggctctgaaggtcctcttcaagtcccagatcgaaaaggagggcctggaacaccagctgcgccgcgagatcgagattcaggcacacctccaacatcctaacatcctcaggctgtataattacttccacgacgcacggagagtctatttaatactggagtacgctccccgaggggagctctacaaagaattgcagaagtcagagaagttggatgaacagcggacggccactatcattgaagagttggccgacgccctgacatattgccacgataagaaggtaatacatagggacattaaacctgaaaatctcttgctggggttccgcggcgaagtcaagatcgctgactttgggtggtctgtgcacaccccaagcctacgaagaaagacaatgtgtgggaccctggactacctccctcctgagatgatcgagggaagaacatacgatgagaaggtggacctctggtgcattggtgttctctgttacgagcttctggtgggatacccgcctttcgagtccgcctcgcacagtgagacctacaggcgcatcctgaaagtggacgtgcgatttccgctcagcatgccactgggagcccgcgaccttatctccaggctactcagatatcagcccctagaaagactccccctcgcacaaatcctcaagcacccttgggtgcaggcacacagtcgtagagtgctccccccttgcgctcagatggcatcatag

SEQ ID NO: 13964 - DNA, 828 bp, Artificial Sequence
  Description of Artificial Sequence: Synthetic coding sequence
atgagaagactgacggtggatgacttcgagattggccggcctttgggaaagggcaagtttggtaatgtgtatctggcaaggcttaaagagtctcacttcatcgtggcactgaaagtgttgtttaagtcccagatcgagaaggagggactggagcaccagttaaggcgcgagatcgagattcaggcccaccttcagcaccctaacattctgagactgtacaattatttccacgatgcccggcgcgtgtacctcatacttgagtacgcccctagaggtgagctgtataaggaacttcagaagagcgagaaacttgatgagcagaggacagccaccatcatagaggagctcgccgacgcactgacgtactgtcacgacaagaaggtcattcaccgtgacattaagcccgaaaatctcctgctgggctttcggggcgaggtgaaaatcgctgacttcggttggtcagtgcacacacctagcctaaggcgcaaaaccatgtgcgggaccttggattatcttccccctgaaatgatagagggtaggacgtacgacgagaaagtcgacctctggtgtattggagtcctctgttacgagcttctagtgggctatcctccatttgagtccgcaagtcacagtgaaacctacagacgtattctcaaagttgatgtgcggttcccactgagcatgccactgggggcgagagatctcatatctcggctgctgaggtatcagcctcttgagaggctccctttggcccagattctcaaacatccttgggtccaggcccacagccgtcgcgtcttgcccccatgtgcacagatggcttcatag

SEQ ID NO: 13965 - DNA, 2589 bp, Artificial Sequence
  Description of Artificial Sequence: Synthetic coding sequence
atgaatatccaagaacagggttttcctctggacctgggcgcttccttcaccgaggacgcaccccggccccctgtgcccggagaggaaggagaactggtgagcacagacccacgtccggctagttacagcttttgctccggtaagggggtaggcatcaaaggcgagacctctaccgctaccccacgacgaagcgacttggacctgggatatgagcccgaagggagtgcgtcccctactcccccgtacctgaagtgggctgaatctcttcattccttattggacgatcaggatggcatttccctgtttcgaacatttctgaaacaggaaggctgtgccgatctgcttgatttttggttcgcttgtaccggctttagaaagctggaaccatgtgatagcaatgaagagaaacggctgaaactcgcacgggccatctaccggaagtacatcttagacaataatggaatagtgagtaggcagacaaagcccgcaaccaagtcctttattaagggctgcattatgaaacagcttattgacccggcaatgtttgatcaggcacaaactgaaattcaggccacaatggaagagaacacatacccatcattcctcaagagtgacatttacctcgaatacactaggactgggagcgagtcaccaaaagtgtgctccgatcagtcctccgggagcgggaccggaaaaggcatttctggctatctgccaactttgaacgaggacgaggaatggaagtgcgaccaggatatggatgaagacgatggccgagacgcggcaccccccggaaggctaccccagaagctcctgctcgaaactgctgcccccagggttagtagcagccggcggtattcagaaggtagagagtttagatacggatcttggagggaacctgtgaacccttactatgttaatgcaggatatgcccttgcgcccgcgaccagtgccaatgatagcgagcagcaatcactgagctctgacgctgatactttaagcttgacagactcatcggtggatggcatacccccctatagaatcaggaaacaacatagacgcgagatgcaggaatctgtccaggtgaacggtcgagtgcccctgccgcacatccctagaacctaccgagtgccgaaggaagttcgcgtggaaccacaaaaattcgcggaggaactgatccaccgacttgaagcagtgcagagaaccagagaggccgaggagaaactggaagagagactgaagcgcgtaagaatggaggaagaaggggaagatggcgacccctccagcggacccccaggcccatgccataagcttccccctgcaccggcctggcatcactttcccccccggtgtgtggatatgggatgcgctggtctgcgcgacgctcacgaggaaaaccccgaatccatcctagatgagcacgttcagagggttcttagaactcccgggaggcagtctccgggtcccggccatagatccccagactctggacacgtcgctaaaatgccagttgccctggggggcgctgcatctgggcacggtaagcacgttccgaagtctggggctaagctggacgcagccggtttgcaccatcaccgccatgtgcatcaccatgttcaccattcaactgcacgccccaaggaacaggtggaagctgaggccaccagacgcgcccagagcagctttgcctgggggctggagccccattctcatggagctaggagccgtggttactccgaaagcgttggagccgcgcccaacgcctccgatgggctggctcattccggaaaggttggggtggcgtgcaagagaaatgcaaaaaaagccgagagcgggaagagtgcttccactgaggtgcccggagcgtccgaggacgctgaaaagaatcagaaaataatgcagtggatcattgagggggagaaggagatttcacgtcacaggagaaccggtcacgggtctagtggcacgcggaagccgcagccccatgaaaattcccggccactctccctggagcacccttgggctggaccacaacttcgcactagtgttcagccctcccatctgttcatccaagacccgaccatgcccccacaccccgctcctaatcctttgacacagctggaagaagcccgccgccgcctagaagaggaagagaaaagagctagccgggcaccatccaaacagcgctacgtgcaggaagtcatgcgtagagggcgcgcgtgcgtgcggcctgcttgtgcaccagtgttacacgttgttcccgccgtctctgatatggagctctcagagaccgaaacacggtctcagcggaaggtgggcggggggtctgctcagccttgcgactcaatcgtggtcgcttattacttctgtggggagcctataccttatcgaactctcgtgcgggggcgagcggtcactctcggccagttcaaggaactgcttaccaaaaaaggctcttaccgatactacttcaaaaaagtgagtgatgaatttgactgcggggtggtctttgaggaggtccgcgaagatgaagcagtgctccccgtctttgaggagaagatcataggaaaagtcgagaaagtcgactag

SEQ ID NO: 13966 - DNA, 2481 bp, Artificial Sequence
  Description of Artificial Sequence: Synthetic coding sequence
atgaatatccaagaacagggctttcctcttgacttaggcgcctctttcacagaggacgctcctaggccgcctgtgcccggcgaagagggagagctggtgtccaccgaccctcggcccgcctcatactctttctgcagcggtaagggcgttggtataaaaggcgagacaagtacagctacacctcgtcgatctgacctggaccttgggtacgagccagagggaagtgcctcaccaacaccgccttatctcaaatgggctgagagtctgcatagcctgctagatgaccaggatgggatttcactgtttcggacgtttttgaagcaggaagggtgtgccgatctcttggatttctggttcgcgtgtacagggtttcgcaagttggaaccgtgcgattctaatgaagagaaaagactcaaattggccagagcgatttatagaaagtacatcctggacaacaacggcatagtgagccggcagaccaaacctgccacaaaaagcttcatcaaagggtgtattatgaagcaattgattgacccagctatgttcgatcaggctcagactgagattcaggcaaccatggaagaaaatacataccctagctttctgaagtccgacatctacctggagtacacgcgcactggcagcgagagccctaaagtctgctctgaccagtctagcggctcgggtactggaaaaggcatctcaggttacctccccaccttgaatgaagatgaagaatggaagtgtgaccaggatatggatgaggacgacggcagagacgctgccccccccgggaggctcccgcagaaactgcttctggagacagccgccccccgagtgagctcaagccgtagatatagcgaaggaagggagtttcgctatggctcctggcgtgaacctgtaaatccttattacgtgaatgcaggatacgcgctcgcgccagcaacttctgcaaacgactcagaacagcaatcattgtcttcggatgccgacacactgtctctaaccgactcaagcgtggacgggatccctccatacaggatcagaaagcagcacagacgggaaatgcaagagtcggtacaggtgaatgggagagtgccgctgcctcatattccaaggacctacagggtccccaaggaggtacgcgtcgagcctcagaaattcgccgaggaattgatccatcgtctagaggccgttcagcgtacaagagaagctgaggagaagctggaggaaaggcttaaaagggtgcggatggaggaggaaggcgaggacggggacccaagcagtggtccaccaggcccctgccataagctgcctcccgcacccgcttggcaccacttcccgccaagatgtgtggatatgggatgcgccggactccgcgacgcgcacgaggaaaatcctgaaagcatcctggatgaacacgtgcagcgtgtccttcggacccctggacggcaatctccagggccaggccatcgcagccctgactctggacatgtggcaaaaatgccagtggcactgggcggagccgcctccggccatgggaagcatgttccgaaaagcggcgcaaagctggacgccgccggtcttcatcaccaccggcatgtccaccaccacgtccatcattccacagccagacctaaagaacaggttgaagctgaggcaacaaggagggcccagtcctcttttgcctggggccttgagcctcacagccatggtgccagatcccgtggctacagcgagagcgtgggggctgctcctaatgcatcagacgggctggcccactctggcaaagtcggagtggcctgcaaaaggaatgctaagaaagcagagtcaggaaagtcagccagcaccgaagtccctggtgcaagcgaagatgcagagaagaaccagaaaatcatgcagtggatcattgagggcgaaaaggagatctctcgtcaccgacgcaccggacatggcagtagcgggacaaggaagccacagcctcacgagaattcccggcccctgtcattagaacacccgtgggcaggcccacagctcagaacctctgttcagcccagccacttgtttattcaagatccaacaatgccaccccacccggccccaaaccctcttactcaactggaagaagctaggcgaaggcttgaggaagaggaaaaacgcgcctcgagggctccgagcaaacagcgcactcgttcccagcgaaaagtgggtggtgggtctgcccagccatgcgacagcatcgtcgtggcctactacttttgtggggaacccatcccatatagaactctggtgcggggaagggccgtcacacttggacagtttaaagagctgctgactaagaagggctcgtaccgctattatttcaaaaaggtatcagatgagtttgattgcggggtcgtcttcgaagaggtgcgtgaagacgaggcagtgctgccggtattcgaagagaaaatcatcggtaaggtagagaaagtcgactag

SEQ ID NO: 13967 - DNA, 309 bp, Artificial Sequence
  Description of Artificial Sequence: Synthetic coding sequence
tgactggaggaggaagagaagcgggccagcagagctccctccaagcagcgcacacgatcccaacggaaggtgggcggaggcagcgcccaaccctgtgactcaattgtggtggcatactatttctgtggagaacctatcccctaccgtacattggttcgcggtagagccgtaaccctcgggcagtttaaagagttgctaacaaagaagggctcctaccggcctccaagccatctccgctgttgtctcctcaccgcactcctcacttccgtcctccagatcctgctgcaagaaagcgagagacgagtgtag

SEQ ID NO: 13968 - DNA, 1824 bp, Artificial Sequence
  Description of Artificial Sequence: Synthetic coding sequence
atggtatgcacgcgcaagaccaagactctcgtgagtacctgtgtaatactgtctgggatgactaatattatttgtctgttatacgtcgggtgggttaccaattacatcgctagcgtctatgtgcgtggccaggaacctgccccggacaaaaaactggaggaggacaagggcgacactttaaagattatcgagcgcctcgatcacctagagaatgtcatcaaacaacacatacaagaggcgccagcaaaacccgaggaagcagaggcagagcccttcacagactccagtttgtttgcccattggggtcaagaactctcccctgaaggtaggcgggttgcgctcaaacagttccagtactacggctacaacgcttacttatccgatcggcttcccctagacagaccactgccagacctgcggcccagcgggtgtaggaacctctcattcccagactcacttcctgaggtgtctatcgtgtttatctttgttaacgaggctctcagtgtattgctgcgatcaatccattccgctatggagaggacacctccacatttactgaaagagattattttggtggacgataactcaagcaatgaagaactgaaagaaaaactgacggagtacgtggataaagtgaactctcagaaaccagggttcataaaggtagtccgacatagcaagcaggagggacttattagatcgcgggtatctgggtggagggccgctaccgcccctgtcgttgccttgttcgacgcccacgtggaattcaacgtggggtgggccgaacctgttctcactaggataaaggaaaaccgaaaaaggatcatcagcccgtcttttgacaatattaaatacgataacttcgaaatcgaagagtacccactggctgcacaaggctttgactgggagttgtggtgcaggtacttaaacccccccaaggcatggtggaaactggagaattccacagcgccgattcggagtccagccttgatcgggtgtttcatagtggatagacagtatttccaggagataggcctgctcgacgagggcatggaggtatatgggggcgagaacgtggaactggggatccgggtgtggcaatgcggcggctcagtggaagtgctgccatgcagcaggatcgcgcatattgagagggctcataagccctacactgaagacctgacggctcacgtgcgaagaaacgcactgcgcgtggctgaggtttggatggatgaatttaagtcacatgtgtatatggcgtggaatataccacaggaggactcaggtatagacatcggggatatcaccgctcggaaagccttgaggaaacaactccaatgcaagactttcagatggtacctggttagtgtttaccccgaaatgagaatgtacagcgacataattgcctacggcgtgctgcaaaatagtcttaaaaccgacctttgtctagaccaaggcccagacacggagaatgtgcctattatgtatatttgtcatgggatgacaccccagaatgtgtactacacatcctcccagcagattcacgtagggatcttgagtcctactgtcgatgacgacgacaaccgctgcttggtcgatgtcaacagccgccccagactcatcgagtgctcgtacgcaaaggctaagcggatgaaactccactggcagtttagccagggcggccccatccagaataggaaatccaaaagatgcttagagttgcaggaaaactctgatttggagtttgggtttcagttagtgctacagaaatgcagcggacagcattggtccattactaatgtactcagaagtctcgccagctag

SEQ ID NO: 13969 - DNA, 1710 bp, Artificial Sequence
  Description of Artificial Sequence: Synthetic coding sequence
atgtctacctactcgacctttcctgccggagtgcccgttagtgagagaagtttggcacgggccggcttctattataccggcgttaatgataaagtcaaatgcttctgttgcgggctgatgctggacaattggaaattgggagactcgccaattcagaagcataaacagctttacccatcttgttccttcatacagaacctggtgtctgcctcgctgggtagcacctctaaaaacacatcgcccatgcgaaactcctttgcccatagtctgtctccaaccctggagcactctagtcttttcagcggctcctattcctcactgagtcccaaccccctcaactcgagggcagtggaagatatttcctcatcaagaactaacccatatagttacgccatgtctaccgaagaggcgcgattcttgacgtatcacatgtggccgctcacctttctcagcccaagtgaactggccagagcaggcttctactacatcgggcccggcgatcgagtagcttgcttcgcttgcgggggcaaattgagtaactgggaacccaaagatgacgccatgtcagagcatcggcggcatttcccaaactgcccttttctcgaaaactccctggaaacactgcgcttctctatctctaatctatctatgcagacacacgccgccaggatgcgcacgttcatgtactggccatcatctgttccggtacagcccgaacagctcgctagcgctgggttctactatgttgggcggaatgacgatgtcaagtgcttttgctgtgacggcggcctgaggtgctgggagtctggagatgacccatgggtcgagcacgcaaagtggtttccaaggtgtgaatttctcatccggatgaaagggcaggagttcgttgatgagattcagggcaggtatccccatttgctggagcagttattatcgacaagtgatacgacaggagaagaaaatgctgacccgccaattatccacttcgggcctggtgaaagttcctccgaggacgccgtcatgatgaacacccccgtggtgaagtcggccctagagatgggatttaaccgggacctggttaagcagacggtacaaagcaaaatcctgacaactggggagaactacaagactgtgaacgatatagtgtccgcattactaaacgcggaagatgagaagagagaagaagagaaggagaagcaggctgaggagatggcttccgacgatcttagcctgattcgtaagaaccgcatggcactgtttcagcagctcacatgcgtcttacctatcctcgataaccttctaaaggcgaacgtgatcaataaacaggagcacgacatcataaaacagaaaacacagattcccctccaggctcgcgaactgattgatactatcttagttaagggaaatgcagcagctaacatattcaaaaattgcctgaaggagatagatagcactttgtataaaaacctctttgtcgacaagaatatgaagtatatccccactgaggacgtctctggactgtccctggaggaacagctgagaagactgcaagaggagcggacctgtaaggtctgtatggacaaagaagtttctgtcgtgttcatcccctgcgggcatttggttgtttgccaggaatgcgcaccttctctgaggaagtgtccaatatgtagaggaattattaagggaacggtccggacattcctgtcctag

SEQ ID NO: 13970 - DNA, 1794 bp, Artificial Sequence
  Description of Artificial Sequence: Synthetic coding sequence
atggaagacagcaccatattgtccgattggacaaactccaacaagcagaagatgaaatacgatttcagctgtgaattgtaccggatgagtacatactcaacgttccccgccggtgtcccagtttccgaacggtctctcgctcgcgccggattctactacactggcgttaatgataaggtgaagtgtttctgttgtggccttatgctcgataactggaaattgggggatagccccatccagaaacataagcagctgtatccaagctgtagctttattcagaaccttgtcagtgctagcttgggatccacttctaaaaacaccagtcctatgcgtaattcattcgcccattccttatcccctactctggaacattcttctctattctccgggtcatacagctccctgtcacccaatccactaaacagcagggctgtggaagatatttcctcttccagaactaatccttattcatatgccatgtctacagaagaggctagatttctgacgtaccacatgtggcctttgaccttcctcagcccttcagagcttgcccgcgcaggcttttactatattggtcctggagatcgcgtcgcctgttttgcgtgcggaggtaagctgagtaactgggagcccaaggacgatgccatgtctgagcatcgccgtcactttcctaattgccctttcctggagaattcgctggagacactacgctttagtatcagcaatctatctatgcagacccatgccgcaagaatgcgaactttcatgtactggcctagtagtgtgcctgtacagcctgaacaactcgcctctgccggcttctactatgtgggaagaaacgacgacgtaaaatgcttctgttgcgatggtggtctgcgctgctgggagtcaggagacgacccatgggttgaacatgctaaatggtttccccggtgcgaattcctgattaggatgaagggccaagagtttgttgatgagatccagggccgttaccctcaccttcttgaacagctgctgtccacctcagataccactggagaggagaacgcggaccccccaataatccactttggcccaggcgaaagcagctcagaggacgcagtgatgatgaataccccagttgtgaagtccgccctagaaatgggattcaacagggaccttgtcaaacagactgttcaatcaaagattttgactacaggagagaattacaaaacggtaaacgatatcgtgtcagctttactcaacgctgaagacgagaaacgagaggaagagaaagaaaaacaggccgaggagatggcctctgacgacttaagcctcattagaaaaaatcgcatggccttgtttcagcagctcacatgtgtactgcccatcctagataatctgctgaaggctaatgttattaacaagcaggaacacgatataatcaaacaaaaaacacagatcccactgcaggcccgcgaactgatcgacaccattctggtgaaagggaacgccgcagctaacatcttcaaaaactgcctgaaagagattgatagcaccctgtacaaaaacctttttgtggataaaaatatgaaatacattccaacggaggatgtatccggattgtcactcgaggaacagctgaggcgcttgcaggaagagagaacctgtaaggtgtgcatggacaaggaagtgtctgtggtgtttatcccctgtggccaccttgtggtgtgccaggagtgcgccccatctctcaggaaatgtcctatctgtagagggatcattaaagggactgtgcgtacatttctgtcctag

SEQ ID NO: 13971 - DNA, 1605 bp, Artificial Sequence
  Description of Artificial Sequence: Synthetic coding sequence
atgcacaagaccgcaagccagcgcctgttcccggggccctcctatcaaaacatcaaatccataatggaggacagcacaatcctttctgattggacgaactccaataaacagaagatgaagtacgactttagttgtgaattatataggatgagtacctactcaactttccccgctggagttcccgtctcggagcgttctttagccagagccggattttactacactggggttaatgataaggtgaagtgtttttgttgcgggcttatgctggataactggaaacttggggacagccctatacagaagcacaagcagctgtacccttcttgctccttcatccagaacctcgtttcagctagcctcggcagcaccagcaagaacaccagcccaatgagaaactccttcgcccatagtctgagtcctactttggaacactcttccctgttttcaggctcttactcctccttatcccctaatcccctcaatagccgagctgtggaagatatttcaagtagcagaaccaacccctattcttatgccatgtccacagaggaggctcggttcctcacataccatatgtggccccttacttttttgtcaccctcagaactcgccagagccggtttctattacatcggcccaggcgatagggtggcctgtttcgcttgcggagggaaactgtccaactgggagcctaaagacgatgccatgtccgagcatagacgtcacttccccaattgtcccttcttagagaactcactcgaaaccctgcgattctcaatcagtaatctgagcatgcagactcatgccgcacggatgaggacattcatgtattggcctagcagcgtccccgtgcagccggagcagctcgcctcggcaggattctattacgtgggtaggaatgacgatgtgaaatgcttttgctgcgatgggggtttgaggtgctgggagagcggcgatgatccttgggtagagcacgccaagtggtttcccaggtgtgagttcttgattaggatgaaaggccaggagttcgtagacgaaatacagggaagatatccgcatctgctcgaacagttgctcagtacttccgacacaactggagaggagaacgcagatccccctatcattcatttcgggcctggagaatcaagttcggaagatgctgtgatgatgaatacccccgtcgttaaaagcgccttggaaatgggcttcaatagagacctggtcaagcagaccgtgcagtccaaaatattaacgacgggagaaaactacaagaccgttaacgacatcgtatccgccctgcttaacgctgaggacgagaaacgcgaggaggagaaggaaaaacaggccgaggaaatggcaagcgacgatttgtccttgatcagaaagaaccgaatggctctcttccagcagcttacttgtgtactccctatcctggacaatttactgaaagcaaatgtaatcaacaagcaggaacatgacatcattaaacagaagactcagattcccctccaggctagggaactcatcgatacaatccttgtgaagggcaacgccgcggcaaacatttttaaaaattgccttaaagtgaagcagcgcttttag

SEQ ID NO: 13972 - DNA, 1815 bp, Artificial Sequence
  Description of Artificial Sequence: Synthetic coding sequence
atgaatatagtcgagaactctatatttctatccaacctcatgaagtccgctaacacttttgagctcaagtatgatttgtcctgtgaattgtatcgcatgtccacttactctactttcccggctggggtccctgttagcgagcgctccttggctcgggccggcttctattacacgggcgttaatgacaaagtcaaatgcttttgctgtggtttgatgctggacaactggaagcgaggcgacagccccactgaaaaacataagaagttatacccgagctgccggtttgtccagtccctgaactctgtgaataatctggaagccacttcccagccaacttttcccagcagtgtaactaactctactcacagtctgctgccggggactgagaacagcgggtacttcagaggttcctactctaattctccttccaacccagtgaactccagagctaatcaggatttctccgcgctcatgcgctcaagctaccattgtgctatgaacaatgagaatgcgagactcctgactttccaaacttggccactgacctttctgagtcccactgacctggctaaggctggtttttactacatagggccaggcgacagggtcgcgtgttttgcttgcggaggtaaacttagcaattgggagccaaaagataatgctatgagtgagcacctgcgtcactttcccaaatgcccatttattgaaaaccagcttcaagatacctcaagatacaccgtcagcaatctgagcatgcagacccacgcagcaaggtttaagacattctttaattggccttcgtccgtcctggtcaaccccgagcagctggcttccgccggcttttattatgttgggaattccgatgatgtgaaatgcttctgttgcgacggcggactcaggtgttgggaaagcggagacgacccttgggttcaacatgctaaatggtttcccagatgtgagtacctgataagaattaaggggcaggagttcattcgtcaggtacaggcctcatatccccacctactcgagcagctcctaagtacatccgacagtcctggcgatgaaaacgccgagtctagcattattcattttgagcctggggaagaccattcagaggatgccatcatgatgaatacacctgtcataaacgcggctgtggagatgggattcagccggagcctggtaaaacagaccgtgcaacgtaagatactggctaccggggagaactatcgcctggtcaacgacctagttctggaccttctgaatgccgaagacgagattcgagaagaagaaagagagagggctaccgaggaaaaggaaagtaacgacttacttctcattcgtaaaaatcggatggccttgttccagcacctgacctgcgtcattccaatcttagactcactgctcacagccggcataattaacgagcaagagcatgacgtcatcaagcagaagacacaaacgtcattgcaagctcgggaactcatcgacactatccttgtgaagggcaacattgccgctactgtctttcgtaactcattacaggaagcggaggccgtgctgtatgaacatctgtttgtccagcaggatattaagtacatacccaccgaggacgtatctgatctccccgtggaagaacaattaagaagattgcaagaggagcgtacttgcaaagtgtgcatggataaggaagtttcgattgtgtttatcccttgtggtcatctggtggtgtgcaaagactgtgccccgtccctgcgaaagtgtccaatctgccggtcgactattaagggaaccgttcgcaccttcctgtcatag

SEQ ID NO: 13973 - DNA, 1815 bp, Artificial Sequence
  Description of Artificial Sequence: Synthetic coding sequence
atgaatattgtggagaactctatctttctgagcaacctcatgaagtctgctaacacattcgagctgaagtatgacttatcctgcgaactataccgcatgtcaacttattctacgttccccgccggggtgcccgtcagcgagcgtagtctggctagagccggtttctactacacaggagtgaatgacaaagtcaagtgtttctgttgcggacttatgcttgataactggaagcgcggcgactctccaacagaaaaacataagaaattgtatccatcttgtcggttcgtccagagcctcaattcagttaataacctcgaggctacctcacagcctacctttccatcaagcgttacaaatagcacccattctctcttaccaggtactgagaactctggctatttccgaggcagctattccaattccccatcgaatccagtgaatagtcgcgctaaccaggattttagcgctcttatgcgctcttcctatcattgcgctatgaacaatgagaacgccaggctgctgacttttcagacctggccgttgaccttcctgtccccaaccgacctggccaaagccggcttttattacattgggcccggagatagagtcgcatgcttcgcctgtgggggcaaactcagtaactgggagccaaaagacaatgctatgagcgaacacctccgtcacttccccaaatgtccctttatcgaaaaccaactgcaagacacatctagatatactgtgagcaacttgtcaatgcagacccacgcagctcgcttcaaaacctttttcaattggccgtcctccgttctagtcaacccagaacagctagcaagcgctggtttttattatgttgggaactcggatgatgtgaagtgtttttgctgtgatgggggactccggtgttgggaaagcggagacgatccatgggtgcaacatgccaaatggtttccccggtgcgaatatctcatacgaattaaagggcaggagtttatacggcaagtgcaagccagctacccgcacctcctcgaacagctgctttcaactagcgactcacctggggacgagaacgcagagtcctcaataattcacttcgaaccaggggaagaccacagcgaggatgcaattatgatgaatacgccggttattaatgccgctgtggagatgggtttttcgcgctccctggtgaagcagacagtgcagcggaagatcctcgctacgggtgaaaactaccggcttgtgaacgatctggtgctggatctactcaatgccgaagacgagatcagagaggaggagagagagagagccacggaggagaaagaatcgaacgatctgctccttatccgaaaaaatagaatggcgttattccagcacctgacgtgcgtgatcccaatcttggactctctcctgacagctggtatcattaacgaacaggaacatgacgttatcaagcagaaaacccagacatctctccaagctagagaactgatcgatacaatcctggtcaagggtaacattgctgccaccgtgttccggaacagcttacaggaggctgaagccgtcttgtacgagcacctctttgtccagcaagatatcaagtacatacctacagaggacgtttctgacctccctgtagaggaacagcttcgcaggcttcaggaagagagaacctgtaaggtctgcatggacaaggaggtgtccatcgtgtttataccctgtggccatctcgtcgtttgtaaggactgtgcaccttccttgaggaagtgtccgatatgccggagtacgatcaagggtactgtgaggacttttttaagttag

SEQ ID NO: 13974 - DNA, 498 bp, Artificial Sequence
  Description of Artificial Sequence: Synthetic coding sequence
atgggcgccccaacattgcctcccgcctggcagccttttctcaaggaccacagaatctccaccttcaagaactggccttttctggaagggtgtgcttgtacacctgaaagaatggcggaagccgggttcatccactgtccaaccgagaatgaaccagatctagcgcagtgcttcttttgctttaaggaactagaggggtgggaaccggatgatgatccgatcggacccggcaccgtcgcgtatgcttgcaatacttccactctgggcgggcgggggggccggattacccgcgaagagcataagaagcactcttcagggtgtgcctttctttcagtcaaaaagcagtttgaggaacttacgctgggcgagttcttgaagctggacagggaaagagctaaaaacaagattgccaaagagacaaacaataaaaaaaaagaatttgaagagacagccgagaaagtccggcgggccattgagcagctagctgcaatggactag

SEQ ID NO: 13975 - DNA, 429 bp, Artificial Sequence
  Description of Artificial Sequence: Synthetic coding sequence
atgggggcaccaacacttccacccgcctggcagcctttcctgaaagaccatcgaatttccacgtttaaaaattggccctttctcgagggctgtgcatgtactcccgaaagaatggccgaggctggcttcatccactgccccacagaaaatgaacccgacctagcacagtgctttttctgctttaaggaactagaaggctgggaacctgatgatgatcccatcgaggaacataagaagcattcaagcggatgcgcttttctgtccgtgaagaagcagttcgaagaacttactctgggtgaatttttgaaactggaccgagagcgggccaagaacaagatcgccaaagaaacaaacaataagaagaaagagttcgaggagactgcggagaaggtgcgccgcgcaattgagcagcttgccgccatggattag

SEQ ID NO: 13976 - DNA, 414 bp, Artificial Sequence
  Description of Artificial Sequence: Synthetic coding sequence
atgggagcaccaacactgcccccagcctggcagcccttcctcaaggaccacagaatttctaccttcaagaactggccatttctcgaaggctgtgcctgtaccccagaacgaatggccgaggctgggtttatccattgccctactgaaaatgagcctgacctcgcccagtgtttcttttgttttaaggaacttgaagggtgggaaccggacgacgatcccatgcagcgcaagccaactatccgtaggaaaaatctcaggaaactgagaaggaagtgcgccgtaccctcttccagctggctgccctggatcgaagctagcggccgatcctgtctggtgcccgaatggctgcaccactttcagggcctcttcccgggggctacctcattgccagttggaccattagcaatgtcctag

SEQ ID NO: 13977 - DNA, 432 bp, Artificial Sequence
  Description of Artificial Sequence: Synthetic coding sequence
atgggggcccctacactacctccagcctggcaaccattcctgaaggatcatagaatctccacattcaagaactggcccttcctggaaggatgtgcctgcacgcccgagaggatggccgaagccggatttatacactgtcccacggaaaatgagcctgatctggctcagtgcttcttttgtttcaaagaactcgagggctgggaaccagatgacgacccaataggtccaggaaccgtggcatatgcttgtaatacctccacgctgggaggtcgtggtgggaggatcaccagagaagaacataagaagcattccagcggctgcgcgttcctctcggtgaaaaagcaatttgaagaactgaccctgggcgaattcctaaagctggaccgggaacgcgccaaaaacaaaatcgagagagccctgctcgccgaatag

SEQ ID NO: 13978 - DNA, 14574 bp, Artificial Sequence
  Description of Artificial Sequence: Synthetic coding sequence
atggtgaccggcggcggtgctgcacccccaggaacagtgacagaacccctgccctccgttatcgtcttgtccgctgggagaaagatggccgctgccgctgcagccgcatctggcccaggctgctccagtgcggccggagctggcgctgcaggcgtaagcgaatggcttgtgctccgtgacggctgcatgcattgcgacgctgatggactccactctttgagttatcatccagcactgaacgccatcctcgcagttacgtcgcgcggcacaatcaaggtaatagacgggacttcaggggccactcttcaggcatccgccctctccgcaaaaccaggaggccaggtgaagtgccagtacattagcgcagtagataaagtgattttcgtcgacgactacgctgtgggatgcagaaaggacttgaacgggatcctccttttggataccgccttgcagacacctgtgtcgaaacaggatgacgtggtgcagttagaactgcccgtcaccgaagcccaacagctgctgagcgcatgcctggagaaagtcgacatctcctcgacagaagggtatgacctgttcatcactcagctaaaagatggcctgaagaacaccagccacgaaacagcagccaatcacaaggtggctaagtgggcgacagtgaccttccacctcccccaccatgttctgaaaagcattgcgtccgcaatagtgaatgagctcaagaagatcaaccagaacgtggcagccctgcctgtggcttctagcgtgatggacaggttgtcttatctgttacccagcgccagacccgaactgggtgtggggccaggtcgttccgtcgaccgttcgctgatgtattctgaggcaaacagacgcgaaactttcacaagttggcctcacgtgggctatcgatgggcccagcctgaccccatggcccaagctggtttttaccatcagcccgcctcctctggcgatgatcgtgctatgtgctttacttgttctgtctgtctggtgtgctgggaacccacagatgaaccttggtcagagcacgaaagacattctccaaattgcccatttgtgaaaggcgaacatacccagaacgtgccactgagtgtgacactggcgactagccccgcccagttcccttgtacagacggaactgacaggatatcctgttttgggagcggaagctgcccccatttcctggctgctgccacaaagcgtggaaagatctgtatttgggatgtgtctaaattgatgaaagtccacctgaagttcgagataaacgcttacgaccccgccatcgtccagcagctcatcttgtctggcgaccccagctccggggttgattcccgtcgcccaacactggcttggttggaagattcttcaagttgttcggacatccccaagctcgaaggggactctgatgacctcctcgaagattcagatagcgaggaacacagcaggtccgattctgtgaccggacatacaagtcagaaggaagcaatggaagtgtctctggacatcactgctcttagcatactccaacagccagagaaacttcaatgggagatcgttgctaacgtgctcgaggataccgtcaaagacctggaggaactgggggccaacccttgcctcactaatagcaagagtgagaaaacaaaagagaaacaccaggagcagcacaatatcccttttccctgtctgctcgccggaggtctgttgacctataaaagtcccgccaccagccctatcagcagcaattctcaccggtcactcgacggcctctcccgcacgcagggggagtccatttccgagcagggaagcactgataacgagagctgtacaaactctgagctcaactccccactggttcggcgcactctccctgttctattgttgtactctataaaggaaagtgacgaaaaggccggaaaaatcttctcccagatgaacaacatcatgtctaaaagtctacatgacgacggatttactgtcccccagattatcgaaatggaacttgactcccaggaacagctgctgctacaggacccaccagtgacctacatccagcagttcgcagatgcggcggccaacctcacatcccctgactctgaaaagtggaattccgtgttccccaagcccggcactctggtgcagtgccttagactccctaagtttgccgaggaagaaaacctctgcatcgattcaatcacaccctgcgccgatggaattcacctgctggtaggcctcagaacctgcccagtggagtctctgtccgccattaaccaagtggaggctctgaataatctcaataagcttaatagcgccctgtgcaaccgaaggaaaggagagctcgaatccaatttggccgtcgtcaacggcgctaacatttccgtcatccagcacgaaagccccgccgatgtccaaactccactaataattcagccggagcagagaaacgtcagcggaggttatttagtattgtacaagatgaattatgcaacgagaattgtaacactggaggaggagcccataaaaatccaacatatcaaggatccacaggataccatcactagcctgatactactaccccctgacattctcgataatagagaagacgattgtgaagaacctatagaggacatgcagctcacctcaaaaaacgggttcgaacgggaaaaaacatcagacatctcaactttaggccacctcgtaatcactacacagggcggctatgtcaagatcctcgatctgtcgaacttcgagatattggcaaaagtggagccaccaaagaaggagggtaccgaagaacaggacacattcgtttccgtaatttactgcagtggcaccgatcgcctttgcgcctgcacgaagggcggggagttgcatttccttcagatcgggggcacatgcgatgatatcgacgaagccgatatcctagtggatggctcactgtcaaaaggaattgagccatcatctgaggggagcaagcctctgtccaacccgtcctcccccggaatctcaggtgtggatctcttggtggaccagcccttcaccttggagattctgacttctctcgtcgagttgaccaggttcgaaactttgacaccaagattctcggccacggtgcctccctgttgggtcgaggtccagcaggaacaacagcagcggagacacccccagcatctgcaccaacagcaccacggcgacgcagcccagcatacccgcacatggaaactgcagaccgacagtaacagttgggacgaacatgtgtttgaactcgtgctacccaaagcttgcatggttggccacgtggacttcaaattcgtgttgaatagcaacattacaaatattcctcaaatccaggtgactctgctgaaaaataaggcacctggtttgggcaaggtgaacgccctgaatatagaagtcgagcagaatggcaaaccctcactggttgatttgaacgaggagatgcagcatatggatgtcgaggaatctcaatgtctcagactgtgccccttcctggaggatcacaaagaggatattctctgcggtccggtatggttggccagcggattagatctgtcaggccacgccgggatgctgacattgacatcccccaaactggttaaggggatggctggcgggaagtaccgctcatttctaatccacgtgaaagcggtgaatgaaagaggaacagaggagatatgcaatggcggtatgcgtccagtggtgcgtcttcctagcctgaagcatcagtcaaataagggatatagcctggcatccctcctggctaaagtcgctgccggcaaggaaaaaagttcaaatgttaagaacgaaaatacctctgggacccgaaaatcagagaatctacggggatgcgatttacttcaggaggtcagcgtaactatccgacggttcaagaagactagtatttccaaagagagagtgcagcgatgtgcaatgctgcagttctcagagttccacgaaaagctggtcaacactctctgtcgaaagacagatgatggccagataaccgagcacgcccaaagcttggtcttagacaccctctgttggctcgctggtgttcattcaaacggccccgggagctctaaggaaggaaacgaaaatctgctctcaaagactaggaagttcctgtccgatatcgtgagagtatgctttttcgaggctgggagatcgatcgcgcataagtgcgctagattcttggctctgtgcatctccaacggaaagtgcgatccctgtcagcctgctttcggccctgtgctattaaaggccctcctggacaacatgtcatttctgccagcagccactacaggcggatccgtgtactggtatttcgttctgctgaattacgtgaaggacgaggacctggccggatgcagtaccgcgtgtgctagcctcttaaccgcagtttctagacagctccaggatcgtctgacgccgatggaggctctcctgcaaacaagatacggattatattccagcccttttgacccagtgctgttcgacctggagatgagcggctccagctgcaaaaatgtgtataactcttccattggagtgcagagtgatgaaattgatcttagtgatgttctctctggaaatgggaaggtttcctcttgtactgctgctgagggaagctttacctctctgactggcttattggaggttgagcccctgcactttacttgtgtgtcgacatctgacggtacacgcattgagcgggacgatgccatgtcttccttcggggtcactcccgctgtcgggggtctgagctctgggactgtgggggaggcaagtactgcgctgagctcggctgcacaggttgccctgcagtccctgtcacacgccatggcctccgctgaacagcagctccaggtgctgcaggagaagcaacagcaactcctaaaattgcagcagcagaaagcaaaactggaggccaaactccaccagacaactgctgcagccgctgccgctgcctccgcggttggtccagtgcacaacagcgtgcccagcaatcctgtggcagctccaggattcttcatacacccttctgatgttattcctcccacgccaaagaccacaccgctgttcatgacacctcctttaacccctccaaacgaggccgtttcagtggtgatcaatgccgagttagcgcagttattccccggatcagtcatcgacccacctgccgtcaacttagctgctcacaacaaaaattcaaataaatcccggatgaacccgttaggaagtggcctggcactggctatctcccatgcgtctcacttcctccagcccccacctcaccaaagcataattatagagaggatgcacagtggggcaaggcggtttgtgaccctcgattttggccggcccatcctgctcacagacgtcctgattcctacgtgtggggatctggctagtctgtcaatcgatatctggacactgggggaggaagtggatgggaggcgcctagtcgtcgccacagacatctctactcactcgctcatattgcacgatttgatacccccacccgtttgcagattcatgaagatcacagtgatcggtcggtatggaagcacaaacgccagagcgaaaatccctcttgggttctactacggccacacttacatcctaccttgggagtccgagctaaaactgatgcatgaccctctgaaaggggagggcgagtctgcgaatcagcccgaaatcgatcaacatctcgctatgatggtagcattgcaagaagatatacagtgtagatacaatcttgcttgtcacaggctggagaccctgttgcagtctattgatcttccccccctgaacagcgccaacaacgcccaatacttcctgagaaagccagataaagccgtggaggaggattcccgcgtgttttctgcctatcaagactgcatacaacttcagctccagctgaatctcgctcataacgcagttcagaggctgaaggtggccctgggagcctccaggaaaatgctgtcggagacttcaaaccctgaggatctgatacagactagctccaccgaacagttaagaaccatcattaggtatctgctagacacgctgctgtcattgctgcacgcctcgaatgggcactctgttccagctgtcctgcagtctactttccatgcacaggcttgtgaggagctgtttaagcacctttgtattagtggcacgccaaagatccggctgcacactgggctgttgctggtacaactttgcggcggagagagatggtgggggcagtttctgtccaacgttctccaggaactgtataacagcgaacagctgttgatttttccccaagacagggtttttatgttactgtcatgcattggacagcgcagcctgtcgaatagtggcgtactggagtctttacttaatcttcttgacaaccttcttagcccgctacagccacagctccctatgcacaggcggaccgaaggtgttcttgacatcccaatgatcagttgggtcgtgatgctggtcagcagattacttgactatgtcgccaccgttgaggacgaggccgcggcggctaaaaagcccttgaacggaaaccaatggtcctttattaataacaatctgcatactcagagtttaaacaggagttccaaagggtccagttccttagacaggctgtacagccggaagatacggaagcagttggtccatcacaagcagcagctgaatctccttaaggctaagcagaaggctctggtggaacaaatggagaaagaaaaaattcagagcaacaaggggagctcttacaaattgttagtggagcaggcgaagttaaagcaggcaacaagcaagcacttcaaggacctcatccggctgcgccgcacagcagagtggagccgtagtaatctggacaccgaagtgacaacggccaaggagtcccctgagatcgagcctctcccctttaccctcgcccacgagcgatgcatttcagttgtgcagaaactggtactcttccttctgtccatggatttcacgtgccatgctgacttgctgctgttcgtttgcaaagtcctcgcgcggattgccaacgccactcgaccaacgatccacttgtgtgagattgtgaacgaaccacagctggaaaggctcctgctactcttagttggaaccgatttcaacagaggggatattagctgggggggcgcgtgggcccagtattcccttacctgtatgcttcaggatattcttgctggtgagctgctcgcccctgtggccgccgaggccatggaggagggtacagtgggagatgatgtaggtgccaccgcaggcgattccgacgacagccttcagcagtcctccgttcaactgcttgagacaatcgacgagccactgactcatgatattactggcgctcctccactgtcgagcctggagaaagataaagagatcgatctggaattgttacaagatcttatggaggtggacatcgacccactggacatcgacctggaaaaggaccccttagccgctaaagtgttcaaacccatctcaagtacttggtatgattactggggcgcagattatggtacatacaattacaatccttacatcgggggtctcgggatccccgttgccaagccaccagctaataccgaaaagaacggtagccagacagtgagtgttagcgtgtcgcaggcccttgacgcgaggctagaggttgggctcgaacagcaagctgaactgatgttaaagatgatgtccacccttgaagctgacagtattctgcaggctctaactaacacgagccccacattgagccaatcacctaccgggacagatgatagcctccttggtggcctccaggctgctaaccagacatcccagttgattatccagcttagttcagtacctatgctgaacgtgtgtttcaataaactgttcagcatgttacaagttcaccacgttcagctcgaatctttactgcagctttggctgacgctgtcgctcaacagttcttccacaggcaataaagagaatggcgccgatatctttctgtataatgccaaccggattcccgtgatctctctgaatcaggcgagtattacaagctttctgactgtgctggcatggtaccctaataccctgctccgtacttggtgcctggtcctccactctctcacattaatgacaaacatgcaactcaactccggctcgtcatcagccattggcacccaagagagtaccgcacatctactggtgtccgaccctaatctcattcacgtgctagtgaagtttctgagtggcacgagcccccatgggactaatcagcactcccctcaggtaggtcctaccgccacccaagctatgcaagaattcttaacaaggttgcaggtgcacctgtccagtacttgcccccagatcttctctgaattcctcctgaagctgattcacattctcagcaccgagcggggcgccttccagaccggacaaggaccattggacgcccaggttaagctgctagaattcaccctggagcagaatttcgaggttgtatccgtctctaccatttctgccgtgatcgaatcggtaaccttcctggtgcatcattatataacctgttcagacaaagttatgtcacgatctggctccgattcttccgttggcgccagagcctgttttggcgggttatttgctaacctcatcaggccaggggacgcaaaggccgtctgtggggaaatgacgcgagaccaactgatgtttgacctactgaagctagttaacattctggtgcaactgcccctctccggcaacagagaatatagcgcccgagtgtccgttaccaccaatacgacagatagcgtgagcgatgaggagaaggtttccggcggaaaggatggtaatggttccagcactagtgtccagggctcacccgcctatgtggcagaccttgtgctggccaatcagcaaatcatgtcccaaattctgtcagcactgggtctctgcaactcctctgccatggccatgataatcggagccagtggcctccacctgacaaagcatgagaacttccatggtggcctcgatgcaatatccgtgggtgacggtttgtttactatcctaactactctctctaagaaggcaagcaccgtgcacatgatgcttcagcccatcctgacctatatggcctgtggatatatgggacgtcagggctccctggccacctgtcagttgtccgaacctctgctctggttcatcctgcgggtgttggacacctctgatgctctgaaagccttccacgatatgggcggagtgcagctgatatgcaataatatggtgacaagtaccagagcaatcgtcaacacagcgcgctcaatggttagtactatcatgaaatttttggattctggaccaaataaagccgttgactccacactgaaaacaagaatcctggccagcgaaccagataacgccgagggtattcacaattttgcgcccctgggcaccattacatcaagctctcctacagcgcagccagcggaagttctgttgcaggcgaccccccctcaccgcagggccaggagcgcggcttggagctacatttttcttcctgaggaagcctggtgcgacttgactatccacctgcccgctgcagtgctcctgaaggaaattcacattcaaccccaccttgctagtctcgctacgtgcccatcttctgtcagtgtggaagtgtctgccgatggggtcaatatgttaccactatctaccccagtagtgacttccggacttacctatataaagatacaactcgtcaaggcagaggtcgcctccgcagtctgtcttaggctgcatagaccgagggatgctagcacactgggtctgtcacagatcaaattgcttggacttaccgccttcgggaccacttcatccgccacagtgaacaatccattcctcccatccgaggatcaagtgtcaaagacatccatcggctggctgagactgttgcaccattgcctaacccacatcagcgatctcgagggcatgatggctagcgccgcagccccaaccgctaatctcctccaaacttgcgctgccctgctgatgtccccctattgcgggatgcatagccccaacattgaggtggtgctagtgaaaattggcctccagtcaacacgcatcggcctgaaacttattgacatcttactgcggaattgcgctgcatctggctcggatccaacagacttgaacagccctctcctgtttggtagattgaacggtctaagttcggatagtaccatagacatcctgtaccagttaggcaccactcaggacccaggaaccaaggaccggattcaggctttgctgaagtgggtcagtgatagcgctcgagttgctgccatgaagagatcaggtcgcatgaactatatgtgccctaatagctctactgtggagtacgggttattgatgccaagcccgtctcacctgcactgcgtggctgcaatcctgtggcattcctacgaactcctggtcgagtacgatctacccgcgctgcttgaccaagaactatttgaattactgtttaattggagcatgagtctgccctgcaatatggtgctaaagaaggccgttgactccttgctgtgcagtatgtgccatgtccacccaaattatttcagtctgctgatgggctggatgggcattacccccccgccggtccagtgccatcaccgcttgtcaatgaccgatgacagtaagaagcaagatctgtcaagcagtctaacagacgactcaaagaatgctcaggcacctctggcattgacagagtctcatctcgccaccctcgcttcaagcagccagagtcctgaagcaataaaacaactgctggactcaggtctcccaagcctgttagtgaggtcattagccagcttctgttttagccacatcagctcttctgaatcaatagctcaaagtatcgatattagccaagacaaactgcgtcgacaccatgtaccgcagcagtgtaataagatgcctatcacagctgacctggtcgcacccatcctgcggtttctgactgaggtgggtaacagccacataatgaaagattggttgggcggctcagaggttaatcccctgtggacagctttgctattcctgctctgccatagtggcagcactagcggaagtcacaacttaggtgcccaacagacctctgcacggtccgctagcctgtccagcgccgccaccacagggctgactactcaacaacgcacagccatagagaacgctacagtcgcttttttcctgcagtgcatcagttgccacccaaataatcaaaaattgatggctcaggtgctctgtgaactcttccagaccagccctcagagaggaaacctgccaacatcggggaatatcagtggatttattagaagactcttccttcagctcatgctggaggacgaaaaagtgactatgtttctccagtcgccttgtccattatacaagggccggatcaacgctacttcccatgtgatccagcatcccatgtacggcgctgggcacaaattcagaaccctacatctgccggtgtccacaacactatctgacgtactcgatagggtgagcgacacaccctcaatcactgctaagttgataagtgagcaaaaggatgacaaagaaaaaaagaatcatgaagagaaagaaaaggttaaagctgagaatggctttcaggacaactactctgtggtagtggcctctggactgaagagtcagtctaagagagccgtttccgccacccccccacgtcccccgagccgcaggggaaggactatccccgacaaaatcggcagtacgagtggagccgaagccgccaataagataatcaccgtccccgtgtttcatctgttccacaagctcttagcgggccagcctttgccagctgagatgacactggcccaactattgacgctgctgtacgacaggaagcttcctcagggctataggtccatcgacttgactgtcaaactcggaagccgggtgatcacagatccctcgctgtctaaaaccgattcatacaagcggctgcaccccgagaaagaccatggagacctcttggctagttgcccagaggacgaggcactgactccgggcgatgaatgtatggatggcattttggacgaaagtctcctggagacgtgccccatccagtcccccctgcaggtgttcgctggcatgggcggccttgccttgattgccgagcggctccccatgctttaccccgaagttattcagcaggtctccgcacccgtggtaacgagtactactcaagagaagccaaaggattccgaccagtttgagtgggttactattgagcagagtggggagctcgtgtacgaagccccagagacagtggccgcggagcctccccccattaagtctgcagtccagaccatgtccccgatacctgcccattccctggccgctttcggattgttccttcggctcccaggctacgccgaggtgctcctaaaggagcgcaaacacgctcagtgccttttaaggctagtgctcggcgtgaccgatgacggcgaagggtcccatatactgcagagtccctcagccaatgttttaccaactctgccctttcatgtgttacgctctctgttctcgacgactcctctcaccacggatgacggtgtgctgctccggagaatggcactggagattggagcactgcacctgatcctggtgtgcctcagtgctctgtctcatcacagcccaagagtcccaaacagttctgtgaaccaaactgagccacaggtatcctctagccacaatccaacctctactgaagagcaacaactgtattgggctaaaggaactggatttggcactggaagtacagcctccggttgggatgtggagcaagcactgactaaacaacggcttgaagaagagcatgtgacatgtctcttgcaagtccttgccagctacatcaaccctgtgtcctctgccgttaatggtgaggcgcagtctagccacgagacccgaggccagaattcaaacgctttgcccagtgtgctcctcgaattattgtcacagtcttgtctgattcccgctatgtcgtcttacctgcgaaacgactctgtcctcgacatggccaggcacgtgccattgtacagagctcttctagagcttctgcgagccatcgcttcttgcgccgccatggtccccctcctgttaccactaagtacagaaaatggtgaagaggaggaagaacagtcagagtgccagaccagcgtgggaaccttattggcaaaaatgaagacctgtgttgatacctatacaaatcggttacggagtaaacgggagaacgtaaagacaggagtaaagccagacgcctctgaccaagagcctgagggtcttacactgctcgtgccggatattcagaagactgccgaaatcgtgtacgccgccacaacatctctgagacaagccaaccaggagaaaaagttaggcgaatactcgaagaaggccgctatgaaacccaagccgctgagcgtactgaagtctctggaggagaagtacgtggcagtgatgaagaagctgcagtttgatacatttgaaatggtatctgaggatgaggatggcaagctggggtttaaagtgaattaccattatatgtcacaggtgaagaacgctaacgacgccaacagcgctgcccgcgcacgccgtctggcgcaagaggctgtcactttgtccacatccttgcctctgtcgtcctcttcatctgtgtttgtccgctgtgatgaggagaggttggatattatgaaagtattgattacaggtcctgccgacacaccctatgccaatgggtgcttcgaatttgatgtgtacttccctcaagactatcccagcagtccacccctggttaacctagagactacaggggggcattccgttagattcaatccgaacctttacaatgatggaaaagtgtgcctgtctatcctgaatacatggcacggtcgcccagaagagaaatggaatccccagaccagctccttccttcaggtgctcgtatctgttcagtctttgattttagtcgccgagccatatttcaatgagcccgggtacgagcgctctaggggcacaccctccggtactcagtcttcgagagagtacgatgggaatataaggcaggctacagtgaaatgggccatgctagagcaaatcagaaatccgagtccgtgtttcaaagaggtgatccataagcatttttacctgaaaagggtggagataatggcgcagtgtgaagaatggatcgcagatatccagcaatattcctccgataagagggttggaaggacaatgtcccaccacgccgccgcactgaagcgccacacggctcagttacgcgaggaactgctgaagttgccctgtcccgaagggctggaccctgacactgacgatgctcctgaagtgtgtcgcgccactaccggtgctgaggagacactgatgcatgatcaagtaaagccctcatctagcaaagagctcccctccgactttcagctgtag

SEQ ID NO: 13979 - DNA, 1566 bp, Artificial Sequence
  Description of Artificial Sequence: Synthetic coding sequence
atgagtctgagcagaagcgaggagatgcacaggcttactgagaatgtgtacaagacaatcatggagcagtttaacccaagtctccggaattttatcgccatgggtaaaaattacgagaaagccttagccggagttacttatgcggccaagggctacttcgacgctcttgtgaagatgggagaactagcgagcgaaagccaggggagcaaggagctgggtgacgtgctcttccagatggcagaggtccatagacagattcagaaccagcttgaggaaatgctgaagagcttccataacgagttgctgacccagcttgagcaaaaggtggagctggatagtagatacttgagtgcagctcttaaaaaatatcaaacagaacagcgatctaagggagatgctctcgataaatgccaagcggaactcaagaagctccgcaagaagtctcagggcagcaagaaccctcaaaagtatagcgataaggagctccagtatattgacgccataagcaacaagcagggcgagctggagaactatgtatccgatggatacaagactgcccttaccgaggagcgtaggcgattctgctttctggtcgaaaagcagtgcgctgtagctaaaaactcagctgcataccacagcaaagggaaggagctactggcacaaaaattgcctctctggcagcaggcttgcgcggacccatcaaaaatcccggagagggcggtgcaacttatgcagcaggtggcttcaaacggcgcgactctaccctcagccctcagcgcatcaaagtctaacctggttatatctgatcctatacctggggccaaaccattgcccgtacccccagagctcgcaccattcgtcggtaggatgagcgctcaggagtcgaccccaataatgaatggggtaactggaccagatggcgaagactattccccctgggctgaccgaaaagccgcgcagcccaaatccctctctcctccacagtctcagtccaaactgagcgattcttactcgaacacgctgccagtgcgtaagtcagtcacacccaaaaacagctatgctacaacagagaataagacacttcctagatcaagctctatggctgccggacttgagcgcaacgggcgaatgcgggtcaaggccattttcagtcatgctgccggcgacaactcaacccttctctcatttaaggagggcgatctgatcacactcctcgtgcccgaggccagagatggctggcactacggagagtcagagaaaactaagatgcgcggctggtttccctttagctacaccagagttcttgactctgacggaagcgacaggctgcacatgtccctacaacaagggaagtcctcaagcaccggcaatttgctggataaggatgatctagccatcccccccccagactacggagctgcgtcaagggccttccccgcacaaaccgcaagtggctttaagcaaagaccgtactcagtagccgtacctgccttctcacaaggactagatgattacggtgcaagaagcatgagctcaggctccggaacacttgtgagcactgtgtag

SEQ ID NO: 13980 - DNA, 1659 bp, Artificial Sequence
  Description of Artificial Sequence: Synthetic coding sequence
atgtcactgtctcgaagcgaggagatgcaccgcctaacagagaatgtgtacaaaactataatggaacaatttaatcccagtcttagaaattttatcgccatgggcaaaaattacgagaaggccctggctggagtgacatacgctgctaaggggtactttgatgccctagtcaaaatgggggagcttgcgtccgaaagccagggttcaaaagaactgggcgatgttctctttcagatggccgaggtccaccgacagattcagaatcagttggaggaaatgctgaagtcttttcacaacgagctattaactcaactagaacagaaggtcgagcttgactccaggtatctttcggcagccctgaaaaagtaccagactgaacagcgcagtaaaggcgatgcactagataaatgccaggcagagttgaaaaaactgcgaaaaaaaagccaggggtctaagaatccacaaaagtattccgacaaagaactccaatatattgacgctatcagcaacaaacaaggcgagttagaaaattacgtgagcgatgggtataagactgccctcacagaagagagacgacggttttgttttctcgtcgagaaacagtgcgccgtggctaagaactcggccgcataccacagtaaaggaaaggaattgctggcccagaagctgcccctgtggcagcaggcttgtgctgaccccagcaaaattcccgagcgtgctgtgcagttgatgcagcaggttgcgagtaatggagcaaccctcccttcagctctttctgccagcaaatccaatctggtgatctccgatcctatacccggcgcaaagccccttccagtgcctcctgagctcgctccatttgtgggacggatgagcgcacaggagagcacacctattatgaacggcgtgacaggacctgatggcgaagactactccccctgggcagacagaaaggcagcccagcccaagtccctgtctcctcctcagtcacagtctaagttgagtgattcctactccaatacgcttcccgttagaaagtccgtcacccccaagaactcatacgctaccacagaaaacaagaccctgccaaggtcttcatcaatggctgccgggctcgagaggaatggccgcatgcgtgtcaaggcgatcttctcacacgcagccggcgacaactccactttattgagcttcaaggaaggcgacctcatcacgctattagtgcctgaggcacgggatggatggcactatggcgagagcgagaagaccaaaatgagaggatggttcccattttcgtatactcgcgtgcttgatagcgatgggtctgaccggctgcacatgtctctgcaacaaggaaaatcatccagtacaggtaatctgctagacaaggacgaccttgcaattccacctcccgattacggggcggccagccgtgcttttccagcgcagacagcttccggctttaaacagaggccctattcagttgccgtccctgcgttttcccaaggattggacgactacggagcaaggagcatgtcccgcaacccgtttgcccatgttcagctgaaacccaccgtaacaaatgaccgatgcgacctgagcgcgcagggcccggagggcagggagcatggcgatggctctgcgcggacgctcgctggccggtag

SEQ ID NO: 13981 - DNA, 1371 bp, Artificial Sequence
  Description of Artificial Sequence: Synthetic coding sequence
atggccgaggtccataggcagatccagaatcaactggaggagatgttgaagagcttccacaatgagctgttgacccagttggagcagaaagtcgagctcgacagtagatacctaagcgctgcgctcaagaaatatcagaccgagcaacgaagtaagggtgatgccctggacaaatgccaggcagaacttaagaagctgaggaagaaaagccaaggaagtaagaaccctcagaagtattctgacaaggaactgcagtacatcgatgccattagtaacaagcagggggaactcgagaactacgtgtctgacggatataaaaccgccctgaccgaggaaaggaggaggttctgctttttggttgaaaagcagtgtgccgtagcaaaaaactccgcggcttatcattctaagggaaaggaacttctcgcccagaagctgcctctgtggcagcaggcgtgcgccgacccatcaaaaatccctgagagggccgttcagctcatgcagcaggttgcttcaaatggcgctacgctgccatctgctctaagcgccagcaagtctaatctcgtgataagtgatccaattccgggcgcaaagcccttgcctgtgcccccggagctagcccccttcgtaggccgcatgagtgctcaggaaagtacaccgatcatgaacggtgtaaccggtcctgatggcgaggactattctccatgggccgatagaaaggctgcccagccaaagagcttgagccctccacagtcgcaatccaagctgtccgactcttactcaaacaccctcccagtgagaaaatctgtgactcccaaaaattcctatgccacgaccgagaacaagactctccccagatctagctctatggcagccggcctggaacgtaatggcaggatgagagtgaaggcaatcttctcccacgctgccggggataacagcacactcctgtccttcaaagagggcgatctgattacacttctggtgcctgaggctcgagacggttggcattatggcgagtcagagaagactaaaatgaggggatggtttcctttctcatacacacgtgtgctggattctgacggttcagaccgcttgcatatgagcctccagcaggggaagagctcttccaccgggaacttgctcgataaggacgacctagccatcccacctcctgattacggcgccgctagcagagcctttccagcacaaactgcctcgggtttcaaacagaggccatactccgtggcagtaccggcattctcccagggcctggatgattatggcgctcgatctatgtcccggaaccctttcgcgcacgtacaactgaaacccactgtcacaaacgacagatccgcccctcttctttcttag

SEQ ID NO: 13982 - DNA, 1128 bp, Artificial Sequence
  Description of Artificial Sequence: Synthetic coding sequence
atgctccttcccgaagggcagaggcaaagagcactgggatttgggaccgtaacctctacatactcgccagtaggtcagtacatcgacgctatttccaacaagcagggggagctggagaattacgtgtcagatggctacaaaaccgcgctcacggaggagcggcgccgcttctgcttcctggtggagaagcaatgcgccgttgccaagaacagtgcagcttaccactctaaaggcaaagagctcctcgcccaaaagcttcccctgtggcagcaggcctgcgccgatccaagtaagattccagaacgggccgtccagctcatgcagcaggttgcttccaatggtgctacactccctagcgcgttgtccgcctccaagagtaacttggtcatttccgaccccatccctggggcaaaacctctgccagtgccacccgaactcgctccgtttgtcggccgcatgtcggcgcaggagagtacccccatcatgaatggcgtgactggacctgacggtgaggattactccccctgggcagatcgaaaggccgcccagcctaagtcgctgagccccccacagtctcaatccaaactatcggacagttacagtaataccttgccagtccgtaaaagcgttactcccaaaaactcatacgcaactacagagaataaaacactgcctcgatcgagcagcatggccgcaggattggagcggaatgggaggatgagagtgaaggccattttctcacacgccgccggagacaattcaaccctacttagtttcaaagaaggcgatctcatcaccctgcttgtccccgaggctagggatggttggcactacggggaatcagaaaagaccaagatgcgtggatggtttcccttttcttacactagagttcttgactccgatggatcagacagactgcacatgtcactccaacaggggaaaagcagctcgacaggcaacctgctggacaaggatgatctcgctatcccacctcccgactatggggcagcttccagggcatttcctgctcagactgcctctggatttaaacagcggccttattcggtcgctgtaccagccttttctcagggtcttgatgactacggcgccaggtctatgtccaggtag

SEQ ID NO: 13983 - DNA, 1605 bp, Artificial Sequence
  Description of Artificial Sequence: Synthetic coding sequence
atgtctctatcgagaagtgaggagatgcataggctaaccgaaaatgtctataagaccatcatggagcagtttaatcctagtttgcgaaattttatcgctatggggaagaactatgaaaaggcgctcgcaggcgtgacatacgcagccaaaggctacttcgacgccctggtaaagatgggcgaactcgcctccgagtcccaaggttctaaggaactgggagatgtgctgttccagatggcggaagtgcacaggcagatacagaatcagctggaggagatgctcaagagttttcacaacgagttactgacacagttggagcagaaagtcgagttggatagccggtatctgagtgccgcgctaaaaaaataccagactgagcagaggtcgaagggtgacgccttggacaagtgtcaggctgagctgaagaagcttcggaagaagtcacagggaagcaagaatccccagaaatactctgacaaagagctccagtacattgacgcaatttctaacaaacagggggagctcgaaaattacgtatctgacggatataagaccgcattgacagaggagagacgcaggttttgcttcctggtggagaagcagtgtgccgttgcaaagaattcagcagcgtaccacagcaaagggaaggaactgcttgcgcagaaactccccttgtggcagcaagcatgtgctgacccctccaagattccagagagagcggtgcagctgatgcagcaggtggcctctaacggcgccaccctgccttctgctctgtcggcttccaagagtaatctggtcataagtgacccaattccgggagccaagcctctgcccgttcctcccgaactggcccctttcgtgggacggatgtccgcacaggagtctacacctataatgaacggtgttacgggccccgacggagaggactacagtccatgggccgataggaaggctgcccaacccaagtcactgtccccgccacagtcccagtctaaactgtctgacagctactcaaatacattaccagtgcggaagagcgttactcccaagaacagttacgcgacgacagagaataagactttgcctcggagcagttctatggcagctgggttggaacgtaatggacgcatgcgggtgaaagccattttctctcacgcggccggcgacaacagtactttactatcgttcaaggaaggggaccttatcactctcctagtacctgaagcacgcgatggttggcattacggcgagagcgaaaagactaagatgcgcgggtggttccctttcagctataccagggtgctcgactccgatggttctgaccgactccatatgtctctccaacaaggaaaatcctccagcacagggaatctgcttgacaaggatgacttggccattcctccacccgactacggtgcagcttcaagggccttcccggcccagaccgctagtgggtttaagcaaaggccttattcagtggccgtcccggctttctcacagggactggatgattacggggccagaagtatgtctaggaatccctttgcacacgttcaacttaaacctacagttacgaatgaccggtcagcacccctgctgagctag

SEQ ID NO: 13984 - DNA, 1563 bp, Artificial Sequence
  Description of Artificial Sequence: Synthetic coding sequence
atgtctctgagcaggtccgaggagatgcacagacttacagaaaacgtatacaagacgattatggaacagttcaatccctctctaaggaatttcattgcaatgggcaaaaattatgaaaaggcgcttgccggggtgacttacgccgccaaaggttacttcgacgcactggtgaaaatgggcgaacttgctagcgagtcacaagggagcaaagagctcggcgatgtcctgttccaaatggctgaagtgcaccgacagatccagaatcagctggaagaaatgctgaaaagcttccataatgagttactgactcagctcgaacagaaggttgaactggactcccgatacttgtcagccgcgctaaagaaatatcaaactgagcagaggagcaagggcgacgcactcgacaagtgtcaggccgaactgaaaaaattgaggaagaagtcccaggggtctaaaaatcctcagaagtactccgataaagaattgcagtatatcgacgcaatcagcaataagcagggcgagcttgaaaattacgtgtcagatggctataaaacagcactgaccgaggagagaagaaggttctgttttctagtcgagaagcagtgcgccgtagcaaagaattctgccgcttaccactcaaaggggaaagagcttcttgctcagaaactccccctgtggcagcaggcatgcgccgaccccagcaagattccagagcgcgccgtgcagctgatgcagcaggtggcctctaatggagcaactctccctagtgcacttagtgcatctaagtcgaacctggtgatcagcgatcccattccgggcgctaagcctttgccagtcccaccagaattagccccattcgtcgggcgcatgtctgcccaggagtccacccctatcatgaacggggtgacaggaccagatggggaagattatagtccgtgggccgatcgcaaggccgcccagcctaaatccctgtctcctcctcagtcacaaagcaaactctccgattcttattccaatacgttacccgttcgcaagtccgtgacccccaagaattcctacgccacgacggagaacaagacgcttcccagatcctccagcatggcggccgggctagagcggaatggccgcatgagggtgaaggccatcttttcacatgccgcgggggacaacagtacactgctgtcattcaaggagggcgacttaattaccctgctagtaccagaagcccgggatggatggcattacggagaaagtgaaaaaaccaaaatgcgagggtggttccccttttcttacacaagggtgctagattctgatggcagtgatagactgcatatgtcacttcagcaaggaaagtcctctagcactgggaatctgctggataaggatgacttagctataccccctcctgactacggcgctgctagtcgggctttcccggcccagaccgccagcggtttcaagcagcggccctacagtgtcgctgtcccggccttttctcagggccttgacgattatggagctaggagtatgtcttccgccgacgtagaggtcgcccggttttag

SEQ ID NO: 13985 - DNA, 720 bp, Artificial Sequence
  Description of Artificial Sequence: Synthetic coding sequence
atggctcatgcggggcgtaccggatatgacaatagagaaatcgtgatgaaatatatccattacaaactctcccagaggggatatgagtgggacgccggagatgtcggagccgcaccccccggggccgcgccggcccccgggattttcagctcccagcctggccataccccacaccctgccgcatctcgcgatccagttgcgcgaacatctcctctccagaccccagcagccccaggagccgcagcaggtcctgccctctccccggtccctccagttgtgcacttgacactccggcaggctggagacgatttctcccgtcgctaccggcgcgattttgccgagatgtcttcccagctccatctcactccattcactgccagaggcaggtttgccaccgtcgtcgaagaattattccgcgacggagtcaactggggacgcatcgtggccttctttgaatttggaggagtgatgtgtgtggagagtgtgaatcgagagatgtcacctctggtggataatatagctctctggatgactgaatatctgaataggcatctgcacacttggatccaagacaacgggggatgggatgctttcgtggagctgtacggtccgtcgatgagaccactctttgacttctcctggctctcccttaagactctgctgagcctggccctcgtaggtgcatgtattactttaggcgcttacctaggccacaagtag

SEQ ID NO: 13986 - DNA, 720 bp, Artificial Sequence
  Description of Artificial Sequence: Synthetic coding sequence
atggcccacgccggcaggactggctacgacaaccgagagattgtaatgaagtacatacactacaaactcagccagcgggggtacgagtgggatgccggcgatgtaggggcagctcctcccggggcggctccagctcccggaattttttcaagtcagcccggccacactcctcaccccgcggctagcagggacccagtggctaggaccagtcctcttcagacgccagctgcacctggggccgccgctggtccagccctttcgcccgtgccccctgtggtccacctcacccttaggcaagctggggacgacttctcacggagatataggagggactttgccgagatgagctcacaactgcatctgaccccattcaccgcaaggggccgattcgcaactgtcgtggaggagctgttccgggacggagtcaattggggccgcattgttgcgttcttcgagttcggcggggttatgtgtgtggagtccgtgaaccgagaaatgtcgccactcgttgataacattgcgctctggatgactgagtatctgaacaggcatctccatacgtggattcaagacaacggtgggtgggatgctttcgtcgagctttatggacccagtatgcggccattgttcgacttctcttggttatctttgaagactcttctgtccctcgcactcgttggagcttgtattaccctgggcgcctatctcggccataagtag

SEQ ID NO: 13987 - DNA, 618 bp, Artificial Sequence
  Description of Artificial Sequence: Synthetic coding sequence
atggcacacgctggccggactggttacgataacagggagattgttatgaaatacattcactataaattgagccagcgaggttatgagtgggacgcgggagacgtaggcgccgcacccccaggggccgcaccggctcccggtattttcagtagtcagcctggccacacaccccacccagccgctagcagggaccccgttgccagaacaagtcccttgcagacccctgccgcaccaggcgccgctgcaggcccagccttgtcaccagtaccccccgtggtacatctgacgctgaggcaggctggcgacgatttttccagaaggtaccgcagagacttcgcagagatgagcagccagttgcacttaacgccttttactgcccgggggaggttcgccacagttgtggaagagctttttagggacggagttaactggggccgcatagtggcattctttgagttcggaggagttatgtgtgttgagtccgtgaacagagaaatgagccccttggtcgacaacattgcactgtggatgacagaatatttgaacagacacctgcatacctggattcaggataacggaggatgggtgggtgccttgggggatgtcagcctaggttag

SEQ ID NO: 13988 - DNA, 1578 bp, Artificial Sequence
  Description of Artificial Sequence: Synthetic coding sequence
atgaaagcactcatagctgccctgctgctcattacactgcaatattcctgtgctgtttcacccaccgattgctctgccgttgaaccagaggctgagaaggccctcgatcttattaataaacggcgccgggatggctatctgtttcagctcctgcgaatcgccgatgctcatctcgaccgagtcgagaataccacagtgtactacctggttctggatgtgcaggaatcggactgctccgtgctgtcgcgcaaatactggaacgattgtgaaccacctgattcacgaaggcctagcgagatcgttatcggccagtgtaaggtgatcgccacccggcatagccacgagtcccaggatttacgggtgattgactttaattgcacgacgagctccgtctctagtgccctggcgaacactaaagactcacctgttcttatcgattttttcgaagataccgaacgttacaggaagcaggcaaataaggctctcgaaaagtataaggaagaaaatgacgatttcgctagctttagagtggatcgaatcgagagagtcgcacgcgtgcgaggaggggaggggaccggctatttcgtggatttctccgtgaggaactgtccacggcatcacttccccagacacccgaatgttttcggattttgtagagcagatctgttctatgatgtggaggctctggaccttgaaagccctaaaaacttagtcataaactgtgaggtatttgatccccaagagcacgaaaatatcaacggcgtgccgcctcacctggggcacccgttccactggggcggacatgaaaggagctccaccaccaagcctccgtttaagcctcacggttctagggaccatcaccatccacacaaaccacacgagcacggtcctccacccccaccagacgagcgagaccatagtcacggaccaccattgcctcaggggcctcctccgctcctgccaatgtcctgtagctcttgtcagcacgccacgttcggaaccaacggtgcacagcgccattcccataacaataactccagtgatctccatccccataagcaccatagccatgaacagcacccgcacggccaccatccacacgcccaccacccacacgaacatgacacccaccgccagcatccccatggccaccatccccatggacaccacccccacggacatcatccccacggccaccacccacacggccatcatccacattgccacgacttccaggattacgggccctgcgaccctcctccacacaatcagggacattgctgccacggccacggcccaccccctgggcacttgcggaggcgggggcccggaaaaggcccgcgcccattccactgtcgtcaaattgggtctgtttacagactgccaccgttaagaaagggagaggttttacccctccccgaagccaattttccgagcttccctcttccacaccacaaacaccctctcaagcctgataaccaacccttccctcagtccgttagtgaatcgtgccccggtaagtttaaatctggatttccgcaggtgagcatgttcttcacccacacttttccaaaatag

SEQ ID NO: 13989 - DNA, 2121 bp, Artificial Sequence
  Description of Artificial Sequence: Synthetic coding sequence
atggcttcaccagctgattcatgcatccagttcacccgccacgcaagtgacgtgttgctgaacctgaatcggctgagaagccgggacattctcactgacgtggtcattgtcgtttcacgagagcagtttagagctcacaagactgtcctgatggcttgttctggtctgttctacagcattttcacagaccagctgaaatgtaatctttctgtcatcaacctggatcccgagatcaaccctgagggcttctgtatacttttagacttcatgtatacaagccgcctgaacctgcgagaggggaacattatggcagttatggcgacagccatgtatttacagatggagcatgtggtcgatacctgcagaaaattcatcaaagcctctgaagccgaaatggtgtccgccatcaaacccccgagagaggaatttctgaattcccgtatgcttatgccccaagatataatggcttataggggtagagaggtcgtcgagaataacctgcccctccgtagtgcccccggctgtgaatcgagggctttcgctccaagcctgtatagtgggctctctacgccccctgcttcgtattctatgtacagccacctacccgtgtcatcactcctgtttagtgacgaggaatttcgagacgtcaggatgccagttgcgaacccattccctaaggagagggctctgccttgcgactcagccaggcctgtgcctggggagtacagccgccccactctggaagtcagccctaacgtctgccattccaacatctactctccaaaggaaacaattcccgaggaggcgagaagtgatatgcactactctgtcgccgaagggctgaagccagcagccccctcggcacgtaacgccccctacttcccttgcgacaaggcctctaaggaagaagaaaggcccagcagcgaggacgagattgctctacacttcgagccccccaacgctcctctgaataggaagggccttgtcagtccccagtctccacagaagtcggattgtcagcctaatagccccaccgaatcctgctcaagcaagaatgcctgtattctccaagcgtctgggagtccgcccgcgaaatcgcccacagaccccaaggcctgcaactggaagaaatataaattcatcgtgctgaattctctgaatcagaatgctaagcccgaagggcccgaacaggcagagcttggccgcctgtctccaagagcctataccgcgccccctgcttgtcagccacctatggagccagagaacctcgaccttcagtcccctaccaaattatcagcgtccggcgaagacagcactatacctcaagcttctaggctgaacaatattgtgaatcgttccatgacgggatcgccaaggtcctcaagcgagagtcattcacctctttacatgcacccccccaagtgtacaagttgcggctcacagtctcctcaacatgcagagatgtgccttcataccgcaggcccgacgttccccgaagagatgggtgagacccagagcgagtactctgactcaagctgtgagaatggcgcatttttctgcaacgagtgcgattgccgattttccgaggaggcatctctgaagcgacacaccctccaaacccatagcgacaagccatacaagtgcgaccggtgccaggcgagctttcggtacaagggcaatctggccagtcacaagacggtgcatacaggcgagaagccctacaggtgcaatatatgcggagcacagttcaataggcccgccaacttgaaaacacataccagaatccactccggtgagaaaccatataagtgcgagacctgcggggcacggtttgtgcaggtcgcacatctgcgggctcacgttctgattcacaccggcgaaaaaccctatccgtgcgaaatctgtggcacaaggttcaggcaccttcagacactgaagtctcatctgcgcatccacaccggcgaaaagccttatcactgtgagaagtgcaaccttcactttagacacaaatcccagctcaggctgcatctgcggcaaaagcacggggctattaccaacaccaaggttcagtaccgcgtaagcgccactgatcttccccccgagcttcccaaggcctgttag

SEQ ID NO: 13990 - DNA, 369 bp, Artificial Sequence
  Description of Artificial Sequence: Synthetic coding sequence
atggctagccccgcagactcttgcatccagttcacccgtcacgcatcggatgtgttgctcaatcttaatagactgagatcgagagacatcttaaccgatgtcgttattgtggtatcccgtgaacaattccgggcacacaagaccgtgctgatggcctgttctggactgttttacagtatttttactgatcagttgaagtgcaatctttcagtcattaacctggatccagaaatcaatcccgagggattttgcatactcctggatttcatgtatacctctcgcttgaacttacgggagggtaacattatggcagttatggccaccgctatgtacctgcaaatggagcacgtggtggacacttgtcggtag

SEQ ID NO: 13991 - DNA, 315 bp, Artificial Sequence
  Description of Artificial Sequence: Synthetic coding sequence
atggcttcgcctgcggacagctgcatccaatttactcgccacgcaagcgacgttttgcttaacctaaatcggctccgttccagagacatcctgacggatgttgtgattgtcgtgtcgagagagcagtttagggctcacaagactgtactgatggcgtgtagtggccttttttattccatcttcactgatcagctcaaatgtaatctttccgtgatcaatctcgacccagagataaatccggaaggtttctgcatcttgctggactttatgtatacatcgaggctgaatctaagagaaggaaatattatggcttag

SEQ ID NO: 13992 - DNA, 1953 bp, Artificial Sequence
  Description of Artificial Sequence: Synthetic coding sequence
atggcttctcccgcagattcctgcattcagttcaccagacatgcctcagacgtattgctgaatttgaatcgtctgcgttcaagagatattttgaccgatgtggtgatagttgtgagtcgggaacaattcagagcgcacaaaactgtgctcatggcgtgcagtggcttgttctatagcatcttcacggatcaactgaagtgcaacctgagtgtcatcaaccttgacccagaaattaacccggagggcttctgcattctcttggattttatgtatacgtcacggctcaatctgagggaagggaatatcatggccgtcatggcgactgctatgtacttgcagatggagcacgtggttgacacgtgcagaaagtttattaaagcatcagaggcagaaatggttagtgcaattaagccacctagggaagagttcctaaactctcggatgttaatgcctcaagacattatggcataccgaggtagggaagtcgtggagaataatcttccattaaggagtgcccctgggtgcgagtctcgcgcattcgcgccttcactgtacagcggcttaagcactcctcccgcctcatacagcatgtatagtcatctgccggtgagctccctgctgtttagcgacgaggaatttcgggacgtccggatgccagtggctaacccattccccaaagagcgcgcacttccctgtgattcagccagacccgtgccgggggaatatagccgtcctacgcttgaggtcagtcctaacgtttgtcattccaacatatacagtcctaaggaaactattcccgaggaggctagatccgacatgcattattcagtcgctgaaggcctcaagcccgccgccccttccgccagaaatgccccttattttccgtgtgacaaagcgtccaaggaagaagaacggccgtcttctgaggatgagattgctcttcacttcgaaccccccaacgcccctttaaatcgaaagggattggtgagtccacaatcaccccaaaagagtgactgccagccaaatagccccactgaatcctgcagttccaaaaatgcttgcatcctccaggcgtctggatcaccaccagccaagtcacccacagatccaaaggcatgtaattggaagaaatataaattcatcgtgttaaacagcctgaaccagaacgcgaagcctgaggggccagagcaggctgaactgggcaggctaagtccccgcgcttacaccgcgccccctgcttgtcagccccccatggaaccggaaaatctggatttgcagtcacctacaaaactgtctgcttctggagaagatagtaccatccctcaggctagtcgcctcaataatatcgtgaatagaagcatgactggatcccccaggagtagtagcgagtcccatagccctttatatatgcacccacctaagtgtactagctgtggcagtcagtcaccacaacacgctgaaatgtgtctccataccgccggcccaacttttcctgaagagatgggagaaacacagtcagaatattcggattcatcctgcggagaaaaaccttataggtgcaacatctgcggggcgcagtttaatcggccagcaaatctgaaaacccatacccggatccactcaggagaaaaaccttacaaatgtgagacttgcggggccagattcgtgcaggtggctcaccttcgtgcccatgtgctgatacacaccggagaaaaaccttatccttgtgagatctgtggcacccgcttccggcaccttcagacattaaaaagtcaccttaggatccacaccggcgagaagccgtatcattgcgaaaaatgtaaccttcatttcaggcacaaatctcagctgcggttgcatctgcgccaaaagcacggcgctataaccaacaccaaagtgcagtacagagtttctgcaaccgacctgcctccagaattgcctaaagcctgttag

SEQ ID NO: 13993 - DNA, 306 bp, Artificial Sequence
  Description of Artificial Sequence: Synthetic coding sequence
atgaagttcggaatgggaagcgcacaggcgtgtccctgccaggttccaagagcagctagtactacatgggtcccgtgccaaatctgcgagaccagaggcgcagccgccgctcctccgctgactctggagggccccgttcaatcacaccatggtacacccgccctgacccagggaccacagtctcctcgcgacggcgctcagctcggagcttgcaccagacctgtggacgtgcgcgactctggcggacggcccctgccccctccggacacactggcaagtgcaggtgacttcctctgtactatgtag

SEQ ID NO: 13994 - DNA, 396 bp, Artificial Sequence
  Description of Artificial Sequence: Synthetic coding sequence
atgaaatttgggatgggctcagcgcaggcatgtccctgccaggtgccaagggcagcgagtaccacatgggtgccatgccaaatctgcggaccccagccatcactctctctggcagagcagcacctagagtctcccgtgcccagcgccccaggggcccttgctgggggacctactcaggctgcaccaggcgtgcgtggcgaggaagagcagtgggcaagggagatcggagcccagttacgacggatggcagatgatctgaatgcccagtatgagcgaagacgccaagaggaacagcaaagacaccgcccatccccctggcgcgtcctttacaatttaataatgggcctgctccccctaccacgcggccaccgcgcacctgagatggagccaaattag

SEQ ID NO: 13995 - DNA, 582 bp, Artificial Sequence
  Description of Artificial Sequence: Synthetic coding sequence
atggctagggcccgtcaggagggcagttctccggaacccgtcgagggtctggctagggacggccctcgtcctttcccactagggaggttggttccatccgccgtcagttgcgggctgtgtgagcctggcctggccgctgccccagccgcaccaacattactgcctgctgcttacctatgtgcgcctacagcaccccctgctgtgaccgctgccctgggtggctccagatggccgggtgggcccaggagcaggcctcgaggcccacggcccgatggccctcagcccagcctgagcctggctgagcagcatttagagtctccagttccgagcgcccccggagcgctcgcaggggggccaacgcaggcggctcccggggttcgcggcgaggaagagcagtgggcgagagaaataggtgcccagttacgccggatggcagacgacctgaacgcccaatacgagaggcggaggcaggaggagcaacagcgccaccggccctcgccttggcgagtgttgtacaatcttatcatgggtttgctgccattgccaaggggtcatagagcccccgagatggagccaaactag

SEQ ID NO: 13996 - DNA, 786 bp, Artificial Sequence
  Description of Artificial Sequence: Synthetic coding sequence
atgaaatttggcatgggctctgcccaggcatgcccgtgccaggttccaagggccgcgtccacaacttgggtcccgtgtcagatctgtggaccacgagagcgacacggacctaggacccccggagggcaactgcccggcgcgcgcagaggaccaggacccagaagaccggcccccttgcccgccaggcctccgggtgccctcggctctgtgctgcgccctctccgcgctcgtcccgggtgccgtccccgacgaccacacccggccgctaggtgccttccactgcggccccatcggccgacacgtcggcatagacgcccaggtgggttccctctggcttggggatctccacagcctgcccctcggcctgccccgggccggtcctctgctttagcactggcaggcggagcagcgcctggtgtggccagggcgcaaaggcccggcggaagtggcggccggagccatcccggaggccccggctcaccacgaggaggagggacagtagggccaggagacagagggcctgctgccgctgacggggggcgacctcagcgcacggtgcgggccgcagagacccgcggcgccgctgcggcccccccactgactcttgagggccccgtgcagtctcatcacggtacccctgcccttactcaagggccgcagagccctcgcgatggtgctcagctgggggcctgtacgcgcccagtagatgtgcgcgactctggaggtcgtcccctgccaccccccgacactctggcttctgcgggagatttcctatgcaccatgtag

SEQ ID NO: 13997 - DNA, 1308 bp, Artificial Sequence
  Description of Artificial Sequence: Synthetic coding sequence
atgctgtgtggatttcaggaagacgcgacacctccacctcctcctcggcccagaaggctgcaccgacgcttaccccgaccggaggaagtaggaatgcttagtcttccgccaggtctgctgactgtctcaggctcagcagccgccgcggacgccgtgcccttgcgccccggagattgggctggcgtctccacagccgataggggcgagagagcccccctgggcccagctttttgtgacctggctgtcagtcccacatctccggcctggcggggtgaggaagacgaaggcgctaaggcgtcatcaggcgacatcggatccctcgattaccaggagtttgtggtggatatcgagtctcgcctgcgcatggaaggggtggagctcaaagaggaatggcaggatgaagacttccctattccgctgccagaggatgacagcatcgaagccgacattcttgccattaccggccccgaggatcaacctgggtcattagaggtcaatggtaacaaggtccgcaaaaaactcatggccccagatatttccctgactctggatccttctgatgggtctgttttgagcgacgaccttgacgaatcaggggagatagatcttgacggattggatactcccagtgagaatagcaacgagttcgaatgggaggatgatctgcctaagccaaaaacaaccgaggtgattcgaaaggggtcaatcaccgaatatacagccgcagaggagaaggaggatggtaggagatggaggatgttccgaatcggagaacaagaccatagagtggatatgaaggcaattgagccatacaagaaagtgatctcacatggcggctattacggcgacggtcttaacgcaatagtagtttttgcagtgtgctttatgcccgagagctcgcagccgaactaccgctacctgatggataatctgtttaagtacgtgataggaaccctagagttgctggtggcagaaaactacatgatagtgtacttaaatggcgccactaccaggcgaaaaatgccaagtctgggttggttgcgaaagtgttatcaacagatcgataggcgtctacgcaaaaacttgaaatccctcatcatcgtgcacccatcctggtttatccgtaccctgctggctgttacaagaccattcatctcaagcaaattctctcaaaagatccgatatgtatttaatttggcagagcttgccgaactggtaccaatggagtatgttggcattcctgaatgtatcaagcaggtggaccaagaactgaatggcaaacaagatgagccaaaaaatgagcagtag

SEQ ID NO: 13998 - DNA, 1131 bp, Artificial Sequence
  Description of Artificial Sequence: Synthetic coding sequence
atggaaccctgtccaagcagtgctcctccaccattttacccaggcgtgggagaggtcgctgggcttaggtggttctcaatttacgaccagaggccaagctggtataggactaaaaagctgggactcttggacatcggatcattggactaccaggagttcgtcgtagacatcgagtccaggctgagaatggaaggagtggagcttaaagaagaatggcaagatgaagatttccccatcccccttccagaagacgacagtattgaggccgatattctcgccattacaggtccagaggaccaacccggatccctggaagttaatggcaacaaggttaggaaaaagctgatggcccctgacattagcctgacactggatccgtccgacggatcagtgttgtcggatgacctggacgagagtggtgagattgacctagacggccttgatacaccttctgaaaacagcaacgagtttgaatgggaagatgacttacccaagcctaaaaccaccgaggtgattcggaagggttctataaccgaatacaccgcagcggaggagaaggaggatggtagaaggtggcggatgtttcgcattggtgagcaagaccatcgggtggacatgaaggcgatcgagccatataaaaaggtaatttcacacgggggttactatggggatggactaaacgctattgtagtgttcgccgtgtgttttatgcccgagtcctcccagcccaattatcggtatctgatggacaacctcttcaaatatgtgattggaacactcgaactgctggtcgcagagaattatatgatcgtttacctgaatggggctacgacccgacgcaagatgccatctcttggctggcttaggaagtgttatcagcagatcgaccgcagacttagaaaaaatcttaaaagtttaataattgtccaccctagttggtttattcggacactgttagccgtgacacggccattcataagctcaaaattctctcagaaaatccggtacgttttcaatttagcagagttggcagagctcgtgcctatggaatatgtgggcattcccgagtgcattaagcaagttgatcaggagttaaatggcaaacaggatgagccaaagaatgagcaatag

SEQ ID NO: 13999 - DNA, 939 bp, Artificial Sequence
  Description of Artificial Sequence: Synthetic coding sequence
atggccaaagtattcagcttcatcttggtcacaacagcgctcactatgggcagagagattagtgccctggaagattgcgctcaggaacagatgcgcctgagggctcaagttagactcctggagactagagtgaagcagcagcaagtgaagataaaacagctgttacaagagaatgaagtccagtttttggataaaggggatgagaacacggtcatcgatctgggttccaaaaggcagtacgccgattgctcggagattttcaacgacggctacaagctgagtggtttctacaagatcaaacctctacagtcccctgccgagttcagcgtctactgcgatatgtccgatggagggggatggactgtgatccagagacgttccgacggaagtgaaaatttcaatcgcggatggaaagattatgaaaacgggtttgggaactttgtgcagaagcacggagagtactggctcgggaacaagaatcttcacttcttgactactcaagaagattacaccttaaagatcgacctagcggatttcgaaaagaattcacgctatgcccagtataagaacttcaaggtgggggacgagaagaacttctatgagctgaatataggcgaatatagcggcacggctggggatagcctggcaggtaacttccatccggaggttcagtggtgggcttctcatcagcgaatgaagttctcaacttgggaccgcgatcacgataactacgagggcaattgcgccgaagaagaccaatccggatggtggttcaataggtgccactccgccaatctgaacggggtttactacagtggaccatacactgctaagactgataacggaatcgtctggtatacctggcatgggtggtggtactctttgaaatcagtcgtgatgaagatcagacccaatgactttatcccaaatgtaatttag

SEQ ID NO: 14000 - DNA, 660 bp, Artificial Sequence
  Description of Artificial Sequence: Synthetic coding sequence
atgtcttcgcacctggtagagccacctcccccactgcataacaacaataacaattgcgaggagaatgaacaaagtttacccccaccagccggactcaactcctcctgggttgaactgcccatgaattcatctaacggcaatgataatggtaatggcaagaatggcggcctagaacatgttccgtctagttcaagcatccacaacggtgacatggagaagatcctgctggacgctcagcatgaatctggacagtcgtcaagccgcggctcctcgcactgcgactcacccagccctcaggaggacggacaaatcatgtttgacgttgagatgcatacaagccgggatcatagttctcagtcagaggaagaagtggtcgaaggagaaaaagaagtggaggcacttaagaaaagcgctgactgggtcagcgactggtcatctaggcccgagaatatcccgcccaaggagtttcattttcgccaccccaaacgcagtgttagcctcagcatgcgtaaatctggggcaatgaaaaagggggggattttctctgctgagttcctgaaggtatttatcccctccctctttctcagccatgttttggccctgggcctgggaatatacatcgggaaaaggctgtctactccatcagctagtacctactag

SEQ ID NO: 14001 - DNA, 540 bp, Artificial Sequence
  Description of Artificial Sequence: Synthetic coding sequence
atgaattccagtaacggcaatgacaatggaaacggcaaaaatggcgggctagagcatgtgccctcctcttcctccatacacaacggagacatggagaaaatactgctggacgcacagcacgagagtgggcagagctccagccgaggctccagtcactgtgattctccctcccctcaagaggacggccagataatgttcgatgtggagatgcacaccagccgggatcactccagtcagtctgaagaggaggttgtggagggtgaaaaagaagtggaggcgttgaaaaagagcgccgactgggtgagcgactggtcttccaggcccgagaatataccgccgaaggagttccatttcaggcacccaaagcgctccgttagcctctcgatgcgcaagtccggggctatgaagaagggaggcatattttccgcagagtttttaaaggtttttattccgagtctgtttctgtcacatgtcctggctctcggcttaggcatttacatcggtaagcgattatccactccaagcgcctctacatactag

SEQ ID NO: 14002 - DNA, 540 bp, Artificial Sequence
  Description of Artificial Sequence: Synthetic coding sequence
atgaattcttcgaacggtaatgacaacggcaacggtaagaacggtggactggaacatgtgccctctagtagttctattcataacggcgacatggagaagatcctgctcgatgcccaacatgagagcggccagtcttcgagtaggggatccagtcactgcgattcccccagtcctcaggaggacggccagatcatgttcgatgtggagatgcataccagtcgcgaccattcctcccagtccgaggaggaagtagttgaaggagagaaagaggtggaagcgttgaaaaagagcgccgactgggtttccgattggtcttccagacccgagaatatccctcctaaggagttccactttcggcatcctaagagatctgtaagtctcagtatgcgcaaatctggcgcaatgaaaaaggggggtatcttttccgccgaatttttaaaagtgtttattccatcacttttcctgtcccatgtgctggctttgggactgggcatttacatcggcaaaaggctgagcactccatctgccagcacctattag

SEQ ID NO: 14003 - DNA, 540 bp, Artificial Sequence
  Description of Artificial Sequence: Synthetic coding sequence
atgaacagttctaacggaaatgacaatgggaacggaaagaacggcggccttgaacacgtaccatcctcatctagtattcataatggggacatggaaaaaatcctactagatgcacaacacgagtcgggacagagcagctctagaggcagttctcattgtgactcacctagccctcaggaggacggtcagatcatgttcgatgtcgaaatgcataccagcagggatcactcttcccagagtgaggaggaggtcgtagagggcgaaaaggaggttgaagccctgaagaaatctgcagactgggtctcagattggtccagtcgcccagaaaacatcccccctaaggaattccactttcggcatccgaagcgcagcgttagtctgtctatgaggaagtctggcgccatgaaaaagggaggcatcttctcggctgagttcctgaaagttttcatcccctcgctgttcctgtcccatgtgctggctctcggcctgggcatctatattggaaaaagactctcaaccccgtccgcttcaacgtactag

SEQ ID NO: 14004 - DNA, 636 bp, Artificial Sequence
  Description of Artificial Sequence: Synthetic coding sequence
atggccagcggacaggggccaggtccgccaaggcaggagtgcggcgagccggcactgccttctgccagtgaggagcaggtggcgcaagataccgaggaggtgttccgtagctatgtgttttaccggcatcagcaggaacaggaagccgaaggggtggccgcacctgcagacccggaaatggtgacgctgccccttcagccctcttcaactatgggccaagtgggacgtcagctcgctattataggggacgatattaaccggagatacgatagcgaattccagactatgctgcagcatctgcagccaacagcggagaatgcttacgaatactttacaaaaattgccacttccctgtttgaaagcgggataaattggggccgagtggttgctctgctgggatttgggtaccggctcgcccttcatgtctaccagcatggactgaccggcttcctcgggcaggttacccgttttgtggtggatttcatgctccatcactgcatcgccaggtggatcgcccagaggggagggtgggttgctgccctgaacctggggaatggaccaatcctgaatgtcttggttgtgttgggggtagtactgttgggccaatttgtggtgaggcggttcttcaaaagttag

SEQ ID NO: 14005 - DNA, 576 bp, Artificial Sequence
  Description of Artificial Sequence: Synthetic coding sequence
atggcctcggggcagggaccaggtccacctcggcaggagtgtggagaaccagcgctgccctctgcttctgaggagcaggtagcccaggacacagaagaggtttttcggagttacgtgttctaccgccaccagcagcaaccgtcctctactatgggccaggtgggccggcagctggccattataggtgatgatataaataggagatatgactctgagtttcagacaatgctgcaacacctacagcccacagccgagaacgcttatgaatacttcaccaagattgctaccagtctgttcgaatctggaataaattggggccgggtggtcgctctgctcggcttcggatatagacttgcactccacgtgtaccaacacgggttgacgggctttctgggacaggtgacccggttcgtggtggacttcatgcttcatcattgcatcgctcgttggatagcccaacggggcggctgggtcgccgcattgaatttagggaacggccctattctgaacgtgctggttgtactgggggtggtgctcttggggcaattcgtagtgaggaggtttttcaagagttag

SEQ ID NO: 14006 - DNA, 636 bp, Artificial Sequence
  Description of Artificial Sequence: Synthetic coding sequence
atggcttcaggtcagggcccggggcctccccgacaggaatgcggggagcctgcccttccatccgcttctgaggagcaggtggcccaagataccgaggaagtttttcgatcttatgtgttctatcggcatcagcaagaacaggaagcagagggagtggccgctcccgcggatcctgagatggtgacacttcctctgcaaccatcatctactatgggccaggtggggcggcaattggcgattatcggagacgatatcaatcggaggtacgactcagaatttcagacaatgctgcaacatctgcagcctactgcggaaaacgcatatgaatattttaccaaaattgctaccagcctgttcgagtcaggcatcaattgggggcgcgtggttgccctgttaggctttggctacagacttgccctgcacgtgtaccaacacggcctcactgggtttctggggcaggttacccgtttcgttgtagacttcatgctgcaccactgcatcgcacgctggatcgcccagcgaggaggttgggttgcagctcttaatcttggaaacggccctattcttaatgtgttggtggtcttaggcgtggtgctgctggggcagtttgttgtgcgacgtttcttcaagtcttag

SEQ ID NO: 14007 - DNA, 462 bp, Artificial Sequence
  Description of Artificial Sequence: Synthetic coding sequence
atggctagcggccagggccccggccccccgagacaggagtgcggagagcccgcgctgcctagcgcatccgaggaacaggttgctcaggatactgaagaagtgttccggtcttacgttttctatcggcaccaacaggaacaggaagcagagggtgtcgccgcgcccgctgaccctgaaatggtgacattgcccctccagccctccagtacaatgggtcaagtgggccggcagctggctattatcggggatgatattaataggagatacgacagcgagttccagaccatgctgcagcatctccagcctacggctgagaacgcttacgagtatttcacgaagatcgccacaagacctgctgccactcccaccgcctgcctgcgggtggcaagcatcggagccgtctggtggttattttgggcctctgctaccgtgtggccctatactagcacttctatggcctag

SEQ ID NO: 14008 - DNA, 507 bp, Artificial Sequence
  Description of Artificial Sequence: Synthetic coding sequence
atgttccagatccccgagtttgagccaagcgaacaagaagactcaagcagcgcggagagagggttagggccttccccggccggggacggtccaagtgggtctgggaaacatcatcgtcaagcgcctggtttactgtgggatgcctctcaccagcaagagcagcctactagtagcagtcaccacggcggcgcaggcgccgtggaaattcgaagccgtcattcctcctaccctgcagggacagaagacgatgagggaatgggcgaggaaccttcacccttccgcggtcgttcacgaagcgcaccccctaacctgtgggctgcgcaaagatacggccgggagttaaggaggatgtcagatgagttcgtggactccttcaagaaaggcctgccacggccaaagtctgcgggcactgccacgcaaatgcgccagtccagcagttggactcgggtttttcagtcatggtgggaccgtaatcttgggcgtggcagcagtgctcccagccagtag

SEQ ID NO: 14009 - DNA, 507 bp, Artificial Sequence
  Description of Artificial Sequence: Synthetic coding sequence
atgttccagatacccgagtttgagcctagcgagcaggaggatagctcttccgccgagcgtggcctcggccctagtcccgccggcgatggaccatccggatcaggcaaacaccatagacaggcccctggcttgctctgggacgcctcacaccagcaagaacagcctacatcatcctcccatcacggaggggctggcgcagtagagatcaggagccgccacagttcttatcccgccgggaccgaagatgatgagggcatgggtgaggaaccctcgcctttcagagggcgttctaggagcgcaccccccaatctctgggcagctcagcggtacggaagagagctccggagaatgagcgatgagtttgtggactcatttaagaagggcttgcccaggccaaagtccgcgggcacagcgacacagatgagacaaagctccagctggacaagggtgttccagtcttggtgggaccgtaaccttgggaggggctcctcagctccctcacagtag

SEQ ID NO: 14010 - DNA, 450 bp, Artificial Sequence
  Description of Artificial Sequence: Synthetic coding sequence
atgttccaaatccctgagttcgaaccaagcgagcaggaggattcgagtagcgctgagcgaggcctggggcccagccctgcaggcgacgggccaagtggatccggcaaacaccataggcaagcccccggattgctctgggatgccagtcatcaacaggaacagccaacctcctcctctcaccatgggggggctggtgctgtggagatcaggagcaggcattcttcctatccggcaggaactgaagatgatgaaggaatgggcgaagaacctagcccttttcgtggccggagccggagcgccccccccaatttatgggccgcccaacgctacgggcgtgaactgaggaggatgagtgatgagtttgtggacagtttcaagaagggcctgcctagacctaagagcgctggcacagctacacaaatgcgccagtcgtccaggcggctgcggtag

SEQ ID NO: 14011 - DNA, 591 bp, Artificial Sequence
  Description of Artificial Sequence: Synthetic coding sequence
atgaacaggagtcaggaggtgacccgcgatgaagaatcaaccagatccgaggaagttactcgcgaggagatggcagctgctggactgaccgtgaccgtcactcattctaatgagaaacacgatctgcacgttacatcccagcaaggttccagtgaacccgtggtgcaagatctggcacaggtggtcgaggaagtcatcggagtaccccagtcctttcagaagctcatctttaagggaaagtcactcaaggagatggaaacgccactatctgccctggggatccaggatggctgccgggttatgttaatcggaaaaaaaaattccccgcaggaggaagtcgagctcaagaagctcaagcatctggagaagtcagtcgagaagattgccgaccagctggaagaattgaacaaggaattgaccggaatacagcagggcttcctgcccaaggacctacaggccgaagccttgtgtaaactcgatagaagggtcaaggcgacgatagaacagttcatgaagatactggaggaaattgacaccttgatcctccccgaaaatttcccgactctgaccctggtcttaaatgaaaaatag

SEQ ID NO: 14012 - DNA, 693 bp, Artificial Sequence
  Description of Artificial Sequence: Synthetic coding sequence
atgaatcgatcacaggaagtcacgcgcgatgaggagtcaacaagatccgaagaagtcacacgcgaggagatggccgctgctggactgaccgtcacagtaacccacagcaacgagaagcatgatctccacgtaacctctcaacaggggtccagcgaacctgtggtgcaagatctggcgcaggtggtcgaggaggtgatcggagtgccacaatcttttcagaaactgatttttaagggcaagtcactgaaagagatggagacgccgctgtccgctctcggcattcaagacggctgtagagtgatgctcataggaaagaagaatagtccccaggaagaagtggagctgaagaagctcaagcatctggaaaagagcgtggaaaaaatcgccgatcagctggaggaactcaacaaggagctaaccggaatccagcaggggttcctgcctaaagatctccaggccgaggctctatgcaaactggataggcgggtgaaggctactatagaacagtttatgaagatcctcgaagaaatagataccctcattctcccagagaacttcaaggactctcgtctgaaaagaaagggtctggtgaaaaaggtccaggctttcttggctgagtgtgacacagtggagcagaacatttgccaggaaacggaaaggctgcagtctaccaactttgccttagccgaatag

SEQ ID NO: 14013 - DNA, 1038 bp, Artificial Sequence
  Description of Artificial Sequence: Synthetic coding sequence
ctcgcccagaggggaggcgccaggaggcccaggggcgatagagagagacttggctctcgtctccgcgcacttcgcccaggccgcgaaccaagacagtccgagccccctgcacaaagaggtcccccgccttcgggacggcccccggctcgtagcaccgcaagtggtcacgacagaccaacccgcggagctgcagccggcgccagacgaccccgcatgaagaaaaagacaaggagacggtctacgaggagcgaagagctgactcgctccgaggaactgactctttctgaagaggccacatggtccgaagaagctacccagtcagaagaggcaactcagggcgaggagatgaatcgcagtcaagaggtgacccgtgacgaggaaagtacccggagcgaggaagtaacacgggaagagatggcagcggcgggccttacggtgaccgtcacgcacagcaacgaaaaacacgacctgcacgtgacatctcagcaaggaagttcagagcccgtcgttcaggacctcgcccaggtagtggaggaggtaatcggtgtgccgcagtccttccaaaaactaatattcaagggtaagagtctgaaggagatggagacccctctctccgctctcggcatacaggatggctgccgcgtgatgctgattgggaagaaaaactccccacaggaggaggtggagctgaaaaagctgaagcacctcgaaaaatccgtggaaaaaatagcagaccagctggaagagctcaataaagagctgactgggatccaacagggctttctgcctaaagaccttcaggcagaggcactgtgtaaactcgatagaagggtgaaggccaccatagagcaatttatgaaaatactggaggaaatcgatactctaattctaccagagaacttcaaagattctcggctcaaacgcaagggcctggtcaaaaaggttcaggccttcctcgcagaatgtgatacagtcgagcagaatatctgtcaggagactgagcggctacaatccacgaattttgctctcgcggagtag

SEQ ID NO: 14014 - DNA, 1728 bp, Artificial Sequence
  Description of Artificial Sequence: Synthetic coding sequence
atgtcggctgccacacatagtccgatgatgcaggtcgccagcggaaacggcgatagagaccctttaccacccggttgggaaatcaaaattgatcctcagacagggtggccattctttgtcgaccataatagccgaaccactacctggaatgatccgagggtcccgtccgaggggcccaaagaaacaccctcctcggcgaatgggccatctcgcgaaggcagccgtcttccgcctgcacgtgagggacatcccgtttacccacagctcagaccagggtatatccccataccagtcctccacgagggggccgaaaaccggcaggtccatccttttcacgtgtatccgcaacccggaatgcaaagatttaggaccgaagccgctgccgcggctccgcagagaagtcaatcccccctaaggggtatgcccgaaactacccagccagataagcaatgtggacaggtagccgctgcggcagctgcccagccccctgcttcccacggccccgaacgcagtcagagtcccgccgcaagcgattgctctagttctagcagcagcgccagcttaccttccagcggcagaagcagtctcggctcacaccagctgccacgaggctatatctctatccctgttatccacgaacagaatgttacacgtccggccgcccaacctagctttcatcaagcccagaagacgcactaccccgcgcagcaaggggagtatcagactcatcagcccgtgtaccataagattcagggcgacgattgggaacctaggcctttgcgtgcagcctcgccgtttcggagctcagtgcagggagcttcatcacgggagggtagtccagcgagaagttccacacccctccattccccgtccccaattcgtgtccataccgtagtggaccggccacaacagcccatgacccaccgcgagacagctccagtatcccagccagagaacaagcccgagtctaagccgggacctgtgggacctgaactgcctccgggtcacatcccaatacaagtaattaggaaggaggtggatagtaaacctgtctctcagaagcctccacctccttcggaaaaggtggaggtcaaggtgccccccgcgccagtgccctgtcctccgccaagccctggaccatctgccgtgccatcaagccctaaatctgtggctacagaagagagagccgctccttcaactgcacctgcagaggcaactccgcctaagcccggcgaggccgaggcccctcccaagcatccgggcgttctgaaggtggaggcaatactagaaaaagtgcagggtctggaacaggccgtggacaattttgagggtaagaagacagataaaaaatatctcatgattgaggagtatcttaccaaggaactgcttgctctggactctgtcgatccagaggggagagccgatgtacgccaggccagacgggatggcgtgcgcaaggtacaaactattttagagaaacttgaacagaaggccattgatgtgccaggacaggttcaggtctatgagctgcaaccctcgaaccttgaagccgaccagccactgcaggccattatggagatgggtgcggtggccgctgacaaaggcaagaagaacgcaggcaatgcagaggacccacacaccgagacgcaacagccggaggccacagctgccgccacttctaatccctcttcaatgactgacacaccaggaaatcccgccgccccctag

SEQ ID NO: 14015 - DNA, 978 bp, Artificial Sequence
  Description of Artificial Sequence: Synthetic coding sequence
atgcaggagaccccaagcagcgccaatggcccaagccgagagggaagccgcctgcctcccgcccgagagggccacccagtttatcctcagctacgaccgggctacattccgattcccgtattacatgagggtgctgagaacagacaggtgcaccccttccatgtgtaccctcaacctggcatgcagcgattccgcacagaggccgccgctgccgcgcctcaacggtcacagtccccattgagggggatgcccgagactacccagccagataaacaatgcggtcaggttgccgcagccgccgccgcacaacccccagcctcacatggccctgagaggagtcaaagccccgccgccagtgattgcagtagttcttctagctcggcaagccttccctcttccggacggtcgtcacttggaagccatcagctgccaaggggctatatcagcattcccgtgatacatgagcagaacgtgacaagacccgcggcccagccaagctttcatcaggcacagaaaacccactacccagctcaacaaggtgaataccagactcatcaacccgtttatcataaaatacagggggacgattgggagccccgtcctctgagggccgcatcacccttcaggtcttctgtccaaggtgcttcctcaagggagggcagtcccgcgcgctcctctactccacttcacagcccttcaccgattcgagtgcacaccgtagttgatcgcccccagccaatgacacaccgtgagaccgctccagtgagccagcccgagaacaaaccggagagcaaaccaggccctgtaggtcccgagctgcctccgggtcatatcccaatccaggttattcgcaaggaagtcgactctaaaccagtctcacagaaaccccccccaccttccgagaaagtggaagtgaaagtgcctccagcacccgtgccctgcccaccgccttcgcctgggccatctgcagtcccctag

SEQ ID NO: 14016 - DNA, 657 bp, Artificial Sequence
  Description of Artificial Sequence: Synthetic coding sequence
atggacggatcaggtgaacagcctcgaggagggggaccaacaagttccgagcagatcatgaaaacaggagcactgctgttgcaagggtttatccaggacagggctggaagaatgggcggggaagccccagagttggcactcgatcccgtgcctcaggacgcctcaacaaaaaagctgagcgagtgtcttaagaggattggagacgagcttgatagtaatatggaactgcagaggatgatcgctgctgtggacaccgacagcccccgggaagtcttttttcgcgtggccgctgacatgttcagtgacggcaattttaattgggggcgcgtggttgcccttttttacttcgcctccaaactagtgttgaaagccctgtgtaccaaagtccccgagttgataaggaccatcatggggtggacccttgattttttaagagagagactgctgggatggattcaagaccagggcggatgggtacggctgctcaagccaccccaccctcatcacagggcattaacaaccgctcctgccccaccatctttaccacccgccacacccctgggtccatgggcattttggtcacggtctcagtggtgccctctgccgattttcagatcttccgacgtggtttacaatgcattctccctacgcgtctag

SEQ ID NO: 14017 - DNA, 579 bp, Artificial Sequence
  Description of Artificial Sequence: Synthetic coding sequence
atggacgggtctggggagcagcctcggggcggggggcccacctcgagcgagcaaatcatgaaaacaggagcgttactcctccagggattcatacaagacagagcaggccggatgggtggcgaggccccggagctggccctcgatcccgtgcctcaggatgcctcaacaaagaagctctccgaatgtctgaaacgtatcggggacgaattggactccaatatggagctgcagcgcatgatcgcagcagtagacacagacagcccgcgggaggtgttctttcgtgtagccgctgacatgttctctgatgggaattttaactggggaagagtggtggctctattctattttgcgagcaagctcgtcctcaaggcactgtgcacaaaagtgcctgaacttatcagaaccattatgggctggaccctcgattttctccgcgaaagactgctggggtggattcaggatcagggcggatgggacggtctcctgagttacttcggtactccaacctggcagaccgtgacaattttcgtcgcaggcgtgctaactgcctctttgactatctggaagaagatgggatag

SEQ ID NO: 14018 - DNA, 432 bp, Artificial Sequence
  Description of Artificial Sequence: Synthetic coding sequence
atggatggatctggggagcagccccgcggcggcggtccgacctccagcgagcagattatgaagactggggccttgctcttacaaggcatgatcgccgctgtagataccgatagccctagagaggtcttttttagggtggctgccgatatgttcagtgatggaaacttcaattggggacgcgtcgtcgcactgttctactttgcaagtaaactggtgcttaaggcactttgcactaaggttcccgaactcattcggactattatgggatggacactggacttcctgcgagaacggctgctggggtggattcaggaccaaggggggtgggatggattactatcttacttcgggactcccacttggcagacagtcaccatattcgtggccggcgtgctgactgcctccctgacaatttggaagaaaatgggctag

SEQ ID NO: 14019 - DNA, 126 bp, Artificial Sequence
  Description of Artificial Sequence: Synthetic coding sequence
atggatggcagtggagagcagcccaggggtggagtcagctcacgcattgaacagggcgaatggggcggccgccatccctcctggccatggaccaggtgtctgagaatgcggccaccaagatcgtag

SEQ ID NO: 14020 - DNA, 540 bp, Artificial Sequence
  Description of Artificial Sequence: Synthetic coding sequence
atggacgggtctggcgagcagcccagagggggtggccctacatcatccgaacaaattatgaagacaggcgccctgctgctccagggatttatccaggaccgagcagggcgaatgggcggcgaggcccctgagcttgcgctggatcccgttcctcaggacgccagcaccaaaaagctcagcgagtgtctcaaaagaataggtgacgagctagactctaacatggaattgcagcggatgatagcagcagtcgacactgactcaccaagggaggttttcttccgcgtggcggccgacatgttttccgatggaaactttaactggggacgtgtagtcgcattattttatttcgcctccaaacttgtactcaaggccctatgcaccaaggtgcccgaattgatccgaacaatcatgggttggacactggatttcctcagggaaagactactgggctggattcaggatcaggggggctggacagttacaatttttgtggcaggcgtccttactgcaagcttgaccatatggaaaaagatgggatag

SEQ ID NO: 14021 - DNA, 495 bp, Artificial Sequence
  Description of Artificial Sequence: Synthetic coding sequence
atggacggtagcggcgagcagccacgggggggtggccctacctcctcagagcagataatgaagacaggcgctctgcttctgcagggattcatccaggaccgtgccgggaggatggggggtgaagcaccggaacttgcactagatccagttccgcaagacgcttctaccaagaaattgtccgagtgtctgaaaaggatcggggacgaattagactcaaatatggaattgcaaagaatgatcgcagccgttgacactgactcaccacgggaggtgtttttcagagtggcagctgacatgttcagtgacggcaacttcaattggggacgggtcgtagctctgttttatttcgcatctaagttagttctgaaggccggggtcaagtggagagaccttggctctttacagcccctcccacctggatttaagcggtttacatgcctttcaattccccggtcttgggattatcgcccatgtgcaccccgctgtcggaattag

SEQ ID NO: 14022 - DNA, 1806 bp, Artificial Sequence
  Description of Artificial Sequence: Synthetic coding sequence
atggcatacgacgattctgtaaagaaagaggactgttttgacggggatcacactttcgaggacatagggctggccgcaggacgaagtcagagggaaaagaaaagaagctataaggactttctgagggaggaggaagagatagccgcacaagtcagaaacagtagtaaaaaaaagttgaaagacagtgaactgtacttcctgggcactgacacacataagaagaagcgcaaacacagctctgacgattactattatggagacatctcatccctggaatcctctcagaagaaaaagaagaaaagctccccccagtctacggacaccgccatggatcttctcaaggctattacaagcccactggccgcaggcagtaagccctccaaaaaaactggggagaagtcttcagggtctagctcacatagtgagtctaaaaaagagcatcaccggaagaaagttagcggctcatcaggcgagctgccactcgaagacggggggagccataaatctaaaaagatgaaacctctatacgttaacacagagactctcactctgcgtgagccagatggcctcaaaatgaaattgattctctctcctaaagaaaagggatcttcaagcgtcgacgaagagtctttccagtacccgtcccaacaggccaccgtgaagaaatccagcaagaaatctgctcgcgatgagcagggagcactcctgctgggtcacgagcttcaatcttttctcaagacagcgcgtaaaaaacacaaaagcagctccgatgcccatagttcccccggacccgaggggtgtggttcagacgctagccagtttgctgaatctcattcagctaatcttgacctgtctggactcgaacccattttagtcgaaagcgattcctccagcggtggtgaactagaagccggcgagctggtgatcgatgactcatacagagagatcaaaaagaaaaaaaaaagcaaaaaatctaagaagaagaaggacaaagagaagcacaaggagaagaggcattccaaatcaaagcggtccctgggactctccgccgtcccggtgggcgaggtgacggtgacaagcggccctcctccatctatcccttatgcaggtgctgccgcgccgccattgcccttacctggcctccataccgacggacactctgaaaagaaaaagaaaaaagaggaaaaagacaaggaaagagagagaggtgagaaacccaagaagaaaaatatgtcggcttaccaggtgttttgtaaagaatacagagtgactatagtagcggatcacccaggaattgattttggcgaactgagtaagaagctggctgaagtgtggaagcagctgcccgagaaagacaagcttatctggaagcagaaggcccagtatttgcagcacaagcaaaacaaggccgaggctaccacagtaaaacggaaagcaagcagctcggaggggtccatgaaggtcaaagcttccagcgttggtgtcctgtctccacagaagaaatcacccccgaccactatgctcctgccagccagccccgcgaaggctccggaaacagagcctatcgacgtcgctgcacatctccagttactgggcgaatcactgtcactgattggtcaccgactccaggaaacagagggaatggttgccgtgagtggatccctgtccgtgctgcttgattcaatcatctgcgcacttggtcctttggcatgccttactacacagctgccagaactgaatgggtgtcctaaacaggtgttgagcaataccttggacaacattgcttatatcatgccaggcctctag

SEQ ID NO: 14023 - DNA, 702 bp, Artificial Sequence
  Description of Artificial Sequence: Synthetic coding sequence
atgtcccaaagtaacagggaactcgtcgtggatttcctgtcctataagttgagccaaaaaggctatagttggagccaattctctgacgtggaagaaaaccgaactgaggcaccagagggaactgaatccgagatggagacacccagcgccattaatggaaaccccagctggcatctggctgattctcccgctgtgaatggagctacaggacactctagctctttagacgcgcgggaggtcatccctatggccgccgttaaacaggctcttagggaggcaggcgacgaatttgagctccgttatcgtagagcatttagtgacttaacctcgcagctccacataacccccggcacagcctatcaatccttcgagcaagtagtcaacgagctgttccgggatggtgtcaattggggcagaattgtagcattcttctcttttggaggggctctgtgcgtggagtcagttgataaggagatgcaggttctggtttccaggattgcagcatggatggctacctacttgaatgaccatctagaaccttggatccaggaaaatggcgggtgggatacgttcgtagaactttacggcaacaacgccgccgccgagtctagaaaaggtcaggaacggttcaaccgctggtttctgacaggtatgactgtggccggagtcgtgctgctggggtctttgttcagcaggaaatag

SEQ ID NO: 14024 - DNA, 513 bp, Artificial Sequence
  Description of Artificial Sequence: Synthetic coding sequence
atgtcgcaatcgaacagggaacttgtggtcgatttcctgtcttacaagctctcccagaaaggttattcatggtcacagttcagcgatgttgaagagaaccgcactgaggcgccggagggaacagagagcgagatggagactccatccgccatcaatgggaatccgagctggcacctggcagactcgcctgccgtcaacggagcaacagggcatagcagttctcttgatgctcgcgaggtgattcccatggcagccgtgaaacaagcgctcagagaggcgggcgacgagttcgaactaagatatagacgagcctttagtgacttaacctctcagctgcatatcacaccagggacagcttaccagtcattcgagcaggacacattcgtcgagctgtatgggaacaacgcagctgcggagagccgcaagggccaggagagatttaaccgctggtttttgaccggcatgacagtggccggcgtcgttcttctgggttccttgttttcaaggaagtag

SEQ ID NO: 14025 - DNA, 702 bp, Artificial Sequence
  Description of Artificial Sequence: Synthetic coding sequence
atgagtcaaagcaatcgtgagctggtcgtcgattttttatcctataaactatcccaaaaaggatactcttggtcccagttttcagatgttgaagaaaaccggaccgaagcgcctgaaggcactgaatctgagatggagactccctctgccatcaacgggaatccaagttggcacctggcagattcgcccgctgtgaacggtgcaaccgggcattcatcctccttggacgccagagaagtgatccctatggcagctgtgaaacaggccctgagagaggcaggggacgagtttgaactccgatacaggcgggccttctccgatctgactagtcagctgcacatcacaccaggaaccgcttaccagagcttcgagcaggtggtcaacgagctcttccgcgatggagtcaattgggggcgtattgtggccttcttcagttttggcggagctctgtgcgtggaaagtgtggacaaggaaatgcaggtgctggtctctcggatcgccgcctggatggcaacatatcttaacgaccatttggaaccctggattcaagagaacggtgggtgggacactttcgtggagctgtatggaaataacgcggccgccgagagtcgtaaaggacaggagaggtttaaccggtggtttctgactggaatgaccgtggcgggcgtggtcttgcttggctctttatttagtcgcaaatag

SEQ ID NO: 14026 - DNA, 567 bp, Artificial Sequence
  Description of Artificial Sequence: Synthetic coding sequence
atgtctcagagcaatcgcgaactggttgtcgatttcttgagctacaagttatcccagaagggatactcctggtctcaattttccgatgttgaggaaaacaggacagaggcgcctgaaggcacagaaagtgaaatggagacaccctctgccatcaacggaaaccccagctggcacctggcggactctccagctgtgaatggcgccactggacatagctcctcactggatgctcgcgaggtaatacctatggcagctgtcaagcaagccctgcgcgaggccggcgacgaatttgagctgcgctatcgacgcgcattctcagacctgacctcacagcttcacataacacccggcaccgcctatcagagctttgagcaggtcgtgaacgagctttttagagacggggtcaactggggtagaatcgtagcatttttttccttcgggggagcactctgtgtcgagagtgtagataaagagatgcaggtgctggtttccagaatagcagcctggatggctacctacttaaacgatcacctggaaccttggattcaggagaatggtggatggtag

SEQ ID NO: 14027 - DNA, 702 bp, Artificial Sequence
  Description of Artificial Sequence: Synthetic coding sequence
atgtcccagagcaaccgagaacttgtggtggatttcttgtcctacaaactttcacagaaggggtattcttggtctcagtttagcgacgtcgaggagaacagaacagaggctcccgagggaacagagtcagagatggaaactccctctgccataaacggtaatccaagctggcacctggctgatagccctgccgtgaacggagcaaccggccatagtagtagcctggacgcccgcgaggtgatccccatggcagcagtgaagcaggccctcagggaagcgggggacgagttcgagctgagataccgcagagcgttttctgacctcacaagccagttgcatattacacccggtactgcttatcagtcttttgagcaggtcgtcaatgaactgtttagagatggcgtgaactgggggcgcattgttgcgttcttttcttttgggggtgctctctgtgtggagtctgtggacaaggaaatgcaggtcctggtgtctcgaattgccgcctggatggctacgtacttaaacgaccacctggagccatggattcaggagaatggagggtgggatacctttgttgagctctatgggaacaacgccgccgcggagagtcgcaaaggtcaggaacgctttaatcgttggttcctgactggaatgactgtggcaggagtcgtgctgctgggcagtctgtttagtaggaagtag

SEQ ID NO: 14028 - DNA, 567 bp, Artificial Sequence
  Description of Artificial Sequence: Synthetic coding sequence
atgtcacaaagcaaccgcgagctggtggtagactttctaagctacaagctgagccagaaaggttactcttggagtcagttttcagacgttgaggagaatcggacagaggctccggagggtacagaatccgaaatggaaaccccttctgcaattaacggcaacccttcctggcatctagccgactcccctgcagtcaatggagctacgggacacagcagtagcctcgacgcccgcgaggtgatccctatggccgctgtgaagcaagcgctgcgcgaggccggtgatgagtttgaactgaggtaccggcgcgcattcagcgacctaaccagccagctacacataacgccaggaaccgcttaccagtcatttgagcaggtagttaacgagctgttccgagacggcgtcaattggggcagaatcgtggctttctttagcttcggaggggcactttgcgttgagagtgtcgataaggaaatgcaggtgctggtgtccaggatcgctgcctggatggccacctacctgaatgatcacctagaaccgtggatacaggaaaatggcggttggtag

SEQ ID NO: 14029 - DNA, 147 bp, Artificial Sequence
  Description of Artificial Sequence: Synthetic coding sequence
atgtcccagagcaaccgggaactagtggttgacttcttgtcctacaaactgagccagaaggggtattcgtggagtcagttttccgacgtagaggagaaccggaccgaggctcctgagggcactgaaagcgagatggaaacgccttag

SEQ ID NO: 14030 - DNA, 546 bp, Artificial Sequence
  Description of Artificial Sequence: Synthetic coding sequence
atgagccagtcaaaccgggaactggtcgtcgatttcctgagttacaagctctctcagaagggctactcgtggagccagttcagcgacgtggaggaaaaccgcacagaagctcccgaaggcacagagagcgagatggagacaccttccgccattaacgggaacccaagctggcatttagccgactcaccagccgtaaacggcgccacagggcacagttcctctctggatgccagagaggtcatcccaatggctgcagttaagcaggccttacgcgaggcaggagatgagttcgagctgcgatatagacgagccttttccgacctaaccagccagctgcatatcacccctgggaccgcctatcagtcctttgagcaggttgttaatgagctgttccgagacggggtgaattggggccgcatcgttgcattttttagcttcggtggggctctgtgtgtggaatctgtagacaaggagatgcaggttttagtctcacgaattgcagcgtggatggccacttatcttaatgatcatctggaaccctggtag

SEQ ID NO: 14031 - DNA, 618 bp, Artificial Sequence
  Description of Artificial Sequence: Synthetic coding sequence
atgtcccagtccaatagggaactcgtggtggattttctgtcgtacaaactctcacagaagggatacagctggtctcagttttccgatgtggaggagaaccggactgaagcccccgaaggcaccgaatctgaaatggagacaccttctgccataaatgggaacccctcctggcacttagctgattcccccgccgtgaacggagcaacagggcactcttcttccctggatgctagagaagtcatccctatggctgctgtcaagcaagctctgagggaagctggagatgaattcgaactacgatacaggagggctttttctgatctgacctctcagttacatataactcctggaaccgcctatcagtccttcgagcaagtcgtaaatgagctgttcagagatggcgtgaactggggccgaatcgttgctttcttttctttcggaggcgcgttgtgcgtggagagcgtggataaggagatgcaggttctggtcagtaggatcgccgcttggatggccacatatctaaacgatcatttagaaccttggatccaagaaaacggagggtgggacaccttcgttgagctgtatgggaataacgccgcggcagagtctagaaagtag

SEQ ID NO: 14032 - DNA, 567 bp, Artificial Sequence
  Description of Artificial Sequence: Synthetic coding sequence
atgtctcagtcaaaccgagagctggttgtagacttcctttcctacaaactgagccagaagggatacagctggtcacaatttagcgatgttgaggagaatagaaccgaggcacctgaggggacggagagcgaaatggagactccttccgccatcaatggcaatccttcatggcacctggcggatagcccagccgttaatggagcaacggggcattcatcgtctctggatgcacgagaggtgatcccaatggctgctgtcaaacaagctctacgcgaggcgggcgacgagttcgagctccgctacaggagggcattcagtgacttaactagccagctgcatatcaccccaggcactgcttaccagagttttgaacaagtggtcaatgagctttttagagatggggtgaattggggaagaattgttgccttcttctcgtttgggggtgcactttgcgtggaatccgtggataaggaaatgcaagtactggtgtcccgcattgcggcgtggatggccacctatttgaacgaccatctggagccatggatccaagaaaacggagggtggtag

SEQ ID NO: 14033 - DNA, 615 bp, Artificial Sequence
  Description of Artificial Sequence: Synthetic coding sequence
atggtagatcagctgagagagcggacaactatggccgaccccctccgggaaaggacagagttactcctagccgattatctgggttattgtgcaagagagccagggactccggagcccgccccttccacccccgaagccgcagtgttgagatcagccgcggcgaggctaaggcaaattcacagatctttcttttctgcctatctcggctacccggggaatagatttgagttggtggctttaatggctgactcggttctgtccgactcacccgggcctacatggggacgtgtcgtaactcttgtgacattcgctggaaccctgctggaaagggggccactcgtgactgcacgctggaagaagtggggcttccagcctaggctgaaagagcaggagggcgatgtcgctagggattgtcagagactcgtggccctgctttcatctaggttgatggggcaacaccgagcatggctccaagctcagggcggctgggatggtttttgtcacttctttagaacaccgtttcccttagccttctggcgaaagcagttagtccaggctttcttatcctgccttctgacaacggcatttatttacctctggaccagactgttgtag

SEQ ID NO: 14034 - DNA, 417 bp, Artificial Sequence
  Description of Artificial Sequence: Synthetic coding sequence
atggccaagcagccttcagacgtcagttccgaatgcgatcgagaaggcagacagttgcagccagccgagcgtcctccgcagcttcggcccggggccccaactagcttgcagaccgaaccccaagatcgttccccagcgcctatgagttgcgacaagagcacgcagacaccctcacctccctgtcaggcctttaatcactacctgagtgccatggccagcatgaggcaggctgagcccgccgacatgagacccgaaatctggattgcccaggaactgcgccggataggtgatgagttcaacgcctattacgctcgccgagtctttctcaacaactatcaagcagctgaagatcatccccggatggtcatcctgagactgttgcggtatatagtgcgattggtgtggcggatgcactag

SEQ ID NO: 14035 - DNA, 339 bp, Artificial Sequence
  Description of Artificial Sequence: Synthetic coding sequence
atggctaaacagccctcggacgtctccagcgagtgcgatcgggaaggccggcagttacagccagcagaaaggccgccacagcttcggcctggcgccccaacctctctccagacagagccacaggaccgaagtcccgctccgatgagctgcgataaatccacccaaacaccatcacctccttgccaggctttcaaccactacctgagcgccatggttgtaatactggaggatataggcgacctgtccctctgtttcggttttatatttaccggcctcgatctgtacgggcatcaccatagtcaggatactgagcaattgaaccacaaagacttcagttag

SEQ ID NO: 14036 - DNA, 519 bp, Artificial Sequence
  Description of Artificial Sequence: Synthetic coding sequence
atggctaaacagccatccgatgtaagctctgagtgtgatcgggagggacgccagctgcagcccgccgaaagaccaccacagctgagacctggagcgcctacctcactccagacagagcctcagggcaaccctgagggtaatcatggcggggaaggtgatagttgcccacacggaagcccccagggaccactggctcctccagccagccctgggccattcgccacgcgttctcccttattcatctttatgaggagatcttctctgttgagcaggagcagtagtggatactttagctttgacacagaccgctccccagctccaatgagttgtgacaagtctacgcaaacccccagtcccccatgtcaggccttcaaccactatctgtcagccatggcctctatgagacaggccgagcctgcggatatgcgaccagaaatttggattgcccaggagctcaggagaatcggcgatgagtttaacgcctactatgctcgccgcatgcctctccccccagattag

SEQ ID NO: 14037 - DNA, 219 bp, Artificial Sequence
  Description of Artificial Sequence: Synthetic coding sequence
atggctaagcagccctccgacgtctccagtgaatgcgacagggaaggccgacagctgcagcccgcagagcgtccgcctcaacttagacctggcgccccaacttcactgcaaacagaacctcaagggaaccccgaggggaatcacgggggggaaggggattcgtgcccccatgggtcaccgcagggacccctggcacccccggcgagcccaggaccttag

SEQ ID NO: 14038 - DNA, 258 bp, Artificial Sequence
  Description of Artificial Sequence: Synthetic coding sequence
atggccaaacagcccagcgacgtgtcatctgagtgtgatcgtgaggggagacaactgcaaccagccgagcggcctccccagctgcgcccaggcgcaccaacaagcctgcagaccgagccacaggcgagcatgcggcaggccgaacctgctgacatgagaccagagatttggatagcccaagagctgaggcgtatcggagacgagtttaacgcatactatgccaggcggctggccaaactcctggcctcatcaacttag

SEQ ID NO: 14039 - DNA, 597 bp, Artificial Sequence
  Description of Artificial Sequence: Synthetic coding sequence
atggccaaacagcctagtgatgtgagcagtgaatgcgatcgagagggcaggcaactgcaaccggctgagcgccctcctcagcttagaccaggggcacccacgtctctgcagactgaaccgcaggggaatcccgaaggtaatcacgggggggaaggggattcctgtcctcacggcagccctcaggggccgctggcccccccggcgagtccaggaccttttgccactcgcagtcccttatttatctttatgcggagatcatcactgctttctaggtccagctccggatatttttcattcgatacagacagatccccagcacctatgagttgtgacaagtcaacacaaactccatcgccgccgtgtcaggcattcaatcactacctcagcgccatggcttccatgcgccaggcagaacctgccgacatgaggcctgagatttggatcgcccaggaattacggagaattggagatgaatttaacgcttactacgctcgtcgcgtgtttctgaataactaccaagccgccgaagaccatccccggatggtgatcctgagattgttgcgctacatagtcagactagtttggcggatgcactag

SEQ ID NO: 14040 - DNA, 369 bp, Artificial Sequence
  Description of Artificial Sequence: Synthetic coding sequence
atggctaagcagccctcagacgtgtcaagtgaatgcgatagggagggccggcaactgcagcccgccgaacgccctcctcagctgcggcccggggcccctacatctttacagacggagcctcagggcaacccagagggcaaccacgggggggagggcgattcatgtccgcacggcagccctcagggcccattggcccctccagcttcccctggtccgttcgcaactagatcacccctgttcatctttatgagaaggtcgtccttactaagtagatctagctccggatacttcagcttcgatacggaccggtcaccagcccctatgagttgcgacaaatccacacagactcccagtccaccctgccagtag

SEQ ID NO: 14041 - DNA, 222 bp, Artificial Sequence
  Description of Artificial Sequence: Synthetic coding sequence
atgcggcaagccgagccggccgacatgcgaccagaaatctggatcgcccaagaactaagacgaattggcgatgaattcaatgcttactacgctcggcgtgtcatgatgttcagcctgcccgcattcctcctcacgccctctcccagcactctctattttttcaaaaagaccgtcactagttgcaattacatgttaattctggagatgattactgtggcctag

SEQ ID NO: 14042 - DNA, 243 bp, Artificial Sequence
  Description of Artificial Sequence: Synthetic coding sequence
atggccaagcagccctccgatgtttcatcggaatgtgatcgcgaaggtcgacagctccagccagccgagcggcctccacaacttagacccggagcgccgacatccctgcagaccgaacctcaggatcggtccccagctccaatgtcttgcgacaaatcgacacagacaccctccccaccctgccaggctttcaatcactacctcagcgctatggttagagaaatcgaggaggttgtggtgtag

SEQ ID NO: 14043 - DNA, 408 bp, Artificial Sequence
  Description of Artificial Sequence: Synthetic coding sequence
atggcaaaacagccttccgacgtgtcttcagaatgtgaccgggagggaagacaactgcagcccgccgagcgacccccacagcttcggccaggagcacctacctcgctgcagacggaaccccagggaaatcctgagggcaatcacggaggagagggggactcatgtccccatggctctccacagggacccctcgcgccccctgcctctccaggacctttcgccacccggagcccacttttcattttcatgcggagatcctctctgctttctcgttcaagctcaggttacttcagctttgacaccgacaggtcccctgccccgatgtcttgcgacaaaagcacccagaccccttcaccgccctgtcaagcatttaatcattacctgtcggcaatggccaactgggactag

SEQ ID NO: 14044 - DNA, 423 bp, Artificial Sequence
  Description of Artificial Sequence: Synthetic coding sequence
atggccaaacagccttctgatgtgagctcagagtgtgaccgcgaagggcgacaactccagccggccgagagaccaccacaactccgtcccggggcacctacctcacttcagaccgaacctcaggggaacccagagggtaatcatgggggcgaaggcgactcctgtcctcacggtagccctcaaggccctttagcaccacctgcctcgccaggcccttttgcaacgagatcacccttgttcatctttatgcgtaggtctagtcttctatctcggtcctcttccggatatttctcattcgacactgaccggtcacccgcaccgatgtcctgcgacaaaagcactcagaccccgtcaccgccttgccaggcttttaatcattacctatccgccatggtaagagagatagaggaggtagtggtgtag

SEQ ID NO: 14045 - DNA, 291 bp, Artificial Sequence
  Description of Artificial Sequence: Synthetic coding sequence
aaacagccttccgacgtctcaagtgagtgtgatagggaagggagacagctgcaacccgcggagcggcccccccagctcagaccaggagctcctaccagcttacagaccgagcctcaggacagatcaccggctcctatgtcttgtgataagtcaacacaaacgccctctcctccatgtcaagccttcaaccactacctcagtgctatggacgactccgcaggctcttcattgcggatagccctgcatcgcgaggttcaatggcccctcaagtggctggccaaaagttcttag

SEQ ID NO: 14046 - DNA, 249 bp, Artificial Sequence
  Description of Artificial Sequence: Synthetic coding sequence
atggcaaagcagcccagcgatgtgtcatccgagtgtgatagagaaggtcggcagctgcagccagccgaaagacccccacagctgcggcccggggcgcctacatcactccagactgaaccccaggcgagtatgcgtcaggctgaaccagctgatatgcggccagagatttggatagctcaggagcttcgacgtatcggagacgagttcaacgcctattacgccaggcgcatgcctttaccccccgactag

SEQ ID NO: 14047 - DNA, 582 bp, Artificial Sequence
  Description of Artificial Sequence: Synthetic coding sequence
atggcaacacccgcctcggcccctgacactcgggctctcgtcgcagatttcgtcggatataaactcaggcagaaggggtacgtatgtggcgccgggcctggcgagggtccagctgccgacccactgcaccaggccatgagagccgccggcgacgagttcgagacacgctttcggcggacattcagtgatctggcggcacagctgcatgtgacccccggttcagcccaacaacggttcacacaggtctcagatgagctgtttcagggcggcccgaattggggccgcctcgtggctttcttcgtgttcggagcagcactgtgcgccgaatcagtgaacaaagaaatggagcccctggtagggcaggttcaagagtggatggtcgcctacttagaaactcaactggctgactggattcattcttcaggcggctgggccgagttcactgccctgtatggcgacggggctctcgaggaagctcgtaggctcagggaaggtaactgggccagcgttcgaaccgtcctgaccggggcggtggccttgggcgccctggtcacagtaggagcatttttcgcttctaagtag

SEQ ID NO: 14048 - DNA, 156 bp, Artificial Sequence
  Description of Artificial Sequence: Synthetic coding sequence
atggctacgcctgccagtgcccccgatactcgagctcttgttgccgactttgtgggctataaattgaggcagaagggttacgtatgcggtgctggaccaggggagggcccagccgctgacccgctgcaccaagccatgcgcgccgccggcgattag

SEQ ID NO: 14049 - DNA, 219 bp, Artificial Sequence
  Description of Artificial Sequence: Synthetic coding sequence
atggcaacccccgcatccgcccccgacacaagagctctggttgccgacttcgtgggatacaaactgcgccagaaggggtatgtctgtggcgctggcccaggtgagggacctgcggcagatccactgcatcaggccatgagggccgccggtgatgagttcgaaacgcgatttagacgcaccttcagcgaccttgctgctcagctgcacgtaacaccctag

SEQ ID NO: 14050 - DNA, 450 bp, Artificial Sequence
  Description of Artificial Sequence: Synthetic coding sequence
atggctacccccgctagcgcacccgatactcgggcattagtcgcagattttgtggggtacaagctgagacagaaaggttatgtgtgcggcgcagggcctggagaagggccagctgcagatcccctgcatcaggccatgagggccgctggagatgagttcgagactcggtttcgtcgcacttttagtgacctagcagctcagctgcatgtgacccctggcagcgcccaacaacgctttactcaggtcagtgacgagctcttccaaggcggccccaattggggccgcttggttgcctttttcgtctttggggccgctctgtgtgctgaaagcgtgaacaaggagatggaaccactagtcggtcaggtgcaggagtggatggtcgcatatcttgagacacaactcgccgactggattcactcaagtggcggatgggcagaattcactgcctag

SEQ ID NO: 14051 - DNA, 435 bp, Artificial Sequence
  Description of Artificial Sequence: Synthetic coding sequence
atggccacccccgcctcagcacccgacacacgtgcactggtggccgacttcgtgggttacaagctccggcagaagggttacgtgtgtggtgccgggcctggcgaaggccccgctgcagatccccttcaccaagccatgagagccgctggtgacgagttcgagacacgctttcgacggactttttccgacctggccgctcagttacatgtcactccagggtccgcccaacagcgattcacacaggtaagcgacgagctttttcagggcggaccaaactggggccgtctggttgcgttcttcgtcttcggagccgccctgtgcgcggagtcagtaaataaggaaatggagccactggttggtcaggtacaggaatggatggtggcctatctggagacccagctggcggactggatccactcttcaggcggctggtag

SEQ ID NO: 14052 - DNA, 528 bp, Artificial Sequence
  Description of Artificial Sequence: Synthetic coding sequence
atgacagactgcgagtttgggtacatttatcgcttagctcaagattatttgcagtgtgtgcttcagattccacagccaggcagcgggcccagtaaaactagccgggtcctccagaatgtggccttctccgtgcagaaggaagtggaaaagaatcttaaatcttgtctcgataacgtgaatgttgtatcggtagatacggctagaacccttttcaaccaggtgatggagaaggaatttgaagatgggataatcaattggggccggatagttaccatcttcgctttcgagggaattctgattaaaaagttgcttaggcagcagattgcccccgacgtcgatacctataaagagatcagctattttgttgcagagtttattatgaataatacaggtgaatggatccggcagaacgggggctgggagaacgggttcgtgaaaaaattcgaaccaaaatcgggatggatgacattcctagaggtcacaggcaaaatatgtgagatgctgagccttctaaagcagtactgctag

SEQ ID NO: 14053 - DNA, 492 bp, Artificial Sequence
  Description of Artificial Sequence: Synthetic coding sequence
atgaccgactgcgagttcggctacatatatagactggctcaggattatcttcagtgtgtacttcagattccgcagccaggatccggtcctagtaagaccagtagggtgctgcaaaatgtggcctttagcgtgcaaaaggaagttgagaaaaacctgaagtcgtgtctcgataacgtcaacgtggtgtccgtggatacagctcggacactcttcaaccaggtcatggagaaggaatttgaagacggcatcattaactggggacgcattgtgaccatttttgcctttgagggaatcttaattaagaaactcctgagacagcagatcgcccctgacgtggatacctacaaagagatctcttattttgtcgcggagtttatcatgaataataccggcgagtggattcgtcaaaatggaggctggggcaagtggcacaatcacacacccatgctagtcgaaagcgttgctcataaaaagcgaaagatggctttatag

SEQ ID NO: 14054 - DNA, 726 bp, Artificial Sequence
  Description of Artificial Sequence: Synthetic coding sequence
atgtgcagcggggccggtgtgatgatggcccgctgggcggctaggggtcgagccggatggcgatctacagtgcggatcctaagccccctgggtcactgcgagccaggagtttcgaggtcctgcagagccgcccaggccatggattgcgaggtgaacaatggatcgtcactccgcgacgaatgcataaccaatctgcttgtctttgggtttctgcagagttgttctgacaacagctttcgaagggaattggatgccctagggcacgaactgccagtgttggccccgcagtgggaaggctacgatgaacttcaaacagacggaaatcggtcctcccacagcaggctcggacgaatagaagctgattccgagtcccaagaggacatcatccggaacatcgctcgtcacctggctcaggtcggtgactcaatggatagatccatccccccgggactggttaacggtttggcccttcagctgaggaataccagccggagtgaggaagacaggaaccgcgacctggccacagctctagagcagctcctccaggcctatccgcgagacatggagaaagagaagaccatgctagtccttgcactgctgcttgctaagaaagtggcatcacatacgccgtcattgctgagagatgtctttcacaccactgttaatttcatcaatcagaacctccggacctatgtgagatcccttgctcggaatggtatggactag

SEQ ID NO: 14055 - DNA, 414 bp, Artificial Sequence
  Description of Artificial Sequence: Synthetic coding sequence
atggactgcgaggtaaacaatggctcctctctcagggatgaatgtattaccaatttactggtttttggatttctccagagctgctctgataactcttttcggagagaactcgacgcgcttggtcacgagttacccgtgctggcccctcagtgggaagggtacgatgaactccagactgatgggaacaggtcaagtcattccagactcgggcggatagaagcaggtgcctctgacaataatactgcctcagctgaagaggaaaccgaagccgctggatctgtggctgtcgagagaggcttgcatggagctgccacagtgattctgaaagtgaagaagacaagcagcggcattctgcctggcaccagtccccggtctggaacagcatggacggtcgcaagcctgcgggcctggtag

SEQ ID NO: 14056 - DNA, 300 bp, Artificial Sequence
  Description of Artificial Sequence: Synthetic coding sequence
atggaccggtctattccccccggcttagtcaacggcttggcgttacaactgcgcaacacttcacgaagcgaggaagaccggaaccgtgacctggcaaccgccctcgaacagctgcttcaggcatacccccgcgacatggagaaagagaaaaccatgctggtcttggcactcttactggcaaaaaaagttgcatctcatacaccgtccctgctcagagatgttttccatacgaccgtcaacttcattaatcagaatcttcgaacctatgttcggagtttagccagaaacgggatggattag

SEQ ID NO: 14057 - DNA, 300 bp, Artificial Sequence
  Description of Artificial Sequence: Synthetic coding sequence
atggacaggtccataccaccagggctcgttaatggacttgcgctccaactcaggaataccagtaggtctgaggaggaccgtaaccgagacctggctacagctttggagcaactgctccaagcctacccacgagatatggaaaaggagaagaccatgctcgtcttagccttgctgcttgctaaaaaagtagctagtcataccccttcactgctgagggatgtgtttcacaccactgtgaacttcattaatcaaaatctgaggacgtatgtcagaagcctcgcgagaaatggaatggactag

SEQ ID NO: 14058 - DNA, 588 bp, Artificial Sequence
  Description of Artificial Sequence: Synthetic coding sequence
atggattgtgaagtgaacaacggttcttccctcagagacgagtgtattacaaatctgctggtgttcggcttcctacagtcttgctcagacaatagctttcgccgagaactcgatgctttgggccacgagctgcctgttctcgccccacagtgggagggatatgacgaattgcagactgacggcaaccgatccagtcatagccggctcggccgtattgaggcagatagcgagtctcaggaagatattataagaaacattgcacggcaccttgctcaggtcggggactcaatggatcggtctataccaccgggactcgtgaacggccttgctctacagctgcgtaataccagtcgctccgaggaggaccggaatagagatcttgctactgcccttgagcaactgcttcaggcttaccctcgagatatggagaaagagaaaaccatgttagtattggcacttctcctggctaagaaggtcgcctctcacaccccaagcctgcttcgggatgtcttccacacgacggtgaatttcattaaccagaacttgcggacctatgtgaggtctctggctcggaatggcatggattag

SEQ ID NO: 14059 - DNA, 588 bp, Artificial Sequence
  Description of Artificial Sequence: Synthetic coding sequence
atggattgtgaagtcaacaatggctctagcctgagggatgaatgtatcacgaacctgctggtgtttgggttcctccaaagctgttccgacaattcctttcgaagagagctggatgcattggggcacgagctgccggtgctggccccccagtgggaggggtatgatgagctgcagaccgacggaaatagatcctcccactcccggttgggccgtatagaggcagattcagagagccaggaggatatcatccgaaatattgctcgccacctggcccaggtcggagactctatggacagaagtatcccgcctgggctggttaatggtctggcattacagctgaggaacacctccagatccgaggaggaccgcaatagggaccttgctacagccctggagcagctcctgcaagcctacccacgagacatggagaaagagaaaacgatgctcgtgctggctctgctgctcgccaaaaaggtagcctcccacaccccaagcctgctacgcgatgtgtttcatactaccgtgaatttcatcaaccagaatctgcgcacatatgtgagaagcctagctaggaatggaatggattag

SEQ ID NO: 14060 - DNA, 1353 bp, Artificial Sequence
  Description of Artificial Sequence: Synthetic coding sequence
atggaggaaccccagaagtcatacgtgaacactatggatctagaacgagacgagcccttgaagagcacgggcccgcagatctccgtgtctgaatttagttgccactgttgctatgatatacttgtcaacccaacaactcttaattgtggccactctttctgccgccactgtctggctctctggtgggcaagctccaagaaaaccgagtgcccagaatgccgggagaagtgggaggggttccctaaggtgtccatcctgctcagggatgcaatagagaagttgttccccgatgctatcagactgcgttttgaggacatccagcaaaataatgacattgtgcagagcctggctgcatttcagaaatatggcaacgaccagattcccctggcgcccaacaccggacgtgccaatcagcaaatgggtggggggtttttttctggtgtgttgaccgcacttaccggcgtggctgtggttctcctggtgtatcattggagttctcgagagtccgagcacgacctgctagtgcacaaggcggtcgccaaatggaccgccgaggaagtcgttctgtggctggagcaactcggtccatgggccagcctgtaccgagaaaggttcctttccgaacgcgtcaatggacggctgctgctgactctcacagaagaagagtttagcaagacaccctataccatagagaacagctcacaccgcagagccattctgatggagcttgagagagtaaaagctctgggcgtgaaaccaccgcagaacctttgggagtacaaggctgtcaatcctggacgcagtctttttctattgtatgccctgaagtccagtcccagactttcactcctatacttatacctgtttgactacaccgatacctttcttcccttcattcacacaatttgccctttacaggaggattcctccggagaagatatagttacaaagttgctcgaccttaaggagccaacctggaagcagtggagagaattcctagtgaaatattcattcctgccgtaccagctgatagcggagtttgcctgggactggctggaggttcattattggacaagtcgttttttgattattaacgccatgctgctgagtgtgctggaactgttctctttctggcggatttggtcaaggtcagagttgaagactgtcccacagcgtatgtggtcccacttctggaaagttagtactcagggccttttcgtcgctatgttctggcccttgatcccgcagttcgtgtgtaactgcctgttttactgggctctttacttcaatcctatcatcaatatagacctggtcgtaaaggaactgaggcgcctggagactcaagtcctgtag

SEQ ID NO: 14061 - DNA, 969 bp, Artificial Sequence
  Description of Artificial Sequence: Synthetic coding sequence
atggtcggtatattcaaggagaacaggatgtcgcgaatgcagaggaagatggggcgctttccgcaatctcaatatagcccccaggtggtgctcctggtttaccactggagcagtcgcgagagcgaacatgatctgctcgtacacaaggcagttgccaagtggacagcggaagaagtcgtcctttggcttgaacagctgggaccttgggcgagtctgtaccgggagcggtttctgtcagaacgagtcaacggccgcctcttgctcactctaaccgaagaggaattctcgaaaaccccatacactatcgagaactcctcccacagacgagctatcctcatggagctggagcgggtgaaagccctcggagtgaaacccccccagaacttgtgggaatacaaggccgtcaatccgggaagaagcctttttctgctttatgctctgaagagttctccacgtctaagtcttctatacctgtatttatttgactatacggatactttcctgcctttcatccataccatttgtcccctgcaggaggacagttccggggaggatatcgtgacaaaactgctggacctcaaggagcctacatggaagcaatggagggagttcctggtgaaatacagtttcctcccgtaccagttaatcgcagaatttgcttgggactggctggaagttcactactggacctcacggtttctgataataaacgctatgctgctcagtgtgctcgagttgtttagcttttggagaatctggtccaggtccgaacttaagaccgttcctcagagaatgtggagccatttttggaaagtctccacccaagggctgttcgtcgctatgttctggcccctcattccacagtttgtgtgcaattgcctgttctattgggcattgtattttaaccccatcattaatatagacctggtcgttaaggaattgaggcgcctggagacccaggtcctgtag

SEQ ID NO: 14062 - DNA, 4254 bp, Artificial Sequence
  Description of Artificial Sequence: Synthetic coding sequence
atggccgccgtgccccagaacaatctgcaggaacaactggagcgccactctgcgagaaccctgaacaacaagctctcattgagcaagcccaagttttccggttttacgttcaaaaagaagactagtagcgacaacaacgtcagcgtgaccaatgtttcagttgctaagaccccagtgctccgtaacaaggacgtaaacgttacagaagactttagtttttcagagcccctgccgaatactactaatcagcaaagggtcaaggatttttttaagaatgcgccagccggacaggaaacacagcgcggagggagtaagtctctgctccctgattttctgcagactccaaaggaggtggtttgcacaacccagaacactcctacggtaaaaaagtcccgcgatactgcactgaaaaaattagagttctcctcaagtcctgatagcctcagcaccatcaatgattgggatgacatggacgattttgacacctctgaaacttcaaagtcttttgtcactcccccccagtcccacttcgtgagagtgagtactgcccagaagtcaaagaaggggaagcgcaacttttttaaagctcaactctatacaaccaataccgtcaagacagacctgccaccgccctcatccgaatccgagcagatagacctgaccgaagaacagaaagatgactcagagtggttatcctccgatgttatctgcatcgatgatgggcctatcgcagaagtccacatcaacgaggatgctcaggagtccgatagtctgaagacacatctggaggacgaacgagacaacagtgagaagaaaaaaaatctagaagaagcagagctccattctacggagaaagtcccttgcatcgagtttgatgatgatgattacgacacagatttcgttccccctagccccgaggagattattagtgcctcgtcgagctctagcaagtgcctgtcaaccctgaaagatctcgacacatcggatcggaaggaggacgtgttgtctacttccaaagacttgctgtccaaaccagagaagatgtcgatgcaagagctgaatcccgaaactagtacggactgcgatgcccggcagatatctctgcagcaacaactcatccacgtcatggagcacatctgcaagctcattgatacgatccctgacgataagctcaagctcctagactgcggaaatgagctcttgcagcagaggaatattagaaggaagcttctcacagaagtggatttcaacaaaagtgatgctagtctgctggggagtttatggaggtaccggcctgacagcctcgatgggcctatggagggggattcctgtccgactggcaactctatgaaagaactgaactttagtcacttgccttccaactccgttagccccggggattgtctgctgactacaaccctgggcaagacggggttcagcgcgaccagaaagaatctattcgaacgcccgctgttcaatactcacctgcaaaagagcttcgtttcttccaactgggctgagactcctagactcgggaaaaagaacgagagttcatacttcccaggcaacgtcctgacatccactgccgtgaaagatcagaataaacatactgcatcgataaacgacctggaaagggagacccaaccaagctatgacatagacaattttgatatcgatgattttgatgacgatgatgattgggaggacattatgcataacctggccgcttctaaaagttccaccgctgcctatcagccaataaaagaaggcagaccaatcaagtctgtgtcagagcgcctgtcttcagccaaaacggattgtctgcctgtgagttctactgcgcagaacatcaattttagtgaaagcattcagaattacacggacaagagtgctcaaaacttggcaagtcgcaatctgaagcacgaaagatttcaaagtctttcattcccccatactaaggagatgatgaagatttttcataagaagtttggtctccacaacttcaggactaatcaattggaagcaatcaatgcggcgctccttggagaggactgcttcatccttatgcctacaggcggcgggaaatccctctgctaccagcttcccgcgtgcgtcagcccaggggtcaccgttgtgatctcaccccttcgcagcctgatcgtcgaccaggtgcaaaagttaacatcactggacatcccagccacctacctcactggcgataagacagactctgaggcaaccaacatttatcttcagctcagcaagaaagatcccatcattaagctcctgtacgttacacccgagaagatatgtgcttctaaccggttgatctctaccttggagaacttatacgagcggaaactccttgctagattcgttatagacgaggctcattgtgtctctcagtggggacacgattttcgacaagattacaagagaatgaatatgttaaggcagaagttcccctcagtgcccgttatggccctaacagcaaccgccaaccctagggtgcaaaaggacatcctcacgcagctgaaaatactgcgaccacaggtgttctccatgagcttcaacagacacaacctcaagtattacgtattgcctaaaaagcccaagaaggtggccttcgactgtctggaatggatcagaaagcatcatccatatgactctggcattatctattgtttgagtcgaagagagtgtgacacaatggccgatactttgcaacgagatggcctcgcagccttagcttatcacgcagggctcagtgattctgccagggatgaggtgcagcagaagtggatcaatcaagatggctgtcaagtgatttgcgccaccatcgcattcggaatgggtattgataagccagacgtgaggtttgtgattcacgcaagtctgcccaagtccgttgagggctactaccaggagtccggcagggcaggaagggacggggaaatctctcactgcctgctcttctacacgtatcatgacgtcacccggttaaagaggttgattatgatggaaaaagacggtaatcaccatacccgagaaacgcattttaataatctgtactccatggtgcactattgtgagaatattacagagtgtagaagaattcagctcctggcctattttggcgagaatggatttaatccagacttctgcaaaaagcatccagatgtgtcctgcgacaattgttgcaaaacgaaggactacaagactagagacgtaactgatgacgtgaaatccatagtccgcttcgtgcaggaacacagcagctcccagggcatgcggaacatcaaacacgtcggcccctccggacggtttactatgaatatgctggtggacatctttcttgggtctaagagcgcaaaaattcagtcagggatctttggcaagggttctgcgtattctcgccataatgccgaacgtctttttaaaaagctgatcctggacaaaatcctagatgaagatttgtacatcaatgccaacgaccaagctattgcatatgttatgctggggaataaggcccaaacagtattgaacgggaacctgaaggtagactttatggagactgagaattctagcagcgtcaagaagcagaaggccctggtcgcaaaagtctcacagcgcgaagagatggtgaaaaaatgtctcggtgaacttacagaagtttgcaaaagtctaggaaaagtttttggagtacactactttaatatttttaatacagtgacacttaagaagttagcggagagcctttctagcgaccccgaagtcttactgcagatcgatggagtcacagaagacaaactagagaagtacggcgctgaggtcatatccgtactgcaaaaatatagtgaatggacctcacctgcggaggatagtagcccagggatttccctaagttcctctcgaggcccgggtcgatctgccgccgaggaattggacgaagaaatacctgtgtcctcacattacttcgcgtcaaaaacgcggaatgagcgaaagcggaaaaaaatgcccgcttctcaacgttcaaagaggcgcaaaactgctagcagcggttctaaggcaaagggaggatccgctacttgcagaaagatctcctctaagactaagtcctccagcatcattggcagctcatccgcctcacacacttcacaggcaaccagcggcgccaactcaaaacttggaatcatggcacccccgaaaccaatcaatcgacctttccttaaaccctcctacgctttttcatag

SEQ ID NO: 14063 - DNA, 3144 bp, Artificial Sequence
  Description of Artificial Sequence: Synthetic coding sequence
atgtccatgcaggaattaaatcctgaaacttccacggactgcgacgctcgccagatttcattgcagcagcagctcatccacgtgatggagcacatatgcaaactgatcgacactatacccgacgacaagctcaaactgctcgattgcggaaatgaactgttacaacagagaaacataagaaggaagcttctcacagaggtggactttaacaaaagcgacgcgtcgttgctgggctcactctggcggtatcgaccggacagcctagacggccctatggaaggggatagctgtccaacaggaaatagcatgaaagaactgaatttctctcacttgccgtccaatagcgtgtcacccggagactgcctgttaaccacaaccctgggcaagacgggatttagtgccacacgcaagaacctgttcgaacgtcccctgttcaatactcatctgcagaagtccttcgtgtcatccaactgggcggagactcctagactgggtaagaagaacgaatctagctacttccctggtaacgttcttacttcaacggcggtcaaggatcagaataaacataccgcgtccatcaatgatctagagcgggagacccagccttcctatgatattgataattttgatatcgacgattttgacgacgatgacgattgggaggatataatgcataacctcgctgcaagcaaatcctcgaccgccgcatatcagccaatcaaggaaggacgtccaataaagtctgtgtccgaaaggctgtcgagcgctaagactgactgcttgcccgtctcaagcaccgctcagaatattaacttctcagagtcaattcagaattacactgacaagagcgcacagaatttagcctcaaggaatttaaagcacgagagattccagagtttatcttttccacacacaaaagagatgatgaagatatttcacaagaaattcggcctgcataactttcggaccaatcaacttgaggccattaacgctgctttgcttggagaagattgcttcatcctcatgcccacaggaggagggaagtcattatgctaccagctccctgcatgcgtgtcccccggtgtcacagtcgtgattagtcctcttagatctcttattgtggatcaggtgcagaagctcacttcgctggacatccctgccacatacctcacaggagataagaccgattccgaggcaacaaacatttacctgcaattgtcaaagaaggaccctatcattaagctgttatacgtgactcccgagaaaatttgtgcctccaatcgccttatctccaccttggagaatctctatgaacgcaaactcctcgctcgctttgtgatcgacgaagctcattgcgtcagccagtggggtcacgactttagacaggattataagagaatgaacatgttgaggcaaaagtttccttccgtccccgtgatggcactcacggcgaccgccaaccccagggtccagaaagacattttaactcaactgaaaatcttgcgcccccaagtgttctccatgtcgttcaatagacacaacttaaaatactatgtcctgccaaaaaaacccaaaaaggtggccttcgattgtctagagtggattaggaaacatcatccttacgatagcggaatcatatactgcctgagtcgcagagagtgcgacacaatggcagataccttgcagaagtggattaaccaagacggctgtcaggttatctgtgccaccatcgcctttggcatgggcatcgacaagccagatgtgaggttcgtaatccatgccagcttgccaaaaagcgtcgaggggtattaccaggagtcgggccgagcgggacgtgatggagaaatatcccactgcctgttattctatacctaccacgatgtgacgcggctgaaacggctgataatgatggaaaaagatgggaatcaccatacgcgcgagacccacttcaacaacctgtattcaatggtacattattgtgaaaacataacagaatgccgcagaattcagctgctagcctacttcggggaaaacggctttaatccggatttctgcaaaaaacaccccgacgtttcctgcgataactgttgcaagacaaaggattacaagacccgcgatgtaaccgacgatgtgaagagtatcgtacggttcgttcaggagcacagcagtagccagggtatgaggaacatcaaacacgtgggacctagtggtcggttcactatgaatatgctggtcgatatattcctgggaagtaagagcgcaaagatccagagtggaatctttggaaaggggtccgcctactcccgacataatgccgagaggctgtttaaaaagctcatcctcgacaagatcttagatgaggacctgtatattaatgctaacgaccaggctattgcctatgtgatgctcgggaataaggctcagactgtcctcaacggaaatctcaaagtggacttcatggagactgagaactcttctagcgtgaagaaacagaaagccctggtagccaaagtttcacagcgagaagaaatggtgaagaaatgccttggagaactaaccgaggtgtgcaaaagcctgggcaaggtgtttggtgtgcactatttcaatatcttcaacactgttaccctcaagaagttagctgaatcactgtcttccgaccccgaagtactcctccagatcgacggtgttacggaagacaagctggagaagtatggagctgaggtgatttcagtgcttcagaagtattctgaatggactagccctgctgaagactcgagcccagggatcagtctgagcagctcaagaggccctggccggagtgcagccgaggaacttgatgaagagatccctgtcagttcccattacttcgctagcaaaacccgcaatgaaagaaaaaggaagaaaatgcctgcgagtcagagatccaaacgacggaaaaccgccagcagcggttctaaggctaagggcggatctgctacctgcagaaaaatttcatctaagaccaagtcttcttcgattattgggtcctcctcagctagtcacacatcccaggccacctccggcgccaatagtaaactgggaatcatggctccacctaaacctattaatagaccctttttaaaaccttcgtacgccttttcctag

SEQ ID NO: 14064 - DNA, 1560 bp, Artificial Sequence
  Description of Artificial Sequence: Synthetic coding sequence
atgaatatgctgcgccagaagtttccatcagtacctgttatggcattgactgcaaccgccaacccccgggttcagaaagacatcctcacccagctgaaaatcctgcggccccaggttttcagcatgagctttaaccgtcacaacctgaagtactatgtgctgcccaaaaagcccaaaaaggtcgcattcgactgcctggaatggatcagaaaacaccacccatacgattccggcatcatctattgcctgagccggcgggagtgtgacaccatggctgatactcttcaaagagacggattggctgcactggcttaccatgccggtttgtccgactctgcccgggacgaggttcagcagaagtggattaatcaggacggttgtcaggtcatctgtgctaccatagccttcggaatggggattgacaagcctgacgttcggtttgtgattcatgcgagcctgccaaagtctgtcgaagggtactatcaagagagcggaagggctggaagggatggagagatttcccactgcctgctcttttatacttatcacgacgtgactcggctcaaacgtttgatcatgatggagaaggacggcaaccaccacacaagagaaactcattttaacaatctctattccatggttcattactgcgaaaatattacagagtgccggcgcattcagttgctcgcgtacttcggcgagaacggctttaacccagacttttgtaagaaacatcctgatgtttcgtgtgacaattgttgtaaaacaaaagactataagactagagatgtgaccgacgacgtgaagagcattgttaggtttgtgcaggagcatagcagctcccaaggcatgcgcaacatcaagcatgtgggtcctagcggacgcttcaccatgaatatgctcgtggatatttttctcggctcaaagtctgcaaagattcaatcagggatttttggaaaaggttctgcgtactctagacataatgccgaaaggctgttcaaaaaattgatcctcgataagattctggatgaggacctctacatcaatgccaatgaccaagcaatagcatacgtaatgctgggaaacaaggctcaaaccgtgctgaatggtaatctcaaagtggacttcatggaaaccgaaaacagctctagtgtgaaaaagcagaaggcactggtcgccaaggtgtcccaacgcgaagagatggtgaaaaagtgcttgggggaactgaccgaagtttgtaaatctctgggtaaagtgtttggtgtgcactatttcaatatttttaacacggtgaccttgaaaaaactcgctgaatctctgtcctctgatcccgaggttctactgcagattgatggtgtcaccgaggataagcttgaaaagtatggcgcggaagtaattagtgtgctgcagaagtacagtgagtggacaagccctgcggaggatagctctcctggaatcagcctgagcagctctcgtgggcccggcagaagtgccgccgaggaattggacgaagagatccccgtcagctcccattatttcgcgagcaagacgagaaactag

SEQ ID NO: 14065 - DNA, 981 bp, Artificial Sequence
  Description of Artificial Sequence: Synthetic coding sequence
atgcaccgaaccacaaggatcaaaatcacagagctgaaccctcatctgatgtgtgtactgtgtggaggttacttcatcgatgcgacaacgattatcgagtgtctacactccttctgtaaaacgtgcattgttagataccttgaaacatcaaagtactgccctatctgcgatgtgcaagtgcacaagactagacctttattaaatattcggtctgacaaaaccctgcaggatatcgtgtacaaattggttcctgggctatttaagaatgaaatgaagaggcgccgggacttttacgccgcacatccatctgccgacgccgccaacggctcaaacgaggacaggggggaggtcgcagatgaggataaaagaataatcaccgatgacgagatcatcagccttagcattgagttcttcgaccaaaatcgactggatagaaaggtgaataaagataaagagaaatcaaaagaagaagtgaacgacaagcggtacctgcgctgccccgccgccatgactgtcatgcacctaagaaagttcctgcgatccaagatggatattcccaataccttccaaatcgacgtaatgtacgaggaagagcctctgaaggattactataccctgatggacatcgcatacatctacacctggagacgcaatggtcctttacccctcaagtatcgcgtgaggccaacctgtaaacggatgaagatttcccatcaaagggacggactaaccaacgctggtgaattggaatctgattccggaagcgacaaggccaactcaccagccggtggtattccctccacttccagctgcctgccctcccctagtacccccgtacagtccccacaccctcagttccctcatatcagctcgactatgaacggcacaagcaattccccatcgggtaatcatcagtcaagttttgccaaccgccctagaaaaagcagcgtcaatggctcctccgccacctcctctggatag

SEQ ID NO: 14066 - DNA, 717 bp, Artificial Sequence
  Description of Artificial Sequence: Synthetic coding sequence
atgtgcgtcctgtgtggtggatactttattgacgccacaacaataattgaatgcctgcattccttttgcaagacctgcatcgtgagatatctggagacctcaaagtactgcccaatctgtgacgtccaggtccataaaacccggccactgttgaatattagactggatcggaaggtgaataaggataaggagaaatccaaagaggaagtaaacgacaagcgatacctacggtgtcctgcggccatgaccgtcatgcaccttagaaagttcctcaggtccaaaatggacattccaaacacttttcagattgatgtcatgtatgaagaagaaccattgaaagattattacacactgatggatattgcttacatctatacctggcggcgtaatggcccgctccctctgaaatacagggttaggcccacgtgcaagcgaatgaagatctcccaccagcgagacggcctgaccaacgccggagaattagagagtgatagtggttctgacaaggccaattcgccagccggcggcatacccagtacatctagctgtctgcccagccccagcaccccagtccagtctccacaccctcagtttccacacatttctagtactatgaacgggaccagcaattcaccttctggcaatcatcagtcctcgttcgccaaccgaccacgtaagtcttccgtcaacggaagttcggccaccagctccggctag

SEQ ID NO: 14067 - DNA, 318 bp, Artificial Sequence
  Description of Artificial Sequence: Synthetic coding sequence
atgcaccggaccacccggattaagataaccgaactgaatcctcatctgatgtgtgtgctgtgcggcgggtacttcatagacgctactacaatcattgagtgcctccatagtttctgcaaaacatgcatcgtacgctatctcgaaacgtcaaaatactgcccgatctgcgatgtccaagtgcacaaaacacgccccctcctgaatatcagatccgacaagaccttgcaagacatagtgtataagcttgttccaggcttattcaagaatgagatgaagcggaggcgagacttttacgccgcccatccttccgccgactag

SEQ ID NO: 14068 - DNA, 624 bp, Artificial Sequence
  Description of Artificial Sequence: Synthetic coding sequence
atgcacagaaccacaagaattaagatcacagagcttaatccgcaccttatgtgtgtgctgtgtggagggtactttattgacgccactacaattatcgagtgcctacattctttttgtaagacttgtatcgtgagatatctggaaacttcgaagtactgccccatctgtgatgttcaggtgcacaagactcggcccctcctgaacatccgatccgacaaaacactacaggatatcgtgtacaagctagtaccaggactgtttaagaacgagatgaagcgccggcgtgatttttacgccgcccacccctccgccgacgccgcaaacggcagcaacgaggaccgcggggaggttgctgatgaagacaagcgaattataactgacgatgagatcatctccctgtccatcgagttttttgaccagaaccgcctggacagaaaagtgaataaggataaggagaagtctaaggaggaagtaaacgataaacggtatcttaggtgccccgctgctatgacagttatgcacctgagaaagttcctaaggtcaaaaatggatatccctaacacctttcagatagacgtgatgtatgaggaagagccactgaaagactattacactctgatgtag

SEQ ID NO: 14069 - DNA, 453 bp, Artificial Sequence
  Description of Artificial Sequence: Synthetic coding sequence
atgcataggaccacacgaattaaaatcacagaactaaacccccatctgatgtgtgttttatgcggcggatactttatcgacgcaacgacaattattgagtgccttcacagtttctgcaagacttgtattgtgcgctatctagaaacttccaaatactgtcccatctgtgacgtgcaggtgcacaagacaagaccacttctcaatatacggtcagacaaaaccctccaggacatcgtgtataagctggttccaggactgttcaagaacgagatgaaacgccggagagacttctatgccgcccacccgtctgccgacgcagctaacggttccaacgaggacaggggcgaggttgctgatgaagacaagagaataatcactgacgacgagatcatttccctcagcatcgaattctttgaccagaaccggttggacaggaaggtaaacaaagactag

SEQ ID NO: 14070 - DNA, 555 bp, Artificial Sequence
  Description of Artificial Sequence: Synthetic coding sequence
tatttcatcgatgctactaccattattgagtgcctccattccttttgcaaaacctgtatcgtccgctatctggaaacctcgaaatactgccctatttgcgacgtacaggtgcacaagaccaggccgcttcttaacattcggttagataggaaggttaacaaggataaagaaaaatccaaggaggaggttaacgacaaaagatacctgaggtgccctgctgccatgacggtgatgcacctgcgaaagtttctcaggtccaaaatggatatcccaaatacatttcagatagatgtaatgtatgaagaggagcctctgaaggactactacacactgatggatatcgcctacatctacacatggcgacgtaacggccccctgcctctcaaatatagagtgcggccaacgtgtaagcgcatgaagatctcacaccagcgggacggcctcactaatgcaggcgagttggaatctgattcaggctctgacaaagcaaattctccagccggaggaatcccctcgactagtagttgcctccccagcccttccacccctgtttag

SEQ ID NO: 14071 - DNA, 279 bp, Artificial Sequence
  Description of Artificial Sequence: Synthetic coding sequence
atgcataggaccactcgaattaagatcacagagctgaatcctcacttgatgtgtgtcctgtgtggcggatatttcatcgatgcgacaaccattatcgagtgcttgcattcattttgtaaaacctgcatagtccgctacctggaaacttcaaaatactgccccatttgcgacgtgcaagtgcacaagacccgaccactattgaacatccgatccgacaagactctccaggatatcgtatacaagttagttcctggtctgtttacagcgaacggatcttag

SEQ ID NO: 14072 - DNA, 2193 bp, Artificial Sequence
  Description of Artificial Sequence: Synthetic coding sequence
atgcccggggtggccagactgccactcctgcttgggttgctgctgctccctcgacccgggcggcccctggatcttgcggactacacctacgacctcgccgaagaagacgattcagaacccttaaattataaagacccttgtaaggctgcagcttttctaggcgacatcgctcttgacgaagaggatcttcgcgcctttcaggttcagcaggcagtagatttgaggagacacacagcgcgaaaaagctccattaaagccgccgtgcccggcaatacttctacccccagctgccaaagtacaaatggccagccacagcggggcgcctgtgggcggtggcgggggaggagtcgaagccgaagggccgcaacctccaggcctgagcgggtatggccagatggcgtgattcctttcgttataggaggtaactttacaggcagccaacgtgccgtttttaggcaagccatgcggcactgggagaaacatacctgtgtcacgttcctcgaacgtaccgatgaagatagctacatcgtgtttacctacaggccttgcggctgttgttcgtatgtgggtcgcagaggaggggggcctcaggcaatttcaatcggtaagaactgtgacaagtttgggatcgtcgtccatgagttagggcacgtagtgggcttctggcatgaacatacccggcctgaccgggatagacatgtctccatagtccgggaaaacattcagccaggtcaagagtacaatttcttaaaaatggagccgcaagaggtagagagcctgggggaaacgtatgattttgattctattatgcactacgcccggaacactttttctagaggtatcttcttagacacaattgtgcccaagtatgaggtcaacggcgtcaagccacccatcggccagcggaccaggctctccaaaggcgacatcgcacaagctcgcaagttgtacaagtgccccgcttgcggagaaacactccaggactccaccggcaatttttcctctccagagtaccccaacggatacagtgcacatatgcattgtgtgtggcgcattagcgttacgccaggcgagaagattattctgaacttcacatctctggatttgtataggagtcggctgtgttggtacgattacgtggaggtccgcgatgggttctggagaaaggccccattgcgcggacgtttctgtggctccaagttaccagagcccatagtgagcacggatagccgactgtgggtggaatttaggagttccagcaactgggtcgggaaaggcttttttgccgtctatgaagccatttgcggaggggacgtgaaaaaggattatggacatatccagagccccaattaccctgacgactaccgccccagcaaagtgtgcatctggcgcatccaggtgtccgaggggtttcatgtcgggctgacattccagtccttcgaaattgaaaggcacgacagttgcgcctacgattatctcgaagtgcgggacgggcattccgagtccagcacacttatcggccggtactgcgggtatgagaagccggacgatattaagagcaccagttcccggctttggttgaaattcgtttctgatgggtcaattaacaaagccggatttgcggtcaacttcttcaaggaggtcgacgagtgtagtcgccccaatcgtggggggtgtgagcagcgctgcctgaacacccttggctcctacaagtgcagctgcgatcccggatacgagctggcacccgacaaaaggagatgtgaggctgcatgcggaggattcttaaccaagctgaacgggtctattacatctcccggctggcccaaagaatatccacccaataagaactgtatatggcagcttgtcgccccgactcagtatcgaattagtcttcagtttgatttctttgagaccgagggaaatgacgtctgtaagtatgacttcgtggaggttaggagcggcctgactgcagactctaagttgcatggaaagttctgcggaagtgagaagcctgaggtcattacttctcagtataataatatgcgggtagagttcaagtcagacaatacagtgtcaaagaaaggctttaaggcccactttttctccgaaaaacgtcccgcgcttcagcccccccgcggccgtccacaccaactcaaattccgcgtgcaaaagcgcaatcgcaccccacagtag

SEQ ID NO: 14073 - DNA, 2961 bp, Artificial Sequence
  Description of Artificial Sequence: Synthetic coding sequence
atgccaggcgttgccagattacctcttctactcgggctgctgctgttgcctagacctggccgtccattggacctggctgactatacttatgacctggctgaggaggatgattccgagcccctgaactacaaggacccttgcaaagccgcagcttttctaggcgacatcgccctagacgaggaggatctgcgggcgtttcaggttcaacaggctgtagacttgagaaggcataccgcacgaaagtcttccataaaggcagcggtgccgggcaacacgtccaccccttcttgtcagtccactaatggccagccgcaacgtggagcttgtggtaggtggcgcggtcgcagtcggtctcgccgcgccgcaacttctcggccggaacgcgtgtggcccgacggggtgataccgtttgtgatcggaggtaactttacagggtcccaacgagccgtgtttcggcaggcaatgaggcattgggagaagcatacttgcgtaacctttctggaacgcaccgacgaagattcttatatcgtcttcacctacaggccctgtggatgctgctcatatgtgggcaggagaggcggagggccccaggcaattagtatcggaaagaattgtgacaaattcgggattgtggtacatgagcttggccatgtagtgggattttggcacgaacacaccaggcccgatcgggatcgacacgtgtcgatcgtacgggaaaacattcaaccaggtcaggaatacaacttcttgaagatggaaccgcaggaagtagaaagccttggggagacttacgacttcgactccatcatgcactacgcaagaaacaccttctctagaggaatcttcctggataccattgtccctaagtatgaggtcaatggcgtgaagcctcccattggtcagagaacccggctctccaaaggcgatatcgcccaggcccgcaaactgtacaaatgtccagcttgcggcgaaacgctgcaggattcaacaggcaatttcagctctccggaatatccaaatggatactctgcccacatgcactgcgtttggcgcattagtgtgacccctggtgaaaagataatcctgaactttacatctctagacctgtacagaagtagactgtgctggtacgactatgtcgaggttcgcgacggtttctggcggaaggcacccctaaggggccgtttctgtggttccaagctacctgaacctatcgtcagcaccgactccaggttgtgggtggaattccgtagcagtagcaattgggtggggaaaggattctttgccgtatatgaggccatttgcggcggggatgtcaagaaagactacggccacatccaatcccccaactatcccgacgactatcgcccctcaaaagtctgcatctggcgaattcaggtgagtgagggttttcacgtaggtctgacattccaatcatttgaaatcgagcgccacgacagttgtgcttatgactacctggaggtgcgggatggccactctgaaagctcaacgctgatcggccgctattgtggctacgaaaagccagacgacattaaatccaccagctctaggctgtggctgaaatttgtgagcgacggttcgattaataaagctggatttgctgtgaattttttcaaggaggtcgacgagtgctctagacctaacaggggcggctgtgagcagcgctgcctcaatactctggggagttataagtgctcatgtgaccccggatatgaactggcacccgacaagcgccgctgtgaagccgcgtgcggaggattcctgaccaaactgaacgggagtattacttctcctggctggccaaaagagtacccacctaacaagaactgcatctggcagctggtggcccctacgcagtacaggatatctctgcaattcgattttttcgagacagaggggaatgacgtatgcaagtacgacttcgttgaggtgcgttcaggcctgaccgcagattcgaaacttcacggcaaattttgtggaagtgaaaaacccgaggtgataactagccagtataacaatatgagagtagagtttaaatcagataatactgtgtctaaaaaaggcttcaaagcccattttttttctgacaaggatgaatgcagcaaggataacggaggctgtcagcaagattgcgtcaacactttcgggtcatatgaatgccagtgcagatccgggttcgtgctccacgacaacaaacatgattgcaaggaggccgggtgcgaccacaaagttaccagcaccagtggaaccattaccagtcccaactggcccgataaatacccttctaagaaggagtgcacatgggcaataagctctaccccggggcacagagtgaaactcacttttatggagatggacatcgagagccaaccggagtgcgcttacgatcatctggaagtcttcgacgggagggacgctaaggctcctgtgcttggtagattctgcggctctaagaagcctgagccagtactcgctaccgggtcgcggatgtttctgcgcttctactctgacaactcggtccagagaaaaggattccaggcgagccacgcaaccgaatgtggaggccaggtgcgcgctgatgtcaagacaaaggatctgtactcacacgcccaattcggggataacaattaccccggaggcgtagattgtgagtgggtgatcgtggctgaagaaggatacggggttgagctggtgttccaaaccttcgaagtagaagaggaaactgattgcggatacgactatatggagctttttgacggctacgattctactgcgcctagacttggccgctattgcggtagtgggcctccagaggaagtgtactctgctggggattctgtgctggtaaaattccacagcgatgacaccatcactaagaaaggtttccacttgagatacacatctaccaagttccaggacacacttcatagccggaagtag

SEQ ID NO: 14074 - DNA, 909 bp, Artificial Sequence
  Description of Artificial Sequence: Synthetic coding sequence
atgccgggagtagcaaggctgccgcttctcctgggcctgctgctgctaccccgtcccggccggcccctggatctggcagactatacatatgatctagcagaagaagatgactctgaacctttgaattacaaagatccgtgcaaagccgccgcttttctgggcgatattgccttggacgaagaggacttgagggcctttcaagtccaacaggcagtcgatctcagacgccataccgcaaggaaatctagtatcaaggctgctgtgccaggtaacacgtccaccccctcatgtcaaagcaccaacggacaaccgcagaggggcgcttgcggtaggtggcgaggtcgctctaggtctagacgtgccgccaccagccggccagagcgggtgtggcctgacggtgtgatcccattcgtcatcggcggaaatttcacaggcagtcagcgtgcagtgtttaggcaggctatgaggcactgggaaaagcacacttgtgtcacttttctggaacggactgacgaagactcatatatagtatttacctaccggccctgcgggtgttgctcgtatgttggccggcgaggagggggcccacaggccattagcattggaaagaactgcgataaattcggaatagtggtccacgaactgggccacgtggtaggattctggcatgagcacacccggccggacagggaccgccatgtctctatcgtgcgggaaaacatacagccgggcgtcctccatagctcactcctccttctttcttgcgggtctagaaacggggcttcgtttccctgttcgctggaatccagtattcatcaggccctctgctggactgggcttttcttaaggccctcaccctttcccaggcttcctctggcagctcctcggacgctaagggcaggtgtgtag

SEQ ID NO: 14075 - DNA, 1869 bp, Artificial Sequence
  Description of Artificial Sequence: Synthetic coding sequence
atgcctggtgtcgcccgcctaccacttttactggggctgttactgctgccacgcccaggtcggcctctggaccttgccgactatacctacgatcttgccgaggaggatgattctgagccactgaactataaggacccatgtaaagccgcagctttcctgggggacatcgccctggatgaggaggatttgcgcgcgtttcaggttcaacaggcggtggatctgagacgacacactgctcgtaaatccagtatcaaggccgcggtaccaggaaatacgagtacaccaagctgtcagtctaccaatggccagccgcagcgcggagcctgcggtcggtggaggggcaggtctaggtcacgccgggccgcaaccagccggccagaaagggtatggccagatggtgtgatcccattcgtgattgggggcaatttcactggctcacagagagctgtgttcagacaggctatgagacactgggaaaaacacacttgcgttacatttctggaacgcaccgatgaagattcttacatcgtgttcacctaccgcccgtgtggctgctgctcctatgttgggaggcgcggcggcggaccccaggccattagtataggcaagaattgtgacaagtttggtattgttgtacatgaacttggacacgtcgtgggattctggcacgagcacaccagacccgatcgagacaggcatgtcagtatcgtccgcgaaaacattcaaccagggcaggaatacaacttccttaagatggagcctcaggaagtggagtcactaggggaaacctatgacttcgatagtatcatgcactacgcccggaacacatttagtcgcgggatttttttggacactatcgtgcccaagtatgaggtgaacggcgtgaagcccccaattggccagcggacccggctgtctaagggagacatcgcccaggctcggaaactctacaagtgccccgcctgcggggaaaccctgcaggatagcaccggaaacttttcctcccctgagtaccccaacgggtatagcgctcacatgcattgtgtgtggagaatttctgtcacgcctggcgagaaaattatactgaactttacgtcactcgatctgtatcgatcgagattatgctggtatgactatgtggaggtgagagatggcttttggaggaaagcacccctgagggggaggttctgtggctctaagttgcccgagcctatcgtctcaactgacagccgcctgtgggtcgagttcaggagcagctcaaattgggtgggcaaagggttttttgctgtgtatgaggctatctgcggcggagacgtcaaaaaggactacggccacatccagtctcctaactatccggacgattataggccttccaaggtgtgcatttggaggatccaagtgtccgagggcttccatgtggggttgacttttcagtccttcgagatcgagaggcatgattcatgtgcttatgattatctggaggtgcgcgacggacattctgagagtagcacactgatcggacggtactgcggatacgagaagcctgatgacattaaaagcaccagctcccgactgtggctgaagttcgtgagcgatggatctattaacaaagctggcttcgcagtgaacttttttaaggaggtggacgagtgcagtcggcccaaccgcggcggttgtgaacagagatgcctgaacactctcggatcctataaatgtagctgcgacccaggatacgagctcgccccagataaacgccgctgtgagggatgctatgaccttcaggtaggcaaacctctattatgggatcgacactgttttagactctctacgcacggtcccgagatgctgggaactgcactccgcggatag

SEQ ID NO: 14076 - DNA, 2472 bp, Artificial Sequence
  Description of Artificial Sequence: Synthetic coding sequence
atgcctggagtggcaaggctgcccctgcttttggggctacttctgctgccaagacccggtagaccgctggacctcgctgactacacttacgacctggctgaagaagacgattcagagcccctcaactataaagacccttgcaaggccgccgcctttcttggagatatagccctcgatgaggaggacctgcgggcgtttcaggtacaacaagcagttgacctccgaagacacaccgctcgcaaatcgtctatcaaagccgcagtgcccggtaatacttctactcccagctgccagtcaactaatggacaacctcaacgtggggcatgtggtaggtggaggggacgctcgaggagtagaagagccgccaccagcaggccagagagagtttggcccgatggagtcatcccattcgtgatcggtgggaatttcactggttcccaaagagcagtgtttcgccaagccatgagacattgggagaaacatacctgtgtgacttttctggaaaggacagatgaggattcttacatcgtgttcacataccgcccctgcggatgttgttcctatgtggggaggcggggaggcgggcctcaagcgatcagcatcgggaagaattgtgacaaatttggaatcgtggtgcacgagctgggccacgtagtaggcttctggcacgaacatacacgtcctgatcgagatcgccacgtatccattgtgcgggagaatatccagcccggtcaagagtacaattttttaaaaatggagccccaggaggttgagtctcttggggagacttacgatttcgatagtatcatgcattacgctaggaacactttctcccggggtatctttctggatacaattgttcctaaatacgaagtgaacggagtgaagccccccatcggacagcggacccggttgtccaagggagatatcgcccaggcaaggaaactgtataaatgcccagcgtgtggcgaaactttacaggatagcactggcaacttctcaagcccagagtaccctaacggatactctgcacatatgcactgcgtgtggaggattagcgtcacaccaggggagaaaatcatcctaaacttcacatctctggacttgtatcggtcaaggctgtgttggtacgactacgtggaagtccgtgacggtttctggagaaaagctcccctgagagggaggttttgtggctccaagttgccagaacctatcgtctccacagattctcgattatgggtggaatttagatcctcatctaactgggtaggtaaggggttcttcgcagtctacgaggccatctgcgggggtgacgtgaaaaaggattacggccacattcagtctcccaattaccctgatgactaccggccttctaaagtttgcatctggagaatccaagtctcggaagggttccacgtagggctgactttccagagtttcgagatcgagcggcacgactcctgtgcctacgattacctggaagtgagggatgggcattcggaaagcagtaccctgatcggcagatattgtggatacgagaagcccgatgatataaaaagcacttcatcccgattatggctgaagttcgtctcggacggtagcataaataaggctgggttcgcagtgaatttctttaaggaagtagacgagtgttcacgtcccaatcggggcgggtgcgagcagaggtgcctgaacacccttgggagctataagtgttcttgtgaccccggctacgaactagcccctgacaaacgcagatgcgaagcggcctgtggggggtttctgactaagctcaacggcagcataacgagtccaggctggccgaaagagtaccctcctaacaagaactgtatttggcagctcgtagcacccacccagtatcgtatttcactgcagttcgatttcttcgagacagaaggaaatgatgtgtgtaaatacgattttgtggaggtacgaagcggtctgaccgctgacagcaaacttcacggtaagttttgcggatcagagaaaccagaagttattacctcgcagtacaataatatgcgagtagagtttaaatctgacaacaccgtgagcaaaaagggcttcaaggcgcatttcttctcagtcctcgagggagccggcgatcggcattcacacctgtcaggcctggagctgttgctctgcccccacgccctagtggacaccgtcccagcaccgccctcagccctgcacggcgacacacacgcccacacccacacccacgtgcatacccactgtcccatcgctcaagaaacatgtcgcgggcccccactgggagcctcacggctgagtcctcaaggccccggacacctgactctcgccccacaggaaggcagttaccttgacttttgggacacacacaggggcgatcctaagccaaggcgtaggcgcaagagtttgaaaactttttcgttgacacccgctacttttcgtggaatatgggcactatag

SEQ ID NO: 14077 - DNA, 2193 bp, Artificial Sequence
  Description of Artificial Sequence: Synthetic coding sequence
atgcccggcgtcgcgcgcctgccactgctgctggggctgctgcttttgccaagacctggacgacctctggatctggcagattatacttatgacctcgctgaagaggatgattcagagcccctcaactataaggatccctgtaaggctgctgcattcctgggcgatatcgccctggatgaggaagatctgagagcattccaggtacaacaggcagtggaccttcgccgacatactgccagaaagtcgagtattaaagctgctgtgccaggtaatacttctaccccttcatgccagtcgacaaatgggcaaccacaaaggggagcttgcggtcgatggagggggcgctccaggtcccgaagagcagctacttcacggccggagcgggtctggcctgatggtgtgattcctttcgtaataggcgggaattttactggctcacagcgcgcagtgttccggcaggcaatgaggcattgggaaaaacacacctgcgtaacatttctcgagagaactgatgaggacagttatattgtcttcacctaccggccttgtgggtgctgttcatacgtggggaggcgaggtgggggtccccaggccatttctataggcaagaactgcgataagttcggaatagtagtacatgagctgggtcatgtggtaggattctggcatgagcacacaaggccagaccgtgatagacatgtctccatcgtgagggaaaatatacagcctggtcaggagtacaattttcttaagatggagccacaagaggtggaaagcctcggggagacctacgactttgattcaatcatgcactacgcccgcaataccttctctagggggatttttttggacaccatagtacccaaatatgaagtaaatggcgtgaagccgccgatcggccagaggaccaggttaagcaaaggcgacattgctcaggcgaggaagctgtacaagtgcccagcctgtggcgagacactgcaagattctactggaaacttttcctcacccgagtaccctaatgggtatagcgcccatatgcactgtgtgtggagaatttcggtgactcctggcgaaaagatcatccttaacttcacctctctggacctgtatagaagtcgactatgctggtatgactacgttgaggtgcgtgacggattctggcggaaggccccactgaggggaaggttttgtgggagtaagctgcctgagcccatcgtctctactgattcccgtctctgggtcgaatttaggtctagcagcaactgggtcggcaagggcttcttcgccgtttatgaggccatatgcggaggggacgttaagaaggactacggacatatccaaagccctaattacccagacgactatagaccgtccaaggtctgtatctggcgaattcaagttagcgagggtttccatgtgggactcactttccagtctttcgagattgaaagacatgacagttgtgcatatgactacctggaggtgcgggatggacattccgagagctcaactttaatcggacgttattgcggctacgagaagcctgacgacattaagtccacatcaagccggctgtggctcaaatttgtcagtgatggctctataaacaaggcagggtttgcagtgaacttttttaaggaagtggatgaatgctcaagacctaacagaggcggctgtgagcaaagatgcctcaataccctgggatcctacaaatgctcttgtgatcctggatatgagctcgccccagacaaacgcaggtgtgaggctgcctgcggagggtttctaaccaagctaaacggatctataaccagtcccggatggcccaaggagtatccacccaataaaaattgtatatggcaattggtcgcgcccacacaatataggatctcacttcagttcgacttctttgagacagagggcaacgatgtgtgcaagtatgactttgtagaagtgaggtcagggttgacggccgacagcaagctgcacggcaagttctgtggctctgaaaaacctgaggtgataacatcacagtacaacaacatgagggtggagttcaagagtgataatacggtatcgaagaaagggtttaaggcccactttttttctgaaaagaggcctgccctgcagccccctcggggaagaccccatcagttgaagtttcgcgttcagaagagaaatagaaccccacagtag

SEQ ID NO: 14078 - DNA, 1509 bp, Artificial Sequence
  Description of Artificial Sequence: Synthetic coding sequence
atgctgctgagaagcgctggcaagctgaacgtgggcactaaaaaggaagacggtgagagtaccgcaccaacaccccggccaaaggtgttgcgatgtaaatgccatcatcattgccctgaggatagtgtgaataatatctgcagcacagatgggtactgctttaccatgatcgaggaggatgatagcggcctcccggtggtgacttcaggctgtctggggctagaaggttcagactttcagtgtagagacacgccaatcccccatcaacgacgctccattgaatgttgcaccgagaggaacgagtgtaataaggatttgcacccgactcttccacctctgaagaatcgcgatttcgtggatgggcctatccatcatcgtgccctgctcatcagcgttaccgtgtgcagcctcctgctggtgttgatcatactcttttgctattttagatataagagacaggagacccggcctcggtacagcataggattagagcaagacgagacatatattcccccaggagaatctctcagggacctgattgagcaatcacaatcttccggctctggaagcggactgccactgttggttcaacgcaccatcgccaagcagattcagatggtcaagcagatcggcaaagggcgctacggcgaggtctggatgggcaagtggagaggggagaaggtagcagttaaagtgttcttcacgactgaagaagcctcctggttcagggagactgagatctatcagacagtcttgatgaggcacgagaatatacttgggttcatcgccgcggacataaaaggcacaggatcctggacacagctgtatctgattaccgactatcacgagaacggcagtctgtatgactacctgaaaagcaccaccctggacgcgaagtccatgttgaagctagcatacagctctgtgtctggcttgtgtcatctgcatactgaaatattttctacccagggaaagccggcaatcgctcatcgagatctcaaaagcaagaatatactggtcaaaaagaatggaacctgttgcattgctgacctgggactcgctgtgaagttcatttccgatacaaacgaagtggacattccccccaataccagggtcggaacaaagaggtatatgcctccggaggtgctggatgagtcactgaataggaatcattttcagtcttacataatggctgacatgtattcatttggcctcatcctgtgggaagtcgcaagaaggtgtgtgagtggaggcatcgtcgaagagtaccagctgccttaccatgatctcgtgccttccgacccaagctatgaagatatgagagagattgtatgcattaagaagctgagaccatctttccctaatagatggtcttcagatgagtgcctgcggcagatgggcaagctgatgaccgaatgctgggctcataaccctgcctcccgtctgactgcactcagggtcaagaagactctggctaaaatgagtgagtcccaggatattaagttgtag

SEQ ID NO: 14079 - DNA, 1509 bp, Artificial Sequence
  Description of Artificial Sequence: Synthetic coding sequence
atgttacttcgctccgcagggaagcttaatgtcggcacaaagaaggaggacggagagagcaccgctcctacaccaaggccaaaggtgctgaggtgcaaatgccatcatcactgtcccgaagacagtgtcaataacatctgctcaacggatggatattgttttactatgatcgaagaggacgatagcgggctgccagttgtaacttccgggtgcctaggcttggaggggtcggacttccagtgtagagacacccccatcccccatcagcgaagaagcattgaatgctgtactgagcggaacgagtgtaacaaagaccttcatccaacacttcccccactgaaaaaccgtgacttcgtcgacgggcccatacatcatagagctctcttaatttcagtaaccgtttgcagcctgctgctggtgctcatcattctattctgctacttccgatacaagcgccaagaaacacggccccgttactcaattgggctggaacaggatgaaacgtatataccgccgggcgaaagtttacgtgaccttatcgagcagtcccagagtagtggctcaggttctgggttgccacttctggttcagagaacgattgcgaagcagatacagatggttaaacagattgggaaggggagatatggcgaggtgtggatgggtaaatggcggggggagaaagtggctgtcaaagtgtttttcaccaccgaagaagcgtcatggtttagggaaacggagatttatcagactgtgttgatgcgccacgagaacattctcgggtttattgccgcagacatcaaaggcacgggaagctggacccagttatacctgatcacagattaccacgagaatggatccctctatgactatctgaaatcgacaactctggacgcgaaaagtatgctgaagttggcctactctagtgtatctggcctgtgtcatctgcacaccgaaatcttctcaacccaaggcaagccagccatcgcccacagggacctcaagtcaaagaatatcttggtcaagaagaatgggacatgttgcattgctgaccttggcctggccgtcaagttcatcagtgacaccaacgaggtggatattccacccaacactagggtgggaacaaagcggtacatgccccccgaggtgctagatgagtctttaaatagaaaccactttcagtcatacattatggccgatatgtatagctttggcctaattctctgggaggtggcccgcagatgtgtctcaggcgggattgtggaggagtaccagctgccataccatgatctcgtgcccagtgaccctagctatgaagacatgagggagattgtgtgtatcaagaaactgaggccctcgttccctaacagatggtcatccgacgaatgcctcaggcagatgggaaaacttatgacagagtgctgggcacacaatcctgctagccgtctcaccgctctccgagttaaaaaaacactggccaagatgtctgagtcacaggacatcaaactgtag

SEQ ID NO: 14080 - DNA, 1599 bp, Artificial Sequence
  Description of Artificial Sequence: Synthetic coding sequence
atgggctggctggaggagcttaactggcagttgcacattttcctgctcatacttctgtccatgcatacaagggcaaatttcctggacaatatgctgttgcgaagcgccggtaaactgaatgtgggcacaaagaaggaggatggggaatccacagcgccgacacctcgccctaaagtgctgcggtgcaagtgccatcaccattgcccggaggacagcgttaacaacatatgcagcaccgatggctattgctttacaatgatagaggaggacgactccgggttgccagttgtcacgtccggatgtctggggttggaagggtccgactttcaatgtcgtgataccccaatcccccaccagagaaggtcaatcgaatgctgcaccgagcgtaatgagtgcaataaagatctgcaccctactttaccgcccctcaaaaacagagactttgtggacggcccgattcaccatcgggccctgctcatctccgttacggtgtgctctctgctgcttgtgctcatcatcctgttctgctatttccgttataagcgacaggagacccgccctcggtattcgatagggctagagcaggatgagacctatattccacccggggagtctctccgggacctgatcgaacagagccagtcctccgggagcggctctggactcccgctgctggtgcagagaactattgccaagcagatccagatggtcaaacagatcgggaaggggcggtatggtgaggtgtggatgggcaagtggcgaggagaaaaagtggcggtgaaggtattttttactaccgaggaggcaagttggtttagggaaactgagatctaccagactgtactgatgcggcatgaaaatatcctgggtttcatagccgctgacattaagggcaccgggagctggacacagctttatctcatcactgactaccacgaaaatggcagtctgtatgattatttaaagtccacaactctggatgctaagagcatgctgaaactagcctatagttcagtgagcggtctgtgccacctccacacggagatttttagtacacagggcaagcctgcaatcgctcatcgggatctgaagtctaaaaatatactggtcaaaaaaaacgggacgtgctgcatcgccgatctcggcctggcagtaaaatttattagtgacaccaatgaagtcgacattcccccaaacactagagttggaactaaacgttacatgccacccgaggtgcttgacgaaagtctgaatcgaaatcattttcaaagctacatcatggccgacatgtactctttcggccttatcctgtgggaggtcgcaagaaggtgcgtgtctgggggaattgtggaggagtaccagctgccgtatcacgatctcgtccctagcgatccttcctatgaagatatgcgtgaaatcgtctgtattaagaagctccgtccctctttccctaatcggtggtcaagcgatgagtgcctgcggcagatgggtaagctcatgacagaatgttgggcacacaatcctgcctcccgcctgacagcacttcgggtgaagaagactttagccaaaatgagcgagtcccaagacatcaagctgtag

SEQ ID NO: 14081 - DNA, 345 bp, Artificial Sequence
  Description of Artificial Sequence: Synthetic coding sequence
atgctgctcaggtccgcagggaagcttaacgtgggaactaaaaaagaggacggagaatccacagcccccacccctcgccctaaggtgctgcggtgcaagtgtcatcatcactgccctgaggactcagtgaacaacatttgttctaccgatggctactgctttacaatgatagaggaggacgacagtggactgccggtagtgacgagtggatgtcttggtctcgaagggtcggacttccagtgccgcgtgcggacacttccctttctgattaaagaggatcaactaaatgcggcacagaagggaactaacgtgatcaaaacttatacactacactgcctccactag

SEQ ID NO: 14082 - DNA, 378 bp, Artificial Sequence
  Description of Artificial Sequence: Synthetic coding sequence
atgttactgcgttctgcaggaaaactgaacgtgggcactaagaaggaggacggggaatctaccgcccccactcctcgccccaaagttctgaggtgcaaatgccaccatcattgcccagaggactctgttaataacatttgtagtacagatggctactgttttacaatgatcgaggaggacgacagtgggcttcctgtggtgacatcaggctgtctcggtctggaaggcagcgattttcagtgccgcgacaccccaataccccaccagaggcggtctatagagtgttgtacagaacggaacgagtgcaacaaggaccttcacccaacactccctccgcttaaaaaccgcgacttcgtggatgggcccatccaccactag

SEQ ID NO: 14083 - DNA, 1509 bp, Artificial Sequence
  Description of Artificial Sequence: Synthetic coding sequence
atgctcctcagaagcgcgggcaaactgaacgtgggcaccaagaaagaggatggggaaagtactgctcctacccccaggccgaaggttttgcgttgcaaatgccaccaccactgccccgaggacagcgtgaataacatctgcagcacggatgggtactgcttcaccatgatcgaagaggacgatagcggcctgcctgtggtgacgagcggatgtctcggcctggaaggatccgactttcagtgcagagatacacctattccacaccagaggagaagcatcgagtgctgtacagaacgcaatgagtgcaataaggacttgcatcctactctcccaccccttaagaatagggacttcgttgacggccccatacaccatcgcgccctcctcatttctgtcaccgtctgctctctgttgttggtgctgatcatactcttctgctatttccggtacaaaaggcaggagacccggccaaggtattccattggcctcgaacaggacgagacatatattccccctggcgaaagcctgcgagatctaatagaacagtctcaaagctccggcagtggctctgggctgcccctccttgttcagagaaccattgcgaagcagattcaaatggtaaaacagatcgggaagggaagatacggagaagtgtggatgggaaaatggaggggagagaaggtagccgtgaaggtgtttttcacaacggaggaagcctcttggtttcgtgagacggaaatataccagactgtactgatgagacacgagaatattttgggcttcatagcagccgatatcaagggcacaggatcatggacccagctgtacttgattactgattatcacgaaaacggatcattgtacgattacttgaagtcaacgacacttgacgcgaagtccatgttaaagctcgcctatagcagcgttagcggcctgtgccacctacacacagagatattttcaacccagggaaaacctgctatcgctcaccgtgatcttaagtctaaaaacatccttgtgaaaaagaacggaacctgctgtattgccgacctgggcctggcagtgaagttcatttccgacacgaacgaggtggacatcccccctaatacaagggtggggacgaagcgctacatgcctcctgaggtcctggacgagtcgctcaatcggaatcacttccaatcatatatcatggccgacatgtactcctttggacttattctctgggaggtggctcgaagatgtgtgagcggaggcatcgtcgaggaatatcagctcccctatcacgatttagtgcctagtgacccctcctatgaggacatgcgagagatcgtatgtatcaagaaacttagaccatcattccccaacagatggagcagcgatgagtgtctgcgacagatgggaaagttaatgaccgagtgctgggcccacaaccctgctagcaggcttactgcacttcgggtgaagaaaacactggccaaaatgtctgagtctcaggatattaaattgtag

SEQ ID NO: 14084 - DNA, 1509 bp, Artificial Sequence
  Description of Artificial Sequence: Synthetic coding sequence
atgctgctcaggagtgctggtaagctgaatgtcgggaccaagaaggaggacggagagtccaccgcacccacccctcggcctaaggtcctccggtgcaagtgtcatcatcactgccccgaagactccgtaaacaatatctgcagtaccgatgggtattgtttcacaatgattgaggaagatgatagcggtttacccgtagtgacatctggttgtttggggctggagggctctgattttcagtgtagagatacgccaatccctcatcagcgacgctctatcgaatgttgtaccgagcggaacgagtgtaataaggaccttcatccaacacttccaccactcaagaaccgcgactttgtggacggacccattcaccatagggcccttcttatctccgtcactgtttgctcactgctcctggtgttgataatcctgttctgttacttcaggtacaagcgacaggaaacccgcccgcgatattccattggcctggagcaggacgagacatatatcccccctggcgaaagcctcagggatttgattgagcagtcccaatctagtgggtccggcagtggcctgcccctgctcgtccagaggacgattgcaaagcagatccagatggtgaagcagattggcaagggccggtacggagaagtctggatggggaagtggaggggggagaaagtcgccgtcaaagtgttcttcaccacggaagaggccagttggtttcgcgaaacagaaatctaccagacagtactgatgcgacacgaaaatatattaggcttcatagccgccgatattaaaggcaccggctcatggacccagctgtacttaattaccgactaccatgagaacggtagcctgtacgattatctgaagtcgaccaccttggatgcaaaatccatgttgaaattagcctattcctcggtctctgggctgtgccacctccacaccgagattttctctacacagggaaagcctgccatcgcgcatagagacctaaaaagtaagaatatcctggtgaaaaaaaacggaacttgctgtatagcggacctgggattggcagtaaagtttatctctgatactaacgaagttgacatcccaccaaatacccgcgtcggcaccaaaagatacatgccacccgaggtgctcgacgaatccctcaaccgcaaccacttccagagctacataatggcagatatgtactcttttggtctaattctctgggaggtggcccgcagatgcgtgtctggcggcatcgtagaggaataccagctaccttatcatgacttagtgccttcagacccttcttacgaagatatgagagagatagtttgcatcaagaaattacggccgtcatttccgaaccggtggagctccgatgaatgtctccgacagatgggcaaacttatgaccgagtgttgggcgcacaatcccgcctcaaggctcacagccctacgcgtcaagaaaacactcgcaaagatgagcgaatcgcaggacataaaactgtag

SEQ ID NO: 14085 - DNA, 1509 bp, Artificial Sequence
  Description of Artificial Sequence: Synthetic coding sequence
atgctgttgcgctctgccgggaagctaaacgtcggaactaaaaaggaggacggcgaatctactgcacctactccacggcctaaagtattacggtgcaagtgtcaccaccactgcccggaagacagcgtgaacaatatttgctctacagacgggtactgttttacaatgattgaggaagacgacagcggccttcctgttgtgacatcgggttgcctcggactcgagggatcagattttcagtgccgcgacactcctatccctcaccagaggagaagcattgagtgttgcaccgagcggaacgaatgcaataaggacctacatccaacgctaccccccctcaagaacagggatttcgtagatggtcctatccaccatagagctttactgatctccgttacagtttgctcccttctattggtgctcatcatactgttttgctactttcggtataagcgccaggagacaagacccagatactcgattggcctagaacaggatgaaacatacataccaccgggcgaatcacttagagatctgattgaacagagccagtcaagcgggagtggtagcggattgcctttacttgtgcagcggacgatagccaagcagatccagatggtgaaacagatcggaaagggacgttatggtgaagtatggatgggtaagtggagaggtgagaaggtagctgttaaggtgttcttcaccactgaggaggccagttggtttagagagaccgaaatttaccaaaccgtgctgatgagacatgagaacatcttaggttttattgccgcagacataaaagggacagggtcttggactcagttgtatctgattacagattatcatgagaatggatcactgtatgactacctgaagagcacaaccctggatgccaaatctatgctcaaactggcctactcatccgtgtccggcttgtgtcacctgcataccgagatattcagcacgcagggcaaaccagctattgcgcaccgtgacttaaaaagcaagaatatactggttaagaagaatggcacgtgctgtattgctgatttgggcttagcagtgaagttcatttctgacacaaatgaggtcgacatcccccctaatactagggtggggaccaagcggtatatgccccctgaggttctggatgaatctcttaatcgcaatcacttccagtcttacattatggcggatatgtattcattcggcttgattctgtgggaagttgcgaggaggtgtgtgagcgggggaatcgtcgaggagtatcagctcccataccacgaccttgtgccgagcgatcccagctatgaggacatgcgggagatcgtctgcattaaaaagctgagaccctcctttcctaaccggtggtcctcggatgagtgtcttcggcagatggggaaactgatgactgagtgctgggcccataaccctgcaagtcgccttacagcactgcgggtaaagaaaactctcgccaaaatgtctgagtctcaggacattaaactgtag

SEQ ID NO: 14086 - DNA, 4755 bp, Artificial Sequence
  Description of Artificial Sequence: Synthetic coding sequence
atgcggggccaggctgccgctccagggcccgtgtggattctcgctccccttctccttctactgctgctcctaggcagaagagcacgtgccgcagccggggctgacgcaggacccggccccgaaccctgtgccacattagttcagggtaaattttttggatacttttctgccgcagccgtgttccctgcaaatgcctcacggtgttcctggaccctgcgcaaccctgacccacgacggtataccctctacatgaaagtggcaaaggctcccgtgccgtgttcagggccagggagggttcgaacttatcaatttgatagctttctagaatctacacgtacatacctgggcgttgagtcattcgatgaggtgctgagactatgtgatccttccgccccactagctttcctgcaggcgagcaagcagtttttacaaatgcgccggcagcagccgccccagcacgatggactcaggccaagggctgggccacccgggcctactgatgatttcagtgtggagtacttagtcgtgggaaatcgaaatccctctagggcagcatgtcaaatgctctgtaggtggctcgacgcttgtcttgctggctcccgttcctcccatccttgcgggatcatgcagacaccctgcgcatgtcttggcggcgaggctggcggccccgctgccggacctctggcacctcggggggacgtctgcctccgcgacgccgtggccggaggtcccgaaaattgcctgactagcttaacccaagaccgcggcgggcatggagccaccggcggatggaagctttggagtctgtggggggaatgcaccagggattgcggcggtgggctgcagacaaggacaaggacatgcctgcccgctccaggcgtggaaggcggtgggtgcgagggtgtcttagaagaaggacgccaatgcaaccgggaagcatgtggtccggccggtaggaccagttcccgaagtcagtcactcagatcaacagatgctagacgaagagaggagctgggagacgagctacaacagtttggatttccagcaccccagacaggggacccggccgcggaagaatggtcgccttggagcgtgtgctcatccacttgcggcgagggctggcagactcggacccgtttctgcgtttcctcttcctactcaacacaatgttccgggcccctccgcgaacagaggctgtgcaataatagcgcagtctgtcctgtccatggggcgtgggacgagtggagcccgtggtccctctgttcatctacatgtggcagaggcttcagagataggacaagaacatgccgaccacctcagttcggtggtaacccttgcgaagggcctgagaagcagacaaaattttgtaacattgcattgtgtccaggcagagccgtggacggtaattggaatgagtggtcttcctggagtgcctgctcagcttcttgtagtcagggacgacagcagaggaccagggaatgcaacggcccatcttacggtggggcggagtgtcagggtcattgggtggagactagggattgtttcctgcagcagtgccccgtggacgggaagtggcaggcctgggcctcctggggcagctgtagcgtgacatgcggagctgggtctcaacggagggaaagagtgtgttccggcccctttttcggtggagccgcctgtcagggaccccaggatgaatatcgtcagtgcgggactcagagatgtccagaaccgcacgagatctgtgatgaggacaatttcggcgctgtcatttggaaggagacacctgcaggagaggtggctgcggtgcgttgccccagaaatgccaccggtctgatcttgagaagatgcgaattagatgaggaagggattgcttactgggagccaccaacttacattaggtgtgtttctatcgactaccggaacattcaaatgatgaccagagagcatctggctaaagcacagcggggcttacccggagaaggggtttctgaggtgattcagacgctcgttgagattagccaggacggcacatcatactcaggcgacctcctttctaccatcgatgtactgcgtaacatgacagaaatcttcaggagggcctactactctcctactcctggagatgtgcagaactttgttcagatactgagcaatctgttagctgaggagaacagagacaaatgggaggaggcccagttagccggccccaatgccaaggagctctttcggctcgtggaagacttcgtcgacgtgataggtttcagaatgaaagatctccgggatgcatatcaggtaacggataacctggtcctctctatccataaactgcccgcgtctggcgccacagatatatctttcccaatgaagggttggagggccactggtgactgggccaaagtcccagaggatcgcgtgaccgtgagcaaaagcgtgttcagcactgggctgactgaggccgatgaggcttccgtgttcgttgtcggcacagtgctgtacaggaacctagggtccttcctcgcgctgcagcgtaatactacggtgctgaactctaaagtgattagtgtcactgtaaagcctcccccgcggtcattacgaacccctctggagatcgagtttgctcatatgtataatggcaccacaaaccagacctgcattttatgggatgaaactgacgtgccctccagtagcgctccaccccagctagggccatggtcatggaggggctgtcgtacagttcctcttgatgccctgagaacaaggtgtctgtgtgaccgcctgagcacattcgcgatcctggcccaactgtcagccgatgccaacatggagaaagctaccctgccatcagtcactctcatcgttggttgtggcgttagcagtctgaccctgctgatgcttgtgatcatatatgttagtgtttggcgatatattagaagcgaacgatctgttatccttatcaatttctgcctttccattatctcaagtaatgcactgattctgattggccaaacacagactcggaacaaggtggtgtgtacactggttgctgcattccttcactttttctttctctcgtctttctgctgggtactcacagaggcttggcagtcatacatggcagtgaccgggcatctgagaaacagactcatccggaaaagattcctctgtctggggtgggggctgccagcgctcgttgttgcaattagtgtggggtttacaaaagctaaggggtactccacaatgaactactgttggctgtctctcgaaggtggattgctatatgcatttgtaggtccggcagctgcagtggtcctagtgaatatggtgatcggtatcctggtgtttaacaagctggttagcaaagacggaatcacagacaagaaattaaaggaaagggctggagcttccctgtggagctcgtgcgtcgtgcttcccctgctggctcttacgtggatgtcggctgttctagctgtcacagacagacgttccgccctgtttcagattttgtttgccgtctttgattctctggagggtttcgtgatcgtgatggtccactgcattctccgacgcgaagtgcaagatgccgtgaaatgccgcgtggtcgacaggcaggaagaggggaacggcgacagcgggggttccttccagaacggccacgcgcaactcatgacagacttcgaaaaggatgtcgacctggcatgccgcagtgttctcaataaagatatcgcggcctgccgcacagccactatcacagggaccttaaaaaggccaagcttgcctgaagaggaaaagctgaaactagcacatgctaagggaccacctaccaattttaattctctgcctgccaatgtgtccaaacttcacctgcatgggtcacctcgttatccaggcggtcctctgcctgacttccctaaccattctctgaccttaaagcgcgataaggcacccaagagttccttcgtcggggacggcgatattttcaagaagctggattctgagctgtctcgtgcacaggagaaagccctggatactagctacgtcatccttccaaccgccacagctaccctgcggccaaagcccaaagaagagcccaaatattccattcacatcgaccagatgccgcagacccggctgatccacctttccacggcccctgaagcttctttgcctgctcggagccccccctcccgccagccaccatccggagggccaccagaggcccctccggcccagccaccccccccccccccaccaccgccaccaccaccccagcagccacttccgccacctccaaacctagagcccgcacccccatccctgggcgacccaggggaaccagctgcacacccaggcccctccacaggccccagtaccaaaaacgaaaatgtcgccacgctctcagtgagctcgctcgagcgcagaaagtcccgatacgccgagctggatttcgagaagattatgcacacgcgcaaaaggcatcaggatatgttccaggacctcaatcgtaaactccagcacgccgcagagaaggataaagaagttcttgggcctgatagtaagccggagaaacagcagacccctaataaaaggccctgggagtctttacggaaagcgcatggcactcctacctgggtgaagaaagagctggaaccactgcaaccttcccctttggaattgcgaagcgttgagtgggaaaggtcgggtgctactatacccctggtgggccaggacatcatcgacctgcagaccgaagtgtag

SEQ ID NO: 14087 - DNA, 4755 bp, Artificial Sequence
  Description of Artificial Sequence: Synthetic coding sequence
atgagagggcaggccgccgcccccggaccagtgtggatcctggctcctctgctcctgttgctgctcctcctggggagaagggcgagagccgcagcaggagcggacgcaggtcccggacccgaaccctgcgccactttggtgcagggaaagttttttggttacttttcagctgctgccgtgttcccagccaatgcaagccggtgttcttggactctgcggaaccctgatccacggagatacactctgtacatgaaagtggccaaagctccagtgccttgcagtggaccaggccgggttcgaacttaccagtttgactccttcctggaatctaccagaacctacttaggcgtcgaaagtttcgacgaagtccttagactatgcgatccatccgctccccttgccttcctccaggcttccaagcagtttttacagatgcggcggcagcagcccccccagcatgatgggttgaggccccgggctggacctcccggccctaccgatgacttctcagttgaatacctagttgtcggaaatagaaatccttccagagcggcttgtcagatgctttgtagatggcttgacgcatgtctcgccgggagccgcagtagccatccttgcggtataatgcagacaccatgtgcatgcttaggcggggaagccgggggtccagccgccggacccctggcaccgagaggtgacgtttgtttacgcgacgcagttgccggaggacccgagaactgcctgacatctctgacccaggaccgcggcggccacggtgcaacgggaggatggaaactgtggtcactgtggggtgagtgcacacgggattgtggcgggggtctccagactagaaccagaacctgtctgcccgcacctggagttgagggtggcggctgtgagggagtgttagaggaaggacgtcagtgtaatagggaggcttgcgggccggcagggcggacatcatcccgatcgcagtccctgagatccacagacgctaggcgtagggaggagctgggggatgaactccagcaattcggatttcccgcaccacagacaggggatcctgctgcagaagagtggagtccgtggagtgtgtgttcctccacatgcggtgagggctggcagactagaacccgtttctgcgtgtcatctagttactctacacaatgcagcggccccttgagggaacagagactgtgcaataactctgctgtgtgcccagtccacggagcttgggacgagtggtctccctggagcctctgttcttccacctgcgggaggggatttcgcgatcgcacacgcacttgtagacccccccagttcggtggcaatccgtgtgaagggcctgagaagcagactaaattttgtaatatcgcactctgccccgggagggctgttgacgggaactggaatgagtggagctcctggtctgcatgcagcgcatcgtgcagccaggggaggcaacaaagaactagggagtgcaatggcccctcttatgggggagctgagtgtcagggacactgggttgaaacaagagattgcttcttacaacagtgtccagtcgatggcaaatggcaggcgtgggctagttggggctcttgttccgtcacctgtggcgctggcagccaacgccgagagagggtgtgtagcgggccattcttcggcggagccgcttgccaggggccccaagatgagtatcggcaatgtggaactcagcgatgccctgaaccgcatgaaatctgcgacgaggataacttcggcgctgtgatatggaaggaaactccagccggagaggtggccgcggtgcggtgtcctagaaacgccaccggcctgatactgaggcgctgcgagctggacgaagaaggtattgcctattgggaaccccctacctacattaggtgcgtgtctattgactatagaaacatccagatgatgacccgtgaacacctcgcaaaggcgcaacggggcctcccaggcgaaggtgtgtctgaggtaatccaaaccttggtagagatctcccaggacggtaccagttacagcggggatcttctgtccacaattgacgttcttaggaacatgacagaaattttcaggagggcctactattcaccgactcccggagatgtccagaattttgttcagattctcagcaacttgctagctgaggaaaatcgtgataaatgggaggaggcccagctggctggcccaaatgccaaagaattgtttaggttggtcgaggacttcgtggatgtcatcggattccggatgaaggatttgagggatgcataccaggttactgacaatctcgtcctgtctatacacaagttgccagcaagcggtgctacagatatttcctttccgatgaaggggtggagagccacaggcgattgggcgaaggtgcccgaggacagagtgacggtgagcaagtctgtgttcagcacagggctaactgaagctgatgaagcatccgtttttgtcgtggggacagtattatacaggaatctcggctcatttctagccttgcagcggaataccacagtccttaattcaaaagtcattagcgtgacagttaagccacccccacgtagcctgaggaccccactggagatcgagttcgctcatatgtataacgggacaacgaatcagacatgcatcctctgggatgagactgacgttccttcatcctctgcccccccccaactgggaccatggagttggcgagggtgtcggaccgttccactagatgcactgcgcactagatgcctgtgcgacaggctgagcaccttcgccattttggcacaactaagcgccgatgctaacatggaaaaggcaaccctgccatccgtgaccttgatcgtgggttgcggtgtaagttctttaactctgctaatgttggttattatctatgttagcgtgtggagatacattcgcagtgaacgcagtgttattctgattaatttttgcttgagcatcatatctagtaacgcacttatcctgatagggcagacccaaacgaggaacaaggtcgtgtgcaccttagtggccgcgtttctgcattttttcttcctgtcttccttttgctgggtgctcaccgaggcttggcagtcatatatggccgttactggacatctgagaaacaggcttatccggaaaaggttcttatgtctgggctgggggctgccggcattggtcgtggcaatcagcgtaggctttactaaggccaaaggttattcgaccatgaactattgttggctgtccctagaaggcggtctcctttatgcgttcgtggggccagcagctgcggttgttctggtcaacatggttattgggatcctggtgtttaataaattggtgagtaaagatggcataactgataagaaactaaaggagagagcaggcgcctcactgtggtctagctgcgttgtgctgcccctgctcgctctgacatggatgtcagccgttttggccgtaactgatagacgcagtgccctgtttcaaatcttgtttgctgtattcgattctctggagggctttgttatagtgatggtgcattgcattctccgtagagaggtccaggacgctgtaaagtgccgggtcgtggacagacaggaggagggtaacggcgatagcggaggaagttttcagaacgggcatgcccagttaatgacagattttgagaaggatgtcgatctcgcctgccggagcgtcctgaataaggatattgctgcctgtagaacggcaacaatcactggcaccctgaaaagaccttcactgccagaagaggagaagttgaagctggcccacgccaagggtccaccaaccaacttcaacagcttacctgcaaatgtgtctaaacttcaccttcatgggtcacccaggtatcctggcgggcccctgcccgactttcctaaccactctttaactttgaagcgggacaaggcccccaaaagctcgttcgttggagacggcgacatttttaagaaactggactccgagctgagtcgagcgcaagagaaagctctagatacatcctatgtgatactgccaactgcaaccgccacactgcggccgaaaccgaaggaggaacccaaatacagcattcatatcgaccagatgccacagacacggttaatacacctgagtactgctcccgaagcttctcttcctgctcgcagcccaccttccaggcagcctcctagcggaggtcccccagaggcccccccagcccagcctcctcctcctcctccccctccaccgccccctccgcagcagccactgccccccccacctaacctggagcccgctcccccctctctcggcgatcccggggagcctgctgcacaccctggccctagcacaggtccatcaactaaaaatgaaaacgttgccaccttatccgtgtcttccctagagagacggaaaagccgctatgcggagcttgacttcgaaaagatcatgcatacaaggaagaggcatcaggacatgtttcaggaccttaatcgcaagctgcagcacgccgctgagaaggacaaagaggtgctgggtcctgacagcaagcccgaaaaacaacaaacacctaataagcgcccttgggagtctctgcgcaaggcgcacggaacacccacttgggttaaaaaggagcttgagccattgcagccatcccctctggagctgcgtagtgtagaatgggagcgttcaggcgcgacaattccactggtgggacaagacataattgatttacagaccgaagtctag

SEQ ID NO: 14088 - DNA, 2334 bp, Artificial Sequence
  Description of Artificial Sequence: Synthetic coding sequence
atgcccgataatcgtcagccccggaatcgacaaccgagaatccgctccggaaacgaaccacgttcagcacctgctatggaacccgacggtcgtggcgcgtgggcacattcaagagcagcattagatcggctagagaaactccttagatgcagccgatgtacgaatatccttcgtgagccagtttgtctcgggggatgcgagcacattttctgctccaattgcgtgagcgattgcatcggtaccggctgtcctgtgtgctacacccctgcctggatccaggacctcaagattaacagacagctcgacagtatgattcaactgtgttctaagctccgtaatcttctccatgacaacgagctcagcgacttgaaggaagataagccaagaaagagtctgttcaatgatgcgggcaataaaaaaaattcgatcaagatgtggtttagcccacgcagcaagaaggttaggtatgtcgtgtccaaagcctcagtccagacccagcctgccattaagaaggatgcttccgctcagcaggactcttatgagttcgtctccccctcacccccggccgacgtttcagagagggctaagaaggcctctgctagatccgggaaaaaacagaagaaaaagaccctggcggaaataaaccagaaatggaatttagaggctgaaaaagaagatggagaattcgactctaaagaagaaagcaagcagaaacttgtgtccttctgttcccaacctagtgtaatcagcagcccacaaattaacggtgaaattgacctgctcgccagcggcagcctgacagaatctgagtgttttgggtctctcaccgaagtttcattgcccctggctgaacagatcgagtctcccgacacaaagagtcgaaatgaagttgtcacaccggaaaaggtgtgcaaaaactacttaacgtccaaaaagtcactccctctcgagaacaacggcaaacgaggacaccacaacaggttaagctcgccgatatcaaagcggtgcagaacatctattctgtctacaagtggcgacttcgtcaagcagacagtgcccagtgaaaacattccactccctgagtgctcgagtcccccttcttgtaaacggaaagtgggcggaacgagtggtcggaagaatagtaatatgtctgacgagttcatcagtctatcacccggaacgcccccctctaccctttctagctctagttatcgtagagtcatgtcatctccatctgccatgaagctcctgcccaatatggctgtgaaacgtaatcacaggggagaaaccctcctccacatagcttctattaaaggggacattccctctgtggagtacctgctacagaacgggtctgatccaaacgtgaaggaccacgctggttggacgccactgcacgaagcctgcaaccacggtcacctaaaggtggtcgaactgctgctacaacacaaagcgcttgtgaatacgaccggctaccaaaatgattccccactgcatgatgccgcgaagaacggccacgtagatatcgtcaagctgcttctgtcctacggggccagtagaaatgcggtaaatatattcgggcttcgtcccgtcgactatactgatgatgagtcaatgaagagtcttttattgttaccagagaagaatgagtcctcctccgctagtcattgtagtgtcatgaacactggacaacggagggacgggccgctggtcctcattggttccgggctgtcttccgagcagcagaaaatgctgtctgagctcgccgtgatcctcaaggcaaagaaatacaccgagtttgattccactgtgacccacgtggtggtgcccggtgatgccgtacagtcgaccctgaaatgtatgctggggatattgaatggctgctggatccttaagtttgagtgggtgaaggcctgcttgcgtaggaaggtctgcgagcaggaggagaaatacgaaattccagaaggtccacgccgttcccgcctcaatcgggaacagctgctaccaaagctatttgatggctgctacttctacttgtggggaacctttaagcaccaccccaaagataacctcattaagcttgttactgctggcggtggccagatcctctcccggaaaccaaaacccgattccgacgttacacagaccatcaataccgtagcgtaccacgcacggcctgattcagatcagcgcttttgcacacagtatattatttacgaggacttgtgtaattatcaccccgagagagtgcgccaaggaaaggtctggaaggccccctcaagttggttcatcgactgtgtcatgagttttgaactacttccccttgattcctag

SEQ ID NO: 14089 - DNA, 1704 bp, Artificial Sequence
  Description of Artificial Sequence: Synthetic coding sequence
atgtggttctcaccaagatctaagaaagttcgttatgtcgtgagcaaggctagcgttcagacccagccagcaatcaaaaaggatgcctcagcccaacaggattcctatgaattcgtcagcccctctccgccagctgacgtgtccgaacgcgctaaaaaggcatctgctcggagcgggaagaagcagaaaaaaaagaccctcgccgaaattaaccagaagtggaatctggaggctgaaaaagaagacggagaattcgattctaaagaagaaagcaaacagaaactggtcagcttctgctctcagccttctgtcataagcagtcctcagataaacggcgaaatcgatctgctagcctctgggagcttgaccgagagcgaatgcttcggaagcttgaccgaggtcagcttgccgctggccgagcagatcgagagccctgacactaaaagccgtaacgaagttgtaactcccgagaaggtttgcaagaactacctaaccagtaagaagagtctgcctctggagaacaatggaaagcggggacatcataaccgactctccagtcctatctcaaaacgctgtagaacctccattctgagcacatcaggggatttcgttaagcagacagtcccctccgagaatattccactcccagagtgctcttcaccacctagttgtaagcgcaaagttggcggaaccagtggcaggaagaactctaacatgtcagacgaattcatttccctctctcctggcacccccccctcgactctgtcctcaagctcttacaggagggtaatgtccagcccttcagctatgaagctcctgcccaatatggcggtgaagcgcaaccatcgcggagagacactcctgcacatcgccagcatcaaaggggacattccaagcgtcgagtacttgcttcaaaacggtagtgatccaaatgtgaaagatcatgccggctggaccccactgcacgaagcctgcaaccacggacacttgaaagtggtggaactcctgctgcagcataaagcccttgttaacacgacaggctatcagaacgattcccccctgcacgacgctgccaagaatggccacgtggatatagtgaaattgttgctcagttacggtgccagtagaaatgccgtgaatatctttggccttcgccccgtagattacacagacgatgaatccatgaagtcactgctgctcctcccagagaagaacgaatcatcttccgcatcccactgttctgtgatgaataccgggcagcggcgggacggcccacttgtgctcatcggcagcggtctctcttctgagcagcagaagatgctctccgaactggccgtgatcttaaaagcaaaaaagtacaccgagtttgacagtacagtgacccacgtcgtggtccccggcgacgccgtccaaagtacgcttaagtgtatgcttggcatcctaaacggatgttggatccttaagtttgagtgggtgaaagcctgcttacggagaaaagtttgtgagcaggaagaaaagtatgaaattcccgaggggccacggcgctcaaggttgaatcgggagcactgccaaagctgcctgatggacgccaccagtatttgcggtgagccgtcgaacacaattcagcgaaccacattgctgtcatcatctctgcaggtgggcgccaggagtagtgtcgaaagcccttcccagaccgttacttag

SEQ ID NO: 14090 - DNA, 3750 bp, Artificial Sequence
  Description of Artificial Sequence: Synthetic coding sequence
atgagttccatgtggtctgaatatacaatcgggggcgtgaaaatctactttccatataaggcctacccttcccaacttgccatgatgaactcgattttgagaggcctgaactccaagcagcattgcctgttggaatctcccacagggtctgggaagagcctagcgttactgtgttccgcactcgcctggcaacagtctctgtctggaaagcctgcagacgaaggcgtatcagaaaaggctgaggttcagctctcttgctgctgtgcctgccacagtaaggatttcacaaataacgacatgaaccagggcacctcacggcattttaattatccctcgacaccgccatccgaacgcaatggcacaagctcaacttgtcaagatagtccggagaagaccacgctagccgctaaattatccgcaaagaagcaagcatctatctatagagacgaaaatgacgattttcaggtagagaaaaaaagaattaggcccctggaaaccactcagcagattaggaagcgacactgctttggtactgaagttcacaatctcgatgcaaaagtagactctggcaagacggttaagttaaattctccccttgagaagataaactctttctccccccagaaaccccctggccattgtagccggtgctgttgctccaccaaacagggcaactcccaggaaagttccaataccatcaagaaggaccacactgggaagtccaagatacccaaaatttactttggcacgcgaacccacaagcagatcgcgcagatcacacgggagctgagaagaacagcctatagcggtgtccctatgacaattctgagctccagggaccatacttgtgtgcatccagaggtggtcggtaacttcaaccgcaacgagaaatgcatggagctgctggacggaaagaatggaaagagttgttatttttaccacggagtccataagatttcagatcagcacactctgcaaacatttcagggaatgtgcaaggcgtgggacattgaggagctcgtgtcgctcgggaagaaactgaaggcctgtccatactacactgccagggagctgatacaggacgcggatatcatattttgcccctacaattacctgctcgatgctcagatacgggagtccatggacctgaacttgaaggaacaggtggtcatcctagatgaggcccacaacattgaggactgcgctagagagtccgcctcgtatagcgtgacggaggtccaactcaggttcgctcgggacgaactggattccatggtgaataacaatatccgtaagaaagaccatgagccactccgcgctgtatgttgttcactgataaactggctggaggccaacgcggagtatctggtggagcgggactacgagtcagcgtgtaaaatttggagtggaaatgagatgctcctgaccttacacaagatgggtattacaactgccacatttcccattttacaaggacacttcagcgccgtgttgcaaaaggaggaaaaaataagcccaatctacgggaaagaggaggctcgcgaggtgcccgtcattagcgcaagcactcaaattatgttgaagggtctcttcatggttctggactatctgttccggcagaattccagatttgccgatgactacaagattgccatccaacagacctattcgtggacaaatcagatcgatattagtgataaaaatggtctgctggtgctgccaaaaaataagaagaggtcgcgccagaaaaccgcggtccacgtgctaaacttttggtgtctgaacccggccgtggccttttccgatattaatggtaaggtgcagacaatcgtcctgacgagtggcactctgtcccccatgaagtccttcagcagcgagttgggggtcacattcacaatccagcttgaagcaaaccacatcatcaagaacagccaagtgtgggtggggactatcggcagcggacccaagggccggaatctgtgtgcaaccttccagaataccgagacattcgagtttcaggacgaagtgggggctctgttgttgtccgtttgccaaaccgtgtctcagggtattctgtgcttcctgcccagctataagctgctggaaaaactgaaagagcgctggctctccaccggcctttggcacaacttagagctcgtcaagactgtgattgtggagcctcaggggggagagaaaactaatttcgacgagctcctccaggtctattacgacgcgatcaagtacaaaggcgagaaggacggcgccttgcttgtcgccgtgtgccgcggcaaggtgtccgaaggcctggattttagtgatgacaatgctagagcagttattacaatcgggatcccattccctaacgtgaaggatctacaagtcgagctgaaacgtcagtataacgaccaccatagtaagctacgaggattgctccccgggcgccaatggtatgagattcaagcttacagagcactgaatcaggctcttggcagatgcattcgacacagaaacgactggggcgctctgattctagtcgatgaccggttcagaaataatccttctaggtatattagcgggctgtctaagtgggtcaggcagcaaatacagcaccacagcacctttgagtccgccctagagtctttggcagaattttcaaaaaaacaccaaaaagtcctgaatgtgtccataaaggataggactaatatccaggataatgaatcaacgctagaggtgacctctctgaagtattcgacctccccatatctcctggaggcagccagccacttgtctcccgagaattttgtggaagacgaggcaaagatttgtgtgcaggagctgcaatgcccgaaaattatcactaaaaatagtcctcttccttcgagcatcatttcaaggaaagaaaaaaatgacccagtctttctggaggaagccggtaaagctgagaagatcgtcatttctcggagcacttctccgacattcaacaagcaaacaaagcgtgtcagctggtcttcctttaactccttgggccagtatttcaccggcaagatccccaaggcaacccccgaacttggctcgtccgaaaattcggcaagttcaccaccacgcttcaagactgagaaaatggaatccaaaaccgtgctcccttttactgataagtgcgaaagcagcaacctgaccgttaatacaagcttcgggtcatgtccccagagcgaaaccatcattagctcccttaaaatcgacgcaactctgacccgaaagaatcatagcgaacacccactgtgctccgaggaggccctcgatccagatatagagctcagcttagtaagtgaggaggacaagcagtctacctcaaatagagatttcgagacagaggctgaggacgagtccatctacttcacacccgaattatacgatcccgaggacactgacgaggagaagaatgacctcgctgaaacagacaggggtaacaggctggctaataattcagattgcatcctggccaaggatctatttgaaatcagaaccatcaaggaagtggattcagcgcgagaagtgaaggccgaggattgcatcgacacgaagctaaacggcatccttcacattgaagagtcgaagatcgatgatatcgatgggaacgtgaaaaccacgtggatcaacgaactggaactgggtaaaacgcacgaaatagagattaagaactttaaaccttctccgagcaaaaataaaggcatgttccccggatttaaatag

SEQ ID NO: 14091 - DNA, 945 bp, Artificial Sequence
  Description of Artificial Sequence: Synthetic coding sequence
atggcaagcaggtcaaaaaggagggccgtcgagtcaggtgttcctcagccccctgacccgcccgtgcagcgggacgaggaagaagagaaggaagttgagaatgaagatgaggacgatgatgactctgataaggagaaggacgaagaggatgaagtaattgatgaagaagtcaatattgagttcgaggcttactctctgtctgacaacgactacgatgggattaaaaaattactgcagcagctgtttctcaaagcacctgtcaacaccgcagaactaactgacctccttattcagcagaaccacattggttccgtgatcaaacagaccgatgtatctgaagatagcaacgacgacatggacgaggacgaagtgtttggctttatcagtttgctcaatctgaccgagcggaaaggcactcagtgtgtcgagcagatacaggagttggtcctccgcttctgtgagaaaaattgcgagaaatcgatggttgagcaactggacaaattcctcaatgatacgaccaaaccagttgggttgctgctaagtgagcgttttatcaacgtgcctccacagatcgctctccccatgtaccagcagcttcagaaggaactagccggcgcgcatcggaccaataagccttgtggcaagtgctacttctatctgcttatctctaagacttttgtcgaggcaggaaaaaacaatagtaaaaaaaaacccagcaacaaaaaaaaggcagctctcatgttcgcgaatgccgaagaggaatttttttacgaaaaagccattctgaagttcaattattccgtacaggaagagtccgatacctgcctgggggggaaatggagcttcgatgatgtgccgatgacccccttgcggacagtgatgttaattccaggggataaaatgaacgaaattatggataaactcaaagagtatctgtctgtgtag

SEQ ID NO: 14092 - DNA, 879 bp, Artificial Sequence
  Description of Artificial Sequence: Synthetic coding sequence
atggcatcgcgtagtaaacgtagagcggtcgagagtggcgtgccacaacccccagatcccccagtgcagcgggacgaggaggaggagaaagaagttgagaatgaggacgaggacgacgacgactctgacaaagagaaagacgaggaagatgaggtcatcgacgaagaggttaatatagagttcgaagcttacagtctatctgacaacgactacgatggaatcaagaaactgctgcaacagctgtttcttaaagctccggttaacaccgctgaattgaccgatctcctaattcaacagaatcacatcggctcagtgattaagcagaccgacgtttctgaagattcaaatgatgacatggacgaagatgaggtgttcggttttatttcactccttaatctgaccgagaggaaaggaacccagtgtgtggagcagattcaggagctcgtactgcgattctgtgaaaaaaactgtgaaaaatccatggtagagcagcttgacaaatttctgaacgataccaccaaacctgtggggctgctgctgtccgagagattcattaacgtacccccccagatcgccctcccgatgtatcagcaactgcagaaggaactggccggtgcccacaggaccaacaaaccttgcggtaaatgctacttctacctgctcatttctaagacgtttgtcgaagctggcaaaaacaattctaagaaaaagccttccaataaaaagaaagccgccctgatgtttgctaatgccgaggaagagttcttttatgaggagcagggaaaaccggaagtgcttggaggccccgacacccgcagggggctcgagcctgtaccaatacagcataatgggtggagcgtacctccagtgctcgaatag

SEQ ID NO: 14093 - DNA, 969 bp, Artificial Sequence
  Description of Artificial Sequence: Synthetic coding sequence
atggcctctaggtcgaaacggagagctgtggagtccggagtaccccaaccccccgatccaccggtgcagcgggacgaggaggaagagaaagaagtcgagaatgaggacgaggatgatgatgactcggacaaggaaaaggacgaagaagatgaggtgatcgacgaggaggtgaatatcgaatttgaagcatactccctgtctgacaatgactacgatggtataaagaaactgctccaacaattatttttaaaggccccagtaaacactgcggaactgactgatcttcttatacagcagaatcacatcgggagtgtgattaagcaaacagatgtgagcgaagactccaatgacgacatggacgaggatgaggtattcggctttataagcttgctgaacctaacagagcgaaaggggacgcagtgcgtcgaacagattcaggagttagtgctgcgtttctgcgagaaaaactgcgagaaatctatggtggaacagttagataaattcctcaatgataccaccaaacctgttggcttactgctgtctgagagattcatcaatgtccccccacagattgcgctcccgatgtaccagcaactgcaaaaagaactggccggggcacatcggaccaacaagccctgtggcaagtgttatttttatttgctcatctccaagacatttgttgaagcaggcaagaataacagcaagaaaaagccatccaacaaaaaaaaagctgctctgatgttcgccaacgctgaagaggaattcttctacgaagagcaagggaagccggaagtactgggtgggccggacacccgccggggtctcgaacccgtcccaatccaacataacggaggaagccgaggccaggttacggctctcgtctctctgaaagccggactgattcagtcaagaagtaccctatccgacttccaggggaccttcatgacagttgggatcgctttaagctag

SEQ ID NO: 14094 - DNA, 879 bp, Artificial Sequence
  Description of Artificial Sequence: Synthetic coding sequence
atggccagccgaagtaagcgcagagcggtggaatccggagtacctcagcctccagacccgccggtgcagagagatgaagaagaggagaaagaagtcgaaaacgaagatgaagacgatgatgactctgataaagagaaagatgaagaagatgaagttatcgatgaagaggtcaatattgaattcgaggcctacagtctcagcgataacgattatgacggcatcaaaaagttacttcagcagttatttctgaaagctcctgtgaacacagccgagttgacagatctgctgattcaacagaaccacataggttccgtaattaagcagacggacgtgtcagaggatagtaacgacgatatggacgaggatgaagtcttcggattcatcagtttgctcaacttgacggaaaggaagggcacccagtgcgtggaacagatacaggagcttgtgctgagattttgtgagaaaaattgtgaaaagagcatggtcgagcaactggataagtttcttaacgatacgaccaagccagttggcttactgctgtccgagcgatttatcaacgtgccacctcagatagccctgccaatgtatcagcagctacagaaggagctggctggcgcccataggacgaacaagccctgcggaaagtgttacttctatttgttgatctccaagacgttcgtcgaagccggcaaaaacaattcgaaaaagaagcccagcaataagaaaaaggcagcattgatgtttgcaaatgccgaggaagaatttttttatgagaaggccatcttaaagttcaattactccgttcaagaagaatccgacacttgtctgggtggaaagtggagcttcgacgattggagtgtccccccagtgctggagtag

SEQ ID NO: 14095 - DNA, 789 bp, Artificial Sequence
  Description of Artificial Sequence: Synthetic coding sequence
atggctagtcgctctaagagacgtgccgtagaaagtggcgtcccacaacccccagatcccccagtccagcgcgatgaggaggaggagaaagaggtagagaatgaagacgaagacgatgatgattctgacaaggagaaggacgaagaagacgaggtaattgatgaggaggtcaacatcgagtttgaagcatactccctgtcggataacgactacgatggcatcaaaaaactgcttcagcagctgtttctgaaggccccagtgaacacggcggaactaacggatctacttatccagcaaaatcacattggatccgtcatcaaaggcactcaatgtgtggaacagatccaggaattagtgctgaggttttgtgagaagaattgcgaaaagtccatggtcgaacagctcgacaaattcttgaatgacactaccaaaccagtgggactgctgctgtctgaaaggtttatcaacgtccctccacagatcgccctgccaatgtatcaacagttacagaaagagttggcaggcgcgcatcgcacaaacaaaccatgcggcaaatgttacttttacttactcatcagtaaaacattcgtggaggctggtaaaaacaactccaagaagaagccttccaataaaaaaaaggcagccctgatgtttgccaatgccgaggaggagtttttctacgaagagcaggggaaaccagaggtgctgggtggacccgatactagacggggtctggagccggtcccaattcaacacaatggatggtccgtgcctcctgtcctcgagtag

SEQ ID NO: 14096 - DNA, 1398 bp, Artificial Sequence
  Description of Artificial Sequence: Synthetic coding sequence
atggtggaccccgtcgggttcgccgaagcctggaaggcacagttccccgacagcgagcctccacggatggagctgcgaagcgtaggagacatcgaacaagaactagaaaggtgtaaggcttctatccgccggttggagcaggaggtgaatcaggaacggtttcgcatgatttacttacagacactgttggccaaagaaaaaaagagctatgaccggcagcgctggggcttccgtcgggccgcccaggccccagatggagcgagcgagcccagagctagcgcatccaggcctcagcccgcacctgcagatggcgccgacccccccccagccgaagaacccgaggcccgaccggatggtgaaggatctcccgggaaagcccggccaggtacagctcggaggcccggcgcggccgcatccggcgagagggatgacagaggtccgcctgccagtgtcgccgccttgagaagcaatttcgagaggatacgcaaggggcacggtcagcccggggctgacgccgagaagcctttctacgttaacgtggagtttcatcatgaaagaggacttgtgaaagtgaatgataaggaggtgagtgatagaattagctccttggggagtcaggccatgcaaatggagcgaaagaagtcccagcacggagcaggtagcagcgtaggggacgcctccagaccaccataccggggaaggtcttctgagtcatcatgtggagtcgacggagattacgaagacgccgagctgaatcctagatttctcaaggataacttgatcgatgccaacgggggctcccgtcctccttggccgccactcgaatatcagccataccagtcaatttatgttggaggcatgatggagggcgaagggaaaggtccgcttcttagaagccagtctacctccgagcaggagaagcggctgacctggcccaggcggagctactctccaaggtccttcgaggattgtgggggcggctacactcctgattgcagcagcaacgagaacctgactagctccgaagaggactttagtagcgggcaaagttcccgtgtatcacctagtccgacaacttaccgaatgttccgagataagagcaggtcaccctcacagaacagccagcaaagctttgactcatcctccccccctactcctcaatgccacaagcgccatcgccactgtccagtcgtcgtgagcgaagcgacaatagttggagtcaggaagactgggcagatctggcctaatgacggggagggtgcttttcatggagagcaccccggcgctgccgaagaggtatttcaaaagctcttgcccgatatcagaggggcagctgacgccgatcagcttgtctgtgagacccctgattgccctcagcatagcgctgatcaccagtag

SEQ ID NO: 14097 - DNA, 1377 bp, Artificial Sequence
  Description of Artificial Sequence: Synthetic coding sequence
atggttgacccggtcggctttgcggaagcttggaaggcacagtttcctgattccgagccgccacggatggagctaagatctgttggtgacatcgagcaggaactggaacggtgcaaagcttccatccgaagactggagcaggaggtcaatcaggagagattcaggatgatttacttgcaaacactgttggccaaggaaaaaaaatcgtatgatcgccagcgttgggggttcaggagggccgctcaggccccggatggcgcctccgaacctcgcgcctccgcctctcgcccccagcctgcgcctgctgacggtgctgaccctcccccggctgaagagcccgaagcccggcccgatggcgagggaagtcccggcaaggctcgtcccggaacagctcgaaggcctggggcagcagcgtctggcgagcgagatgaccgggggccccccgcatccgtggcggccctcaggtccaatttcgagagaattagaaagggacacggacaaccgggggccgatgctgagaaaccattttacgtgaacgttgagtttcaccatgaacgagggctcgttaaagtgaacgataaggaggtgtctgacaggatctcatcactcggcagccaggctatgcagatggaaaggaaaaagagccaacacggagcaggcagctccgtcggtgatgccagcaggccaccatacaggggccgtagttctgaaagtagctgcggtgtagacggagattacgaagacgctgagttgaatcctagattcttgaaggacaatctgatcgacgcaaacggaggctccaggccgccttggcccccactggagtaccaaccctatcaatccatttatgtgggtggaatgatggaaggagagggtaagggaccacttttacggagccagagcactagtgagcaggaaaaaagactcacatggcccaggcggtcctactcgcctaggtccttcgaagactgtggcgggggatatactcctgactgcagttcgaacgagaacctgactagcagtgaagaggacttttcttccggccaatctagcagagtttcaccctccccgactacataccgcatgttccgggacaaatcccgaagccccagtcaaaattcgcagcagagctttgactcctcgtctccccctactccgcagtgccacaaaagacacagacattgtcccgtagtggtgtcagaggccaccattgtgggagttcgaaagacagggcagatctggcctaacgacggtgaaggagccttccacggcgacgccgatggctctttcggaacaccaccaggctatggatgtctctgtctgccagcctggccctccggttgtacagcagcgactgctagggttacacggagctag

SEQ ID NO: 14098 - DNA, 3816 bp, Artificial Sequence
  Description of Artificial Sequence: Synthetic coding sequence
atggtggatccagtgggatttgcagaggcttggaaggctcagttccccgacagcgaaccacctcgcatggagctgcgatcggtaggagatattgaacaagaattggagcgttgcaaagccagtatccggcgactggagcaggaggtgaatcaggaacgcttccgcatgatttacctacagacactcttggctaaggagaagaagtcctacgaccggcagcggtggggctttaggagagcggcccaggccccggacggcgcctctgaaccgcgagcgagcgcaagtcgcccccaacctgcacccgcagatggtgcagatcccccgcccgccgaagagccagaggcccggccagatggcgagggctcaccagggaaagcccggcccggaaccgcaagacgacccggagccgctgcctccggcgagcgcgatgacagaggaccgccagccagcgtggccgccttacgaagcaatttcgagagaatacgcaagggccacggccagcccggcgccgatgcagaaaagccgttctacgtaaatgtggaatttcatcatgagaggggtctggttaaggtgaatgataaagaggtatcagatagaatatctagcttagggtcccaagcaatgcagatggagcgcaaaaagtcccagcatggcgcaggctcctccgtgggtgatgcctcacgaccaccatataggggcagatcaagtgaatcatcctgtggggtagatggcgactatgaagatgcggaactcaatcctcgatttctcaaggacaacctgatcgatgcaaatgggggtagtcggcccccttggccgcccttggaataccagccctaccagtctatttatgtcggcggaatgatggagggggaaggcaaaggccccctccttcggagccagtcaacctcagagcaggaaaaacgcctgacctggccccggcgctcgtacagccctagaagcttcgaagattgcggaggggggtacacaccggactgttcaagtaatgagaacctcacttcaagcgaagaagattttagttctgggcagagttccagggtttctccatctcccaccacctaccgcatgttccgggataagagccggtccccctcacagaattcccagcagtcctttgatagcagttccccccccaccccacagtgtcacaagcgacaccgccattgtccagtggtggtgagcgaagctacgattgtcggcgttaggaagactgggcagatttggccaaatgacggcgagggagcctttcatggtgacgccgacgggtcattcggtacaccccccgggtatggctgcgcagctgaccgggccgaagaacaaaggagacaccaagatggattaccctatattgatgattcaccatcctcatccccccacctgtcctccaaaggacggggtagcagagatgctcttgtgagcggagctctcgagagcacaaaagctagcgagctggacctggaaaaaggcttggagatgagaaagtgggttctttccggcattctcgcctccgaggagacttatctcagccatcttgaagccctgttgctgccaatgaagccacttaaggccgccgctaccacaagccagcccgtcctcaccagtcagcaaatcgagacgatcttcttcaaagtgcccgagctctatgaaattcataaggagttttacgatgggttgtttcctcgggttcaacagtggtcacaccaacagcgcgtgggggatctcttccaaaagctggctagccagctcggagtgtatagagcctttgtggacaattacggcgtcgccatggaaatggcagagaaatgttgccaggcaaacgcgcaatttgccgaaatatctgagaacttaagagctcggtccaacaaggacgccaaagatcccacaactaagaattcattggaaaccttgctctacaagccggttgaccgagttacccggtccaccctggtgctccacgacctgctcaagcacacacctgcctcccaccccgatcaccccctgttgcaggacgccctcaggataagtcaaaattttctcagcagtatcaatgaagagataactccacgccgccagtcaatgacagtcaagaagggtgagcacagacagttgcttaaggactcttttatggtcgaacttgtggaaggggcccgtaagctgcgccacgtgtttctgttcactgatttattactttgcaccaaactcaagaaacagagcggtgggaaaacccagcagtacgattgcaagtggtacatcccgttaacagacctctcattccaaatggtggacgagcttgaggcggtgcccaatataccactggtccccgatgaagaactggatgcattgaagatcaaaatcagtcaaatcaaaaacgatattcaaagggagaaacgcgccaataagggttccaaagccaccgagagactgaagaaaaaactctctgaacaggagagccttctgttactgatgtccccgagcatggccttccgtgtccactctcggaatggaaagtcttacactttcctgatttccagcgactacgaacgcgcggagtggcgggagaacattagagagcagcagaaaaagtgttttagatcctttagtctgacgtcagttgagctacagatgctcacaaatagttgtgtcaaattgcagactgtgcatagcatccccttaactataaataaggaggacgacgagagccccggcctgtatggattcctaaacgtgattgtacactcagcaaccggctttaaacaatcaagcaatctgtactgtacgctagaggtcgactcttttggttatttcgtgaacaaagccaaaacaagggtttacagggacacagccgagccgaactggaacgaagaatttgaaatcgagttagagggttcccaaaccctccgcatcctatgctacgaaaagtgctacaacaagaccaagatccccaaggaggacggggaaagtacagataggcttatgggaaaagggcaagttcagttggatcctcaggcacttcaagatagagattggcaacggaccgtgatcgctatgaacggcatagaggtcaagcttagcgtaaagttcaatagccgagagttcagcctgaaacgaatgcccagccggaagcagacaggcgtctttggtgtgaaaattgcggtcgttactaaaagggagcgctcgaaggtcccatacatcgtcaggcaatgcgtggaagaaatcgagaggcggggcatggaggaagttggaatttatagggtttctggggtcgccaccgacatccaagcgctaaaagcagccttcgacgtcaacaacaaggatgtctccgttatgatgagtgaaatggacgttaatgccatagcgggaacacttaaactgtactttagggagctgccagaacctctctttacggacgaattttacccaaatttcgccgaggggattgccctaagtgacccggttgcaaaggaaagctgtatgctgaatctactgctgagccttccagaggctaatctgctgacatttttattcctgctggaccatttgaaacgagtggccgaaaaggaagcagtgaacaagatgtcattgcataacctcgccaccgtctttgggcccacgctcctcaggcctagtgaaaaggagagtaaacttccagcgaacccctctcaacccattaccatgacagacagttggtccctggaggtcatgtctcaggtgcaggtcctcttgtacttcttgcagctcgaagctatcccagcgcctgatagcaagaggcagtctatactattctccacagaggtttag

SEQ ID NO: 14099 - DNA, 2811 bp, Artificial Sequence
  Description of Artificial Sequence: Synthetic coding sequence
ccttcagctccccgggttagcaccgtgggactcttatgttccggtgcaggtccacacctctgcccctgcgcagaggagggaacggggggcctggagagccaaggggagatcatcccgtctcgggggtctagaaagccggacggtgtcagcggatcccgccgcttattcagcagcctgtgtaagtcccaagagggttcaagaaaagaatgcctgaggaaacaccgacggctaggccctgcaatgccagtttccagcccaggtttcccaggcccattggcacgcagtgaacaccatcttgataccgccgcactccagactggccagagatcctccgccggtacaaaaatgggatgtccaaccctgatgacccggccccctcacaggccgaccagcgccgcgagggccggggcggcaggcatgcgatggagcagagagccatggtcccctcttaagaggtctgagctggacttggaaaagggcctggaaatgaggaaatgggtgttatcaggcatcttagccagcgaagagacatacctgagccacttggaggccctactgctgcccatgaagcccctgaaggcggccgcaactactagccaaccggtgttgaccagccagcagatagaaaccattttttttaaggtcccagagttgtatgagatccataaagaattctatgatgggctcttcccgagagtacagcaatggagtcatcagcaacgggtaggagacttatttcagaaattggcctcacagctgggagtgtaccgggcattcgtggacaactacggggtggctatggagatggccgaaaagtgttgccaagccaatgcgcagtttgctgagatctcagagaacttgagggcacgatccaataaagacgccaaggatcctacaaccaagaactcgttggaaacattactgtataaacctgtagatcgggtgacgcgtagcacactggtgcttcatgacttgctgaaacataccccagcatcacatccagatcatccactgctccaggatgccctgcgtatctctcagaattttctttcctcaattaacgaagagatcactcccaggagacagagcatgacagtgaaaaaaggggaacacagacaactgctcaaggattcgtttatggtggagctggtagaaggggcccgtaaactacgacacgtcttcctgtttacagaccttttactgtgcacaaaactgaaaaagcaatctgggggcaagacccagcagtacgattgtaaatggtatattcctctcaccgatctgagctttcaaatggtcgatgagctggaggctgtgccaaatatcccactagtgcctgacgaggagttggacgccctgaaaattaaaattagccagataaaaaacgatatccagcgtgagaaacgggctaataagggctcaaaggcgaccgagcgcctgaaaaaaaaactgagtgagcaggaatctctgctgctgttaatgtccccttccatggcattccgcgtgcattctcgcaatggaaaaagttatacattcctcatctcaagcgattacgagagggcggaatggagagagaacatccgggaacagcagaagaaatgtttcaggagtttctcgctgacatctgtggagctccagatgctgacaaacagctgcgtcaagctacagaccgttcatagcatacccctcaccattaacaaggaagacgacgaatctcccggcctgtatggctttctgaatgtgatagtacattcagccactggttttaagcagtcctccaacttatattgcactctcgaggtagacagcttcggctactttgtaaataaggcaaaaacacgagtctatagagatacggctgaacccaattggaatgaagaattcgagattgaactggaagggagccaaacgttgcgtattctgtgttacgagaaatgctacaataaaactaagatccctaaggaggatggcgaaagtacagatcggttaatgggcaagggtcaggtgcaattagatccccaagccctgcaggacagggactggcagcggaccgttatagcaatgaatggcatcgaagtcaaactgtccgttaagttcaattcacgggagttctcactgaagaggatgccctctcgcaagcagactggagtgttcggcgtgaagatcgccgtggtgacaaagagagaacgttctaaggtcccctacattgttcgtcagtgcgttgaagaaattgagcggcgagggatggaggaggttgggatctaccgggtgagtggagtggccaccgatatacaagccctgaaggccgccttcgacgtcaacaataaggacgtttccgtcatgatgtccgaaatggacgttaacgccatcgcaggtaccttaaagctgtactttcgtgagctcccagaaccactcttcacagatgaattctatcccaatttcgctgagggaatcgccctctcagaccccgtcgccaaggaatcgtgcatgctgaatcttctactgtcactgcccgaggccaatttgctgactttcctgttccttctcgatcacctgaaacgggtggccgaaaaagaagccgtgaataaaatgagtctgcacaacctagccacagtttttggccccacactgctcagaccttccgaaaaagagtctaagttgccagcaaatccttctcagccaatcaccatgactgactcttggtcactggaagtgatgagccaagtacaggttctcctgtatttcctgcaactggaggccatccctgctccagattccaagcgtcaatccatactgttcagcaccgaggtctag

SEQ ID NO: 14100 - DNA, 3684 bp, Artificial Sequence
  Description of Artificial Sequence: Synthetic coding sequence
atggtggatccagtcggttttgctgaagcttggaaggcacagtttcccgacagcgaaccacctcgcatggagctgagaagcgtgggagatatagagcaagagttagagcgctgtaaagcatcaattaggaggcttgagcaagaagttaaccaagaacgatttcgcatgatctatttgcaaactctgctcgctaaggagaagaagagctatgaccgacagaggtggggttttcggcgggctgcccaggcccccgatggcgcctcagagccacgtgcttcagccagccgtccacagccggccccggccgacggagccgaccctcctcctgcagaggagcctgaagccaggcctgacggtgaagggagccctggcaaagcaagaccgggcactgccaggcgacccggggctgccgcatccggggaacgtgatgaccgcgggcctcccgcatcagtggccgccctccgctcaaatttcgagagaattcgcaaaggacacgggcagccaggcgctgatgcggagaaacccttctacgtcaatgtcgagtttcatcatgaaaggggtctcgtaaaagtaaatgataaagaggtctcagacagaatcagcagcctgggaagtcaggccatgcagatggaaagaaaaaagagtcagcacggcgccggttcttccgtcggagacgcaagtcggccaccgtacaggggcagaagtagcgaaagtagctgtggggtagacggagactacgaggatgccgaattaaacccgagatttctaaaggacaatctgattgacgccaacggcggttcaagacccccgtggccgcccttggagtatcaaccttaccagtctatttacgtgggtgggatgatggagggggaaggaaaggggcccctgttgcggtctcagagcacctccgaacaagagaagcggctgacttggcctagaaggtcttactcaccccgaagcttcgaggactgtggcgggggttatactcctgactgtagcagcaacgaaaatttgacatcctctgaggaagacttctcctccggtcaatcttcccgggtgagcccgtctccaacgacctatcgcatgtttagggataagagcagaagtccctcccaaaatagccaacaaagtttcgacagctcctccccgcctaccccccaatgccacaagaggcataggcattgccctgtagtggtttcagaggcaaccattgtgggggtgagaaaaaccggacagatttggcctaacgacggtgagggagcgttccacggcgatgcagatggcagcttcggcacgccccccggctacgggtgtgctgctgatagggccgaagagcagcgtaggcaccaggacggcctcccctacatcgatgatagtcccagtagttcccctcatctgagtagcaaaggaaggggcagccgcgatgccttggtgagtggagctcttgaaagtacaaaagcgagcgagctagacctcgaaaagggactcgagatgcggaaatgggtgctctcagggatcttggcttctgaagagacgtatctctcacacttggaagctctactgctccctatgaaaccgttaaaagccgccgcaactacctcgcagcctgtgctaacaagccagcagattgaaacgatattcttcaaggtgcccgaattgtacgagatccataaggaattctacgacggtctcttcccccgggtgcagcaatggtcccatcagcagcgggtaggagatttattccagaaactagcgagtcaactgggggtctacagagcgttcgtggacaactatggcgttgcgatggagatggcggaaaagtgctgccaggcaaatgcacagtttgccgagatctccgaaaatttgagagcacgctccaacaaagacgccaaggatcccactaccaagaatagcttggagactctgctttacaagcccgtcgaccgagtgactcggtcaaccctggtgcttcacgatctgctcaagcacacaccagcctcacatcctgaccacccacttctccaggatgcgcttcggatttcgcagaactttcttagctcgatcaacgaggagatcactccccggcgtcagtccatgactgtcaaaaagggcgagcacagacaactgctcaaggattctttcatggtcgagctcgtcgaaggagcccgcaaacttagacacgtcttcctcttcaccgatctcctgctttgtacaaaattaaagaagcagtccggggggaagacacagcagtatgattgtaagtggtacatccctcttacggatttgtcatttcaaatggttgacgagttggaagcagtaccaaacatccctctggtgcccgatgaagaacttgacgctctgaagataaaaattagccaaatcaaaaacgacattcagagagagaaaagagccaacaaagggtcaaaggcaacagaaaggctcaaaaagaagctgagcgaacaagaatctttattgcttttgatgtccccaagcatggcgttcagagtgcacagccgaaatggaaagtcttacaccttcctcatctcctccgattatgagagggctgaatggagagagaacattagagaacagcagaagaaatgtttccggtctttttctttaactagcgtggagttacagatgctgacaaatagttgcgttaaactgcagaccgtccacagcattccccttacaatcaacaaggaggacgatgagagtccagggttgtatggattcctaaatgtgattgtgcatagtgcaactggcttcaaacagtctagcaacttgtactgtactttggaggtggatagtttcggctatttcgtaaacaaggccaagactcgggtgtatagggatacggccgagcccaattggaacgagctggaccctcaggccctacaggacagagattggcagcgcactgtgatcgccatgaatggcatcgaggtgaagctgagcgtcaagtttaactcaagagagttcagcctcaagagaatgccttccaggaaacaaaccggagtctttggagtcaaaatcgccgtggtcacaaaacgcgagcggagcaaggtgccatacatcgtcagacagtgtgtggaagagattgaacgccgtgggatggaggaggtcgggatttacagggtgagcggagtcgcgacagatatccaggccttgaaggcggcattcgacgtcaacaataaggacgtatcggtcatgatgagcgagatggatgtgaatgccatagccggcactctcaagttgtacttcagggaactacccgagccactgttcaccgacgaattttacccgaattttgcagaaggtattgcactgagtgatccagtcgccaaagagagctgcatgcttaatctgttactctctctgcctgaagctaacctgctcaccttccttttccttcttgatcacctgaaaagagtggcagaaaaggaggctgtcaacaagatgtccttacataacctggcgactgtgttcggtccgacgctgctacgccctagcgagaaagagtcaaaattgccagcaaatccctctcagcccatcacaatgacagattcttggagtctagaagtgatgtctcaagtgcaggtcctcctgtacttcctacagctcgaggctataccagcaccagactctaaaagacagtctattctcttttctactgaggtgtag

SEQ ID NO: 14101 - DNA, 1404 bp, Artificial Sequence
  Description of Artificial Sequence: Synthetic coding sequence
atggttgatcccgtggggtttgccgaagcctggaaagctcagtttcccgacagtgagccgcccagaatggaactcaggagcgtaggagacatagaacaagagttggagaggtgcaaggcctccatccgccgacttgagcaggaggttaaccaggagaggtttcgcatgatttacctgcagacactgctggccaaagagaagaagagttatgaccgccagaggtggggctttcgccgggctgcacaagcacctgacggcgccagtgagcctcgcgcatccgcaagccgaccacagcccgccccggcagacggggcagaccctccacctgcggaagagccagaggcccgacctgatggcgaaggctccccagggaaggcacgtccaggcactgccaggaggccaggggctgctgcatctggcgagcgtgacgatagggggccacccgcttccgtcgccgccctgagaagtaattttgaacgtatccgcaaagggcatggccagccaggcgcagacgcagagaagccattctacgttaatgttgagttccaccacgagcgagggcttgtgaaagttaacgacaaggaggtatctgaccggatcagcagcctgggcagccaagcaatgcaaatggaaaggaaaaaaagtcaacatggagcagggagttcagtcggtgacgccagccgtcctccatataggggcagatcttcagagtcctcttgcggggtcgatggggattatgaggatgcagagctgaacccccggtttctgaaggataatctgatcgatgccaacggcggatctagacccccttggcctcccttagagtaccagccctatcagtctatttatgtcggagggatgatggaaggggaaggaaaaggacccctgctcaggagccagtctacctccgaacaggaaaaaaggctgacttggccgcggaggagctacagcccgagatcctttgaggattgcgggggcggatacacaccagactgttcttcgaacgaaaatcttacgagtagcgaggaggacttttcctcagggcagtccagcagggtgtccccttctccaactacctataggatgttccgggacaaatcccggagccctagtcaaaactcgcagcagagtttcgactccagcagccctccaaccccccagtgtcacaagcggcacaggcattgcccagtcgtcgtctcggaggctactatcgtgggggttaggaaaacagggcagatttggcccaatgatggggaaggcgccttccacggcgatgcagtgctaaagaccgaggtccctcatcagggtgtcaggcgggcccgcctctcactggaagcactgggagaagacccttcctttctcttccctgccagcgatggcccgagacattctagcacttggtag

SEQ ID NO: 14102 - DNA, 1365 bp, Artificial Sequence
  Description of Artificial Sequence: Synthetic coding sequence
atggtcgacccagttggttttgccgaagcttggaaggctcaatttccagacagcgagcccccacgaatggaactccggtccgtcggggatattgagcaagagctggagaggtgcaaagcctcaataagaaggctggaacaggaggtgaatcaagaacggtttcggatgatttacttgcagactctacttgctaaggagaaaaagagctatgacaggcagcgctggggcttccgtcgcgccgctcaggccccagacggcgcctctgagccaagggcctctgcaagtcggccacagccggcccccgccgatggggccgacccaccaccagccgaggagccagaagcacgccccgacggggaggggagtcctggaaaggctcggccaggcacggcgcgtcgccccggcgctgccgccagtggcgaacgagacgatcgaggaccccccgcatctgttgccgccttaaggtcaaatttcgagcgtatccggaaaggccacggccagcctggcgctgatgccgagaagccattctacgtgaatgttgaatttcaccatgagaggggccttgtgaaagtcaatgacaaggaagtctccgaccgaatcagttcactgggttcgcaagctatgcagatggagagaaagaagagtcagcatggcgctggctcttctgtgggagacgcatcccggccaccctatcgcggaagatcatctgaaagctcctgtggtgtggatggggactacgaagacgcagagctaaacccaagatttctcaaagacaatctgatcgatgcgaatggaggcagccggcccccctggcctcccttggagtatcaaccttatcaatctatttacgtaggcgggatgatggagggcgaagggaaggggcccctcttgcgttcccagtcaacatccgagcaggaaaagagattgacctggcccaggaggagttactcacctcggtcttttgaggactgcggcggagggtataccccagattgcagctctaatgagaaccttacatcttcagaagaagacttttcaagcgggcagtctagccgcgtgtccccctcaccaaccacatatcggatgttcagagacaagagcaggagtccaagtcagaattcccagcagtcctttgactcttcatccccaccaactcctcaatgtcataaaaggcatcgacattgccctgtcgtggtgtcagaggctactatcgtgggtgtgcgcaaaacgggccagatatggccgaatgacggtgaaggcgctttccatggtgacgctgacggctctttcggaactccaccgggatacggatgtgctgcagggcggcccccgcacttgacagaactgccagtgcagcatcagtag

SEQ ID NO: 14103 - DNA, 4704 bp, Artificial Sequence
  Description of Artificial Sequence: Synthetic coding sequence
atgaatgtagagaaggctgaattttgcaataaatcgaagcagccaggtcttgctagaagccagcataatcgatgggccggtagtaaggagacctgtaacgaccgtcgcacaccgagcaccgaaaagaaagtggacctaaacgctgacccactgtgcgagcggaaggaatggaacaagcagaagctgccctgcagcgagaatcctagagatacagaggacgtgccctggatcaccttgaactcttccatccaaaaagtgaatgaatggttttctaggtccgatgagttgctgggctcagatgattcccacgacggcgagagcgaatctaatgctaaggtcgccgatgtcttggacgtcctgaatgaggtcgacgagtatagtggctcttcagagaaaatagacctcttggcctccgatcctcacgaagcactgatctgcaaaagtgagcgagtccactctaaaagtgtggaatctaacatcgaggacaagattttcgggaaaacctatcgaaagaaagcctccctgcctaacctgagccacgtgactgagaaccttattatcggggcattcgtaacagagccccagattattcaggagaggccgttaacaaacaaactgaagcgcaagaggaggcctactagcggtctgcaccctgaagattttattaagaaggctgatctggcagtgcagaaaacccccgagatgattaaccaaggcactaaccagactgagcagaacggacaggtaatgaatataactaactcagggcatgaaaataagaccaagggggattccatccagaatgagaagaaccctaatccaatcgaatcactagagaaagagtccgcctttaagaccaaagcggaaccaatctcttctagtataagcaacatggaactcgagctgaatatccacaattctaaggcccctaaaaagaatcgtctcagacgtaaatcttctacacggcacatccatgccctcgagctcgtggtttcaagaaacttgtcccctcccaattgcacagagctgcagatagactcatgtagctcttctgaagagataaaaaaaaaaaagtacaatcagatgccagtgagacacagccgtaatctccagttgatggagggcaaagagccagcgacgggcgcgaaaaagtccaataagccaaatgaacagaccagcaaacggcatgactccgacacattcccggagttgaagctcacgaacgctcccggatcctttaccaagtgttctaataccagtgagttaaaagaatttgtgaatcccagcttgcctagagaagaaaaggaagaaaagctagagacagttaaggtttccaacaatgcggaagaccccaaagatctgatgctgtcgggagagagagtgttacagacagaaagatcggtggaatcctctagtatctcactagtcccagggacggactatgggacacaagagagcatctccctgctggaggtctccaccttgggtaaggcaaagaccgagccaaataaatgcgtttctcaatgcgccgcatttgagaatcctaagggacttattcacggctgcagcaaggacaaccggaacgacaccgagggctttaagtacccactcggccacgaggtaaaccactcgagggagacaagcatcgagatggaagaaagcgaactggacgcccaatatttgcagaatacttttaaagtgtcaaaaagacaatcgtttgcccccttcagtaatcccgggaatgccgaagaagaatgcgctacatttagtgcccattcagggtccctgaagaagcaaagcccaaaggtgacttttgagtgtgagcagaaggaggagaaccagggtaagaacgaatctaatatcaaaccagtgcagactgttaacattacagcaggcttcccggtggtggggcagaaagataagccagtggataatgccaagtgttcaatcaaaggggggagccggttttgcctatcatctcagttcagaggaaatgaaactggcctgatcacaccaaacaaacatggcctgctgcagaatccatatagaatacctccgttatttccaattaagtcttttgtcaaaacgaagtgtaaaaagaatctccttgaggagaatttcgaggagcactctatgagccctgagagggaaatgggaaacgagaacatcccatcaaccgtcagcacgatctcaaggaacaacataagggaaaatgtctttaaggaggcatcttcctcgaacattaacgaagtcggctctagtaccaatgaggtgggtagctccataaatgagataggttcaagcgacgagaatatacaagcagagctgggccgaaatcgagggcctaagttgaacgcaatgctgaggcttggtgtgctacagcctgaggtgtataagcaatcgctccctggaagtaattgtaagcaccctgaaatcaagaagcaggagtacgaggaagtggtgcagacagtgaacaccgatttctcaccctacctgattagcgataacttggaacagccaatggggagctctcacgccagccaggtgtgcagcgaaaccccggacgacctgctggatgacggcgaaatcaaagaagacactagcttcgcagaaaatgatattaaagaatcgtcagcagtgtttagcaagagtgtgcaaaaaggagagctgtcccgcagcccctccccattcacccatacccacttggcccaagggtatcggagaggagccaagaaattggagtctagtgaagagaatttgtcatccgaagacgaagagctgccatgttttcaacacctgctctttggcaaggtcaacaatataccttcccagagcactcggcacagcactgtcgcaactgagtgcctgagcaaaaacaccgaggaaaacctgttgagcctgaaaaacagtctgaatgactgtagcaaccaggtcatcttagccaaagccagtcaggaacaccacctgagcgaagaaacgaagtgttcggcgtcccttttctctagccagtgttcggaactcgaagacctaaccgcaaataccaacactcaggatccattcctgataggctcaagcaagcagatgagacatcagtctgagagccaaggcgtgggactatccgataaagaactagtgtccgatgacgaggagcggggcactggactggaggagaataaccaagaggagcagtcaatggatagcaatttgggggaagcagcctcaggctgcgagagcgagactagtgtgagcgaggactgctctggattgagttcccagtcagacatccttactacacagcagcgggacactatgcagcacaatcttattaaactgcagcaggaaatggctgagctcgaggccgtgctagaacagcatggctcccagccctcaaacagctaccctagcataatctctgactcgtctgccctggaagacctgagaaaccccgagcagtctacttcggaaaaagcagtgctaactagccagaagtcttccgagtacccaattagccagaacccagagggcctgagcgccgacaaattcgaagttagcgccgactcctccaccagcaagaataaggagcctggcgtggagagaagcagccctagcaagtgcccgtcattagatgacaggtggtacatgcatagctgttccggaagtttgcagaataggaattaccccagccaggaagaactgatcaaggtcgtagacgttgaagaacagcagctggaggagagtgggccacacgatcttaccgagacgtcctatttacccaggcaagatctcgaagggaccccatacttggaaagcgggattagtctttttagcgacgaccccgagtctgatccctcagaggatcgtgctcctgaatccgcacgggtgggaaatatcccatcatccacaagcgccctgaaggtgcctcagttgaaggtcgccgagtcagcacaatcccctgccgccgcccacactactgatactgctggctacaacgccatggaggaatcagtctcccgcgaaaagccggaactcacagcatccactgagagggtgaataaaagaatgtcaatggtagtaagtggccttaccccagaggaatttatgttagtttataaattcgcccggaaacaccatatcaccctgaccaatcttatcaccgaagagactactcacgtcgtgatgaaaaccgatgccgagttcgtgtgcgagcggacgctcaaatatttcctgggaatcgccggcggtaagtgggtcgtgtcttacttttgggtgactcagtctattaaggagagaaagatgttgaatgaacacgactttgaggtccgaggggatgtcgttaatggtcgtaaccatcagggacctaaaagagccagagagtcccaggatcggaaaatctttcgcggattggaaatttgttgttatgggcccttcactaacatgcctactgatcaactggaatggatggttcagctgtgtggcgccagcgtggtgaaggagctgagttcatttaccctgggcacgggtgtacaccctatagttgtggtacagccggacgcatggactgaagataacggcttccatgcaattggtcagatgtgcgaggctcccgtggtgactagggaatgggtcctggacagcgtcgcactctaccaatgccaggagttagacacatatttgatcccgcaaattccccacagtcattactag

SEQ ID NO: 14104 - DNA, 4875 bp, Artificial Sequence
  Description of Artificial Sequence: Synthetic coding sequence
atggatttatctgcccttagggtcgaggaggtgcagaacgtcatcaacgccatgcaaaagatcttggaatgccccatttgcctagaacttatcaaggagccagttagtactaaatgtgaccatattttttgcaagttctgcatgttgaaacttttaaatcagaagaagggtccttctcagtgtccactctgtaaaaacgatattacaaaacgctctctccaggagagcacacgattctcgcaactcgtcgaggagttactgaagatcatttgcgccttccaattagacaccgggctggaatacgcgaacagctacaacttcgccaaaaaggagaataatagtccagagcacctcaaagacgaggtttcaattatacagagcatgggctatagaaatagagcaaagcgtttgttgcaatccgagcctgaaaatccatctctgcaagagacatccctttctgtacagttgtccaacctgggaactgtcaggacactgcgaacaaagcagcgaatacagccgcagaagacatcagtctacatcgagctgggatctgacagctccgaggatactgttaataaagcaacctactgtagtgtgggagatcaggagctgctccagattacccctcaaggcacgcgagatgaaatttccttagactctgctaaaaaagcggcatgtgagttctccgaaaccgatgtgaccaacactgaacatcaccaacctagcaataatgacctcaatactacggaaaaaagggccgccgagcggcacccagaaaagtatcaagggagctctgtgtctaacctacatgtggaaccatgtggaactaacacacatgcctcctccctccaacacgagaactcatccctgctgttgacaaaggaccggatgaatgtggagaaggccgagttttgcaataagtcaaaacaacctggcctcgctcgcagtcagcacaatcgctgggccgggtcgaaggaaacatgtaacgataggcgaacaccaagcacggaaaagaaagtagatctcaacgctgatccactgtgtgagcgaaaggagtggaacaaacagaagcttccttgcagtgagaatccccgagacaccgaggatgtgccttggatcaccttgaactcaagcatacagaaggtcaacgaatggttctccaggagcgacgagctcctgggcagcgatgactcccacgacggtgagtccgagagcaacgctaaggtagccgacgtgttggacgtactcaacgaggttgatgagtattcaggttcgtctgagaagatcgatctgctggcctccgaccctcatgaagccctcatctgcaaaagtgaacgcgtgcattcaaaatccgtggaatccaatatcgaagacaaaatctttggaaaaacttacagaaagaaggcaagtctgcccaatctttcccacgttactgagaacctgatcatcggggcatttgttacggagccccagattatacaggaacggcccctgacgaataaacttaagcggaagagacggccaacttctgggctgcatcccgaggactttatcaagaaagctgacttagcggtgcagaaaacacccgaaatgatcaaccagggcaccaatcagaccgagcagaatggtcaggtaatgaatattactaattccggccatgagaataaaacgaaaggcgacagtatccagaatgagaagaatcctaatcccattgaatccctggaaaaagagagtgcctttaagacaaaagctgagcccatctctagttcaatctctaacatggagctggagttgaacatccataattccaaagcccccaaaaagaatcgtctcagacggaaatcctcaaccagacatatacacgccttggagttagtcgtaagtagaaatctttccccacccaattgtaccgaactgcaaatcgacagctgctcatcatccgaggaaatcaagaagaaaaaatacaaccaaatgcccgtgagacattcacgaaatcttcaactcatggaggggaaggagccagctacaggagctaagaagtccaacaagcccaatgaacagacatccaagcgccacgactcagatacattccccgagcttaagttaacaaacgccccaggcagtttcacaaagtgctctaacacctccgagctgaaagaattcgttaacccctctctccctagggaggaaaaggaagaaaaactggaaacagtcaaggtgtcaaacaacgcagaagaccccaaggaccttatgctgagcggcgagcgcgtgttgcagaccgagcgctctgtggaaagctcttctattagtttagtgcccgggactgactatggcacacaggagagcatttctcttctagaggtctctactctgggaaaggctaaaacagaacctaataagtgtgtgtcacaatgcgccgcattcgagaaccccaagggtctaattcatggttgttctaaggacaatcgaaacgatactgaaggcttcaaataccccttgggccacgaggtgaatcactcccgcgagacatccatcgagatggaggagagcgaacttgacgcacagtacctgcagaacacattcaaagtgtcaaaacggcaatcatttgccccctttagtaacccgggaaatgccgaagaagagtgtgccacattttctgcccactccgggagtctgaagaagcagagtcctaaggtaacttttgagtgcgagcagaaggaggaaaatcaggggaagaatgagagcaacattaaacctgttcagacggtgaatataaccgcaggctttccggtcgtgggccaaaaggacaagcccgttgataacgccaagtgttccatcaagggtggatcacggttttgtcttagcagccagtttcgggggaacgagactgggctcattactcctaacaaacacgggctactccagaacccatatagaatcccccctctgtttccaataaagtccttcgtgaagaccaaatgcaaaaaaaacctcctggaagaaaacttcgaagagcactcaatgtctcctgaacgagagatgggaaatgagaatattcctagcactgtgtccaccatcagccgaaacaacattcgagagaacgtttttaaagaggccagcagctcaaacatcaacgaggttggctcttcaacaaatgaagtgggaagcagtatcaacgagatcgggtcttccgatgagaacattcaagctgaactcggccgtaaccgcggccctaaactgaacgccatgctcaggcttggcgtcctccagcccgaggtgtacaaacagagcctaccaggttccaattgtaaacaccccgagataaaaaagcaggagtacgaagaggtggtgcagaccgtgaacaccgacttttctccctacctcatctctgacaatctcgaacagcctatgggctccagccacgccagtcaggtgtgctctgaaacgcccgacgatctccttgacgatggagagattaaggaggacacaagtttcgcggagaatgacatcaaagagagcagtgccgtcttcagtaaaagcgtgcagaagggcgagctcagtcgatccccgagtccattcactcacacgcacctcgcccagggatatcgacgaggtgcaaaaaaactggaaagttctgaagagaatctgtcctcggaagatgaggagctcccatgttttcaacacttgttgtttggcaaggtcaataatatcccaagtcagtcaacacgccacagcacagtggctactgagtgcctttccaagaacacagaggagaacctgctgagcctgaagaattccctcaatgactgctcaaatcaggtaattctggccaaggcgagccaggaacatcacctgagcgaggaaaccaaatgtagtgccagtttgttcagctcacagtgttcagagttagaggatctgaccgccaataccaacacacaggatcctttcctcatcggcagctccaagcagatgcgacatcagtccgaaagccagggtgttggcctcagtgataaggaactcgtgtccgacgacgaggagaggggtacggggctggaagagaataatcaggaggaacagagtatggactctaacctgggggaagctgcttcagggtgtgaatccgagacatctgtgtccgaagattgttcagggctgtcatctcagtctgacattttgacgacacagcagcgcgataccatgcagcacaacctgatcaagctgcagcaggagatggcagaactggaagccgtccttgagcagcatggctcccagccctcaaacagctatccctctatcatttcagactcttctgccctggaagacttaagaaaccctgaacagagcacctccgagaaagatgctgagtttgtatgcgagcggaccctaaaatatttcctaggcatcgcaggcggcaagtgggttgtgtcctacttctgggtcacacaaagtataaaagagaggaagatgttgaacgagcatgatttcgaagtccgcggagatgttgtgaacggccgtaatcaccaaggtccaaagagagcaagagaaagtcaggacaggaaaatttttcgtggtctggaaatttgctgttacggaccctttacaaacatgccaactgaccaactggagtggatggtccagctctgcggagccagtgtagttaaggaattgagcagctttactctgggcactggtgtgcatcctattgtcgtcgtccagcctgacgcctggaccgaggacaatgggttccatgcgatcgggcagatgtgcgaagctccagtggttactcgagaatgggtgctagattctgttgcactctaccaatgccaggagctcgatacttacctgataccacagatccctcattcacactactag

SEQ ID NO: 14105 - DNA, 2043 bp, Artificial Sequence
  Description of Artificial Sequence: Synthetic coding sequence
atggatctctcggcgctgagagtggaagaggtgcagaacgtaatcaacgcaatgcagaaaattctggagtgtccaatttgcttagagctgattaaggaacctgtcagcactaagtgtgatcacattttttgcaaattttgtatgttgaaactcctcaatcagaagaaggggccctcccagtgcccactgtgtaaaaacgatattactaaacggtctttacaagagtccacaagatttagtcaactagtggaagagcttctgaagattatttgcgcatttcagttggacacaggattggagtatgccaatagctataattttgccaaaaaagagaacaactctcccgagcatctgaaggatgaggttagcatcatacagagcatgggatatcgcaaccgtgctaagcgcctcctgcagagtgagccagagaacccttccttgcaagagacatccctcagcgttcaactcagtaaccttggcacagtgaggacactgcgcactaagcagcgcatccagccgcagaagacatccgtctatatcgagcttggcgaagctgctagcgggtgcgaatcagagacgtccgtcagcgaagactgtagtggtctctcttcacaaagcgatatcctgactactcagcagagggacaccatgcaacacaatctgatcaagctgcagcaggaaatggctgagctcgaggccgtgctcgagcaacacggttcccagcccagtaactcatacccgtccatcatcagcgactcatcagcattggaagacctgcggaacccagaacagtccaccagcgaaaaggctgtcctcacctcacagaagtctagcgaataccccatcagtcagaaccccgaagggttgagcgccgataaatttgaggtctccgcagacagttcaacttccaaaaacaaagaacccggagtagaacggtcctccccatcgaaatgcccgagtctggacgataggtggtatatgcacagttgctctggatccctgcagaacagaaattacccctcacaggaagagctgatcaaggtcgtcgacgttgaagagcagcaactagaggagtcaggtccgcacgacctgacagaaactagctacctgccacgacaggatctggaaggaacgccttacttggagagtgggatcagcctgttcagcgacgatcccgagtccgatccatccgaagatagggcccccgaatcggccagggttggaaatattccttctagtaccagcgccctgaaagtgccacagctgaaggttgctgagtcagcccaatcccctgcagccgcccacaccacagacactgcaggatacaacgccatggaagaatccgtttctcgggaaaaaccagaattgaccgcctctacggagcgggtgaataagagaatgtccatggtggtgtccggactcaccccagaggagtttatgttagtctataaatttgcaagaaagcaccacatcaccctcactaatttaattacagaggagactactcacgtcgtaatgaaaactgacgctgagttcgtatgcgaacggacccttaagtactttctgggaatcgctgggggaaagtgggtggtgtcctacttttgggttactcagtctataaaagagcgcaagatgttgaacgaacacgattttgaagttcgcggagatgtagttaatggaagaaatcaccagggccccaagcgtgccagagaaagtcaggaccggaaaatctttcgcgggttggaaatctgctgttacggacctttcaccaatatgcccacagatcagttagaatggatggtccaactgtgcggcgcctctgtcgtcaaggagctttcttcttttaccctgggaactggagtacacccaattgtcgtggtccagcccgatgcatggaccgaggataacggcttccatgcaattggccaaatgtgcgaagcccctgtagtcacacgggagtgggttctagacagtgtcgccctctatcagtgtcaagagcttgatacataccttatcccccagatcccgcactctcactactag

SEQ ID NO: 14106 - DNA, 2166 bp, Artificial Sequence
  Description of Artificial Sequence: Synthetic coding sequence
atggacctttctgcgttgcgagtcgaagaggtgcagaatgtgataaacgccatgcaaaagattttggaatgccctatctgtctggagctgattaaggaacctgtcagtacaaagtgcgaccacatcttttgtaaattctgcatgctgaaacttttgaatcagaaaaaggggccgtctcagtgccctttgtgcaagaacgatattaccaagcggagcctccaggagagtactcggttttcccagctcgtggaggaactcctgaagattatctgcgcattccagctggatacaggattggagtacgcgaattcctacaattttgccaagaaggaaaacaactcgccagagcatcttaaggacgaggtctctattatccagtccatgggttaccgtaatcgtgccaaacggttactacagtctgagccggagaaccctagcttgcaggaaacctctctctccgtccaactgagcaatctggggacagttcggaccttgcggactaagcaaaggatacagccccagaaaaccagtgtctatatcgaactggggtccgactcatccgaagacacagttaacaaggcaacgtattgcagtgtgggggatcaggaactcctccagatcactcctcaggggactcgcgatgagattagtctagactccgctaagaagggagaggcagctagtggatgcgagagtgaaactagcgtgagtgaggattgtagtggcctcagtagccagagtgacattctcacaacacagcagagggacactatgcagcataatctgattaagcttcaacaggaaatggcagaacttgaagctgtgctggagcagcacggatctcagccatcaaacagctacccctccattatcagtgactcctctgcattggaggacctcagaaaccctgaacagtccacatcggaaaaggctgtattgacttcccagaaaagcagcgagtatccaatcagccaaaaccccgagggactttcagctgacaaattcgaggtttccgcagatagcagtacctcaaagaataaagaacccggcgtcgagcgatcgtctccatctaagtgtccttctctcgatgaccggtggtacatgcactcttgctcagggtccctacagaacaggaactatccaagccaggaagagctgatcaaagtagtggacgtggaggagcagcagctcgaggagtccgggccccacgatctgacagaaacttcttacttgccccggcaagatctggaaggcacaccctacctggaaagcggtattagcttgtttagcgatgatcccgagagtgacccttcagaagacagggctccagagtcagccagagtcgggaatatcccatcctccacaagcgcccttaaagtaccccagctgaaagtagccgagagcgctcagtctccagcagctgctcacacaaccgacaccgcgggctacaatgccatggaagaaagtgtttctcgcgagaagccggaactaaccgccagtactgagcgggtcaacaaacgtatgtctatggtggtttccgggttgacacccgaggagtttatgcttgtgtataagtttgcacggaaacatcatatcacacttacaaacctgattacagaggagacgactcatgtcgtcatgaaaaccgacgccgaattcgtgtgcgaaaggacactaaaatatttcctgggcatcgccggcggaaagtgggtggtgagctatttctgggtgactcagagcataaaagaacgtaaaatgttaaacgagcacgattttgaggtgagaggggacgtggtgaacggcagaaatcaccaggggcccaaacgagcacgcgagagccaagaccgtaaaatctttcgagggctggaaatctgttgttatggtccattcacgaacatgccaaccgatcaattagagtggatggtccagttgtgcggagcctctgtcgtcaaggagttgtcgtcgttcactttggggaccggtgtgcacccaatcgttgttgtgcagcccgacgcatggaccgaagataatggattccatgccattggccaaatgtgtgaggccccagtcgttacaagggaatgggttctggactcagtagccttatatcaatgtcaggaactggacacgtacctgatcccacagatccctcactctcattattag

SEQ ID NO: 14107 - DNA, 4797 bp, Artificial Sequence
  Description of Artificial Sequence: Synthetic coding sequence
atggacctgtcggctttaagggtcgaggaagtgcaaaacgtgattaacgctatgcagaaaattcttgaatgtccaatttgtttagaactgatcaaggaacccgtctctaccaagtgcgatcacatcttctgcaagttctgtatgcttaagcttctaaaccagaagaaaggcccgagccaatgtccactttgcaaaaatgacatcaccaagcgttcgctgcaggagtcaacccggttttcccagctggtggaggaactgttgaagatcatttgtgcttttcagctggatacaggcttagaatacgccaactcttataactttgctaagaaagaaaacaactcccctgaacacctaaaagatgaggtgtccatcattcagtctatggggtatagaaacagggcaaagaggcttctgcagagcgagcctgaaaacccctcactgcaggaaacaagcttgtcagtgcagttaagcaatctgggtacggtgagaacactgagaacaaaacaacgaatccagccacagaaaacttccgtatacattgaactcggcagcgattcatcagaggatacagtcaacaaggctacctattgctctgtcggggaccaggagctcctgcagatcacacctcagggaacgcgagatgaaatcagcttggattctgccaaaaaagcagcttgcgagttctccgaaactgacgtgactaataccgagcaccatcagccaagcaataacgacctcaataccaccgaaaagagggccgccgaaaggcaccccgagaaatatcaaggaagctctgtgtcaaatctgcatgttgagccctgcgggaccaatacacacgcgagcagtctccagcatgagaatagctccctcctactcacaaaggatcgcatgaacgtcgagaaggctgagttttgcaacaaaagtaagcagccgggactcgcccgcagtcagcacaatcgatgggccgggtcaaaggaaacgtgcaacgacaggcgcaccccatcaacagagaaaaaggtggatctgaatgccgaccctctctgtgaaaggaaagagtggaacaaacagaaactcccttgctctgaaaacccccgggacactgaggacgtgccatggattacactgaactccagtattcagaaagtgaacgagtggttttccaggagtgacgagcttttgggtagtgatgacagccatgacggcgagagcgaatctaatgcaaaggtcgcagacgtcctggatgttctgaatgaagtggatgaatactccggcagctctgaaaagatcgatctcctagccagcgacccacacgaagccctaatttgcaaaagcgagcgggtgcactccaaaagtgtagagagcaacatagaagacaagatcttcgggaaaacgtacagaaaaaaggcaagcctacccaatttgtcccatgtaaccgagaacttaataatcggggcatttgtcaccgaacctcagattattcaagaacggcccttgaccaacaaactaaagaggaagcgccgccccacaagcgggctacaccctgaagacttcatcaagaaagcagatctggcggtgcagaagacaccggaaatgatcaaccaaggcacgaatcaaaccgaacagaatggacaagtgatgaacattacaaatagtggacatgaaaacaaaacaaaaggagatagcatccaaaacgagaaaaatccaaaccctatcgagtcactggaaaaggagtctgcattcaagaccaaggctgagcccatctccagtagtatctcaaatatggagctcgaactcaacattcacaattctaaagcgcccaagaaaaaccggctgaggcgcaagagttcgactaggcacatccacgctctcgaactggttgtgtctagaaatctgtcacccccgaattgcacagaacttcagatagacagttgcagttccagcgaggaaattaagaagaaaaaatacaatcagatgcctgttaggcactctcggaacctgcaactcatggaaggcaaggagcccgccaccggagccaagaaatctaataaaccgaacgagcaaacttccaagcgacatgattcagatacctttcctgaactgaaattgaccaatgcacccggctcgttcactaagtgttctaacacatccgagctcaaggagttcgtcaatccctcccttcctagggaggagaaagaagaaaagttggagacagtcaaagtgtcaaataacgcagaagatccgaaagatctcatgctgagcggcgaaagggtgcttcagaccgagcgtagcgtagagagctcttctatttccctggtgccaggaacagactacggcacccaggagtcgatttctctgctagaggtgtctaccttgggtaaagccaagaccgagcctaacaaatgcgtatctcagtgtgctgcttttgaaaatcccaagggactgatccacgggtgctctaaggataaccggaatgacacagaaggtttcaagtaccctctggggcatgaggtgaaccattctagggaaacgtccattgaaatggaagaaagcgagctggatgctcagtacctacagaatacttttaaggtgtctaagaggcagtccttcgctcctttctccaaccctggaaatgctgaagaagagtgtgccactttcagcgcacacagtgggtcactcaaaaagcaaagccccaaagtcacctttgaatgcgagcagaaagaggaaaatcagggaaaaaacgaatctaacattaagcctgtacagaccgtcaatatcaccgctggcttcccagtggttgggcagaaagacaagcctgtcgacaacgctaaatgcagcatcaaagggggttctaggttctgcttgagctcccagtttaggggtaacgagaccgggctcatcacaccgaacaagcatggattactccagaatccctacaggattcctccactgttccccatcaaaagctttgtgaagaccaagtgcaagaagaatctccttgaggagaacttcgaagagcactcaatgagtcctgagagagagatgggaaacgagaacatcccttctactgtaagtaccataagtcgcaataatattagggaaaatgtgttcaaagaggcttcttcaagcaatatcaatgaggtgggctcaagcacaaacgaggtggggtcatctatcaacgaaatcggcagctcggacgaaaacatacaggccgagctgggacggaaccgaggacccaaattgaacgctatgcttcgtttgggcgtcctccaacctgaagtgtataagcagagcctccccggctccaactgcaaacacccagagattaagaagcaagaatatgaagaagtggtgcagaccgtgaacacggacttctcaccatatctgattagtgataacctggaacagcccatggggtccagccacgcatctcaggtgtgcagcgagacgccagatgatctcttggacgacggtgagattaaagaagacacatcgttcgccgaaaacgacattaaggaatcttccgcagtgttttcaaaatctgtgcagaaaggtgaattgtcacgctccccatctcccttcacacatacccacctcgcccaggggtatcgaaggggagctaaaaagctagaaagttccgaagaaaatttatcctcggaagatgaggaactgccgtgtttccagcacttgctgttcggaaaggtcaacaatattccttcccagtccacgcggcacagcacagtagctacagagtgtctttctaagaatacagaagaaaacctgctgtcccttaaaaactcactgaatgattgtagtaatcaggttatcctcgccaaggctagtcaagagcatcacctatctgaggagacaaagtgctctgcttccctgtttagtagtcaatgtagtgaactggaagacctgaccgccaacacgaatacccaggaccccttcctgataggctctagcaagcaaatgaggcatcaatcggaatcacagggggtgggcctctctgacaaagagctggtctccgacgacgaggaacgggggaccggccttgaggagaacaaccaggaggaacagtccatggacagtaacctcggagaagctgcttctggatgcgagtccgaaacatcagtctccgaggattgctccggtttatcctcccagagtgatattctgacaacccagcagcgtgacaccatgcaacacaatctcataaagctccagcaggagatggccgagcttgaggctgtgttggaacaacacggtagccagcccagtaattcttatccaagtatcatttctgactcatcagcccttgaggatctgcgaaatcccgaacagagtaccagcgaaaagggagttacgcagtccatcaaagaacggaagatgctcaatgagcacgacttcgaggtccggggcgacgtcgtgaatggacggaaccaccagggtcctaaaagagcaagagagtcacaggatcgcaaaatcttccggggactcgagatctgttgttacgggcctttcaccaacatgccaactgatcagctggagtggatggtgcagttatgcggcgcatccgttgttaaagaactgagctcattcacactgggcaccggagtgcatccaatcgtggtggtgcagcccgacgcatggaccgaagataatggcttccatgctatcggtcagatgtgtgaggcaccagttgttacccgtgaatgggtgctagacagtgtagctctctaccagtgtcaggagctcgatacatatttgatcccccagatcccccactcacattactag

SEQ ID NO: 14108 - DNA, 5592 bp, Artificial Sequence
  Description of Artificial Sequence: Synthetic coding sequence
atggacttgtccgccttacgggtcgaagaggtgcagaacgtgattaatgcgatgcagaagatactggagtgtccgatttgccttgaactgattaaggaacccgtgtccactaagtgtgaccacatcttttgcaagttttgcatgttaaagctgttaaatcagaagaaggggccatctcaatgccctctatgcaaaaacgacattaccaagagaagtttacaggagagtacccgcttttcacagttggtggaggaactgctgaaaataatttgtgcgttccagctggacacaggcctcgagtacgctaatagctataactttgccaagaaggagaacaactcgcctgagcacctgaaggatgaggtgtccattatccagagtatgggctaccggaatcgggcaaagagactactccaatccgaacctgaaaaccccagcctgcaggaaacctctctgtcagtgcaactttctaacctaggcacagtccggaccctgcgcaccaagcagagaattcaacctcagaagacatctgtgtatatagagcttggctctgattcctctgaagacaccgttaacaaagcaacatattgctccgtgggggatcaggagctgctgcaaattaccccacagggaacccgagatgagattagtttggattcagcaaaaaaggcggcgtgcgaattctcagagacagacgtcaccaatacggaacatcatcaaccttccaacaacgacctgaacaccactgaaaaaagagcagctgagaggcaccccgagaaatatcaggggtcctcagtaagtaatcttcacgtcgaaccatgcggcacgaatacccatgcaagttccctccagcatgaaaacagttccctgctcctcactaaggacagaatgaatgttgaaaaagccgagttctgtaataaatcaaagcaaccaggcctggcacggagccagcacaaccggtgggcggggtctaaggagacttgtaacgaccgtagaacacccagcaccgaaaagaaagtcgatctgaacgctgatcctctgtgcgagcgcaaagagtggaataagcagaaactgccgtgctctgagaaccccagggatacagaagatgtcccctggattaccttgaactcgtccattcaaaaagtaaacgaatggtttagcagaagtgatgagctgcttgggtcagacgacagccatgatggggaatccgaaagtaacgccaaagttgccgatgttctggatgtacttaacgaggtggatgagtacagcggaagctccgagaaaatcgatctcttggcctctgacccacacgaagcacttatctgtaagtctgagcgggtccactctaagagcgtcgagtcaaacatcgaggataagatttttggtaagacttatcggaagaaagcctctctccccaacttatcccacgtcacggagaaccttatcataggcgcctttgtaactgagccacagatcattcaggagcgacccctgaccaataagctaaagaggaaaaggaggcccactagcggtcttcaccctgaggactttattaaaaaggcagaccttgccgttcaaaagacgccagaaatgattaatcaggggacaaatcaaacggaacagaacggacaggtgatgaacatcacaaattccgggcacgagaacaagactaaaggtgacagcattcagaacgaaaagaatcccaacccaattgagtctttggagaaagaaagtgctttcaagacaaaagcagagcctatcagtagctccataagtaatatggagctcgaacttaacatccacaactccaaagctcccaaaaagaataggctccggcgtaagtcaagcaccagacatattcacgccctcgagctggtggtatctcgcaacttgagcccacctaactgtacggaactgcagattgatagctgcagtagtagcgaggaaatcaaaaagaaaaagtataatcagatgcctgtgcgccattccagaaacttgcagctgatggaggggaaggagcctgcaaccggggcgaagaagagcaacaagccaaatgaacagacttcaaaacgtcatgactcagatacctttcctgagttaaagctcaccaacgctcccggaagcttcactaagtgcagcaacacctctgaacttaaagaattcgttaaccccagtcttcccagggaagaaaaggaggaaaaactcgagactgtgaaggtaagtaacaatgcagaggatccaaaagatctcatgctgtccggagaacgtgtccttcaaacagaacgatccgtggaaagtagctctatcagtttggtacctggtaccgattacggcactcaggagagcatatcattgctggaggtgagtaccctgggaaaagctaaaaccgagccaaataagtgcgtatcgcagtgtgcagctttcgaaaatcccaagggtctgattcatggctgctctaaggacaacagaaacgatacagagggttttaagtaccctttagggcatgaagtaaaccatagcagagaaacatctattgagatggaggagagcgagctagatgcccagtatctccagaacaccttcaaagtgtcaaagaggcaaagctttgcaccattctctaaccccggcaatgcggaggaggagtgtgccacgttcagtgcacatagcgggagtcttaagaagcagagcccaaaagtgacattcgaatgcgagcaaaaggaagaaaaccaggggaagaacgaatctaatatcaaacctgtccaaacagtgaacattactgcaggcttccccgtggtgggtcagaaagacaaaccggtcgacaacgcgaagtgtagcattaagggcggttcacgtttttgtcttagtagccagttcagaggcaatgaaactgggttaattaccccgaacaagcacgggctgcttcagaacccgtatcggataccgcctttgtttccgatcaaatcatttgtgaagacgaagtgcaagaaaaatctgctggaggaaaatttcgaagaacactccatgagtcccgagcgtgagatgggaaatgagaatatccctagcacagtttcaacgatctctaggaacaatatacgcgagaacgtattcaaagaggctagctcctccaacataaacgaggttgggtcttccaccaacgaagtaggtagttccataaatgaaatcggctcctccgacgaaaatattcaagctgagctggggcgtaatcgcggcccgaaactgaatgctatgctgcgtctgggggtcctgcagccagaggtgtataaacagtctttgcctggatcaaactgcaaacatccggaaatcaagaagcaggaatacgaggaagttgtgcagactgtcaacactgacttcagtccgtacctgatttccgataatctggagcagccaatgggttcttctcacgcctcacaagtgtgctccgaaacacctgatgacctgcttgatgacggagagatcaaggaggacacaagcttcgctgaaaacgacataaaggaatctagcgccgtcttcagtaagtccgtgcagaagggggaactgtcccgaagcccctctccgtttacccatacccacttagcacaaggatatcggagaggcgcaaagaagctggaatctagcgaggaaaacctctcctcagaagatgaagaactgccgtgttttcagcacctgctctttgggaaggtaaacaacataccatcacagagtactcgccactccacggtcgcaactgagtgtcttagcaagaacactgaagagaatttgctgtctttgaaaaacagcctgaacgactgctctaatcaagtgattctggctaaagcgtcgcaggagcaccacctgagtgaggaaactaagtgttccgcctcccttttcagctctcaatgttccgagctggaggaccttaccgctaacacgaacacacaagatccttttctgatcggctccagcaaacaaatgagacatcagtctgagagccagggggtaggcctgtccgataaggagctggtgagcgatgacgaagagaggggaactggcttggaagagaacaatcaggaagagcagagtatggactcaaacctgggcgaagccgcgagcggatgcgagagcgaaactagcgtgagtgaagattgcagcggtctgtcctcccagtcagacatcctgaccacccagcaaagagatacgatgcagcataacctgatcaagcttcagcaggagatggcagaactggaggccgttctcgagcagcatgggagtcagccttctaacagctacccttccatcattagtgatagctcggccctcgaggacctgaggaaccctgaacagtcaacgtccgagaaagctgtgctcacctcacagaagtccagtgagtatcccatttcccagaaccctgagggactgtctgccgataaattcgaggtctcagctgacagctcaacttcaaaaaacaaggaacccggcgtggagcggagttctccgagtaaatgcccttctttggatgaccgctggtacatgcacagctgttcgggttcgctgcagaatcgaaactacccctctcaggaggagctgataaaggtcgtggatgtggaagagcagcagctcgaagaaagcggcccccacgacttaacggaaacctcatacctgccccggcaagatctcgagggcacgccttatttggagtccggcatctccctgtttagcgatgatccagaatcagaccccagcgaagatagggctccggagagcgctagggttggtaacatccccagttccacttctgcgctgaaggtaccccagctgaaggttgcggaatctgctcagtcccctgctgctgctcacaccaccgatactgccggatataacgctatggaagaatctgtgtctagagaaaagcccgagctgacggcctcaacagagcgtgtgaacaaaaggatgtccatggtggtatctggccttacacctgaggaattcatgctcgtgtacaagtttgcaagaaaacaccacatcaccctgaccaacctgataaccgaggaaactacccacgttgtgatgaagaccgacgcagagttcgtttgtgagcgaaccttaaagtattttctgggcatcgccggaggtaaatgggtggtgtcctatttctgggtgacccagtccatcaaggagcgaaagatgttgaacgagcacgatttcgaggttagaggagatgttgtgaacggaagaaaccatcaaggcccgaagcgggccagagagtcccaagacagaaaaatattccgaggcctggaaatctgttgttacgggccttttacaaacatgccaacagatcaacttgaatggatggtgcaactttgcggagccagcgtcgtcaaagagctctccagctttaccttaggcactggagttcaccctatcgtggtcgtacagcctgacgcatggacagaggataacggctttcatgcaatagggcagatgtgcgaggctccagttgttacaagagagtgggtgctcgattccgtggctctgtatcaatgccaggagctggatacatatctgattcctcagattccccactcgcattactag

SEQ ID NO: 14109 - DNA, 2139 bp, Artificial Sequence
  Description of Artificial Sequence: Synthetic coding sequence
atgctgaagcttctcaatcagaagaaaggaccttctcagtgtcccctgtgcaagaacgatattacaaagcgctcgctccaggaaagtacacgcttcagccagctcgtggaggagttacttaagatcatctgcgcttttcagcttgataccgggctggaatatgctaactcgtataatttcgccaagaaggaaaataactcccctgaacatctaaaagatgaagtatcaataattcagagtatggggtatcggaatagagccaagcggctcctccagtcagaaccagagaatccttccctccaggagacttccctttctgtccaactcagcaatctgggcacggtccggactctgcgcaccaagcaaaggatacagcctcagaaaacgagtgtctacatcgaactgggaagcgacagcagcgaggatacggtcaataaagccacttactgctcagtgggagaccaagagctcctgcaaattacaccgcagggaacccgtgacgaaataagtctggattccgccaagaaggctgcgtgtgagttctcggaaacggacgtgactaatacagaacatcaccaaccatccaataatgatctgaacacaaccgagaaacgggccgccgaacggcatcctgagaagtaccagggtgaggccgcaagtggctgcgaatcagagacaagcgtgagcgaggattgtagcggcctgagcagtcagtcagatatcctcacaacacagcagcgggataccatgcagcataatcttattaagttgcagcaagagatggcagaattggaagctgtcctagaacagcacgggtctcagcccagcaatagttacccctcaataatttcggatagctccgcccttgaagatctccgcaatcctgagcaaagcaccagcgagaaagtgctgaccagccagaagtcatccgaatatcctatctctcagaatcccgagggcctgagcgccgataagtttgaagtgagtgccgacagctcaacgtccaagaacaaggaaccaggagtggaacgcagctctccctctaagtgcccttcattggacgatcgttggtacatgcatagctgctccgggtcactacagaaccgcaactatccaagtcaggaggaactgattaaggtggtcgacgtagaagaacagcaacttgaggagtctggaccccacgatttgacagaaactagctatcttccacgccaagatctggaggggacgccctatctagagtccgggattagcttgttctcggatgatccagagtctgatccgagtgaagacagggcaccagaatccgctcgggtcggcaatatcccctcttccacctcagcgctcaaggtgcctcagcttaaagtggccgagagcgcccagtccccagccgctgcccacactaccgacacagcaggttacaatgcaatggaggaaagcgtctctagggaaaagcccgagctcacggcatccactgaacgagtgaacaagcggatgagtatggtagtctctggtcttacgcctgaagaattcatgcttgtgtataaattcgctagaaagcaccatataacactgaccaaccttatcacggaggaaaccacacacgtggtgatgaagactgacgctgaattcgtgtgtgagcggactcttaagtatttcttgggaatagctggagggaaatgggtggtgagttatttctgggttacccaatccattaaggagaggaagatgctgaacgagcatgacttcgaggtgaggggggacgttgtcaacggccggaaccatcagggccccaagcgtgctcgggagtcacaggatcgcaaaatctttcgcggtcttgaaatttgttgttacggtccattcactaacatgcctactgatcagctcgagtggatggtgcaactgtgtggagcgtcagtggtgaaagagctgtcaagtttcaccctggggactggggtgcacccaatcgtggtggtccagcccgacgcttggacagaggataacggtttccacgccatagggcagatgtgcgaggcccccgtcgtgacccgcgagtgggttttggactcagtggctttgtatcaatgccaggagctggatacttatctgataccccagattccccacagccactattag

SEQ ID NO: 14110 - DNA, 5655 bp, Artificial Sequence
  Description of Artificial Sequence: Synthetic coding sequence
atggatctaagtgcactcagggtggaagaggttcagaatgtgattaatgctatgcagaaaattctggagtgtccaatatgtcttgagcttattaaagagcccgtttcaactaaatgcgaccacatattttgtaaattttgtatgctgaagctgttgaatcaaaagaaaggcccttctcaatgccctctttgtaaaaatgacataacgaaacgctccctgcaggagtctactcgctttagtcagttggtggaggagcttctgaagatcatctgtgctttccagctggacacaggattagaatacgctaatagctataatttcgccaaaaaggaaaacaactcccctgaacatctgaaggatgaggttagcattattcagagtatgggatatcgaaatcgagccaaaagattgctgcagtctgagcccgaaaatccctccctccaagaaacttctttgtccgtccagctgtctaacttgggaaccgtgagaactctgaggacgaagcaaaggattcagcctcagaaaacatctgtatacattgagttgggaagcgactcttccgaagacaccgtcaataaagccacctactgctcggtgggcgatcaggagctgttgcagatcacccctcagggcacacgggacgaaatctccctcgattccgctaagaaagcagcgtgcgagttttccgagaccgacgttacaaacactgaacaccatcaaccatcaaataacgatctcaataccaccgagaaacgcgctgcagagcggcatcctgagaagtaccagggtagctctgtctctaacctgcacgtagaaccatgcggcacaaacacccatgccagttctctccagcatgaaaactcttcactcctcctaacaaaagatcgtatgaatgtcgaaaaggcggagttctgcaacaagagtaagcagcctggcctggcgaggagccagcataacaggtgggctggcagtaaagaaacttgtaatgaccgcagaaccccatccactgagaagaaggtcgatttgaacgctgaccctctgtgtgaacgcaaagaatggaataagcagaagcttccctgttcagaaaatcccagggacactgaagacgttccctggattacactcaattcctcgatccagaaagtaaatgaatggttttcacgctcagacgagctgctagggtcagatgactcccacgacggggaatccgaatctaatgccaaggtagctgatgtgctggacgtgctgaacgaggtcgacgagtactcagggtcaagcgaaaaaattgatctcctcgccagtgacccccatgaagcactgatctgtaagtctgagagggtgcacagtaagtcggtagagtccaatatcgaggacaagatctttggaaagacctaccgcaagaaggcgtcattgcctaatttgtcccatgttacggaaaacttgattattggagcgttcgtcacagagccacagataatccaggagaggccactgaccaacaagcttaagcggaagcgcagacccacaagcggcctccatcctgaggactttatcaaaaaggcagatctggcggtccagaagacacccgagatgattaaccagggaaccaaccagaccgagcagaacggccaggttatgaacatcaccaatagcgggcatgagaataagaccaaaggcgactccatccagaacgaaaagaatcccaaccctattgagtccctggagaaggaatctgcttttaagacaaaggcggagccaataagctcaagcatttctaatatggaactggagctgaacattcacaacagtaaagccccaaagaagaataggctgagaagaaaaagtagcaccagacacattcacgccctggaactggtcgtgtcacgtaatctgagcccacctaattgcaccgaactgcagatcgattcctgttcatcatccgaagagataaaaaagaagaagtacaaccagatgccagtacggcattctaggaaccttcagctcatggagggcaaggaaccagctaccggagctaaaaagtctaacaagccaaatgaacagacttctaagcgacacgattccgacacctttcccgagcttaaactcaccaacgcccctgggagctttactaaatgctctaatacctcagagctcaaagagtttgttaaccctagcctgccaagggaagagaaggaagagaagttggaaaccgtgaaggtgagtaacaatgccgaggatcccaaggacctcatgttgtctggagaacgggtcctacaaacggagcggagtgtggaatcgagtagtattagcctcgtcccaggcacggattacggaacacaggaatctatttcacttttagaagttagcacactaggcaaggcaaaaactgagcccaacaagtgcgtctcccagtgtgccgctttcgagaaccctaagggactcattcacggatgcagcaaggacaaccggaatgacacagagggtttcaagtaccctctcggtcacgaggttaaccactccagagagacgtccatcgaaatggaggagtcagagctggacgcacagtacctgcagaatacatttaaggtctccaagcgacaatccttcgctcctttttcaaacccaggaaacgcagaggaagagtgtgctaccttttctgcccattcgggcagcttgaagaagcagagtcctaaagtgacattcgagtgtgagcaaaaagaggaaaatcaaggtaaaaacgaaagtaatatcaagcccgtacagaccgtcaacatcaccgcagggtttcctgtagttggtcaaaaggataagccagtcgacaatgctaagtgtagcatcaaagggggaagcagattctgtctctcttctcagtttaggggaaatgagacaggtttgattacccctaacaagcacggacttctgcagaacccctaccggataccacctcttttccctataaaaagcttcgtgaaaactaagtgcaagaagaaccttctggaagagaacttcgaagagcactccatgagccctgagagggagatgggaaacgagaacattccttctactgtatcaacgatttccagaaataacatacgggagaatgtttttaaagaggccagttcttcaaatatcaatgaggtggggtcttccacaaatgaggtaggcagtagcattaacgaaataggaagttcagacgagaatatccaggccgaactcggtagaaatagaggccccaaacttaacgctatgctgcggctgggcgtcctccagccagaggtgtacaaacagtctttacccgggagtaactgcaaacaccctgagatcaagaagcaggaatacgaagaggtagttcaaaccgtgaataccgatttttctccctatctcatttccgataacctagaacagccaatgggatcctcacatgcctctcaagtgtgtagcgagactcctgacgatcttctggatgacggagagatcaaggaagacaccagtttcgccgagaatgatattaaagaatcctctgctgtcttttcaaaaagcgtgcagaagggggaactctcaaggtccccgtctcccttcacacacacacatctggcccaggggtataggaggggcgccaaaaaactagaaagttccgaggagaacctgagcagcgaggatgaggaactgccatgcttccagcacttactgttcggcaaagtgaacaacattccctcccagtccacccgacactctacagtcgctaccgaatgcctgagtaagaacacagaggagaatctgctctctctcaagaatagtctaaacgactgttcaaatcaggtaatcctggctaaggcctcccaggagcaccacctctccgaggagaccaaatgcagtgcttcattgttttcatcacaatgctctgaattagaagacctcactgctaacacaaatacacaggaccctttcttgattgggagcagtaagcagatgcgacaccagagtgaaagtcagggggtggggctgagtgataaagaactggtgagtgatgacgaggaacgaggcactggtctggaagaaaataaccaggaagaacaaagcatggattcaaatttgggagaagcagccagcggctgcgagtctgaaacatctgtttccgaagactgtagtggcctttccagtcagtcagatattctcactacccaacaaagggacaccatgcaacataaccttatcaagctgcagcaggaaatggccgagctggaagccgtactggagcagcatgggtctcaacctagcaatagctacccttcaatcatatcagattcctcagcactggaagacctgaggaacccagagcagtctacctccgagaaagacagccatattcacggacagagaaacaacagcatgttctccaagcgccctagagaacatatctctgtccttacctctcaaaaatctagcgagtatcccatcagccaaaaccccgagggcctatcggcagacaagtttgaggtgtcggctgattcctccactagcaagaacaaagagcctggtgtggagcggagtagtccctccaagtgtcccagtctggacgatcgctggtacatgcattcatgctctggctctctgcagaatcggaactatccctcacaggaagagctgataaaggtggtagatgtcgaggagcaacagctcgaagaaagcggcccccatgatttgaccgagacatcatatctgcccaggcaggaccttgaggggaccccgtacctggaaagtggaatctcacttttctccgacgaccccgaatccgacccctctgaggaccgggcccccgagagtgctagggtggggaacattccgtcaagcacctcggccctgaaggtcccgcagctgaaagtggctgagagtgcacagtcacccgccgccgcacatacaacagacactgctggctacaatgccatggaggagagcgtgtctcgcgagaagccggagctgacagcctctaccgagcgcgttaataagaggatgagcatggtcgttagcggtctgacccccgaggaattcatgctggtgtacaaattcgctcgcaaacatcacattactttgactaatctgatcacagaggaaaccacacacgtagtgatgaagactgacgccgagttcgtgtgtgagaggaccctgaaatatttcctagggatagccggcggcaagtgggtggtctcatacttttgggttacacagtcaatcaaagaacgaaagatgcttaatgagcatgattttgaggtcagaggtgacgtagttaacggacggaatcatcaaggtccaaaacgcgcccgcgagtcccaggaccgcaaaatattccgtggtctcgagatctgttgctatggcccattcacgaacatgccaaccgaccagctggaatggatggtgcagctctgtggggctagcgtagtgaaagaattgtctagcttcacactggggaccggggtgcatcccatcgtcgtggtgcagcccgacgcatggaccgaagataatggcttccatgcgattggacagatgtgtgaggcacccgtggtgacccgcgagtgggttctagacagcgttgctctctaccagtgccaagagctggatacatacctcattccccagattccgcactcccactactag

SEQ ID NO: 14111 - DNA, 192 bp, Artificial Sequence
  Description of Artificial Sequence: Synthetic coding sequence
atggacctaagcgcccttcgcgtcgaggaagttcagaatgttattaacgccatgcaaaaaatcctcgagtgcccgatctgcttggagctgatcaaagagcctgtatctacaaagtgcgatcacatattctgcaaattttgcatgctgaagctgctcaaccagaagaagggcccatctcagtgtccgctgtag

SEQ ID NO: 14112 - DNA, 192 bp, Artificial Sequence
  Description of Artificial Sequence: Synthetic coding sequence
atggacctctcagctctaagggtagaagaggtgcaaaacgtgattaatgccatgcagaaaatccttgagtgcccaatctgcctggagcttatcaaagagcccgtgagtacaaaatgtgaccacatcttctgcaagttctgcatgctgaagttgcttaaccagaaaaagggcccctctcagtgccccttgtag

SEQ ID NO: 14113 - DNA, 2100 bp, Artificial Sequence
  Description of Artificial Sequence: Synthetic coding sequence
atggatctctccgctctccgtgtggaagaggtccaaaatgttatcaacgcaatgcagaagatactcgagtgcccaatttgccttgagctgattaaagagcccgtttcaacaaagtgtgatcacattttttgtaaattttgcatgctcaagctgctgaaccagaaaaagggccctagtcagtgccccctgtgcaaaaacgacattaccaaaaggagcctccaggagagcacaagattctcccaactggtggaggagttgctaaaaattatctgcgcattccagctcgatacgggcctggagtatgcaaacagctacaacttcgcaaagaaagagaataatagccccgaacacctgaaggacgaggtgagcattatccagagcatgggctaccgaaatcgcgccaagcgcctcctacagtcagagccggagaacccaagcttacaggaaacgagtctgtccgtgcaattgtccaatctcggcaccgtacggacgctgagaacgaaacagaggatccagccgcagaagaccagtgtgtacattgaactgggaagtgatagcagcgaggacactgttaacaaagcgacttactgctcagttggagatcaggaacttctacagatcaccccacagggtacaagggacgagatctccctggatagcgcgaagaaggccgcctgcgagttttcagagaccgatgtaaccaacacagaacatcaccagccaagcaacaacgatcttaacaccacagagaagagagcggccgaacggcaccccgaaaagtatcaaggagaggcggcttcgggctgcgaaagcgaaactagcgttagtgaagactgctcagggctctccagtcagtccgatatactaacaacacagcagagggacaccatgcagcacaatctgatcaaactgcagcaggaaatggcggagctggaagccgtcctggaacagcatggctcccaaccctcgaactcatatccttccatcatttccgattcctcagccctcgaggacctgaggaaccccgagcagagcacctcagagaaagtgctgacaagccaaaaatcaagcgagtatccaatctctcagaatcccgaaggcctctccgccgataaattcgaggtgagcgctgacagttccaccagtaagaacaaagagcccggggtggagagatccagcccttctaagtgtcctagcctggacgaccgctggtatatgcacagttgctcgggttccctgcagaacaggaactaccccagtcaggaggagctcatcaaagtcgttgatgtggaggagcagcagctcgaggaatccggtcctcacgatctgacagagactagctatctgccccgacaggacctggaggggaccccttacctggagtctggcatttccctgtttagcgacgaccccgaatctgacccatctgaggacagagctcctgaatcagccagggtggggaatattcccagttctactagtgcgctgaaagtgccgcagctgaaggtggcagagtccgctcagtcccccgccgccgctcacacaaccgatacggctgggtacaatgcaatggaggaatcagtgagccgggagaagccagaattgaccgcatccaccgagagagtaaataagcggatgtctatggtggtgtctgggttaacacctgaagaatttatgctcgtatataagttcgcacgtaaacaccacataactttgactaacctgattaccgaagaaaccacgcacgttgtgatgaaaaccgacgcggagttcgtgtgcgagcggaccttgaagtatttcttagggatagccggagggaaatgggtcgtctcctatttctgggtcacacagagtatcaaagagcggaagatgctgaacgagcacgattttgaagtccgtggagacgtggtgaacggcagaaaccatcaggggcctaagcgcgcacgagaatcacaggatagaaagatctttcgaggcctcgagatttgttgttacgggccattcaccaatatgcctacagggtgccctccgaactgcggatgcgcggcccgctgtctggacagaggtcagtggcttccatgcaactgggccgatgtgtag

SEQ ID NO: 14114 - DNA, 1950 bp, Artificial Sequence
  Description of Artificial Sequence: Synthetic coding sequence
atggacctgtccgccttaagagtcgaagaagtacaaaacgtcatcaacgcgatgcagaagatcctggagtgccctatttgcctggagctgattaaggaacccgtgagtaccaaatgcgaccacattttttgtaaattttgcatgttgaaacttctgaaccagaaaaaaggacctagccaatgccctctctgcaagaacgacattactaaaaggtctcttcaggagtcaacacgcttttctcagttagtggaggagttactcaaaattatctgcgcctttcagctcgacaccggactggaatacgctaactcatataactttgccaagaaggagaacaatagccccgaacatctgaaggacgaagtcagcataatccagagcatggggtaccgaaaccgagcgaaaaggttgctccagtcggaacccgagaacccaagcctccaggagaccagtctcagtgtccaattgagtaatcttgggactgtgcggacacttcgaaccaaacaacgcatacagccccaaaaaaccagtgtatacatcgagctggggtcagattccagtgaagatactgtgaataaggcaacttactgcagtgtgggggaccaagaacttctgcagatcacgccgcagggcacccgggacgaaatttccttagatagtgcaaagaaagctgcttgtgaattctccgaaactgatgtgacaaacaccgagcaccaccagccctccaacaatgatttgaacactacagagaagcgtgccgcagagagacatccggaaaagtatcaggggtcttccgtgtctaatttacacgtggagccgtgcggaaccaatactcacgcctcttctcttcagcacgaaaacagcagtctgctccttacgaaagatagaatgaacgtggagaaagctgaattctgcaataagtctaaacagcctggacttgcaaggtcccagcataatcgctgggccggttctaaggaaacgtgtaatgaccgaagaaccccctccacggagaaaaaggtcgatttaaacgccgacccattgtgcgagcgcaaagagtggaataagcaaaagttaccctgctctgaaaatccccgggacactgaagatgtcccttggatcacccttaatagctccattcagaaggtgaacgagtggttttctagatccgatgagctgctgggcagcgacgactctcatgatggtgaaagtgagtccaacgcaaaagtggccgacgtgctggacgtgctcaacgaagttgacgaatacagtggatcttccgagaaaatagatctgctcgctagtgacccccacgaagcccttatttgcaagagcgaacgggttcactccaagtctgtagagtccaacatcgaggataagattttcggcaaaacctatagaaagaaggcctccttgccaaatctgtcccacgtgacggagaacctcatcattggggccttcgtgaccgagcctcagatcattcaggagcgtccactcacaaacaagctaaaaaggaaacggcggccaacaagcgggctacatcctgaggattttatcaaaaaagccgacctagctgtccaaaagactccagagatgattaatcagggaacgaaccagacagagcagaatgggcaggtgatgaacatcacgaattcaggccatgaaaacaagaccaagggcgatagcatccagaacgaaaagaaccccaacccaattgagagcctggagaaggagagcgcattcaaaaccaaggctgaacctattagcagcagcatctcaaatatggagctggaactcaacatacacaattccaaagcacccaaaaagaacagattgcggcgtaaaagctcaactaggcacatccatgctctggagttggtggtctccaggaacctttccccccccaactgcacagagctgcagattgacagctgttctagctcggaggaatag

SEQ ID NO: 14115 - DNA, 5658 bp, Artificial Sequence
  Description of Artificial Sequence: Synthetic coding sequence
atggatctgtctgcacttcgcgtggaggaagtccaaaatgtcattaatgcgatgcagaagattctagaatgtcctatatgtctagagctgatcaaagaaccagtttcaaccaagtgcgatcatattttctgcaaattttgcatgctgaaactcctcaaccaaaagaaaggccccagccagtgtcccctctgtaaaaatgatatcacaaagaggagtctgcaggaatcaacaaggttttcacagctggtggaagaactgctcaaaatcatttgcgccttccaattagatacaggtttggagtatgcaaactcttacaatttcgctaaaaaggaaaataatagcccggagcatctcaaggacgaggttagcattattcagtccatggggtaccgaaaccgcgccaagcggttgctgcagtccgaacctgagaatccatcactgcaggagacctccctctcggtgcaactttcgaatctgggcactgttcgtaccctcagaaccaaacaacggatccagccgcaaaaaacttcagtgtatatcgagctgggctcggattcctccgaagataccgtgaacaaggccacttattgcagcgtgggcgatcaagagttattgcagattacccctcagggcacacgcgatgagattagccttgacagcgccaagaaagcagcctgcgaattctccgaaacagacgtaactaatacagagcaccatcagccatccaataacgacttaaatactaccgaaaaaagggccgccgagagacatccagagaaataccaagggagcagtgtgtccaacttacacgtcgagccctgtggaaccaatactcacgcaagctctttacaacatgagaactccagcctgcttttgactaaggatcggatgaatgtggaaaaggcagagttctgcaacaagtccaagcagcctggactcgcccggtcccagcataaccgctgggcgggcagtaaggaaacctgcaacgaccgacgaacaccttcgacagagaagaaggtcgacctgaacgccgaccctctctgtgagcgcaaggagtggaataagcagaaacttccttgttctgagaatccacgtgacacagaggacgtgccttggattaccctcaactcaagcattcagaaggttaatgaatggtttagtaggagcgacgaattactcgggtcagacgacagtcatgatggcgagtcagaatcaaacgctaaagttgcagatgtactcgacgtcttgaatgaagtggacgaatatagtggaagctccgagaagattgacctgctcgcatcagatcctcatgaagccctcatttgtaaatcagaaagggtacactctaaaagcgtggagtcaaacattgaggacaagatcttcggcaagacgtatagaaaaaaagcctccctcccgaacctttcccatgtgacagaaaacttgatcattggcgcgtttgtcaccgagccccagatcatccaggagaggcctctgaccaacaagttaaagcggaaacgtcggcctacatcaggcctccatcccgaagacttcataaagaaggcagatctcgctgtgcagaagacacctgagatgatcaatcaggggacgaaccagacagagcagaatggacaggtgatgaacataacgaactcagggcatgagaacaagaccaaaggtgacagcatccagaacgagaaaaatcccaaccccatcgaatccctcgagaaagagtcagcattcaagaccaaagctgagcctattagtagcagtatcagtaatatggaactcgagttgaatatccataacagtaaagcccctaaaaagaacagactgagacgcaaatcatctactcgtcacatccatgcactggaactggttgtgtcccggaacctttcgccacccaactgcacagaactgcagatcgattcatgctcaagttctgaagaaatcaaaaagaaaaagtacaaccagatgccggtccgccactcccgtaatctgcagctcatggaaggcaaggaaccagcaaccggggccaagaaatcaaataagccaaacgaacagacatccaagcgtcacgactccgacaccttccccgagctgaagctcactaatgctcccggaagtttcactaagtgctccaatacctcagaactgaaagagttcgtgaatccgtccctcccacgagaggaaaaggaagaaaagctagagacagtcaaagtatccaataacgccgaggatcccaaggatctgatgctgtctggcgagcgggtgctccaaaccgagagaagcgtcgaatctagcagcatcagtttggttccgggcactgattacggaactcaggagtcaattagccttctggaagtgagtacactggggaaagctaaaaccgagccaaataaatgtgtgtcacaatgtgccgcctttgagaaccccaaagggctcatccatggttgttcaaaggacaaccgcaatgatacagaagggtttaagtatccactggggcacgaagtgaatcactctcgcgaaactagtatcgaaatggaggaatccgaactggatgctcagtacctgcagaacacgtttaaagtaagcaagcggcagagcttcgctccattcagcaaccccggaaacgcggaagaagagtgcgcaaccttcagcgcacacagcggctcccttaaaaagcagagtccgaaagtgactttcgaatgtgagcagaaggaggagaatcagggtaagaatgagtctaacattaaaccagtgcagaccgtgaatattacggccggcttccctgtggtcggccagaaggataaacctgtcgacaacgcgaagtgttctataaaggggggctctcggttctgtctctcctctcagtttcgagggaatgagactggtctcatcacccctaacaagcacgggttgttgcagaatccttaccggataccacctctgtttcctatcaagtcctttgtgaagactaagtgcaagaagaatttgctcgaagagaactttgaggagcatagcatgtctccagagagagagatggggaatgagaacattccaagtacagtatcaacaatctccaggaacaatattagggaaaatgtcttcaaggaagctagcagctccaatataaatgaagtgggtagttcgaccaatgaagtcggcagctcaattaatgaaattggatctagtgatgagaatatccaggcagagctcggccgcaatcgtggcccgaagctcaacgccatgcttcgcctgggtgtgttgcagcccgaggtgtacaagcagagcctccccggctcaaactgtaaacacccagagatcaaaaagcaggagtacgaggaagtagtacaaaccgtgaacactgattttagcccctatctgatctctgataacctggaacagccaatgggtagctcccatgcgtctcaggtgtgtagtgaaacacctgatgacctgttagacgatggagagataaaggaggacacttctttcgccgagaacgacatcaaggagtcctccgcagtgttcagcaagagtgtccagaagggtgaactctcccgctccccatctcctttcacccacacacacttagctcagggctaccgccgaggagcaaagaagctggagagcagcgaggagaacctatcgagtgaggatgaggagctgccctgctttcagcatctgctcttcggaaaagtgaataacatcccatcacagtcgaccaggcactccaccgtggctacagagtgtctctctaagaacactgaagaaaatcttcttagtctgaagaatagtctcaacgattgtagcaaccaggtaatcctagctaaggcttcccaggagcatcatctgtcagaagaaaccaaatgtagcgcaagtctgttcagctctcagtgttcagaactggaagaccttactgccaatacaaatacccaggatccgtttcttatcggctcctctaaacagatgaggcatcagagcgagagccaaggtgtgggcttaagcgataaggagctagtgtcagacgacgaggaaagaggaaccggcttggaagaaaataaccaagaggagcaaagtatggattccaaccttggggaggccgcttcaggctgtgagtcagagacatctgtgtcagaagactgtagcggtctcagtagccaaagtgatatactgacaacccaacagagagacaccatgcaacacaacttgattaaactccagcaggaaatggcagagcttgaggcagtgttagaacagcatggaagccaaccatccaacagctacccttctattatttccgacagcagtgccttagaagacctgaggaaccccgagcaatccactagtgaaaaggattctcatattcacgggcaacgcaacaattcaatgttcagcaagcggccaagagagcatataagcgccgtccttacgtcccagaagagttctgagtatccaatcagccagaatccagagggcctgagtgcggacaaattcgaggtgtccgcagactcatccaccagtaagaataaagagccaggcgtggaaaggagttctcctagtaaatgcccttctttggacgaccgatggtacatgcatagctgcagcgggtccttacaaaatagaaactacccgagtcaggaagagcttattaaggtcgtcgatgtcgaagaacaacaactggaagagagtgggccacacgacttaaccgagacaagttacttgccccgccaggacctggagggtaccccttacctcgagagcggaatatccctgttctctgatgaccccgaaagtgatccatcagaagatagggccccagaatccgcacgggtgggcaatatcccttcctctactagcgcgctgaaagttccccagcttaaggtggccgaaagtgcccagtcacccgctgccgcacataccaccgacacagccgggtacaacgcaatggaggagtctgtgtccagagaaaaacccgagttgacggctagcacagagagagtgaacaagagaatgtctatggtggtcagcggactaacacccgaggagttcatgctggtctataaatttgctagaaaacatcacattaccctcactaatcttatcacagaagagaccacacatgtggtgatgaaaactgacgctgagtttgtctgtgagagaactctgaagtattttctcgggatcgccgggggcaaatgggtggtgtcctatttctgggtcacccaatccattaaagagcggaagatgctgaacgagcatgactttgaggtccgtggggacgttgtcaatgggcggaatcaccagggtcccaagagagctagggaatcccaggaccgcaagatttttcgcggactggagatatgttgctatggtccattcacaaatatgccgacagaccagctggaatggatggtgcagctgtgcggagcttctgttgtgaaggaactgtcctctttcacccttggaactggcgtgcatccaatcgtggtggtgcagcccgacgcctggaccgaggacaatggcttccacgctattgggcagatgtgcgaggcccccgtcgtcacgagagaatgggtgctcgattccgtcgcattgtatcagtgtcaggaattggacacttatcttattccacagattccacatagccattattag

SEQ ID NO: 14116 - DNA, 669 bp, Artificial Sequence
  Description of Artificial Sequence: Synthetic coding sequence
atggacctgtcggcactgcgggtggaagaggtgcagaatgttatcaatgccatgcagaaaattttggagtgccctatttgcttagagctgattaaagaaccagtatccacaaagtgcgaccacattttctgcaaattttgcatgcttaaactattgaatcagaagaagggtccttcacagtgtccattatgcaagaacgacatcaccaaacggtcgctccaggagtccactcgatttagccaattggttgaggagttactgaaaatcatttgtgcctttcaattggacactggattagaatatgcaaattcttacaattttgctaaaaaggagaataacagtccagaacacctgaaggacgaggtatctatcatccagtccatgggctatcggaaccgcgccaaacgactcctccagtctgagcccgagaatccatctctggagacttccctatccgtccagctgtcaaacctgggaaccgttcggactttacgcaccaaacaacggattcagccacaaaaaactagtgtgtatatcgagttaggctctgatagcagtgaagacacggttaacaaggctacctattgtagcgtcggagatcaagagctgcttcagattaccccacagggaacgcgggacgagatcagcctggacagcgcgaagaagtag

SEQ ID NO: 14117 - DNA, 1869 bp, Artificial Sequence
  Description of Artificial Sequence: Synthetic coding sequence
atggacttgtccgccttacgggtagaggaagtgcagaatgtcatcaatgctatgcagaagatcttggaatgcccgatttgcctggagctgatcaaggaacccgtaagcacgaaatgtgatcatattttctgcaaatccttgcaagagtccacacggttctcgcaactggtggaggaactgctaaaaataatatgcgcttttcagcttgatacgggccttgaatacgccaattcctacaattttgcaaagaaggagaacaactctcccgaacacttaaaggacgaggtctctatcatccagtccatgggataccggaatcgcgcgaaacgcttgctccaatcagaaccagagaatccctctttgcaagaaacttcgctgtccgtccagctgtccaatctgggtacagtgcgcacactccggactaagcagaggatacaaccccaaaagacaagtgtatacattgagcttgggtccgactcgtccgaggacaccgtcaacaaggctacctattgctcagtgggcgaccaggagctcttgcaaatcacacctcagggaacacgggatgagatctcgttggatagtgctaaaaaggcggcttgcgaattctccgagactgatgttaccaacactgagcaccaccagccttccaacaacgatctgaacacaaccgaaaagcgcgcagctgaacgccaccccgagaagtaccagggttcctctgtctctaatctgcacgtcgaaccatgcggtacaaacactcacgcaagctccctgcagcacgagaatagtagtctcctgctgactaaggaccgtatgaatgtggagaaggctgaattctgcaacaagagcaagcaacctggcctggccagatcgcagcataaccgatgggcagggtccaaagagacctgtaacgaccgccgcactccttcgactgaaaaaaaagtcgatctgaatgccgacccgttgtgtgagcggaaagaatggaataagcagaagttaccctgctctgaaaatccccgtgacaccgaggatgttccctggatcactctcaattctagcatccagaaagttaacgagtggtttagtcgtagtgacgagctactggggtcagacgacagtcacgacggcgagagtgaatcaaatgccaaggtcgcggacgtgctcgacgtgctgaacgaggttgatgagtattcagggtcttccgagaaaatcgatttactagcatctgaccctcacgaggccctaatttgtaaatccgaaagggttcatagcaagtccgtggaatctaatatcgaggataagatcttcggtaaaacttatcgcaagaaggccagcttgccgaacctctcgcacgttacggagaatctcatcattggcgcattcgttaccgaaccacagattatccaggaacggccactgacaaacaagctgaaacgaaagcggagacccacaagcggtctccaccccgaggattttattaagaaagcggacctggcagtgcagaagactccagagatgattaatcaggggactaatcagaccgaacagaatgggcaggtgatgaatataacgaacagcgggcacgaaaacaagaccaagggtgatagcatacagaacgagaaaaaccccaacccaatcgagagcctggagaaggagtccgcctttaaaacaaaggcagagccaatctcttcctctatttcaaacatggagttggaactcaatatccacaatagtaaagcaccaaaaaaaaaccgacttcggcgaaaatcaagtactcgacacatccacgccctggagctggtcgtgagcaggaacctatctcctcccaattgcactgaactacagattgacagctgttcaagctcggagtag

SEQ ID NO: 14118 - DNA, 1872 bp, Artificial Sequence
  Description of Artificial Sequence: Synthetic coding sequence
atggatctgtctgcattaagagtcgaggaagttcagaatgtgattaatgcaatgcaaaagattctagagtgtcccatctgcctagagttgatcaaagagcccgtgtccaccaagtgtgatcacattttctgtaaattttgtatgctgaagctgctaaaccagaaaaaaggaccgagccagtgccctctgtgtaagaatgatataactaagcggtcactgcaggagagcactagattcagtcaactggttgaggagctgctgaaaataatctgtgcctttcagctcgacacaggccttgaatatgcgaattcctacaactttgccaaaaaggagaataactcacccgagcacctgaaggatgaggtgtctattatccagagcatgggatatcgcaaccgagccaagcggcttctgcagtccgaaccagaaaatccctccttagagacatccttaagcgtgcagctctctaaccttggcaccgtcagaaccttacgcacaaagcaacggattcagccccaaaaaactagcgtctatatcgagctgggcagcgattctagcgaagacaccgtgaataaagccacctattgctctgtcggtgaccaggagttgctgcagattacaccccagggaacgagggacgagatctcattggactctgcaaaaaaggcagcttgtgagtttagcgaaactgatgtgacgaacaccgagcaccatcagccaagtaataatgacctgaatacaaccgaaaagcgggcggcagagcggcatcccgaaaagtaccagggggaagcagcttcaggctgcgaatccgagacaagcgtatcagaagactgctccggcttatcgagccaatctgacatcctcaccacacagcaacgtgacacaatgcagcacaacctcattaagctgcagcaggaaatggccgaactggaggcagttcttgaacagcatgggtcccagccaagcaacagttatccatctatcatcagcgatagcagcgctctcgaggaccttcgcaatcctgaacagtctacatccgagaaagcagttctaacctctcaaaagtcaagcgaatacccaattagccagaacccggagggcttatctgcggataaattcgaggtttcagctgactcctcgacttctaagaacaaggagccaggggttgagcggagttctcctagtaaatgcccgtctctagatgacagatggtacatgcatagctgtagcggcagcctgcagaatagaaattacccatcccaggaggaattgattaaagtggtcgacgtggaagaacagcagcttgaagagagtggcccacatgatctcacggagacaagctacctacctcgtcaggatctggagggcaccccgtacctggaaagcggtatcagcctgttctccgacgaccccgagtcagatccctccgaagacagggctcccgagtccgctagggtggggaacattccctcaagcacaagcgcattgaaggtcccacaacttaaggttgccgaaagcgcgcagtcccctgctgccgctcacaccactgacaccgctggttacaacgccatggaagagtcagtatcccgggaaaagccggagctgacagcctcaacagaacgggtcaacaagcggatgagtatggttgtatctggcctaactcctgaagagtttatgttggtatataagttcgcccgcaaacaccacataactttgactaatcttatcaccgaggaaacaacccacgtggttatgaagaccgatgctgaatttgtgtgtgagcgaacactgaaatatttcctcgggatcgctggtggcaaatgggtggtaagttacttctgggtgactcagagtataaaggaaaggaagtag

SEQ ID NO: 14119 - DNA, 1497 bp, Artificial Sequence
  Description of Artificial Sequence: Synthetic coding sequence
gaattactgaagataatttgtgcatttcagctcgatacgggcctggaatacgccaatagttacaactttgctaaaaaagagaataactcacccgagcatctgaaagacgaagtatcgatcatccagtcgatgggctacagaaacagggcaaagagactgcttcagagcgagcctgagaaccccagtctggagacctctctgagcgtccagctcagcaacttgggaacggtgagaaccctccgaactaaacagagaatacagccgcagaagacctctgtgtatatcgagctcgctgcttgtgagttttccgaaaccgacgttacaaataccgaacaccaccagccgtctaataacgacctgaataccactgagaagcgcgctgcggagagacaccctgaaaaataccagggcgaggcagcttccggctgcgagagtgagaccagtgtgtcggaggattgctccggtctcagttctcaaagtgacatcctgactactcagcagcgggacacaatgcagcacaatctcatcaaacttcaacaagagatggccgagctcgaggcagtgctggagcagcacggcagccaaccttctaactcctatccgtccatcatttctgatagcagcgctctcgaggacttgagaaatcccgagcagtctacgtcagagaaggcagtcctgacctcccagaagagcagcgagtatcctatctctcagaatcctgaaggactgtctgctgataaattcgaggtctctgcagacagctccaccagcaagaacaaggaaccgggggtggaaagaagttccccctccaaatgccccagtttagacgacagatggtatatgcacagctgcagcggaagtttgcagaatcggaactaccctagccaggaagagctcataaaggtggtcgacgtagaagaacagcagcttgaggaatctggacctcacgatttaacagaaacgagctatctcccccgccaagacctcgaaggtacaccttacctggaatccggtatcagtctattttcagacgaccctgagtctgacccgtctgaggaccgagccccagagtctgccagggtcggaaacatacccagttccacctccgctcttaaagttccccagctcaaggtggctgagtccgcccagtcaccagctgctgctcacactacagacactgccggttataatgcgatggaagagtccgtgagccgcgagaagcctgagttaactgcatccaccgagagagtgaacaagcggatgagtatggtggtctcaggactcacccccgaggagtttatgcttgtttataaatttgcgaggaaacatcacatcaccctcactaacctgattacggaagaaacaactcatgtagtcatgaagaccgatgcggagtttgtgtgcgagcggacgttaaagtatttcttgggtattgcgggaggcaaatgggttgtctcctatttctgggtgacacagtctatcaaagaaaggaaatag

SEQ ID NO: 14120 - DNA, 297 bp, Artificial Sequence
  Description of Artificial Sequence: Synthetic coding sequence
atggacctaagcgcgctgagagttgaagaagtccagaacgtcatcaacgcaatgcagaagattctcgagtgcccaatatgcctcgaactcattaaagagccagtatcaaccaagtgcgaccacatattttgcaaatcgttgcaggagagtacaaggttcagccagctggtggaagagctcctgaaaattatttgtgcattccaacttgataccggcttagagtatgcaaacagttataacttcgccaagaaagagaataactcaccagagcacctgaaggatgaggtctcaatatag

SEQ ID NO: 14121 - DNA, 2280 bp, Artificial Sequence
  Description of Artificial Sequence: Synthetic coding sequence
atggatctgtcagcactgcgggtcgaggaagtacagaacgttattaatgccatgcagaaaatcttggagtgcccaatctgtttagagctgataaaggagcctgtgagcaccaaatgcgaccatatcttttgtaagttctgtatgctgaaactgctgaatcagaaaaagggtcctagccagtgtcctctatgcaagaatgacatcaccaagaggagtctgcaagaatccacccggtttagtcagctggttgaggagctcctgaaaatcatatgtgcatttcagttggacactgggctggaatatgctaactcctacaattttgcaaaaaaagaaaataattcccccgaacatttgaaagatgaggtttctatcatacagagcatgggatatcggaatagggctaaaagactgttgcagagcgaacccgaaaacccttccctacaagagacctccttgagcgtgcaattgtccaacttgggaactgtgcggacccttagaacaaaacagcgcattcagccgcagaagacatcagtgtatatcgagttagggagcgattcatccgaagacactgtgaataaggcaacctactgctcagtaggtgatcaggagttactgcaaatcactcctcaaggtactcgggatgaaatctccttggacagcgccaaaaaagccgcatgcgaattcagcgagacagatgtcaccaataccgaacaccatcagccgagcaacaatgatctgaatactaccgagaagcgggcggctgaacggcatcccgaaaaataccagggggaggctgcaagcgggtgcgagagcgagactagcgtatccgaagattgcagcggccttagtagtcaatctgacatcttgaccactcagcagagagacaccatgcagcacaatttgatcaaacttcagcaagagatggccgaactggaggccgttctggagcagcacggatctcaaccgtcaaactcttaccctagcataatttccgatagctcggcactggaggatctgcgtaatccagagcagtctacctccgagaaggtactgacgagtcaaaagtcttcagaatatccaatcagccagaaccctgaaggattatccgctgataagttcgaagtctccgcggattccagcacatccaagaataaggagcctggggttgaaaggagctcacccagcaaatgtccttcattagatgacagatggtatatgcactcctgtagcgggagtcttcagaataggaactaccccagccaagaagagctgatcaaagttgtggacgtagaggagcagcaactggaagagtcaggacctcacgatctcactgagacatcctacctccccaggcaggacctagaaggtacgccatatttggaatctgggatttcgctcttctctgacgatcctgagtctgatcccagcgaagatcgggctcctgaatctgccagagtaggcaatataccatcctctacatcagccttaaaagtgccacagttaaaggtagccgagtctgcgcagagccctgctgcagcacacacgaccgataccgcaggatataatgcgatggaagagtccgtcagtcgcgaaaagccagagctgaccgccagcacggagcgcgtgaacaagaggatgagcatggtggtctccggcctgacgccagaggaattcatgctcgtttacaaattcgccagaaaacatcatatcaccttgacaaacctgattacggaagagaccacacacgtcgtgatgaagacggacgcagagttcgtatgcgagcgaacacttaagtattttctgggcattgcgggagggaaatgggtggtttcctacttttgggtaactcaatccattaaagagcggaagatgttgaacgaacatgattttgaagtaaggggagacgttgtgaatggacgcaaccaccaggggcccaaacgcgctagggaaagccaggatcggaaaatttttaggggccttgagatttgctgctacggaccgtttactaacatgccaaccgaccaactcgagtggatggtgcaactgtgtggggcgtctgtggtaaaggagctttcatcatttacactcggcacgggcgtgcaccctattgttgtggtgcagccagatgcatggaccgaggacaacgggtttcacgccatcggacagatgtgtgaagcacctgtggtaacaagggagtgggttctggactctgtggctctgtatcagtgtcaggagctggacacgtatctcataccccagattccacacagccactactag

SEQ ID NO: 14122 - DNA, 180 bp, Artificial Sequence
  Description of Artificial Sequence: Synthetic coding sequence
atggatctgtccgcactcagagtggaggaagtgcagaacgttattaatgctatgcagaaaatcctcgaatgcccaatctgtctcgaactcatcaaagagcctgtcagcacaaagtgtgatcatatattctgcaaagtgctgttatgctgcccatcctggtcgaccgtggtcagatcctag

SEQ ID NO: 14123 - DNA, 5451 bp, Artificial Sequence
  Description of Artificial Sequence: Synthetic coding sequence
atgctcaagcttttgaaccaaaaaaaggggccctcgcagtgtcccctttgcaaaaatgatattaccaagagaagtcttcaggagtccacccgcttcagccaactggtcgaagaactgcttaagattatctgtgcatttcagctggacaccggattggagtatgcaaattcctacaacttcgcaaaaaaggaaaataactcacccgaacatctgaaggacgaagttagcatcattcaatccatgggatatcggaatcgtgcgaaaagactgctgcaaagcgagccggagaacccatctcttcaagaaactagcctctctgttcagctgtcaaatctcggcaccgtccggactcttagaactaaacagagaattcagccccagaaaacctccgtctatatcgaactgggcagcgactcttctgaagacactgttaataaggccacttactgttccgtgggggaccaggaacttttgcagattaccccccagggtacgcgggacgaaatttctcttgatagcgctaagaaagccgcctgtgaattcagcgaaaccgatgtcacaaacactgagcaccatcagccatcaaacaatgatctgaatactactgaaaaaagggcagccgaacgccatccagaaaaatatcaaggaagctccgtatcaaatctgcatgtggagccttgtggcacgaacactcacgcttcctctctgcagcatgaaaactccagtcttttgctgaccaaggacaggatgaacgtagaaaaagccgaattctgtaacaaaagtaagcagccgggtcttgcacgctcccaacacaatcgctgggccggcagcaaggaaacctgtaacgatagaaggacaccatctacagaaaagaaagtcgatctgaacgcagaccctctttgtgagcggaaagagtggaacaagcagaaactcccctgctccgaaaatcccagggacaccgaagatgtaccttggattacgttaaattccagcattcaaaaggttaacgagtggttcagtcgaagcgacgagctcttgggcagcgatgactcccatgatggagagagcgaaagcaatgctaaggtcgctgatgttctcgatgtactcaatgaggtggacgagtattctggaagctcagagaaaatcgatttactggcctccgatccccacgaggccctgatttgtaagtcagagcgcgtgcactccaaatcggtcgaaagcaatatagaggacaagatatttgggaagacctaccgtaaaaaagcctctcttcccaacctctcccacgtgacagaaaaccttattatcggagccttcgtgacagaaccacaaataatccaggaacgccccctgaccaataagctgaaaagaaaacgcagaccgacatccggtttgcaccctgaggattttatcaaaaaggcagatttggctgtacaaaagactccagagatgattaatcaaggcaccaaccagaccgagcagaacggacaagtgatgaatatcacaaattctggccacgagaataaaaccaagggagacagcatccaaaatgaaaaaaacccaaaccccatagaaagcctagagaaggaaagcgcattcaagaccaaggccgagcccatttcctccagcatctctaacatggagcttgagctgaatattcataactcgaaggctcctaagaaaaacagattgagaagaaaaagctctactcggcatattcacgcactggaactggtggtttccagaaatctctctccgccaaactgtaccgaactgcagattgattcatgcagtagttctgaggagatcaaaaagaaaaaatataatcagatgcctgtgagacattcaaggaacttacagctgatggagggcaaagagccagccactggagcaaagaaatccaacaagcctaacgagcaaacaagcaagcgccatgactccgataccttccccgagctgaagctgaccaacgcacccggcagcttcactaaatgttcaaatacttcggagcttaaagagttcgtgaatccctcgcttcccagggaggagaaagaggagaagttggaaaccgtgaaagtgtccaataatgcagaggacccgaaagatctaatgctcagtggcgagagagtcctgcagaccgagcgtagtgtcgagtcatcatccatctccttggtgcccggtaccgattacgggacacaggaatcaatttctctgctggaggtgtctaccttgggaaaggccaagaccgagcccaataaatgcgttagtcagtgcgcagcatttgagaatccaaaggggctgattcacggatgcagtaaggataatcgcaacgacacggagggttttaagtatccgctcggtcatgaggtgaatcattcccgcgaaacaagcattgaaatggaagagagcgaactggacgcccagtatctgcagaatacctttaaagtgagtaagagacagtctttcgcccccttttctaatcctggcaatgccgaagaggaatgtgcaacctttagtgctcactcaggcagcctgaaaaagcagagccccaaggttacctttgagtgtgagcagaaggaggagaaccaggggaagaacgagtcaaacattaaaccagttcagacggttaacatcactgctggcttccctgttgtcggacaaaaagataaacccgtggacaacgccaaatgctcgattaaaggtggctcacggttctgcctttcaagtcagtttagaggcaacgagaccgggttgattactcctaataagcacggcttgcttcagaatccctacaggatccccccgctgtttccaatcaagagcttcgttaagactaaatgtaaaaaaaaccttctcgaagaaaatttcgaggaacactccatgtccccagagcgggagatggggaatgaaaatatccctagtaccgtgtccaccatttcacgcaacaatatcagggagaatgtttttaaggaggcctcctcaagtaacatcaatgaagtgggctcctccaccaacgaggtaggatccagcatcaatgaaatcggttcgtccgatgagaatattcaggccgagctgggaagaaatcgcggaccaaagctaaacgccatgcttagattgggtgtattacagccagaggtatataagcaaagtttacccggcagcaactgcaagcaccccgagataaaaaagcaggaatatgaagaagtggtccagactgtcaatacagatttcagcccgtatctcatatcagacaatctcgaacagcctatggggagcagccacgcctcccaggtttgtagtgaaacacctgacgaccttctcgacgacggagagatcaaggaagatacttcttttgcagagaatgacatcaaagagagttcggcagtgtttagtaaatcagtgcagaagggagaactgagtcggtcaccttctccatttactcatacacacctggctcagggatatcgtcgtggggccaaaaagctagagtcttccgaagaaaacctcagctcagaagatgaagagctgccgtgcttccagcacctgctgttcggaaaagtgaataatattcccagccaatctacacgtcattcaacagtcgcaactgagtgtctgtccaagaacacagaggaaaatcttctgtcccttaagaactccctgaacgattgcagtaatcaggtgatcctggccaaagctagtcaggagcatcacttatcggaggagaccaagtgctccgcctctctgttcagttcacagtgttccgaactggaagatctgactgccaacactaacacacaggaccccttcctgatcggtagcagtaagcagatgagacatcagagcgaaagtcagggggtgggcctgtctgataaagagctcgtcagtgatgatgaggaacgtggcaccggactcgaggaaaacaaccaggaagagcaaagtatggattcaaaccttggtgaagccgccagtgggtgcgagtctgagacgagcgttagcgaggattgctcgggactatcaagccagagcgacattctgaccacacaacagcgtgacacaatgcagcataacttgattaagctccagcaggagatggctgaactggaggcagtgctcgagcaacacggttcacagcccagcaacagctacccctccatcatctcagactcctccgccttggaggatctgaggaatcccgagcaatccacctcagagaaggctgtactgaccagtcagaaaagctcggagtacccgataagccagaacccggagggactttctgctgataagttcgaagtatccgctgactcgtctacgtcaaaaaacaaggaaccaggcgtggaaaggagctccccttccaagtgtccatccctggacgataggtggtatatgcattcctgtagcggtagcctccagaaccgcaattatccctcccaagaagagctgattaaggtggtagatgtcgaagaacagcaattggaggaaagcggcccgcatgatctcaccgagactagctacctgccaagacaggatcttgagggaaccccctatctcgagagcggaatcagcttgtttagcgacgaccccgagagcgaccccagcgaagacagagctcccgaaagcgctagagtgggaaacatacctagtagtaccagcgcattgaaagtcccccaactcaaagtggcagagtccgcgcaaagccccgcagctgctcatacaactgacaccgccggatataatgccatggaggaatccgtttccagggaaaagcccgagctgaccgcctctaccgagagagtgaacaagcgcatgtcaatggtggtgtctgggttaaccccagaggagtttatgttggtatacaagtttgcccgcaagcaccacatcacactgactaatttgattactgaggaaactacccacgtggtgatgaagacggacgcagagtttgtgtgtgagcgaacactaaaatacttcctggggattgccggcggaaagtgggtcgtgtcctatttctgggtgacccagtccatcaaagagcgtaaaatgttgaacgaacatgactttgaagtcagaggtgacgttgtgaacgggaggaatcaccagggaccaaaaagagcccgtgaaagccaagatcgtaaaatctttcgcggcctcgaaatctgttgttacggtccttttactaatatgcctacagaccagctagagtggatggtccagctgtgcggcgcaagtgtggtgaaggagctgagctccttcactcttggaaccggagttcatccgattgtagttgttcaaccagatgcctggactgaggataacggatttcacgccatcggacaaatgtgcgaagccccggtagtgaccagggagtgggtgttggactccgtcgctctttaccagtgtcaggaactggatacatacctgatcccgcagattccacactctcactattag

SEQ ID NO: 14124 - DNA, 1719 bp, Artificial Sequence
  Description of Artificial Sequence: Synthetic coding sequence
atgcttaagctgttaaatcagaaaaaagggccgagccagtgccctctgtgcaagaacgatataaccaagaggagcctgcaggagtctacacgattcagtcagcttgttgaggagttgctgaagatcatttgcgcatttcaactcgatacggggctggaatacgctaacagctacaattttgccaagaaggaaaacaacagccctgagcaccttaaggacgaggtttcgattatccagagtatgggatacagaaatcgcgcgaagaggctgctgcagtccgagccggagaacccatctctgcaggaaacgagcctgtctgtgcagctgtctaacttaggaaccgttcgcaccctgaggaccaaacagaggattcagccacaaaagacctcagtctatatcgagttaggtagtgatagcagtgaggacacagtaaacaaggctacttattgttctgtgggcgaccaagaactgttacagatcacccctcagggcaccagggatgagatttcactagattcagccaagaaagcagcctgcgagttttcagaaaccgatgtgactaacaccgagcaccaccagccatcaaataatgacctaaatacaacagaaaagcgtgctgccgagaggcatccagaaaaatatcagggagaagccgcgtctggctgtgaaagcgaaacatcagtgtcagaggactgcagtggcctatctagccagtccgacatccttaccacccagcaacgggatacaatgcaacacaatcttattaagctgcagcaagaaatggcagagcttgaagcagtactagagcagcacggctcgcagccgagcaattcatatcccagtattattagcgactctagtgctctggaagatctgcgcaaccctgagcagtcgacaagtgagaaagcagtcctgacatcacaaaagagctccgagtacccaatcagtcagaatccggagggtttgagcgctgacaagtttgaagtgagtgccgactcctctacatcaaaaaacaaggagcccggggtcgaaaggtcctcgcctagtaaatgcccttctttggatgatcggtggtacatgcatagttgcagtggaagcctgcagaatagaaattatccttcgcaggaagagttgatcaaggttgtcgacgtggaggagcagcaactcgaggaatccggcccccatgacctcaccgaaacctcatacttgccacggcaggatcttgaaggcacaccctacctggaatcaggaatctctctgttcagtgatgaccctgagagtgacccatctgaggatagagctcctgagagtgccagggtgggaaacatccctagttccacctctgcactgaaagtgccacagctgaaagtggccgagagcgcacagagcccggcagccgcccataccacggacaccgccggctacaacgccatggaggaatctgtgtcccgggagaaacctgagctcacagcgtcaactgagcgggtgaacaaacgcatgtctatggtggtgtccgggctcacccccgaggaattcatgctggtatacaagtttgccagaaagcaccatattacattgaccaacctgattacagaggaaacaacacacgtagtcatgaagaccgatgctgagtttgtctgcgagcggaccttgaagtattttcttgggatagccggtggaaagtgggtggtgtcctacttttgggtcacccagtcctag

SEQ ID NO: 14125 - DNA, 1422 bp, Artificial Sequence
  Description of Artificial Sequence: Synthetic coding sequence
atggacctcagcgcactcagggtagaggaagtgcagaatgttattaatgcaatgcagaaaatcctggagtgccccatatgcctcgaactgattaaggagcccgtgtcgactaagtgcgaccatatcttttgtaaattttgtatgctcaaactgcttaaccagaaaaaaggtccttcacaatgtcctctttgcaagaatgatattactaagcgaagtcttcaggaaagcactagatttagtcagttagtagaagagcttctcaaaatcatttgcgccttccagctggacaccggcctggaatatgccaacagctacaatttcgccaagaaagaaaacaactctcccgaacatcttaaagatgaggtaagcatcatacagtctatggggtatcgcaatagggctaaaaggttgcttcagtccgaacctgagaaccccagccttcaggagacctcactctccgtacagctctccaatttgggaaccgtgcgtacattacggactaagcagcggattcagccccaaaagacttccgtgtacatcgagctgggatccgattcctctgaagacactgttaacaaagccacttactgctcagtgggagaccaggagctgctccagattacaccgcaaggaactcgggatgaaatttccctggattccgctaaaaaggccgcctgcgaattcagtgagactgacgtgaccaatactgagcatcaccagccaagcaataacgatctgaatacaacggaaaaacgagctgcagagagacaccctgaaaagtatcaggggtcaagcgttagcaacctgcacgtggagccgtgtggtaccaacacccatgcgtcctcacttcaacacgagaacagttcattgctgctgaccaaggataggatgaatgtcgagaaggctgaattctgcaataaatcaaagcagcctggcctggccaggtcccagcacaaccgctgggccggctctaaggaaacgtgcaatgatcgccgcactccctccaccgagaagaaggtggatttaaatgccgaccccctttgtgagcggaaagagtggaacaagcagaagctcccgtgttccgaaaatccacgcgataccgaagacgtgccatggatcactctgaactcgagtatacagaaagttaacgaatggttcagccggagcgatgagctgcttggaagtgatgattctcatgacggcgagtcggaaagcaatgccaaggtagcagacgtactggacgtgttgaacgaggtggacgagtactccgggagcagcgaaaaaattgacctactggcctcagatccacatgaggcactgatctgcaaatccgaaagggtgcactctaaatccgtggagagcaacatagaggacaagatatttgggaaaacgtatcgaaaaaaagccagcctcccgaactag

SEQ ID NO: 14126 - DNA, 534 bp, Artificial Sequence
  Description of Artificial Sequence: Synthetic coding sequence
atgaacgtcgagaaagccgaattctgtaataaaagtaaacagcccgggctagcccgctcacagcacaatagatgggctggctccaaagagacctgcaatgataggagaacgccctccacagagaagaaggtcgacctaaatgccgaccccctttgtgaaaggaaggagtggaataagcagaaacttccatgctctgagaaccctcgggacaccgaagatgtgccatggatcaccctgaactcgtcgatacagaaggtgaatgagtggttcagccggtctgacgagctgctgggaagtgacgattctcacgacggggagagcgaatcaaatgccaaggtggctgacgtgctcgatgtgcttaacgaagtagacgagtattctggatcttctgagaaaattgacctcctggcctccgacccccatgaagccctgatctgcaaatctgaacgggtgcacagcaaaagcgtggaaagcaacatcgaggataagatcttcggtaagacatacaggaaaaaggccagcctccctaactag

SEQ ID NO: 14127 - DNA, 10257 bp, Artificial Sequence
  Description of Artificial Sequence: Synthetic coding sequence
atgcctatcggaagcaaagagagaccaactttctttgagatttttaagacgcgctgcaacaaggccgatctcggtcctatctccctaaactggttcgaggagctgagcagcgaagcccccccatacaattctgaacccgcggaggagtcagagcacaaaaataataactacgaaccaaatcttttcaagactccccaaagaaagccttcctataaccagctcgcttccacccccattatttttaaagagcaaggactgaccttgccactgtatcagtcccccgtgaaagagcttgacaaatttaaactcgacctaggcagaaatgtccccaattctagacataagagcttgcgtacagtcaaaacgaaaatggatcaggcggacgatgtctcttgcccactgctgaactcctgcctgtccgagtctcccgtagttctgcagtgcactcacgtcactcctcagcgggataaatccgtcgtctgtggatcactcttccacactccaaaattcgtgaagggccggcagacccccaagcatatctctgaaagtttgggcgccgaagtcgacccggatatgtcctggagcagttctttggcaacgccacccactctttcatccacagttctcatcgttcgtaacgaggaggccagcgaaaccgtgttccctcacgataccactgccaacgtaaagtcctatttcagcaatcatgatgaatccctgaaaaaaaacgatcgcttcattgcatccgtgactgattccgaaaacaccaatcagcgcgaggcagccagccacggctttggcaagacgtcaggcaactcatttaaggtcaactcttgcaaggaccatatcgggaaatccatgcccaacgtcttagaggacgaagtatacgaaacagttgtcgatactagtgaggaggattcgttctctttgtgtttcagcaaatgtcgtactaaaaacctacaaaaagtgcgaacaagtaaaacccgaaagaaaattttccacgaggccaacgccgatgaatgtgagaaaagtaagaatcaggtgaaggaaaagtacagttttgtatccgaagttgagcctaatgacaccgaccctctggattcaaatgtagcaaatcaaaagccctttgaatccggttccgacaaaatcagtaaggaagtggtcccttctcttgcctgcgagtggagtcagctgaccctgtcaggactaaatggagcccaaatggaaaagattcctctgttacatatctcaagctgtgatcagaatatcagtgagaaggatcttcttgacacagagaataaaaggaagaaagactttttgacttcggaaaactcgctgcctcgtatctcttccctccccaagtccgaaaaaccattaaacgaggaaaccgttgttaacaaacgcgatgaagagcaacacctggaaagccacaccgactgcattctagcggtaaagcaggccataagtggaacttctcccgtggcatcaagctttcagggcatcaagaagtccattttccggatccgcgagtcccctaaggagacttttaatgctagcttctcagggcatatgaccgaccctaacttcaaaaaggagacggaagcatctgaaagcgggctagagattcacaccgtatgtagtcagaaagaggattctctgtgccccaacttgatagacaacggatcgtggcccgcgaccaccacgcagaatagcgtggccctgaaaaacgccgggcttatatcgactcttaaaaaaaagactaataaatttatctatgccatacatgacgagacctcttacaagggtaagaaaattccaaaggatcagaagtctgaattgatcaactgctccgctcaattcgaagccaacgccttcgaagcccccttaacatttgcgaacgcagactctggactgctgcactcaagcgtcaaaagaagctgctcccagaatgatagtgaagagcccactctaagcctgacctcctcattcggcaccattctgagaaagtgctcacgaaatgagacttgttctaacaacaccgttattagccaagaccttgattataaagaggcaaaatgcaacaaggagaagctgcaactgtttatcactcctgaggccgacagcctcagttgcctccaggagggtcagtgcgagaacgatcccaaatcaaagaaggtgtctgatataaaagaagaggttctggctgcggcttgtcatccagtgcaacacagcaaagtcgaatacagcgacactgatttccagtcgcagaaatctcttctgtatgaccacgaaaacgcctctacgttaattctaactcccacttcaaaggacgtcctctctaacttggttatgatcagtcggggcaaggaatcatacaagatgtctgacaagttgaaagggaataattacgagtcggatgtggaactgaccaagaatatccctatggaaaagaatcaggacgtctgtgctctcaacgagaattacaagaacgtcgaactgctgccaccagagaaatacatgagagtcgctagccctagcagaaaagtccagttcaaccagaacactaatctgcgtgtcatccagaagaatcaggaggaaaccacaagtattagtaagatcacggtaaatcctgatagtgaagaactgttctccgataacgaaaacaatttcgtctttcaggtagcgaatgaaagaaacaatctggccttagggaacactaaggaactccacgaaacagatctgacatgcgtgaatgagccaatttttaaaaattcgaccatggtcctgtatggagataccggcgataaacaagcaactcaggtctctattaaaaaggacctcgtctatgtgcttgccgaggagaacaaaaactctgtcaaacagcatatcaaaatgactctcggacaagacctgaaaagtgacatttcattaaatatcgataaaataccagaaaagaacaacgactacatgaataagtgggctgggttgctgggacccataagcaaccattcctttgggggatcatttagaactgctagcaataaggaaattaagctgtctgagcataacatcaagaagtcaaaaatgttcttcaaagacatcgaggagcagtatcctacatctctcgcgtgcgtcgagatagtgaacacactcgccctggataatcaaaagaaactctctaagccacagagtatcaataccgtctccgcccatctgcaaagctccgtggtggtgtcagactgcaaaaatagtcatatcactccccagatgcttttttctaagcaggatttcaactctaatcacaatctgaccccatcccagaaggcagaaatcacggaactgtcaacaattttagaggagtctggaagccagtttgaattcacacagttcaggaagccatcttacattttacaaaaatcaacatttgaagtgcccgagaatcaaatgaccattctgaagaccaccagcgaggaatgccgcgatgccgacctgcatgttataatgaacgcccccagcattggccaggtggactcgagtaaacagttcgaggggacagttgagatcaagcggaagttcgcagggctgctgaagaatgactgcaataagagcgccagtgggtacttaactgacgagaacgaagtggggtttagggggttctacagtgcgcacgggaccaaactcaacgtttctacagaggcactgcagaaggctgttaaactgttttccgatatcgaaaacatctccgaggagacctctgccgaagtccaccctatcagtctgtccagctccaagtgccatgacagcgtagttagtatgtttaagatcgagaaccacaacgacaaaaccgtttccgagaagaacaataagtgccaactgattctgcagaataatatcgagatgactacaggtactttcgtcgaggagatcacagaaaactataaacggaacaccgagaatgaggataataaatatactgcagcctctaggaactcccataacttggagtttgatgggagcgactcgagcaagaacgataccgtctgtattcacaaggatgagaccgatctgcttttcacagatcagcataacatctgcctaaaactcagtggccagttcatgaaagaaggaaacacacaaatcaaagaggacttatccgatctgaccttcctagaagtagccaaggctcaggaagcctgccacggtaacaccagtaacaaggaacagctgaccgctacaaaaactgaacagaatatcaaggactttgagacctcagataccttttttcagactgcaagcggcaaaaatatctccgtcgctaaagagagtttcaataaaatcgtgaattttttcgatcagaaaccagaagaactccacaatttctccctcaactccgagctccacagcgatatccgcaaaaacaaaatggatatcttgagttatgaggagacagacatagtgaagcacaagatcttgaaagaatcagtcccggttggaacaggcaatcaactagtgaccttccaggggcagcctgagagggatgagaaaataaaggagccgaccctcctgggcttccatacggcatcggggaaaaaggtgaaaattgccaaggaatctctggataaagtgaaaaatttgtttgacgaaaaggagcaaggtacatctgaaataacctcatttagtcaccaatgggccaaaacactgaagtatagagaggcctgtaaagatctggaattggcatgcgagactattgaaattactgcggcccctaagtgcaaagaaatgcaaaactctttgaataatgataaaaacctggtgtcgatcgagacggtggttccacctaaactcctgtcagataatctgtgccggcaaactgagaacctcaagacctccaagtctatcttcttaaaggtgaaagtccacgaaaacgtggaaaaggagacagcgaagtccccagccacttgctatactaatcagagcccatactcagtgattgaaaatagcgcactcgcgttttacactagctgttctcgcaaaacgagcgtgagccagacttctttactggaggctaagaaatggctccgtgagggcatatttgatggccagcctgagagaatcaacacagctgactatgtggggaactacttgtatgagaacaacagcaactccacgatcgccgaaaacgataagaatcatttgagcgagaaacaggatacctacctctcaaatagcagtatgagcaattcttactcctaccattcagacgaggtgtacaacgattcaggctacctgagtaagaacaagttggactccggaatagaacctgtattaaagaacgtggaagatcagaagaataccagcttctctaaagtaatttctaacgttaaggatgccaacgcttacccgcaaactgtcaacgaagatatatgcgttgaggaacttgtgactagtagttctccatgtaaaaacaaaaacgccgccataaagctgagtatctccaactccaacaactttgaagtcggccctcctgcattcagaattgcctctggcaagatagtctgcgtgagtcacgaaaccattaaaaaagtcaaagacatcttcaccgattccttcagtaaggttataaaggaaaacaacgagaacaagtcaaagatctgccaaactaaaattatggcagggtgctatgaagcgctggatgacagtgaagatattctccacaattcactggacaacgatgaatgttctactcacagccacaaagtctttgccgacattcaatccgaggaaatccttcagcataaccaaaacatgagcggactggagaaggtgtcaaagattagcccttgcgacgttagcctcgagacttccgatatatgcaagtgttcgattgggaagttacacaagtcagtgtcctctgccaacacctgtggaatcttcagcaccgcaagcgggaaatccgtacaggtgtcagacgctagcttgcagaacgctcgacaggtgttcagtgaaatcgaggacagtaccaagcaggtgttttcaaaggtgctatttaagtccaatgaacatagcgaccaactcacacgggaggagaacactgccattcgtacccctgaacacttgatatcacaaaaaggattttcatacaacgtggtgaattccagcgcctttagcggtttcagtaccgcgtccggcaaacaagtctcgatacttgaatccagccttcataaagtgaaaggagtgctggaagagtttgacctgatacgtaccgaacatagtctacactactccccaacaagtcgccagaacgtgtcaaagatcctcccaagggtcgacaagaggaatccggagcactgcgtaaactcagagatggaaaagacatgcagtaaggaattcaagttgagtaacaacctcaatgtcgagggcggctccagcgagaataaccactcgataaaggttagtccatacctttctcagtttcagcaggacaaacagcagcttgttctgggaacaaaggtctcattggtcgagaacatccacgttctggggaaggaacaggcgtcccccaagaacgtcaagatggagattggcaaaacagagacattctcggatgtccctgtcaaaactaatatcgaggtttgtagtacctactcaaaggacagtgagaactacttcgaaacagaggctgtggaaatcgccaaagcctttatggaagacgacgagcttacagattcaaaactcccctctcatgccacccatagcctgtttacatgccccgaaaacgaagagatggtcctgagcaactcccgcatcgggaaacggaggggggaacctctgattctagtgggtgaaccctctataaagcgtaatctgctgaacgaattcgacagaattatcgagaaccaagagaagtccctcaaggccagtaagtccaccccagacggcaccattaaggacaggagactgttcatgcaccacgtctcactcgagccgataacttgtgtcccctttagaacgaccaaggagagacaggaaatccagaatcccaacttcaccgctcctggacaggaattcctctccaaatcccacctctatgaacatttaaccctggaaaagtcatcctccaacctggcagttagcggccatcctttttaccaagtgagcgccacgaggaatgagaaaatgcgccatcttatcaccacaggtcgtcccaccaaagtctttgtgccaccattcaaaacaaagagccacttccatcgcgttgaacagtgtgtgcgaaatatcaatctagaggagaacaggcaaaaacaaaacattgacggccatgggagcgatgacagcaaaaataaaataaacgataacgaaattcaccaatttaataaaaataatagcaaccaagcggtggccgtaacgttcaccaagtgtgaagaggagcccctcgatctcatcaccagtctccagaacgcaagagacatccaagatatgcgcattaagaagaaacaacgacaacgcgtgtttccccagccaggatcactttacctggcgaagacctccacattgccccgcataagcttgaaggccgcagtcggaggccaggtgccctccgcctgctcacacaaacaactgtatacatacggggtttctaaacattgcattaaaatcaactcaaaaaacgcggagtcatttcagtttcacacagaagattatttcggcaaagaaagcttatggaccgggaagggaatccaactggcggatggaggctggctgattcccagcaacgacggcaaagcaggaaaagaggagttttatcgcgccttgtgcgacacccctggtgtcgatcctaagctgatttcccgtatctgggtgtacaatcattaccgatggatcatctggaaactcgcggccatggaatgcgcgtttcctaaggagtttgcgaatagatgcctaagccccgaacgagtgctgctgcagctcaaataccggtatgataccgagatcgaccggtcccgccgatctgcgatcaagaagatcatggaaagagatgacacggccgcgaagacactggtgctttgtgtgtccgacatcatctccctgtctgctaacatatctgaaacatctagcaataagacatcttcagctgacacccagaaggtggctattatagagctcacagacgggtggtacgccgtgaaggcccaactggaccctcctctgcttgccgtgctgaaaaatgggcggttgactgtgggacaaaagattatcctgcacggagctgaactggtgggaagcccggacgcttgtactcccttggaggccccggagtccctgatgctgaaaatttcagccaactcaacgaggccggctagatggtatacaaaattagggtttttccccgaccccagaccttttccactgccactctcatctctgttctcagacggcggcaacgttggttgtgttgatgtgatcattcagcgcgcgtaccccatccagtggatggagaagacatcatctggattatacatctttcgcaacgagcgtgaagaagagaaggaggccgctaagtacgttgaggcacagcagaaaaggctcgaagctctgttcaccaagatccaggaagagttcgaagagcacgaggagaatacgacgaagccttatctgccaagtcgggctctcacccggcaacaagtgagggccttgcaggacggagctgagctgtatgaggcagttaaaaacgccgctgaccccgcctacctggagggatatttctccgaggagcagctgcgggccctgaataaccaccgtcagatgctgaatgacaaaaagcaggcacagatccagctggagattcggaaagcaatggagtcagccgagcagaaggaacagggcctgagcagagacgtgactaccgtctggaaattaaggatagtaagctactccaaaaaggagaaggattccgttattctttcaatctggaggcctagcagcgatctttactctctgttgaccgaagggaagcgctacaggatctatcacttggctacttcgaaatcgaagtcaaaatctgagcgcgcaaatattcagctggctgcaactaaaaaaacacagtatcagcagctgccagtttctgacgaaatcctcttccagatttaccagcccagagaacccttacacttttccaagtttctagatccggactttcagccttcttgcagtgaggtggatttaattggcttcgtggtatccgttgtcaagaagactgggttggccccctttgtctatctgtctgacgagtgctataatctcctggctatcaagttttggatcgatttaaacgaggatatcataaaaccacatatgctgatcgccgcctcgaatctccagtggagacccgaatctaagagcggactgcttactctgttcgcaggagacttctctgtcttttccgcctcccccaaggaggggcactttcaggaaacctttaataagatgaagaacactgtggagaacatcgacatcctgtgtaacgaagccgagaacaaactgatgcacattctgcacgccaatgaccctaaatggagcacaccgacgaaagattgcacgagcggcccatataccgctcagatcataccaggaacagggaataagcttctaatgtcctctccaaattgtgagatctattaccaaagtcccctgagcttatgcatggcaaaacggaaaagcgtttccacaccagtctcagctcaaatgactagtaagtcctgcaagggagagaaagagatcgacgaccagaaaaattgtaagaaaagacgcgccctagacttcctttctcgactgccactccctcccccagtttcaccaatctgtacattcgtcagcccagcggcccagaaggcattccagcccccccgcagttgcggaacaaagtacgagactcccatcaagaaaaaggaattaaacagtccccagatgaccccatttaagaagtttaacgagatttcccttctggagagcaattctattgctgatgaagagctcgccctgataaacactcaggcactgctatccggctctactggtgagaagcagttcatttcggtgtcagaatcaactcggactgcccctactagttccgaagactacctgagactgaagaggagatgcacgacctccctgattaaggagcaagaatcttcacaggcatcgactgaggagtgcgaaaagaataaacaggacacgatcaccaccaaaaagtacatatag

SEQ ID NO: 14128 - DNA, 1809 bp, Artificial Sequence
  Description of Artificial Sequence: Synthetic coding sequence
atgccaatcggttccaaggaacgccctactttctttgagatcttcaagacacggtgtaacaaggcagggccaatctcgctaaactggtttgaagaactgagtagcgaggcaccaccatataatagtgagcctgctgaagaaagcgaacacaaaaacaataactatgagccgaatctgtttaagacaccgcagagaaaaccttcctacaaccagctcgctagcacacctattatattcaaagagcagggtctgaccctcccactgtaccagagccctgtgaaagagctggacaaatttaaacttgaccttgggagaaatgtgcctaactcccggcataaatccctgcggaccgtcaagacaaaaatggatcaagcggacgacgtatcctgtccattactcaactcttgcctgagtgaatcccccgtggtcctgcagtgtacacacgtcacacctcaacgagacaagtccgtcgtttgtggctccctgtttcacactccaaaatttgtgaagggacgccaaaccccgaaacacatttcagagagtctgggcgcagaggtggaccccgacatgtcttggagttcaagccttgctacaccccctactctgtccagcacagtgctcatagtgaggaacgaagaagcctctgagacggtgttcccacatgacaccaccgcgaacgtgaagagttatttcagtaatcatgatgagtcattgaagaagaacgacaggttcatcgccagcgtcaccgattccgagaacacgaaccagagagaggccgctagtcacggtttcggtaaaacatccgggaatagcttcaaagtgaattcatgcaaagaccatatcgggaaatccatgccgaatgtcctcgaagacgaggtctatgaaaccgtcgtggatacctcagaagaagactccttcagtctctgcttcagcaagtgccggaccaaaaatcttcagaaggtcaggacaagcaaaacacgcaagaaaatcttccatgaggctaacgcagacgagtgcgagaaatccaagaatcaggtcaaggaaaagtactcctttgttagcgaggtagaaccaaacgacacagatcccctggactccaatgtggccaatcaaaagccattcgagtctggttcggacaagatctcaaaagaggtggtcccctccttagcctgtgagtggagtcagcttactctgtctggcttgaacggggcccaaatggagaagatccctctgctgcacattagttcatgcgaccagaatatctccgagaaggacctgcttgacacagaaaacaagcgtaaaaaggattttttaacatccgagaactcactgccacggatctctagtctgccgaaatctgagaagccactaaatgaagaaaccgtggtgaataagcgcgatgaagagcaacatctggaaagtcatacagattgtattctggccgtcaagcaggcaatttccggcacttcgccagtcgcaagcagcttccaggggattaagaagtcaatttttcggattagggaatccccgaaggaaacctttaacgctagcttctccggacacatgaccgaccccaactttaagaaggaaaccgaggcgagtgagagcggcctcgagatacacactgtctgctcacaaaaggaggatagtctgtgtcctaatctcattgacaacgggtcttggccggcgacgactacccaaaattctgtcgcactgaaaaatgcagggctgatcagcacgcttaagaaaaagaccaataaatttatctacgccatccacgacgagacaagctacaaagggaagaaatag

SEQ ID NO: 14129 - DNA, 10257 bp, Artificial Sequence
  Description of Artificial Sequence: Synthetic coding sequence
atgcccatcgggtccaaagagcggccaacgttttttgagatctttaagaccagatgcaataaggctgatcttggtccaatatccctcaactggtttgaggagctcagttctgaagcacctccttataattccgaaccggccgaggagtcagagcacaaaaacaataactacgagcctaatctcttcaagaccccccagagaaagccctcgtataaccagctggccagtacgcccattatctttaaagagcaagggctgacactcccgctgtaccagagtcctgtcaaggaactagacaagttcaaactggatcttggcaggaacgttcctaatagccgtcacaagagccttagaactgttaaaaccaagatggaccaggcagatgatgtaagttgccctcttcttaatagttgtctcagtgagtctccggtcgtgttgcaatgcacacacgtgactccccagagggacaaatccgttgtgtgcggctccttgttccatacaccaaaattcgtgaaggggaggcagacaccaaaacacatttcagaatctctcggtgctgaagtggacccagatatgtcctggtcaagctctctcgcaacacccccgacgctcagctctacagtgctgatcgtgcgaaacgaagaggctagtgaaaccgtatttccccatgacacaactgcaaatgtcaagtcctatttttctaatcatgatgagagccttaaaaaaaatgatcggtttatcgcctctgtgacagattcagagaacacaaatcagagagaggccgcctcacatggattcggcaagacctccggtaatagcttcaaggtgaatagttgcaaggatcatatcggaaagagcatgcccaacgtcttggaggatgaggtgtacgagacagtcgtagacacaagcgaggaggatagctttagtctctgcttctctaaatgtaggacaaaaaacctgcagaaagttaggacctccaaaactaggaaaaaaatctttcacgaggcaaacgctgatgagtgtgagaagagcaagaaccaggtcaaagaaaagtattctttcgtgtctgaagttgaacctaatgacactgaccccttggactcaaatgttgctaatcagaagccgttcgagtccggttcagataagatctccaaggaggttgtccccagcctcgcctgcgaatggtcacaactaactctgtcgggcctcaacggcgctcagatggaaaagatccctctactgcacatcagtagttgcgaccaaaacatcagcgagaaggacctgctggatacagagaataagcgtaagaaggactttctcaccagcgaaaacagcctaccacggatttcttccttgccgaagtcagaaaagcctcttaatgaagaaaccgtggtaaacaaacgagacgaagaacagcacctggagagccacactgactgcatcttggctgtgaagcaggccatttcaggcacctctccagtggcctccagtttccaggggattaagaaaagcatcttccgcatccgggaaagcccaaaagagacgttcaatgcctcattttcaggccatatgaccgatccgaatttcaagaaggaaacggaagcctctgagtccgggctggagattcacactgtgtgctctcagaaggaggactcactctgtccaaatcttatcgataatggtagctggccagctacaactactcagaatagtgtcgccttaaagaatgctgggctgatcagcaccctgaaaaagaaaacgaacaaattcatctacgccatccatgatgaaacgtcttacaaagggaaaaagatccctaaggaccagaaaagtgagcttatcaattgctccgcgcagtttgaggccaacgccttcgaagcccctttgacttttgctaacgctgattctggcttgcttcatagcagtgtaaaaagatcttgcagccaaaacgactctgaagagcctaccctgagcttgacgagcagctttggcactatactgaggaaatgcagtcggaacgagacatgctccaacaacaccgtcatctctcaggatttggactacaaggaggccaaatgcaacaaggaaaagctgcagttattcataactcccgaggcggatagtttatcttgtctgcaggagggacagtgtgaaaatgatccaaagagtaaaaaagtctcggatattaaagaggaggtacttgccgccgcctgccaccccgtgcagcactcaaaggtggaatactccgacacagatttccagtcgcaaaagtctcttctgtacgatcacgagaacgcttctaccctcatcctgacccccacctctaaggatgtgttgagtaacctcgtgatgatcagccggggcaaagagtcctacaagatgagtgacaaactcaagggaaacaactatgaatctgacgtggagctgacaaaaaacatcccaatggaaaagaaccaggatgtatgcgctctgaatgaaaactacaaaaacgtggaactgctgcccccagaaaaatatatgcgggtcgcctccccctcccggaaagtgcaattcaaccagaatacaaacctgagggtgatccagaagaatcaagaggagacaacatctatcagcaagatcactgtgaatcctgatagtgaggagctgtttagtgacaacgaaaataattttgtatttcaggttgcaaacgagaggaataatctcgccctggggaatactaaggagctccacgaaacagatcttacctgtgtgaatgaacccatcttcaaaaactcaaccatggtactttatggggacacaggggacaagcaagccactcaggtttctattaagaaagaccttgtgtatgtcctggccgaggaaaacaaaaactcggtgaaacaacacattaaaatgacgctgggacaggatctgaaatcagatatttccctgaacatcgataagatcccagaaaagaataatgactacatgaataagtgggctgggttactggggcccatctccaatcacagctttggcggcagctttagaactgcgtccaacaaggagatcaaattatcggagcataatatcaaaaaaagtaagatgttctttaaggacattgaggagcagtatccaacttccctggcctgcgtggagatcgtgaatactctggccctggacaaccagaagaaacttagtaaaccgcagagcattaacacagtttctgcacatcttcagtctagtgtcgtggtcagtgattgcaaaaactcacatatcacaccacagatgctattcagtaagcaagactttaattctaatcacaacctcacgccctctcagaaagctgagattacagaattatctaccatcttggaagaaagcggtagtcaattcgagttcacccaatttcgcaagcctagctatatccttcagaagagtacgtttgaggtgccagaaaaccagatgacgattttgaagaccacaagtgaagaatgccgcgatgccgatctccatgtcatcatgaacgctcctagcataggtcaggtggactcttctaagcagtttgagggcactgttgagataaagaggaagttcgcgggcctcctcaagaatgactgtaacaagagtgcgagcggatacctgaccgatgagaacgaagtgggtttccgtggattttattcggcccacggcactaagctaaacgttagcaccgaggcactgcagaaggctgtgaaactctttagcgacattgagaacattagcgaggaaacttctgcagaagtccaccctatatccctttcaagcagcaaatgccatgactccgtcgtatctatgttcaagatagaaaatcacaatgacaagacagtgagtgagaaaaacaataaatgccagctgattttgcagaataacattgaaatgacaacaggcaccttcgtggaagagataaccgagaactacaaaaggaacactgaaaacgaagataacaagtacacagccgcctctcgaaacagccataaccttgagttcgacggaagtgattccagcaaaaacgacacggtttgcatccacaaggatgaaactgatctgctttttacagatcagcacaacatctgcctaaaactgtcggggcaattcatgaaggaaggcaacacacagattaaagaggacttaagcgacctgacatttctagaggtcgcaaaggcgcaggaggcttgccatggcaacacgtccaacaaggaacagcttaccgctacgaaaacagaacagaacattaaggatttcgagaccagcgacacgttttttcagaccgcgagtggaaagaatatctcagtcgccaaagagagcttcaacaaaatcgtgaactttttcgatcagaagcccgaagagttgcataactttagtctgaactccgagctccacagtgatattaggaagaataagatggatatcttgagctacgaggagactgacatcgtcaagcataagatcctgaaagaaagcgtccctgtcggcacgggaaatcagctggtcacctttcaaggacaaccagaacgcgacgagaagatcaaagagcccacactgctggggttccataccgccagtggaaaaaaggtcaagatcgccaaggaaagcctcgacaaggtgaaaaacctgtttgacgagaaagagcagggaacctctgaaattacctcattctctcaccagtgggctaagacacttaaatacagggaggcttgcaaagacttagaactggcgtgcgagactatcgaaattacagccgcccccaaatgtaaggagatgcaaaacagtctgaataacgacaagaacttagtgagtatcgagaccgtagtcccccctaaactcctttctgacaatctgtgtagacaaacagagaatttgaagaccagcaagtccatctttctgaaagtgaaagtacacgagaacgtcgagaaagagaccgcaaagtccccagccacttgttacaccaaccagagtccttactccgtgatcgagaattctgcactcgctttctacacctcctgttcccgaaaaacatctgtgagccagacttctctcctcgaagcaaaaaaatggttaagggagggaatctttgacggacaacccgaacgtataaacaccgcagactacgttggtaactatctgtacgaaaacaatagcaacagcactatcgcagagaatgacaaaaatcatttatccgagaagcaggacacatatctcagtaacagtagcatgtctaattcctacagctatcattctgatgaagtgtataatgactccggctacctgagtaaaaacaaactggattcaggcatcgagcctgtactgaaaaatgtagaggatcaaaagaataccagtttctccaaagtgatttccaacgtcaaggatgcgaacgcctatccccagaccgtaaacgaggacatttgtgtcgaggaactggtcacctcttcctccccatgtaaaaacaaaaacgctgccattaagctatccatttcaaactcaaacaattttgaggttggtcccccagcgttccggatcgctagtggaaagatcgtctgcgtttctcacgagacaatcaaaaaagtcaaagatatcttcactgatagttttagcaaggtgatcaaggagaataacgagaacaagtctaagatctgtcagaccaaaattatggcaggctgctacgaggctctcgatgacagcgaagacatactgcacaattccctggacaatgacgagtgttccacacattctcataaagtgttcgcagacatccagagcgaggagattcttcagcataatcagaatatgagtggcctggagaaagtctctaagatctccccatgtgacgtgtccctggaaacaagtgacatctgcaaatgctcaatcggcaagctccataaaagtgtgagctctgccaatacctgcggaattttttctacagcctccgggaaatcggtgcaggtcagtgacgctagtttgcaaaatgccagacaggtgtttagtgagattgaggattccacaaagcaagtgttcagcaaagtgctttttaaatccaacgaacatagcgaccaactgactagagaagagaatacagccattaggaccccagagcacctgatttcacaaaagggtttttcgtataatgtagtgaacagctccgcattttctggattctctacagccagcgggaaacaggtcagcattctggagtcttcgctgcacaaagttaagggagtgctggaggaatttgatcttattagaacagaacatagtctgcattattcccctacttccagacagaatgtgtctaaaattttgccccgggtggataagcgaaacccggaacactgtgtaaattccgagatggagaaaacgtgttccaaggagttcaaactaagcaataacctgaacgtggaaggaggctcttcggagaacaaccattcaatcaaagtatctccatacctcagccaattccagcaggataagcagcagttagtcttaggaaccaaggtgagcttagtcgaaaatatccacgtgctgggaaaagagcaggcgtccccaaaaaatgtaaaaatggaaattgggaaaaccgaaaccttctccgatgtgcccgtcaagactaacatcgaggtgtgcagcacatactccaaggattcagagaactacttcgaaactgaggcagtggagatcgcgaaggctttcatggaggacgatgaattgaccgacagtaagttaccctcccacgcgacccacagcttatttacctgtcctgaaaacgaggagatggttctaagcaatagtaggataggcaaaaggagaggcgagccattgatcctcgtaggagagccatctatcaaacgcaacttgttaaatgagttcgaccgcatcatcgagaatcaagaaaaaagtctcaaggcatccaaatccaccccagacggcacgattaaagatcgtaggctgtttatgcaccatgtttctttggaaccaatcacatgcgtgcctttcaggaccacaaaggagcgccaggaaatccagaaccccaattttaccgctcctggacaggaatttctctccaagtcacatctttacgagcacctgacactggagaagagtagttctaatcttgcagtgtcaggacatcctttctaccaggtcagcgcaaccaggaacgaaaagatgaggcatctgatcaccactgggcgccccacgaaggtgtttgtgccacctttcaagactaagagccacttccatcgcgttgagcagtgtgtccgtaacattaaccttgaggaaaacagacagaagcagaacattgatggacatggttccgacgactctaagaacaagatcaacgataacgagattcaccaattcaacaagaacaattccaatcaggccgtcgccgtgactttcacaaaatgcgaggaggagcctctcgacctgatcacctcgctccagaacgctcgggacatccaggacatgcggattaaaaaaaagcagcgtcagagagtgttcccccagcccggctcactgtatctggccaagacctctacgttaccccgcatcagcctgaaggccgcggtaggagggcaggttcccagcgcttgctcgcacaaacaattgtacacatatggagtgtcaaagcactgcatcaaaatcaactctaagaatgcggagtcgttccagttccacacggaagattattttgggaaagagtccctatggacaggcaagggcatccaactggccgatggtggttggttgatcccgtcaaacgacgggaaagctgggaaggaggaattttacagagccctatgcgacacacctggggtggatcccaagctcatctcaagaatttgggtgtataaccattacaggtggatcatttggaagttggccgcgatggagtgtgcctttccaaaggagtttgccaatcggtgtctgtcaccagaaagagtgctgttgcagctgaagtataggtatgacaccgagatcgatcgctctaggcgaagcgccatcaagaagatcatggagcgagatgataccgctgctaagacactagtgctctgcgtgtcagacatcatcagcctctcggccaacatctctgaaacaagttccaataagactagtagcgcagatacgcagaaggtggctatcatcgagctgaccgacggctggtacgctgtgaaagcccaattggacccacccctgctggctgtcctaaaaaacgggcgcctaacagtcggccagaaaatcatccttcatggggccgaactggtgggcagccctgatgcttgtacccctctggaggcgcctgagagtttgatgctgaaaatctctgccaactctacccggccagcccggtggtatacgaaactcgggtttttccctgatccccgtcctttccccctcccgctgagcagcctattctccgacggagggaacgttgggtgcgtcgatgtaatcattcaaagagcataccccattcagtggatggagaagacttcctccggattgtacatcttccggaacgaacgtgaagaagagaaggaagctgctaagtacgtcgaagctcagcagaagagactggaagccctgttcacgaaaattcaagaagaattcgaagagcatgaggaaaacacaaccaagccatatctgccgtctcgtgctctcacaagacagcaggtacgggccctgcaggatggggccgaattgtacgaggccgtcaagaatgctgccgaccccgcctacttggaaggatactttagcgaggaacagttacgcgccctgaacaaccatcggcaaatgctgaatgacaagaagcaggctcagatccagctagagatccggaaggcgatggagtctgccgaacaaaaggaacagggcctctctcgagatgtgactactgtgtggaagctgaggatcgtgtcctatagcaagaaggagaaggattcagtgattctgagcatctggcgtccctctagtgatctctattccttgctaactgaaggcaaacgctaccgcatttatcatttggctacaagtaaatctaagtcaaagagcgagcgggcaaacatccagttggctgccactaagaagactcaataccagcaactgccggttagtgatgaaattctctttcagatataccagcctcgtgaaccccttcatttttccaagtttttagatcccgacttccagcctagctgctcagaagtggacctgatcggcttcgttgtctcggttgttaagaaaactggattggcaccattcgtttaccttagtgacgagtgttacaacttgctggccatcaagttctggatagacctgaatgaggacatcattaagccacacatgcttatcgctgcatccaatctgcagtggcggcctgaatcaaaatcgggattgctaacgctcttcgcgggagacttctctgtctttagcgccagccctaaggaggggcattttcaagagactttcaacaagatgaagaacacggtggagaacatcgacattctgtgcaacgaggctgaaaacaaactgatgcatattctgcatgctaatgacccaaagtggtcgacaccaaccaaagactgcacgagtggtccctacactgctcaaattatccctggaaccggcaataagctcctgatgtcgtcccccaactgcgagatctactaccagtctcccctgtccctgtgcatggctaagagaaagtctgtcagcaccccagtgtctgcgcagatgaccagcaagagttgtaaaggcgaaaaggagatcgacgatcagaagaattgcaagaaaaggcgcgccctagactttcttagcaggttgccactgccaccgccagtcagtcccatttgcactttcgtgtctcccgccgcccagaaagcctttcaacccccaaggtcttgcggcacgaaatatgaaaccccaatcaaaaagaaggagctgaatagcccacaaatgacccctttcaagaagttcaacgaaatttctctgctagagagcaattctatcgccgatgaagagctcgccctgatcaacacccaagcccttctaagcggaagtacgggagagaaacagtttatctcagtgtccgaatcaacccggacagcacccacatcctccgaggactaccttcgcttgaaaagaaggtgtacgacctccctgattaaggaacaggagagctcacaggcatcgaccgaagaatgtgagaagaataagcaagacactataactaccaaaaagtatatctag

SEQ ID NO: 14130 - DNA, 2667 bp, Artificial Sequence
  Description of Artificial Sequence: Synthetic coding sequence
atgcattgccctggggaggcacccctcgccgcaccacggcctacaccaaaggacccttgcctcagaaatgttctggctaaagcactgtacgataatgtggctgagtcacctgacgaattgtcattcagaaagggcgacattatgaccgttctggagcaggatacgcagggcctggacgggtggtggttatgcagtctgcacggacggcagggcatcgttcccggcaacaggctgaaaatcttggtgggcatgtacgataagaagcctgcaggccccggacctggcccccctgccactccggcgcagcctcagccaggactgcacgcccctgccccacccgctagccagtatacaccaatgctacctaatacgtaccagccccagcctgatagcgtgtacctggtacctaccccttctaaggcacagcaggggctttatcaagtcccaggcccctctccgcagttccagtcaccccccgccaagcagacaagcactttttcaaagcaaacaccccatcacccctttcccagccctgccaccgatctctatcaggtgccgcccggccccggcggaccagctcaggacatttaccaggtccctccctccgccgggatgggccacgatatctatcaggtacctccctccatggatacgcgcagttgggagggcactaaacctcccgctaaggttgtggtgccaacaagagtggggcagggttacgtgtatgaggccgctcagccagagcaggacgaatatgatatccctcgccatctcctggccccaggcccccaagacatatatgatgtgccgcccgtccggggcctgctgccctcccagtacgggcaggaggtgtatgatactccacccatggcagtgaagggccccaacggaagggaccccctcctggaggtctacgacgtacccccatccgtcgagaaagggctgccaccttctaaccaccatgccgtttatgacgtgcccccttccgtgtctaaggacgtacccgacggtccgctgctgcgggaagagacatatgatgtgccccccgcctttgctaaggccaaaccctttgatcctgcacggaccccccttgtcctggccgcccctccccccgactcgccacctgctgaggacgtttacgatgtccctccaccggctccagacctttacgacgtccctccagggttgcggcggcctggccccgggacactgtacgatgtgccccgtgaacgggtgttaccacccgaggtagccgacgggggcgttgtggacagtggtgtctacgcagtgcctcctcccgctgagcgcgaagcccccgccgaaggcaagcggctgagcgccagtagcactggttccacacggagtagccagtctgctagtagccttgaagtggccgggccaggtcgagaaccactggagctggaagttgccgtggaggcactggctagactccagcaaggcgtgagcgctacagttgctcatctgctggacctcgcaggatctgccggcgccacaggttcttggcgttcgccaagcgaaccccaggaacctctggtccaagatctccaggccgctgtcgccgctgtgcaatccgccgtccatgaacttttggaattcgctcggtcagctgtcggaaatgctgcccacacttcagatcgtgccttacatgccaagcttagccgccagctgcaaaagatggaagatgttcaccagaccttagtggcccacggtcaggctctggacgccggtagggggggtagcggggctacgctcgaggacctggacaggctcgtcgcatgcagtagagccgtacccgaagatgctaagcagctggccagttttctgcacgggaatgccagcctcctgttcagaagaacgaaagcaactgctccggggcctgaaggagggggtactctgcatccaaatccaacagataaaacttcttctattcaatcccgaccacttccgtctcctccaaagttcacctcacaggactcccctgacggacagtacgagaatagtgagggcggctggatggaagattatgactacgtccatctgcagggtaaggaagagttcgaaaagacacagaaagagctgctggaaaagggctccatcacccgccagggcaaaagccaattggagctgcaacaactgaagcagtttgaacgactggagcaagaggtgtcccgtcctattgatcatgacttggcgaactggacaccagcccaacctctcgcacccggacggactggcggactgggcccctcagacagacagctcctactgttctatctcgagcagtgcgaggctaacttaaccacactcacaaacgccgtggacgcatttttcaccgctgtagcaaccaaccagccaccgaagattttcgtggcacacagcaaatttgtcatcctgtctgcacacaagttggtctttataggcgacactctgagccgccaggctaaggctgctgatgtgagaagccaggtgacacactattccaatctcttgtgtgatttgctgcggggcattgttgccacaaccaaggccgccgctctccagtatccgtcaccgagcgcggcccaagacatggtggagcgggtcaaggaattaggccatagcacgcagcagtttcggcgcgtgcttgggcaacttgcagccgcatag

SEQ ID NO: 14131 - DNA, 2613 bp, Artificial Sequence
  Description of Artificial Sequence: Synthetic coding sequence
atgaaccatttaaacgtgctggccaaggcactgtacgacaatgttgctgaaagtcctgacgagctctccttcaggaaaggtgatatcatgactgttctggagcaggacacgcaaggattggatggctggtggctgtgttctttgcacggacgacagggaattgtgccaggaaaccgcctgaaaatactcgtggggatgtacgacaaaaagccagccggacctggccccggccccccagctacacccgctcaaccgcaacctgggctgcacgcgcctgctccgcctgcttctcagtacacccctatgctccctaacacttatcaaccccagcccgattccgtgtatctcgttcccaccccctctaaggcccagcaaggcctgtaccaggtacctggtccatccccccagttccagtcaccccctgcgaaacagacaagcaccttctctaaacagacccctcatcacccatttccctcccccgccactgatttgtaccaggtaccccctggaccgggcggacctgcacaggacatttaccaagttcctccttccgcaggaatgggacacgacatttatcaagtcccaccctcaatggacaccaggtcctgggaaggcactaagccacccgctaaggtggtggtgcccaccagagttggtcaggggtacgtgtacgaggcagcccagccagagcaggacgagtatgacattcccaggcatctgttagccccaggcccacaggatatctatgatgtgcctcctgttagggggctgttgcccagtcagtacggccaggaggtctatgatactccacctatggccgtgaagggaccgaatggacgagatcctcttctggaagtttacgatgtgccccctagcgtcgagaagggactacctccatccaatcatcatgcggtctatgatgtgcccccatctgtcagcaaagacgtgccggatggcccacttctgcgcgaagaaacatacgatgtgcctcccgctttcgcaaaagccaaaccttttgaccctgccaggactccactggtactggccgcaccgcctccagattcaccgcccgccgaggacgtgtacgatgtgcctcctcctgcacccgatctgtacgatgtaccccctgggctgaggcgccccggccccggaactctctacgatgtgccgagagaaagagtgctgccaccggaggtggcagatggaggagtagtggactcaggggtgtacgccgtccctccccccgcagaaagggaggccccggctgagggcaaacggctgtccgccagctccactggctctactcggagcagccaaagcgccagctccctggaggtggctggccccgggcgggaacctctcgagctggaggtcgctgttgaggccttagcacggttacagcagggtgtgtctgccaccgtagcgcacttactggatcttgctggttccgccggcgccacaggaagctggcgctcccccagtgagccccaagaacctctggtgcaagatctgcaggctgccgtggccgctgttcaatctgctgtccatgaactgctggaattcgctcgcagtgcggtagggaatgcggcccacacgtctgacagagccttgcacgctaaactgagccggcagttacagaagatggaggacgtacaccaaacccttgtggcccatgggcaggcactcgatgctggacggggggggagtggagcaacgttagaggacttggaccggctggtggcctgctctcgcgccgtccctgaagacgctaagcagctggccagtttcctgcatggcaacgccagcctgctgttccggcgtactaaggctaccgcccccggcccggaagggggagggaccctgcatccaaatcccacggacaagactagctccattcagtcacgtcctcttccaagtccccccaaatttacttcccaagacagccccgatgggcagtatgaaaacagtgaaggcgggtggatggaagattacgattacgtccacctccaggggaaagaggagttcgagaaaacacagaaagagctgctcgaaaagggatctatcactcgccaaggaaaatcacagctggagcttcagcagcttaagcagtttgagaggctggagcaggaggtctcccggccaatcgaccatgatctggctaattggactcccgcgcaacctttggccccggggcggacaggtggactcggtccttctgaccgccaactcctgcttttctatctggagcaatgcgaagccaacttgacaaccttaactaacgctgttgacgcgttcttcactgcagtagccacaaaccagccccccaaaatcttcgtcgctcatagtaagttcgttatcctgagcgcacacaaactcgttttcattggagacactttatctcggcaagccaaggccgctgatgtgcggtcccaggtgactcattactcaaacttgctctgtgacttattgcggggtatagtggccaccacgaaggccgcggcgttgcagtatccaagtcctagtgcagcccaagacatggttgaacgcgtgaaggaactgggccacagcacgcagcagttccgcagggttttaggacagctagccgcagcctag

SEQ ID NO: 14132 - DNA, 2667 bp, Artificial Sequence
  Description of Artificial Sequence: Synthetic coding sequence
atgaatcatctcaatgtcctggctaaggcactgtatgacaatgtcgctgagagtcccgacgagctttccttcagaaagggcgatataatgaccgtcttggaacaggatactcaggggcttgacggatggtggttgtgtagcctacacggaaggcagggcattgtccccgggaatagacttaaaatcctagtgggcatgtatgataaaaagcccgccgggccaggtcctgggccacctgcaactcctgctcagcctcagcccggacttcacgctcctgcaccacctgcatcacagtataccccaatgctccccaacacctaccagccccagccagacagtgtctatctggtgcccacgccttctaaggcacagcagggtctctaccaggtaccaggccccagccctcaatttcagagtcctcctgccaagcagaccagtacttttagtaaacagacaccgcatcacccctttccaagccccgcaaccgacctgtaccaggtgccccctggcccaggcggccccgctcaggatatctatcaggtgcccccgagcgccgggatgggtcatgacatttaccaggttccaccttcaatggacacccgtagctgggagggaaccaagccccctgcgaaggtggtggtgcctacaagggttgggcagggctacgtgtacgaggccgcgcagcccgagcaggatgaatatgacattccccgccatctactggctccggggccccaggatatctatgacgtgccacccgttcgcgggctactgccgtctcaatacggccaggaagtgtatgacactcctccaatggctgtgaagggcccgaacggccgcgacccactgctggaggtttatgacgtacctccctcggtagagaaagggctgcctccttcaaatcaccatgccgtgagcaaatgccagggtaacgcgagggccaggctcagattgtggggcgtgtgggtctacgatgtccccccctcggtgagcaaggatgtccccgatggccccctcctgagagaggagacgtacgacgtccctcctgccttcgcgaaggctaagccattcgatcctgcaagaacccccctggttctggcggcgccccctcctgatagccctcccgctgaggatgtgtatgacgtgccgccaccagctccggacctatatgacgttcccccaggcctgcgaagaccagggccagggacactgtatgacgttccccgtgaacgagttcttccacccgaggtggccgacgggggtgtggtcgactcgggcgtttatgccgtgccaccaccagcagagcgcgaagcacctgccgaagggaagagactgtccgcaagcagcaccggcagcacgcgctctagtcagtctgcatcctccctggaagtggctggccctggcagggaaccgctggagctggaagttgccgtcgaggccttggccagattgcagcaaggcgtgtcagcaacggtggcacacctgttagacttggctgggagcgcgggcgcaactggttcctggaggtcccctagtgagcctcaggagccgctggtgcaggatctgcaagctgccgtcgctgctgtgcaatcagccgtccatgagctgctggagtttgcccgatccgctgtcggtaacgcagctcacacaagcgatcgggctttacatgcgaaactgagtagacagctgcagaagatggaagatgtgcatcagaccctggttgcccatgggcaagcgttggatgccggacgaggagggagcggagcgaccttagaggatttggatcgcctggtggcctgttctagggccgttccagaagatgctaagcagcttgcgagtttcctccatgggaacgcctccctgctctttaggcgcacaaaagcaaccgcacccggccctgaggggggtgggactctccaccccaatcctacagacaagacatcttctattcagagccggcctctaccctctccaccaaagttcacttctcaagattcacccgacggccagtacgagaactcagaaggaggctggatggaggactatgactatgtgcatttacagggcaaagaagaattcgagaagactcagaaagagctattggagaagggtagtattaccagacaggggaagagccagctagagctgcagcaactgaagcagtttgagcgactggagcaggaggtgagtagacccatcgaccacgatctcgctaattggactccggctcaacctctggcccccggcagaactggtggcctggggccaagcgaccgccagcttcttctgttttatctggagcagtgcgaggcaaatcttacaaccctgacaaacgcggtggacgctttttttactgcagtggccacaaaccagcccccaaagattttcgtggctcactcgaaattcgtgattctgtctgcccataagctcgtattcataggcgacactctgtcaagacaggccaaagctgccgacgtgaggtctcaggtgactcattatagtaacctgctgtgcgatcttctaaggggtatagtagcaacgaccaaagccgcggccttgcaatacccgagcccatcagctgcccaggacatggtagaaagggtcaaagagctgggacatagcacccagcaattcagaagggtcctgggccagctggccgccgcgtag

SEQ ID NO: 14133 - DNA, 2751 bp, Artificial Sequence
  Description of Artificial Sequence: Synthetic coding sequence
atgccagcaaagccatttttatcgagtgtgctgctgtcctggaaggtgttagattttagcgggcccgggccccagggcaccggccagccctgctcatgcgggcactgggccgaagggcagggcggtccccctgagccagccgggggacctaatgtactggctaaagctctctatgacaatgttgcagagagccctgacgaactgagcttcagaaagggtgacatcatgacagtgttggaacaagacactcagggtctggacgggtggtggctctgctccttgcatggacggcagggcattgtgcctggaaatagactgaagatcctggtggggatgtatgacaagaaacctgccggccccggtcccggaccacccgcgactccagcacagccccaacccgggttgcacgcgccagctccacccgcctcccagtacactcccatgcttccaaatacctaccagcctcagcccgacagcgtttatctcgtgcccacaccctcaaaagcacaacaggggctgtaccaggtgcccggaccttcacctcaattccagagcccacccgcaaaacaaacctccactttttctaagcagacaccgcaccaccctttcccttcccccgcaactgacctgtatcaagttccccccggacccgggggaccagcccaggacatttaccaggtacctccatctgccggtatgggccacgatatatatcaggtgcctccctcaatggacactcggtcttgggaggggacaaagccgccagccaaggtcgtggttccaacacgcgtgggacaggggtacgtatatgaggccgcgcaaccagaacaggacgagtacgatattccccgacatctgttagcacccggaccccaggatatctacgatgtgccgccggtgaggggactgctgccatctcagtatggccaagaggtgtacgatactccccccatggcggttaaggggccaaatgggcgggaccccctgttagaggtatatgatgttcccccatcagtggagaagggactgccaccctcaaatcaccacgcagtgtacgacgttccaccctctgtttccaaagacgtcccggatggaccattgttacgggaggagacttacgacgtcccacccgcgttcgccaaggctaaaccttttgatcccgcacggacgcctctggtgctggccgctcctccccctgattcccccccagcggaggacgtgtatgacgtccctccacctgcccctgacctgtatgatgttccaccagggctccgcagacccggcccgggaaccctctacgatgtgccccgcgagcgtgtgctcccccccgaagtagcggatggaggagtggttgattctggagtctatgccgtcccccctccagcagagagagaggcccctgcagaaggtaagaggctaagtgctagctctaccggttcaacacggtcaagccagtcggctagtagcctcgaggtcgctggaccaggtcgcgagcctttggagctggaggtggccgtcgaggctcttgcaaggctgcagcagggcgttagtgccacagtggcccacctgcttgatctggccggtagcgctggggcgaccggctcgtggcgaagtccttctgagccgcaggagccactggtacaggatctgcaggccgcggtcgccgccgtgcagtctgcagtgcacgaattgctggagtttgccaggtcggccgtgggaaatgccgctcatacttcagatcgtgcgcttcacgccaagctgtcccgccaattgcagaaaatggaggacgtgcaccagactctcgtggcacacgggcaggccctggatgccggaagaggcggttccggcgctacccttgaggacctcgatcgattagtggcgtgctcgagagcggtacccgaggatgccaagcagctggcttcattcctgcacgggaacgcctctctcctctttagacgtaccaaagctacagctcccgggcccgagggaggcggcaccttgcacccaaatccgacagataaaacaagttccattcaatcccggccactgccgagtccccctaagttcaccagtcaggactctcccgatgggcagtacgagaacagtgaggggggttggatggaggattatgattacgtccatctccagggcaaagaggagttcgagaagacccagaaagaactgctggaaaaaggttcaatcacccgtcagggcaagtcccaactcgagctccagcagctgaaacaatttgagagactggagcaagaagtgtcccgtcctatcgatcatgacctggcaaactggacccctgcccagcccttggctccaggtaggaccggcggcctaggaccttctgaccggcagctgttgcttttctacctggagcagtgcgaggccaacctgacgacgctgacaaatgccgtggacgcattttttacagctgttgccactaaccagccacccaaaatctttgtcgcccatagcaaattcgtaatcctctccgcacacaaactagtgtttattggcgacacactgtcgaggcaggcgaaggctgccgacgtgaggagccaggtgacacattacagcaatctgttgtgtgatctgctcagagggatagtggccaccaccaaagccgcggcactgcaatacccgtccccctctgcagctcaagatatggtcgaacgggtaaaagaacttggccattcaactcaacaattcagaagggtgttaggacagctggccgccgcatag

SEQ ID NO: 14134 - DNA, 2667 bp, Artificial Sequence
  Description of Artificial Sequence: Synthetic coding sequence
atgctgactcatcgcccacaggaagccgagcagagggggcgtacgcccggcccttcttttgagtggaatgtgctggccaaggccctgtacgacaacgtggctgaaagcccagacgaactgtcttttaggaaaggggatattatgactgtgctcgagcaggatacacagggacttgatggttggtggctgtgctccctgcatggcaggcagggaattgttcccggcaataggcttaagattctcgtggggatgtacgacaagaagcccgctgggccaggcccaggacccccggccacccccgcccaaccccaacccggactccacgcccctgcacccccagcatctcagtacaccccaatgctaccgaacacataccagcctcagcccgatagtgtatacctggtccccaccccatccaaggcccagcaaggcctatatcaggtgccaggaccatcccctcagttccagtccccaccagccaagcagacttctacattctccaaacagacccctcaccatccctttccaagcccagccactgacctctaccaagttcctcctggcccaggaggcccagctcaagatatataccaggtgcctccatcagctggaatgggtcacgacatctatcaggtccccccaagcatggataccagaagttgggagggcaccaagcccccagctaaggttgtggtgccaactagagtgggccaaggatatgtctacgaggccgcccaacccgaacaggatgagtacgacatacctcgtcacttattggcgcctggcccacaggatatttacgacgtcccgcctgtgcggggcctgctgccttctcaatacgggcaggaagtctacgatactccacccatggctgtgaaagggccaaatggtagggaccccctgttagaggtgtacgatgtccccccctccgttgaaaaaggacttcccccttctaaccaccacgccgtatacgatgtccctccaagcgtttctaaggacgtgcccgacggaccgctgctgcgtgaggagacgtacgacgtgcctccagcgtttgccaaggctaaaccattcgaccctgcccggacgcctctggtgctcgccgcccctccgcctgactctcctccagctgaagacgtgtatgacgtgccaccaccggcacccgacttatatgatgtcccccctggactgcgaaggccaggaccgggcactctgtatgacgtcccacgtgagcgcgtactccccccagaagtagcagacgggggcgtcgtggactccggcgtttacgcagtgcctccgccagcagaacgggaagcgcccgcagaaggtaaaaggctgtcggccagcagtaccggctcgacgaggagcagccagtctgcttcaagtttggaagtggccggccccggacgcgagcctttggagcttgaggtcgccgtggaagcactagctaggttgcagcagggggtgtctgccacagtggctcatctattagatcttgccggaagtgccggcgccactgggtcctggcgttctcccagtgaaccacaggaaccactggtccaggacctccaggccgctgtggctgccgtgcagtccgccgtgcacgaactgctggagtttgctcgttccgccgttggtaacgctgctcatacctctgaccgggcactccatgccaagctatcacgacagctgcagaagatggaagacgtacaccagaccctggtcgctcatggccaggcacttgacgccgggcgcggcggatctggcgctaccctggaggatttggatcggctcgtggcttgtagtcgggctgttcctgaggacgccaagcaattggcctcatttcttcacggcaacgcctcactgctttttcggcggacaaaggccactgcgcccggacccgagggaggtgggactttacatcccaaccccacagataaaacgtcttccatccaatctagacccctcccgtcaccgccgaaatttacatcacaggactcccccgatgggcaatacgagaatagcgagggtggttggatggaggactacgactatgtgcacctccagggtaaagaagaatttgagaaaacccagaaggagctgcttgagaagggcagtattaccaggcaaggcaaatcacaactggagctgcagcagttaaaacaatttgagcgactcgagcaggaagtctctaggccaatcgaccacgacctggcaaattggacgcccgcccagccccttgccccaggacgaacgggcggactggggcccagcgataggcagcttctgttgttctaccttgaacagtgcgaagcaaacctaaccacacttaccaatgcagtggatgcatttttcacagctgtcgcgactaaccagccccccaaaatctttgtggctcactccaagtttgtcatcctaagtgcacataagctggtgtttataggcgacactctctcgcgacaggccaaagcagccgatgtaagatctcaggtgacacactactcaaaccttctctgcgacctgttacgcggcatcgtggccacaacaaaggccgcggccctgcaatatccttctccgtctgccgctcaggatatggtcgaaagagtcaaggagctggggcattctacacagcagtttaggagggtgttgggacagttggctgcggcttag

SEQ ID NO: 14135 - DNA, 2169 bp, Artificial Sequence
  Description of Artificial Sequence: Synthetic coding sequence
atgcagggaaagaacgtcctggcgaaagctctgtacgacaacgttgccgagagccccgatgagctttccttccgaaagggcgatatcatgaccgtactggaacaggatacccaaggtctcgatggatggtggttgtgcagcctccatggacggcaagggatcgttccaggtaacaggctcaagatcttagtcgtggtgccaactagggtggggcagggctatgtttacgaagctgctcaaccggaacaagatgagtatgacatcccaagacacttactggcccctggaccacaggatatttatgatgtgccccccgtgcggggtctgttgccgagtcagtacgggcaagaggtttacgataccccaccgatggctgttaagggaccaaatgggagagaccccctcctcgaagtttacgacgtgccacccagcgtggagaaggggctgcccccctcgaatcaccacgctgtttatgatgtccctccttcagtgagtaaagacgtccctgatggccctctcttacgggaagagacttacgacgtccctcccgcgtttgccaaagcaaagccgttcgacccagccagaacacctctcgtgctcgcggcgcctccaccagacagcccaccagctgaggacgtatacgacgtgcctccaccggccccagatttatatgatgtgccccccggcctgaggaggcccggacccggtactttgtatgatgtcccaagggaacgggtgctaccacctgaggttgccgacggaggggttgtggactctggggtgtatgcggtgccaccccctgccgagcgcgaagccccagctgaaggtaaacgactgagcgctagctcgaccggtagcaccaggagtagtcaaagtgcgagttctctggaagtagctggacctgggcgtgagcccctggaactagaggttgccgtggaagccctggcacgtctgcaacaaggtgtgtcagctactgttgcccacctgctggatctagctgggtcagctggcgcaacggggtcgtggcgctcaccatccgaaccacaggagcctctagttcaagatctgcaggctgccgttgccgccgtccagtccgcggttcacgagctcttggaattcgcccgtagcgcggtgggtaacgcagctcatactagcgaccgtgccttgcacgctaaactaagcaggcagctccagaaaatggaagacgtacaccagaccctggtggctcacggccaagcgctcgacgctggccgcgggggttctggggcgaccctggaagacttagataggctggttgcctgtagcagggcagtgcccgaagatgccaaacaactggcatcctttttgcatgggaacgcgagtctgttatttcgccgcacgaaagccactgcgccaggtccggagggtggtggcacgctgcacccgaatccaactgataaaacatcgtcaatacagtcacggcctttaccctcaccccctaaattcacgagccaggattcgccagatggacagtacgagaactccgagggcggatggatggaggattatgattatgttcaccttcaaggaaaggaagaatttgagaaaacccagaaagaattactcgagaaaggctccattactcgccagggcaaaagccaactcgagcttcaacaactgaagcagttcgaaagactcgagcaggaagtctctcgccccattgatcacgacctggctaactggacaccagctcagcccttagcccccggacgcacaggcgggctgggccctagcgataggcaactgttgctgttttaccttgaacagtgtgaggctaatctaaccaccctaactaacgctgtggacgcctttttcactgcagtggcaactaaccagccccctaaaatttttgtggctcattctaagtttgtgattctctctgctcataaactggttttcatcggggacacactgtcccgccaggccaaagccgccgatgttaggagtcaggtgacccactactccaacctgctgtgcgatcttcttagaggtatagttgccaccactaaagccgccgccctgcagtaccccagccctagtgccgcacaagatatggttgaaagggtcaaggagctgggccactcgacccaacaattccggcgggtgttgggtcagctggccgccgcttag

SEQ ID NO: 14136 - DNA, 2613 bp, Artificial Sequence
  Description of Artificial Sequence: Synthetic coding sequence
atgtccgtccccaatgtgctggcaaaagccttgtatgacaatgtggccgagagccctgatgaactctcgtttcgaaagggggacataatgacagtgctcgaacaggacacgcagggtctcgatggatggtggctgtgctctttacatggcaggcagggcatagttccagggaaccggctgaaaatcctggtgggcatgtacgataagaaacccgcagggcctggacccggcccgcctgcaaccccggcacaaccacagcctggactgcacgcaccggctcctcccgcaagtcaatatacccccatgctcccaaatacctaccagccgcagcccgacagcgtttacttggtacccactccttcaaaagctcagcagggactataccaggtcccgggaccctcccctcagtttcagagtcctccagccaaacaaacctcgacattctctaagcagactccccaccaccccttcccctctccggcaactgatctttatcaggtcccccctggcccagggggtccagcccaggatatttatcaggtgccccctagtgcaggcatggggcatgacatctaccaagtccccccaagcatggacactcggagttgggaaggcactaagcctcccgcgaaggttgtagtgccaacgagggtgggacagggctacgtgtacgaggcggcacagccggagcaggatgaatatgacatccctagacacctcctagcccctgggcctcaggatatctatgatgttccccctgtccgggggttactgccaagccagtatggtcaggaggtctacgacacccccccaatggccgtaaaaggccccaacggccgcgatccacttcttgaggtgtatgacgtacccccctccgtcgaaaaggggctacccccatcaaatcaccacgctgtatacgatgtcccgccaagcgtgagcaaagatgtgcccgacgggccgcttctgagggaagaaacctacgatgtgccccccgcattcgccaaggcaaaacctttcgaccccgcaaggactccactggtgctggccgctccgcctccagattccccccctgcagaagacgtttatgatgttcctccccctgccccagacttgtacgacgtgcctccagggctgaggcgaccaggacccggcacattgtatgacgttcctagagaacgggtgctgcctccagaagtggctgacggcggggtagtggatagcggcgtgtatgccgtcccaccacccgctgagcgggaagcacctgcagagggaaagcggctaagcgcatctagtacgggatctacacgtagcagccagagcgccagctcactggaagttgcaggacccggccgtgaacctcttgagttggaggtggccgtggaggctctcgcacggctgcaacagggggtgtcagccacagtcgcccacctgctggacctcgctggctcggcaggtgccactgggtcttggcggtctccatccgagccgcaagaacctctggtgcaggacctgcaggccgctgtggccgcggtccagagcgcggtgcacgagttgctcgaatttgctcgttcagctgtggggaacgccgcgcacaccagcgaccgggccttgcatgcgaaactgagcaggcagctccagaagatggaagatgtgcaccagacacttgtggcccatggtcaggcccttgacgccggacgtggcggctccggggccacactcgaggacctggatcggctggtggcgtgctctagggccgtgcccgaggatgctaagcaactggcttcattccttcatggtaatgccagcctgctgtttcggagaaccaaagccaccgccccagggcccgaggggggcgggactctccaccccaaccctaccgacaaaacctcttcgattcagtctagaccacttccctccccaccaaaattcacctcccaagactcgccagatggacagtacgagaattctgaaggaggctggatggaggattatgactatgtgcacctgcaaggtaaagaagagttcgagaaaacgcagaaagagctgctcgaaaagggatctatcaccagacaggggaaatcccaactggagctccagcaactgaagcagttcgaacggctggagcaagaggtctcacggcccatcgaccacgacctggccaattggacacctgcacagcctctggcacccgggcgcactggtggcctgggaccttccgaccgccaactgttgttgttctatcttgagcagtgtgaggccaatctgaccactttgacaaatgctgtggatgcgttttttaccgcagtcgccacaaatcagcctccaaagatttttgtggcccacagcaaattcgtaattctctctgcccacaagctggtgttcataggcgatactctctctaggcaggctaaggccgccgatgtcaggtcacaggtcacacactactctaacctcctgtgtgacctactacgaggcatcgtggctactaccaaggcggctgcacttcagtacccctcgccatccgcagcccaagacatggtggaacgggtgaaagagctgggacactccactcagcagttccgccgagtcctgggacaactcgcagctgcatag

SEQ ID NO: 14137 - DNA, 2607 bp, Artificial Sequence
  Description of Artificial Sequence: Synthetic coding sequence
atggagaatgttctcgcaaaagctttatacgataacgtggccgagtcccccgacgagcttagttttaggaagggagacataatgacggttcttgagcaggatactcagggcttagacgggtggtggctctgctcattgcatggtcggcaggggatcgttcctgggaaccggttaaaaattctggttgggatgtatgataagaagcctgctggtcctggaccaggccctcccgctacccctgcgcagccccagcccggactgcacgctcctgcaccacccgcctcacagtatacacctatgttgcccaatacctaccagccccagcccgatagcgtgtatctggttcccacgccctcaaaagcccagcagggcttataccaggtgcctggaccaagcccccaattccagtctcctcctgcaaaacagacctcaacattcagtaaacagacaccacaccaccctttcccctctcccgcaaccgacctctaccaggtgccacctggacctggtggcccagcacaagatatctaccaagttcctccaagtgcaggaatggggcatgatatataccaagtcccaccctcgatggacactcgttcttgggagggaacaaagccccctgctaaggtggtggtgccgacccgcgtcggacaaggttacgtgtacgaagctgcacagcctgagcaggacgaatacgatatccctcggcacctgttagctcccggtccacaggatatatatgatgtgcccccagtcaggggcctgttgccttctcagtacggacaggaagtttacgatacccctccaatggcggtgaagggccctaacggccgcgatccacttcttgaagtatacgatgttcctcccagtgtcgaaaaaggcttgcctccctcaaaccatcatgcagtgtacgacgtgccccccagcgtcagcaaagatgtcccagacggaccccttctgcgggaggagacctatgatgtccctccagccttcgcaaaagccaagccttttgatcccgctagaaccccccttgtgctggccgcgccaccacctgacagtccacctgccgaagacgtctacgatgtaccccctccagccccagacctatacgacgtcccgccagggttgcgaaggccagggcctggcaccctgtacgatgtacctcgcgagcgggtgctgccacctgaggtcgccgatggcggagtcgtcgactcaggggtttacgcagtgcctccacccgccgagagggaagcgcccgcagaaggcaagaggctatcggcatcaagcacagggagcacccggtcatcacagagcgccagcagcctcgaagtcgctgggcctggaagagaacccctggaactggaagtggccgttgaggctctcgctcgactccagcagggggtcagcgccaccgtggcccacctgctcgacctcgctggatcagccggcgccaccgggagttggagatcccccagtgaaccacaggagcccctcgtgcaggatcttcaggctgccgtagccgctgtccagagcgccgtccacgaactcctcgaatttgcccgtagtgcagttggcaatgccgcccacacatctgaccgggcgctccatgcaaaactgagtcggcagctccagaaaatggaggacgtccaccagaccttggtggcacacggacaggctctcgatgctgggcgtggagggtccggcgctacactagaagatttggatcgccttgttgcctgctcacgagctgtccccgaggatgccaaacaactagcctcgttcctgcatggcaacgcttcactactcttcagacggacaaaagccaccgccccaggacccgaaggcggcgggacgctgcatcccaacccgactgacaaaacctcctctatccagtccaggccgctccccagcccccctaaattcacgagtcaggacagccctgatggccagtatgaaaactccgagggagggtggatggaggattacgactacgttcatctgcaggggaaggaggaattcgagaaaacgcagaaggaactactggagaaaggaagtattacacgtcagggcaaaagtcagcttgaactccagcagcttaaacagtttgaaaggcttgaacaggaagtgtctagacccatcgaccatgacctcgctaactggaccccagcacagcccttggctccaggacggaccggaggacttggccccagcgaccggcagttgttattgttttacctcgaacagtgcgaggcaaatctgacaaccctcacgaatgccgtggacgcgttcttcaccgccgtggccaccaatcagccgcccaaaatcttcgtggcccactccaagtttgtcatcctgtccgcgcataagctggttttcattggtgatactctgtcaaggcaagcgaaggcggcagacgtgcgatctcaagttacccattacagtaacctactgtgcgatcttcttaggggtatagtcgcaactactaaagctgccgctttgcaatacccgtctccatcagccgctcaggacatggtggagagagtcaaggagctcggccactctacccaacagtttcggcgagttctcgggcagcttgcagccgcttag

SEQ ID NO: 14138 - DNA, 2526 bp, Artificial Sequence
  Description of Artificial Sequence: Synthetic coding sequence
atgacagtgctggaacaggatacccagggacttgatggttggtggctgtgctccctgcacggaagacaaggcatagtaccggggaatagacttaagatactggttggcatgtacgataaaaaaccagctgggccaggacctggtcctcctgccacacctgcccagccccagcctggcctgcacgcccccgccccacccgcatctcagtacacaccaatgctgcccaacacatatcaaccccagccagatagcgtgtacctggtgccaaccccctctaaggcccaacagggcctatatcaagtccccggccctagcccacaattccagtccccacctgcaaagcagaccagcacctttagcaagcagaccccccaccacccttttccctcgccagcaaccgacttgtaccaggtgccacctgggccgggcggacctgcacaggacatttaccaagtgcctccatctgccggaatgggacacgatatttatcaagtgccccctagcatggatactaggtcctgggagggaactaagccacctgccaaggtagttgttcctaccagggtggggcagggatatgtttacgaggcagcccaaccagagcaggatgagtatgacatcccccgacacctactcgctcccggaccccaggatatttatgacgtcccgcctgtaaggggcctcctgccaagccagtacgggcaggaggtctatgatacacctccaatggcagtaaaggggcccaacggcagggaccccctactggaggtgtatgacgtccctccaagcgtggaaaagggactgccacctagtaaccatcacgcagtatacgatgtccctccgtcagtgtccaaagacgttccagacggtcccctgctccgcgaggaaacctatgatgtgcctcccgcttttgctaaggctaaacctttcgaccccgctcggactcccctggtcttagctgcgccccctcccgactcccctcccgccgaggacgtttacgatgtaccaccaccagcccccgacctgtatgatgtgcctcccggtctccgtaggcctggcccaggaacattatatgatgttcctcgggagcgcgttttgcccccggaagtggccgacggaggtgtggtggactctggagtctacgcggtgccgcccccagccgaacgcgaagcccctgccgaaggaaaaagactctctgcttccagtactgggagcacgcgatccagccagtcagcatcatccctcgaagtcgctggccctgggcgggaaccgctcgaactcgaggtggctgtagaagccctagctcgcctgcagcagggagtgagcgccaccgtggcacacctcctggatcttgccggctctgccggggcaaccggatcttggagatcacctagcgagccccaggagcccttggtgcaagacctccaggccgctgttgctgcagtgcaatctgccgtacacgagctacttgagttcgcaagaagcgcagtgggcaacgccgcacatacctctgatcgtgctctccatgccaagctgagtaggcagctacaaaaaatggaggatgtccaccagaccctggtagctcatggacaagctcttgatgccggtcggggtgggagtggggcgaccctggaagacctggacagactggttgcgtgctcccgtgctgtgccagaggatgctaaacagcttgcctcattcctgcatgggaacgcttctctgttgtttagaaggacaaaagctacagcaccaggcccagaaggcggtggaacattacatcctaatccgacagataaaacctcctctatacagtcccggcccctgccctcccccccaaagtttacatctcaggattctccggacggacaatatgaaaactctgagggcggatggatggaggactatgactatgttcacctgcagggaaaggaggaatttgaaaaaacgcagaaagagctgctggagaagggttcaataacccggcaggggaaatcacagcttgagctgcagcagctgaagcaattcgaaagactcgagcaggaggtgagccgccccattgaccacgacctggctaactggaccccagcccagcctctggcacctggcaggacaggtggcctcggtccatctgaccggcagttactgctgttctaccttgagcagtgcgaagccaacctcaccacacttacaaatgcggtcgacgccttcttcacagccgttgccaccaatcagccaccaaagattttcgtggcgcactcaaagttcgtgatcctgtctgcccacaagctcgtgttcatcggtgacactttatctagacaagcgaaggccgccgacgttagatcacaggttacccactactcgaatttactgtgcgacctgctgcgaggcattgtagctacaaccaaagcagctgctcttcagtaccccagccccagcgcggcacaagacatggtcgagcgcgtcaaggagctgggccattccacccagcaatttcgcagagttttagggcagcttgctgccgcctag

SEQ ID NO: 14139 - DNA, 741 bp, Artificial Sequence
  Description of Artificial Sequence: Synthetic coding sequence
atgcctgtccaaccccctagcaaagacacagaagaaatggaggctgagggtgatagtgccgctgagatgaacggagaagaggaagagagcgaagaagaaaggtcaggctctcaaaccgaatccgaggaagaaagctccgaaatggacgacgaggactacgagaggaggcggtccgaatgcgtgagcgaaatgctagatctcgaaaagcagttttccgagttaaaggagaaactgttccgagaaagactcagccaactgcgcctcaggctggaagaggtgggagccgagcgtgcgccagaatacacagaacctcttggcggcctgcagcggtctcttaaaattagaatccaggtcgccggcatttacaagggtttctgtctggatgttattagaaacaagtacgaatgcgaacttcagggcgcgaaacagcaccttgagtcagaaaaactgctgctgtacgatacactgcagggcgagttacaggaacgcatccagcgacttgaggaggaccgccagtcacttgacctatcatctgaatggtgggacgataaactgcatgcacgaggatccagtcgatcttgggattcactgccaccctccaaacggaagaaggccccattagtcagtggaccctacattgtttatatgctccaagagattgacattctcgaagattggacagcgattaaaaaagcccgcgccgccgtgtccccgcagaagcggaagagtgatgggccgtag

SEQ ID NO: 14140 - DNA, 873 bp, Artificial Sequence
  Description of Artificial Sequence: Synthetic coding sequence
atgcctgtacagccgccttcaaaggacacagaagagatggaggcagagggtgactcagccgcagagatgaatggcgaggaggaggaatctgaagaggaacgtagtggcagccagacagaaagcgaagaagagagttctgagatggatgatgaggactatgagaggcgacgctctgagtgcgtgagcgagatgttggatctggagaaacagttttcagaactgaaagagaagctgtttagagagcgcctgtcccagctgcgtctgagactcgaagaagtgggcgccgagagagcgcctgagtacacggaacccctagggggcctgcagagatccctgaagatccgaattcaggtggctggaatctacaaaggcttttgtctggacgtcatcaggaacaagtacgagtgcgaactgcaaggcgccaagcagcatctggagtcagaaaagctactgttatacgatacgcttcagggcgaactgcaggagcggatccagcgcctggaggaggaccgccagtctctggatctgtcctctgagtggtgggatgataagctgcacgcccgcggaagttcccgttcttgggactctttgccccccagcaaaagaaagaaagccccgctcgtgagcggtccctacatcgtgtacatgcttcaggagatcgatattctggaggactggaccgccatcaagaaggctagagccgctgtttcccctcagaagcgcaagtccgacgatcgtcgcacgcacaggccattgcgagtctgtcccgcacggctgctttggtgctgttgggccctcccactgcacctggcactagcttggacccctccactgcccagtagcagacctgcacagctctggccttggtcttag

SEQ ID NO: 14141 - DNA, 735 bp, Artificial Sequence
  Description of Artificial Sequence: Synthetic coding sequence
atgcctgttcagcctccgtccaaagatacggaggagatggaggccgagggggattccgcggccgagatgaacggggaggaggaggaatcggaagaagaaagatcaggaagtcaaactgagtccgaggaggagagtagcgagatggacgatgaagactacgaacggcgaaggtcagaatgtgttagcgaaatgctggatctggagaaacagttttctgagctgaaagagaagttgttccgggaacggctgtctcagcttcgacttagactcgaggaggttggcgctgaacgcgcacccgaatacacagagcctcttggcggacttcagcggagtctgaagatccggatacaagtggccggtatttataaggggttttgcctcgacgtgattcgcaataagtacgagtgcgaactccagggcgcaaagcagcatctggaaagcgagaaactgctcctgtatgacacacttcagggcgagctccaggaacgtatacagcgcctggaagaggacagacagtcattggacctcagctctgagtggtgggatgacaagttgcatgccagggggagttcccggtcatgggatagtctgcctcccagcaaacgcaaaaaggcccccttagtcagtggcccgtatatcgtctacatgctccaggaaatagacatcctcgaagattggacagccattaaaaaagctcgtgccgctgtgtctcctcagaagaggaaatccgactag

SEQ ID NO: 14142 - DNA, 1494 bp, Artificial Sequence
  Description of Artificial Sequence: Synthetic coding sequence
atggcggaaatgggaagcaagggcgtcaccgccggcaaaatagcctcaaacgtgcagaagaagctgacacgggctcaggaaaaggtgctccagaagcttggtaaggctgacgagaccaaggacgagcagttcgagcagtgcgtccaaaactttaataagcaactgacagaggggactaggctgcaaaaggacctgcgaacctatctagcatcagtgaaggccatgcacgaggcttccaagaaacttaatgagtgtttacaggaggtctacgaacctgactggccgggccgcgacgaagccaataaaattgccgagaataacgacttgttgtggatggactaccaccagaaactggtggatcaagcactgctgacgatggacacgtaccttgggcagtttcctgatataaagtcccgtatcgcaaaacggggacgtaagctggtagattacgactctgcccggcatcactacgagagcttgcaaacggctaaaaagaaggatgaggccaaaattgccaaagccgaggaagagttaattaaagcgcagaaagtatttgaagaaatgaatgtggacctgcaagaggagctgccatctttgtggaacagtcgcgtcgggttctatgttaacacatttcagtcgatcgcgggacttgaggaaaatttccacaaggagatgtctaagcttaaccagaacctaaacgacgtcctggttgggctagagaagcagcatggcagtaatacattcactgtcaaggcacagcccagaaaaaaaagcaaactattctcccgacttcggaggaagaaaaactcggataacgccccagcaaaggggaacaaatctccttcaccaccagatgggtcacccgcggccacacctgagataagggtgaatcacgaacccgagcccgctggaggcgctaccccaggagccacccttccgaagtccccatctcaactccgtaaaggacctccagttcctcccccaccgaagcatactccctccaaggaggtaaaacaagaacagatactgtccctctttgaggatacgtttgtgcccgaaatctccgtcactaccccatctcaaccagctgaggcttccgaagtcgcggggggcacacagccagctgccggggcccaggagcctggcgagactgccgcgtcagaagctgcctcttcgtcactcccagcggtggtcgtagagacattccccgctaccgtcaatggcaccgttgaagggggctctggcgctggccggctggacttgcccccagggtttatgttcaaggttcaggctcaacacgactatacagctaccgacacagatgagctgcaattgaaggccggcgacgtggttctcgtcatcccgtttcaaaaccctgaggagcaggatgagggctggctgatgggggtcaaagaatccgactggaatcaacacaaggaactcgagaaatgtaggggagtgttcccagaaaactttaccgagcgcgtgccttag

SEQ ID NO: 14143 - DNA, 1782 bp, Artificial Sequence
  Description of Artificial Sequence: Synthetic coding sequence
atggccgagatgggatccaaaggggtgaccgctggaaagattgcgtccaacgtccagaagaaactgacccgtgcccaagagaaggtccttcagaagcttggaaaggccgatgagactaaggacgagcaatttgagcagtgcgtgcagaatttcaacaagcagcttacagaggggacgcggctgcagaaggacttacgcacataccttgccagtgtgaaggctatgcacgaggctagcaaaaagctgaatgaatgtctgcaagaagtgtacgaacccgattggccgggccgcgatgaagccaataaaatcgccgagaacaacgacctcctctggatggattatcaccaaaagctcgtagaccaggctttattgactatggacacttatctgggtcagttccctgatattaagtctcggatcgcaaagcgtggccgcaagctcgttgattacgacagcgcccggcaccattatgaatctctacagaccgctaaaaaaaaggatgaggccaaaatcgccaaacctgtgagcctcctagagaaagcggcgccccagtggtgtcaggggaagctccaggcacacctcgtggcccagactaacctgcttagaaaccaggccgaagaagaactaatcaaggctcaaaaagtgttcgaggaaatgaatgtcgaccttcaggaagaactgcctagcctttggaatagccgtgtaggtttttacgtcaacacgttccagagcatcgctgggctggaggaaaatttccataaagagatgtctaagctgaatcaaaaccttaacgatgtgctagtgggcttagaaaagcagcacggttccaacacattcacagtgaaggcacagccaagcgataacgccccagccaaaggaaataaatcacctagccctcccgatgggtccccagccgcaaccccggagattcgggtgaatcacgaaccggaaccagccggaggcgcaacacccggagcaacactgccaaagtctcccagtcagctcaggaaaggaccccccgtgcctccgccccctaagcacacacctagcaaggaagttaagcaggagcagatccttagcctgtttgaggataccttcgtaccagagatttccgtcacaactcctagccaattcgaagctcccgggcctttttcggagcaggcgtcactgctcgatttggactttgatccactgcctccagttaccagtcctgtgaaggcacccacccccagcgggcagtcaatcccctgggatctgtgggagcccacggaatcccccgcggggagtttaccctcaggggagccaagcgcagctgaaggaacattcgccgtaagttggccaagccagaccgccgaacctggacctgcccaaccggcggaggcctccgaggtggctggtggcacccagcccgccgccggggctcaggaacccggcgagacagccgccagtgaggctgcatcctctagtctacctgctgtggtcgtcgaaacgtttccagcgactgttaatggaactgtggaaggagggtcaggagctggacgtttggatctgccaccaggattcatgtttaaagtccaggcccaacacgattatactgccaccgacaccgacgaactacaactcaaagccggcgacgtggttctggtgattcctttccagaatccggaagagcaggatgaaggctggttgatgggggttaaagagagcgattggaaccaacataaggaactagagaaatgtaggggcgtcttccctgaaaatttcacagagcgcgtgccatag

SEQ ID NO: 14144 - DNA, 1557 bp, Artificial Sequence
  Description of Artificial Sequence: Synthetic coding sequence
atggccgagatgggctccaagggtgtcaccgctggcaagatagcatctaatgtgcagaaaaaactgactcgagctcaggagaaggtcctgcagaagctggggaaagctgacgagaccaaggacgaacagttcgagcaatgcgtacagaatttcaataaacagctgactgaaggaacacgcctacagaaagatcttaggacctacttggccagcgtgaaagccatgcacgaggcatccaagaaattaaacgaatgtttgcaggaagtgtatgaaccagattggccagggcgggacgaagccaacaaaattgccgagaacaacgacttactctggatggattaccatcagaaacttgtagaccaagctctgctgacgatggacacgtacctcgggcagttccccgacatcaaatcgcggattgcgaagcggggacgaaagctggttgactatgattcggcgcggcatcactacgaatctttacagactgccaagaagaaggatgaagccaagatcgccaaggccgaagaggagctgattaaagctcaaaaggtgttcgaagagatgaatgtggacctccaagaggaactgccatctctatggaatagtcgagtcgggttctatgttaacaccttccagagcatcgctgggctggaagaaaatttccacaaggagatgtcaaaattgaatcagaatctgaacgatgtgctcgtgggtctagaaaagcagcatggttcaaacacgttcactgtaaaggcccaacctagtgacaacgcacccgcaaaaggaaacaaaagtccctccccgcccgacggcagtcctgcagccactcccgaaattagagtgaaccatgaacccgaaccagcaggaggggcgacacccggagctaccttgccaaagtcccccagtcagctgcggaaaggcccacctgtgccaccccctcctaaacacacacctagcaaggaagtgaagcaggaacagatcctgagcttgttcgaagataccttcgttcccgaaatctctgtgacaactcctagccagccgaccgagagccctgcaggtagtctgccctcaggcgagccatccgcagcggaaggcacttttgccgtgtcgtggccatcacagacggccgaaccgggcccagcacagcccgcagaagcaagcgaggttgccgggggtacacagcctgccgcgggggcccaggaacctggtgagaccgctgcctcggaggccgcctctagctccctgcctgcagtggtggtggagactttccctgccaccgtcaatggtacggtcgaaggtggatctggcgcgggaaggctcgatttgccaccaggatttatgttcaaggtgcaggcccagcacgactatacagccaccgacactgatgagctccagctgaaagccggggacgtcgtcctggttataccgtttcaaaatccagaagaacaggatgaaggatggctcatgggggttaaggaatccgactggaatcagcacaaagagctggagaagtgtaggggggttttccccgagaacttcactgaaagagtgccctag

SEQ ID NO: 14145 - DNA, 1230 bp, Artificial Sequence
  Description of Artificial Sequence: Synthetic coding sequence
atggccgaaatggggagcaaaggggtgacagctggcaaaatcgcaagcaacgttcaaaagaaactcacgagggctcaggaaaaggtcctgcagaaacttggaaaagctgacgaaacaaaagacgaacaattcgaacaatgcgtccaaaattttaataagcagctgaccgagggtactcgcctgcagaaagatctgaggacttacctggcttcagtgaaggctatgcatgaggctagcaaaaagctaaatgaatgcctccaggaggtctacgagcctgactggccagggagggatgaggccaacaaaatagcggagaataacgacctgctttggatggactaccatcagaaattggtggaccaggccctattaacgatggacacttacctcgggcagttccccgacataaagagtcggatagcgaagcggggtaggaaattagtggactacgatagtgcaaggcatcactatgagagcctgcagaccgccaagaagaaggacgaagcaaaaatcgccaaggcggaagaagagctgatcaaggcccagaaggtgtttgaagaaatgaatgtggacttgcaggaggaactgcctagcttgtggaacagtcgggtgggcttctatgtcaacacatttcaatccattgccggattagaggagaacttccataaggaaatgtctaagctaaaccagaatctgaacgacgttctggtgggactggagaagcaacatggatctaacaccttcacagtcaaagctcagccatccgataatgctccagcgaagggaaacaaatctccatctcccccagacggctccccggcggcgacccccgagattcgcgtgaaccatgaacctgagcctgccgggggcgctacacctggggctactctgcccaaatctccttctcagtcctccctgcccgctgtggtggtagaaactttccctgcgaccgttaatggcacagtggaaggtggctccggcgcggggcgcctggacctgcctccagggtttatgttcaaagtgcaagctcagcatgattatacagctactgacacagatgagttgcaactaaaggctggcgatgtcgtcttggtgatcccgttccaaaatcctgaggaacaggacgaggggtggctgatgggagtcaaggaatcagattggaaccaacacaaagaactcgaaaagtgccggggtgtgttcccagagaatttcacggagcgcgttccatag

SEQ ID NO: 14146 - DNA, 1521 bp, Artificial Sequence
  Description of Artificial Sequence: Synthetic coding sequence
atggctgagatgggatcaaagggcgttactgccggcaagatcgcttctaacgtccagaagaaactgacgagggcgcaggagaaggtgctccaaaagctcggcaaggctgatgagactaaggacgagcagtttgagcagtgcgtgcaaaattttaacaaacagttgacagagggaacgcgactgcagaaagatctgaggacatacctcgcgtccgtcaaggcgatgcatgaggcatcaaagaaactgaacgagtgtctgcaggaagtgtatgagcccgattggcctgggagagatgaggctaacaagatcgccgagaacaatgacctgctgtggatggattaccaccagaagctagtggatcaagccttgctgacaatggacacttacctcggtcagttcccagacattaagtctcgtatcgccaaacggggtcgaaagcttgtggactatgacagcgcacggcatcactacgagtccctacagacagcaaagaagaaggacgaagccaagatcgccaagcccgtgtcccttctggagaaagctgctcctcagtggtgccagggtaaactccaggcacatctcgttgctcagaccaacctcctacgtaaccaagcagaagaggaactcatcaaggcccagaaggtgttcgaagagatgaacgtcgacctgcaagaggagctgcccagcttatggaatagtagagtggggttttacgtgaacactttccagtccattgccggcctggaggagaatttccataaagagatgagcaaactaaatcagaatctgaacgacgttttggtggggctggaaaaacagcacggtagcaatacatttactgtaaaagcccagccaagcgataatgccccggcaaaggggaacaagtctcctagtcccccggatggcagtcctgccgccactcccgagattcgggtgaaccacgaacctgaacccgcaggcggggccaccccgggtgctacactgccaaaaagtccttctcagcctacggaatctccagccggctccctgccatccggcgagcccagtgctgctgaaggcaccttcgccgtcagctggccctcacagacggcggagcctgggccagcccagcctgcggaagcatccgaggtggccggggggacacagccagcagccggtgctcaggagcccggcgaaactgctgcctccgaggctgcaagctcctcacttcctgcagttgtggtggaaacattccctgctacagtgaatggaacggtggaagggggcagcggcgcaggcaggctagatcttcccccaggtttcatgttcaaggttcaagcacagcacgactacaccgccacggacacagatgaactgcagttgaaagccggtgatgtggttctggttattccttttcagaacccagaggagcaggatgaggggtggctcatgggagtgaaagaatccgattggaatcaacataaagaactggaaaagtgccgcggagtgtttccagaaaacttcacagaacgcgtgccttag

SEQ ID NO: 14147 - DNA, 1365 bp, Artificial Sequence
  Description of Artificial Sequence: Synthetic coding sequence
atggccgaaatgggaagcaagggcgtaactgcagggaagatagcatccaatgtgcagaaaaaactcaccagagcccaggagaaagtgctacagaagttgggaaaggcagacgagacaaaggacgagcagttcgagcaatgtgttcagaatttcaacaagcaactgactgagggaactcgcctgcagaaggatttaaggacatacctggcgagcgtgaaagccatgcacgaggcgtccaaaaaattgaacgagtgcctgcaggaggtgtatgagcctgactggcctggacgggacgaagctaataagatcgccgaaaacaatgacttactatggatggattaccaccaaaaattagtggaccaggctctgctgacaatggatacctacttgggtcaattccctgatatcaagtcacggatagctaaaagggggcgaaaacttgtagattacgattccgctcggcatcactatgagtctctccagaccgcaaaaaaaaaagacgaggctaagattgcaaaagcagaggaagagttaattaaggctcagaaggtctttgaagagatgaatgtagacctccaggaggagctcccctctctgtggaactctcgggtggggttctatgtaaacacctttcagtcaatagctgggctcgaggagaactttcataaggagatgtcgaagcttaaccagaacttgaacgatgtccttgtgggcctggagaagcagcacggatccaatacgttcacagtaaaggcgcagccacgcaagaagtctaagctcttctcaagacttcggcggaaaaagaattccgataatgctccagccaaaggaaacaagagcccatctccccccgacggctcccccgcagcgacccctgaaatacgggtgaatcatgagccagagccggcgggcggggccaccccgggggcaacgctacctaaatctcccagtcagccggctgaagccagtgaggttgccggcggcacacagcccgctgccggtgctcaggagcctggggagactgctgctagtgaagctgcctcctcctcacttcctgccgtcgttgttgagacctttcccgccaccgtgaacggcaccgtggagggcggatcaggggctggaaggctcgacttgccacccggcttcatgttcaaagtgcaggcccaacatgactacacagctactgacaccgacgaactgcagcttaaggccggcgatgttgtattggttattcccttccaaaacccggaggagcaagatgaagggtggctcatgggcgttaaagagtctgactggaaccagcataaagaacttgagaaatgcaggggagtttttcccgagaactttacggaaagagtgccctag

SEQ ID NO: 14148 - DNA, 1653 bp, Artificial Sequence
  Description of Artificial Sequence: Synthetic coding sequence
atggccgagatgggatccaaaggagttactgccggaaaaatagcgtccaacgtgcaaaagaaactaacccgcgcccaggagaaggtgctgcaaaagcttggtaaggctgatgagacgaaagacgagcaatttgaacagtgcgtgcagaactttaataaacagctgacagagggaacccgtcttcagaaagaccttcgaacgtaccttgcatccgtaaaggctatgcacgaggcttcaaagaagctcaatgaatgccttcaagaagtgtacgagccagactggcccggaagggacgaagcgaacaagatcgcggaaaacaacgaccttctgtggatggattaccatcagaaactggttgatcaagcattgctaaccatggatacctacctgggacagttccctgatatcaaatctagaatcgctaagagaggtagaaagcttgtggactacgacagcgcccgccatcactatgagagtctgcaaactgccaaaaagaaggacgaggcaaaaatcgccaagccagtgtcgcttctggaaaaagccgccccacaatggtgccagggcaaactgcaggctcatttagtggcacagactaacctgctacggaatcaggccgaagaggagttgatcaaagcccaaaaggtttttgaggagatgaacgttgacctgcaggaagaactcccatctctatggaactctagggtggggttctacgtgaatactttccagagcatcgcagggcttgaggagaatttccacaaagagatgtcaaagcttaatcaaaacctaaatgatgttctcgtaggcctagagaagcagcatggcagcaataccttcactgtaaaggcacagcccagtgacaatgcccccgccaagggtaacaagagtccgtccccccccgacggctcaccagccgcaactcccgaaatacgagtgaaccatgagccagaacctgccggaggggctacccctggcgctaccctgccaaaatctccatcccagttcgaagctccaggccctttttctgagcaggcatcactgctggacctcgatttcgacccactgcccccggttacatctcccgttaaagcacccactcccagtggacagagcatcccctgggacctctgggagcccaccgaatcgccagccggctcactgccttctggggagccttctgctgcagagggaacctttgctgtgtcgtggcctagtcaaaccgctgagcccggtcccgcacagcccgcagaggccagtgaggtcgctgggggaacacagccagctgccggggctcaggagccaggcgagactgctgccagcgaagccgccagctcatcactgcccgcggtcgtggtggaaaccttcccagctaccgtgaacggtaccgtcgaagggggcagtggtgcgggcagacttgacctgccccccgggttcatgttcaaggtccaggcccaacatgactatactgcaactgacacagatgagctgcagctaaaggcaggagacgtggtgctcgttatccctttccagaatccagaggaacaggacgaagggtggctaatgggtgtgaaggagtccgattggaaccagcacaaggagcttgaaaagtgtaggggagtgttcccggaaaatttcacggaacgggttccttag

SEQ ID NO: 14149 - DNA, 1449 bp, Artificial Sequence
  Description of Artificial Sequence: Synthetic coding sequence
atggctgaaatgggcagcaagggagtcaccgccggtaaaattgcctccaatgttcaaaagaaacttaccagggcacaagagaaagtcctccagaaattgggtaaggcggatgagaccaaggatgagcagtttgagcaatgcgtgcaaaacttcaataaacaactgacagagggaaccagactgcagaaggatctgaggacctatctcgcctctgttaaagccatgcatgaggcttctaaaaagctgaacgaatgtctgcaggaagtgtacgagcccgactggcccggtcgcgatgaagcgaacaagatcgccgaaaataatgatcttctgtggatggactaccatcagaaacttgtggaccaggcactgctgactatggatacgtacttaggccaattccctgatatcaagtcacggattgccaagcgtggaaggaagctggtcgactatgactcagctcgacaccactatgaatccctccaaacagctaaaaagaaggacgaggccaagatagcgaaggcggaggaggagttgatcaaggcacagaaggtattcgaagaaatgaatgttgacctccaggaggagctgccctccctgtggaacagtcgggtggggttctacgtcaatacttttcagtccatcgcaggcctggaggagaatttccacaaggagatgtctaagctaaaccagaatctgaatgacgtcctggtcggacttgaaaagcagcacggctcaaacaccttcacggtaaaggcacagcctagcgataatgcccctgctaagggcaataagagccctagtccgcccgacggcagtcctgcagctacacctgaaatccgagtgaatcacgagccggaacccgcaggtggtgccactcccggcgccactctgcctaagtctccatcgcagctgcgtaaaggaccgcctgtgccgcccccaccaaagcatacaccgagcaaagaggtgaagcaggagcagatccttagcttgtttgaagatacattcgttccggagattagtgtgactacacctagccagccagctgaggcgagcgaagtggccggaggaacacagccggctgccggagctcaggaaccgggcgaaacagcggctagtgaggccgcgtctagctccttgccagctgtcgtagtggagacgtttcctgccaccgtgaacggaaccgtagagggaggcagcggagctgggaggctggacctgccccctgggttcatgttcaaggtgcaggcgcagcatgactacacggcgactgacactgacgagcttcagctgaaagccggcgatgtggtgctagttattccttttcagaaccctgaagagcaggatgagggctggctcatgggtgtcaaagagagcgactggaaccagcataaggagctcgaaaagtgcaggggcgtttttccagaaaactttacagagcgcgtcccctag

SEQ ID NO: 14150 - DNA, 1428 bp, Artificial Sequence
  Description of Artificial Sequence: Synthetic coding sequence
atggccgagatggggagcaaaggggtcactgctgggaagatcgcttccaacgttcagaagaaacttaccagggctcaggagaaagtcttgcagaaactcggcaaagccgatgaaacaaaagacgaacagttcgaacagtgcgtccagaattttaataaacaactgaccgaagggaccaggctgcagaaagacctccggacatatctggcttctgtcaaagccatgcatgaagccagcaagaagttgaacgaatgcttgcaggaggtgtacgaaccagactggccaggtcgcgacgaagcaaataaaattgcggaaaacaacgatcttctgtggatggattaccaccagaaactggtcgaccaagccctcctgactatggacacctatctcgggcagttccccgatattaagagccgtatcgctaaaagaggccggaaactggtggattacgacagcgcaaggcaccactatgagtctctccaaaccgcgaaaaagaaagacgaggccaagatcgcaaaggctgaagaggaacttatcaaagcccagaaagtgttcgaagagatgaatgtcgatctgcaggaggagctcccctccctctggaactctagagtgggtttttatgttaatacctttcaaagcatagccggactggaggaaaactttcacaaggagatgagcaagctgaatcagaatcttaatgacgttctcgtcggccttgagaaacaacatggctcaaacactttcacagtcaaggcccagccctctgacaacgctcccgccaaaggaaataagagtccttcaccgcccgacggatcacccgccgctacccccgaaatacgagtgaatcatgaacccgagcctgcaggaggcgcgactccaggagctaccctgcctaaatctccgtcccagcccaccgaaagtcccgctggcagcctgcccagtggagagccttccgccgccgagggcacctttgcagtgtcctggccctcccaaactgcagaacccggcccggcgcagcccgccgaagcgagtgaagttgcaggaggcactcagcctgccgctggagcgcaggagcctggtgaaacagcagcttctgaggcagcaagctcctcactccccgccgtggtggtggaaacgttccccgcaaccgtgaatggtacagtggagggtggctccggggctggccgtctcgaccttcctcccggattcatgtttaaggtacaggctcagcatgattacactgccaccgataccgacgaactgcagcttaaggccggagacgtggtgctagtgatccccttccaaaacccagaagagcaggatgagggttggctgatgggcgtcaaagaaagcgactggaatcagcataaggaactggagaaatgcaggggggtgttccctgaaaactttacggagcgagtgccctag

SEQ ID NO: 14151 - DNA, 1320 bp, Artificial Sequence
  Description of Artificial Sequence: Synthetic coding sequence
atggccgagatgggttccaaaggcgtgaccgccggcaagattgccagcaacgtgcagaaaaagctgactagagctcaggagaaggtcctccaaaagctgggcaaagccgatgaaacaaaggacgagcagttcgagcagtgcgtgcagaactttaacaagcagctgacagaggggacacggttgcaaaaagacttgcgcacctacctcgctagtgtgaaggccatgcacgaagcttccaagaagctcaatgagtgtttgcaggaggtctacgaaccagactggcctgggcgtgatgaggctaataaaattgctgaaaataatgatcttctctggatggactaccatcagaagctggtcgaccaagccctgttgacgatggacacatacctgggtcagttccccgacatcaagtcaagaatcgctaagagaggacgcaaactggttgattatgattccgcgagacaccactacgaatctctgcaaacagccaagaagaaagacgaagccaagatagcgaaggccgaggaagaacttatcaaagctcagaaagtctttgaagaaatgaacgtggacctccaggaggagctccccagtctgtggaacagccgggtgggcttttatgttaacacttttcagagcatcgcaggcctcgaggagaatttccacaaggagatgtctaagttaaatcagaacctgaatgacgtgcttgtggggctggaaaagcagcatggcagcaacaccttcactgtgaaggcgcagcccagtgacaacgctccagccaagggcaacaaatccccttcgccacccgacggtagccccgcagccacacctgagatccgagttaaccatgagcctgagcctgctggaggcgccacacctggtgccactcttcctaagtctccttcccaaccagcggaagcaagtgaagtggccggcggtacacagcccgccgctggggcgcaggagccaggtgagactgccgcttccgaggcagcgagcagttcactgcctgctgtcgttgtggaaacctttcctgcaaccgtcaacggcacagttgaaggagggtcaggggcagggcggctggacctgcctcctggcttcatgtttaaggtacaggcccagcatgactacacagccacagataccgatgagttacagctcaaagcgggggatgttgtgctcgtgattccattccaaaacccagaagaacaggatgaaggatggctcatgggagtgaaggaatctgattggaaccaacataaggaactggagaagtgtagaggggtcttcccagaaaactttactgagcgggttccttag

SEQ ID NO: 14152 - DNA, 1956 bp, Artificial Sequence
  Description of Artificial Sequence: Synthetic coding sequence
atgggaaaaaagcataagaagcacaaaagtgataagcacctctatgaagaatatgtagagaagccgctgaagctggtgttgaaggtcggtgggaacgaggttacggagctaagcaccggaagctctggccacgactctagtctgttcgaggataaaaacgaccatgataaacacaaggacaggaaacgcaaaaagagaaaaaagggggaaaagcagattccaggcgaggaaaaagggagaaagcgtcgtagagtgaaagaagacaagaagaagagagacagagacagggttgaaaatgaagctgagaaagacttgcaatgccatgctcctgttcggttggacctgccaccggaaaaaccgctgactagtagccttgcaaaacaagaggaagtcgagcagacacctctgcaagaggctcttaatcagctaatgagacaattgcagcgcaaagatcctagtgccttctttagttttcccgtcacagacttcatcgcccctggttacagcatgatcattaaacatcccatggatttctccaccatgaaagaaaaaattaagaacaacgactaccagtccatcgaggaactcaaggacaatttcaagctgatgtgcactaatgctatgatctacaataagccagagaccatctactataaggctgccaagaagctgttgcatagtgggatgaaaatactcagtcaggaacgaatccagtctctcaagcaaagcattgacttcatggccgatcttcagaagacccgcaaacagaaggacggaaccgacaccagccagtcaggagaagatgggggctgttggcagagggagcgggaggatagcggggacgctgaggcacatgccttcaaaagcccatctaaggaaaataaaaaaaaggataaagatatgctcgaagacaaattcaaaagcaataatctggagcgcgagcaggaacagttggataggatagtgaaagaatctggcggcaaactgacaagacggctcgtgaattcgcaatgcgagttcgagaggcgcaaaccagatggtacaaccactttgggcctgctgcacccggtcgaccctatcgtaggagagcccggatattgtcctgtaagactgggaatgacaacggggagacttcagtcaggtgtgaacacacttcagggatttaaggaggataaacgaaacaaggtcacccctgtactttacctgaattatggcccgtactcctcttacgctcctcactacgattccacgttcgccaatattagcaaagatgactcagaccttatttactccacatacggcgaggatagcgacctacccagcgacttctctattcatgagttcctcgctacatgccaggactacccctacgtcatggctgactctctcctggacgtgctcaccaagggcgggcattctagaactctgcaggagatggagatgtctctccccgaggacgaggggcacacccgcaccctcgacactgctaaagaaatggagattaccgaagttgaaccgccaggtcgcctggactcttcaacccaggataggttgatagctctgaaagccgtcacaaacttcggcgttccagtagaggtattcgattctgaagaagctgagatcttccagaaaaaactggatgagacaacccggctgctgcgggagcttcaggaggcacaaaacgagaggctcagcactagaccgccacccaatatgatctgcttgctcgggccatcttatcgggaaatgcatcttgcagagcaagtgacaaacaatctgaaggagcttgcacagcaggttacccccggtgatatagttagtacttacggagttcgaaaggccatgggaatcagcattccttcaccagtgatggagaataacttcgtggatctgacagaagatactgaggagcccaagaagacagatgtggctgagtgcggcccgggaggctcttag

SEQ ID NO: 14153 - DNA, 1959 bp, Artificial Sequence
  Description of Artificial Sequence: Synthetic coding sequence
atgggcaaaaagcataagaaacacaaatctgacaagcacctgtacgaggaatacgtggaaaagcctcttaagctcgttttaaaggtgggaggcaacgaggttaccgagctgagcacaggctcatcaggacacgactcgagtctgtttgaagacaagaacgaccatgacaaacataaggacagaaagcgaaagaagcgaaagaagggcgagaagcagatcccaggggaggagaaaggccggaaacgacggcgtgtgaaggaagataagaaaaaacgagatagagaccgcgtggagaatgaggccgaaaaagatcttcagtgtcacgcacctgttcggcttgatctgcccccggagaagcccttgacaagtagtctagccaaacaagaggaggtcgagcagactcctcttcaggaagcactgaaccagttgatgcgacaactgcagagaaaggatccttctgcttttttctcttttcctgttaccgatttcatagcacctgggtatagcatgatcattaagcacccaatggacttttccacaatgaaggagaaaattaaaaataacgattatcagtctattgaggaactcaaagacaattttaaactgatgtgtactaatgctatgatatataacaaacccgaaacaatctattataaggctgccaaaaaactgctgcattccggcatgaagatcctgtcccaggaacgaatccagagcctcaagcagtcaatcgatttcatggcagacctgcagaagacgcgcaagcagaaggatggcactgacaccagccagagtggcgaggacggagggtgttggcagcgcgagcgtgaggattctggcgacgcagaggcccatgcttttaaaagcccctctaaagaaaacaagaaaaaggataaggatatgctcgaggataaatttaaaagcaacaacttggaaagggagcaggaacaattagatcgcattgtgaaggagtctggtggaaagctgacaagacgcctggtgaattcccaatgcgaatttgagagacggaaaccagatggtacaaccactctggggttattgcatcccgtggatccaattgtcggagagcctggctactgccctgtgcggctgggaatgaccacgggcaggctgcagtctggtgttaatacactgcaaggcttcaaggaagacaaacgaaacaaggtcactccggtgctctatctcaactacgggccttacagttcttatgccccccattacgacagcacattcgccaacatcagcaaggatgactccgatctcatatattcaacctatggcgaggactccgatctgccaagcgacttctctattcacgagttcttggctacttgccaagattacccatacgtcatggccgatagccttttggatgtcctcacaaagggcgggcactccaggacactgcaggaaatggagatgagtctgcccgaagacgaaggtcacaccaggacacttgatacggccaaagaaatggagcagattactgaagttgaaccccctgggcggctggactccagcacacaggacaggttaattgctttaaaggctgtgaccaacttcggagtacccgtcgaggtgtttgatagtgaagaagctgaaatctttcagaagaagttagatgagacaacgcggttgctccgcgaactgcaggaagcccagaacgagcgcttgtcaacacgcccaccgccaaacatgatctgtctcctgggtccatcataccgcgagatgcatctggctgagcaggtcacaaacaatctcaaagagttagcccagcaggtcacccccggggatattgtttccacatacggggtcaggaaagcgatgggcatatccattccaagcccagtcatggaaaacaactttgttgacctgaccgaggatacagaggagcctaaaaaaaccgacgtggccgagtgcgggcctgggggcagctag

SEQ ID NO: 14154 - DNA, 1959 bp, Artificial Sequence
  Description of Artificial Sequence: Synthetic coding sequence
atgggcaagaaacacaagaagcataagtccgacaaacatctttatgaagagtatgtagaaaaacccctgaaactggtactcaaggtaggaggtaacgaggtcacggaactgtcaaccgggtcctcagggcacgacagctccctgtttgaagataaaaatgaccacgacaagcacaaggatagaaaaaggaagaaacggaagaagggtgagaaacagatccccggcgaagaaaagggccgcaaacggcggcgagtaaaagaggacaagaaaaaacgagatagagaccgggtcgagaacgaggccgaaaaagatctgcaatgtcatgccccggttaggctagacctacccccagagaaacccctgacttctagcttagctaaacaggaagaggtggaacagaccccactccaggaggccctcaaccagctcatgcgccaactacagcgaaaggatccgtctgcgtttttctcattcccggtgacagattttattgcccccggctactccatgatcatcaaacatcctatggatttctcaactatgaaggagaaaattaagaataacgattatcaaagtattgaagaactcaaagataacttcaagcttatgtgcacgaacgccatgatttataacaaaccagagactatctattataaagcagcaaagaagctccttcatagcgggatgaaaatactgtctcaggagcgaatccagtccctcaagcagagtattgattttatggcagaccttcagaagacacgaaagcaaaaggatggcactgatacaagccagagcggtgaggacggtggctgctggcagcgtgagcgcgaggactccggcgacgcggaggcccacgcgttcaagtcccccagcaaggagaacaaaaaaaaggataaagatatgctcgaagacaaatttaagtccaacaacctcgaaagagaacaggaacaattggatcgtattgttaaagaatctggcggcaaactcacccggaggcttgtgaattctcagtgcgaatttgagcggcgaaagccagatggcaccacaaccctgggactgttgcaccctgtcgaccctatagtcggtgagccaggatactgtcctgtgcgcctgggtatgaccacggggcgcctgcagagcggagtaaacacgctgcagggtttcaaagaagataaacggaacaaggtaacacccgtgctctatctgaactatggtccctacagctcatatgcacctcattacgattctactttcgcaaacatttctaaagatgacagtgacttgatttattctacatacggtgaggactctgacctgccttccgacttcagtatccatgagttcttagccacatgccaagattatccatatgtgatggcggactcactgctcgacgtgctgaccaaggggggccattcaagaaccctccaggaaatggaaatgagcctgcctgaggatgagggccacacacggacactagacacagccaaagaaatggagcagatcacagaagttgagccaccgggtagactggactcatctacccaggaccgtctgatagccctcaaggctgtgacaaattttggagtgcctgtggaagtgttcgactctgaagaggccgaaatcttccagaaaaaactggacgaaactaccaggctgctgagagaattgcaggaggcccagaacgaaaggcttagcacacgccctccgcctaatatgatttgcctgcttggcccaagttatcgggaaatgcacctggccgaacaggtcactaataacctaaaagagcttgctcagcaggtaacccctggtgacattgtctcaacgtatggggtgagaaaggccatggggatttctataccaagtccagtgatggagaataatttcgtggatctgactgaggacacggaggaacctaagaagaccgatgtcgccgaatgtgggccgggagggtcatag

SEQ ID NO: 14155 - DNA, 1980 bp, Artificial Sequence
  Description of Artificial Sequence: Synthetic coding sequence
atggccgcggtcatcctggagagtattttccttaaacggtcacagcagaagaaaaagacttctccccttaattttaagaagcgactgtttctcctgactgtccataagctgtcctattatgagtacgattttgagcgtggacgtcgcggatccaagaaaggctctatcgatgtggaaaagattacatgcgtggagacggttgtgccagaaaagaacccccccccggagaggcagatccccagacgcggcgaagagtctagcgaaatggaacaaatatccatcattgaacgcttcccttacccctttcaggtggtgtatgacgagggtccactctatgtgttctcacccacagaggagctgaggaagcggtggatacaccagctcaagaatgtcatccgatataattcagatctggttcagaagtaccacccctgtttctggattgatggccagtatctgtgttgtagccagaccgcaaagaacgccatgggctgccagattctagaaaatcgcaatggcagtcttaaaccaggctcctcccatcgaaaaaccaagaaacctctcccacctacaccagaggaggaccagatactcaagaaaccactacctcctgaacccgctgccgctccagtgagcacgagtgaactcaaaaaggttgtcgcgctctacgactatatgcctatgaacgccaatgatttgcagctccgcaagggcgacgagtattttattctcgaggaatcaaacctgccatggtggcgagcccgggacaagaatggtcaagagggctacattccctctaactacgtaacagaagcagaggatagtatcgaaatgtacgaatggtattccaagcacatgacgagaagtcaggctgaacagcttctgaaacaagagggaaaagagggcggctttattgttcgcgacagctccaaggcaggaaaatacactgtaagcgtgtttgccaaatccacaggcgatccacagggggtgattcggcactacgtagtctgtagtactccccagtcacagtactatctagcggagaaacacctttttagtacaatcccagagctgataaattaccaccagcataattctgccggcctcattagccgactgaaatatccagtttcgcagcagaataaaaatgcaccctcgacggccggcctgggctatggctcttgggagatcgaccctaaagacctgaccttcctcaaggaactaggaacagggcagttcggtgtcgttaagtatggaaagtggcgcggacagtacgatgttgcaatcaagatgataaaagaggggtctatgtccgaagacgagttcatcgaagaggcaaaagtcatgatgaatttatcccacgagaagctggtgcaactgtacggcgtgtgcacaaagcagcgccctatcttcattatcacagagtatatggcgaacggatgccttttgaattatctgcgggagatgcgccacaggtttcaaactcagcaactgctcgagatgtgtaaagacgtctgcgaggccatggagtatctagagagcaagcagtttctgcatcgcgatcttgctgcccgcaactgcctggtgaacgatcagggtgtagtcaaagtaagcgattttgggctgagtcgttacgtcttggatgatgagtatacttctagcgtgggatcaaagttcccggtaagatggtcacctccagaggtcctgatgtactcaaagttctctagcaaaagtgacatctgggcatttggggtgctcatgtgggagatctatagcctcggtaaaatgccttacgaacgttttaccaactcagagactgcagaacacatagcacagggcctccgcctttaccggcctcatttggcctccgagaaggtgtacaccatcatgtattcttgctggcatgagaaagcggatgaacggcctacctttaagatcctgctcagcaatattttggacgtaatggatgaggagagctag

SEQ ID NO: 14156 - DNA, 627 bp, Artificial Sequence
  Description of Artificial Sequence: Synthetic coding sequence
gttattaggcactatgtggtgtgcagcacaccccaaagccagtattacctagctgaaaaacacttgttctccaccatcccagagctgatcaactaccatcagcataactctgcagggttgatatccagaacccaacagctcctggagatgtgtaaagacgtatgcgaggcgatggagtacctggagagcaaacagtttctccatagagatcttgcggcccggaactgcttggttaacgaccaaggcgtggtgaaggtgtcagacttcgggttgtcccgctacgtactcgacgatgaatacacttcttccgtgggctcgaaattccccgtgcgatggtccccccccgaagtgttgatgtatagcaaattttctagcaaaagtgatatatgggccttcggcgttctgatgtgggaaatctattcattgggaaaaatgccatacgaacgctttacaaacagtgagacggcagaacacatagcacagggcctgcggttatacaggcctcacctggcgagtgaaaaggtgtatacaatcatgtacagttgttggcatgaaaaagccgatgaacgtcctacattcaagattttgttatccaatatcctcgatgttatggacgaagaatcatag

SEQ ID NO: 14157 - DNA, 420 bp, Artificial Sequence
  Description of Artificial Sequence: Synthetic coding sequence
gtgattcggcattatgtggtctgctccacgcctcaaagtcagtactaccttgcggagaaacacctgttttctacgattcctgagctgattaactatcaccagcacaattccgcgggcctgataagcagacttaagtatcctgtgagccaacagaacaagaacgccccatcgacagctgggttggggtacggtgttttgatgtgggagatctactctctggggaagatgccatacgagcgctttacaaactctgaaaccgccgagcatatcgcgcagggcctgcgtctttatcgcccacacctggctagtgagaaggtgtacacaattatgtatagctgctggcacgaaaaggcagacgaacgacccacgtttaaaatcctgctctccaacatcctggacgttatggacgaagaaagctag

SEQ ID NO: 14158 - DNA, 705 bp, Artificial Sequence
  Description of Artificial Sequence: Synthetic coding sequence
cgacattacgtcgtgtgcagtacaccccaatctcagtactatttggcagagaagcacctattcagtaccattcccgagctgatcaattatcaccagcataatagtgccgggttgatttcccgcctgaagtatcctgtatcacaacagaataaaaacgctccctctaccgccggcctaggctatggctcttgggagatcgacccaaaggatctcactttcctcaaggagttggggacgggccagttcggtgttgtcaaatatggtaagtggaggggccagtacgacgtcgctataaagatgatcaaggagggctcaatgtccgaggacgagtttatcgaagaagcaaaagtgatgatgtacgtgttggatgatgaatatacatcttctgtcggatccaaatttccagttcggtggtccccgcctgaggtgctcatgtactccaagttttcatctaagtctgacatctgggcatttggcgtgctcatgtgggagatctatagccttgggaagatgccctatgagagatttaccaactcagagactgcggaacacatcgctcaaggactaagactgtatagaccacatctggcatcagaaaaagtgtataccatcatgtattcttgctggcacgagaaagccgacgaacgacccacttttaaaatcctactctcaaatattcttgacgtaatggatgaagaatcctag

SEQ ID NO: 14159 - DNA, 225 bp, Artificial Sequence
  Description of Artificial Sequence: Synthetic coding sequence
gtcattagacattatgtcgtgtgtagtacccctcaatcacagtactacctggcagagaagcatctattttctaccattcccgagctgatcaactaccaccaacacaacagtgcagggctgatctcccgacttaaatacccagtttctcaacagaacaaaaacgcgcctagtacagcaggactgggatacgggatgtcatggatgatgaatacgcaggcccaatag

SEQ ID NO: 14160 - DNA, 1452 bp, Artificial Sequence
  Description of Artificial Sequence: Synthetic coding sequence
atggcggccgttatactggagagcattttcttaaagcgatctcagcaaaagaaaaaaactagccctttaaactttaaaaagcgtctgtttcttctcacggtccacaagctctcttactacgaatatgacttcgagcggggaaggcgaggaagcaagaaggggagcatagatgtggagaagattacatgcgtggagactgtagtacccgaaaagaatcctcctcccgagcggcagatccctcgacggggcgaagaatccagcgagatggaacagatctccatcatcgagagattcccatacccgtttcaagttgtgtacgacgaaggacctctttacgtttttagtccaacggaggagttgagaaagagatggattcaccagcttaaaaacgtcatacgctacaactctgatctcgtgcagaaatatcatccctgcttctggatcgacgggcaatacttatgttgtagccagactgctaagaacgcgatggggtgtcaaatcctcgagaatcggaacggctcgttaaagcctggcagttcccacaggaagacaaagaagcccctgccacccactcctgaggaagaccagatcttaaagaaacccctgccccccgaaccagctgcagctcctgtgtccactagcgagctaaaaaaggttgtagctctgtacgactatatgcccatgaatgcaaacgacctgcagctgcgaaaaggcgatgaatattttattctagaagaaagcaacctgccttggtggcgtgcgagagacaagaacggacaggaagggtacattccaagcaactacgtcaccgaagcagaagactcaattgagatgtatgagtggtattctaaacacatgactagaagtcaggcagagcagctcttgaagcaagagggtaaagagggaggattcattgtccgggattccagtaaagccggcaagtatactgtttcagtgtttgcaaaaagtacaggagatccgcagggcgtaatccgccactatgtcgtttgtagcactccacagtcccagtactatttggcggccaggaactgcctcgttaacgaccagggggtggtgaaggtgagtgacttcgggctgtcaaggtatgttctggatgatgagtatactagttccgtgggatcaaaatttccagtgagatggagcccacccgaagtcctgatgtattctaaattctcttccaagtcagacatatgggcttttggagtccttatgtgggaaatttacagccttggcaaaatgccttacgaaagattcacgaacagcgagactgccgagcacatagcacaggggctgcggctctaccggcctcacctcgcttctgagaaggtttacactataatgtattcctgttggcacgagaaggcagatgaaagacccacatttaaaatcctgctgagtaatatactggatgtgatggacgaagagagctag

SEQ ID NO: 14161 - DNA, 519 bp, Artificial Sequence
  Description of Artificial Sequence: Synthetic coding sequence
gttatccgccactacgtggtgtgttcgacccctcaatcccagtactacttggcagagaagcatctgttcagcaccatccccgaactgattaattatcaccaacacaactccgctgggctgatttctaggttgaaataccctgtgagtcagcaaaataagaacgcaccgtccacggccggtctaggctacggcagctgggagattgatccaaaggaccttactttcttaaaggagctgggaaccgggcaattcggagtggtgaagtacggaaagtggagaggtcagtacgatgttgccataaaaatgataaaggagggctcgatgagcgaagacgaatttatcgaagaggccaaggtgatgatgaacctgtcacatgaaaagttggtgcagctgtatggagtgtgtacaaagcagcgccccattttcataattactgaatacatggcgaacggctgcctgccctgtactgtagctgggatgagaaagcaaatgagcgttccactatccaagttcttctag

SEQ ID NO: 14162 - DNA, 594 bp, Artificial Sequence
  Description of Artificial Sequence: Synthetic coding sequence
gttataaggcactatgtcgtatgcagcactcctcagtctcagtactatctggccgaaaagcatctgttttcaacaattcctgagctgatcaactatcatcaacacaatagcgccggcctaatatccaggcttaagtatcccgtgtcccagcagaacaagaatgcgccctctactgcgggcctgggttatggatcctgggagatcgatcctaaggacctcactttcctgaaagagctcggtacagggcagtttggcgtggtgaaatatggcaagtggcgaggacagtatgatgtcgccatcaagatgatcaaagaaggttccatgagtgaagacgagtttattgaggaagccaaggtgatgatgaatctgtctcatgagaaactcgttcagctgtacggcgtctgtacaaaacagaggccgatcttcataatcacagagtatatggcgaacggatgtttgctgaactacttgcgagaaatgcggcataggttccagacccagcagctcctcgagatgtgcaaagatgtttgtgaggcaatggaatatttagaaagcaagcagtttcttcatagggacctcgtctgtcctggatag

SEQ ID NO: 14163 - DNA, 156 bp, Artificial Sequence
  Description of Artificial Sequence: Synthetic coding sequence
attcgtcactacgtagtttgctccacccctcagtcccagtactacctggctgagaagcatttgtttagcacgattcctgagcttataaactaccaccagcataacagcgcgggcgaggactcggcggccgctcgcgatgtccagggctgtctctag

SEQ ID NO: 14164 - DNA, 891 bp, Artificial Sequence
  Description of Artificial Sequence: Synthetic coding sequence
atgaagaatgaaatcgcagccgtcgtctttttcttcacacgcctggtgcgcaagcatgacaagctgaagaaagaggccgtggagcgctttgctgagaaactgaccctgattctgcaggagaaatataagaaccactggtatccagagaagcctagcaagggccaggcttatcggtgtatacgtgtaaataagttccaacgggtggaccctgacgtattgaaggcatgtgagaactcatgcatcctctactccgacctcggcttgccaaaagaattgactttatgggtagatccatgcgaggtatgttgtaggcgcgacggggtgtccccgtgttggcctgattgcagccagactcctgatctcgtgattaggcctccttggcccccaaaggctctggattataggagggaaccgcttagacccgcttcttcctttcttattatgtacggcgagaaaaataacgccttcattgtggcgagtttcgagaacaaggatgagaataaggatgagatcagccggaaagtgacacgggctctggacaaggttacaagcgactatcattcaggaagcagttctagtgacgaggaaacctcaaaagagatggaagtgaaacctagtagtgttaccgccgctgcgtcccctgtataccaaatctcagagctaatctttccgcctctgcctatgtggcaccccctgcctagaaagaagcccggcatgtacaggggcaacggccatcagaatcactaccccccgcccgtgccttttgggtatcctaaccaggggcgaaaaaataagccttacagacccattccagtgacatgggtcccccctccaggaatgcactgcgaccggaatcattggataaaccctcacatgctcgccccgcattag

SEQ ID NO: 14165 - DNA, 759 bp, Artificial Sequence
  Description of Artificial Sequence: Synthetic coding sequence
atgaagaatgaaatcgcggccgtggttttctttttcactcgactggtgcgcaagcacgacaagctgaagaaggaagcagtggagcggtttgcagagaagctcaccctgatcctccaggagaaatacaaaaaccattggtatccggagaagccttctaagggacaagcctaccgatgtatccgggtgaacaagtttcagcgcgtggatcccgacgtcctgaaggcatgtgagaacagttgcatactgtactctgacctgggcttgcctaaagagcttacgctgtgggtagacccttgtgaggtgtgttgcagatacggagaaaagaataacgctttcatcgtcgcttcgttcgagaataaggacgagaataaggatgagatctctcgtaaggtcacaagggctttagataaagtgacctcagattaccactctggaagcagcagctcggacgaagagacctcaaaagaaatggaggtcaaaccctcctccgtaactgcggctgcgtccccggtataccaaattagtgagctcatatttccccctcttcccatgtggcatcccctacctcgcaaaaagccaggcatgtacaggggcaacggtcatcagaatcattacccaccgcctgtgccctttggctatcccaatcagggaagaaaaaacaagccttacagaccaattcccgtgacctgggtgcctccaccaggcatgcactgcgatcgcaatcactggattaacccgcatatgctcgcaccccactag

SEQ ID NO: 14166 - DNA, 141 bp, Artificial Sequence
  Description of Artificial Sequence: Synthetic coding sequence
atgaagaacgagatcgccgcggtggtgtttttttttacacgcctcgtgagaaagcatgacaagctgaagaaagaagcagtggagcgatttgccgaaaagctgaccctcattctccaggagaaatacaagaatcactggtag

SEQ ID NO: 14167 - DNA, 1560 bp, Artificial Sequence
  Description of Artificial Sequence: Synthetic coding sequence
atgatgagtgagcacgacctggcggacgtcgtgcagatagctgtggaggatctctctcctgaccaccccgtcgtattggagaaccacgtcgttaccgacgaggatgaacctgccctgaagagacagcgattagaaatcaattgccaagatccttccatcaagaccatttgcctcaggttggattcaatcgaagctaagttgcaagccctggaagccacttgcaagagccttgaagagaagttggatctcgtaacaaataagcagcactccccgatccaagtgccaatggtggctggaagtcctttgggtgcaacacagacctgtaataaggtcagatgtgtagtgccacagacaaccgtgatcctcaataatgaccgacagaacgcaatcgtcgccaaaatggaggatcccctctccaatagggcgcctgatagcctggaaaacgtgatttcaaatgccgtgcctggccggcggcagaacactatcgtggtgaaggtccccggccaggaggattcacaccacgaggacggggaatctggctcagaggcctcagattctgtttcctcatgtgggcaggctggatcccagtccatcggatctaatgtgacactgattaccctgaattcagaggaggattaccccaacggcacctggctcggcgatgaaaacaaccccgagatgcgagtgcgttgcgcgattatcccaagtgacatgttgcacattagcaccaattgccgcacagccgagaagatggccctgactctgctcgactacctctttcaccgggaggttcaagccgtgtcaaatctgtcaggccagggtaaacacggcaagaagcagttggatcctctgacgatctacggtatccggtgtcacttattctacaaatttggaatcactgagagtgactggtaccggattaagcagtcgattgattccaagtgccgaacagcctggagacgaaagcagaggggtcagagtctcgcggtgaaatctttttcccgacgcactccgaattccagttcctattgtccctctgagccaatgatgagcacacctccccccgcctccgagctcccccaaccgcagccccaacctcaggctctccactatgccctggccaacgcccagcaagtccaaatccaccaaattggcgaggatggacaggtgcaggtagggcatctgcacatcgcccaggtgccacagggcgaacaggtccagatcacccaggattccgaaggcaatctgcagattcatcacgtcggacaagatggccaactactagaggctaccaggattccctgcctgcttgctccatcagtgtttaaggccagctctgggcaagtcctgcagggggcacagcttatcgctgttgcttcttctgatccagccgccgccggagtggacggttctccgctccagggctccgatatccaagtccagtacgtccaactcgcccctgtgtcagatcacacagctggcgctcagaccgcggaagctttacagcccactctgcaacccgaaatgcagttggagcacggagcaatccaaattcagtag

SEQ ID NO: 14168 - DNA, 1398 bp, Artificial Sequence
  Description of Artificial Sequence: Synthetic coding sequence
atgatgtcagagcacgatcttgccgacgttgtgcagattgccgtggaggacctgtcacctgatcatcctgtggttttagaaaaccatgtggtgaccgacgaggatgaacctgcgctcaagcggcagcgtcttgaaataaattgtcaagatccctccataaaatcgtttctatattcgatcaatcagacaatttgcctaagactggattctatcgaggccaagcttcaggcgctcgaggcaacctgcaagagccttgaggagaagctcgatttagtgacaaacaaacaacattctccaatccaggtgcccatggtggctggatccccgctgggggcgacccagacatgcaatgccgtgccaggccggcgtcagaacacaatcgtggtgaaggtgcccggtcaggaggactcccaccacgaagacggggaatcaggaagtgaggcatcagattccgtgtcctcatgcggtcaggctggatcgcagagtatcggatctaatgttaccctcatcaccttgaatagtgaggaggattatcctaatggcacatggctgggtgacgagaataaccctgagatgcgagtcaggtgcgctatcattccctcagatatgttacacatatctactaattgccgaaccgccgagaagatggccctgaccctcctcgattacttgttccatagagaggtgcaggccgttagtaatcttagtggacaaggtaaacacggcaaaaagcagttagatccgctaaccatctacgggatccgctgccacttgttttacaagtttggcattaccgaatctgactggtacagaatcaagcagtccatcgatagtaagtgcaggaccgcctggcggcggaaacagcgcggacaatccttggcggtgaagtccttttcaagacgcacacctaactcgtcatcctattgtccatcagagccgatgatgtcaacacctcctccggcttccgagcttcctcagccgcagccacagcctcaggcactgcactacgcgctggccaatgcccagcaggtgcagatacatcagattggagaggatgggcaggttcaagtgatcccccagggccacttgcacatcgcccaggtgcctcagggtgagcaggtccagataactcaggacagcgaggggaatctccaaatacaccatgtagggcaggacggccaagtcctccagggagcccagctgattgctgtggcatcatcagaccctgccgctgctggggtggacggcagtccgctgcagggcagcgacatccaggtacaatatgtgcaacttgcacctgtttcagaccacacagctggagcacagaccgcagaagccttacaacccaccttgcagccggagatgcaactagagcacggggccatacaaattcagtag

SEQ ID NO: 14169 - DNA, 1410 bp, Artificial Sequence
  Description of Artificial Sequence: Synthetic coding sequence
atgatgagcgagcatgaccttgccgatgtggtgcagatcgccgttgaggatctcagtcctgatcacccggtcgtcttggaaaatcatgtggtaactgatgaagatgagcccgcgctgaagcggcaaagactagagataaattgccaggacccctccattaagtctttcttgtacagcattaaccagaccatatgtctaagactggactccattgaagccaagttgcaggccctcgaggcaacttgcaagtccctagaggaaaagcttgacctcgttacaaataaacagcatagtccaatacaggttccgatggtcgctggttcacccctgggagcaacccagacctgcaacaaagtgcggtgtgctgtgcccgggcgccgccagaatacgattgtggtgaaggtccctgggcaggaagactcccatcacgaagatggagagagcggtagcgaggcttctgatagtgtgagtagctgcggtcaagccggctctcagagtattgggagtaatgtaacacttatcacattaaattccgaagaggattatccgaatggtacttggctcggggatgaaaataatccagaaatgcgcgtgaggtgcgcgattattcctagtgacatgctccatatcagcactaattgccgaaccgccgagaagatggccctcactctgttggactatctgtttcaccgggaggtccaggccgtatcaaacctgtcggggcaggggaagcacgggaagaaacaactcgatccactcaccatctacggcataagatgccacctcttttataagtttgggataacagagtcggattggtatcgtatcaagcagtctattgactctaaatgtaggactgcctggagacgaaaacagcgcggacaaagcctagccgtaaagagtttttcccgccgcacgcccaactctagcagctattgtcctagtgaaccaatgatgagcactccaccccctgccagcgagctcccgcagccgcaaccacagccccaggccctccactacgctctagctaatgcccagcaggttcagattcaccagattggcgaggatggccaagtccaagtgattcctcagggccatttgcacattgcacaggtcccacagggagaacaggttcaaataacacaggattcggagggaaacttgcagattcaccacgtgggccaggacggacaggtgttgcaaggagctcagctcattgctgtggcttcctccgatccggcggcagcaggagtggacggcagtcccttgcagggaagtgacattcaggtgcaatacgtgcagctcgcccctgtcagcgaccatactgctggggcacaaacagccgaagccctgcagccaactctgcagcccgagatgcagcttgaacatggcgcgatacaaatacagtag

SEQ ID NO: 14170 - DNA, 1494 bp, Artificial Sequence
  Description of Artificial Sequence: Synthetic coding sequence
atgatgagcgaacacgatttggctgatgtggtgcaaatagcagtggaagatctgtcaccggatcatccaggtactgaactttgggacattgtgctcgagaaccatgtggttaccgatgaggacgaaccggcactcaagaggcagaggctggaaatcaactgtcaggatccatcaattaagtcttttctgtattccatcaatcagacgatttgtctcaggctggactccatcgaggccaaattacaagctctggaagctacctgcaaatctcttgaggagaagctcgatctggtcaccaataaacaacactccccaatacaagtaccaatggtcgcgggttcccccctgggggccacccagacttgcaacaaagttaggtgcgcggtcccagggcgccggcagaatacaatcgttgtcaaggtgccaggacaggaggattcccaccacgaggatggagagagtgggagtgaagctagtgacagtgtgtcctcatgcggacaggccggctctcaaagcatcggaagcaacgtgaccctgatcacccttaactctgaggaagactatcctaacgggacctggttgggcgatgagaataaccccgaaatgagagtccgatgtgcgattattccctccgatatgctgcacatctcaaccaactgccggaccgccgagaagatggctttgaccttgctcgactatctgtttcatagggaggtacaggcggtgagcaatttatcagggcagggtaaacatgggaagaagcagctggatcccctgacaatttacgggattaggtgccatctgttttataagtttggaatcaccgagtctgactggtatcggataaagcaaagtattgattctaagtgccggacagcatggcgtcggaaacagaggggccagagcctggctgtgaaatctttttcacgccggacaccaaatagttcatcatattgtccgtcagaacccatgatgagcactccaccacccgcttctgagctgcctcagcctcaacctcaacctcaggcattgcattacgccctggcaaacgcgcaacaggtacagatccatcaaatcggggaagatggccaggtccaggtgatcccccaaggacatctccacatagcacaggttccgcagggagagcaggttcagatcacccaggactcagagggaaacctgcagattcaccacgtgggccaagatggccagctgcttgaggcaacacggattccgtgcttattggctcccagcgtgtttaaggcttcgagcggccaggtactgcagggggctcaactgattgccgtggcttcatcagaccccgccgcagctggagtggatggttcccctttacagggctctgatattcaggttcaatacgtgcagctcgctccagtttccgatcacacagcgggcgctcaaaccgccgaagctttgcagcccaccctccagcccgagatgcagctagagcatggagcaattcaaattcagtag

SEQ ID NO: 14171 - DNA, 1560 bp, Artificial Sequence
  Description of Artificial Sequence: Synthetic coding sequence
atgatgtccgagcatgacctggctgacgtagtgcagatcgctgtcgaggacctgagccctgatcaccctgtggtgctcgagaatcacgtcgtgaccgacgaggacgagcccgcccttaaacgccagcgtctggagattaactgtcaggatcctagcattaaaacaatatgcctacgcctcgactccatcgaagcaaagctgcaagccttggaagccacctgcaaatctctcgaggaaaagctggatttggtgactaataaacagcattccccaatccaagtgccaatggttgccggctcccctctcggagccacccagacatgcaacaaagtgcggtgtgtcgtgcctcagactaccgtgattctgaataatgacaggcaaaatgccatagtcgcgaagatggaggatcccctctcgaacagggcccccgattccctggagaatgtgataagcaacgcagtccccgggagacgtcaaaacactattgtggtaaaagtgccaggacaggaggactctcaccatgaggatggagagagtggctctgaagccagcgatagtgtgtcgagttgcggacaggccgggtcacaatctattgggtctaacgtgacgctgatcacccttaatagcgaggaagattatcctaacggaacctggcttggcgacgagaacaatcccgaaatgagggttcgatgtgcaatcataccaagcgatatgctccatatcagcactaactgcagaacagctgaaaagatggcactgacgctattggattacctgtttcacagagaagtgcaagcagtcagcaatctgtccgggcaggggaagcacggtaaaaaacagctagacccactaaccatttatggcatccggtgccatttgttttataagttcggcatcactgaatcagactggtatcggatcaagcagagcatcgacagcaagtgcagaacggcctggcggagaaagcagcggggacagagcctggctgtaaagagcttctcaaggaggaccccaaatagcagcagctattgtcccagtgagcccatgatgtctacacctccccctgcatctgaattgccccagccacagccacagccccaggccctccattacgcactggccaacgcccaacaggtgcagatccatcagattggcgaggacgggcaggttcaggttggccacctgcacatcgcgcaggtaccccagggggagcaggtccagattacacaggacagcgaggggaatctgcagatccaccacgtgggccaggacggccagctgcttgaggctaccaggatcccatgtttattagcccctagcgtgttcaaagctagctccggacaggtgctccagggtgctcaattaatagcggtagccagcagcgacccagccgctgctggagtcgatggatccccgctgcagggatcggatatccaggttcaatacgtgcaacttgctcctgtgtccgaccacacggccggtgctcagacagccgaggccctccagcccaccctgcaaccggaaatgcaactcgagcacggggcaatccagattcagtag

SEQ ID NO: 14172 - DNA, 1476 bp, Artificial Sequence
  Description of Artificial Sequence: Synthetic coding sequence
atgatgtctgaacacgacctcgctgacgtggtgcagattgccgttgaggatctttcccctgatcacccggtggtcctcgaaaatcacgttgtcaccgacgaagacgagccagctttaaagcgacagcggctggagatcaattgccaggatccctctataaagtctttcttgtactccataaatcagaccatctgcctgcgacttgattcaatagaagctaagctgcaggctctggaggcaacttgcaagtccttggaggaaaagttagatctggtaactaataagcagcattctccaattcaggtgccaatggtcgccggctctcccctcggcgccacgcagacatgtaacaaggtaaggtgtgcagtgcctggaagacgccaaaatacgatcgtagtgaaggtgcctggccaagaggactcccaccatgaggatggcgaatccggctcggaagcttccgatagcgttagttcctgcgggcaggcaggcagccagagcatcgggagcaatgttaccctcattactctaaacagtgaagaggactatcctaacggcacatggttaggagacgaaaacaaccctgagatgcgggtgcgatgcgccatcatcccgagcgacatgcttcacatttccacaaattgcaggacagccgagaagatggccttaactttgctagattacctttttcacagggaagtgcaggccgtgagtaacctttccgggcagggtaaacacggcaaaaagcagctcgatcccttgacgatctacggcatccgctgccaccttttctacaaatttggcattacagagtcagattggtaccggattaaacagtccatcgatagtaagtgccgaacagcttggagaagaaagcaaaggggccagagcttggccgtcaagagcttctccaggcgcactccaaactcaagctcctactgcccaagcgaaccaatgatgtcaacacctccccctgcatcagaacttccacagccccagcctcagcctcaggctctccactatgcccttgccaatgctcaacaggtgcagatccatcagatcggagaggatggacaggtgcaagtgattcctcagggacacctgcacatcgcacaggtgccacagggggagcaggtgcaaattacacaagactcagagggcaacctccagattcatcatgtggggcaggacgggcagctcctggaagcaacgagaatcccatgtctcctggccccttcagtctttaaggccagttctggtcaggtcttacagggggcccagctcatcgcagtggcatcatccgacccggcagcagctggcgttgatggatcccccttgcagggaagcgatatacaagtccagtacgtgcagctggcccccgtgtccgaccacacagctggggcccagacggcggaggccctgcagcccactctgcagccagaaatgcaactcgagcatggggccatccagattcagtag

SEQ ID NO: 14173 - DNA, 357 bp, Artificial Sequence
  Description of Artificial Sequence: Synthetic coding sequence
atgatgtctgagcacgaccttgccgatgtagtacaaatagcggtagaagacctgagccctgatcaccccgttgtgctggagaaccatgtggtgacagatgaagacgaacctgctctcaaacgccagagattggagatcaattgccaagatccaagcattaagagtttcctttactccatcaatcaaaccatttgtctgcgactggattctatcgaggccaaactccaggctctggaggctacgtgcaaaagtctcgaagaaaagcttgatttggtcacgaacaagcaacattccccaatccaagtgcccatggtggctggctcacctctgggcgccacacaaacttgcaataagtag

SEQ ID NO: 14174 - DNA, 87 bp, Artificial Sequence
  Description of Artificial Sequence: Synthetic coding sequence
atgatgagcgagcacgatctggccgatgttgtacaaatcgccgttgaggatctctcccctgaccatcccgtggtccttgagaattag

SEQ ID NO: 14175 - DNA, 288 bp, Artificial Sequence
  Description of Artificial Sequence: Synthetic coding sequence
atgatgtctgagcacgaccttgcggacgtcgtgcagatcgcagtcgaggacctgtcacctgaccatccagtggtactggagaaccacgtggtcactgacgaagatgaacctgccttgaaacgacagcggctggagatcaattgtcaagacccttcaatcaagtcttttctttactctattaatcaaaccatctgtctgcgcctggactccattgaggccaagttgcaggccctggaagcaacctgcaaatctctcgaggaaaagcttgacctcgtcactaataaatag

SEQ ID NO: 14176 - DNA, 372 bp, Artificial Sequence
  Description of Artificial Sequence: Synthetic coding sequence
atgatgtccgaacacgacctggccgatgtggtccaaatcgcagtggaagatctgtccccagatcacccggtagtgctagagaaccatgtggtgaccgacgaagatgaacccgctctaaaaaggcagcgtctcgaaatcaactgccaggacccttctattaagagctttctctacagcattaaccaaaccatctgcctaaggcttgattccatcgaagccaagctacaggcattagaagctacctgcaagtccttagaggaaaagcttgatctggtgaccaataaacaacattcccccatacaggtgccaatggtggctgggtctccgttaggtgccacccagacttgtaacaaggtgaggtgcgtcgtgtag

SEQ ID NO: 14177 - DNA, 588 bp, Artificial Sequence
  Description of Artificial Sequence: Synthetic coding sequence
atgatgagcgaacatgacttagctgacgttgttcagatcgcagtggaagatctcagtcccgaccaccccggcaccgagctttgggatattgtactggagaaccacgtcgtgacagacgaggacgagcctgccctcaaacgccagcgactcgaaataaactgccaagacccatcaatcaagtcgtttctgtacagtatcaatcagacaatatgcctcaggctggatagtattgaggctaagctgcaggccttggaggccacatgcaaatcacttgaggaaaagctcgatttggtgacaaataaacagcactcacctatccaggtcccaatggtcgcgggcagcccattgggcgccactcagacttgcaacaaggtgaggtgtgcagtgcccggccgtaggcagaataccatcgtggtgaaagtgccaggccaagaagacagccatcatgaagatggcgagagcggctcagaagcttctgacagcgtgtcatcctgcgggcaggctgggagccagtctatcggtagcaacgtgaccctcatcactctcaactccgaagaggactatcctaacggtacatggctcgggtag

SEQ ID NO: 14178 - DNA, 360 bp, Artificial Sequence
  Description of Artificial Sequence: Synthetic coding sequence
atgatgagcgagcatgaccttgccgatgtggtgcagattgccgtcgaggacctgtccccagatcaccctgtagtcctcgaaaatcatgtcgtgaccgacgaggacgagcctgctttgaagaggcaacgactcgagatcaactgccaggacccctccatcaagtcttttctttacagtattaatcaaactatttgcctgaggctggactcgatcgaggcaaagctgcaggcgctcgaggctacttgtaaatcactagaagaaaagctggacctggtgaccaataaacagcattcgcccatccaggtgccaatggttgccgggtctcccctaggcgccacgcaaacctgcaataaggtgtag

SEQ ID NO: 14179 - DNA, 1401 bp, Artificial Sequence
  Description of Artificial Sequence: Synthetic coding sequence
atgatgtccgaacatgacctggcagatgtcgtccaaattgcagtggaagatttgtccccagaccatcctgtagttctggagaaccacgtcgttaccgatgaagatgagcccgcacttaagcgccagcgtctggagattaattgccaggatccctcaatcaagagtttcctgtactccattaaccagactatctgcctccgactcgattcgattgaggcaaagctacaggctcttgaggccacatgcaaaagcctggaagaaaagctggaccttgttaccaataaacagcacagcccaatccaggttccgatggttgctggatcacctctgggtgctacccaaacatgtaataaggtccgatgtgctgtgcctggcagacggcaaaacacgattgttgtgaaagtgccagggcaagaggacagccaccatgaggacggcgagtcaggaagcgaggcctccgatagtgtatccagctgcggccaagcaggatctcaaagcatcgggtccaatgtgactctgatcacattgaactctgaagaggattaccctaatggcacctggctcggagatgagaacaatcctgagatgagggtgaggtgtgccattatccctagtgacatgctacatatatcaacaaactgcaggactgctgagaaaatggcactgacgcttttggattatctgtttcatagagaggtccaggctgtgtctaatctctccggtcagggaaaacacggaaagaaacaattggaccccttgaccatatacggtatccgctgtcacttgttctataaattcggaatcactgaatcggattggtatcgaatcaaacaatctattgattccaagtgtcggaccgcatggaggcggaagcagcgcggacagtccctggccgtaaagtccttttcgcgcaggaccccaaactcctcctcctattgcccttcagagccaatgatgagtactccgcccccagcctctgagctgccccagcctcagccacagccccaagctctccactacgctctcgcaaacgcacaacaggtccagatacatcagattggagaggatggacaggtgcaagtgggccacttgcacatcgcccaagtgcctcagggagagcaggtccaaatcacccaagacagcgaaggtaatctgcagatccatcacgtgggccaagacgggcaggtgctgcagggggcacagctgatagccgtggccagtagtgatcccgctgctgcgggggtggacggctcccccctgcaggggtctgacattcaggtccagtacgtgcagctcgcccctgtatctgaccacaccgcgggagcccagaccgctgaagcactccagcccaccctccagcccgaaatgcagcttgagcatggcgccatacagatacagtag

SEQ ID NO: 14180 - DNA, 753 bp, Artificial Sequence
  Description of Artificial Sequence: Synthetic coding sequence
atggggtcacctgagcctactcagggaccccggctgtctcccatcctgatcccatacagcggcagacgctataaggtggggagagcttctggcgctctttgccaccaggactccctaccacccatattggagctgggactgactttcctaagagcgagtgctgggttttccgtgcctacaagctcctctttcgcattacctgaaccactccgtagcctctgcctcgggaacggcgagggcctcgggctgtctctgactctcaccgtcctggcctggatcctcggactgtctgggacactgggcgccttggtcctcttcatggtggcgaccgggatctttcaagaggccctctggcacctgctgctcctgtcattcagcgtcgaagcacttccctgctttttcttcttccctttttttctgctgtgtcgctgcctcagagcagagttacagattcagcaaagacttgatggcacactctcccttgaccttatgcgcctggaatcagacggagaaacaggttgtgcagctgagagttccgtgctacagggggcccaactgatagccgtagcttcttccgatcccgccgcggccggggttgatggttcgcccctgcaaggatcagacatccaggtgcagtatgtgcagctggcccctgtcagcgaccacacggctggcgcccagacagccgaggctctgcaacccacgctgcagcccgaaatgcagctcgagcacggcgctatccaaatccagtag

SEQ ID NO: 14181 - DNA, 1527 bp, Artificial Sequence
  Description of Artificial Sequence: Synthetic coding sequence
atgatgtccgagcatgacttggcagacgtagttcagatcgccgtggaagatctgtccccagatcaccccgtagtgttagagaaccacgtcgttaccgacgaggacgagccggccctgaaaagacaaaggcttgagattaattgtcaggatccttctatcaaatcattcttgtactcgatcaatcagactatctgcctccggcttgattcgattgaggccaagttgcaggccctggaagccacatgcaaatctctggaggagaaactggacctggttaccaataaacagcacagtccgattcaagtgcccatggtggccggtagtccgctcggcgctacccagacctgcaataaggtgcgatgcgtggtgccacagacgaccgtgatcttgaacaatgatcggcaaaacgctattgtcgctaagatggaagaccccctttccaaccgcgctccagactcgctggagaatgtaatctccaacgccgtccctggccgacggcagaacacgatcgttgtcaaagtgcctggtcaagaggacagccaccacgaggacggtgaatctgggtcagaagcctcagacagcgtgtccagctgcgggcaggcaggcagtcaatcgattggcagtaacgtcaccttgatcactctgaacagtgaggaggattatcctaacggcacgtggctgggagatgaaaataaccccgagatgcgggttcgctgtgcgatcattccctctgatatgctccacatctccactaattgtcgcaccgctgaaaagatggctttgaccctgttagactacctgttccatcgtgaagtgcaggcagtctcaaatctgagcggccagggcaaacacggcaaaaaacagttagatccactaactatttacgggattcgatgtcatctgttctacaagttcgggattacggaaagcgactggtataggataaaacagagcatagatagcaaatgccggaccgcgtggcgccggaaacagcggggacagagtctggcagtgaaatcattttcccggcgaactccaaatagttcctcctactgtcccagcgaaccaatgatgtccacaccgccacccgcaagcgagttgccacagcctcagccacagccccaggccctgcactatgccctggccaacgctcaacaagtccaaattcaccagatcggtgaggatggccaggtgcaagtcatccctcagggccatctacacatcgctcaagtgccacagggagagcaagtgcagatcacccaggatagcgagggaaaccttcagattcatcacgtgggtcaggatggtcaagtattgcagggggctcaactcattgccgtcgcaagcagcgacccagccgcagccggagtcgacggtagcccactacagggatccgacattcaggtacagtacgtccagttggcacctgtgtcggaccacactgccggagcccagactgccgaagcacttcagccaaccctgcagccggaaatgcagctggaacacggcgctatccagatccaatag

SEQ ID NO: 14182 - DNA, 1476 bp, Artificial Sequence
  Description of Artificial Sequence: Synthetic coding sequence
atgatgtcagaacatgatttggctgacgtggtgcagatagcagtggaagacttatctcctgatcatccagtcgtgttggaaaatcacgtggtgactgatgaggatgagccggcccttaagaggcagagattggaaattaactgccaggacccatcaattaaatcctttctctattctatcaatcagacaatctgtctgagactggactctatcgaagcaaaattacaggccctcgaagccacttgtaaaagcctggaggagaagttggacctggtgactaataaacagcactcaccgatccaagtgccgatggttgctgggagtccactgggcgcaactcagacctgtaataaagtgcgttgcgctgtccccggccgtcggcagaacactatcgtggtcaaagtgcccgggcaagaagactcccatcacgaggacggagaatccgggtcagaagcaagcgatagtgtctcaagctgcggccaagcaggctcacagtcaatcggaagcaatgtgacactaatcacgctcaattccgaggaagattacccaaatggcacatggctcggggatgaaaataatcctgagatgcgagtgaggtgcgcaattattccatccgacatgctccatatctctaccaattgcagaacggccgaaaagatggcactgacactgttagactatctgttccaccgggaggtccaagccgtgtctaacctgagtggacagggaaaacatggtaaaaagcagctggaccccctgactatctacggcatccgttgccacctgttctacaaatttggtattactgagtctgactggtaccgcatcaaacagagtattgactctaaatgtcgaacagcatggcggcggaagcaaaggggccagtctttggccgttaaaagcttcagtcgtcggactccaaactctagtagctattgccccagcgaacccatgatgtcaacacccccccctgcctcagagttaccacagccacaaccccagccgcaggctcttcactatgccctcgctaacgcacaacaagtgcagatccatcaaatcggcgaagacggccaggtgcaggtgatccctcagggccaccttcacatcgcccaggttccccaaggcgaacaagtccagattacccaagactctgaaggcaatcttcaaatccaccatgtgggccaagatggccaactactcgaggccacacgcatcccttgcctgcttgccccatctgtgtttaaagcatcttccggacaggtgctacagggggcccagctcatcgctgtcgccagcagcgaccccgctgctgccggtgtggacgggtcacctctccagggctccgatatacaagtacagtatgtgcagctggctcccgtgagcgaccatacagcaggggcgcagaccgcggaggcattacagcctacactgcagccagagatgcaacttgagcacggggctattcagattcaatag

SEQ ID NO: 14183 - DNA, 3153 bp, Artificial Sequence
  Description of Artificial Sequence: Synthetic coding sequence
atggcagctgtgaagaaagaggggggggctcttagcgaggcgatgagcctggaaggagatgaatgggaactctcaaaagagaacgtacagccattgcggcagggtcggatcatgtctaccctgcaaggcgctctcgcccaagagtcagcatgtaacaacactttgcagcagcaaaaaagggcattcgaatacgagattcggttttacaccggaaacgatcctctcgacgtgtgggataggtacatcagctggactgagcaaaactatcctcagggtggaaaggagagcaacatgagcaccctcctggagcgggcagtcgaagccctgcagggagaaaagcgatattattcagatcccagattcctgaatctgtggctaaaattggggagactttgtaacgaaccactggacatgtattcctatctgcacaaccagggcattggtgtctctctggctcagttctacatatcatgggcagaggaatacgaggcgcgcgagaatttcagaaaggcagatgccatctttcaggaagggatccagcagaaggccgagccattggagaggcttcagtcccagcaccgtcagtttcaggctcgagtatctcgccagactctgcttgcactggaaaaagaagaagaagaggaggtgtttgaaagcagcgtgccccagaggagcaccctggctgagctaaagagcaaagggaaaaaaacagcacgtgcgccaataatccgtgtgggtggggcattaaaggcccctagtcagaatcgtggattgcagaacccgttcccccagcagatgcaaaacaacagcaggattacagtctttgacgagaacgccgatgaagcctccacagccgagctgagcaagccaacagtgcagccctggatagcacctcccatgcctcgggccaaagaaaatgagctgcaggcgggtccctggaatacagggcgctctctggaacataggccgcgtggcaacacagcatccttaatagccgtgccagctgtcctcccttccttcaccccttatgttgaggaaaccgcacggcaacccgttatgactccctgcaaaattgagccaagcattaaccacatcctttccacacgcaagcccggaaaggaagagggcgaccctctgcagcgagtgcagagtcaccagcaagcttcggaggaaaaaaaggaaaagatgatgtactgcaaagagaagatttacgccggtgtgggagagttttcatttgaggaaatcagggccgaggtcttcaggaagaagctaaaggaacagagggaggccgagctgctgactagcgctgagaagcgagcagagatgcagaagcagattgaagaaatggaaaaaaaacttaaggagatccagactacgcagcaagaacgaacaggagaccagcaggaagaaactatgccaactaaagagaccactaagctgcagattgcttcggagagtcagaagattcctggcatgacactgagtagtagcgtatgtcaagtgaactgctgcgctcgcgaaacctcccttgccgagaacatttggcaggaacagccccacagtaagggcccatccgtgccattttccattttcgacgaattcctactgagcgagaagaagaacaaaagcccaccggcagacccacctcgcgtgcttgcccagagaaggcctctcgcagtcctaaagacctcagaaagcatcacctcgaatgaggacgtaagtccagatgtttgtgatgaattcacgggcattgaacccttatcagaagacgccattataacaggattccgtaatgttactatttgccccaatcctgaggatacttgtgatttcgctagagctgcaagatttgtgagtacccccttccacgaaattatgagccttaaggatcttccatccgatcctgagcgcctgctgccagaggaggaccttgacgttaagacatccgaggatcagcagacggcttgtggaacaatttatagccagactctatctatcaagaagctttcaccaatcatcgaggacagccgtgaggcaacacattctagcgggttctccggtagcagtgcttcagtagcttctacatcaagcatcaagtgtctgcagatcccagagaagctagaactaacgaatgagacaagcgaaaatcctacacaaagcccatggtgttctcagtacaggaggcagttgcttaaaagcctacccgagctctccgcaagtgcagaattatgcatagaggaccgccctatgcccaaactagagattgaaaaggagattgaattaggaaatgaggactattgtatcaagagggagtacttgatttgcgaggattacaaacttttctgggtggcaccgcgcaattccgccgaactcactgtcatcaaagtgagctctcagcctgtgccctgggacttctatattaaccttaagttgaaagagcgcctcaatgaggattttgaccatttttgctcctgctatcagtaccaggatgggtgtatcgtatggcaccaatatataaattgcttcactctgcaagacctgttacagcatagtgagtacattacacatgagattacagtgctgattatctataacctgctgaccatcgtcgaaatgcttcacaaggctgagatagttcatggagatcttagtccaaggtgcctgatcttaagaaacaggattcatgatccttacgactgcaataagaataaccaggccctgaaaattgtggatttctcatacagcgtcgatctccgcgtgcaactggatgtgttcacactcagcggctttagaacagttcagatactggagggccagaagatcttggctaactgctcaagtccctaccaggtggacctcttcggcatagctgacctggcgcatctcctgttgttcaaagagcatttacaggtgttttgggacggaagcttctggaagctatcccagaacatttctgaactcaaggacggcgaactctggaacaagtttttcgttcggatcctgaatgcaaatgatgaagcaacagtaagcgttttaggggagctggctgctgaaatgaacggagtctttgataccacattccagtcacatctgaataaagcgctatggaaagttggcaagctaacctcacccggtgcattgctatttcagtag

SEQ ID NO: 14184 - DNA, 3195 bp, Artificial Sequence
  Description of Artificial Sequence: Synthetic coding sequence
atggccgctgtcaaaaaggagggaggcgcactgtccgaagccatgtccctggagggcgatgagtgggagctcagcaaggaaaacgttcaaccacttcggcagggtaggatcatgtctaccctccagggtgctctagctcaagagtcggcctgtaacaatactctgcagcagcagaaacgggcattcgagtacgagatccgcttctatactggcaacgaccctctggatgtatgggacaggtgggtgtttctgtttcacaaggataacagaaatatcaaccgttatatctcatggacagagcagaattatcctcagggcggcaaggagtccaacatgagcactctgcttgagagggccgtcgaggctcttcagggtgagaagcggtactattccgaccctagattcctgaacttgtggctgaagcttggccgtctgtgcaacgaacctctggacatgtactcctatctgcacaaccagggaatcggggtctcgctcgcccaattctatatcagctgggcagaagagtacgaggcgcgcgaaaattttcggaaggcagatgccattttccaggaaggaattcagcagaaagctgaacccttggaacggttgcagagccaacaccggcagttccaagccagagtttcaagacagactctcctggcactggagaaggaagaagaggaggaagtttttgagtctagcgtgccacaacggagtactctcgccgagttgaaatcaaaagggaagaagacggctcgcgcaccgattataagagtaggaggtgccctcaaggctccaagccagaatcgcgggctccagaatcccttcccccaacagatgcagaacaatagcaggatcacagtgttcgacgagaacgccgacgaggcgtccactgctgagttgtctaagcctaccgtacagccctggatcgccccaccaatgcctcgggccaaagaaaatgagttgcaggctggaccatggaatacagggagatccctggagcacaggcccaggggaaatacggctagtctgatcgccgtgcctgccgtgctcccgtctttcactccttacgtcgaggaaacagcccgacagccagtcatgactccttgtaagattgaaccctctataaaccacattctgagtacccgaaagcctggcaaggaagagggtgatccgctgcaacgcgtacaaagtcatcaacaggcttccgaggagaaaaaggagaagatgatgtattgcaaagagaagatctacgccggtgttggagaattctccttcgaggaaattcgagcagaagtgtttcgaaaaaagttaaaggagcaacgcgaagcggagctactgaccagcgccgagaaacgagcagaaatgcagaagcaaatcgaagagatggaaaaaaaactgaaagaaatccagaccacgcagcaggagcggacaggcgaccagcaggaagaaactatgccaaccaaggaaacaacgaagttgcagatcgcttccgagagtcaaaaaatccccggcatgacattatctagttcggtttgtcaagtgaattgctgcgctagggagaccagccttgcagagaatatttggcaggagcagccccactctaaaggcccttccgtgccattcagcattttcgacgagttcttacttagcgagaagaagaacaagtcaccaccggcagatcccccacgcgtcctagcccagcgccgccctcttgcagtgcttaaaacaagtgagagtatcaccagtaatgaggacgtatcgcccgatgtatgcgacgagtttacagggatcgaaccgctgtcagaggacgccatcatcaccggattccgaaacgtgaccatttgtcccaacccggaagatacatgcgactttgcgagagcagctcgctttgtaagtactcccttccacgagattatgtctcttaaagatttgccatccgacccagaaaggttgctccctgaggaggatcttgacgtcaagaccagcgaggatcagcagacagcttgcggcaccatttacagccaaacgctttcaataaaaaaactcagtccaattattgaggactccagggaggcgactcacagtagtggattctccggctcatcagccagtgttgcatcaacatcctccattaagtgcttgcagatccctgaaaagttggagctcaccaatgagacatctgaaaatcccacacagtctccctggtgctctcagtacagaagacagctgctcaaatctttgccagagctatcagcttctgcagaactgtgcatcgaggaccgaccaatgcctaagctggaaattgagaaggagatagaattagggaacgaggattattgcatcaagagggaatacctgatctgcgaggattataagctcttctgggtcgccccgcgcaacagcgccgaacttactgtgataaaggtttcatcccagccagtgccttgggatttctatattaacctgaagctgaaagagagacttaacgaagacttcgatcacttttgttcttgttaccaataccaggacggatgtatagtgtggcaccagtatatcaactgttttacgttgcaagatctgttgcaacactccgagtatataactcacgaaattaccgtgctgattatttacaacttactgacaatagttgaaatgctgcataaggccgagatagtgcacggcgacctttcgccccgctgcttgatcctgcgcaacagaattcacgacccttacgactgcaacaagaacaaccaggcactgaaaatagtggactttagttactccgttgatctcagagtgcagctcgatgtgttcactctcagcggcttccgcactgtccagatcctggaaggccagaaaatcttagccaactgcagtagcccttaccaggtggatttgtttggaattgctgacctggcccacctgcttctcttcaaagagcacctccaggtgttttgggacggctcattctggaagctatcccaaaacatctccgagctgaaggacggcgaactgtggaacaaattcttcgttcgtatcctcaacgccaatgacgaggccacagtttccgttttgggagagctcgccgcagaaatgaacggggtgttcgatacaacctttcagtctcacctcaataaggcattatggaaggttggcaagctgacttcccctggtgccctgctgttccaatag

SEQ ID NO: 14185 - DNA, 2802 bp, Artificial Sequence
  Description of Artificial Sequence: Synthetic coding sequence
atggccgcagtgaagaaagaaggtggtgccctttcagaggccatgagcctggaaggtgatgagtgggagctgagcaaggagaacgttcagccactgcgtcaggggcgaattatgagcacacttcagggagccttagcccaggaatctgcatgcaataacacactgcaacagcagaagagggcctttgagtacgaaatccgcttttacacagggaacgaccctctggatgtttgggaccgatacatctcatggacagagcagaactaccctcaggggggcaaagaaagcaacatgagcactctgctcgaaagggctgtggaggctctgcagggtgaaaacttctggaaggctgacgccatatttcaagaaggcatccagcagaaagccgagcccctcgagaggcttcagagtcagcatcggcaatttcaggccagggtcagccgccaaaccctcctcgccctcgaaaaggaggaagaggaggaggttttcgagtccagtgtccctcaacgatccacactggcagagctcaagtccaaaggcaagaagaccgcaagggcccctatcatccgcgttggaggagccctcaaagcaccatcacaaaatcgcgggctgcagaacccctttccccagcagatgcaaaataactcgaggatcaccgtgtttgatgagaacgccgatgaagcgtctactgcagagctaagtaaacccactgtgcagccatggattgccccccccatgcctcgtgccaaagagaatgaactgcaggccggaccgtggaataccggcagaagcttagagcacagaccgcgcgggaacaccgcgagtctcattgctgtacctgctgtgctcccgtctttcaccccttacgtggaagagaccgctcggcaacccgtcatgaccccctgcaagattgagccaagcatcaaccacattctgtcaactcgcaaacctggcaaggaggagggggatcctctccagagggtgcagtcccaccagcaggccagtgaagagaaaaaggagaagatgatgtattgcaaggaaaagatttacgcaggagttggagagttttcgttcgaggagattcgggccgaagtatttaggaagaagttgaaggaacagagagaggctgagttgcttacatcggcagagaagcgggctgagatgcagaaacaaattgaggagatggagaaaaagcttaaggaaattcagaccacacaacaggagaggactggcgaccagcaggaggagacgatgcctacaaaagaaaccactaaattacaaattgccagtgagtctcagaagatacccggaatgactttgagctccagcgtttgccaggtgaattgctgcgcccgcgagacaagtcttgccgagaacatctggcaggaacagcctcactccaaggtgtcactttcactcggcccctcagtcccattcagcattttcgacgagtttttgctgagcgagaagaagaacaagtctcctcctgccgatccgccacgggtcttagcccagcggcggcccctggccgtgctgaaaacctctgagtctataacctctaatgaagacgtgagtcccgacgtgtgcgatgagtttactggcatcgagccgctttcagaagacgccatcattactggattcaggaacgtaaccatatgtcccaatcctgaagatacacgcgaggctacacacagtagtggctttagtggttccagtgcctctgttgccagtacatcgagcatcaaatgtctgcaaattccagaaaaactcgaactgaccaacgagacatctgaaaaccccacccagtcaccctggtgttcacagtaccggaggcagctcctgaagtctctccctgagttaagcgcctcagctgagctgtgcatcgaagatcgacccatgccaaaactcgagatcgagaaggagatcgagttaggaaacgaggactactgcatcaagagagaatatctgatctgcgaggattataagctgttctgggtagcccccagaaacagtgccgagctgaccgtcattaaagtgtcttcccagcctgtcccctgggacttttacattaatcttaagctcaaggaacgcttgaacgaggacttcgatcatttctgttcctgttatcagtaccaagacggatgcatcgtgtggcaccaatatatcaattgtttcacactgcaggatctcctgcagcactctgagtacatcacccatgagatcaccgtcctgattatctataacctgctgactatcgtggaaatgctacacaaggctgaaatcgtgcacggggacctgtccccgcgatgtctcatcctaagaaaccggatccacgatccctacgactgtaataagaataatcaagccctgaagatagtagacttttcctatagtgttgacctccgggttcagctggacgtctttacactttcaggattccgcacagtgcagatacttgagggacagaagattttagctaactgttccagtccctaccaagtggatttatttggaatagccgatttagcacatctgttgctgtttaaggagcacctccaggtcttttgggatggtagcttctggaaactttctcaaaatatttccgagctgaaagacggggagctatggaacaagttcttcgttaggatcttgaatgcaaacgatgaagctactgtgtctgtgctcggcgagctggccgcggagatgaatggcgtgtttgacacgacatttcagagccatctgaataaagctttgtggaaagttggaaagcttacaagtcctggcgccctcctctttcaatag

SEQ ID NO: 14186 - DNA, 3393 bp, Artificial Sequence
  Description of Artificial Sequence: Synthetic coding sequence
atgctcgagatctgcctgaagcttgtgggctgcaaaagtaagaaaggtctgagcagttcttcaagttgttaccttgaagaagccctccaaagaccagtggcaagtgacttcgagcctcaagggctgtccgaagcggcaagatggaacagtaaagaaaatctgctggccgggccctcagaaaacgacccgaatctgttcgttgctctctatgacttcgtggccagtggcgacaataccctgtcgattactaagggagaaaagctgagggttctgggatacaatcacaacggggaatggtgtgaggctcagaccaagaatggacaggggtgggtgccctccaattatatcaccccagtcaactcgttggaaaaacactcctggtaccatggacccgttagcaggaacgctgccgagtacctcttatcatccgggatcaacggctcattccttgtgcgcgaatccgaatcttcccctggccaacgctccatcagtcttagatatgaggggcgggtatatcattataggatcaacaccgcctccgatggcaagttatacgtcagttcagaaagcaggtttaacaccctggccgaactggttcatcatcacagtaccgtagcagacggcttgataactactctacactatcctgcccctaagcgtaataagccgaccgtgtatggtgtaagcccaaactacgacaagtgggagatggaacgaaccgatatcacgatgaagcacaagctaggggggggacagtacggtgaggtgtatgaaggtgtgtggaaaaaatactcactgaccgtggcggtcaaaaccttaaaagaagacactatggaagtcgaagagtttttgaaggaggccgccgtgatgaaagagatcaaacatccaaatctagtgcagttattgggcgtctgcacccgcgagccccctttttatataatcactgaatttatgacatatgggaatttattagactacctgagagagtgcaatcggcaagaggtcaacgcggtggttctcctgtacatggccacccagatttcatccgctatggagtatctagagaagaaaaatttcatacatagagacctggctgccaggaattgcctggtcggcgagaaccatcttgtgaaagtcgccgacttcggtctgtcacgtcttatgactggcgatacatataccgcgcacgccggagcaaagttcccaattaagtggaccgcccccgagtcactggcttacaacaaatttagcatcaagtcagatgtgtgggcctttggagtcctgttgtgggaaatcgcaacatacgggatgtcaccttaccccgggatcgacctgtctcaggtctatgagctgctcgagaaggattaccggatggagcgtcccgaaggatgtcctgagaaggtgtatgagctaatgagggcctgctggcaatggaacccctctgaccgaccttcctttgccgaaatccatcaggctttcgagactatgttccaggagtcttcaatcagcgatgaggtggagaaggagttgggcaagcagggggtgcggggcgccgtgtcaaccctgctgcaagcacccgagctccctacgaagactcgaacctctcgacgggctgccgagcaccgagatacgaccgatgtgcccgagatgccccatagcaaaggccaaggggagagcgaccccctggaccatgagccagctgtctccccgctacttcccaggaaagaaaggggcccaccagagggaggtcttaacgaagatgaacggctgcttcctaaagataaaaaaacaaacctgttttctgcactgatcaagaaaaaaaaaaagaccgctcccacgcctccgaaacgctccagtagctttcgagagatggacggccagccagaacggcgaggagcgggcgaagaggagggtcgcgacatctctaacggagcactggctttcacgcccctggatactgccgacccagccaagtcccccaagccgtcaaacggtgcgggggtgcctaatggtgccctaagggaatcggggggcagtggattccgtagccctcacctgtggaagaagtcctcaaccctgacatcttctcgccttgctacaggtgaagaggaaggcggcgggtccagttccaagcgcttcctcagaagttgctccgcatcttgcgttccgcacggcgccaaggacactgagtggcggtccgtgacgctccctcgggacctgcaatcaactggccggcaatttgattcgtctacttttgggggtcataaatccgagaaacctgcccttccgagaaagcgggccggcgagaatcgcagcgatcaggtgactcgcgggactgtgaccccccctccaagattggtgaagaaaaacgaggaagccgccgacgaggttttcaaagatataatggaaagctctcccggcagcagcccacccaacctgacgccaaagccgctgcggagacaggtcactgtcgccccagcctcaggtcttccccacaaggaagaggctgggaaaggttccgccctggggacacccgccgcggcagagccagttacccccactagcaaagctggctctggggctcccggaggcacctcaaagggcccagcagaggagagtagggtgcgtcgccacaagcacagcagtgagagtcctggaagggataaggggaaactatcacgcctcaaaccagctccacctccaccaccagccgccagcgcaggcaaagctggcgggaaaccctcccagagtcccagccaggaagccgctggtgaggcagtcttgggagcaaaaacaaaggccacttccctggttgatgctgtaaacagcgacgccgccaagccttcacagcctggagaaggcctgaagaaacccgttctgcccgcaacccccaaaccccagagcgcaaagccatcagggactccgatatcgcccgcccccgtgcccagcacactcccgagcgcatcatccgcgctcgccggagaccaaccatcctctaccgcgttcatacctctgatttctaccagagtctctttgagaaagacacgacagccacccgagcgtatagcatccggtgccattacgaagggcgttgtccttgatagcacagaagccttatgtttggctataagccggaactctgagcagatggcttctcatagtgcagttctggaggcgggcaagaatctgtacaccttttgtgtctcatatgtcgactccatccaacaaatgagaaataaatttgcctttcgggaggccatcaacaaactggagaacaacttgcgagagttacagatctgtcccgctacagcagggagcggtccggcggcaacacaggatttctcaaaactcctgagctccgtgaaagaaatcagcgacattgtgcagcgctag

SEQ ID NO: 14187 - DNA, 3450 bp, Artificial Sequence
  Description of Artificial Sequence: Synthetic coding sequence
atgggacagcagcctgggaaggtgctgggggatcagcgcaggccctcgctgccagctctccatttcatcaagggagcaggcaaaaaggagagctctcgccacggtggtcctcattgtaacgtctttgtggaacatgaagctttgcaacgcccggtggcttccgatttcgaaccccagggtctgtcagaagccgctaggtggaactcaaaagagaacctcctggcaggcccttctgaaaacgaccccaatctgttcgtcgctttgtacgacttcgtcgcgtctggggacaacaccctgtcaataactaaaggcgagaagttgcgagtgctggggtataaccataacggggaatggtgcgaggcccagactaagaatgggcagggctgggtgccatccaattatatcactccagtgaactcccttgaaaagcactcttggtatcacggtcctgtgagccggaacgcggcagagtacctcctatcatctggcataaatgggtctttcttggtccgtgaatcggagtccagtcccggtcagaggtccattagcctgcgctacgaggggagagtttatcattatcggatcaacaccgcatctgacggtaagctgtatgtaagctctgaatctcggtttaatactcttgcagaactagtgcaccatcattcaaccgtggcagacggactgatcacaactctacattatcccgcccccaagcgaaacaaaccaacggtgtacggtgtgtctcctaattatgacaaatgggagatggagcgaactgacataactatgaagcataagcttggaggaggacagtacggtgaggtgtacgaaggcgtttggaagaaatattctctgacggtcgctgttaagaccttaaaagaggatacgatggaagtcgaggagttcctgaaggaggccgcagtaatgaaggaaatcaagcaccccaacttggtccagcttctgggtgtatgcactcgggaacctcccttttacattattaccgagttcatgacctacgggaacctgcttgactatctgagggaatgcaacagacaggaagtcaatgccgtggtcctgctatacatggccacacagatctctagcgccatggaatatttggagaagaaaaactttatccatagggaccttgccgctcggaattgcctagtaggtgaaaatcacctggtaaaagtggctgatttcgggctgtcccgactgatgacaggcgatacttatactgcacatgcgggagcaaaattcccaatcaagtggaccgctcccgaatcgctggcttataataagttttcaatcaagtctgatgtgtgggcctttggtgtgctgctgtgggagatagccacttacggaatgtccccatatccaggtattgacttgtcccaggtctacgaattactcgagaaagactatcggatggagcggcccgaaggctgcccagaaaaggtatacgagctcatgagggcctgctggcagtggaacccttcagaccgtccctcctttgctgagatccatcaggctttcgagacgatgtttcaagagagctccatctctgacgaggtagaaaaggagttaggcaagcaaggggtacggggagcagtttctactctgctccaggctccggagcttcctacaaagacccgcacctctcgtcgcgctgcagaacatcgcgataccacagatgtccccgaaatgccgcactctaaagggcagggcgaaagcgaccccctggaccatgagcctgccgtctccccactgctgccgagaaaggaaaggggacctcctgagggtggcctcaacgaggatgaacgtttactgcctaaggataagaagactaatctgttttccgctctgattaagaagaagaaaaagaccgcaccgacccccccaaaacgctccagcagtttccgagagatggacggacaaccagagaggcggggtgctggcgaggaagagggtcgggacatttctaatggcgcgctggcctttactcctcttgataccgcggaccccgctaagagtccgaagccttccaacggcgctggagtccccaatggagcattgagagaatccggcggtagtgggtttagaagtccccatttgtggaagaagtcctcaacactgacgtcgtctagactggccaccggtgaagaagagggaggggggtcttcctccaagcggttcttgcgcagctgcagtgctagttgtgtccctcatggcgccaaagacacagagtggaggtccgtgactttacccagagacctccaatctaccggtagacaattcgactctagtacatttggagggcacaagtccgagaagcccgcactcccgagaaagcgggctggagagaaccgcagcgatcaagtgacgagggggactgtgacgccgccaccgaggctggtcaagaaaaatgaggaggcagctgatgaggttttcaaggacatcatggagtcttcaccaggatctagcccacccaatctgactcctaaaccacttcgacgtcaggtgacagttgcccctgcatcgggcttgccccataaggaagaagccggaaagggatccgcactaggaaccccggccgcggctgagcctgtgacaccaacatctaaggccggctctggagcacctggcggaactagcaaggggccagccgaggagtcccgggtacgtagacataagcacagtagcgagagcccaggacgagataaggggaagctgagtagacttaagcctgccccacctcccccacccgcggccagtgcaggtaaggctggcggtaaaccttcgcagagcccaagtcaagaggccgccggagaagcggttctgggggccaaaactaaggccacaagtctggtcgatgcagtaaactctgacgccgccaaaccttcacaacctggagaaggattgaagaaacccgttctccccgccacacccaagccacagagcgccaaacctagtggaacccctatctcccctgctcctgttccttcaaccttaccttccgcatcctctgccctcgccggagatcaaccaagcagtacagcgtttatcccccttatatccacccgcgtgtccctgcgtaaaactcgccagccacctgagcgtatagcgtcaggcgccattaccaagggagtggtgcttgacagcaccgaggccttgtgcctcgccatttctaggaattctgagcagatggcttctcactctgctgttttggaggctggtaaaaacttgtacacattctgcgtgagctatgttgattccatccagcagatgaggaacaagtttgctttccgggaggcaatcaataagctggagaacaatctcagggaactgcagatttgtccggccacagcaggctctgggccagctgccactcaggacttttctaaacttttgtccagtgtcaaggagatctccgacattgtgcagagatag

SEQ ID NO: 14188 - DNA, 195 bp, Artificial Sequence
  Description of Artificial Sequence: Synthetic coding sequence
atgggtcagcaacccggaaaggttcttggtgatcaaaggaggccctctctccctgctctccactttatcaaaggagcaggaaagaaagagtcttcccgccacggtggcccccattgcaatgttttcgtggaacaggccctccagcgcccagtcgcctccgactttgaaccccagggattatcagaagctgcttag

SEQ ID NO: 14189 - DNA, 486 bp, Artificial Sequence
  Description of Artificial Sequence: Synthetic coding sequence
ggtcgccccgggcgcagtagagctcggggaggcggagaaggtggatggagaggtggcggtagagctggacgcgccgggccggagcccggccccagagctggtagaggagttcccgcccctgactgttggcgaggtaagatgctggagatttgtctgaaattagtcggctgcaagtcgaagaagggcttgtcctcttcgtcaagctgctatctggaggaagcacttcagcggcctgtggcaagtgattttgagcctcaggggctttccgaggccgctcgatggaacagcaaggagaacctgctggcgggaccctccgaaaacgaccctaacctttttgtcgctctctacgactttgtcgccagtggcgacaacacacttagcatcacgaagggagaaaagctgagggtcctgggctataatcacaacggagaatggtgtgaggcccagactaagaatggacagggttgggtacctagcaactactag

SEQ ID NO: 14190 - DNA, 2838 bp, Artificial Sequence
  Description of Artificial Sequence: Synthetic coding sequence
ttacgcctcctgcgggagcctttacagcatccaggacgcgtaggctcttcatctttcaacggcgggcggcgggcccatcatcatgcacccctgtcctctcccaaggctcaacaggcccattgtttatggtgcgtgccccaactgagacaggtgggtgacggaacccatggtcaccaccacgaggcccagggggggggccaatatggcgaggtgtacgaaggcgtctggaagaagtattcactcactgtcgcagttaaaaccttaaaggaggatacgatggaagtggaagaattcctgaaggaggcagccgtgatgaaagaaattaagcatcccaacttggtccagcttctcggcgtctgcacacgcgagcctcctttctacattatcaccgagtttatgacatatggtaatttgctcgattatctaagggaatgtaatagacaggaagttaatgccgtcgtgctcttgtacatggctacacaaattagcagcgctatggaatacctcgagaaaaagaattttattcacagggatttagcggcccgcaactgcctcgttggcgagaaccatttggtcaaagtagccgacttcggcttgtcaaggctgatgaccggtgatacttataccgcccacgcaggcgcaaaattcccaataaagtggactgctccagagagcctggcttacaacaaattcagtataaaatcagatgtgtgggccttcggcgtcttactgtgggagattgcaacatacggcatgagcccctacccaggcattgacctttcccaggtctacgagctccttgagaaagactacagaatggagaggcccgaaggttgccccgagaaggtgtatgaactgatgcgggcctgttggcaatggaacccttccgacagacctagtttcgccgaaattcaccaggcctttgagaccatgtttcaagaatcatccattagcgacgaggttgagaaggagctcggaaagcagggggtgcggggcgccgtgagcacactgctgcaggcccctgaactacccacgaagacaaggacatcaagacgggccgcagaacacagggacactaccgatgtgccagagatgcctcatagcaaaggacagggggagtccgatcccctcgaccacgagcccgctgttagtcccttgctgcctagaaaggagagaggtccccctgaaggtggtcttaacgaagacgagagattacttcctaaggacaagaaaacgaaccttttcagtgcccttatcaagaaaaaaaagaaaaccgccccaacaccacctaaaaggagtagcagttttcgcgagatggacggccagcctgagcgacgcggtgccggcgaggaggaagggcgcgatatatcaaatggagctctggcatttacccctttggacactgctgaccccgcaaaatccccaaagccaagcaatggagccggtgtgcctaacggggcgttgcgcgaatccgggggctcgggcttcaggtcacctcatctatggaagaagagctccacattgaccagtagtcgactggcaaccggcgaggaggaagggggaggttcttccagcaagcggttcctccggtcttgtagcgcctcttgcgtcccacacggagctaaggacacagagtggcgctctgtcaccctgcccagagatctgcagagcaccggacgccagtttgactcttctacctttggtggacacaaatcggagaaacccgctctgcccagaaaacgggccggggagaatcgtagtgatcaggtgactagaggcacagtgacgccacctcccagacttgtcaagaaaaacgaagaggccgcagacgaggtgttcaaagatatcatggagtcctcacctggttctagcccccctaatttaacacccaagcctctccgccggcaggttaccgtcgctccggcctctggtcttccgcacaaagaagaggcgggaaagggcagcgcccttggcacaccagctgccgccgaacccgttacccccaccagtaaggcggggagtggcgcacctggtggcacttccaaaggcccagcagaggagtctcgggtccgacggcacaagcactcgagcgagtcacctggtcgcgacaaagggaagctcagccggctgaaaccagcaccaccccctccccccgcagcatcagccggaaaggcaggtgggaagcctagtcaaagtccctcccaggaagctgccggagaggccgtgttgggggctaagactaaggccacgtctttggtagacgcagtgaatagcgacgcagctaaaccatctcagccaggggagggccttaagaagcctgttctccctgcaacaccgaagccacagtcggcaaagccttccggcaccccaatcagtccagcacctgttccatctacgctaccctcggctagttcagcattggctggggatcaaccaagctctactgccttcattccgctcatatctaccagggtgtctctgagaaaaacgagacagccacctgagcgaattgcctccggcgcaatcactaaaggcgtggtcctggatagcactgaggctctgtgcctcgcaatatctagaaatagtgaacaaatggcatctcattcagccgtgctggaggctggaaagaatctttatacgttctgcgtgagctacgtggattctatccagcaaatgagaaataaatttgctttccgcgaagcaatcaacaaattggaaaataatttgcgggaattgcaaatctgtccagccaccgccggatctggccccgcggctacccaggatttctctaagctgttgagttctgtgaaggagattagcgatatcgttcaacgctag

SEQ ID NO: 14191 - DNA, 2649 bp, Artificial Sequence
  Description of Artificial Sequence: Synthetic coding sequence
atgggcccctggagtcggtctctatccgcccttctgctcttattacaggtgtcgtcatggctctgccaggaacctgagccttgtcaccccgggtttgatgctgagtcatacacatttactgttcccaggaggcacctcgagcgggggagggtgctgggacgtgtgaatttcgaggattgcacgggtcgccagagaactgcgtattttagtctcgacactcggttcaaggtaggtaccgacggagtcattaccgtgaaacgcccacttaggttccacaacccacagatccacttcctcgtctacgcatgggactcgacatacaggaagtttagtactaaggtaacactgaacaccgtgggtcatcaccatcgaccccctcctcaccaagcctctgtctcagggatccaagcggagctgctcacctttccaaatagtagccccggccttagacgccaaaaaagagattgggttatcccccctatctcatgccctgagaatgagaagggaccgttccccaaaaacttggtgcagatcaaaagtaacaaagataaagaagggaaagtgttctactcaataaccggtcagggggctgacaccccacccgtgggagttttcatcatcgagcgcgagaccgggtggctgaaggtgacggagcccctggatcgcgagagaatagctacgtacacactcttctcccatgctgtgtcgtccaacggaaatgctgtggaagacccaatggagatccttattactgtaaccgatcagaacgataataagcctgaatttacccaggaagtgtttaaggggtcagtgatggagggagcccttcccggtacaagtgttatggaggttacagctacagacgcagacgatgatgtaaatacctataatgccgccatagcatacacgatcctctcacaggatcctgaattgccagacaagaatatgtttactattaaccggaacaccggggttatctcggtggttactactggcttggaccgcgagtcatttcctacatacactctcgtggtgcaagccgcagatttacagggggagggcctaagcactacagcaacagccgtaatcaccgttactgacaccaacgacaaccctcccatcttcaatcccaccacttacaaggggcaggtgccagaaaacgaagccaacgtagtgatcactacacttaaggtgaccgacgcagacgctccaaacactccagcttgggaagcggtctacaccattctgaacgacgatggaggccagttcgtggttacaacaaatcctgttaacaacgatggaatattaaaaactgctaaagggctggatttcgaggcaaagcagcagtacatattacacgtggcagtgaccaatgtggtgccgttcgaggtgagcctgacgacctcaactgcaactgtgaccgttgacgtgttagatgttaacgaggctccaatcttcgtcccgccagagaagagggtggaagtctccgaggacttcggcgtgggccaggaaatcactagttacacagctcaggagcccgatacctttatggagcaaaagatcacctatagaatctggcgcgacaccgcaaactggttggagatcaatcctgatactggggccatttcaacccgcgcggagctggaccgcgaggacttcgagcatgtgaagaactcaacttacacagcattgattatcgccactgacaatggctctcccgtcgcaaccgggaccgggacactgctgttgattctctcagacgtcaatgataacgcccccattccagaacctcgtactatctttttttgtgaacgtaacccgaagccacaggtcatcaacattattgacgccgacctgccccctaataccagcccatttacggccgaactgactcacggggctagtgccaactggacgatacaatacaacgatcctactcaggaatccatcatcctaaaacccaaaatggctttggaggttggtgattataagatcaatttaaagttgatggacaatcagaacaaggaccaagtgaccactcttgaggtctctgtctgcgactgtgagggtgctgccggggtgtgcaggaaggcgcagccggtggaagccggactgcagatccccgctattttgggcatcctggggggaatcttagcgctgctcattttaatacttcttctgctgctgttcttgcgccgccgggcggttgtaaaagagccactcctgccgcctgaagacgatacccgcgataatgtctactattacgatgaagagggcggtggcgaggaagatcaggactttgatctatcccagctgcaccggggcctcgatgcacgccccgaggttacccgcaatgacgttgcacccactctgatgtccgtccctcggtacctccccagacctgccaatcccgacgagatcgggaacttcatagacgagaatctgaaggcggctgatacggaccccaccgcccccccttatgatagtctactggtgtttgactacgaaggaagtggctcggaggccgcatcgctgtcctccttaaacagctccgaatccgataaggaccaggattacgattacctgaatgaatggggtaatagatttaaaaaattggccgatatgtatggcggcggcgaggatgattag

SEQ ID NO: 14192 - DNA, 1944 bp, Artificial Sequence
  Description of Artificial Sequence: Synthetic coding sequence
atgggcccatggtcaagatctctcagtgccttattgctgttgcttcaagttagctcttggctctgccaggagcctgaaccttgccatcctggattcgacgccgagagctacactttcactgttccccgcaggcatctggagagaggccgggtgttaggccgggtaaattttgaggattgcaccggacggcagcgaactgcctatttcagcctcgatacacggtttaaagtgggaacagatggagtgataaccgtgaaacgacctctgcgattccacaaccctcagatccattttttagtctatgcatgggattccacctaccggaaattctcgaccaaggtgaccctcaatacggtgggccaccaccatcggccacctccacatcaagcaagcgtgtccggaattcaagccgaactattaactttccctaatagctccccgggtctgcgaaggcagaaaagggactgggtgatccctccaatatcctgtccggaaaatgaaaagggtccgtttcctaaaaatcttgtccagataaagtccaataaagataaagagggaaaagttttctacagcataaccgggcagggcgcagatactcccccagtaggtgtatttatcattgaacgagagactggttggctaaaagtgacagaacctttggaccgagagaggatcgctacctatactttgttctcccatgctgtaagctcaaatgggaatgccgtggaggatcctatggaaatcctaattactgtgaccgaccagaacgacaataagcccgagtttacgcaggaagtgtttaagggaagcgtgatggaaggcgcactgcctggtacttcagtgatggaggtaacagcaacggacgctgatgatgatgtgaacacctataacgccgcaatcgcgtatacaatcctgtctcaagatcccgaactgcccgataagaatatgtttaccatcaacaggaatacaggtgtaatttctgtcgtgacaacgggtctggacagggaaagcttcccgacatacaccctcgtggtgcaggccgcagatctgcagggggaagggctgagcaccaccgccacagcagtgatcactgtaacagacaccaacgataaccctccaatatttaacccgaccacctataaaggccaagtaccagaaaatgaagccaacgttgtcatcacaactttaaaagtgacagacgccgatgctcccaatacacctgcgtgggaggccgtatataccatcctgaatgacgacgggggacagttcgtggttacgactaatcctgttaataatgatgggatcttgaagaccgccaaaggcttggactttgaggctaagcagcagtacatcctccacgtggctgttacaaatgtcgtgccatttgaggtgagtctgaccaccagtacggcaacagtgaccgtcgacgttcttgacgtcaatgaagctccaatcttcgtccccccagaaaagagagttgaggtgtcagaagactttggagtgggacaagagatcacgagctacaccgcccaggaacctgacacattcatggaacagaagatcacctacagaatttggcgggatacagcaaactggttggaaattaaccccgataccggagccattagtacgcgagccgaattggatagggaggacttcgagcacgtcaaaaacagcacttataccgcactgatcatcgccacagataacgggagcccagtggctaccggtactggcaccctgctgctgattctgagtgatgtcaatgacaatgcccccatacctgagcctcgcacaatcttcttttgcgaacggaatccaaagcctcaagtcatcaacattattgatgcggatttgccccctaacctcgctagccagtctattgggattacagatatgtcccactgtacttgccctgcaccgcagctgccagctattttctag

SEQ ID NO: 14193 - DNA, 2703 bp, Artificial Sequence
  Description of Artificial Sequence: Synthetic coding sequence
atgggcccttggagtcgatccctgtccgctttgcttctcctgctgcaggtttcttcttggctgtgtcaggagccagagccctgccacccaggcttcgatgcagagagctacactttcacagtgcctcggaggcacctggagcgtgggcgggtactcgggcgtgtcaacttcgaagactgtaccggcagacaaagaacggcttatttctctctcgatactcgcttcaaggtgggcacagacggagtgatcaccgtgaagaggcctctcagattccacaatcctcaaatacattttctggtatacgcttgggattcaacctatcgaaaatttagcacaaaggtgactctcaatacagtgggtcatcaccaccggcctcccccccaccaggcctctgttagtggcatccaggctgagctgctgaccttccccaacagtagtccaggactccggagacagaaaagggactgggttatcccaccgatttcctgtccagaaaatgagaaaggtccattcccgaagaacctggtacagataaagagcaataaagataaagaggggaaggtgttctatagcattacaggacagggcgcagatactcctccagtgggagttttcatcattgagcgggaaactgggtggcttaaggttaccgaaccgcttgatcgcgagaggatagctacttatacccttttctcccatgctgttagctctaacggcaatgcagtagaggaccccatggagatcttgatcaccgtgaccgatcagaatgataataaacctgagtttacgcaggaagtctttaagggctccgtgatggaaggggccctgcccggaacaagcgtgatggaggtgacagctactgatgcagacgacgacgtgaatacctataatgcggcaatagcatacaccatactttcccaggatccagaactccccgataaaaatatgtttactatcaacaggaacacgggagtcataagtgtggtcacaacgggattagaccgggagagttttcccacatacacgttggttgttcaggctgccgaccttcaaggcgaaggattgagcaccacagcgactgcggttattaccgtaacagacacaaacgataacccgccaattttcaatccaactacctacaaaggccaggtcccagagaatgaggccaacgtggttatcaccaccctgaaagtgacggatgcagacgccccaaatacgcctgcatgggaggcggtttacactattctcaacgatgacggcgggcagttcgttgtaactactaatccagtgaataatgacggaatcttgaaaaccgccaaattggcacgttgtaggaactggcacccacactcgtgtagttacccatgtcctctcggactggacttcgaggcaaagcagcagtatatactccacgtggccgtaaccaatgtcgttccgttcgaggtgagcctgacaactagcaccgccaccgttacggtcgacgtgttagatgtgaacgaagcccccattttcgttcctccagagaagagagtggaggtgtcggaggacttcggagttggacaggaaattacctcctacacggctcaagaacctgatacattcatggagcagaaaattacatacagaatctggcgggacacagccaattggctggaaatcaacccagatacaggtgccatttcaacccgcgccgaactggatcgtgaagatttcgaacacgtgaagaactcgacttatacggcattgattatagccacggacaatggttcgcccgtcgctacgggaacaggtaccttgctcctcattctgagcgatgtcaatgataatgcccccatcccagagccccggactatttttttttgcgagagaaatccaaaaccacaggtgatcaacataattgacgccgatttgccccctaatacctctcctttcaccgccgaactcacccacggggcctcagcaaactggacgatccaatacaacgacccaacccaggagagcatcattctaaaaccaaaaatggccctggaggtgggtgattataaaataaatctcaagttgatggataatcagaataaggaccaggtgaccacattagaagtgagcgtgtgcgactgtgagggcgcagccggcgtctgccggaaggcccagcccgtggaagcgggtctgcaaattcccgccatcctgggaatactgggtgggatactcgccctgctgatcctcatactgctgctgctcctctttctgagacgaagggctgtggtcaaggaaccacttctgccgcccgaagacgacactcgcgataatgtgtattactatgacgaggaggggggtggtgaggaggatcaggacttcgacctgtcacagctgcatcgcgggctagatgctagaccagaagtgacgagaaatgacgtggctccaactttgatgtctgtcccgcggtaccttcctcgtccagcgaatcccgacgagatcggcaactttattgatgagaatctcaaggcagcagatacagatccaacagctccaccgtatgattctctgctcgtgttcgactacgaaggctctggaagtgaggctgcttccctctcctcgttaaactcctcagagtcagacaaagatcaggactacgattatctgaatgaatggggaaacaggttcaaaaagctggcagacatgtacggggggggcgaagatgactag

SEQ ID NO: 14194 - DNA, 2466 bp, Artificial Sequence
  Description of Artificial Sequence: Synthetic coding sequence
atgggaccgtggtcccggtccctttcggcccttctcctgctcttgcaggtgagctcgtggctatgtcaagagccagaaccttgccacccggggtttgatgccgaaagctacaccttcaccgtgccccggaggcatctagaacgtgggagagtgctcggccgcgttaactttgaagactgcaccggacgccagcggaccgcttattttagcctggacacacggttcaaagtgggcacagacggtgtgattacggttaagagacccctgcggtttcataacccacaaattcacttcctggtgtacgcttgggactcaacataccggaagttttccactaaagttactctaaacacagttggacatcaccaccgcccccccccacatcaggcctcggtcagtggaattcaggcagagctactcactttcccgaacagttccccagggttgcggcggcagaagcgtgactgggtgatcccgcccatcagttgccctgagaatgagaaaggcccttttcccaagaacctcgtgcaaatcaagagcaacaaggacaaggaaggcaaggtgttttactccatcaccgggcagggggccgatactccacctgtgggagtgtttatcatagaacgggagacaggctggttaaaagtaactgagccccttgatagggagagaatcgcgacatataccctattcagccacgcagttagctcgaatggcaacgcggtcgaggatcccatggagatcctgatcactgtcacagatcaaaatgacaacaaaccagagtttacacaagaggtcttcaagggatccgtgatggaaggtgctctgcccggtacttctgttatggaagtaactgcaacagatgccgacgacgatgtgaacacatataatgccgccatcgcttacacaatccttagccaagaccccgagttgcctgacaaaaacatgttcaccataaaccgaaatacaggtgtcatttccgtggttacaaccggtctcgaccgggagtcctttccaacatacaccctcgtcgtgcaggcggccgacctccagggagagggactgagcacaactgcaactgccgtgattacagtgaccgacactaacgacaatccacctatctttaaccctaccacgggactggactttgaggctaagcagcagtacatccttcacgtggccgtcactaatgtggtgccctttgaggtgagccttacgacttcaacggcaacagtgacagtggatgtgttggacgtgaacgaggcaccgatcttcgtgccgccggagaagcgcgttgaggtaagcgaggactttggcgtggggcaggagattacatcctatactgcccaagagcctgatacattcatggagcagaagattacctataggatatggcgagacacagccaattggctcgagattaatcctgacacaggggccatatccaccagggccgagctggatagagaagattttgagcacgtcaagaattctacctacactgctcttatcatcgccaccgacaacggatctccggtggcaacggggaccggcactctgttgcttatactctccgatgtaaatgacaacgcacccattcctgaacctcgaaccatcttcttttgcgaacgaaatccgaagccacaggtgattaacatcattgacgcagacttgcctcccaacacttctccattcactgctgagctgacccatggagcaagcgccaattggacaatccagtacaacgacccaacacaggagtcaattatattaaagcctaaaatggcgctggaggtaggcgattataagattaacctgaaattgatggacaaccagaataaagatcaggtaacaaccctcgaggtctccgtttgtgactgcgaaggggccgctggggtctgtaggaaggcccagcccgtggaggctggtctccagatcccagctatcttgggtatcctcggcggaatattggctttgctgatactgattctgttgctcttgctgtttctgcgcagacgtgctgttgtcaaagaacccctcttgccccctgaagacgacactcgtgataacgtgtattattatgatgaagaggggggtggtgaggaagatcaggactttgatctgagtcagcttcatcgcggcctggatgcccggcctgaggtcacgcgtaatgatgtggcgcccaccctgatgtccgttcccagatacctgcctaggccggcaaaccccgatgagattggaaactttatcgacgagaatcttaaagcagctgacaccgatcctaccgcaccaccttacgattcactgctggtatttgactatgagggctccgggtccgaagccgcctctctgtcctcccttaactctagcgagtctgataaggatcaggattacgactacctgaatgagtgggggaaccgtttcaagaagctcgccgatatgtatggcggtggggaagacgattag

SEQ ID NO: 14195 - DNA, 2391 bp, Artificial Sequence
  Description of Artificial Sequence: Synthetic coding sequence
atgaaagaaaactactgtttacaggctgctctggtttgcctcgggatgctgtgccacagtcatgcattcgcacctgagcgtaggggacatctcagaccatcttttcatggccatcacgagaaggggaaggaaggacaggtgttgcagaggtctaagagggggtgggtgtggaaccagttctttgtcattgaagagtatacaggccctgatccagtgcttgtggggaggttgcactccgatatagattccggggatggcaatatcaagtatattttgagtggggaaggcgccgggacaatcttcgtgatcgatgacaagagcgggaatatccatgcaacaaaaacgctcgaccgggaagagcgagcacagtatacactgatggcccaagccgtggatagagatacaaacagaccactcgagccaccttctgagttcatcgtgaaggtgcaggatatcaatgataacccgcccgaattcctacacgaaacttatcatgcaaacgtgccagagagaagcaatgtcgggacgtctgtaatccaggtgacagcctccgacgctgatgatcctacttatggaaattctgcaaagctagtgtatagtattctggagggacagccttattttagcgttgaagcccagacaggcatcatccgcaccgcccttcctaacatggatcgcgaagccaaggaggaatatcatgtggtgatccaggccaaagacatgggcggacatatgggggggttgagtggcaccactaaggtcactatcaccttaaccgatgttaacgacaacccacccaagttcccccagtccgtgtatcagatgtccgttagcgaggctgccgtccccggggaagaggttggcagagtgaaagccaaagatcctgatatcggtgagaatgggttagtgacttacaacatcgttgatggcgacgggatggaaagttttgagattaccacagattacgaaacgcaggagggcgtcattaagttgaagaaacccgttgattttgaaacgaagagggcctacagcctcaaagtggaagctgctaatgtgcacattgaccctaagtttatatccaacggcccgttcaaagataccgttacggtgaagattagcgtggaggatgctgatgaaccgcccatgttccttgctccctcctatatccacgaagtacaggagaatgcggccgcaggcaccgtagtcgggcgggtgcacgcgaaggatcctgacgccgccaactcgccgattagatactcgattgataggcacactgatcttgatagattcttcactatcaaccctgaagatggcttcattaaaacaactaaaccccttgatagggaggaaacagcctggctgaatattacagtattcgcagccgaaattcacaaccgccaccaggaggccaaagtgcctgtcgccattagagtccttgatgtcaatgacaatgctcccaagttcgctgctccctacgagggctttatttgtgagagcgatcagaccaagcccctgtccaaccagccaatcgtcactatttcagcggacgataaggatgataccgctaatgggccacggttcattttttcactgcctcctgagatcatccacaatccaaattttaccgtacgggacaacagggataacaccgccggtgtctacgcccgaagaggagggtttagccgccagaaacaggacctctatctgttgcctatcgtcatctccgacggcggaatccctcccatgtcctctaccaacacgctgaccatcaaagtgtgtggatgcgatgtcaacggagcactgctatcttgcaatgctgaggcatacatcctgaatgccggactgtccactggagcactgattgctatcctagcttgcattgtgatcctgctcgtgattgtcgtcttattcgttacactgagaaggcagaagaaagagcctctcatagtctttgaagaggaggatgtgcgggaaaacataattacctacgatgatgagggaggcggagaagaggatactgaggctttcgacattgctacactgcaaaatccagacggtattaatggcttcataccccgaaaagacatcaagccggagtaccagtacatgcctcgcccaggcctgagacccgcacctaattccgttgatgtggatgactttatcaatacacggattcaggaggccgacaacgatccaacagcacccccgtacgattccatacagatatacggttacgagggtcgggggtccgttgcggggtccctttcctctctggagtccgccacaacagactcagacctggactacgattacttacagaactggggccctcggttcaagaagctggccgatctttacggtagcaaagacacattcgacgacgactcatag

SEQ ID NO: 14196 - DNA, 2082 bp, Artificial Sequence
  Description of Artificial Sequence: Synthetic coding sequence
atgaaggagaactactgcctccaggccgccctggtctgcctaggcatgttgtgccactcacatgctttcgctccagaacggcgagggcacctgcgcccctccttccatggacaccatgaaaaggggaaggaggggcaagtcctgcaaagatcaaaacggggctgggtgtggaatcagtttttcgtgattgaggagtatacggggcccgaccctgttctggtggggcggctgcactctgatatagacagcggggatgggaacattaaatacattctcagtggcgaaggtgccggcaccatcttcgtgatcgacgataagtccggcaatatacacgccaccaaaacgctggatagagaggagcgtgcccagtacactttaatggcccaggctgttgatcgcgacacgaatcgccctctggagccaccctctgagttcatcgttaaggttcaggatatcaatgacaatccccctgagtttcttcatgaaacataccatgccaacgtccccgagagatctaacgtcggaacttcggtgattcaggtgactgcctctgatgccgacgaccccacatacggcaacagcgccaagcttgtgtatagcattcttgagggtcagccttatttctctgttgaggctcagactggtatcatcaggaccgctttgcccaacatggatcgggaggcgaaggaggaataccatgtggtcatacaggcgaaggatatggggggtcacatgggtggcctctccggcactactaaggtcaccataaccctgactgacgtaaacgataatccgcccaagttcccacagagcgtgtatcagatgagcgtgtctgaggctgccgtgcccggagaagaagtcggaagagtcaaggctaaggaccccgatatcggcgagaatgggcttgtcacctataatattgtggacggcgatggcatggaatcatttgagataacgaccgactatgaaacccaggagggggtaattaaattgaaaaagcctgtcgactttgagaccaagcgtgcctactccttgaaggtggaggccgcaaacgtgcacatagacccaaagtttatttctaacggacctttcaaggatacggtcacagtgaaaattagtgtggaggatgcagatgagccacctatgttcctcgccccctcctatatacatgaggtccaagaaaatgctgcagcaggcaccgtggttgggcgggtgcatgctaaggaccccgatgccgcgaactcacccatccgttactccattgaccgccataccgatctcgaccggtttttcacaatcaatcccgaggacggattcatcaaaacaacaaagcctctcgaccgggaggaaactgcttggctgaatataactgtgttcgccgctgagatacacaatcgccaccaggaggctaaagtgccagttgccattagagtgcttgatgtgaatgacaatgctcccaaatttgccgccccgtacgaaggcttcatttgtgagtctgatcagacaaagccattgtctaaccagccgatcgtcactatctctgcggatgataaagatgacactgcaaatggaccgcggttcattttctctttgccacctgaaattattcacaaccctaacttcaccgtcagggacaaccgggacaacacagcaggcgtgtatgcgaggaggggtggctttagccgacagaagcaagacttatacctgctgcctattgtcattagcgacggggggatacctcctatgtcttccactaacacactcaccattaaggtctgcggatgtgatgtaaacggagcccttttgtcatgtaacgccgaggcttatattctgaatgctgggttgtccaccggagcactgatcgctatattagcctgtattgtcattctgcttggatgcccaagcctgatggaaccccctagccccagggaagatatgcggctgctgtaccttgggttccagctcatgctgttctcatatgtgaaagtgaatagacggttttgcctgcttggagtgttcatcaagctacctttcctgtacgtggtggccactgagtccccaaccaccctgacgtcattgtag

SEQ ID NO: 14197 - DNA, 516 bp, Artificial Sequence
  Description of Artificial Sequence: Synthetic coding sequence
atgaaagaaaattactgtctgcaggccgcccttgtttgtctgggcatgctgtgccatagccatgctttcgcgcctgagagaagaggccacttacgcccgtcgttccatggtcatcacgagaaaggaaaagaaggacaggtcctccagcgtagcaaacgggggtgggtctggaatcagttcttcgttattgaggagtatactggcccagatcccgtattagtgggccgtctacatagcgacattgacagcggcgatgggaatatcaaatatatcctgtcaggcgagggcgcagggacgattttcgttatagacgacaagagtggcaatatacacgcaactaagacccttgatcgcgaagagagagcccaatatacgctaatggcacaggcagtagaccgggacacaaaccggaatagtctgtcacggtcgcgcactctgatgacaacgctgcgtagcagttgcacccggcccatcatgcccacttgtctccgcgggcccatgtgggtccggacttag

SEQ ID NO: 14198 - DNA, 2340 bp, Artificial Sequence
  Description of Artificial Sequence: Synthetic coding sequence
atgggacccggtctggcagccagacgacttagacccccaagtagggcgcccgagattaccgtgttctcagctcagcgcccgtgcgatatcccctcttgttgtcacctcctatcagaccaaagcgatgggtggagcgttctgcaaaagcttgctgcaagcatccagtgggttaagaagctccactctgacatcgacagtggagacggaaatattaagtacatcctgtccggagaaggagccgggactattttcgtgatcgatgacaaatccggtaacatacacgcaacaaagacactagatagagaggaaagggctcagtatactctgatggcccaagctgtcgaccgtgacaccaataggccacttgagccacccagtgagttcattgttaaagtgcaggatatcaacgacaaccccccagagtttctccacgagacgtatcatgctaatgtgccggagagatctaatgtggggactagcgttatccaagtgactgccagtgatgccgacgaccccacatacgggaactctgccaagttggtgtactccatcttggagggccagccctacttctctgttgaggctcagacaggcataattcggactgccttacccaacatggatcgggaagccaaggaagagtaccacgtggtgatacaagccaaagacatggggggacacatgggggggctcagtggaaccacgaaggttactatcacattgaccgacgtcaatgataaccctcccaagttcccacaaagcgtttatcagatgtctgtgtcggaagccgcggttccaggcgaagaagtgggacgtgtgaaagccaaagatcccgatataggggaaaacgggctggttacttacaatatcgtggatggagatggcatggagagttttgaaatcactactgattatgaaactcaggagggcgtcattaagctgaaaaagcctgtggatttcgaaactaagagggcctacagcctgaaagtggaggccgctaacgtgcatatcgaccccaaatttatttctaatgggccattcaaggatacagtgacagtgaagatctcagtagaagacgccgatgaaccgcccatgtttctggccccctcctatatccacgaggttcaagagaacgctgctgctggaaccgttgtcgggcgtgtgcacgccaaggatcctgatgccgccaatagtccaattcgatactcgatagaccgccacaccgatcttgaccgcttctttactataaacccagaagatggattcatcaaaacgactaagcctcttgacagggaggaaacagcctggttaaacataactgttttcgcagccgaaatccataatagacatcaagaagcaaaggtgcccgtggccataagggtactggatgtgaatgataacgcgcccaaattcgctgcaccttacgaagggtttatctgcgagagtgaccagacgaagccactaagtaaccagccaatcgtgactatatccgccgatgacaaagacgatacagcgaacggacctcgatttatattttctttgccccctgagattatacacaaccctaatttcaccgtccgggacaatcgcgataataccgcaggcgtgtatgccagacgcggagggttcagccgacaaaaacaggatctgtatctactgccaatcgtcattagtgatggggggattccacccatgtcgtcaaccaatactctgacgatcaaggtgtgcggctgcgacgtgaacggggcccttcttagctgtaacgcagaggcctacatcttgaatgccggactgtctactggggccctgattgccattcttgcatgcatcgtaattctcctcgtcattgtggttctcttcgtgaccctcagacgacagaagaaggagcccctgatcgtattcgaggaagaagacgtcagagaaaatatcatcacatacgacgacgaaggaggaggcgaggaagacaccgaagccttcgacatcgccacactgcagaacccagacggcattaatggattcattcccaggaaagatatcaaaccagagtaccagtacatgccacgtccaggcttgcggcccgcccccaattctgtcgatgttgatgactttattaatactagaatacaagaggcggataatgatcctaccgctccgccatacgattcgatccagatctacggctacgaaggcagaggatcggtcgctggatcactgagctccctggagtccgccacaacagacagcgacctagactatgattaccttcaaaactggggacctcgctttaaaaaactcgctgatctgtatgggagcaaagataccttcgatgacgactcctag

SEQ ID NO: 14199 - DNA, 528 bp, Artificial Sequence
  Description of Artificial Sequence: Synthetic coding sequence
atgcagccccgcacacctcttgtgctgtgtgttctgctcagtcaagttttactgctgacttcggcagaagacctggactgcacccctggcttccaacaaaaggtgttccacataaaccaaccagctgaatttatagaggaccagtctattctcaacctgacgtttagtgactgtaaaggtaacgataaactgaggtatgaggtttcttcaccctatttcaaagtaaacagtgatggaggcctggtggcgttaagaaacatcacagctgttggcaagacactgttcgttcacgcacgcacacctcacgcagaagatatggcggaactggttattgtcggcgggaaggacatacagggaagcttacaagacatcttcaagttcgcccgcacaagtcccgttcctcggcagaaaaggtcaatcgtcgtgtctcccattctgatccctgagaaccaacgccagccttttccgagggacgtaggcaagatgaaaatttggcaggtcctttgtctcgccaggtggcttacgtag

SEQ ID NO: 14200 - DNA, 2142 bp, Artificial Sequence
  Description of Artificial Sequence: Synthetic coding sequence
atgcaaccccggaccccgcttgtcctgtgcgtcctactcagccaggtcctgctactgaccagtgctgaggacctcgactgcaccccaggcttccaacagaaggtgttccatatcaatcagcccgccgagttcatcgaggatcagtctatactcaacctcacctttagtgactgtaagggcaatgataagctgcgatacgaggtgagcagcccttattttaaggtcaactccgatggcggccttgtggccctcaggaatatcacagccgtggggaagaccctttttgtgcacgccagaactcctcacgcggaagacatggctgaactagtaattgtaggcggcaaggacatccaggggtctctgcaggacatctttaagtttgctagaaccagtccggtcccaagacaaaaaaggtctatcgtagtgagccccatcttgattcctgagaatcagaggcagccttttccaagagacgttgggaaggtagtggactctgataggcctgagcgcagtaaattccgtctgacaggcaaaggtgttgaccaagagcccaagggaatctttcgaatcaacgagaataccggttcggtttcagttacccggactctggacagagaagtaatcgccgtttaccagctcttcgtcgaaacaaccgatgtgaatggaaagaccctagaaggtcccgtgccattggaagtaatagttatcgaccagaatgacaaccgaccaatcttccgcgaaggaccctatattggacatgtaatggaggggagtcctacaggaaccaccgtcatgcgcatgacagcttttgatgcggacgatccggccactgataatgcattactgcggtataacattaggcagcagacaccagacaaacctagccccaatatgttctacatagatcccgaaaagggtgacatcgtcacggtagtgagtcccgcccttctggaccgcgaaaccctcgaaaacccgaaatatgagctaatcattgaagcccaagatatggccggattggacgtcggcctgaccggcaccgcgacggccaccataatgattgatgacaaaaatgaccattctcctaaatttaccaagaaggagtttcaggcaacagttgaagagggggcggtgggcgttattgtgaatctgaccgtggaggacaaggacgaccctactaccggagcctggcgcgctgcatacaccatcattaacggcaacccaggccagtcctttgagatacacacaaacccacagacaaatgagggcatgcttagcgtggtcaagcctctggactatgagatcagcgcattccacacactgcttatcaaggtcgagaacgaggatcccttggtgcctgacgtgtcatatgggccgtcctctacagcaaccgtgcacatcactgttctggatgtcaacgaggggcccgtgttctacccagaccctatgatggtaacacgacaggaagacctctctgtgggaagcgtgctcctgacagtgaatgctacagatccggactcgctgcagcaccaaacaattcgttactcggtgtataaggatcccgctggatggctgaacatcaacccaatcaacggcaccgtcgacactaccgctgttctggatcgggaatctccctttgtggataattcagtctacacagcgctgttcttggcgatcgattctggcaacccaccagccacgggcaccggaaccttgctgataaccctcgaggacgtgaacgacaacgcccccttcatctacccaactgtggctgaagtttgcgacgacgcaaaaaatctgtctgttgtaattctcggagcttctgacaaggacttgcatccaaacacggatccattcaagtttgaaatacataaacaggccgtgcctgataaggtgtggaaaataagcaagattaataatactcatgcactcgtgagcctgctgcaaaatctgaacaaggccaattataacttgccgatcatggtgacagattctggtaagccacccatgactaacattaccgacttgcgagtacaggtgtgtagttgccgcaattccaaggtggactgcaacgctgccggcgcactgcggttctcccttcccagcgtcctgcttctttccctcttcagtttggcctgtctgtag

SEQ ID NO: 14201 - DNA, 2283 bp, Artificial Sequence
  Description of Artificial Sequence: Synthetic coding sequence
atgaaaacccctcccggggcaagcagcaggactaaatgttctcgcgagctaagatccttttgtgcattttcctgtcccagagcgaaacaacccacatgcacggcgtggtttcctcagcaggagcatccctccgagaacggtccgcagatgcctggtcgagacccccccgctgccagcaccatgcaggtgctgctcctcacatctgctgaggacctggactgcacacctgggtttcagcagaaggtgttccatattaatcagccagctgagttcattgaggaccagtcaattcttaatctcaccttctccgactgcaagggtaatgataaattgaggtacgaagtcagcagcccctacttcaaagttaacagtgatggcggcttggtagccctccgcaacatcactgctgtcggaaagactttgtttgtgcatgcacgaactcctcacgcggaggacatggcagagctagtcatcgtcggaggtaaagatattcagggttcactacaggatatatttaaatttgcccgaacttccccagtgccccgacagaaaaggagcattgtggtatctccaattctgattcctgaaaaccagcgtcagcccttcccaagagatgtgggcaaggtcgtcgatagcgacaggccggaacgcagtaaatttaggctgactgggaaaggcgtggatcaagaacccaagggaatatttcgcataaatgagaacaccggttctgttagtgtcacacgcactttagatagggaggtcatagccgtttaccagttatttgtcgaaacaaccgacgtgaacgggaaaaccctggaaggtccagttcctttggaagtgatcgtgatcgatcagaacgacaaccggccgatattccgtgaaggaccgtatatcggacatgttatggagggttccccaacaggcaccactgtgatgcggatgacagcatttgatgccgatgaccccgccacagataacgcacttctcagatacaatatcagacaacagacacctgacaaacctagtcctaatatgttttatatagacccggagaaaggcgatatagtgaccgtcgtcagtccggctttgcttgacagagaaactttagagaaccccaagtacgaactcatcatagaggctcaagacatggccggactagacgtgggccttacagggactgctactgcaacaattatgatcgatgataagaacgatcattcgccgaaattcaccaagaaagaattccaggcgaccgtggaggagggcgctgttggggtcatcgttaacctgaccgtggaggataaggacgatccgaccacgggcgcatggcgcgcagcctacaccatcataaacggtaacccaggccagtcgtttgagattcacaccaacccccagacaaacgaggggatgttaagtgtggtcaagcccctcgattacgagatcagtgcatttcacacacttctgattaaggtggaaaatgaggatcctttggtgcctgatgtgtcatatggtccctcctctacggctacagtccatatcacagtcctcgacgtgaatgagggaccggtgttctacccagaccccatgatggtgaccagacaagaagacctgtcggtgggttctgtgttgttgactgtaaatgcgacagatccagactccttacagcaccagaccatcagatattctgtgtacaaggaccctgccgggtggctgaatatcaatccaattaatggtacagtggatacaacagcagtgctggatagagagtcgccgttcgtggacaactcggtctacaccgccctgttcctcgcaatcgactctggcaatcctccggctactggtactggtactctgctcattaccctcgaagatgtgaacgacaatgcccctttcatttatcccactgtcgccgaggtttgtgacgatgccaagaacctaagtgtggtgatcctgggggcctctgacaaagaccttcaccctaataccgatccgttcaagttcgaaatccataagcaggctgtacctgataaggtgtggaagatatctaaaatcaacaatacacatgccctcgtgtctcttcttcagaacctcaataaggcgaattataacctacctatcatggtgactgactctgggaaacctccgatgaccaatattactgatctccgcgtgcaagtgtgctcctgccgcaacagcaaagtcgattgtaacgctgccggggctcttaggttcagcctacccagtgtcctgctgctgtctctcttttccctagcatgcaagtag

SEQ ID NO: 14202 - DNA, 2142 bp, Artificial Sequence
  Description of Artificial Sequence: Synthetic coding sequence
atgcagccgagaacacctcttgtgctatgcgttctgctgagtcaagtgctactgctcactagtgccgaggatctggactgcacaccagggttccagcagaaggtgttccacattaatcaacctgccgaattcattgaggatcagtccattcttaatctgactttttccgactgcaaaggaaatgataagctgcgctatgaagtgagtagcccctatttcaaagtgaacagtgacggggggttggtggcgcttaggaacattaccgccgttgggaagaccctctttgtacacgccaggacgccccacgccgaggacatggcagagctggtaatcgttggggggaaggatattcagggaagtcttcaggatatctttaaattcgctaggacttctccagtgccccggcaaaagcgttcaatcgtagtgagccctatcctgatacccgaaaaccagagacagccattccctcgcgacgtgggcaaagtggttgactcagataggcctgagcgaagtaaattcaggttaaccggcaagggcgtcgatcaggaacccaagggcatcttcagaattaatgaaaacaccggctccgtctccgtgactcggacattggatcgcgaggtcattgcggtataccagttgtttgtggagaccactgatgtgaacgggaagaccctggaaggaccagtcccactggaggtaattgtgatagatcagaacgacaaccgcccaatcttcagggaggggccatacataggacatgtgatggaggggtcccccaccggaactacagtgatgcgaatgaccgcctttgatgcagatgaccctgcaaccgacaacgccctcctcagatataacatacgccagcagactcccgataagccaagtccaaacatgttctatatcgaccccgagaaaggtgatatcgtgactgtggtctcccccgcactcctcgatcgagagactttggagaatccaaagtacgagttgattatagaggctcaggacatggccggcctggacgtgggcctcactggcacggccaccgccacaatcatgattgatgacaaaaacgaccattctcctaaattcaccaagaaggagtttcaggccaccgtcgaagagggggctgtaggggtgattgttaacctaaccgttgaagacaaagacgaccctaccacaggggcctggcgggctgcctataccataatcaacggcaaccccggccagagcttcgagattcacacaaatccacaaacgaacgagggcatgctttcagttgtgaaacccttagactacgaaatttccgcctttcacaccttattgattaaggtggaaaatgaagatccgctcgtaccagacgtatcctacggcccctccagcaccgccacggtgcatataaccgttttagacgttaatgagggccccgtattttatccagacccgatgatggtgacacggcaagaagatctctcggtcggctctgtgctcctcactgtcaacgcaacggatcctgacagtttgcagcatcagactatcaggtacagcgtgtataaagaccccgccggatggctaaatatcaatcctataaatggaaccgtcgacaccactgcagtgcttgatagagagagtccttttgtggacaattccgtctacactgctttgtttcttgctatcgattcaggcaatccgccagcgaccgggacgggtacgttgctgattaccctagaagacgtgaatgataacgccccctttatttatcccacagtggctgaggtctgcgatgatgcaaaaaatttgagtgtggttatacttggggccagcgataaggacctccatcccaacactgatccctttaagtttgaaattcataagcaggccgtgccggacaaggtttggaagatatctaagatcaataatacccacgccctcgtgagtcttctgcagaatctgaacaaggccaactataatctgccaattatggtaacagattctggaaaaccgccaatgactaacattacggacctgagggtgcaggtctgttcctgcagaaacagtaaggttgattgtaatgctgctggcgctttgaggttttcactgccgtctgtcctccttctgagcctcttttcactcgcatgtaagtag

SEQ ID NO: 14203 - DNA, 573 bp, Artificial Sequence
  Description of Artificial Sequence: Synthetic coding sequence
atgcaaccccgcacaccactggttttgtgtgtgcttctctcccaggtgttattactcacctcggcggaagatttagactgtactccggggttccaacaaaaggtgtttcatataaatcagcctgctgaatttatcgaggaccagtccattttgaacctgacatttagtgactgtaaggggaacgataagctaagatatgaagtctcgtccccttatttcaaggtgaatagtgatgggggccttgtggcactgaggaatattacggcagttgggaaaacattgtttgtgcatgctcggactccccacgccgaagacatggccgagctcgtaattgtaggaggtaaggacattcagggaagtctgcaggacatatttaagtttgccaggacctcccctgttcctcgccagaaacgttctattgtcgtgtcacccatcctcatcccagagaatcaacggcaacctttccctcgggacgtaggtaaacgcactcataacccaattaactcagagcttctgttaaatgaaggcatcacagccgacctaaatccttgtataactatactcgcaatttag

SEQ ID NO: 14204 - DNA, 528 bp, Artificial Sequence
  Description of Artificial Sequence: Synthetic coding sequence
atgcaacccagaaccccactggtgttgtgtgtcttattgtcgcaagtgctgttactgacctctgcagaggatctggattgcacccctggatttcagcagaaagtgtttcatatcaatcaaccagctgaatttattgaggaccagagtatcctgaaccttacattttccgactgcaaaggcaacgacaaacttcggtatgaggttagctctccttacttcaaggtgaattcagacgggggcctcgtcgccctgcgcaatataactgccgtaggcaagactctgttcgtgcacgcgaggacaccgcacgctgaagacatggccgaactggtaattgtaggagggaaggatattcagggttcgctccaggatattttcaagttcgcccgcaccagccctgtgcctaggcagaagcgttctatcgtcgtctcccctatactgattcccgagaaccagaggcaaccctttcccagggacgtgggcaagatgaagatctggcaggtgctttgcctggcccggtggttgacatag

SEQ ID NO: 14205 - DNA, 2025 bp, Artificial Sequence
  Description of Artificial Sequence: Synthetic coding sequence
atgcagcccaggacccctctcgtcctgtgtgtgctcctgtcccaggtcttgctgcttacatcagctgaagacctggattgcaccccaggcttccagcagaaggtgttccacattaaccaaccagccgagtttatcgaagaccaaagtatcctgaacctgaccttcagtgattgtaaggggaatgacaagctgcgctacgaagtctcaagcccctattttaaggttaactctgatggagggctggttgcactgagaaatataacagccgtcggcaaaaccctgttcgtccacgcgagaactccgcatgctgaggacatggcagagctggtcattgtcggggggaaagacatccagggttctctgcaggtcgtagattctgatagaccagagcgtagcaagtttaggctgaccgggaaaggagtggatcaggagcctaagggcattttccgaatcaatgaaaataccgggagcgtctcagttacgaggacactggatagggaggtgatcgccgtgtatcagctgtttgtcgaaacaaccgatgtcaacggtaaaacgctggaaggtccagtgccactcgaggtgatagtcatcgatcagaacgacaatcggcctatttttagggaaggcccttacatagggcacgttatggaaggttctcccaccggcactacagtgatgcgcatgacagcattcgacgcagatgacccggccacagataatgccctgctgagatataatattcgacagcagactccagacaagccgagtcccaacatgttctacatcgatccagagaagggcgacattgtgaccgtcgtctcccccgcacttctggatcgggaaactttggagaacccaaaatacgaactgataattgaagcacaggacatggccggacttgacgtaggcttgactggaacagcaacagccactattatgatcgatgacaaaaacgatcacagtcccaaattcacaaagaaagagtttcaggctacggtggaggagggcgctgtgggtgtcatcgtcaatctgaccgtggaagataaagacgaccctaccacaggtgcctggagagccgcctacacaatcatcaatggaaatcctggccagagcttcgaaatccacacgaacccacagactaacgaaggaatgttatcagtagtcaaacccctggactatgagatcagtgcgtttcacacactgctcattaaggtggaaaacgaggatcctttggttcccgacgtttcatacggcccttccagtactgctactgtgcatatcactgtccttgatgttaacgaaggaccagttttctacccagaccctatgatggtgactcgtcaagaggatctttccgtgggctcggtcctgctgacggtaaatgcaacagatcccgactcattgcagcatcagacgatccgttactccgtgtacaaagacccagcaggctggctaaacattaacccaattaacggaactgtcgataccacggcagtccttgatcgagaatctcccttcgtggacaattccgtttacacagcactgttcctggcaatcgactcaggaaacccgcctgccaccgggaccggcacgttgctgattaccctggaagatgtgaatgacaacgcgccgtttatatacccaaccgtggctgaggtctgcgacgatgccaaaaacttgtccgtggtgatccttggcgcgtccgataaagacttgcatccaaacacagaccctttcaaattcgaaatacacaagcaggcagtgcctgacaaggtctggaaaatcagcaagattaataatacgcatgccctggtgtccctcctgcaaaacctcaataaggcgaattataacctgcctattatggtcaccgactccggcaagcctcctatgaccaacatcaccgatcttcgcgttcaggtatgcagctgcagaaatagcaaggtcgactgcaacgccgccggagcacttcgcttctccttaccctctgtgctcttgctgagcttattcagtttggcctgtaagtag

SEQ ID NO: 14206 - DNA, 1248 bp, Artificial Sequence
  Description of Artificial Sequence: Synthetic coding sequence
atgcagcctcgaactccattggtgctttgcgtgctcctctctcaggtcgccctgcttgatcgggaaactctggaaaatcctaagtatgagctgatcatcgaagctcaggacatggctgggctggatgtgggactcactggcactgcaactgccacgatcatgatcgacgataagaatgaccatagccctaaatttacaaaaaaggaattccaagcgacagttgaggaaggtgccgtgggtgtgattgtgaatttgacagttgaagataaggatgaccctaccactggagcctggcgagcagcgtatacaattatcaacggaaatcccgggcagtcattcgaaattcacaccaaccctcaaacaaacgagggcatgttatccgtggttaagcccctggactatgagatctctgcctttcacacactattgattaaagtggagaatgaagatccattagtccctgacgttagctatggtccttcatccactgccactgtccacatcacagtgcttgacgtaaatgaggggcccgttttctaccctgacccgatgatggtcactcgccaggaagacctgagcgtgggctccgtgctgctgacagtaaacgcgactgatccggacagtctgcagcaccaaacaattcgatattccgtgtacaaagatcctgcagggtggttgaacattaacccaattaacggaaccgtggatacgacagccgtcctggatagggagtccccttttgtcgataactccgtgtataccgcccttttcttggccatcgactccggcaatcccccggccactggtactggcaccctgctcattactctggaggacgtaaatgacaacgcgcccttcatctaccctacggtcgccgaagtgtgcgatgacgccaagaatctctcagtagttatcctcggggcaagtgataaggatcttcatcctaacacagacccctttaaatttgaaatccacaagcaggccgttcctgacaaggtctggaagattagtaagatcaataatacacacgccctggtgtcgctgctccagaatctgaacaaagcaaactacaacctaccaatcatggtgactgattcagggaaaccacccatgaccaacatcacggacctccgggtccaggtttgttcctgcaggaacagtaaagtagattgtaatgctgctggagctctcagattctctctgccgtctgtgctgttgttgtccttgttttccttagcgtgcaaatag

SEQ ID NO: 14207 - DNA, 819 bp, Artificial Sequence
  Description of Artificial Sequence: Synthetic coding sequence
atgcaaccccgtacacccctagtgctgtgcgtcttgctatcccaggtactcctcctcacatctgctgaggacctagactgtactcccggttttcagcaaaaagtgtttcacattaaccaaccagccgagttcatcgaagaggatctgtcagtagggtccgtcttgctgaccgtgaatgccaccgatccggatagcctgcagcaccagaccatacgatattccgtttacaaggaccccgccggctggttgaatatcaaccctatcaatggtacggttgacactacagctgtgctggatagggagagcccctttgtggataacagtgtttatactgccctctttctggccattgatagtgggaacccacctgccacaggaacaggcacccttctaattacattagaggatgtaaatgataacgccccctttatctatcctacggtggccgaggtgtgcgacgacgcaaaaaatttgtcagttgtgattttgggtgcgtctgataaagacctccatcccaatacagatccattcaagttcgagattcataaacaggccgtgccggataaggtttggaaaatctctaaaatcaacaacacccacgcgctggtgagtctgctgcaaaatctgaacaaggctaattacaatcttccgatcatggttactgactccggtaagccacccatgaccaacattaccgaccttagagttcaggtatgcagttgccggaactctaaagtcgattgtaacgcggctggggcactgagattctcactgcccagtgtgttactgctgagcttgttcagcttggcttgcaagtag

SEQ ID NO: 14208 - DNA, 1212 bp, Artificial Sequence
  Description of Artificial Sequence: Synthetic coding sequence
gtagtgagtcctgctttgttggatcgggagacactcgagaatcccaagtatgaactgattatagaagcacaagacatggccgggctggacgtgggtctgacaggcacggccacagccaccattatgatcgatgataagaacgaccacagccctaagtttacaaagaaggagtttcaagcaactgtggaggagggggccgtaggcgtgatagtcaacctgacagtcgaagacaaagatgaccccactaccggggcctggagagccgcctacacaatcattaacggcaaccccggccagtcgtttgagattcatacgaatcctcagacgaacgaaggtatgctctctgtagttaagcccttagattacgaaatcagcgcgttccacacattgctgataaaggtcgaaaatgaggaccctttggtgccggatgtttcgtatggccctagcagtaccgccaccgtgcatatcaccgttcttgacgttaacgagggtcccgtattttatcccgaccctatgatggtgacaaggcaggaggatctgtctgtgggctccgtgctccttactgtcaatgccaccgatcctgactccttacaacaccaaacaattcgctattccgtgtacaaggacccggccggatggctcaatataaacccaatcaatgggacagttgatacaactgccgtgctcgatagggagagcccttttgtggataactccgtgtataccgcgcttttcctggccatcgactctggaaacccacccgccactggaaccggaactctcctcatcaccctggaagacgtaaatgataatgcacccttcatctaccccactgtcgcagaggtttgcgacgatgccaaaaacctgagcgtagtcattttgggggctagtgacaaggacctacaccctaatacagaccctttcaagttcgagatacataagcaggcagttccagacaaggtctggaaaataagtaaaatcaacaacactcacgccctggtttccctgcttcagaacctcaataaagcgaactataatcttcctattatggtgacagatagcggtaaacctcccatgacgaatatcactgacctccgcgtccaggtgtgttcatgccggaattctaaggtggactgtaacgccgccggagcgctcagattctcgctgcccagcgtgctgttactatccctgtttagcttagcatgtctgtag

SEQ ID NO: 14209 - DNA, 2721 bp, Artificial Sequence
  Description of Artificial Sequence: Synthetic coding sequence
atgtgtagaatcgctggggccttgcgaactctcttacctctcttggctgccctgctccaggcgtccgtggaagcaagcggggagattgccctgtgtaagaccggattcccggaggacgtatactccgctgtgctcagcaaggatgtgcatgagggccaaccactgttgaacgtgaagttcagcaattgtaacggcaagagaaaagttcaatatgaatcttccgagccagccgattttaaagtggacgaagacggtatggtctacgccgtacgctctttccctctttcctcggaacacgcgaaattccttatctatgcacaagataaggagacccaggagaaatggcaggtggccgttaaactgtccttaaagcctaccctgacggaagagagtgttaaagagtcagccgaggtagaggagattgtgttcccacggcagttttctaagcacagcggccatctgcagaggcagaagagagactgggtcatccccccaattaacttaccggaaaattctcgcggtccatttcctcaggagctcgttcgcatcagaagcgatagagacaagaatctgagtctaaggtactctgtgaccggacctggggccgaccagccccccactggcatttttatcattaatccgataagcggccagctgtctgttactaaacctctggatagagaacagatcgcccgatttcatctgcgagctcacgcggtggatattaacggcaaccaggtggagaaccctattgacattgtgatcaacgtgattgatatgaatgacaaccggcccgaattcctgcatcaggtctggaatgggaccgtgcccgagggctccaagcccggaacctacgtgatgactgtaacggctatcgacgccgacgatcccaatgcattgaacgggatgctgcggtatagaatcgtctctcaagcccccagcaccccctcccctaatatgttcaccatcaacaatgagacgggagacataattacagtcgcggcaggccttgaccgggaaaaggttcagcaatacactctaatcatccaggcgacagatatggaaggcaaccccacgtacgggctatctaataccgcaacagcggttatcaccgttaccgacgtaaacgacaatccgccagaattcactgcaatgaccttctacggggaagtcccagaaaacagagtggatatcatcgtcgcaaatctcaccgtgaccgataaggatcaaccccatacccctgcctggaatgcggtgtacagaatatccggcggagacccaacgggaagattcgcaattcaaactgatcctaacagcaatgatggtttagttacggtggttaaaccaattgacttcgaaacaaatcgaatgtttgtcctgactgtcgctgctgagaaccaggtacctctcgctaaggggatacagcacccccctcagagcaccgctaccgtttcggtcacagttattgatgtgaatgaaaatccatatttcgccccaaaccctaagatcattagacaggaagaaggcctgcatgcaggaactatgctcactacattcactgcgcaagaccctgaccgctatatgcagcagaacatccgctacaccaaacttagcgaccccgctaactggttgaagatcgatccagttaacggccagattacgaccattgcggtgctggatcgggaaagtccgaacgtgaagaacaatatttataacgccactttcctcgcatccgataacggaatccctcccatgtctgggaccggcacgctgcagatttatctgttggacattaacgataacgctccccaggtgctgcctcaggaggccgaaacctgcgaaactccagacccgaactctattaatataacagcattggactatgacatcgatcccaatgctggcccctttgcctttgatctgcctctcagccccgtaactatcaaacgtaactggaccatcacccggcttaatggcgattttgctcagctaaacctgaaaataaagtttctggaggcaggcatttacgaggtgcctattatcatcaccgactctggtaatccacccaagtctaatatatccatcctcagggtgaaagtgtgtcaatgcgatagcaatggcgattgtacagacgtggatcggatagttggcgccggcctcggaaccggcgccattatcgcaattctgctgtgcatcattattctgttaattttggtgctcatgtttgttgtttggatgaagagacgcgataaggaaagacaggccaaacagctgctcatagaccccgaggatgatgtgagggataacattctaaaatacgatgaggagggggggggagaggaagaccaggactacgatctaagtcagctccaacagccagacacagtggagccggacgctattaaacccgtcggcattagacgcatggacgaacgacctattcacgctgagccccagtaccccgtgagatcggccgctccccacccaggagatatcggcgacttcattaatgaaggcctgaaagccgccgataatgacccaaccgccccaccttacgacagcttgcttgtattcgattatgaaggctctggctcaaccgccggcagcctttcgtcactgaattcctcgagttccggcggggagcaagattatgactatcttaatgactggggtccacgtttcaaaaaattggctgatatgtacggaggcggggacgactag

SEQ ID NO: 14210 - DNA, 2628 bp, Artificial Sequence
  Description of Artificial Sequence: Synthetic coding sequence
atgtttttgctccgaagatacgtttgcatttttaccgagaagttaaagaaccaggcggagctttatgtgttcttatcagtgaagtttagtaactgcaacggcaaaaggaaagtccagtatgagtcctctgagcccgcggatttcaaagtggacgaagacggcatggtttacgctgtgcgaagctttcccttatctagcgagcatgccaagtttctcatttatgcccaagataaagaaacccaggaaaagtggcaggtggccgttaagctgtcgcttaagccaaccctcacagaggagagcgtcaaggagtccgcagaagtcgaggagattgtgttccctcgccaatttagtaagcactccggccacctgcagagacagaagcgagattgggtcatcccccccatcaacctgcccgaaaatagccggggaccttttccccaagagctcgtgaggattagatctgacagagataagaatctcagtctgcgctatagcgtcaccggaccgggggccgatcagcctcccactgggatcttcattataaatcctatatccggacagctttccgtgacaaagcccctagatcgggagcaaatagccagattccacctgagggcccatgcagtcgatataaatggcaaccaggttgagaacccaatcgatattgtgatcaatgtaatcgatatgaatgacaatcgacccgagtttcttcatcaagtgtggaatggcaccgtgcctgaaggctctaagcccgggacctacgtgatgactgttaccgctatcgatgctgatgatcccaatgcactcaatggcatgctgcgctatagaattgtctcgcaggcaccctcgactccatcccctaatatgttcaccattaacaacgagactggcgacataataacagtggccgccggacttgaccgggagaaagtccagcaatacacactcataatccaagctaccgatatggagggtaaccctacatacggtcttagcaacaccgccacggccgttatcactgtcactgacgtcaatgacaatcctcccgaattcacagcaatgaccttctatggtgaagtgccagagaatcgcgtggacattatcgtcgccaaccttactgtcacagacaaggaccagccgcatactccagcctggaacgccgtgtacagaataagcggcggtgaccctaccggacggttcgcgattcagactgaccccaacagcaacgacggattggtgacggtggttaagccaatcgactttgaaacaaatagaatgtttgtgcttacggtggctgcagaaaaccaggtgcctctcgccaagggaatacagcatccaccccaatctacggctaccgtgtctgtcacggtcattgatgtaaacgaaaatccctacttcgcgcccaaccccaaaatcataaggcaggaagagggtttacacgccggcacaatgcttacgaccttcacagcacaagatcccgataggtacatgcagcaaaacataagatacactaagctgtccgaccctgcaaactggctgaagatcgatccagtgaatggccaaatcacaacaatcgcggtcttagacagggaatctcccaacgtcaaaaacaatatttacaacgctacctttctggcttctgacaatggtattccccctatgtcaggaaccgggaccctgcaaatatatctcctagacatcaacgacaacgccccgcaggtcttgccccaagaggcagagacttgcgaaacccccgatcccaacagtattaacattaccgcacttgactatgatatagacccgaatgctggaccatttgcattcgaccttccactctctccagtcacgattaaacgaaactggaccatcaccaggttgaatggcgactttgcccagctgaacctcaagataaaattcctcgaagctggcatatatgaggtccccataatcattaccgactccggtaatccacccaagagcaatatctctatactccgtgtcaaggtatgtcagtgtgactctaacggtgactgtaccgacgtcgataggattgtgggggctggcctgggtactggggccataattgccatactattatgtattataattctattgattttggtacttatgtttgtggtttggatgaaaaggagggataaggaaaggcaagccaagcaattactgatcgaccccgaggatgatgtccgcgacaatatcctgaagtatgacgaggagggcggaggcgaggaggaccaagactatgacctctcacagctgcagcaaccggatactgtagagccggatgctatcaagcccgtagggattcgtcgaatggatgagcgaccgatccatgccgagccccagtaccccgtgcggtctgctgccccccacccaggggatatcggcgattttatcaacgagggcctaaaggcagctgataacgaccctacggctcctccatacgattcattgctggtcttcgattacgaggggtcggggagcactgcaggtagcctcagcagcctgaattccagctccagcggaggagagcaggactacgactacctcaacgattgggggccacgcttcaagaaactcgctgacatgtatgggggaggagatgactag

SEQ ID NO: 14211 - DNA, 2355 bp, Artificial Sequence
  Description of Artificial Sequence: Synthetic coding sequence
atgcagcgtttaatgatgttactggccacttccggagcgtgcctgggtctgctggcggttgctgcggtcgcggcagctggcgctaatccagcccagcgggatacacatagccttcttccaacccaccgtcggcaaaagagagactggatttggaatcagatgcacatcgatgaggaaaaaaacacctccttaccccatcatgttggcaagatcaagtcaagcgtgagccggaaaaatgcaaagtacctgctgaagggtgagtatgtgggcaaagtattccgggtagacgccgagaccggtgacgtcttcgcaattgagaggctggaccgggagaatatttctgaataccacctgacggccgtgatcgtcgacaaggatactggggagaacctggagactcccagttcctttacaatcaaggtacacgatgtgaacgataactggccagtgttcactcatcggctctttaatgctagtgtgccagaatcttccgctgttggtactagcgtgatctcagtgaccgccgtagatgctgacgacccgacagttggcgatcatgcctctgttatgtaccagatcctgaagggcaaggagtactttgcaatagataattcgggccggataattactataacaaaaagccttgacagagagaagcaggcccgctacgagatcgttgttgaggctcgtgacgctcagggtcttcgcggtgactccggaaccgccacagtgctggtaacgttgcaagacatcaacgataattttcccttcttcactcaaactaaatacacctttgttgtgcccgaggatactcgggtagggacatccgtcggtagtctattcgtcgaggaccccgatgagccacagaatcggatgacaaagtacagtattttacggggcgattaccaggacgcgttcactatcgaaacgaaccccgcacataatgaaggcattattaagcccatgaagccactcgattacgagtacattcaacaatattccttcattgtggaggcaaccgaccctaccatagatctgcgatatatgagtccccccgcaggaaaccgtgctcaggtcatcatcaatatcactgacgtagatgaacccccaatttttcagcaacctttttatcatttccaattaaaggaaaatcagaagaaacccctcatagggacagtactggccatggaccccgatgccgcccgacactctatagggtactcaattagacgaacctcggataagggccagttttttcgggtgacaaagaaaggagacatctataatgagaaggagttggatcgtgaagtgtacccctggtataatttgaccgttgaggccaaggaactggatagtacagggacaccaactggtaaagagagcatcgtccaagtccatattgaggttttagatgaaaacgataacgcaccagagtttgcaaaaccctatcagccaaaagtgtgtgagaacgccgtacatggacagctagtgctgcaaatatccgccattgacaaggacatcactccccggaatgtgaagttcaagttcattctgaataccgagaataatttcaccctaactgataatcatgataacactgccaacataacggtaaaatacggccagttcgatagagaacacacaaaggtccacttcctcccggtcgtgatctctgacaatgggatgccatccagaaccggcacgtctactctgacagtggccgtgtgcaaatgcaacgaacagggcgaattcactttttgcgaggacatggcagcccaggtgggcgtaagtattcaggcagtcgtggcaatcctgctgtgtatcctgacgataactgtgattacgctgctgatcttcctcagacggcgccttaggaagcaagcccgtgcccatgggaagagcgtaccagaaatccatgagcagttggtaacatacgacgaggaaggagggggagagatggacaccacctcgtatgatgtctctgtcctgaacagcgtgcggagagggggcgcaaaacctccacggcccgccctagatgcccgtccaagcctttacgctcaggttcaaaagccaccaagacatgcgcccggcgcccacggaggccccggagaaatggcggccatgattgaggtgaaaaaggatgaagcagaccatgatggggatgggcccccctatgacacactacacatctacgggtatgaaggttccgagagcattgccgaaagcctgagtagcttaggcacggattcctctgatagcgatgtcgattatgattttttaaatgattgggggccacgttttaagatgcttgccgagctctacggctccgaccccagggaagagttgctgtattag

SEQ ID NO: 14212 - DNA, 2010 bp, Artificial Sequence
  Description of Artificial Sequence: Synthetic coding sequence
atgcagcgacttatgatgctgctcgctacatccggggcatgtcttggcttactggctgttgccgctgtcgccgcggcgggggctaatcccgcacagagagatacccacagtctccttccaactcacagaaggcagaaacgcgactggatctggaatcagatgcatattgacgaggaaaagaatacaagtctgccacaccatgtgggaaagatcaaaagctctgttagtcgcaaaaatgccaaataccttctcaaaggtgagtacgtagggaaggtttttagggttgatgcagagacaggggacgtctttgcaatcgaaaggctggatagagaaaacatctccgagtaccacctgacagccgtgattgtcgataaggatactggggaaaatttagagaccccaagttctttcactataaaggtgcatgacgttaatgataattggccagtgttcactcaccgtctgttcaacgcatctgtgcccgaatctagtgccgtagggacctcagtaatttcagtgacagccgtggacgctgacgacccaactgtgggcgaccatgccagtgtcatgtatcagatactgaagggaaaggaatactttgccattgacaactctggccggattataacgataactaagagcctggatagggagaagcaggcgagatacgaaatagtcgtggaagctcgcgacgcccaagggttaagaggggactctggaaccgccacggtgctcgtcacactacaggacatcaacgacaatttcccttttttcacccaaaccaaatatactttcgtggtgcccgaagacactcgtgttggcacatctgtcggctctctgttcgtagaagaccctgacgagccgcagaaccgaatgacaaagtactctatcctcagaggcgactatcaggacgcgtttacaatcgagaccaacccagcacacaatgaagggatcataaagcctatgaagcctttggactacgagtatattcaacaatactcctttatcgtggaagctactgacccaaccatagatttaaggtacatgtccccaccagcaggtaatagggcgcaggtgattataaatattacagatgtagacgagcctcctatcttccaacagcctttctatcatttccagctagtgctgcagataagtgctatcgacaaagatataacccctcggaacgtgaagtttaaatttattctcaacactgaaaataattttaccctgactgacaatcacgataataccgccaatattacagttaagtacgggcagttcgaccgggagcacaccaaggtccactttttgcctgtggtaatcagcgacaatggaatgccatcccgcactggcacgtctaccctcacagttgcagtgtgtaaatgcaacgagcaaggtgagtttaccttttgtgaagatatggcagcccaagtaggggtatcaattcaggccgtggtcgccattctcctctgtattctgacaatcactgtcataaccttgctcattttcctcaggagaagactgcgcaagcaggccagggcacatggtaaatcagtgcctgaaatacacgagcagcttgtgacttacgatgaggaaggaggaggcgagatggatactacttcatatgacgtctctgttcttaacagtgtgcggcgcgggggtgccaaaccccctcggccagccctggacgccaggccatctttatatgcacaagtgcaaaaaccacctcggcatgcccccggggcccacgggggacctggagagatggctgcaatgatcgaagtgaagaaagatgaggcggatcatgatggggatggacccccctacgacactctgcacatctatggatacgaaggcagcgaaagcatcgccgagtctctttccagcctaggcaccgatagttccgacagcgacgtggattatgactttctcaatgattggggcccacggtttaagatgttggccgagctttacggttctgatccgagggaagaactgctatattag

SEQ ID NO: 14213 - DNA, 672 bp, Artificial Sequence
  Description of Artificial Sequence: Synthetic coding sequence
atgccttcacgtactgggacctcgacactcacagtcgccgtgtgtaaatgcaatgagcagggggagttcaccttctgcgaagacatggcggcccaggtcggagtgtcaatccaggccgttgtagctatccttctttgcatcctcactatcacagtgatcactctcttgattttcctacggaggaggctgaggaaacaggccagggctcacggcaaaagtgtacctgagattcacgaacagctcgtcacctacgacgaggaggggggtggagaaatggatacaacctcctacgatgtttcagtgctaaattccgtcaggcggggaggagcgaagccacctcgccctgcccttgatgcccggccatcactgtacgcccaggtccagaaacccccccgccatgccccgggagcgcacggaggtccgggagaaatggcagcgatgatcgaggtcaaaaaagacgaagccgaccacgacggagatggcccgccctatgatacgcttcacatctatggttatgagggaagtgaaagcattgcagagagtctatccagtctcggcactgactcatcagacagcgacgttgattacgattttctcaatgactgggggccgaggttcaaaatgcttgccgaactttacggctccgaccccagggaagaacttctgtattag

SEQ ID NO: 14214 - DNA, 1578 bp, Artificial Sequence
  Description of Artificial Sequence: Synthetic coding sequence
atgcccagtacttgctctaaagaaaacatgtgggcccggagttccgggtcaatgcagaggcaagaaacttgctctccactgcgcgcccagaatcggatgactaagtacagcatcctaagaggtgactatcaagatgctttcacaatcgagacaaatccagcgcacaacgaagggatcatcaaaccaatgaaacccttagattatgagtatattcaacagtattccttcattgtagaggctactgacccgaccatcgacctccgttatatgtcccctccggccggaaacagggcacaggtaataataaacattacagacgtcgacgaacctccaatctttcaacagcccttctatcacttccagttgaaggagaatcagaagaagccactgattggcactgtcctcgccatggatcctgatgccgcccgacactccatcgggtattcaattagacgaacttccgacaaggggcaattctttagagtgacaaaaaaaggtgacatatacaatgagaaggagttggatagggaagtgtacccctggtacaacctgaccgtcgaggccaaagagttggacagcacaggtacacccactggcaaagaaagtattgttcaggtgcatatagaggtgctcgacgaaaacgacaatgcccccgagtttgccaagccctaccagcctaaggtgtgtgagaacgctgtgcatgggcagttggtgctgcagatttcagcaatagataaagacataaccccaagaaatgtcaagtttaagtttattctgaacactgagaacaacttcacattgaccgacaaccatgataacacggcaaatatcactgtgaagtacggacaatttgatcgtgagcatacaaaggtacatttcctgcccgttgttattagcgacaacggcatgccctcccggaccggcacaagtacactcacagtagctgtctgcaaatgtaatgagcaaggggagtttacattttgcgaagatatggcggcgcaggtaggagtatctatccaagccgttgtcgccattctgctgtgtatactcaccataacagtgattaccctgctgatttttcttagacgaaggctaaggaagcaggccagagcccatggcaagagcgtaccagagatccatgagcagctggtgacttacgatgaagagggagggggcgagatggatactaccagctatgatgtgtccgtgcttaacagtgttaggaggggaggggccaagccccctcggcccgcgctggatgctcgtccctcattatatgcgcaggtgcagaagccccctcgtcatgctccaggtgctcatggcgggccgggggaaatggcagccatgatagaggtgaagaaagacgaagctgaccatgacggtgacggccctccctatgataccttgcatatctatggttatgaaggaagcgagtccattgccgagtctctcagttctctgggaaccgacagcagcgatagcgatgtggattacgatttccttaacgattggggacccaggttcaagatgctcgctgaactgtacgggtcagatccgcgcgaggagctgctttactag

SEQ ID NO: 14215 - DNA, 2373 bp, Artificial Sequence
  Description of Artificial Sequence: Synthetic coding sequence
atgcgtacttaccgctactttctactgttgttttgggtgggtcagccttacccaaccctcagcaccccattgagcaagagaacaagtgggttccccgccaaaaaacgggctcttgagctgtccggcaactccaaaaatgagctgaaccgctctaagaggagctggatgtggaatcagtttttcctgcttgaggaatacactggtagtgattaccaatacgtgggcaagctgcactctgatcaggatcggggcgatggctccctcaaatatatactgagcggtgacggcgcaggagacctgttcatcatcaacgagaatacaggcgacatccaggcaaccaagaggctggatagagaagagaagcctgtgtatatactgagggcacaggccataaaccgacggacaggacgacctgttgaacccgagagcgaatttataatcaagatacacgacatcaatgataatgaacctatctttactaaagaggtgtacacagcgaccgtacccgagatgtccgatgtggggacctttgtggtccaagtgaccgccacggacgcagacgaccccacctacggaaacagtgcgaaggttgtgtactcgatcctgcagggtcaaccctacttctccgtggaaagcgaaactgggataataaaaaccgctttactgaatatggaccgggagaaccgcgagcagtaccaggtagtgatccaggccaaggatatggggggtcagatgggaggattatctggcacgacaaccgtaaacatcaccctcacagacgtcaatgacaatccgcctcggtttccccagtctacctaccagttcaaaacgccagagtcaagcccacctggaacacctatcggacggattaaagcctctgacgctgatgtgggcgagaacgcagagattgagtattccatcaccgatggcgagggcttagacatgtttgacgttattacagatcaagagactcaggagggcatcattactgtgaagaagttgctggacttcgagaagaaaaaggtctacacgttgaaagtagaagctagcaacccttacgtggagcctcgattcttatatctggggcccttcaaggactccgctacggttcgcattgtggtggaagacgtcgatgaaccgcccgtgttctccaagctggcttacatcctccagattagagaggacgcccagatcaacacaacgatcggttccgtgacagcacaggatcctgatgctgcacgtaacccagtgaagtacagtgtagacaggcataccgacatggaccggattttcaatatcgactccggtaatggtagcatttttacaagcaagcttttggatcgggagaccctgctgtggcacaatatcacagtgatagcgactgagattaacaaccccaaacagtccagccgtgttccattgtatattaaagtgcttgacgtaaatgacaacgccccagaattcgccgaattttacgagacatttgtctgcgaaaaggcaaaggcagaccagctaattcagacactgcacgcagtggataaagacgatccatacagcggtcaccagttctccttttcactcgctcctgaggccgcctccgggagcaatttcactattcaggacaacaaagataacacagccgggattctgacaaggaagaacggctacaatcggcacgagatgagcacatatctgctgccagtggtcattagtgataatgactaccccgttcagtcgtccaccgggactgtgacagtaagagtgtgcgcttgtgaccatcatggcaacatgcagtcatgccacgcagaagctctgatccacccgacgggactgtcaaccggagccttagtcgcgattctgctgtgcatagtgattttacttgtcacagtagttctgtttgcagcactgagacggcaacggaaaaaagagcctctcattataagcaaggaagatataagggataatattgtgtcttacaatgacgagggaggcggggaggaggacacccaggcattcgacataggtactctgagaaacccagaggcgattgaggacaataaactgcggagggatatcgtcccggaggctttgtttctacccagaagaacccctacagcgcgcgataataccgatgtccgggacttcataaaccagcggctgaaggagaacgacacagaccccactgccccgccctacgatagcctcgcaacgtacgcctacgaggggaccgggagcgttgccgactccctctcttcactcgagtctgttaccacagacgcagaccaggactacgattatctcagcgattggggcccgcgtttcaaaaaactcgctgacatgtacggcggggtagactcagataaagacagttag

SEQ ID NO: 14216 - DNA, 576 bp, Artificial Sequence
  Description of Artificial Sequence: Synthetic coding sequence
atgggcggatcagggtctcggctcagtaaagaattgcttgctgaatatcaggatctgacctttctaacaaaacaagaaattctgcttgcacacagacggttctgtgagctgctgccccaagagcagagatcagttgagagctctctgcgcgcccaagttccattcgagcaaattctctcactccctgagctcaaggccaacccattcaaagaacgcatttgccgggtttttagtacttcacccgcgaaggactccctgagtttcgaggactttttggatttgctgtcagtcttctccgatactgctacccccgatataaagtctcactacgcattccgcattttcgactttgatgatgacggaaccctgaacagggaagatcttagtaggttagtgaattgcctgactggcgagggagaggatacacgactgtccgcatctgaaatgaagcaattgattgacaacatcctcgaggagagcgatatcgacagagacgggaccattaatctttcggaatttcagcacgtgattagtagaagcccagactttgcctcatctttcaaaattgtgctgtag

SEQ ID NO: 14217 - DNA, 237 bp, Artificial Sequence
  Description of Artificial Sequence: Synthetic coding sequence
atgtcagaggtgctgccatacggagacgagaagctctcaccttatggcgacgggggcgatgtcggtcaaattttttcatgtagattgcaggacacaaataattttttcggcgccgggcagaataagcggccccccaaactgggccagatcggaagaagtaagcgtgtagtcatagaagacgataggattgacgacgttctaaagaacatgaccgacaaggcacctcctggagtctag

SEQ ID NO: 14218 - DNA, 1563 bp, Artificial Sequence
  Description of Artificial Sequence: Synthetic coding sequence
atggagggtggacccgccgtgtgctgtcaggacccgcgagccgagctagtcgaaagggtggctgcaatcgatgtgacccatttggaagaggctgacggggggcctgaacctaccagaaatggtgtagacccaccaccccgggcccgagctgcatcagtaatccctggctccacttcacggctgttgccagcccgaccgagcctgtccgcacggaaactgtcactccaggagcgacctgccggatcttacctggaggcgcaggctggtccctacgctaccgggcctgcaagtcatatctctccacgcgcatggcggcggcctaccatagagtcccaccacgtggccatctctgatgccgaagattgcgtgcaattgaaccagtataagctgcagagcgaaattggaaaaggagcgtacggcgtagtgcggttggcctataatgaatccgaagaccgccactacgcaatgaaggtgctgtctaaaaagaagctgctaaagcaatatggttttcctaggcggccaccaccgcggggcagccaagccgctcagggcggaccagccaagcaattattgccactggagcgtgtgtaccaagaaatcgccattctgaaaaagctcgaccatgttaacgtcgtcaagctgatcgaagttcttgatgaccctgccgaagataatttgtacctagccttacagaaccaggctcagaacatccagttggacagcactaacatagccaagccccatagcctgcttccctctgaacagcaggattccgggtcaacatgggccgcacgcagtgtcttcgacctgctgcgaaaaggacctgtgatggaggtgccctgtgataaaccttttagcgaagaacaggcccgactgtatcttagggacgtgatccttggcctggagtacctgcattgccagaagatcgtccacagggatattaaacctagcaacctgttactcggcgacgacggccacgttaagatagcagactttggtgtttccaaccaattcgagggaaacgatgctcagttgagctccacagccggcacgcccgctttcatggcacctgaagcaattagcgattctggacagtcattcagtggaaaagccctagatgtgtgggccaccggcgtgacactttattgttttgtgtacgggaaatgcccattcattgacgatttcatacttgcacttcatagaaagatcaagaacgaacccgtggtattccctgaggagcctgagatttctgaggagttgaaggatttaatcctgaaaatgttagataagaatcccgagactcgaattggcgtgcccgatatcaagctacacccctgggttaccaaaaatggagaggaaccactgccaagcgaggaggagcactgctctgtcgtggaagttactgaagaggaggtgaaaaatagcgttaggcttatccccagctggaccactgtcatcctggtcaagtctatgctaagaaaacgctcttttgggaatcctttcgagcctcaggctaggagagaggaacggagcatgtccgccccaggtaacctgttagtgtag

SEQ ID NO: 14219 - DNA, 1518 bp, Artificial Sequence
  Description of Artificial Sequence: Synthetic coding sequence
atggaggggggccctgcggtgtgctgccaggaccctcgggccgagctggtagaaagggttgccgccatcgacgtaacccacctggaggaggcagatggaggtcccgaacccactaggaatggggtcgatcctccgccacgggccagggcagcaagcgttatcccaggatcgacctccagactgctgccagcccggccttctctgagtgcccggaaattaagcttgcaggagagacccgcaggaagctaccttgaagctcaggcaggcccctatgccactggtcctgcaagtcatattagtccccgggcctggagaagaccaacaatagagtcccatcacgtcgcgatctccgacgcggaagactgtgtccagctgaatcagtacaaattgcagtcagagatcggcaaaggcgcctacggcgtcgtgagactggcatacaatgaaagcgaggacagacattatgccatgaaggtgctgagtaagaaaaagctccttaagcagtacggcttccctagacgccctccacctagaggcagtcaggccgcccaagggggcccggccaaacagctgctgccgcttgagcgggtgtaccaggaaatcgccatcttgaagaaactcgatcatgtgaacgtggttaagctaattgaagttcttgatgaccccgctgaagacaacctttatctcgttttcgatctactgcggaaggggcctgttatggaggtgccctgcgacaaaccattctcagaagaacaagccaggctgtacctaagagacgtcattctggggctagaatacctgcactgtcagaagatcgtacatcgggatattaagccttcaaacctgctgctgggtgatgatggacatgtgaaaatagctgatttcggcgtatcaaaccagtttgaaggaaatgatgctcaactgagttccacagcaggcaccccagcattcatggctcccgaagccatttccgattccggccagtcattcagcggcaaggctcttgacgtctgggctactggggtgacactttactgcttcgtatacggcaagtgtcctttcatcgacgatttcatcttggctctgcaccgcaagattaaaaacgaacctgttgtgttccctgaagagccagaaatttccgaagagctgaaggatctcattttgaagatgctggacaaaaatccggagactcggataggagtgcctgatataaagctacatccttgggtgactaaaaacggagaagaaccgctcccatccgaagaagaacactgctcagtagtggaagtaacggaggaagaagtaaagaatagcgtgcgtttgatcccttcctggacaaccgtcatcctggtgaaaagtatgttaagaaaacgctcctttgggaacccctttgagccacaagccagaagggaagagcgttccatgtccgcaccaggcaacctcctggttaaagagggttttggggagggggggaaatctcctgagctgcccggcgtgcaggaagacgaggccgctagttag

SEQ ID NO: 14220 - DNA, 1599 bp, Artificial Sequence
  Description of Artificial Sequence: Synthetic coding sequence
atgcagtttggaaaactctggtgtggctgttctggcgaattccctactcgtctgcgtcgtcgcacgcctttaacggaagccatggagggcgggcccgccgtgtgctgtcaagacccccgcgcggagctggtggagcgggtggctgccatagatgtcacccacctcgaagaggccgacgggggccccgaacccacccgcaacggcgtcgatcctccccctcgggcgagagctgcctcagtgattccaggaagcaccagccggttgctccctgcgcggcctagcttgagtgcccgtaagctgagcttacaggaacggcctgcaggatcatatctggaggctcaagcaggcccatatgctactggaccagcaagccacatcagccctcgagcctggagacgccccaccatcgagtcccatcacgtggccatatcggacgcagaggactgtgttcagttgaaccagtataagctccagtcagaaatcggaaagggagcttacggcgtggtgagattggcatacaatgagtcagaggatagacactacgcaatgaaggtgctgtccaagaagaaacttcttaaacaatatgggtttcctcgccggccccctccccggggcagtcaggccgcccagggcggcccggctaagcagctgctgcccctggaacgggtgtaccaggagatcgcaatcctgaagaaactggaccatgtgaacgtcgttaagcttattgaggtcctagatgatccagccgaagataatttgtacctggttttcgatctgctgagaaagggcccagtgatggaggtaccttgcgacaagcccttctccgaggagcaagccaggctttacctcagagatgttattttaggtctcgagtatctgcactgccagaaaattgtgcatcgggatattaagccgtcaaatctgctgctaggcgatgatggccacgtgaagatcgcggatttcggcgtttctaatcagtttgagggaaacgacgctcagctgagttccactgctggcactcccgcctttatggcaccagaagcaattagtgacagcgggcagagtttctctgggaaagctctagacgtgtgggccaccggcgtgacactgtactgctttgtctacggaaagtgcccgttcatagacgatttcattctggctttgcatagaaaaatcaagaacgaaccagtggtttttccagaagagccggagatcagcgaagaactgaaggacctgattctcaagatgctggacaaaaatccggagactcgcataggtgtccccgatataaaactccacccatgggtgaccaagaatggagaggagccactgccttccgaagaagaacactgttcagtcgtggaggttaccgaagaagaagtcaagaactcagtgcggctcattcctagctggaccaccgttatcctagtaaaatccatgctcaggaagcgctcattcgggaacccctttgagccacaggcccggagagaggaaaggtccatgagcgcgccaggcaatctactcgtgaaggagggctttggtgagggtggaaaatcccccgagctgcccggagtgcaagaggatgaagctgccagttag

SEQ ID NO: 14221 - DNA, 1632 bp, Artificial Sequence
  Description of Artificial Sequence: Synthetic coding sequence
atggaggggggccccgccgtttgctgccaggatcccagggcagagctcgtggaacgggtggccgctatagacgtgacccaccttgaagaagctgacggcggacctgaaccgacacggaacggggtcgacccccctccgagggcgagggccgcgtcggtgatacccgggtccacctctcggctcctgcccgcgaggccatccctgtccgcacgaaaactctctctgcaggagaggcctgctgggagttatcttgaagcccaggctggcccatatgcgacgggcccggcctctcatatcagccctagggcctggcgccgcccaactattgagagccaccacgtggctatttcggatgcggaggactgtgtgcaactgaatcagtacaagctgcaatccgaaatcggaaaaggcgcatacggagtggtgcggctggcgtacaatgagagcgaggatcgtcattacgctatgaaagtcctgagcaagaagaaactgttgaaacagtatgggttcccaaggcggccccccccccgtggttcccaggctgcccagggcggacctgctaagcagcttcttcctctggaacgtgtgtatcaagagattgccatcttgaaaaagctcgaccacgtcaacgtggtaaagctcattgaggttttggatgaccctgcagaagacaatctgtatctggccctgcagaatcaggcccaaaacattcagctcgattcaacaaacatagcgaagccccatagtctgttaccttccgaacaacaggactctggatctacatgggccgccagaagcgtattcgacctgctgcgtaaaggtcccgtgatggaagtgccttgtgacaagcccttttccgaagaacaagccaggctctatctgagagacgtgattttgggactcgagtatctgcattgccagaagattgtgcatcgggacatcaagccttcgaacttactgcttggggatgatggccacgtgaaaatcgcagattttggggtgtcaaaccagtttgaaggcaatgatgcacagctgtctagcactgccggcacacccgccttcatggcacccgaagctatctctgactcaggtcagagtttttctgggaaggcattggatgtatgggccaccggggttactttgtattgctttgtttatgggaagtgcccctttattgatgacttcatcctggcacttcacaggaaaatcaagaacgagcctgtggtgttccctgaggaaccggaaatctccgaggagctgaaagatcttattctcaaaatgctcgataagaacccagagactcgcattggggtgccagatattaaactgcatccgtgggtaaccaaaaatggagaggagcctctccctagcgaggaggagcattgctcggtagtggaagttacggaagaggaagtaaagaacagtgtccgcctaattccctcctggactacagtgatcttggtgaaatccatgttgcggaagcgtagtttcggtaatccctttgagccacaggccaggcgtgaagaacggagcatgtccgccccaggcaacctgctggtgaaagagggtttcggagagggaggcaaatcccccgagttacccggcgttcaagaagatgaagctgcgtcttag

SEQ ID NO: 14222 - DNA, 1695 bp, Artificial Sequence
  Description of Artificial Sequence: Synthetic coding sequence
atggatgactttgagcggcgccgcgaacttaggcgtcaaaagcgcgaggagatgcgtctggaggctgagcgaattgcctatcagcgcaacgatgatgacgaagaagaagcagccagagaaaggcgcagaagagcaaggcaggagcggctccgacagaaacaggaggaagagtccctgggccaggtgacagatcaggtcgaggtaaacgcccagaacagcgtccctgatgaagaagcgaaaaccaccaccaccaatacgcaggtggaaggcgatgacgaggctgcctttctggaacggctagcaagaagggaggaacggcgccagaaaagacttcaagaggccctcgaaaggcagaaggagtttgaccccacaattaccgacgcctcgttgtcattgccatccaggcgtatgcaaaacgataccgctgaaaacgagactacggagaaggaggagaaaagcgagtcgagacaggagcgctatgagattgaagagactgagaccgtgaccaaatcttatcagaagaatgactggagggatgctgaggagaacaaaaaagaggataaagagaaggaggaagaggaagaggaaaaaccaaaacgcggttctattggggagaaccagggtgaagagaaagggactaaagtgcaggcaaaacgcgagaaactgcaggaagacaaacctacatttaagaaggaagaaatcaaggacgagaaaatcaagaaagacaaggagccgaaggaggaggtcaaaagctttatggacaggaaaaagggttttacagaggtgaaatctcagaacggagaatttatgacccataagctgaagcataccgaaaacaccttttctcgacccggaggtagagcctccgtggacactaaggaggctgaaggggcgcctcaggtggaagcggggaagcgacttgaagaactacgtaggaggcgcggagagactgagagcgaggagtttgagaaactcaagcaaaagcaacaggaagccgccctcgagctggaagaactgaaaaaaaaacgggaggaacggagaaaagtattggaggaagaggaacagcgacgcaaacaggaagaagccgatcgcaagcttcgggaggaggaagagaaaaggcgtctgaaggaagaaatagagagaagacgagccgaggcggcggaaaagcgtcagaagatgccggaagacggcctgtcagatgataagaaaccatttaagtgttttaccccaaagggctcgtcactcaagattgaagaacgagccgagtttcttaataagagcgtacagaagagctctggtgtgaagtctacccaccaggccgcaatcgtttccaaaatagattctcggctggaacagtacacctcagctatcgagggtacaaagagcgccaaacccaccaagcctgccgcctcggatctgccagttcccgccgaaggcgtgagaaatattaagtctatgtgggaaaaggggaatgtgttttcgagcccaaccgctgctgggacgccaaataaggagaccgccgggctaaaggtgggcgtatcttcacgcattaatgagtggctgacaaaaacccctgacggcaataaatcccctgcacccaaaccgagcgacctccgaccaggcgacgtatccagcaaaagaaacctctgggagaaacagtcggttgacaaagtgacttcccctactaaggtttag

SEQ ID NO: 14223 - DNA, 2382 bp, Artificial Sequence
  Description of Artificial Sequence: Synthetic coding sequence
atggatgatttcgagcggcgcagggagctcaggagacagaaaagagaagaaatgcggctggaagcggagaggattgcctaccaaaggaacgatgatgatgaagaggaggcagcaagagaacggaggagacgagccaggcaggagcgcttgcggcagaagcaggaggaggaaagcctcggccaggttaccgatcaggttgaagtaaatgcacaaaattctgtgcccgacgaggaagccaagactactactactaatacacaggtagagggagatgacgaggcagcttttctggagcgcctcgcccggcgggaggagcgacgtcaaaagaggctgcaggaggccttagaacggcagaaagagtttgatccgaccattactgacgctagcctgtcactcccttcaaggcgtatgcagaacgataccgccgaaaatgaaaccacggaaaaagaagagaagtcggagtctcgccaggagagatatgaaatcgaagagaccgaaacagtaaccaaatcgtaccagaaaaacgattggagggacgcggaggagaacaaaaaagaagataaggagaaagaagaggaggaagaggaaaaaccaaaacgaggatccattggtgaaaatcaggttgaggtgatggtggaagaaaagactaccgaaagtcaggaagaaacagtggtaatgagtctgaagaacggccagatcagctcagaggaacctaagcaggaagaagagagggaacaaggaagcgatgaaatctcccatcacgaaaaaatggaagaagaagacaaggagcgagcagaagccgaacgcgctcgcctggaggcagaagagagggagagaatcaaagctgaacaggacaaaaaaatcgccgacgagagggcccgaatcgaagccgaagagaaagcagcggctcaggaacgggagcgtcgggaggctgaagagagggaaaggatgcgggaagaagagaaacgcgcagcagaggagcggcaacggattaaggaagaagagaagagagccgccgaagaaagacaaaggatcaaggaggaagagaaacgagctgccgaagaacgtcaaaggattaaggaggaggaaaagcgggcggctgaggagcgacagcgggctcgggccgaggaggaggagaaggccaaagttgaagagcaaaagaggaataagcagctcgaagagaaaaaacatgcgatgcaagaaactaagatcaagggcgagaaagtcgaacagaaaatcgagggaaaatgggtgaatgaaaaaaaggcccaagaggacaaactccagacagccgttttaaaaaaacaaggggaagagaagggtacaaaagtgcaggccaaaagggagaagctgcaggaggataagcctacattcaagaaggaggagatcaaggacgaaaagattaagaaagacaaggagcccaaggaggaagtgaaatcgtttatggaccgaaagaaaggcttcacagaggtgaaatcccagaacggggagttcatgacacacaagctgaaacacaccgagaatacattctccagacctgggggtagagcgtcagtggacacaaaggaggcagagggagccccccaagtcgaggccgggaaacgtctggaagaattgcgtcgccgcaggggagagacggaatcagaggagttcgaaaaactaaagcagaagcaacaggaggccgcactggagctcgaggagcttaagaagaaacgagaggagcggcggaaagtactggaggaagaagagcaacgccggaagcaggaggaggccgacaggaagctccgagaggaagaggaaaaaaggcgcctgaaagaagagattgagcgaaggagagccgaggctgctgagaagaggcagaagatgcccgaggatgggctgagtgatgacaaaaagcctttcaagtgttttacccccaaagggtcatcactaaaaatagaggaaagagccgagtttctcaacaagtccgttcagaagtcttctggtgtcaagagcacccaccaggccgctatcgtaagtaaaatcgattcccggcttgagcagtacacctctgccatcgagggtacgaaatccgctaaacccacaaaaccagcagcttctgatctgcctgtacctgctgagggggtgcgcaacataaaaagcatgtgggaaaaggggaatgtgttcagcagccctaccgctgccgggacacctaacaaggagaccgccggcctgaaggtcggcgtaagctctagaataaatgaatggctcacgaagaccccggacggaaataaaagccccgcccctaagcccagcgacctgcggcccggggacgtgtctagcaaacgcaatttatgggaaaaacagagtgtggataaggtgacctcacctaccaaagtgtag

SEQ ID NO: 14224 - DNA, 1617 bp, Artificial Sequence
  Description of Artificial Sequence: Synthetic coding sequence
atggatgactttgaaaggcgccgtgagctcagaagacaaaaacgtgaggagatgagactcgaagccgaaagaattgcctatcagagaaatgacgacgacgaggaagaagcagctcgcgaaaggcgaaggagggcccggcaggagcgcctcaggcaaaagcaagaagaagagtccctgggacaagttacggatcaggtggaggtcaacgcacaaaattccgttcccgacgaggaggccaagaccacaacaaccaacacacaggtggaaggcgatgacgaggcggctttcctggagaggctggcccggagagaggagcgccgccaaaaaaggcttcaggaagctttagagaggcaaaaagaattcgacccaaccattactgatgcttccttgtcccttccaagccgccgaatgcagaacgacacagcagagaacgagactacagaaaaagaagagaagagcgagagtaggcaagaaaggtacgagatcgaggaaaccgaaaccgtgaccaaaagctatcagaagaacgactggcgcgacgctgaagagaataaaaaagaggataaagaaaaggaggaggaagaggaggagaagccaaagcgcggctcaatcggcgagaaccaaataaaggacgagaagatcaagaaggataaagaacccaaagaggaggtgaaatcttttatggaccgcaaaaaggggtttacagaggttaaatcacaaaatggagagtttatgactcataagctcaagcacactgaaaataccttcagtcgccccggcggaagggccagtgttgataccaaagaagccgagggcgctcctcaagtggaggctggaaaacgtctggaagagctcagaagacgacgcggcgagactgagagcgaggagtttgaaaagctgaagcaaaagcagcaagaagctgcactggagctggaagagttaaagaagaagagggaagaacgccgaaaggtgttggaggaagaagagcaacggcggaagcaagaggaagccgacaggaaactgcgggaagaggaggagaagcgaagactgaaggaagaaatcgaacgccgccgggccgaggcagccgagaagagacagaaaatgcccgaggatggtctttcggatgacaaaaaacccttcaaatgttttaccccgaagggctcatccctaaagatcgaggaacgcgccgaattcttaaacaaaagcgttcagaagtcatcaggcgtgaaaagcacccaccaagcggctattgtgagtaagattgacagccggttggagcagtacaccagcgcgatagagggtacaaaatcggccaagccaaccaaaccagctgcctccgacttgccggtgccagcggaaggcgttaggaatatcaagagcatgtgggagaaggggaatgtctttagctcacccactgctgctggtaccccaaataaggaaactgccggactaaaggtgggggtgtcttcaaggatcaacgagtggcttactaaaacacctgacggaaataaaagtcctgctcccaaaccatccgatctgagacctggagacgtgtccagtaaacgcaacctgtgggaaaagcagtctgtcgataaagtaacatccccaactaaagtctag

SEQ ID NO: 14225 - DNA, 1677 bp, Artificial Sequence
  Description of Artificial Sequence: Synthetic coding sequence
atgcttggagggagtggcagtcacgggcggcgcagtctcgctgccctgtcccagattgcttaccagcggaatgacgatgacgaggaggaagccgcgcgagaaaggaggcgccgggcaagacaggagaggctcagacagaagcaagaagaggaatcattgggccaggtgaccgaccaggtggaggtgaacgcgcagaacagtgtgccagatgaggaggcaaagacgacaaccacgaacacacaggtggaaggcgacgatgaagctgcattccttgagcggctcgcgagaagggaagaaaggcgccagaagaggttgcaggaggctctggagagacagaaggagttcgaccccacgataactgacgcttctttgtccttgccttctcgaaggatgcagaatgatactgccgagaatgagacaacggagaaggaggagaaatccgaaagccgccaggagcgttatgagatcgaggagactgagaccgtaaccaagagctaccagaagaatgactggagagatgccgaggagaacaaaaaggaggataaggagaaggaagaagaagaagaagaaaaaccaaagagaggaagcataggggagaaccagggagaagaaaaggggacgaaagttcaggctaagcgcgagaagctgcaagaagacaagccaactttcaagaaagaagagatcaaagatgagaagataaaaaaggacaaagagccgaaggaggaagtcaagtccttcatggaccgtaagaagggtttcacagaggtgaagtcccagaatggagaattcatgacccacaagcttaaacacacagagaatacctttagtcggccagggggccgcgcttccgtagacaccaaggaagctgagggagcacctcaagtcgaggctggtaaaaggctggaggagttacgcaggcggcgcggagagactgagagtgaagagttcgagaaattgaaacagaagcagcaggaagcggccctcgaactggaggaactcaaaaaaaagagagaagagcgacggaaagtcctggaagaggaagagcagagacggaagcaggaggaggcagaccggaagttaagggaagaggaagagaaaagacggctcaaagaggaaattgagcggcggcgtgccgaggccgctgagaagaggcagaagatgccagaggatggcttgtctgacgacaaaaaaccctttaaatgcttcactccaaaaggtagctcactcaaaatagaggagcgggccgagtttcttaacaagtcagtacagaaatcctccggagtgaagagcacccaccaagccgcaattgtatctaagatcgatagtcggttggagcaatatacttcggctatcgaaggcaccaaaagcgctaaacctaccaagcccgcggctagcgatctgcctgtacccgccgaaggagtgaggaatatcaaatccatgtgggagaaaggaaacgttttctccagtccaaccgctgccggcaccccgaataaagagacagcgggtctgaaggttggggtgagtagtcgcataaatgagtggctaactaagactcccgacggcaataagtcgccggcccctaaaccatctgacctccgtccaggcgatgtcagttctaagaggaatctatgggaaaagcagtctgtagacaaagtgacctccccaacgaaggtgtag

SEQ ID NO: 14226 - DNA, 1617 bp, Artificial Sequence
  Description of Artificial Sequence: Synthetic coding sequence
atggacgactttgaaaggagaagggaactgagaaggcagaaaagagaggagatgaggctcgaggccgaaagaatcgcgtaccaaaggaacgacgacgatgaggaagaagccgctcgggaaagacgaagaagggccagacaagagcgactcagacagaagcaggaagaggaatcactgggacaggttaccgatcaggtggaagtaaacgcccaaaactctgtgcctgacgaagaagctaaaactacaactactaatacacaggtcgaaggcgatgacgaggcagcattcctcgagagactcgctcgcagggaggaacgcaggcagaaacggcttcaagaggctctggagcgtcagaaagagtttgacccaacgattacagacgccagtctgagtcttccgtcccggcgcatgcaaaatgacactgccgagaatgaaactaccgaaaaagaagagaaatccgagagccgacaggagcgctacgagattgaggaaaccgagaccgtaacaaaaagttaccagaaaaatgattggagagatgctgaggagaataagaaagaagataaggaaaaagaagaggaggaggaggagaaacccaaaagaggatctattggagagaatcaaattaaagacgagaagatcaagaaggataaagagcctaaggaggaagtgaaatctttcatggataggaagaaagggtttacagaagtcaagtctcaaaatggcgagtttatgacgcataaactcaagcacacggagaacaccttcagccggcccggcggacgcgcctctgttgatactaaggaggccgagggggctccgcaggtcgaagctggaaagcggcttgaagagctaagaagacgcaggggcgaaacagaatcagaggaattcgaaaaactgaaacagaaacagcaggaggcggcgcttgagctggaggagctcaaaaaaaaaagggaagaaagacggaaagtgctggaggaagaagagcagaggaggaagcaggaagaggctgaccggaaactccgggaggaagaagaaaagcgaagattgaaggaggagatagaaaggcgcagggccgaggcagctgaaaaaagacaaaagatgcctgaggatggcttatccgatgataaaaagcccttcaagtgcttcactcccaaggggtcgtccctgaagatagaagaacgagccgaattcttgaacaagtccgtccaaaaatcctcaggcgttaagtcaacccaccaggccgctatcgtgagcaaaattgatagcaggcttgagcaatacacaagtgcaatcgaagggacaaaatccgctaaacccacaaagccggctgccagcgacctgcctgtacccgcagaaggagtgcggaacatcaaaagcatgtgggagaaaggtaacgttttctcttcgccgactgccgctggcacgccaaacaaagaaactgcgggactaaaggtcggagtcagcagtcgaataaacgagtggctaacaaagactcctgatggcaacaagagtcccgcacccaaaccttccgacctgcgccctggcgatgtttcttccaaacggaacctctgggagaaacagtccgtcgacaaggttacttcacccaccaaggtatag

SEQ ID NO: 14227 - DNA, 1692 bp, Artificial Sequence
  Description of Artificial Sequence: Synthetic coding sequence
atggacgactttgaaaggaggagggaactgagaaggcaaaagcgcgaagaaatgaggctggaggcagagagaatagcttatcagagaaatgacgatgatgaggaggaagccgctcgcgaacgtcgcagacgggctcggcaagagaggctccgacaaaaacaggaggaggagtcgctagggcaggtgaccgaccaggttgaggtgaatgcacagaattctgtccctgacgaggaggccaaaacgaccacaacaaacacccaggtcgagggcgacgatgaagcagccttcctcgaacggcttgcccggagggaggagaggcggcagaaacgactgcaggaggctctggaaagacagaaagagtttgaccctacaattacggacgcaagtctgagtctgccatcccgtagaatgcagaatgataccgccgagaatgagaccactgaaaaggaggaaaagagcgagtcgagacaggagcgctacgagatcgaggaaacggagactgtgaccaagagttatcaaaagaacgattggcgggacgcggaagagaacaagaaggaagacaaggaaaaggaagaggaagaagaagaaaaacctaagagaggttccattggtgaaaatcagggggaggagaaaggcactaaggtgcaggccaaacgcgaaaaactgcaagaagataaacctacttttaaaaaagaagagattaaagatgaaaaaattaaaaaagataaggagccaaaggaggaggtcaaatcgttcatggataggaagaagggcttcaccgaggtaaagtcccagaacggagaattcatgactcacaagctgaagcacactgaaaacaccttctctcgacccggcggtcgggccagtgtggacacaaaagaagctgagggggccccgcaggtggaggccgggaaacgcctcgaggaactgcgcaggagacgaggcgaaactgaatccgaggaattcgaaaagctgaaacagaagcagcaagaagccgccctggaactggaggagttaaagaagaaacgggaggaacgacgaaaagttcttgaagaagaggagcagaggaggaagcaggaagaggccgaccggaagctgagggaagaagaggagaagcggcgtctcaaagaagaaattgaacgacgaagagcggaagccgctgagaagaggcaaaaaatgccagaagatgggctgagcgatgacaaaaagcccttcaaatgttttactcctaaaggtagcagcctgaagattgaagaacgcgcagaatttctcaacaagagtgtgcaaaagtctggtgttaagagcacccatcaagccgcgatagtttccaagattgacagcaggctggagcagtacacctctgccatcgaaggaaccaagtcagcaaagccgactaaaccagcagcgtcagacctgcccgtgcccgcggaaggagtgcggaacatcaaatcaatgtgggaaaaaggtaacgtcttttcctcacccaccgctgcagggactcctaataaggagacggctgggctcaaagtcggtgttagttcgcgaatcaacgaatggctcaccaaaaccccagatggaaacaagagcccagcccccaagccatctgacctgaggcccggcgatgtgtcgagcaaaaggaacctgtgggaaaagcagtccgtagataaggtgaccagcccgactaaagtatag

SEQ ID NO: 14228 - DNA, 1599 bp, Artificial Sequence
  Description of Artificial Sequence: Synthetic coding sequence
atgctaggaggctctggtagtcacgggaggcgcagtttagcagccttatcacagatcgcgtatcagcgcaacgacgacgatgaagaggaggctgcccgggagcggaggcgacgggcccggcaggagaggctgcgacagaagcaggaggaggaaagcctgggacaggttaccgaccaggtggaagtcaacgcccagaactctgttcctgacgaggaagctaagacaacaacaaccaatacacaggtggagggtgatgatgaagctgcttttttggaacggctcgcacgccgcgaggaacgtaggcagaagcgcctgcaggaggcgttggaacgacagaaagagtttgaccccaccataactgacgcgagcctttctctacccagtcgccgtatgcagaatgataccgctgagaacgaaacgaccgagaaggaggagaaatccgaatctcggcaggagcggtatgaaattgaggaaacagagacagtgaccaagtcctaccagaaaaacgactggcgtgatgccgaggaaaataaaaaagaggacaaagagaaagaagaagaagaggaggagaagcccaagcggggatccatcggcgagaatcaaattaaagacgaaaaaataaagaaagacaaagagccaaaggaggaggttaagagttttatggaccgtaaaaaaggctttaccgaagttaaatcccagaatggggaattcatgacacacaaactgaaacacactgaaaacaccttctctagacccgggggccgcgcgagcgttgataccaaagaagctgagggggcccctcaggtggaggcaggaaagcgcctggaggagttacgacgccgcagaggcgagaccgaatccgaggagttcgaaaagctgaaacagaaacagcaggaagccgccctagaactggaagagctgaagaagaagcgagaggaacgtcgaaaagttctagaagaggaagagcaaaggcgaaagcaggaggaggccgataggaaactgagggaggaggaggagaagcggcgactaaaggaggagatcgaacgaaggcgcgcagaggctgccgagaagcgacaaaagatgccagaagacggcctgtctgacgacaaaaagccatttaagtgtttcacccctaaaggatcttcactgaagattgaggagcgagcagagtttctgaacaaatctgtgcagaagagctctggcgtcaagtccactcatcaggccgctatcgtgagcaaaatcgacagccgattagagcagtatacttcggccattgaagggactaaatccgctaagccaacaaagccggcggcctctgacctgcctgtgcctgcagaaggagtgcggaacatcaagtcaatgtgggaaaaggggaatgtgttcagttcaccgactgcagcaggcacgcctaacaaggaaactgcagggctgaaggtgggtgtaagtagcaggattaacgagtggttaactaagacaccagacggcaataaatccccagccccaaaacccagcgatctccgtcccggggatgtctcttcaaagagaaatctgtgggaaaaacagtcggtggacaaggtaactagtcccaccaaagtctag

SEQ ID NO: 14229 - DNA, 528 bp, Artificial Sequence
  Description of Artificial Sequence: Synthetic coding sequence
atgccagaggacggcctctctgatgataaaaaacccttcaagtgtttcacacctaaagggagctccctgaaaatagaggagagagccgagttcttgaataagtccgtacagaaaagcggtgtcaaatctacccaccaggccgcaattgtgagcaagatcgatagtaggctagagcagtacacttctgccattgagggcaccaaatctgccaaacctacaaaacctgccgcatcggacctgcctgtccctgcagagggcgtacgcaatattaagtctatgtgggaaaagggaaacgtgttttcttccccaaccgcagccggaaccccaaataaagaaactgcgggacttaaagtgggcgtgagctcaaggattaatgaatggttgaccaagacccctgatgggaacaagtcaccggcacccaaaccgtctctgacattctgcagtagcctgttcggcttgtggttaataggtaacctcctgctcctccctagctttctgccactgctgcccgagtgggtcttcctgtag

SEQ ID NO: 14230 - DNA, 219 bp, Artificial Sequence
  Description of Artificial Sequence: Synthetic coding sequence
atggatgacttcgagcgcagacgggagctacggaggcaaaagcgggaggagatgcgcttagaagccgagcgcatcgcataccagcggaatgatgacgatgaggaagaggctgcccgcgaaaggcgccgcagggcacgccaggagcgcttgcgtcagaagcaggaggaggaatccctggggcaggttacagatcaggttgaagtcaacgcccagaactag

SEQ ID NO: 14231 - DNA, 1380 bp, Artificial Sequence
  Description of Artificial Sequence: Synthetic coding sequence
atggatgatttcgaaaggagaagagaactgcgccggcagaaacgagaggaaatgcggttggaggccgagaggatcgcataccaaaggaacgacgacgatgaggaagaagcagccagagagcgtcgtcggcgggcccgacaggaacgtttaagacagaagcaagaggaagagagtctaggtcaagtcactgatcaggtagaggtgaacgcgcaaaattccgtgccagacgaggaagctaagaccacaacaaccaatacccaagtcgagggagatgacgaggccgcattcctggagcgactggcccgaagggaagagcggcggcaaaagagacttcaggaggcccttgagcggcagaaggagttcgaccctaccattaccgacgcctcattgtccctgccctctcgcagaatgcagaacgacactgcagagaacgagactaccgaaaaggaagagaaatcggaatcccgtcaggagaggtacgagatagaagaaactgagacagtgactaaatcctatcaaaaaaacgactggagagatgccgaggaaaataagaaagaggacaaagagaaagaagaggaagaggaagaaaaaccgaagcgggggtctatcggagagaatcagatcaaagatgagaagataaaaaaggacaaagaacccaaggaggaagtcaagagctttatggaccggaagaaggggtttactgaggtgaaatcccagaacggcgaattcatgacccacaaactgaagcacacggagaacacgttctctagacccggtggcagggcttccgttgatacaaaagaggcggaaggtgctccacaggttgaagccgggaaacggctggaagagctgcgcagacgccgcggggaaacggagagtgaagagttcgagaagctgaagcaaaagcaacaggaagcagctctggagttggaggagctgaagaagaagagggaggaaagacgcaaggtgctagaggaggaagagcagaggaggaagcaggaggaagccgatcgaaagctgcgggaggaagaggaaaaaagacgactgaaggaggagatcgagcgcagacgtgccgaggctgctgagaagagacagaagatgcctgaggatggcctgagcgacgataaaaaaccctttaagtgctttactccgaaaggctctagtctgaagatagaggagcgagctgagttccttaacaagagcgtacaaaagtcaagcggtgtcaaatctactcaccaggcggccattgtgagcaaaatcgactccaggcttgagcaatatacctctgctattgagggaacgaaaagtgccaaaccaactaagcccgccgcctctgatcttcccgttcccgccgagggagtgaggaatatcaaatcttag

SEQ ID NO: 14232 - DNA, 219 bp, Artificial Sequence
  Description of Artificial Sequence: Synthetic coding sequence
atggacgacttcgaaaggcgtcgcgagctcaggcggcagaaaagagaagagatgcgattggaggccgagaggattgcctatcagcgcaacgacgatgacgaggaggaggcggcaagggagaggagacgccgggcccggcaagagcggctgaggcagaagcaggaagaggaaagcttaggacaagtgacagatcaagtggaagtgaatgcgcagaactag

SEQ ID NO: 14233 - DNA, 1632 bp, Artificial Sequence
  Description of Artificial Sequence: Synthetic coding sequence
atgaccagctatatgaaagttgaccggcagtggaatgcagaaattctggagctgatcctcgggaccggccaattgagcactggccagattgcgtatcagcgaaatgatgacgatgaggaggaggcggctcgagaacgacggaggagagctagacaagagagacttagacaaaaacaggaggaggagagtctaggacaagtgactgatcaggtggaggtgaatgcccaaaacagcgtgcctgacgaggaggccaagaccaccacgaccaatacccaggtggaaggcgatgacgaagccgcctttcttgagcgtctggcgcgccgggaggagcgtcggcagaagcgacttcaagaagctctggagagacaaaaggagtttgaccctaccataactgatgcctcattgagccttccatcccgccggatgcagaatgataccgccgagaacgagaccaccgaaaaggaggagaagagtgagagccggcaggaacgctatgaaatagaagaaaccgaaactgtcaccaagtcgtatcagaaaaacgactggagggatgcggaagagaataagaaagaggacaaagaaaaagaggaggaagaagaagagaagcctaagagaggcagtatcggcgaaaatcagattaaggacgagaaaatcaagaaggataaggaacctaaggaagaagtcaagtcatttatggaccggaagaaaggctttacggaggtgaaatctcagaatggtgaattcatgactcataagctgaaacatactgagaatacattcagcaggccaggaggacgtgctagcgtggatactaaggaggcagagggcgctcctcaggtggaggccggaaaaagactggaagaactccgtcgcagacgcggcgagacagagtccgaggaatttgaaaaactgaagcagaaacagcaggaagctgctctggagctcgaggaacttaaaaaaaagagggaagaacgccgcaaggtactggaagaagaagagcaacggcgcaaacaggaggaggcggacagaaagctgcgggaagaagaggaaaagagacgcttaaaagaggagatcgagaggagacgcgccgaggctgccgagaagaggcagaaaatgcctgaagacgggctgagtgacgacaagaaaccatttaagtgctttacacctaagggttcctctctcaaaatcgaggagcgcgccgagttcctgaataagagtgtgcagaagtcgtccggggtcaagtctacccaccaggccgcaattgtgagcaagatcgatagccgccttgagcagtatactagcgctatagagggaacgaagagtgctaaacctaccaagcctgccgcaagtgacctgcccgtaccagcagagggagtgagaaatattaagagcatgtgggagaaaggtaatgtgttttccagccccaccgccgccggaaccccaaataaagaaactgcgggcctgaaggtcggggtgtctagtagaatcaatgaatggcttacaaaaacacctgacggtaacaagtcccccgcccctaaacccagtgatttgcgccctggtgacgtgtcctctaagcgaaacctctgggaaaagcaatccgtggacaaggtcactagtccaactaaggtgtag

SEQ ID NO: 14234 - DNA, 3975 bp, Artificial Sequence
  Description of Artificial Sequence: Synthetic coding sequence
atggccgatagcctgtacaacatccggctactgagggagttttcaaacgaatatttgaataaatgcttctacctgacactcgaagatatgctatatgcacccttggtgctgaaacctaacgtgatggtgttcattgccgaactcttctggtggtttgagaacgtgaagccagattttgtgcaacctagagatgtccaagaactgaaggacgccaagaccgtgcttcatcagaaatcaagcagaccaccagttcccatctcaaacgctaccaaacgcagtttcctcggcagtcctgccgcaggcaccctggccgagcttcagcctcccgttcagctgccagcagaggggtgtcacagacattacctgcatccagaggagccagagtatttgggcaaaggcactgctgccttctcgccaagccatccgttgttgcctttacgccagaagcaacagaaaagcatccagggcgaagacatacctgatcagaggcaccgcagcaattctttgacaagagtggatgggcagcctcgtggcgcggccattgcctggcccgaaaaaaaaacaagaccggcctctcagcctacaccctttgcgctccaccacgccgcctcttgtgaggtggacccttcctccggggactcaatatcactggccaggagtatctccaaagacagcctggcatcaaacatagtgaatctcacacctcagaatcagccacatccaaccgcgacgaaaagtcatggcaagagcctcctgtccaacgtgagcatagaggatgaggaggaggagctggtggcgatcgtcagagccgacgtggttcctcagcaggccgatcccgagtttcctcgtgcctctcctcgtgctctcggccttaccgctaatgccaggtcacctcagggccaactggacacctcggagtctaaacctgattccttctttctcgaaccccttatgcctgcggtactgaagcctgccaaggaaaaacaggtcataacaaaagaggacgagcgcggggaaggcagacctcggagcatcgtctcgaggcggccctccgagggaccacagcctctggtgaggaggaaaatgactggctctagagacctaaaccgaacatttactcccatcccctgcagcgaatttcctatgggtatcgatccaacagaaaccggaccgctgtcagttgagactgccggcgaggtttgtggcgggcctctcgcgctgggtgggtttgatccctttcctcagggccccagcactgatgggttcttcttacatgtggggcgtgcagacgaggataccgagggacggctatacgtcagctgcagcaagtctcctaacagtcacgactccgagccttggaccttacttagacaggattcagactctgatgtggtcgacatagaagaagccgaacacgatttcatgggggaggcccacccagtggtcttcagcagatacattggagaggaagagagcgcaaaattacaggaggacatgaaggtaaaagagcatgaggacaaagacgacgcctctggccgctcatctccttgtctgtccaccgctagtcagatgagctccgtgagtatggccagtggcagtgtgaagatgaccagctttgccgagcgtaagctgcagcgcttgaacagctgtgagactaagagctctacatcctcctcccagaaaactacaccagacgcctccgagagctgtccggctcctcttacgacctggcgtcagaaaagagaacagtccccctctcagcatggcaaggaccctgcatctctgctggcctccgagctggtccagctgcacatgcagctggaggaaaaacggcgggccatagaggctcaaaaaaaaaagatggaggccttgtcggccagacagcgtctgaagttgggaaaggccgccttcctgcacgtggtgaaaaaggggaaagcggaagctgccccgccactgaggcccgaacattttgcaaaggagtatagccagcataatggcgaagattgtggggacgctgtctcaaagactgaggattttctcgtgaaggaagagcaacgggaggagctgctccatgagccgcaggacgtggacaaggaatccttggccttcgcccagcagcacaaagcaaaggatcccgttgctttacatgagcttgagaggaataaggtcatctctgcagctctcctcgaggacacagtgggggaggtggttgatgtgaatgaatgtgacctgagtattgagaagctcaacgaaaccatctctacacttcagcaagctatcttgaaaatttctcagcagcaggaacaactgctgatgaagtccccaactgtcccagtgcctgggagcaagaataactcacaggaccacaaggtgaaggcaccagtccactttgtcgaacccttgagcccaaccggcgttgctggacacaggaaagctcctcgtctggggcagggccgaaattcgcgatctggcaggcctgccgagctgaaagtacccaaggaccggcctcagggttcctcccggtctaaaacccccacaccatcagtggagacattgccgcacttgcggccgttccccgcctcaagtcaccccagaacacctacggacccgggcttggactccgccctggaacctagcggcgacccccacggcaagtgcctgtttgacagctatcgactacacgacgagagtaatcaacgaaccctgactctgagttcctctaaagacgcaaacatattgtctgagcagatgtcccttaaggaggtgcttgacgcctccgtgaaagaagtcggatcatcaagttctgatgtgagcggaaaagagtcagtgccagtggaagagcccctgagatctcgagcttccttgatcgaggtcgacctgtcagatcttaaggctccagatgaggacggcgaactagtgtcactcgacggttccgctgacctggtttcagaaggagaccagaagccaggcgtcggctttttctttaaagacgagcaaaaggccgaggatgagcttgctaagaaacgggctgcctttctgctgaagcagcagcgcaaggccgaagaagcccgagttagaaaacagcagctagaggcggaagtcgagttaaaacgggacgaagcacgacgaaaggcagaagaagatcgcgttcgcaaggaagaggagaaggctcgtagagagctaattaagcaggaatatctgcggcgcaagcagcagcaaatcttagaggagcagggtttgggcaagccgaagtctaagccaaaaaaaccgcggccaaaaagtgtgcatcgggaggagagttgttccgattcagggaccaaatgctcctcgactcccgacaatctcagccggacccagtccggctcctcactctccttagcctctgctgctactaccgaaccagagtccgtgcactccggcggtacgcctagtcagcgcgtggaatccatggaggcgttgccgattctgagccgcaatccgtccagaagcacagatagagattgggagaccgcctccgctgccagcagcctggctagtgtcgccgaatataccggccccaagctctttaaagagcccagctcaaagtccaataagccgatcattcataacgctatcagtcattgttgcctcgctggtaaggtgaatgagccccacaagaacagcattctcgaagagctggagaagtgtgacgccaaccactatattatcctgtttcgcgatgctggctgccagtttcgcgccctttactgttattatcccgacaccgaggagatctataaactgactggaactgggcccaaaaacattaccaagaagatgatcgacaaattatacaagtatagttccgatcgaaagcaattcaatctaatccccgccaagactatgagtgtgtcagttgacgctttgaccatccataaccacctatggcagcccaagcggccagcggtccctaaaaaggcccagaccaggaaatag

SEQ ID NO: 14235 - DNA, 4809 bp, Artificial Sequence
  Description of Artificial Sequence: Synthetic coding sequence
atggtcgacgcatctggcagggcggccgctgaagggtggagaaaaatggaagccccccccgacggggctgctgatttagtgcccctggaccggtatgatgcagcccgagcaaagatcgccgcaaacctgcagtggatatgcgccaaagcctacggccgggataatatccccgaagatctccgcgatccgttctatgttgaccaatacgagcaggaacacatcaagccaccggttatcaagcttctcttgtcatccgagttatactgcagggtttgctccttgatcttaaaaggggaccaagtcgcggctctccaagggcatcagtccgtgatccaagctctcagtcgcaaggggatttacgtgatggaaagtgatgacacgcctgtaacagagagcgacctcagcagggcccccatcaagatgtccgcccatatggctatggttgatgcattgatgatggcttataccgttgaaatgatctccatcgagaaggtagtggcctccgtaaagagattctcgaccttcagcgcttcaaaggaattaccgtatgatctggaagacgctatggttttctggatcaacaaagttaatttgaagatgagggaaattacagaaaaggaggtcaagctgaagcaacaactgttggagtcccccgctcaccagaaagtacgttacaggcgggagcacctgtctgcaaggcaaagcccgtatttcccactgttggaggacttgatgagagatggctccgatggcgctgccctgctggcggtgattcactattactgtcccgaacagatgaaactcgacgacatatgcctcaaagaagtgacctccatggcagacagtctgtacaatatacgcctgctccgcgaattctctaacgagtaccttaacaagtgtttctacctcaccctggaagacatgctctatgctcctctggtgctgaagcctaatgttatggtgtttattgctgagctcttctggtggtttgaaaatgtaaaacctgacttcgtgcagcctagagacgttcaggagctcaaggacgcgaagacagtgctgcatcagaagtcatccaggcctcccgtgccaatctccaatgcaacgaagcgctcattcttgggcagcccggccgccggtacattagccgaattacagcctcctgtgcaactaccggccgaaggttgccatagacactacctgcaccccgaggagccggagtatctgggcaagggaaccgccgcattttcaccctctcacccattattgcctctgcgtcagaagcagcagaagtccattcagggagaggatataccagatcagaggcatcggtctaactccctgaccagagtggatggtcagccaaggggggccgctatcgcttggccagagaagaaaactagacccgcatctcagcctacacccttcgccctgcatcacgctgcgagctgcgaggtggatccaagtagcggtgattccatctctctggcaaggtcaatcagcaaagattctctggcttcaaatattgttaacttgacgcctcagaatcagcctcatcctaccgcgacaaagtcccatgggaaatccctcttgagcaatgtgagcatcgaagacgaagaggaggagcttgtcgccatcgtgagggccgatgtagtccctcagcaggcagatcccgagtttccaagagcttcacccagggctctggggttgacagcgaacgccagaagcccacagggacagctggataccagcgagagcaaacctgattcttttttcctcgaacccttgatgcctgcggtcctgaagcccgccaaagaaaagcaggttattaccaaggaagacgagaggggtgaaggacgccctagatcaattgtgtcccgccggccatcggaaggcccacagccacttgttagacggaagatgacagggtctcgtgatctgaaccgcactttcacccccatcccgtgcagtgagttccccatggggatagatccaactgagactggcccccttagcgtggaaactgccggcgaagtgtgcggcggacctctggccctgggtgggttcgatccatttcctcagggcccatcgaccgacggattctttctacacgtgggtagagccgatgaggatacagagggaagattatacgtcagctgttccaagtctcccaacagtcatgacagcgaaccctggaccctgctccgccaagattcggactcagacgttgtagacatcgaggaagccgagcacgacttcatgggcgaggcacatcccgtggtgttctcacgctacatcggcgaggaagaatctgccaagctccaggaggacatgaaagtaaaggaacatgaggataaggatgacgctagcggacggtccagcccttgcctatcgacagcgagtcagatgtctagcgtttccatggcctctggatcagttaagatgacctcattcgccgagaggaagttacagcggctgaattcctgcgaaacaaagagctccacgtcatcctcccaaaaaacaacccctgacgcatctgagagttgccccgcccctcttactacttggagacagaagcgggagcagtcaccgagccaacatgggaaagacccagccagtttactggcgagcgagttggtgcagttgcacatgcagctcgaggagaagaggagggctatcgaagctcagaagaaaaaaatggaggccctgtctgcccgccagcgcctgaagctaggtaaggccgcctttctccacgtggtcaagaaggggaaggccgaggccgcgcctcccttgcgcccagagcattttgcgaaagaatatagtcagcacaatggggaagattgtggcgacgccgtaagcaagaccgaagactttttggtcaaggaggaacagcgggaagagctgttgcacgaaccacaggacgtggataaagagagtttggcgtttgcccaacagcacaaggccaaagacccagtcgccctccacgaactggaaaggaacaaggtgatctcagctgcattgcttgaggataccgttggcgaggtggtggatgttaatgagtgcgacctatccatcgagaagcttaacgaaaccatcagtaccttgcagcaggctatccttaagatatcccagcagcaagaacagcttttgatgaaatcacccacggtccctgtgcccggatccaagaacaacagtcaagaccacaaggtgaaagcccctgtgcacttcgtcgagccattatctcccacaggggtagctggtcacagaaaagccccaaggctaggacaaggtaggaatagccgttctggccgacctgctgaactcaaggtgccgaaagacagaccacaaggtagttcgaggagtaaaacacctacccctagcgtagagacccttccccacctgagaccttttccggcatcctctcacccccgcacccctactgaccccgggttagatagcgcacttgaaccttctggcgacccgcacggaaagtgcctgtttgactcgtacagactgcatgacgaaagcaatcagagaacgctcacactttcatcctcaaaggatgccaatatcctgagtgagcaaatgagccttaaagaagtcctcgatgccagtgtcaaagaggtgggtagcagctcttctgacgttagcggaaaagaatccgtgcccgtagaagagccgttgcggtctcgagcctcactgatcgaggtggatctgtcagaccttaaggcccccgatgaagacggagaactggtgtccctagacggaagcgccgacctggtctccgaaggggaccagaaacccggcgtaggattcttcttcaaggatgagcagaaagcagaggatgaattggctaaaaagcgcgcagcctttttgttgaagcagcagagaaaggctgaagaggcccgggtaaggaaacagcagctggaggcagaggtggaactgaaacgagatgaggcgaggcgcaaggcagaagaggatagagttcgcaaagaggaagagaaggcgcggcgggaactgataaaacaggagtatctcagaaggaagcagcaacagatccttgaggagcagggactaggcaaaccaaagagtaaaccaaaaaagccccggcccaagtctgtgcaccgagaggagtcatgctctgactcaggcactaagtgcagctcaactcccgacaatctgtcccgtacgcaatccggctcttccctgtccctggcttccgctgctaccactgagcccgagtcagtccatagtggcggcactccttcccaacgggtggagtccatggaggctctccccattctgtcgcggaacccttctaggtccactgatcgcgattgggaaaccgcatccgcagctagctctttggcatccgtggctgaatatacagggcccaagctgtttaaggagccctccagcaagtcaaacaaacctatcatacacaatgcaatctctcattgttgcctggcagggaaagttaatgagcctcacaagaactcaattcttgaggagctggagaagtgcgacgccaatcattacattatcctcttccgagacgcaggctgtcaattcagggccctatactgttactaccccgatacagaagagatctacaaactgaccgggaccgggcctaaaaacatcaccaaaaaaatgattgacaagctgtacaagtactcttcggataggaaacaattcaacctgatccctgcgaagacaatgtccgtctctgtcgacgccctgaccattcataatcacctctggcagcccaaacgccccgcagtgcccaaaaaagcacagactcggaagtag

SEQ ID NO: 14236 - DNA, 4842 bp, Artificial Sequence
  Description of Artificial Sequence: Synthetic coding sequence
atggttgacgcatcaggtagagctgccgccgagggatggcgcaagatggaggcaccccctgacggcgctgccgacctcgtccccttggataggtatgatgcagcccgagcaaagatcgccgcaaatctacagtggatctgcgcaaaagcgtacggcagggataacatacccgaggacctgagggacccattttacgtggaccagtatgaacaggaacatatcaaaccacccgtgattaaactcctgttaagcagcgagttgtactgcagggtatgttccctcattctcaagggcgaccaggtggccgccctccagggccaccaaagcgtgattcaggcgctttctaggaaagggatttatgtcatggagtctgacgatacaccagttaccgagtccgacctctcccgagcaccgataaagatgtctgcccacatggccatggtcgatgccttgatgatggcctatactgtggagatgatttccatagagaaggtcgtggcttctgtgaagaggttctccaccttctctgcgagcaaagagctcccctacgatcttgaggacgccatggtgttctggatcaataaagtgaatctcaagatgagggagatcaccgaaaaggaggtgaagcttaaacagcagttgctggagtccccggcacaccagaaatccccgagcaagtggtattggaaactggtccctgtgcgctacagacgagaacacctctccgccaggcagagcccatattttccgttgttggaggacctgatgcgggacggatccgacggagccgctcttttagcagtgatccactactattgcccagaacaaatgaagttagacgacatctgcctgaaagaagtaacttccatggccgatagcctgtataacatccgcctgctgcgtgaattttctaatgaatatttgaacaaatgtttctacctcacccttgaagacatgctttacgctcctttagtattgaagcctaatgtgatggtgttcatcgctgagcttttttggtggtttgagaacgtgaagccggatttcgtccaaccgagagacgtccaggagcttaaagatgccaaaactgtccttcaccagaaaagctctcggcctccagttccgatcagtaacgccacaaaaagatcgttcctcggatcgccggccgccggcacactggcagaactgcagcccccagtacagctgcctgcggagggttgtcacaggcattatctgcaccccgaagagccggagtacttaggcaagggtaccgcagcattctctcccagccaccctctgcttccactcaggcagaagcagcaaaaatctatccagggtgaagatatcccagaccagcgccatcggagcaatagtctgacccgggtggatggtcagccaaggggggcggccatcgcctggccagagaagaaaactcgcccggcttcccagcctacaccgttcgctctgcatcacgcagcgtcatgcgaggtggacccatcgagcggcgactccatctctctcgctagaagcatttcaaaggattctcttgccagcaatattgtgaacttgaccccgcagaaccaaccccatcccaccgccaccaaaagtcacggcaaaagtctcctgagcaatgtgtcaatcgaggacgaggaagaagagctcgtggcaattgtgagggcagacgtggttccccaacaagcagacccagaatttcctagagccagcccccgcgccttagggttaactgccaacgcccggtccccccagggccagctggatacaagtgagtcaaaaccagacagcttcttccttgagcccctcatgccagcagtgctcaaacctgccaaagaaaaacaagtgatcacaaaggaagacgagcgaggggaaggcagacccaggtcaatcgtgagtaggagaccgtctgaaggaccacaacccctagtccgtcgaaaaatgactggctctagggatctgaaccgcacttttacacccatcccctgcagcgaattccctatgggaatcgatcctaccgagactggaccactctccgttgagaccgctggggaagtgtgcgggggtcccctagcactgggagggttcgacccctttcctcaaggccctagcaccgacggattcttcctccatgtgggacgggctgacgaagatactgaaggacgactgtatgtttcctgttcgaagtctcctaatagccacgacagcgaaccatggactctcctcagacaggattccgactccgacgtggttgacattgaagaggcagagcacgactttatgggcgaggctcaccccgtggttttttccagatacatcggagaggaggagtctgccaaactccaggaggacatgaaggtcaaggaacacgaggataaggacgatgcctctgggagaagctctccatgtttgtccacagcctcccagatgagttcggtgtctatggccagcggctctgtaaagatgaccagcttcgccgagaggaagctgcaacggctcaactcatgtgagaccaaaagcagtacctccagttcacagaagacgacccccgacgcaagtgagtcttgccctgctcccctcacaacatggaggcagaagcgcgaacagagtccttcccagcatggtaaggatcctgcctcattactggctagtgaacttgttcagctacacatgcagctggaggagaagcggcgggctatcgaagcccagaaaaaaaaaatggaggccctgtccgcacggcagcgcctgaagctcggtaaggccgcgttcctgcatgtggtgaagaagggaaaagctgaggcggcccccccgctcaggccagagcacttcgctaaagaatacagccagcacaatggagaggattgcggcgatgccgtgagcaagacagaggatttcctggttaaggaggaacaaagggaggagctcctacatgaaccacaggatgtggacaaggaatcactcgccttcgcccaacagcacaaggccaaagatcccgtggcactccatgagcttgagagaaataaagtcatatccgcagctctcctcgaggatacagtaggcgaggtcgttgacgtaaatgagtgcgacctctcaatcgagaagctgaacgagacaatctccacacttcaacaggcaatcttgaagatcagccaacagcaggaacaacttctgatgaagtcccctaccgtgcccgtgcccggttcaaagaataatagtcaggatcataaggtgaaggcccccgtgcactttgtcgagcccctgagtccaactggggtggctggacaccggaaagcccctcgcttgggccaggggagaaatagcaggtctggtcggcccgccgagctgaaggtccccaaagataggccccagggctcttctagatcaaagacccccactccctcggtggagacactgcctcatctgaggccttttcccgcatcctctcatccaagaacaccaacagaccctggtctggacagcgcgctggaacccagtggcgacccccacggcaagtgtctgtttgattcgtacagactgcacgacgaaagcaaccagcggactttgactctcagctcctccaaagacgctaatatcctgagcgaacagatgtccctgaaagaggtgctggacgcttctgtgaaggaggtgggatcctcttcttccgatgtcagcgggaaggagtccgtgccagtggaagaacccctcagatcacgcgccagtctgatcgaggtggacttgagtgatctcaaagccccagacgaggacggtgagttagtgagcctcgacggctccgctgatctggtgagcgagggagaccagaaaccaggggtggggttcttcttcaaggatgagcagaaagctgaggacgagctggcaaagaagcgcgcggccttcctcctgaaacaacagagaaaagctgaggaagcaagagtgagaaagcagcagctggaggcagaggtggagcttaagagggatgaagctcgacgtaaggccgaagaggacagggtgaggaaagaagaggagaaagccagacgcgaactgattaagcaggagtatctcaggcggaaacagcaacagattttggaggaacagggcctcgggaaaccgaaatcgaaaccaaagaaacctcggcctaaatccgtgcatcgagaagagagttgttcagactcaggtaccaaatgttcaagcacacccgacaacctgtctcgcacgcaatccgggtctagcctgagcttggcctctgcggctacaaccgagcccgaatcagtccacagcggcggcacaccctcacaacgtgttgagagcatggaagccttgccgatcctctccagaaatccaagtagatccacagaccgggactgggagactgcatccgcagcttcaagtctcgctagtgttgccgagtataccggtcccaagctcttcaaagaaccctccagtaaatcaaacaagcccattattcacaacgctatttcccactgctgtttggctggaaaggtgaacgagccgcacaaaaactctatcctggaagagcttgagaagtgcgacgccaaccattatattatcctgtttcgcgatgcaggatgccagtttagggcactgtattgttattaccccgacaccgaagaaatctacaaactcactggaacaggaccaaagaatatcacgaagaaaatgattgacaagctctataagtattcctcggaccgcaaacagttcaacctgatacccgcaaagacaatgagtgtgagtgttgacgcgctgacgattcacaatcacctgtggcagcccaagcgccccgccgttcccaagaaagcccaaactagaaaatag

SEQ ID NO: 14237 - DNA, 1983 bp, Artificial Sequence
  Description of Artificial Sequence: Synthetic coding sequence
atgagaatgccatcctccacctgggctcgcatcatgtcatcgtgcgggtgtgatgcatgtagggtcggtcctagcagcgtaatgagaccaagtcctcggtatcctcgcgcctgggtaacacgaacttgggtgccgattcctcctcgtccaatggcatcgagcggctcagtaccaagagactgttggctgctagcagccatcgcaagtttaacactgaatgacaccctgctgcaccgagtagtgccccatggccagagctttcagaacggctacgcaggcatctttcacttccagctctggcagttcggggaatgggtagatgtcgtcgtagatgacctcttgcctatcaaggatgggaagctggtttttgtacattccgccgagggaaatgagttttggagcgcccttctcgaaaaagcgtatgccaaggtcaatggatcttacgaggccttgagcggtggctccactagtgagggcttcgaagacttcacagggggagttacagaatggtatgagttgagaaaggccccttcagacttataccaaatcattctgaaagccctggagcgaggcagtctgctcggttgcagcatcgacattagctcggttcttgacatggaggccattacctttaagaagctggttaaaggccatgcttactctgtaaccggcgctaagcaagtaaactacaggggccaggtcgtcagtctgatccggatgagaaatccatggggagaagtggagtggacaggcgcctggtctgattcgtcctcagagtggaacaacgtggatccctatgagcgggaccagctgagggttaagatggaggacggcgaattttggatgagcttccgcgacttcatgagggagtttacccggttggaaatatgtaacctgacacctgacgccctaaaatccagaacgattcggaaatggaacacaaccctgtacgaagggacatggcgccgtggctcaacggctggcggttgtcgcaactacccagcaactttctgggttaatcctcagtttaaaattcgcctggacgagacggacgatcccgatgactatggggacagagagtcaggttgctcttttgtgcttgccctgatgcaaaagcaccgccgtagagagcgacggtttggaagggatatggagacaattggttttgccgtttacgaagttccaccagagctggtgggccagccagcggtgcatttaaaacgcgattttttcttggccaatgctagcagagctcggtccgagcagttcataaacctgcgcgaggtgagcactcggtttaggctcccaccaggagaatacgtggtggtgccatctacgttcgagcctaacaaggaaggagatttcgtgctccgattcttcagcgagaaaagcgctggaactgtcgagctggacgatcagattcaggctaacctcccagacgaacaagtccttagtgaggaggagatcgacgagaatttcaaggccttgttcagacagctcgcgggagaggacatggagatctcggtgaaagagctaaggactatcctgaatcgcattatttctaagcacaaggatcttcgcactaaggggttctcgttggagtcttgtcgtagtatggtgaacctgatggacagagacggaaatggaaaactggggttggtcgagtttaacatactctggaatcggatccgcaactacctctcaatcttccggaagttcgatcttgacaagagtggttccatgagtgcttacgaaatgcgaatggctattgagtctgccggctttaaattgaacaaaaagctttacgagctgatcataactaggtattcagaacccgaccttgctgtcgattttgataatttcgtgtgctgtctcgttcggcttgaaaccatgtttaggtttttcaagactctggacacagacttagatggggtcgtcacctttgacctctttaagtggctgcagctcaccatgttcgcatag

SEQ ID NO: 14238 - DNA, 2145 bp, Artificial Sequence
  Description of Artificial Sequence: Synthetic coding sequence
atgtctgaggagattatcacgcctgtttactgcaccggtgtttcagcacaagtccagaaacagagggcgcgagaactagggctcggacgtcacgaaaacgccattaagtacctgggacaagactatgagcagctgagagtgagatgcctacagtcaggaaccctgtttcgtgatgaagctttccctcctgtgcctcagagcctgggctacaaagatctgggtcccaatagctccaagacatacgggatcaaatggaagcggcccacagagctcctctccaatccgcagttcatcgtggacggcgctaccagaaccgatatctgtcagggcgccttgggagactgctggttactcgccgctatagcctcccttactttgaacgatacattactacatcgtgtggtaccccatggtcagagttttcagaatgggtacgctggaattttccactttcaactgtggcagtttggcgagtgggtcgacgtggttgtcgatgacctgctcccaataaaggatggtaagcttgtctttgtgcattccgccgaggggaacgagttctggtctgccctcctggagaaagcatatgctaaggtgaacgggagctacgaagccttatccggaggtagtacctctgaaggattcgaggactttactggcggtgtaacagaatggtacgagttgcgtaaggccccaagcgatctgtaccagattattcttaaagctctagagagaggatccttgttgggctgcagtattgatatatcttccgtgctcgacatggaggctatcacatttaaaaaactcgtgaaaggccatgcatattctgtgactggcgcgaagcaggtcaactatcgcggacaggtggtttcccttatccgtatgcgcaacccctggggggaggtagagtggactggagcttggtccgactcttcgtccgagtggaacaacgtggacccatacgagcgggatcagctccgagtaaaaatggaagacggagagttctggatgagcttcagagattttatgcgcgagttcacgcgtctggagatttgcaacctgacccctgatgcattgaagtctcgcaccatacgcaagtggaataccaccctctacgagggaacatggaggagggggtccaccgccggaggctgtagaaattaccccgctaccttctgggtcaacccccagttcaagatccggttggacgagaccgatgacccagatgattacggcgatcgagagtcgggatgttctttcgttttggcactcatgcagaaacataggcggagggaacggcgctttggacgcgacatggagaccatcggcttcgcggtttatgaggtcccgcccgagttagtgggccagcctgcggttcacctgaaacgtgatttcttcctggccaacgcatctagagctaggtctgagcagtttatcaacctccgtgaggtatcgacccgattccgcctgccaccgggggagtatgtcgtggtgccttctaccttcgagcctaataaggaaggggactttgtgttaagattcttttccgaaaaaagcgctgggaccgtggaactagacgatcagattcaggctaaccttcccgatgaacaagttttgagcgaagaagagatagatgagaatttcaaagcactcttccgacagcttgccggggaggacatggagatctctgtaaaagaattgcggaccattcttaatagaatcatcagtaagcacaaagatttgcggacaaaggggttcagtctcgagtcttgcaggtccatggtgaacctcatggatagagacgggaacgggaaactcgggctggtcgaattcaacatattatggaatagaattcggaattacctttctattttcaggaaattcgaccttgataaatccggatctatgagtgcttatgagatgagaatggccatcgagtcagcggggttcaagttaaacaaaaagttatacgaactgatcatcacaaggtactcagaacctgatctggccgttgatttcgacaattttgtgtgttgccttgtgagactggagactatgtttagattcttcaagactttagatacagacctagatggggtggtgacttttgatctcttcaaatggctacagctgaccatgtttgcctag

SEQ ID NO: 14239 - DNA, 2145 bp, Artificial Sequence
  Description of Artificial Sequence: Synthetic coding sequence
atgtccgaggaaatcatcacccccgtctactgtaccggcgtgtcagctcaggttcagaaacaaagagcaagggagctgggcttgggacggcatgagaacgctataaagtatctggggcaggattatgagcagctgcgcgtccgatgcctgcagtccggcaccctgttccgggatgaggcatttccccccgtgccccagagcctgggctataaagacctgggccccaactcttcaaagacatacggaataaaatggaaaagaccaaccgagttactaagcaacccccaattcatcgtggacggggccacacgcacagatatctgccagggcgccctgggagactgttggcttttggctgcaatcgcctcccttacgctgaatgataccttgctgcatcgggtggtcccccacgggcagtctttccaaaacgggtacgcgggaatctttcacttccaattatggcaattcggggagtgggtggatgtagttgttgatgatctgctgcccatcaaagacgggaaactcgtctttgtgcactcggcggaagggaatgagttctggtccgctcttcttgagaaggcgtacgcaaaggtcaatgggtcttatgaagccttaagtggcggctccacgagcgagggtttcgaagattttactggaggtgtcactgagtggtatgagcttcgcaaagcccctagtgatttgtaccagattatcttaaaagccctcgagaggggaagcctacttggctgtagcatagacatctcctccgtccttgacatggaagccattaccttcaaaaaactggtcaaaggacacgcgtattcagtcaccggagcaaaacaggttaattatagggggcaggtggtatctttaatacgaatgcgcaatccctggggtgaggtcgagtggacaggggcatggagcgattcttccagtgaatggaataacgttgacccttatgaacgggaccagttgcgggtcaaaatggaggacggcgaattctggatgagctttagggacttcatgagggagttcacaaggctggaaatttgcaatcttaccccggacgctctcaaaagcagaacaatccgtaaatggaacacaaccctgtatgagggaacttggaggagaggaagcaccgccggcggttgtaggaactacccagccacattctgggtcaacccacaattcaaaattcgcttagatgagacagacgacccggacgattacggagatagagagagcggctgctccttcgtacttgctctgatgcagaagcacaggcgtcgtgagcgtcggtttggcagagatatggagaccatcggttttgccgtgtatgaggtcccaccagagctagtggggcagccagccgtccatttgaaacgggatttctttcttgcaaacgcttctcgggcccgctcagagcaatttattaatttgcgcgaagtctcaacccggtttcgcctcccccctggggaatacgtggtggtgcctagtacgttcgagcccaataaggagggggattttgtacttaggttcttcagcgagaaatcagctggcacagtcgagctggatgaccaaatccaggctaacttgccagacgaacaagtgctgtccgaggaagaaattgacgagaactttaaagcgcttttccgccagctggcaggggaggacatggaaatttccgtgaaggagctgagaacaatactcaacaggatcataagtaagcataaagatcttcggaccaaagggttttcacttgagtcttgtagaagcatggtcaatctgatggatagggatggaaatgggaagctcggccttgtagaattcaatatcctgtggaatcgcatcagaaattacctgtcgatctttaggaagttcgaccttgataagtccggatccatgagtgcatatgaaatgaggatggccatcgagagcgctggtttcaaactgaacaagaagctgtacgagctgattatcactagatactctgaacctgatctcgctgtagatttcgacaactttgtgtgctgcctggttaggctggaaacaatgtttcggttcttcaaaacccttgatacggatcttgatggggtggttacgtttgacctcttcaaatggctgcagctaaccatgtttgcctag

SEQ ID NO: 14240 - DNA, 489 bp, Artificial Sequence
  Description of Artificial Sequence: Synthetic coding sequence
atgagtgaggagattatcacacccgtgtactgtaccggggtgagcgcccaagtacagaaacaaagagcacgcgagctagggctagggcgccatgaaaacgcaattaaatatcttgggcaggactacgaacagttgagagtaaggtgcctgcaatcaggtacactctttagggatgaagctttcccaccagttccccagtccctgggatacaaagacctgggaccgaactcctccaagacatacggcatcaagtggaaaaggcctactgagctgctgagcaatccccagttcatagtggacggcgcaacaagaaccgatatctgtcagggcgcacttggggactgctggctccttgccgccattgcttccctaactctgaatgatacccttctgcaccgcgtcgtcccgcacgggcaaagcttccagaacggttacgcagggatctttcacttccagctgtggcaatttggtgaatgggtggatgtatag

SEQ ID NO: 14241 - DNA, 2145 bp, Artificial Sequence
  Description of Artificial Sequence: Synthetic coding sequence
atgagcgaggaaatcattacaccagtatactgtacaggggtatcagcccaggtgcagaaacagcgagctagggagctagggctgggaagacatgaaaacgccataaagtatcttggccaggactatgaacaattgcgagtccggtgcttgcagagcggaaccctcttccgcgatgaagctttcccacccgttcctcaatccctgggctacaaagatctcgggcctaactcctctaagacgtatggaataaagtggaagcggcccaccgaactactgtccaacccccagtttatcgtcgacggcgccactagaaccgacatttgccaaggagctctgggcgactgttggttgcttgctgctattgcctcactgactctgaatgacaccctgctccacagagtagtgcctcatgggcaaagcttccagaatggctatgcgggaattttccatttccagctgtggcagttcggggagtgggtggatgtggttgtcgacgatctcctgccaattaaggacggcaagctggtgttcgtacactccgccgaaggaaatgaattctggagtgccctcctggaaaaggcatatgcgaaggtgaatggctcatacgaagctctgagcggcggctcaaccagtgagggctttgaggattttacgggcggggtgactgagtggtatgaactccgaaaggcccctagtgacctataccagataattttaaaggccctggaacgcggctctcttctgggatgttcgatagacatctctagcgtccttgatatggaggcgatcacatttaagaagcttgtgaaaggtcacgcgtatagtgtcactggtgctaagcaggtgaattatcggggccaggtcgttagtctcattagaatgcgcaatccttggggcgaggttgaatggactggagcttggtccgattcatcctccgaatggaataatgtcgacccgtacgaacgggatcaattaagagtaaagatggaggatggggagttctggatgagttttcgcgactttatgagagagttcacccgccttgagatttgtaatctgacaccagatgctcttaaaagcagaaccatcaggaaatggaatactacgctctacgaaggaacttggagaagaggaagcacagctgggggatgcagaaattatcctgcgaccttttgggtgaatccccagtttaagatccgtttagatgagacagacgaccccgacgattatggggatcgggaatcgggttgcagcttcgtgctggccttgatgcagaagcaccgaagacgagagagaagattcggcagggacatggaaacaatcgggtttgcagtgtacgaagtgccccctgagctggttgggcaacctgctgttcacctcaaacgcgatttctttctcgctaatgcctcccgggcgcgcagtgagcagtttattaatttaagagaggtttctactaggtttcgcctgccccccggggagtatgtcgtcgtaccaagcacgttcgaaccaaacaaagagggagacttcgtccttagattcttctcagaaaagagtgcaggaacggttgagctcgatgaccaaatccaggcgaaccttcccgatgagcaggttctcagcgaggaagagatcgatgagaactttaaggctttatttcgccagctagcgggggaggacatggagatatctgtgaaggaactgaggaccattcttaatcgaattatctcaaagcacaaggacctgagaaccaaaggcttttcgctcgaatcctgccgctccatggtgaacctcatggaccgggatggcaatggcaagttgggccttgtcgagttcaatattctgtggaaccggatacgaaactacttaagcatttttcgaaagttcgatcttgacaaaagcgggagtatgagtgcatatgaaatgaggatggccattgagagtgctggctttaagctgaacaagaaactatatgaattgattattactcgatactcagaacctgatctggcagtcgatttcgacaattttgtctgctgtctggtgcgcctcgagacgatgtttcgtttcttcaagaccttggataccgaccttgatggcgttgtgacctttgatctttttaagtggcttcagctaacaatgttcgcttag

SEQ ID NO: 14242 - DNA, 459 bp, Artificial Sequence
  Description of Artificial Sequence: Synthetic coding sequence
atgagcgaggaaattattacaccggtgtactgtactggtgtcagcgcacaagtgcagaagcagagagcccgcgaactggggctgggacggcatgagaacgcgattaagtacttggggcaggactatgagcagctccgcgtgagatgccttcaaagtggcactttgtttcgggatgaggcattcccacccgtgccccagtccttgggctacaaggatctgggccccaactcaagtaaaacatatggaatcaaatggaagaggcctaccgagcttctatcaaacccccagtttatagtcgatggtgcgaccaggactgacatttgccaaggcgccctgggcgattgttggctcctcgctgccatcgccagcctgactttaaatgacaccctgctccaccgcgtagttcctcatgggcagtcattccagaatggttatgccggtatcttccattttcagtag

SEQ ID NO: 14243 - DNA, 489 bp, Artificial Sequence
  Description of Artificial Sequence: Synthetic coding sequence
atgtccgaggaaattattaccccagtttattgcaccggcgtgagtgcccaggtgcagaaacagagagctcgggaattgggacttgggcggcacgaaaatgccataaagtatctcggacaggactacgaacaactaagagtgagatgtttgcagagtggcaccctttttcgagatgaagcattcccccctgttccccagagtctgggctacaaagatctcggacctaattccagcaagacatacggtatcaagtggaagaggcctactgagctgctctctaacccccaatttattgtggatggtgctacccgcaccgatatttgccagggcgccctcggcgactgctggctgcttgctgctatcgcctccctgactcttaatgataccctactgcaccgggtcgtcccacatggacagagttttcagaacggctacgcagggattttccattttcagctctggcagttcggggaatgggtggatgtgtag

SEQ ID NO: 14244 - DNA, 492 bp, Artificial Sequence
  Description of Artificial Sequence: Synthetic coding sequence
atgagcgaggagatcataacccctgtttactgcactggcgtctccgctcaagtgcagaagcagcgggctcgtgagctgggactgggccggcatgagaacgctattaaatatctcggacaggactacgaacaacttagagtccgttgcctccagtctgggacactctttagagatgaagcatttcctccagtccctcagtcattgggatacaaagatttagggcctaatagttctaagacgtatggaattaagtggaagagacctaccgagttgcttagcaacccacagttcatcgtagacggagcaactcgaacggacatctgtcagggcgccctaggcgactgctggttgctagccgctattgcaagcttaaccctgaacgacaccttgctgcacagagtggtgccccacggccaatccttccagaacgggtatgctggcattttccattttcaactctggcagttcggcgagtgggtcgacgtggtgtag

SEQ ID NO: 14245 - DNA, 576 bp, Artificial Sequence
  Description of Artificial Sequence: Synthetic coding sequence
atgtccgaagagattatcacccccgtgtattgtactggggtgagcgctcaggtccagaagcagcgcgctcgggaacttggccttggccgacacgagaatgcaataaagtatctgggacaggattacgagcaactacgagtgcggtgtctgcagtcaggcacactgttcagagatgaggccttccctccagttcctcagtcactgggttacaaagacctgggcccgaacagctcgaaaacttatggtatcaaatggaagcggcccactgaactgttatcaaatcctcagtttatcgtagatggcgcaacgagaaccgatatctgccagggagcattaggggactgctggctcctggccgccatagcatctttgaccctgaacgatactttgctacatcgggttgtcccccacggccagagtttccagaatggctatgccggcatattccatttccagctgtggcaattcggggagtgggtggatgtagtggtggacgacctgcttccgatcaaagatggcaagttggtttttgtacactcggcagagggcaacgaattctggtctgccctgctttag

SEQ ID NO: 14246 - DNA, 513 bp, Artificial Sequence
  Description of Artificial Sequence: Synthetic coding sequence
atgtcagaagagattataactccagtttactgcaccggggtctctgctcaggtgcagaagcagcgcgcgagagagctggggcttggcagacacgaaaatgccattaagtacctaggacaggactatgaacagcttcgggtccggtgtctccagtctggaacattattccgggatgaagccttcccacccgtcccccaatcccttggatataaggacctggggccaaactccagcaagacttatggcatcaaatggaagcggcctaccgagttgctctccaacccccaattcatagtggatggcgctaccaggacagatatttgccagggcgcactgggtgattgttggctgctggcagcgatcgcctcactgaccctaaacgatacattgctgcacagagtcgtacctcacggccagtcgttccaaaatggctatgccggcatatttcattttcaactgtggcagttcggcgaatgggttgatgtcgtcgttgacgatctgctgcccatctag

SEQ ID NO: 14247 - DNA, 369 bp, Artificial Sequence
  Description of Artificial Sequence: Synthetic coding sequence
atgtcggaagagattattacccccgtttactgtaccggcgtttccgcccaggttcagaagcagagagctcgggagctgggccttgggaggcacgaaaacgctattaagtatctgggacaggattacgagcaacttcgggtgagatgcctgcagagcggaacactcttccgtgacgaggctttccctcctgtcccccagtctttaggctacaaggacttgggccccaatagctcaaaaacctatggcattaagtggaaacgcccgacagaactgctgtcgaaccctcagtttatcgttgacggggctacaagaacggatatctgccagggagcgctcggtgactgttggctgcttgctgccatcgcttag

SEQ ID NO: 14248 - DNA, 192 bp, Artificial Sequence
  Description of Artificial Sequence: Synthetic coding sequence
atgagtgaagaaattattacacctgtctactgtactggcgtctctgcacaggtgcaaaagcagcgtgctagagagctggggctgggacgacatgagaacgctataaagtatctggggcaggactacgaacagctgcgtgtccgctgcctgcagtcaggcaccctgtttcgcgatgaagccttcccgccctag

SEQ ID NO: 14249 - DNA, 2145 bp, Artificial Sequence
  Description of Artificial Sequence: Synthetic coding sequence
atgagcgaggaaattatcactccagtgtactgtactggggttagtgctcaggtgcagaagcagagagcgagagagctgggactgggaagacacgagaacgcaattaagtatttgggtcaggactacgagcaactgagagtccggtgcctgcaatctggcacgctcttccgcgacgaagcttttccaccagtccctcagtccctgggctataaggacctgggaccaaattccagcaaaacgtacggaatcaagtggaagcggccgactgaactgctgagcaaccctcaattcatcgtagacggcgcgaccaggaccgatatctgccaaggagcgctgggcgattgctggctgctggccgctatagccagcctgaccttgaacgatacactcctgcatcgggtggtgccgcatggtcagtcattccaaaatggttatgccgggatctttcactttcaactgtggcagtttggcgaatgggtcgatgttgttgtagacgatttactgccaatcaaggatggtaaactggtgtttgttcacagcgctgagggaaatgaattctggtccgccttgctcgaaaaggcatacgctaaggttaacgggtcctacgaagccttgagtggggggtcaacttcagaaggcttcgaggattttacgggcggagtgactgagtggtatgaattacggaaagcccccagcgatctgtatcagatcattctgaaagccctcgaacggggaagcctccttggctgttcaattgacatcagctccgtgctggacatggaggccattaccttcaaaaaacttgtgaaggggcacgcttactccgttacaggtgccaaacaagtcaattacaggggacaggttgtaagcctgataagaatgcgtaatccatggggagaggttgaatggaccggcgcttggtcagactcctcgtctgaatggaacaacgtagacccatacgaacgggatcagttgcgcgtgaagatggaagatggggagttttggatgtcatttagggactttatgcgggagttcactagactggaaatctgcaacctgacacccgacgccctgaagagccgcaccataaggaagtggaataccacactctacgaagggacatggagacgcggctccacagccggcggctgcaggaactaccctgctaccttctgggttaatccacagttcaaaatcaggttagatgaaacagacgatccagatgactatggcgacagggagtcaggatgtagcttcgtgcttgccctgatgcagaaacataggaggagggagaggcggttcggtagggatatggagacaatcggctttgccgtctatgaggtaccgcctgagctggtcggccagcccgccgtgcacctgaagcgggatttttttttggccaatgcctcccgagcacgaagtgagcaatttatcaacttacgggaggtgtcaacaaggttcagactaccacctggagaatatgtcgttgtgccatcaacctttgaacctaacaaggagggggactttgtgttgaggtttttttctgaaaagtctgcaggtactgtcgagctggatgaccaaatccaggccaatctgcccgatgagcaagtcctgtctgaggaggaaatcgacgagaactttaaggccctctttagacagttagccggggaagatatggaaattagtgtgaaggagctgagaaccatacttaatagaattatctccaaacacaaagatctgcgcacgaaaggcttcagtctagagtcttgccgatccatggtgaatctgatggaccgagacggcaatggaaagctggggctggtggagttcaacatcctgtggaatcgtattcgcaattacctttctatctttcgcaagtttgatctggacaagtcggggtccatgagtgcctacgagatgcgcatggccattgagtcagccggtttcaagctgaacaaaaagctgtatgaattgataataacacggtatagtgaaccagatctagcagtcgatttcgacaactttgtctgttgtttagtccggcttgagaccatgtttaggttttttaaaactctggacaccgacttagacggcgtggttacattcgatctttttaagtggcttcagctgaccatgtttgcttag

SEQ ID NO: 14250 - DNA, 2145 bp, Artificial Sequence
  Description of Artificial Sequence: Synthetic coding sequence
atgtccgaggagattattactccagtctattgcaccggcgtatctgcccaggtacagaaacagcgggctcgcgagctagggctgggccgccacgagaacgcaataaaatatcttggccaggattatgagcagctgcgcgtgcgctgcctgcaatctggcacattgtttcgggatgaagcatttcccccggtgcctcaatcgctcggctacaaggacttaggacccaactcgagcaaaacttatggtatcaagtggaaacggcccacggagctgcttagcaacccacaatttatcgtcgatggggccacacgcaccgacatatgccaaggagcgttgggggattgctggcttttagcagcgatcgcatcacttacactgaacgataccctgctgcaccgagttgtaccacatgggcagtccttccagaacggctacgccggcatctttcattttcagttgtggcagttcggcgaatgggtagacgttgtggtggacgacctactgcccatcaaggacggtaaactggtgtttgtccatagtgctgaggggaacgagttctggagcgccttattagaaaaggcctacgcgaaggtgaacgggagctacgaagcccttagcgggggaagcacgagcgaaggatttgaagactttacagggggggtgacagagtggtacgagcttcggaaggcaccaagcgatctctatcagataatcctcaaggcattagagagaggatctttgctcggttgcagtatcgatatttccagcgttctcgacatggaggctattacttttaagaagcttgtgaagggccacgcctactcggtcaccggagcaaagcaggtgaactatcgggggcaggtcgtcagtctgatcagaatgcgcaacccctggggcgaggtcgaatggaccggagcctggtctgattcatcttccgaatggaataacgtggatccctatgagcgggatcagctccgagtcaagatggaggatggcgaattctggatgagcttcagagacttcatgcgagaattcactcgactggagatatgtaacctgacgcccgatgccctgaaatcgcgaacgattagaaagtggaatactaccctctacgagggcacatggaggcgcgggtcaactgccggcgggtgtagaaactatccagccactttctgggttaatcctcagtttaagattcgcctggacgagacagacgacccagacgactacggcgaccgcgagtccggatgtagctttgtattagccttgatgcagaagcacagaagaagagagcgccggttcgggagggacatggagacgattggatttgctgtatacgaggtcccacctgagctggtcggccagcctgcggtccacctgaagcgagacttcttcttagctaacgcctccagagcacgatccgagcagtttatcaacctccgcgaagtgtccacccggtttcgccttccgccgggcgagtacgtggtagttccgagcaccttcgagccgaacaaagagggcgatttcgttttgagattttttagtgagaagagcgcgggaacagtggaactagatgatcagatccaggccaacctgccagacgaacaggtgcttagtgaagaggagatcgatgagaactttaaagcactgttcaggcagcttgctggcgaagatatggagatcagcgtgaaagagctgagaacaatcctcaacagaatcataagcaagcacaaagacctccgcactaaggggtttagcctcgaatcctgtaggtccatggtgaacttgatggaccgggatggtaatggcaaattagggctggtggagtttaatattctgtggaacagaataaggaattatctgagcatatttcgcaagttcgacctggacaaatccggctccatgtctgcatatgagatgcgtatggctattgaatctgcggggttcaagctaaataagaagctgtatgagctgattataacgcggtacagcgaacccgatttggctgtggatttcgacaactttgtgtgctgcttagttcgcttagagactatgttccgatttttcaaaacactcgacacagatctggacggagtggtcacatttgacctcttcaaatggcttcaactaactatgttcgcctag

SEQ ID NO: 14251 - DNA, 447 bp, Artificial Sequence
  Description of Artificial Sequence: Synthetic coding sequence
atgtccgaggaaatcattacaccagtttactgcacaggcgttagcgcacaggtgcagaagcagagggctcgggaactgggactcgggcggcacgagaacgccataaagtatctcggccaggattatgaacagctaagggtgcgctgcttgcagtcgggtacgctctttcgcgacgaagcctttccccctgtcccacaatctctgggttataaggacctggggccaaactcaagtaaaacctacggaatcaaatggaaaagacctaccgagctcctaagtaatccacaattcatcgtggatggtgctacgaggaccgatatttgccagggtgctttaggcgattgctggttgttagccgctatcgctagcctcacattgaacgatactctgctacatcgagtggtgccacacggacaatcttttcagaacggatatgccggaatatag

SEQ ID NO: 14252 - DNA, 411 bp, Artificial Sequence
  Description of Artificial Sequence: Synthetic coding sequence
atgtccgaggagattataacccccgtctattgcaccggcgtaagcgcacaggtgcaaaaacagcgggcacgtgagcttgggctgggccgccacgaaaacgctatcaaatatttgggccaagactacgagcagctcagagtccggtgccttcagagcggtaccctgttccgggatgaggcatttcctcccgtgccccagagcctgggatataaagacctcgggcctaactcctccaaaacgtacggcatcaaatggaaaaggcctacagagttgctgtctaacccacagttcatcgtcgacggagctactcgcactgacatttgccagggggccctcggcgactgctggctgttggccgccatagcgtcgctcaccttaaatgataccctcctgcaccgggtcgtcccatag

SEQ ID NO: 14253 - DNA, 2103 bp, Artificial Sequence
  Description of Artificial Sequence: Synthetic coding sequence
atggctggcattgcagccaaactggctaaagatcgggaagccgccgaaggcctggggtctcacgacagagccattaaatacctgaaccaagactacgaggcattgagaaatgaatgtctcgaagccggaactcttttccaggacccatcttttcccgccattccctctgcattgggattcaaggagctggggccgtactcttcaaaaactagaggtatcgagtggaaacgccccactgagatttgtgctgacccccagtttatcatcggaggtgccacaaggactgatatatgtcagggcgccttaggggattgttggctgctcgcagccattgccagcctgaccctcaatgaagagatccttgcacgagtggtgcctctcaatcagagttttcaggaaaattacgcaggcatttttcactttcaattctggcagtatggagagtgggttgaagtggttgttgatgatcgactgccgactaaagatggcgagcttctgttcgtacattctgccgaaggatccgaattttggagtgccctgctggagaaggcttatgcaaagattaatggttgctatgaagccctcagtggcggtgcgacgactgaaggatttgaagatttcaccggaggcatcgccgagtggtacgagctgaaaaaaccacccccaaacttgttcaagatcatacaaaaggctctccagaaaggcagcctgttaggctgttccatagatattacttcagcagctgattcagaagccattacatttcagaagctggtcaagggccatgcctatagcgtaaccggtgcagaggaggtggagagtaacggctccctacagaagcttatcaggatccggaatccatggggtgaggttgaatggactggcagatggaatgataactgccccagctggaataccatcgatccagaggaacgcgagcgcctaacccggaggcacgaggatggggagttctggatgagcttcagcgacttcttacgccactattctcggctagagatctgcaatcttacacctgataccctcacgtctgacacatacaagaagtggaaactcaccaagatggacggtaattggcgacgtgggagcaccgcagggggctgcagaaactatcccaacacgttttggatgaaccctcagtatctcattaaattagaggaagaggacgaagatgaagaggacggggagagtggatgtacctttctggtcggcttgatccaaaagcacagaagacgccaacgcaagatgggggaggatatgcacacaatcgggtttgggatctatgaagtccctgaggagttgtcaggacagaccaatatccatttatctaaaaacttctttcttaccaaccgagccagggagcggtccgatacttttatcaacctccgggaggtgctcaacaggttcaagctgcctcctggcgagtacatcctggtcccttccacattcgagccaaataaggacggtgacttttgcatcagagtgttctctgaaaaaaaggcagactatcaggcagtcgacgatgagattgaggccaacctggaagaatttgacatatccgaagatgatatcgacgacgggtttagaagactgtttgcccagctggctggcgaagatgccgagataagcgcctttgaactacagactatactgcggcgggtactggccaaaaggcaagacatcaagtccgacgggttttctatagagacctgcaaaatcatggtggacatgctcgattccgatggatcgggcaaactcggcctgaaagagttctatatcctgtggacaaagatccagaagtaccagaagatctacagagaaattgatgtagaccgcagcggaaccatgaactcttatgaaatgcgcaaagcattggaggaggccgggttcaaaatgccttgtcagttacatcaggtgattgtggctcgttttgctgatgaccaactaattatcgattttgacaatttcgtcaggtgcctagtgagactggagaccctgtttaagattttcaaacagctcgacccggaaaacacaggaactattgaactcgaccttatctcttggttgtgcttcagcgtcttgtag

SEQ ID NO: 14254 - DNA, 2190 bp, Artificial Sequence
  Description of Artificial Sequence: Synthetic coding sequence
gccccaggcccaggcagagccccagccgagcgcagtgcagaatccccaaggcccttctcagctcagtatggcagaagggacagatccatggcgggaattgcggccaagctggctaaagatcgcgaagccgcagagggcctggggtctcacgatagggccatcaagtacctgaaccaggattacgaagcattgagaaacgagtgcctagaggcaggaacactgttccaagacccctctttcccagctatcccatcggctctgggctttaaagaacttggcccttacagttctaagactcgcggcatcgaatggaagaggccaaccgagatttgtgccgatcctcagtttatcatcggcggagccacaagaacagatatttgtcaaggcgctctgggggattgttggttattggccgctattgcttcgcttaccttaaatgaagaaattctggctcgtgtggtaccactgaaccaaagctttcaagaaaattatgcaggcattttccactttcaattctggcagtatggagaatgggtggaggttgttgtggatgatcgtctcccaacaaaggacggagaactcttatttgttcattctgctgagggcagcgagttttggtcagccctgcttgaaaaggcgtatgcgaagataaacgggtgttacgaggccctgtccggtggcgctactacggagggttttgaggacttcaccggtgggatcgccgagtggtatgaattgaagaagcctccccccaacctattcaagattatccaaaaggctctgcagaagggttctttgctcggatgtagtatagacattacaagcgccgccgacagcgaggccattacattccagaagctcgtaaaagggcatgcgtactccgtgaccggggccgaggaagtggagtctaacggttcccttcagaagctgatccggattcggaacccatggggagaagtggaatggacagggagatggaacgacaattgcccgtcttggaatacaatcgacccggaagagcgagagaggctcactcgtcgacacgaggatggcgaattttggatgtcctttagtgatttcctgcggcactatagtagactcgagatctgcaatctgaccccagacaccttgacaagtgacacttataagaaatggaagctcacgaaaatggatgggaattggcggcgcggaagtacagctggcgggtgccgtaattaccctaacaccttctggatgaatccgcaatatctgatcaaactggaggaagaggatgaagacgaggaagacggcgagtctggctgtacatttttggttggactcattcagaaacaccgcagaaggcagcggaagatgggcgaggacatgcacacaatcggctttggcatctacgaagttcatccacagctttcagggcagacaaatatccacttgtcaaagaacttcttcctgaccaacagggcgcgtgagagaagtgatacctttattaacctgagggaagtgcttaaccgcttcaaactgcctcctggagagtacattcttgtaccaagcacattcgagcctaacaaggatggcgatttctgcatcagggttttcagcgagaaaaaggccgactatcaagctgtggacgacgagatcgaggccaatctcgaagaatttgacatcagcgaagatgacattgatgacggttttcgccgattgttcgctcagcttgccggtgaggacgccgaaatttcagccttcgaacttcaaacaatcctgagacgagtgctagctaagaggcaggacatcaaatcagacggttttagcatcgagacctgcaagatcatggtagacatgctggactctgatggctcggggaagctcggacttaaagagttttatatactttggactaagattcaaaaataccagaaaatataccgcgaaattgatgtggatcgtagcgggaccatgaactcttatgaaatgaggaaagccctggaagaggcaggattcaaaatgccatgtcaacttcaccaggttatagtggcaaggtttgcagatgatcaactaatcatcgatttcgacaatttcgtgaggtgtctggtgcggttagaaacattgttcaagatattcaagcaactggacccagagaatactggaacgatcgagctggatctaatttcctggctatgctttagcgttctgtag

SEQ ID NO: 14255 - DNA, 1869 bp, Artificial Sequence
  Description of Artificial Sequence: Synthetic coding sequence
atggaaatctgcgccgacccccagtttatcatcgggggggccactagaacagacatttgccagggcgccctgggtgactgctggctgcttgcagcgatcgccagcctgaccctgaacgaggagatcctcgcaagagtcgtcccgctaaaccagtctttccaggaaaactatgccgggatcttccatttccagttctggcagtacggcgagtgggttgaggtggtagtggacgaccgactgcccaccaaagacggggaactgctgttcgttcacagcgcggaaggctctgaattctggagcgcgctgctggaaaaagcatatgccaaaatcaatgggtgttatgaggcactgagcgggggcgctacaaccgaaggcttcgaagacttcacggggggcatcgccgaatggtacgaactgaagaagccacctcccaatctcttcaagatcatccagaaggccctgcagaaggggtccctgttaggctgttcaattgatataaccagtgccgcggactcggaggccataacatttcaaaaactggtcaaaggacacgcatattcggtgactggcgctgaggaggtggagtctaacggaagcctccagaagcttattagaatcaggaatccctggggggaagtagagtggaccggccgttggaacgataattgtccatcatggaacaccatagaccccgaggaacgcgaacggctcactcggaggcacgaggacggcgagttttggatgtctttctcggacttcctgcggcattactcaaggctggagatctgtaaccttacccctgacaccctcaccagtgatacctacaagaaatggaaattaacaaagatggacggcaactggaggcggggttcaactgccggagggtgcaggaactacccaaatacattttggatgaatccccagtatctgataaagctcgaggaggaagacgaggatgaagaagacggcgagtccggctgcacatttctggtgggattaatccagaagcatcgaaggcgtcagaggaaaatgggggaggatatgcatactattggcttcggaatttacgaggtcccagaagagctttctggacagaccaatatacatcttagcaaaaactttttcctgaccaaccgagctagggaaaggtcagacacgtttatcaacttgcgcgaagtgttgaatcgtttcaagttgcccccaggggaatatatcctggtccccagcacatttgagcctaacaaggatggcgacttttgcattagagtgttctccgagaaaaaggcggactaccaggcagtggatgatgagatcgaagccaacttggaggaatttgatataagcgaagacgacatagatgatgggttcagacggttgtttgctcagctggcaggagaggacgcagagatctctgccttcgagctgcagacaatcctccgtagagtcttagcgaagagacaggatatcaagagcgatggcttctctatcgaaacctgcaaaataatggtggacatgctagattccgatggtagcgggaaattaggactgaaggaattctacatactgtggaccaagattcagaaataccagaagatctacagagagatcgatgtcgatcggtctgggaccatgaacagctacgagatgcgaaaggccctggaggaggcaggtttcaagatgccttgccagttgcatcaggtgatcgtcgctcgcttcgccgacgatcaactgattatagattttgataatttcgtgaggtgcttggtccgactggagacactcttcaagattttcaagcagctggaccccgagaatactgggacaattgaattagacctcatatcatggctgtgctttagtgtcttgtag

SEQ ID NO: 14256 - DNA, 396 bp, Artificial Sequence
  Description of Artificial Sequence: Synthetic coding sequence
atggagatatgtgctgatccccagttcattataggcggagctacccgtacggacatctgtcagggagcactgggagactgctggcttttagctgccatcgccagtctcacactgaacgaagagattctggcccgcgtagtccctctgaaccagagctttcaggagaattatgctgggatcttccacttccagttctggcaatatggcgagtgggttgaagtcgtcgtcgatgataggctgccaacaaaggatggcgaactgctgttcgttcactcggcagaaggaagtgaattttggagcgcactcttagaaaaggcctacgctaaaatcaacgggtgctacgaggcactgtctggcggagccaccacagaaggctttgaggatttcacaggatag

SEQ ID NO: 14257 - DNA, 156 bp, Artificial Sequence
  Description of Artificial Sequence: Synthetic coding sequence
atgaaaaatcgtgaggccgctagggaatgccgcagaaagaaaaaggaatatgtgaagtgcctggagaacagggtcgcggttctcgaaaaccagaataaaactctaattgaggaattgaaagccctgaaagacttatactgccacaagagcgattag

SEQ ID NO: 14258 - DNA, 984 bp, Artificial Sequence
  Description of Artificial Sequence: Synthetic coding sequence
atgactatggagtcgggagctgagaaccagcagtctggcgatgctgctgttacagaggccgagaatcaacagatgacagtccaggcccaaccgcaaatagccacccttgctcaggtaagcatgccagcagcccacgccacatcctcagcccctaccgtgaccttggtgcagttgcctaacggacaaacggtacaggtacatggggtgattcaggctgctcagccgtctgtgattcaatccccgcaggtacagactgttcaaatctccactatagctgagagcgaagactcgcaggaaagcgtggactctgtaaccgattctcaaaaacgccgggaaatactaagcaggcgtccaagctacagaaaaatactcaacgacctttcctcagatgctcccggagttcccaggatcgaggaggaaaaaagcgaggaagagacaagtgcccccgctatcacaaccgtcactgtgcccactcctatttatcagaccagttccggacagtacattgccatcacgcaaggcggagcaattcagctagccaataatggcacggatggagtacagggcctccagaccctaactatgaccaatgcagcagctacacagcccgggaccaccattctgcagtacgcccagacgacagacggccagcagattcttgtgccttctaaccaggttgttgtacaggccgcctccggagatgttcagacctatcagatacgcaccgcacctacgagcactattgcaccaggtgtggtgatggcttcatccccagccctgcccacccagccggccgaagaggctgcccggaaaagggaggtccgactgatgaagaatcgggaggcggcaagagagtgcagaagaaagaaaaaagagtatgtaaagtgcctggagaatagggtggcagtccttgaaaaccagaacaaaaccctgatcgaggagttgaaagctttgaaagacctgtattgccacaagagcgactag

SEQ ID NO: 14259 - DNA, 693 bp, Artificial Sequence
  Description of Artificial Sequence: Synthetic coding sequence
atgaccatggagtcaggggctgagaaccaacaaagtggggacgcggccgtcacagaagccgaaaaccaacaaatgacagtccaagctcaaccccagattgccacattggcccaggtgtctatgcctgcagcccatgccacaagctccgctcccactgtgaccctcgtccagttgcccaacggccaaacagttcaagtccatggagtcatccaagccgcccagccctccgttatccagagcccccaggtacaaactgtgcagtccagctgcaaagacttaaaacgtttatttagcgggactcaaatctcaaccatcgccgagtcggaggattcacaggagtcagtggactctgtgactgacagccaaaagaggagagaaattctctccaggcgcccatcttatcgcaagatattgaacgacctgtcctctgacgcacccggcgtgcctaggatcgaagaagaaaaatctgaagaagagacctccgcactgcccacccagccagctgaggaggccgctaggaagagggaagtgcgtctgatgaagaacagggaggctgccagagagtgtcggcggaagaaaaaggagtatgttaagtgtttggagaaccgcgtggcggtgctcgaaaatcagaacaagacgctcatagaagagctaaaagctctgaaagacttatattgccataaatcagattag

SEQ ID NO: 14260 - DNA, 240 bp, Artificial Sequence
  Description of Artificial Sequence: Synthetic coding sequence
atgacgatggagagcggagccgagaaccaacaaagcggggatgccgctgtaacagaagcggagaaccagcagatgactgtgcaagcccagccccagatcgctactctggcacaagtatctatgcccgctgctcacgccacttccagcgcccccacggtcacattggttcagcttcctaacggacagactgtgcaagtgcatggggtgattcaggccgcacagccttccgtgatccaatag

SEQ ID NO: 14261 - DNA, 984 bp, Artificial Sequence
  Description of Artificial Sequence: Synthetic coding sequence
atgactatggagtctggagcggagaatcaacagtcgggcgatgccgcagtgacagaggccgagaaccagcaaatgaccgtgcaggcgcaaccgcaaatcgctacattggcccaggtctcgatgccggctgctcacgccacaagttcagcccctacggtcaccttagtgcaactgcctaatggacagactgtgcaggtgcacggggttatccaggcagcacaaccttccgtgattcagtcgccccaggtacagactgttcagatctctaccattgctgagtcggaagactctcaggaaagtgtggacagtgtaacggatagtcagaaaagaagggaaatcctgtcacgtaggccttcttatcgaaaaatcctgaatgatctgtcttctgacgcgcccggggtgcctaggatcgaggaggaaaaaagcgaagaggagacctctgctccagctattaccacagtgactgtgcccacacctatctatcaaacaagttccggtcaatacattgcaatcacacaggggggcgctatacagctggcgaacaacggaacagacggggtccagggcctgcagactctgacgatgacgaatgccgccgcaacacagcctggtaccaccatcctccagtacgcacaaacaactgacggtcagcagatcttggtgccaagtaaccaggtcgtggtgcaagctgcctcaggtgacgtacagacgtaccagatacgaactgctccgacgagcacaattgcccccggggtggttatggctagtagccccgctcttcctactcagccggcagaagaagctgcccggaaacgggaagtgaggctcatgaagaatagggaagccgctagagaatgcaggaggaagaaaaaagagtacgtcaagtgtcttgagaatagggttgctgtgctcgaaaatcagaataaaaccctgattgaggaactcaaggccctcaaagacctgtactgtcacaaatctgactag

SEQ ID NO: 14262 - DNA, 1026 bp, Artificial Sequence
  Description of Artificial Sequence: Synthetic coding sequence
atgaccatggagagtggagccgaaaaccagcagtcaggagacgccgccgtcactgaagccgaaaatcagcagatgaccgttcaggcgcagccccagatcgccacactagcccaagtctcaatgcccgcagcgcatgcaacttcgagtgccccaacagttaccctggtgcagttgccaaatggccagaccgtccaggtgcatggggtgattcaagctgctcagccttctgtgatccaatctcctcaggtccagactgtgcaatcaagctgcaaggatctgaagaggctcttctccggtactcaaatttcaacaatagcagagagcgaggattcccaggaatcagttgactcagtcaccgattcacagaagcgtcgagagatactttcccggcggcccagttaccgaaagattctaaacgatctgagttccgacgctcctggtgtgccgcgaatagaggaagagaaatccgaggaagaaacatctgcacctgccatcactactgtgaccgttcccacccctatttatcagacgtcatctggacagtacattgcgattacacagggcggcgcaattcaactggcaaataacggcacagatggcgtccagggtctgcagacccttacaatgactaatgcagccgcgactcagcctggaactactattttgcagtatgcccagaccacagacggtcagcagattctcgttccttcaaatcaggtcgtggtgcaggcagccagcggcgatgtgcagacttaccagatcaggaccgcccccacctccactatagcccctggggtggtcatggctagctcccccgccctgcccactcaacccgcagaggaggcggccagaaaaagagaagtcagacttatgaaaaatagagaagctgcccgtgagtgccggcgaaagaaaaaagagtatgtcaaatgcctggagaaccgagtggcagttctggagaaccagaacaagactctaatcgaggaattaaaagctcttaaagacctatactgccataagtccgactag

SEQ ID NO: 14263 - DNA, 549 bp, Artificial Sequence
  Description of Artificial Sequence: Synthetic coding sequence
atgaccatggagagcggtgccgaaaaccagcagagtggcgacgccgcagttacagaggccgaaaatcagcaaatgactgtccaggcacagcctcagatcgctacgctagctcaggtttccatgcctgcagcccatgccacgtcatctgcccccacggtgacactcgtccagctgcccaatggccagacagtgcaggttcacggcgtgatccaagcggctcagccgtccgtcatacaatcccctcaggtgcagaccgtacagtcctcttgcaaggacttaaaacgactattcagtggcactcagatttccaccattgctgaatccgaggattcccaagagtcagtggatagtgtgactgactcccagaaacgacgcgaaatcctctccagacggccctcttacaggaaaattttgaacgatctaagttcagacgctccgggagtaccgagaattgaggaggagaaatccgaagaggagacctcagctcctgctatcactactgtgacggtccccacccccatttatcaaactagcagcggccagtactag

SEQ ID NO: 14264 - DNA, 399 bp, Artificial Sequence
  Description of Artificial Sequence: Synthetic coding sequence
atgacaatggaatcaggtgccgaaaaccagcagtctggggatgccgctgttacagaagccgagaaccagcagatgaccgtacaggcgcaaccccaaattgccactttggcccaggtgagcatgcctgctgcacacgctacgagctccgctcccaccgtgaccttagtccagttgcccaacggccagactgtacaggtccatggggtcattcaggcggcgcaaccatctgtgatccagagtcctcaagtccagacagtgcagtcatcatgtaaggatctgaagaggttgtttagtggcacacagatcagcactatagcagaaagtgaagattcccaggagtcggtggactccgtgacggacagccaaaaacgccgcgagatcttgtcaaggaggccttag

SEQ ID NO: 14265 - DNA, 705 bp, Artificial Sequence
  Description of Artificial Sequence: Synthetic coding sequence
atgactatggagtctggagccgaaaaccagcaaagcggggatgccgcagtgacagaagccgaaaaccagcagatgacagtgcaggcccagcctcagattgctacccttgcccaggtgtcaatgccagccgctcatgccaccagtagcgcccccacagtgacgctcgtgcagctcccaaacggccagaccgtgcaagtgcacggagtgattcaggctgcgcaacctagtgtgattcagagtccccaggttcaaactgttcagatttcgactatagccgaatccgaggactcacaggagagtgttgattccgtgactgacagccagaagaggcgtgagatcttatcccgtcggccatcttatcggaagatactgaacgatctctcgtcagatgctcctggcgttccacgcatcgaagaagagaaaagcgaagaggaaacatcagcacctgccattaccaccgtgactgtgccaactcctatctatcagacttcctctgggcaatacatagcgattacccaaggtggggccatccagctggcaaacaatggtacagatggggtgcaggggctgcagactttgaccatgaccaacgcagctgccacacaacctggcaccacgatccttcaatatgcccagaccacggacggccaacagattctagtgccctccaatcaagtggtagtgcaagggacccagaaattatag

SEQ ID NO: 14266 - DNA, 462 bp, Artificial Sequence
  Description of Artificial Sequence: Synthetic coding sequence
atgccagctgcccacgccaccagcagcgcccccactgtgacgctagtgcagttgccaaacggccagacagtgcaggtccacggtgtgattcaggccgcacagccaagcgtgattcagagcccccaagtgcagactgtacagagctcatgtaaagatttgaaacgcctgttctccgggacgcagatctccacgatcgccgagtcagaggatagccaggagagcgttgattcagttactgacagtcagaagaggcgggaaattttgagtcggaggccttcttatcgcaaaatcctcaatgatctcagtagcgatgctccaggagttccccgtatagaagaggagaagtccgaagaagagacttcggcccccgcaattacaacagtgacggttcccaccccaatctatcaaactagttccggacagtatacctatctccgagataccacctacagttgccagtag

SEQ ID NO: 14267 - DNA, 1998 bp, Artificial Sequence
  Description of Artificial Sequence: Synthetic coding sequence
atggcccacgagatgatcgggacccagatcgtgacagagagactcgtggcccttctggagtccggaacagaaaaagtgctgttaattgactctcggccctttgtggagtacaatactagtcatatccttgaggcaatcaacataaattgttccaagctgatgaagcgtagacttcagcaggacaaagtcctcatcactgagctgatccagcatagcgcaaaacacaaagtagacatagattgctcccaaaaggttgtcgtctacgaccaatcatcccaagatgtggcttctctctcttcagactgctttctaacagtcctgctgggaaaactcgagaaatcgtttaactctgtgcatttgctagctggagggtttgcggagttttcccggtgcttcccaggcctctgcgagggcaagagcacactggtgcccacgtgcattagccagccttgcctcccagttgccaatatcgggcccacaaggatcttgcctaatctctaccttggttgccaacgcgatgtgttaaacaaggagttgatgcagcaaaatggtattgggtacgtcctgaatgcctctaatacctgccccaagcccgactttattcccgagtcccatttcctgcgcgtgcccgtcaatgattcattttgcgagaagatcctcccttggctggataagagcgtcgattttattgagaaagccaaagcctccaatggctgcgtgctggtccactgcctagctggcatctctagatctgccaccattgcaatagcatatatcatgaagagaatggacatgtcattggatgaagcttacaggtttgtgaaggaaaagcgacctaccatctcccctaattttaactttctgggccaactgctagactacgaaaaaaagatcaagaatcagacgggtgccagcgggcccaaaagtaagttgaaactgctgcacctggaaaagccaaatgaaccagtcccagctgtgagtgagggcggccaaaaaagtgaaacacccctgtctccaccatgtgcggactccgctactagcgaagctgctggtcaaagacccgtgcatccagcatccgtcccctcagtgccttcagtgcaaccctccctccttgaggattcccccctggtgcaagctctcagcggccttcacttgtcggccgatagactagaagatagcaacaagctgaagcgatccttttccttagatatcaagagcgtctcctactcagccagcatggcggcctccctacatggattctcgtcatcagaggacgccctggaatactacaagcctagcacgactctcgatggcacaaacaagctctgccagtttagtcctgtgcaagagctctcagaacagacgccagagacttctcctgataaagaggaggcttcgatcccaaagaagttacagacagcgaggcccagcgactcacagtccaagcggttgcattctgtccgtactagttcaagcggaaccgcgcagcggagcttgttatcccctctgcataggagcgggtctgttgaagacaattatcacacttcattcttatttggcttgtcaaccagccaacaacacctgaccaagtccgccggactgggtttaaagggatggcacagtgacattttagctcctcagacgagtacaccttccctaacctcctcttggtactttgccacggagagctcgcacttttactccgcctctgccatatacgggggtagcgcatcttactctgcctattcatgctctcaactccccacgtgtggggaccaagtgtatagcgtgaggaggagacagaaacctagcgatcgggctgactctcgccgatcctggcacgaagagagcccatttgagaagcagtttaagcggcggtcttgccagatggagtttggtgagtctatcatgtcggaaaaccgctctcgggaggagctcggcaaagtaggatcccaatcctcattcagcggctccatggaaatcatcgaggtgagttag

SEQ ID NO: 14268 - DNA, 939 bp, Artificial Sequence
  Description of Artificial Sequence: Synthetic coding sequence
atgcgcatgctgctcgccctgctggccctcagcgcagcccggcccagcgcttccgccgagtctcactggtgttatgaggtacaggctgagtcatctaattacccatgcctggtgccagtcaagtggggcggcaattgtcagaaagatagacagtctcccatcaacattgtgaccaccaaggccaaagtagataagaagttaggacggttcttcttttccggttacgacaagaaacaaacctggacggtgcagaacaatggccactctgtgatgatgttactggaaaacaaggcatcaatatcaggtggaggactcccagcgccttaccaagcaaaacagctgcacttgcactggagtgacttaccctacaaggggtcagagcattcacttgacggggagcatttcgctatggaaatgcatattgtccacgagaaagaaaagggaacttcacggaacgtgaaagaggctcaagatcctgaagatgaaatagccgtcctggcctttttggttgaagccggcacccaggtgaatgaaggcttccagcctttggtggaagccctgtccaatatccctaagccagagatgagcaccaccatggcagaatcttccttgctggatctgttacccaaggaggaaaagcttcgtcactattttaggtacctggggtcgctgactacacccacttgcgacgagaaagtggtgtggacagtcttccgtgaacccattcagctccaccgggaacaaatcctggcattttcacagaagttgtactacgacaaggagcagactgtgagcatgaaagacaacgtgcgacccttgcagcaactgggacagaggactgtcattaagtcaggggcgccaggccggcccctaccttgggcactgcccgcccttctcggacctatgctcgcctgtctgctcgcaggcttcctgcggtag

SEQ ID NO: 14269 - DNA, 1380 bp, Artificial Sequence
  Description of Artificial Sequence: Synthetic coding sequence
atggccccgttatgccctagcccatggcttcccctgttaatccctgctcccgctccgggccttactgtccaattgctccttagcctccttcttctggtgcccgtccatccccagcgactgccccgcatgcaggaggactctccccttgggggtgggtcgtctggcgaagacgaccccctcggcgaagaggacctgccatctgaagaggacagtcctagggaggaggaccccccaggggaagaagatctgcctggagaggaggacctgcccggagaggaggacctgccagaagtgaaaccgaagtctgaggaggaggggagcctcaagctggaagacctcccgaccgtggaggcccccggagatccacaggagcctcagaataatgctcacagagacaaagagggcgacgatcagtcacactggcggtacggaggcgaccctccgtggccacgagtgtcccccgcctgtgcaggccgattccagagtcccgtcgatatccggcctcaactggccgcattctgcccagctctgaggccgcttgagcttctgggctttcaactccctcctctccctgagttgcgcttgcgtaataatggacacagtgtccagctgaccctccctccagggctggagatggccctggggcctggccgtgagtatagggccttacaactgcacttgcattggggcgcagctggcaggcctgggagtgagcatacggtggagggacaccggttccctgcagagattcacgtggttcacctttcaaccgccttcgccagggtggacgaagcactcggaagaccaggaggcctcgccgtgcttgccgctttcttggaagagggacccgaagagaattcagcgtacgaacagttgctgtctagacttgaagagatcgccgaagagggtagcgagacccaggtgcccggcctggacatatcggctctgctgccgtccgactttagcaggtactttcagtatgaaggatcactgaccacccctccttgcgcgcaaggagtgatctggacagtcttcaaccagacagtaatgctcagcgcaaaacagctgcacacattaagcgacaccctctggggcccaggcgacagtcgcctgcagctcaattttcgagcaacacagcctctcaacggccgtgttattgaggcaagcttccctgcaggtgttgattcgtctccacgtgcagccgaaccagtgcagctgaattcttgcctcgctgctggagacatcctagcccttgtgttcggacttctgttcgccgtaacttctgtggcttttctggtacaaatgcgcaggcagcataggagaggaacgaaaggcggcgttagttacaggcccgcagaagtggccgagactggggcatag

SEQ ID NO: 14270 - DNA, 1071 bp, Artificial Sequence
  Description of Artificial Sequence: Synthetic coding sequence
atggctccattatgtcccagtccctggcttccgctgttgatccctgcccctgcccccggactgacagtgcagttgctcttatcccttctgttgctggtgcccgtgcacccccagcggctgccaaggatgcaggaggactcaccactaggcggcggctcgtctggggaggatgacccgttgggtgaagaggacttgccttctgaggaggacagccctcgagaggaagatccccctggcgaagaggacttgcctggagaggaagacctgccgggggaggaggaccttcctgaggtcaaaccaaagagcgaagaagaagggagtcttaaactggaggacttgcccaccgttgaggctcccggcgaccctcaggaacctcagaacaatgctcaccgtgacaaggaaggagacgaccagtcacattggcgatacgggggcgatccgccatggcctcgtgtcagtcctgcctgtgcggggaggttccagtctcccgtggatattcgtcctcaattggccgccttctgcccggcgctgcggccactggaattactcgggtttcaactcccacccctgccagaactgcgcttaaggaacaacggccatagcgtacagttgaccttgcctcccgggctcgaaatggcactcggtccaggaagagaataccgtgccttgcagctgcatttacactggggtgccgcaggcaggcctgggagcgaacataccgtggaaggacaccggttccctgccgagattcatgtggtccacctgagcaccgcttttgccagagtagatgaggctttgggacggccaggcgggttagctgtgctggctgcatttctggaagaaggccccgaggagaattctgcttacgagcagttgctatcccgccttgaggaaatcgctgaggagggttcagagacccaagtacctggtctggatatctccgctctccttccatccgacttctctagatactttcaatacgagggctctctgaccacgcccccatgcgcacagggtgtgatatggactgtcttcaatcagaccgtgatgctgtccgcaaagcagtcctag

SEQ ID NO: 14271 - DNA, 2775 bp, Artificial Sequence
  Description of Artificial Sequence: Synthetic coding sequence
atgcccggcccctcgccaggactgaggcgggccctgctcgggctctgggcagcactgggccttggactctttggactatccgccgtctctcaggagcccttttgggcggatctgcagcctcgtgtggcttttgtggagcggggaggcagcttgtggcttaattgcagcactaactgtcccagaccagaacgtggtggcctcgaaacgtctttgagacgcaacggaacccaacgaggcttaagatggttggcacggcagctggtggacatccgcgaaccggagactcagcctgtgtgttttttcagatgtgccaggaggactctccaagccaggggcttaatcaggactttccagagaccagaccgggtggagctgatgccccttcccccatggcaaccggtcggtgaaaatttcactctgtcatgtagagtacctggtgctgggccacgagcttctctgaccttaacacttctgaggggggcacaagaactcatcagacgctcatttgcgggcgagccgccacgggcacggggagctgtgctgactgccaccgtcttagcgcgcagggaagatcacggcgcaaacttcagttgcagagccgagctggatttaagaccacatggcctcggactgttcgagaacagctcagccccccgggagctcaggacgttttccttgtccccggacgccccgaggctcgccgctcctaggctgcttgaagtgggcagtgagagacctgtgagctgcacactggacggcctatttcctgcgagtgaggcccgggtttatttagcactcggggatcagaacctgtcccccgatgtcacactggagggggacgcctttgttgcaacggcaacagctactgcaagtgctgagcaggagggtgcaagacaactggtctgcaatgtgactctgggaggcgagaacagggagactcgtgagaacgttacgatatacagttttcctgccccactgttaaccctaagcgagccatctgtgtccgagggtcagatggtgacggtaacatgtgctgctggagctcaagccctagtgactttagagggagttccagctgcggtgccagggcagcccgctcagcttcaactcaatgcaaccgagaacgatgatcggcggtcctttttttgcgatgcgactttagacgtggatggagagactctgattaaaaacaggtcagccgaactgcgggttctgtatgccccgaggctggatgacagtgactgcccgcggagttggacttggcctgagggccccgagcagacgcttaggtgcgaagccagaggaaaccccgaaccttctgttcactgtgcaaggtctgacgggggagcagtcctggcgctcgggcttttggggccggtgactcgtgcactgagcggaacgtatcggtgcaaagctgccaacgaccagggcgaggctgtcaaggatgtgaccctgacggtggaatacgccccagccttggactccgtgggatgccccgaacgaattacctggctcgagggaaccgaggcgtcattatcttgtgtggcccacggggtgcctcccccagacgtcatctgtgtgcggtccggtgaactgggggctgtgatcgaaggtttactaagagtggcccgggagcacgccggcacctaccggtgcgaggccacaaatccccgggggtctgcagccaaaaacgtggcagtgaccgtagagtacgggccacgatttgaagaaccaagctgtccatcaaactggacttgggtggagggaagcgggcgcctcttcagctgcgaggttgacggcaaaccgcagccatcagtaaagtgcgtgggcagtgggggcgcgacagagggagtgttactccccctcgctcccccggatccctccccccgggccccccgcatcccacgagtgctggcccctggtatctacgtctgcaatgccactaacagacacggcagcgtggccaagactgtagttgtcagcgccgagtcaccacccgaaatggatgagtctacctgcccatcccaccagacctggttggagggagccgaagctagcgccctggcctgtgccgcgcggggcagaccctcccccggagtgagatgctccagggaagggatcccttggcccgagcagcagcgcgtgagtcgtgaggacgcaggcacataccattgcgtagcgactaacgctcatggtaccgacagtagaactgtaaccgttggagtagagtaccggcctgtcgtggccgaactggcagcttctccgcccgggggggtgagaccaggaggaaattttaccctgacttgcagggctgaagcatggcctccagcccagatctcgtggcgggccccacccggagcactaaatattggtctgtcttccaataactcgaccctctccgttgccggggccatgggatcgcacgggggcgagtatgaatgtgcagccaccaatgcccacgggcggcacgcgcgacgcatcactgtgagggttgctggaccctggctatgggttgctgtcggcggcgccgccggtggagccgctttgctcgcagccggcgctggtcttgccttctacgtccagtctacagcatgcaagaagggggagtacaacgtgcaagaagctgagtcgagcggagaagccgtttgcctgaatggcgcaggcggcggcgccggaggcgcagcgggggccgaaggaggtcccgaggcagccggcggcgccgcggagtctcccgccgagggggaggtgttcgctatccaattgactagcgcttag

SEQ ID NO: 14272 - DNA, 1263 bp, Artificial Sequence
  Description of Artificial Sequence: Synthetic coding sequence
atggaatccccgtcagcacctccccacaggtggtgcatcccttggcagcgcctgttactaacagctagcctgttaaccttctggaacccacccacaactgccaagctcacgatcgaatctacacctttcaacgtggcggagggtaaagaagtgctgttgctggttcacaatctcccgcagcaccttttcgggtactcttggtataagggagagagagtcgatggcaaccggcagattatcggatacgtgatcgggactcagcaggctaccccagggccagcttacagcgggagggagattatatatcctaatgccagtctgctgatccagaacatcatccagaacaagctgtccgtcgatcacagcgaccctgtaatcctgaatgttctgtatggccccgacgacccgactatctccccttcttacacctattatcggcctggcgttaacttgtcgctgtcttgccatgccgccagcaatccccccgctcagtatagctggcttatagatggcaatatccagcaacacactcaagaactgttcattagcaacattaccgagaaaaattctggtctgtatacctgccaggcaaacaacagtgcatcgggccatagccggaccactgttaagacgattaccgtcagtgcagaactgcctaagccgagcatatcttccaacaatagcaagcctgttgaggataaagatgctgtcgcatttacgtgtgaacctgaggcccagaacaccacttacttgtggtgggtgaacggccagtccctacccgtcagtccaaggttgcaactcagtaatggcaatcgcacgctgacattattcaacgtgactaggaatgatgcacgagcttacgtgtgtgggattcagaactccgtgagcgcaaatcgcagcgacccagtcaccctggacgttctctacggccccgacaccccgattattagcccaccggattcaagttatctatctggtgccaatctgaacctgtcttgccattctgcatcaaacccctctcctcagtactcttggcggattaatggaatcccccagcagcacacccaagtgttgttcatcgctaagattactcctaacaacaacggtacgtacgcttgtttcgtctccaacttggcaacaggcaggaataacagcatcgttaaatctattacagtatcagctagcggaaccagtcccggattatcggccggagctacagttggtatcatgatcggagtcctcgtcggggtggctctgatctag

SEQ ID NO: 14273 - DNA, 2109 bp, Artificial Sequence
  Description of Artificial Sequence: Synthetic coding sequence
atggaatccccaagcgcacctcctcataggtggtgcatcccctggcagagactattgctgaccgcatctcttctgacattctggaatccgcccacaacagcaaagctcactatcgagtcgaccccctttaacgtcgccgaggggaaggaagtcctgctgctcgtccacaacttaccacagcatctcttcggctacagctggtacaaaggcgaacgcgttgatggcaatcggcagatcataggatatgtcattggcacacagcaagcgacccccggccccgcctactccgggagagagataatctacccaaatgcctctctcctgatccagaacataattcagaatgacacgggattttacacgctgcacgtgataaagagtgatctcgtaaatgaggaagctactggtcagttcagggtgtaccctgaactgcctaaaccttccatttcaagcaataacagcaaaccggtcgaggacaaggatgccgtggcctttacttgcgaacctgaaacacaggacgctacctatctatggtgggtgaacaaccagagcctgcctgtctcaccacggttgcagctgtccaatggtaaccgaacacttactctgtttaacgttacgcgaaacgataccgcctcttataaatgtgagactcagaacccagtgagtgctagaagatcagacagcgtgatactcaacgtgttgtatggccccgatgcccccacaatttcccccctcaatacctcctacagatcgggtgaaaaccttaatctatcatgtcatgctgcatctaaccccccggcccagtacagctggttcgtcaatggcacctttcaacaaagtacacaggaattgttcatccctaatatcacagttaacaattcagggtcctatacctgtcaggcccacaattccgacaccggccttaatcgcaccacagtgacaaccattactgtgtatgcagagccacccaaaccattcataacctcaaacaactccaatccggtcgaagacgaggatgcggtggccttaacatgtgaaccggagattcagaataccacttatttgtggtgggtaaataatcaatctctgcctgtgagcccaagattacagctgtccaatgataaccggacactgacactgctcagcgttactcgcaatgacgtggggccgtatgaatgtggcattcagaacaagctgtccgtggatcactccgatcctgttatactgaatgtactgtacggacctgatgatccaactatcagtcctagctacacctactaccgcccaggggtgaatcttagcctttcctgtcacgccgcatccaatcctcccgcccagtactcctggttgatcgacggcaatattcaacagcacacgcaagagctgttcatctccaatataaccgaaaaaaattctgggctgtacacttgccaggccaacaatagcgccagtggccattcccgtaccactgtaaagactataaccgtgtcggcagagctgccaaagccaagcatctcatcaaacaattctaagcccgtggaagacaaggacgctgtagccttcacatgtgagccagaggcccagaataccacatacttgtggtgggtcaatgggcagagcctcccagtgtccccccgactgcagttatctaacgggaaccgcactctcaccctcttcaacgtgactcggaacgatgctagggcttatgtgtgtggaattcaaaactccgtgtccgctaaccgatcggatcccgtgactttggatgtgctgtacgggccagatactccaatcatctcaccaccagatagttcatacctttcgggcgccaacctgaacctctcttgtcacagtgcttcaaacccctccccgcagtactcttggcggataaacggaattccacagcaacacacgcaggtgctatttattgcgaagatcactcctaacaacaacggcacatatgcctgcttcgtgtctaatttggctacaggcagaaataattccatcgtcaaaagcattaccgtctctgcaagcggaacaagccccggcctgtctgcaggggccaccgtgggcataatgataggggtgcttgttggcgtggcactaatctag

SEQ ID NO: 14274 - DNA, 1035 bp, Artificial Sequence
  Description of Artificial Sequence: Synthetic coding sequence
atgggaccacccagcgcgcccccatgcagactgcatgtgccatggaaagaggtgttgctgactgcttcactgttgaccttctggaacccccccactaccgcgaagctgactatcgaatccaccccatttaacgtggccgaaggaaaggaggtgttgctgcttgctcacaacttaccacagaaccgcattggctatagttggtacaaaggcgagagggtggatgggaactcacttatagtgggttacgttatcggtacacagcaggcaacccctggacctgcttacagtggaagagaaactatttatcctaacgccagcctcctaattcaaaacgtcactcagaacgacactggtttttacacattgcaggtcattaagtccgacctggtgaatgaagaggccacagggcaatttcacgtataccccgaattgcccaagcctagcattagcagcaacaactctaaccctgtggaagataaggatgccgtcgcttttacttgtgagcccgaagtccagaatactacctacctatggtgggtaaacgggcagagccttccagtctctccccgcctccagctgagcaacggtaatatgactctcaccctactgtctgtcaagagaaacgatgcaggtagttacgaatgtgaaattcagaaccctgcctcagcgaaccggtccgacccggtcacactcaacgtcttatacggccccgacggccccacaataagtcctagcaaagcaaattacagaccgggcgagaatttaaacttgagttgtcatgcagcctcaaaccctccggcccagtatagttggtttattaatgggacctttcagcagtcgacgcaggagctgtttataccgaatatcactgtcaataacagcggctcttacatgtgccaggctcataatagtgcaaccggtttaaacaggacaactgtcaccatgattactgtcagtggcagcgcacctgtgctctctgccgtggccacagttggcattaccatcggggtgctagcacgcgtggctctcatatag

SEQ ID NO: 14275 - DNA, 1977 bp, Artificial Sequence
  Description of Artificial Sequence: Synthetic coding sequence
atggtcccccgcctgctcctgagagcatggccacgcgggcctgccgtggggcccggcgcacccagccgcccactgtccgccgggtccgggcccggccagtaccttcagaggagcatcgtccccacaatgcactaccaagattccctcccacggctgcctattccaaagctggaggatacaatcaggcggtacctcagtgctcaaaagccattactgaacgatggacagtttcgcaaaacagaacagttttgtaagagctttgaaaatggcatcggcaaagagttgcacgagcagcttgtggctctggacaaacagaacaagcacacatcctacatctcagggccatggtttgatatgtatcttagtgcccgagacagcgtagtcctgaattttaatccatttatggcattcaaccctgacccaaaatcagagtataatgaccagctcacacgggccacaaatatgactgtgagcgccatccgcttcctgaaaactttgagggccggactgctcgagcccgaagtctttcacctgaatcctgctaagtctgacacaattactttcaagaggttaattcgcttcgtgccgagctccttgagctggtatggtgcctacctggtgaacgcctatccgctagatatgagccagtactttcgccttttcaactctactcggctccccaaaccctctagggatgagctgttcacggatgacaaagcgcgacacctgttggtgctgcggaaggggaatttttacatcttcgacgttctggaccaggatgggaacattgtttcgccatcagagattcaagctcatctgaaatacatcctgtccgattccagcccagcaccagaatttccattagcatatctaactagcgagaacagggatatatgggccgaactgaggcaaaagctcatgtcatccggcaatgaggaaagcttgcgcaaggtggactccgcagtgttctgcttgtgtctggacgactttcccataaaggacctagtccacctgagccataatatgctgcatggagatggaactaatcgctggttcgataagagtttcaacttaattattgctaaggacggttctacagcagttcatttcgagcacagttggggagatggagtcgctgtgttgcgcttttttaatgaagtcttcaaagattcaacgcaaacaccagccgtgacaccacagagtcagcctgccacaacagactccaccgtcaccgtacagaaacttaattttgaacttaccgatgcgctgaagacgggaatcactgccgccaaggaaaagtttgatgctacaatgaaaaccctgaccatcgactgtgtgcaattccaacgaggtgggaaggagttcctgaagaagcagaagctgagcccagacgcagtcgcgcagctggcgttccaaatggcattcttgcggcaatacgggcagaccgttgccacatatgaaagctgttcaacagcagcctttaagcacggccggactgaaaccattagacctgcttcagtgtacactaaacgatgctccgaagccttcgtgcgcgaaccctcaagacatagcgcaggggaactgcagcagatgatggtggaatgctccaagtatcacggccagctgaccaaagaggccgctatgggccagggctttgacagacacctgttcgctctccgtcacctcgccgccgctaaaggtattatcctgcctgaactgtatctggatccagcctacgggcaaatcaatcataatgtactcagtacttctacactgtcctcgcccgctgtgaatctgggtggcttcgcaccagtggtttccgatggatttggggttggatatgccgtgcatgacaattggatcggctgcaacgtgagcagttatcctggaagaaacgccagagagttccttcaatgtgtggaaaaggcactggaagatatgtttgacgccctggagggcaaatccattaaaagttag

SEQ ID NO: 14276 - DNA, 1077 bp, Artificial Sequence
  Description of Artificial Sequence: Synthetic coding sequence
atgcgcgctacacccttggcggccccagcagggtcactctcaaggaaaaagagattggaattagacgacaatcttgatacagaacggcccgtgcagaagcgggctaggagcgggccacagcctagacttcccccttgtctgctgcctttgtccccacccacggcccctgaccgggcaaccgccgttgctaccgcctccaggctgggaccttacgtacttttagaaccagaggaagggggccgcgcatatcaggctctgcattgccctaccggcaccgaatacacttgcaaggtgtaccctgtccaggaggcactggcggttcttgaaccatacgcacgacttcccccgcataagcatgtagcacgccctacggaggtgttagctggtacacaactgttgtatgccttttttacacgtacacacggggacatgcattctctcgtgcggtctaggcacaggattccagagccagaagctgccgtgctgttcagacagatggccaccgccctcgcccattgtcatcagcacgggctggtcctacgcgacctgaaactgtgcagatttgtattcgccgacagagagcgcaagaagctcgtactagaaaatttagaagattcctgtgtgctgacgggccctgacgactctttgtgggataagcatgcttgccccgcctacgtgggaccagaaatactgagcagccgggcatcatactcaggtaaggcggcagacgtatggtccttaggggtggccctgttcaccatgctcgcgggccactacccttttcaggactcggagccagttctgctgttcggaaaaattaggaggggtgcctatgctctgcctgccggcctctccgcgcccgcgagatgcctggtgcggtgcctgttacggagagaacctgccgagcgcttgacggctaccggaatcctgctccacccctggttacgccaggaccccatgcccctcgcccctacacgctcccatctgtgggaggcagctcaggtcgtgcccgatggtctcggactcgacgaggcgcgggaggaggagggtgatcgagaggtagtcctctatgggtag

SEQ ID NO: 14277 - DNA, 1176 bp, Artificial Sequence
  Description of Artificial Sequence: Synthetic coding sequence
atgtccggacctgtgcctagtagggctagggtttacactgacgtgaatacacaccgtccgagggaatattgggattacgaatctcatgtggtggagtgggggaatcaggacgactatcagttagttagaaagctcggcaggggcaaatacagcgaggtgttcgaggcgattaacatcactaataatgagaaagtggttgtcaaaattctcaagcccgttaaaaaaaagaagatcaagcgggagatcaaaatactcgagaacctgcgcgggggcccaaacattattacccttgcagatatagttaaagatcctgtctccaggactcctgcgttggtcttcgaacacgttaacaacaccgattttaagcaattgtaccaaacattgactgactatgatatccgtttttatatgtatgagatcctcaaggctctcgattactgccatagtatgggcatcatgcacagggacgtgaagccacacaacgtgatgattgaccatgaacataggaaattacgcctgattgattggggattagcagaattttaccacccgggccaggaatacaatgtccgcgtcgcaagtcgctacttcaagggccctgaacttctcgtcgactaccagatgtatgattattccctggacatgtggagcctgggttgcatgctagcctccatgatctttaggaaggaaccgtttttccacggacacgacaattacgatcagctggtgagaattgctaaagtattggggacggaagacctctacgattatatagacaagtataatatagagcttgatcctcgatttaatgacattctgggccgccatagtcgtaagagatgggagcgttttgtgcactccgagaatcagcacctggtttctcctgaagccctggacttcctcgacaaattgctgagatacgaccaccaaagcaggctgaccgcccgagaagcaatggagcacccttacttctacactgtcgtgaaggaccaggctcgcatggggagctcatcaatgcccggcgggtcaaccccagtgtcctctgctaatatgatgtctggaatctctagtgtccctaccccttcgccactcggacccctggcaggctctcccgtgatcgctgctgccaacccactgggtatgccagtcccagccgccgccggggctcagcagtag

SEQ ID NO: 14278 - DNA, 1194 bp, Artificial Sequence
  Description of Artificial Sequence: Synthetic coding sequence
atgagtgggccagttccaagccgagcaagggtctataccgatgtcaatactcatcgacctcgcgaatactgggattatgagtcacatgtagtcgaatgggggaatcaggatgattaccaactagtgcgcaagctcggaagaggcaagtattccgaggttttcgaggctataaacatcacaaacaacgagaaagtcgtcgttaaaattctgaaaccggtgaaaaagaaaaaaatcaagagggagatcaagatattggaaaacctccggggaggccccaacatcattacactggccgatatagttaaggaccccgtttccagaacacccgctctcgtgttcgagcatgtaaataatacggactttaagcagctctaccagactttgactgactatgatatcagattctacatgtacgaaatattgaaagctctggactattgccattccatgggtataatgcacagagacgtaaaacctcataatgttatgatcgatcacgagcatcgcaagctacgcctcatcgactggggactagcagagttttaccatccgggccaggaatataatgttcgagttgcatcgaggtattttaagggacccgagctgctcgtagactatcaaatgtacgattactcattggacatgtggtcccttgggtgcatgctggcatcaatgatcttcaggaaggagcctttctttcatggccacgacaattatgaccagctagtccggattgccaaagtgttaggaaccgaggacctttacgattatatagacaaatataacatcgaactggatccccgatttaacgacattctagggagacattcgagaaagagatgggagagattcgtgcactcagagaatcagcatctcgtgtctccagaggctctggattttctggataagctgctgcgctatgaccatcagagtcgtctgaccgcgcgcgaggctatggagcatccatatttctacactgtcgtgaaggatcaggcccggatgggctcctcctccatgcctgggggctctactcccgttagctccgcaaacatgatgtcaggcatttcaagcgtacccaccccctcccctttagggccactggcaggttcacctgtgatcgccgccgccaatccactgggctgcttgttccagctgcctctgcgcagtgccgttaccgccctgagtgtgtcttag

SEQ ID NO: 14279 - DNA, 768 bp, Artificial Sequence
  Description of Artificial Sequence: Synthetic coding sequence
atgtatgagatcctcaaggcactggattattgtcacagcatggggattatgcaccgagacgtgaaaccccataatgtcatgatagatcacgagcacaggaagctgcgcctcattgactggggcttggccgagttctatcaccccggccaggagtacaacgtcagagttgccagccgatatttcaaagggccggagctgcttgtggattaccagatgtatgactactccctggatatgtggtccctgggttgtatgctggcttccatgatctttcgcaaggagccattctttcatgggcacgataattatgaccagctggtccgcatcgccaaagtactgggaactgaggatctgtacgattacatcgacaagtataacattgagcttgatcctaggtttaacgacatcctgggacgccactcgaggaaacgatgggagcgcttcgtgcactccgagaatcaacacctggtatctccagaagctctggactttctggacaaactgcttagatacgaccaccagagtcgtctcacagcccgtgaggctatggaacacccatacttctataccgtcgtgaaggatcaggcacggatgggctcatcgtcaatgccgggagggtcaacaccagtttcttcagcaaacatgatgtccggtatttcatccgttcctactccatccccattggggccattggctgggagccctgttatcgccgccgcaaatcccctcggaatgccagtccccgcagcagccggagcccagcagtag

SEQ ID NO: 14280 - DNA, 1158 bp, Artificial Sequence
  Description of Artificial Sequence: Synthetic coding sequence
atgtctgggccggtgccttcacgggcacgtgtatatacggacgttaacacgcaccgcccccgtgaatactgggactatgaaagccatgtagtggaatggggcaatcaggacgactatcaattggttaggaagctgggacggggaaaatattcagaagtgttcgaggccattaacattaccaataatgaaaaggttgtggtaaagatcctgaagcctgtgaagaaaaagaaaatcaagcgcgagatcaagattttggaaaacttacgaggcgggcctaatattataacattggctgatattgtgaaagatcccgtttctcggacgcccgctctcgtgttcgaacatgtaaacaacacagacttcaaacagctctatcagacactcaccgactacgatattaggttctatatgtacgagatcctaaaagcgctcgattattgccactcgatgggaattatgcatagagacgttaagccccacaacgttatgatcgatcacgagcatcgcaaactgagactgatcgactggggactagctgaattctatcatcctgggcaggagtataatgtgcgggtcgcatcccgatacttcaagggacctgaactgttggtcgactaccaaatgtatgactacagtctggacatgtggagcctgggttgtatgcttgcatcgatgatcttccggaaggagccattttttcacgggcacgacaattatgaccagctggtccgcattgccaaggttctcggcaccgaggatttgtatgactatatcgataagtacaatatcgagttagatccaagattcaatgatattttaggtcgtcatagtaggaaacgatgggaaaggttcgtgcattccgaaaatcagcatttggtttctcctgaggctttggatttcctggataagctcctccgctacgaccaccagtccagactcacagcgagggaggccatggaacacccatatttttacactgttgtgaaggaccaagcacggatggggtcatcgagtatgccaggagggtctacacctgtgagctctgcaaatatgatgtcagaaatgaagttctgtagagtcgctcaggcaggccttgagctgctgagttcaaccgtatatccaccctggccccccaaggttttgagacttgaagcctag

SEQ ID NO: 14281 - DNA, 1053 bp, Artificial Sequence
  Description of Artificial Sequence: Synthetic coding sequence
atgcctggtcctgcagcgggatcacgggcccgtgtgtacgctgaggtaaactccctcaggagtcgagagtattgggactacgaggctcacgtcccatcctggggaaaccaggatgattatcaactggttagaaaactgggccgcggcaagtacagtgaagtgtttgaagccattaacataaccaacaacgaaagagtggtggtgaaaatcctgaaaccggtaaagaaaaaaaagataaagcgggaagtgaagatccttgagaacctgaggggaggcactaatatcatcaagcttattgatacagtcaaggaccctgtgtcaaagacgcctgctctggtattcgagtacataaacaataccgactttaagcagctgtaccagatcctcactgacttcgatattcggttctatatgtatgagttgttgaaggcactcgactactgtcacagtaaaggcatcatgcaccgagatgttaagccacataatgtcatgatcgaccatcagcaaaagaagctacggctgatcgactgggggttggcagagttctaccaccccgcccaagagtacaatgttagagtggcgagccgttattttaaaggccctgagctactcgtagactaccagatgtacgactactcattagacatgtggtcactcggctgtatgcttgcctctatgatctttagaagggaaccattcttccacggtcaggataattatgatcagctggtgagaatagcaaaggtgctggggaccgaagagctctatggctacctgaagaagtatcacattgatctagatccccactttaacgacatcctaggacagcactctcgcaaaaggtgggagaatttcatccattctgaaaatcgacatttggtgtcgcccgaagccttagacctattagacaagctgctgcgctacgatcaccagcagagattgaccgcgaaagaggccatggaacacccatatttctacccggtggtgaaggagcaaagtcagccatgcgctgacaatgcagtgctgagttcaggtctcaccgccgctagatag

SEQ ID NO: 14282 - DNA, 600 bp, Artificial Sequence
  Description of Artificial Sequence: Synthetic coding sequence
atggaagctagagacaaacaggtgctaaggagtctgaggctcgaacttggcgccgaagtgcttgtggagggcttagtactgcagtatctgtatcaagaggggatcctaacagagaatcatattcaggaaatcaatgcccagaccacaggccttcgcaagactatgctgttgctggacatattaccaagcaggggtcccaaggctttcgacacattcctagatagtctgcaggaattcccatgggtgagggagaaacttaaaaaggcacgcgaggaggccatgaccgacctccccgctggcgacagattaaccggaattccgagccacatcctgaactccagtccgtctgaccgccagattaatcagctggcacagaggctggggccagagtgggagcctatggtgctgtcgttgggcctgagccagaccgacatctacaggtgtaaggccaaccatcctcataatgttcaatcccaggtggtcgaggctttcatccggtggcggcaaagattcggtaaacaggctactttccagagcctccacaatggtcttcgtgccgtggaggtcgatccatcgctgctgttgcacatgctggagtag

SEQ ID NO: 14283 - DNA, 366 bp, Artificial Sequence
  Description of Artificial Sequence: Synthetic coding sequence
atggaggcgcgcgacaagcaggtgcttcggtccctgcgtctggagcttggagcagaggtgctggtcgaaggccttgtcctgcagtacctctaccaggaggggatcctgactgaaaaccacatccaggagattaatgcacaaaccacgggcctgaggaaaactatgctgctgctggacattctccctagtcgaggtcccaaggcttttgacactttcctcgattctctccaggaattcccatgggtaagggaaaaattaaaaaaagctagggaagaagctatgactgatctgcccgccgagatgcgtaagcttcggccaaaggactccgtcacatgcctggcttcccaattgacctggaggttctag

SEQ ID NO: 14284 - DNA, 600 bp, Artificial Sequence
  Description of Artificial Sequence: Synthetic coding sequence
atggaagctagggacaagcaggtcctcagaagtcttcgactggagctgggcgccgaggtgctcgtggaaggactcgtgctgcagtatttataccaagagggaatattgacagagaatcatattcaagaaatcaacgcccagactacaggtctccgtaagacaatgctgttgttggatatcctccctagccggggacccaaggcgtttgacacttttctcgatagccttcaggagtttccctgggtcagggaaaagctgaagaaggctcgggaggaagccatgaccgatctacccgcaggggatcgcttgaccggtataccctcccatattctcaactcatccccatctgatagacagattaaccagttggcccaaagattagggccagagtgggagcccatggtacttagccttggcctgtcgcagacggacatatatcggtgtaaagccaaccacccccacaatgtgcagtcccaggtcgtagaggcatttatacggtggagacagagatttgggaaacaggcaactttccagtctcttcacaatggattgcgcgctgttgaggtggacccctcactgctgctccacatgctcgaatag

SEQ ID NO: 14285 - DNA, 312 bp, Artificial Sequence
  Description of Artificial Sequence: Synthetic coding sequence
atggaagcccgggataagcaggtgctccgttcactgcgcttggagcttggcgcagaagttcttgtagaaggtttagtcctgcaatatctttatcaggagggaatcttgaccgagaaccatatccaggagataaatgcccagaccacaggactgaggaagactatgctgttgttggatattctgccctcaagaggaccaaaagcgttcgacactttcttggactcactgcaggagtttccctgggtgagggaaaagttaaagaaggctcgagaagaggccatgacagacctgcccgctggttgttggccctag

SEQ ID NO: 14286 - DNA, 1443 bp, Artificial Sequence
  Description of Artificial Sequence: Synthetic coding sequence
atgtccgcagaagtgatacaccaggttgaggaagctctggatacagacgaaaaggagatgctgcttttcttgtgccgcgacgttgcaattgacgtcgtgccacctaacgtgagagatctgctggacattctcagagagaggggtaaactgagcgttggcgatctagccgagttgctgtatagggtgaggcggtttgacttgctcaagcgaatcctgaagatggaccgaaaggctgttgaaacccacttgctgcggaacccacatcttgtgtcagactacagggtgcttatggccgagatcggagaggatctggacaaatctgacgtgtcttctttaatctttctgatgaaagattatatggggcgagggaaaatctccaaagagaaatcatttctcgacctagtggtggaactcgaaaagttgaacttggtcgctccggaccaacttgacctgctcgaaaaatgtctaaagaatatccatcgaattgacctaaagactaagatccaaaagtataaacagtcagtgcagggagcaggcaccagctatagaaacgttctgcaggccgctatacaaaagtctttaaaagatccaagcaataactttcggttgcacaatgggcgctccaaggagcagcggctcaaagagcaactgggcgcacagcaggagcctgtgaagaagagtatccaggagtccgaagcttttctgccccagtctatccccgaggaacgctacaagatgaaatctaagcccctcggtatatgtttaattatcgattgcataggaaatgaaacagagttgcttcgcgatacttttaccagcctgggctatgaagtccaaaagttcctacatctgtccatgcatggcatttctcagattctcgggcagttcgcgtgtatgcccgagcacagggattacgattcatttgtttgtgttctggtgagccgcggggggtcccaatccgtgtacggagtcgaccagacgcatagcggcctgcctctgcaccacatcagacgcatgttcatgggggactcctgcccctaccttgcaggaaaacccaagatgttcttcatccagaattatgtcgtttctgaaggacaactggaggactctagcctcctcgaggtagacggaccagcgatgaagaacgtcgaattcaaagcccagaagagagggctgtgcacggtgcacagagaggccgattttttctggagcctgtgcacagcagatatgtccctgctcgaacaatctcatagttccccaagtttatatctgcaatgcctctctcagaaacttagacaggagagaaagagaccgctattggacctgcatattgagctgaatggatacatgtatgattggaactcaagggtgtccgcaaaagagaagtactacgtgtggcttcagcacacccttcggaagaaactcatcctctcttacacttag

SEQ ID NO: 14287 - DNA, 1389 bp, Artificial Sequence
  Description of Artificial Sequence: Synthetic coding sequence
atgagtgccgaggtgatccaccaggtggaggaagcccttgatacggacgagaaagaaatgcttctgtttctttgtagagacgtcgcaattgatgtggtcccacctaacgttagagatctgttggatattttgcgggaaagggggaagctcagcgtgggggatctggccgagctgctgtaccgagtcaggagattcgacctcctgaaaagaattttgaagatggaccgtaaggccgtcgagactcatctgctgagaaatcctcacctggtgagcgattaccgggttctgatggctgagatcggggaagacctagataagagcgacgtcagttccctgatctttctaatgaaggattacatgggccgggggaaaatcagcaaggagaaatcatttctagacctggtggttgagttggagaagctgaatctcgtcgcccccgaccagctcgacttgctggaaaaatgtctcaaaaatattcacaggatcgatctgaagactaagattcaaaagtataagcagtcggttcagggggcgggcacatcctacagaaatgtactgcaggccgctatccagaagtctctcaaggaccctagcaataacttcagattgcataacggaagaagtaaggagcaaaggttaaaggagcaactgggggcacagcaggaaccagtgaaaaaatcaatacaggaatcagaggccttcctgccacaatccatccccgaagagcgatataagatgaaaagcaagcctctgggcatttgcctgatcattgattgtatagggaacgaaactgaactgttgcgcgatactttcacatctttgggttacgaagttcagaaattccttcatttatctatgcatggaatctcacaaatactgggtcagtttgcctgcatgcccgaacacagggattatgattccttcgtgtgcgtgttagtgagcaggggtggtagtcaatcggtgtatggagttgaccagacccactcgggcctccccctacaccacatccgccgaatgttcatgggagacagctgcccttacctggctggcaagccgaagatgttcttcattcagaattatgtcgtcagtgagggtcagcttgaggactcctctctgctggaggttgacggccccgcaatgaagaatgtggaattcaaggcacagaagagaggcctgtgcacagtgcatcgggaagcagacttcttctggagtctttgcacagcggatatgtctcttttggaacagagtcattcgagcccatccctctacctccagtgcctctcacagaagctgcgccaggaaaggggtacaatccccgggtctggaatcaccgaaagcaaggatatgcacttcagctctctggggtgtatccttctcgacgttctgtag

SEQ ID NO: 14288 - DNA, 1047 bp, Artificial Sequence
  Description of Artificial Sequence: Synthetic coding sequence
atggctgagattggagaagaccttgacaagtccgatgtgtccagcctcatattcctgatgaaagactacatgggacgtggaaagattagcaaggagaagtcatttctagaccttgtcgtcgagcttgaaaaactcaatctggtcgcacccgatcaactcgacctgctcgagaagtgtctgaaaaatatacacaggatcgatttaaaaacaaagattcagaagtataaacagtccgtgcagggagctgggacttcttacaggaacgtccttcaggcagcgatccagaaatccctgaaggacccctcgaataacttccgcgaagagccagttaagaagtcaattcaggaatccgaggcattcctcccccagtcgatccccgaggagcgctacaagatgaagagcaagccactcgggatttgtctgataatcgactgtatcggcaatgaaactgagctgctgagggacacttttacaagcctaggatacgaggtacagaaatttcttcatctgtcgatgcacggcatcagtcagatactcggccaattcgcctgcatgccggaacaccgtgattacgattccttcgtctgcgtgctggtgtcacggggaggcagccaatccgtctacggcgtcgatcaaactcactccggcctcccactgcatcacatacggagaatgtttatgggggattcctgcccctacttagccggcaagcccaagatgtttttcatacaaaattatgttgtgagcgagggccagctggaggactccagtctgttagaagtggacgggcccgccatgaagaacgttgagttcaaggcacagaagcgaggattgtgcacagtacatcgcgaagcagacttcttctggtctctctgcaccgccgacatgtcactgcttgaacagtcccactcatctccctcactctatctgcagtgtctgtctcagaagttgcggcaggagaggggcacaattcccgggtccggcatcactgaaagtaaggatatgcacttctctagccttggatgtatcctgctagacgtgctgtag

SEQ ID NO: 14289 - DNA, 903 bp, Artificial Sequence
  Description of Artificial Sequence: Synthetic coding sequence
atgagtgcggaggtgatccatcaggtggaagaggcactggacacagacgagaaagagatgctcttgttcctatgtcgggacgtagcaatcgatgtcgtaccgcctaacgtaagggacctgcttgacatactcagagaaagaggcaaactctctgttggtgacctggcagaacttttgtaccgggtccggcggttcgatctcctgaaacggatcctgaagatggaccggaaggccgttgaaacccatctcctgcgcaatccacatcttgtcagcgattacagggtgctcatggctgaaattggagaggatctagataaaagtgatgtgtcttcccttatcttcctgatgaaggattacatgggccgcggaaagatcagcaaggaaaagtcttttctggacctcgttgtggaacttgaaaagcttaacttggtcgcccctgatcaactggaccttctagaaaagtgtttgaaaaacattcatcggatcgatcttaagactaaaatccagaagtacaagcagagtgtccagggagcaggcacctcttacaggaacgtgttgcaggcagccatccagaaaagcctgaaagaccctagcaacaactttagactgcataacgggcgctccaaggagcagcggttgaaagaacagctcggcgcgcagcaagagcctgttaaaaagtctattcaggagtccgaagccttcttaccccagtcgattcccgaggagcgctacaaaatgaaaagcaagcctttgggcatttgtcttattatcgattgtattggaaacgagacggaaaatgcccactcgtggatctttacccttaatagcatggccacatgtatgatcggcacagcggagtttctgccacgaagaaacataatgtccggttgctccactctctag

SEQ ID NO: 14290 - DNA, 753 bp, Artificial Sequence
  Description of Artificial Sequence: Synthetic coding sequence
atgtcagccgaagtgattcaccaggtcgaggaggcccttgacactgatgaaaaagagatgctgctgtttctgtgtagagatgttgccatagacgtggttcctcccaacgttcgcgacttgctagacatacttcgagaacgaggcaaactgtcggtaggggatctagctgagctcctatatcgggtgcgtcgctttgacctgctgaagagaattctgaaaatggatagaaaggctgtcgagacccatctgctgcgtaatccgcacctcgtatccgattaccgcgtattgatggctgaaatcggggaagacctggacaaatcggatgtgagctcactgatcttcctgatgaaggattatatggggcggggcaagatctccaaggaaaagtcattcctcgatctggtggtggagctggaaaaactgaacttagttgcccccgatcaactggacttactcgagaaatgtctgaagaacatccatagaatcgacctcaagacaaagattcagaagtataagcagagcggcggctggaatggaacgtggatgactaaagcaagcttctcactgtggctggaaatagccagcctttatattctgcacattccggacctgccgactcccctgccttgcatttttatgatcagcgctaagtgctgtcaggcagtgctgaacatcagtgttttcaaaaaggagagtgggatttgtacaggctggcaatcatacggacactcaggcgtgctccacgtatgctag

SEQ ID NO: 14291 - DNA, 357 bp, Artificial Sequence
  Description of Artificial Sequence: Synthetic coding sequence
atgtccgccgaagttatccatcaagtggaagaggcgctggatacagacgagaaagagatgttactctttttatgcagggacgtggccatagacgtggtacctcccaacgttcgggacctcctcgatatactcagagagagagggaagctgtccgtgggtgatctggcagagctcctgtaccgcgtgagacgttttgacctgttaaagcgcatcctgaaaatggacagaaaagcggtggagactcatttgctgaggaaccctcatctggtgtctgactacagagtcctcatggcagaaatcggggaggacttggataaaagtgacgtgtcatctcttatcttcctcatgaaggactag

SEQ ID NO: 14292 - DNA, 1443 bp, Artificial Sequence
  Description of Artificial Sequence: Synthetic coding sequence
atgtcagccgaggttatccatcaggttgaagaagcactggacaccgacgaaaaagagatgctgctcttcctgtgccgggacgtcgcaatcgacgtggtcccgcctaacgtgagagacttgctcgacatcctgcgcgagcgcgggaagctgagcgtgggcgatctggctgaattgctataccgggtacgcaggtttgatctactcaaacggatactgaaaatggatcggaaagcggtcgagacccatctccttagaaacccacacctcgtaagtgactaccgcgtcttaatggcagaaatcggagaggacctggacaagagcgacgtgtcttccctgattttcctcatgaaagattacatgggacgcggcaaaattagcaaggaaaaaagtttcttggacttggtggtcgagctcgagaagctcaatttagttgcgccggatcagttagacctcctggagaagtgcctgaaaaacatacatcgaattgatctgaagaccaagattcaaaagtacaagcagagcgttcaaggagctggaacttcctaccggaatgtactgcaggcagcgattcagaagagtcttaaggacccaagtaacaattttcgcctgcacaacggcagatccaaggagcaaaggctaaaagagcagcttggtgcacaacaggagcccgtcaaaaagagcatccaggagtcagaagcattcctcccccagagcattccagaagagcgctacaagatgaagagcaaaccactggggatatgtctgattatcgactgtattggcaatgaaaccgaactactgcgagacacctttacttctctgggttacgaagtccagaagtttctccatctgagcatgcatggcatctcacagatcctgggccagttcgcttgcatgccggagcatcgggactatgatagctttgtgtgtgtgttggtcagcaggggcgggagtcaatcagtgtacggtgtcgaccaaactcacagtggactgcctctacaccatatccgtagaatgttcatgggtgacagttgcccttacctcgccggaaagccaaagatgttttttattcagaattatgtggtctcggagggacagcttgaggatagctccctgctggaagtcgacggaccagctatgaagaacgtggaattcaaggcccaaaaacgcgggctctgcacagtgcatagggaagctgattttttttggagtttatgcactgcggatatgagcctgcttgagcagagtcatagctccccaagtctatacctacagtgtctgagccagaagctgagacaggaacggaagaggcctctgctcgacctgcacattgaactgaacggctatatgtacgactggaatagcagggtgagtgcaaaagagaaatactacgtttggttgcagcatacgctccgcaaaaaactgatactgagttacacctag

SEQ ID NO: 14293 - DNA, 189 bp, Artificial Sequence
  Description of Artificial Sequence: Synthetic coding sequence
atgtcagccgaagtcattcaccaggtggaggaggcccttgacactgatgagaaggagatgttgctttttctttgccgagacgtggctatcgatgtagtcccacccaacgtacgagacctgcttgacatcctccgagaacggggcaagctctccgttggcgacttggcagaactgctgtatcgcgtatag

SEQ ID NO: 14294 - DNA, 195 bp, Artificial Sequence
  Description of Artificial Sequence: Synthetic coding sequence
atgagtgccgaagtgatccaccaggtggaggaggctctcgacaccgatgagaaagagatgctactattcctgtgtcgagatgttgccatagatgtggtgcctcctaatgttagagatctactggatatcttgagagagcgaggcaaattgtccgtgggcgacttggcagagttgctctatagagtgaggcgttag

SEQ ID NO: 14295 - DNA, 390 bp, Artificial Sequence
  Description of Artificial Sequence: Synthetic coding sequence
atgtccgcagaagttattcaccaggtggaggaggcgttggatacagacgagaaggaaatgctgctctttctttgcagggacgtggcaatcgatgtggtacctcccaacgtccgggatctattggacatactgcgtgagcgtggcaaacttagtgtgggagatttagcggagcttttatatcgcgttagacgtttcgacctcttaaagcggatattgaagatggataggaaagccgttgagactcacctgctgagaaatcctcatctggtgtcagattatcgggtgcttatggccgagatcggggaagatttggataagtcagatgtttcaagtctgatttttctgatgaaagactacatgggtcggggcaaaatttcgaaagagaagtag

SEQ ID NO: 14296 - DNA, 1155 bp, Artificial Sequence
  Description of Artificial Sequence: Synthetic coding sequence
atggctgaaattggcgaagatctggacaagagcgacgtctcatctttgatatttctgatgaaagactatatgggacgcggtaagattagtaaagagaaatctttcctggacctcgtggtggaactcgagaaactcaacttagttgcacctgaccagctggatctactggagaagtgccttaagaacattcacaggattgacctcaagaccaaaatccaaaagtacaaacagtccgtacaaggggccggtacatcctaccggaacgttctgcaagcagctattcagaaatccttgaaagaccccagtaacaactttcgtttgcacaacggtagatccaaggagcagagactcaaagaacagcttggtgcgcagcaagagccagttaagaagtctatacaggagtctgaagcctttcttccccagtccattcccgaagagagatataagatgaagtcgaaaccgcttggcatctgtcttatcattgattgcataggaaacgaaaccgagttacttcgggacacattcacaagcctggggtatgaagtgcagaagtttcttcacctgagtatgcatggtatttcacagatactgggtcagttcgcatgtatgccagagcaccgggattacgattccttcgtttgcgtgcttgtgtctcgcggcggaagccagtcggtatatggcgtggaccagacacattcaggactccccttgcaccacattcggagaatgtttatgggtgactcatgcccctatctcgctgggaaacccaagatgtttttcattcagaattacgttgtgagcgagggccagctggaggatagttccttgctggaagtggatgggcctgcaatgaagaatgtggaattcaaagcccagaaaaggggcttgtgcaccgtgcatcgggaagctgactttttttggtcgctgtgtaccgccgatatgagcctgttggagcagtcacacagtagtccatcactgtatcttcagtgtctgtcccaaaagttgcggcaagagcgcaagcgccccctgttggatctgcacatagaacttaatggatacatgtacgactggaactcacgggtgtctgcgaaggagaagtactatgtgtggctgcaacataccctgcgcaagaaactgatactgtcgtatacctag

SEQ ID NO: 14297 - DNA, 666 bp, Artificial Sequence
  Description of Artificial Sequence: Synthetic coding sequence
atgtcagcagaggtgatccaccaagtcgaggaagcgttggatactgatgagaaagagatgctcctgttcctgtgccgggatgtggctatcgatgtggtgcctcccaacgtgagggatctactggacattttgagagaaagaggaaaactgtctgtaggtgacctagccgagctgctttacagggtgcggagatttgatctgctcaaacggattctgaagatggacagaaaagccgtggagacccaccttctgaggaacccgcacctggttagcgactacagagtgttaatggccgagataggcgaggacctggataagagcgacgttagcagcctgatcttcctgatgaaggattatatggggcgcggtaagattagcaaagaaaaatccttcctcgatctcgttgttgaactggaaaaactcaatttagtggcccccgatcaactggacctattggagaagtgcctgaaaaacattcaccggatcgacttgaagacaaagatccagaaatacaagcagtccgtacagggcgccgggaccagctataggaacgtactccaagctgctattcaaaaatctctaaaggatccgtcaaataatttccgaatgatcacaccttacgcacactgcccagacttaaaaatcctgggcaactgtagcatgtag

SEQ ID NO: 14298 - DNA, 1338 bp, Artificial Sequence
  Description of Artificial Sequence: Synthetic coding sequence
atgtcagctgaggtgattcaccaggtagaagaggccctagacaccgatgagaaagaaatgctgctgttcctgtgtcgagacgtcgccattgatgttgtgcccccgaacgtcagagacctgttggatatcttgcgcgagcgtggtaagctaagcgtgggggatctggcggaactgttgtatagagtacggaggtttgacctcttgaaaaggatcctgaaaatggatcgcaaggccgtcgagactcacctcctaaggaacccccatcttgtttccgattatagagttctcatggcagaaatcggagaggatctggacaagtcagatgtgagttctctgatttttttaatgaaggattatatgggccgaggcaagatctcaaaagagaaatcgttcctggacttggttgttgaactggagaaactgaatctggtggccccggatcagcttgatctgttggagaaatgcctgaagaacatccatagaatagatctcaaaactaagatccagaagtacaaacaatccgtacagggggctgggactagctaccggaatgtactgcaggccgccatacagaagtctctcaaagacccctcgaataattttaggagcatccctgaggaacgttataaaatgaaatctaagccacttggcatctgtctaattattgactgtatagggaatgagactgagcttttgagagatacctttacctcattgggctatgaggtgcagaaattcctgcatctctctatgcacggaatttctcagattctgggtcagtttgcgtgcatgccggaacatagagattacgactcatttgtgtgcgtgttggtgagtagaggcggatctcaaagcgtctacggtgtggatcagactcatagcggattgccacttcaccatattagaaggatgttcatgggcgactcttgtccgtacctggccgggaaacctaaaatgtttttcatccaaaattacgtcgtgtcagaagggcagttggaagacagctcactgctcgaggttgatggtcctgccatgaaaaatgttgaatttaaagcccaaaagcgtgggctgtgcacagtgcatagagaggctgattttttctggtccttatgcacggccgatatgtccctattagaacagtcacacagctcgcctagcctctatctgcaatgcctgagccaaaagctaagacaggagagaaaacgccctctcctggatcttcacatagagcttaacgggtatatgtatgattggaactctcgggtgtcagccaaggaaaaatattatgtgtggctgcagcacaccctgcgcaaaaaactgattctgtcttacacctag

SEQ ID NO: 14299 - DNA, 1152 bp, Artificial Sequence
  Description of Artificial Sequence: Synthetic coding sequence
atggccgataaggtactcaaggaaaagcgcaaactgtttattagaagcatgggcgaagggaccattaacgggctgctggacgagctgcttcagacacgtgtgttgaacaaggaggagatggagaaggttaaacgggagaatgccactgtcatggataaaacccgagcactcattgattccgtaatccccaaaggtgcgcaggcttgtcagatctgcatcacctacatttgtgaggaagactcatatctggcaggcacgctggggcttagtgccgctccgcaggctgtgcaagacaaccccgctatgcctacctcttctggttctgaggggaatgtcaaattatgctcccttgaagaggctcaacgcatctggaagcagaagtccgctgaaatttaccctatcatggacaagagctcgagaacccggctggctctgatcatttgtaacgaagagttcgattcaatccccagacgcactggagctgaggtcgacatcacaggcatgacgatgttgctgcagaatttaggctactctgtggacgtcaagaaaaatctaactgcaagtgatatgacaactgaactcgaggcattcgcccatagacccgaacacaaaacctctgattccacctttttggtctttatgtcacacggcatccgggagggcatctgtgggaagaagcatagtgaacaggtacctgacattctgcaactgaatgctatcttcaacatgctgaatacaaaaaattgcccttcactgaaagataagcccaaggtcatcatcattcaggcttgtaggggggactcccctggggtcgtatggtttaaagactcggtgggagtttccggtaatctgtctttgcccaccacagaggagtttgaagacgatgccattaaaaaggcgcatatcgagaaggatttcatcgctttctgctcatccactccggacaatgtgagctggcggcatcctacaatggggtctgtgttcatcgggcgacttatcgagcacatgcaggaatatgcttgttcatgtgacgtggaagagatcttccgcaaggtgcgctttagctttgaacaacccgacggcagagctcaaatgcccacgaccgagagagtaaccctgacccggtgcttctacctgtttcctggacactag

SEQ ID NO: 14300 - DNA, 792 bp, Artificial Sequence
  Description of Artificial Sequence: Synthetic coding sequence
atggccgataaagtgttaaaagaaaagagaaaactctttattaggagcatgggggaggctccccaggctgtgcaggacaaccccgccatgccaaccagctcgggaagtgaaggtaacgttaagctgtgtagcttagaggaagcacagcgaatctggaagcagaaatcggcggagatctatcccattatggacaagagttcacgcacacgactcgcccttattatctgcaatgaagagtttgactctatcccaagacgcacgggggccgaagttgacatcacaggaatgacgatgctactgcagaacctggggtattccgtcgacgtgaagaagaaccttacagcctcggacatgacaactgaactggaggcttttgcccatagacccgagcacaagacctccgactccacttttctagtgtttatgagccatggcattagagaagggatctgtgggaaaaaacatagtgagcaggtgccagacatcctgcagctgaatgcgattttcaacatgctgaatactaagaattgcccaagcctgaaagacaagccaaaggtgatcatcatacaggcgtgtcgtggcgacaatgtgtcttggagacaccctaccatgggttcagtgttcatcgggaggttgatcgaacatatgcaagagtacgcatgttcctgtgatgtcgaggaaatcttcagaaaggtgcgcttcagcttcgaacagcccgacggccgcgcacagatgccgactacagagagagttacactgacgagatgtttctaccttttccccgggcactag

SEQ ID NO: 14301 - DNA, 267 bp, Artificial Sequence
  Description of Artificial Sequence: Synthetic coding sequence
atggctgacaaagtcttgaaagagaaaaggaagctctttatcagaagcatgggagaagacaacgtcagctggaggcacccaaccatgggcagcgtctttatcggcagacttattgagcatatgcaagaatatgcctgctcatgtgacgtcgaagagatcttccggaaagtcaggttctcgtttgaacagccggacggccgggcccagatgccaaccaccgagcgggtgacactgactagatgtttttacctgttccccggccattag

SEQ ID NO: 14302 - DNA, 1152 bp, Artificial Sequence
  Description of Artificial Sequence: Synthetic coding sequence
atggccgacaaagttttgaaagagaagcgcaaactctttattaggagcatgggggaggggaccatcaatggcctactggatgagctgctgcagaccagggtgctgaataaagaggagatggagaaagtcaaacgggagaatgccactgtcatggacaagacccgcgccctcattgatagcgttatacccaagggcgcccaggcatgccagatttgtattacttatatctgtgaagaggactcatatctagccggtaccctggggctgtcggctgctccgcaggctgtgcaggacaatcccgctatgcctactagctctggtagcgagggcaacgtgaagctgtgctcactggaggaggctcagcgaatatggaaacagaagtcagctgaaatctacccgattatggacaagagctcccgaacaaggctagcgctgatcatatgcaacgaagaattcgactcaattccacgtcggacgggcgcagaggtggatatcactgggatgacaatgctcttacagaacctcggctacagcgttgatgttaagaagaatctgaccgctagtgacatgacgacagagctggaggcgttcgcacaccggcccgaacacaagactagcgatagcacctttctggtttttatgtctcatggaatccgcgaaggaatctgtggaaagaagcactcagagcaggtgccagacatcctacagttaaacgccatttttaatatgctgaacaccaaaaactgtccgagtcttaaggataagcccaaagttattattatccaggcctgcaggggagatagtccaggagtggtctggtttaaagatagtgtcggtgtttcaggaaatctcagcctgcccacaacagaagagttcgaagacgatgcaataaaaaaggcccatatcgagaaggattttatagcgttctgctccagcactcctgacaatgttagttggcgccacccaactatgggcagcgtgtttattggccgcctgattgagcacatgcaggagtatgcctgtagctgtgatgtggaggaaatttttcggaaggttcgcttttccttcgagcaacctgacgggcgggcccagatgcccaccactgagcgcgtaacattgactaggtgtttttatctcttccccggccactag

SEQ ID NO: 14303 - DNA, 267 bp, Artificial Sequence
  Description of Artificial Sequence: Synthetic coding sequence
atggctgacaaggtactgaaggaaaaacggaaactgttcattcgcagtatgggcgaggacaacgtctcctggaggcacccgacgatggggtccgtcttcatcgggcgcctcatcgagcacatgcaagagtacgcctgtagctgtgacgtggaggagatctttcggaaggttcgctttagttttgaacagcctgacgggcgagcacagatgcccactactgaacgagtgactctgacaagatgcttctacctgttccctgggcattag

SEQ ID NO: 14304 - DNA, 1215 bp, Artificial Sequence
  Description of Artificial Sequence: Synthetic coding sequence
atggcggataaagtactcaaagagaaaaggaagctgttcataagaagcatgggggagggcactattaacggtcttctggatgagctgttacaaactcgcgtgctgaacaaagaggagatggaaaaagtcaagagagaaaatgccacggtgatggataaaacccgggctctcatagactcagtgatcccgaagggcgcccaggcttgccagatttgcataacttatatctgtgaggaggatagctatctggccggcaccctaggcctgtcagcagatcagacatccgggaactacctcaacatgcaggacagccagggcgtgctgagcagtttccctgcccctcaggctgtgcaggacaaccctgccatgcccacgagcagtggcagtgaggggaacgtaaagctgtgcagtttggaggaagctcagaggatctggaagcaaaagtctgccgaaatttaccccatcatggataagtcttcacgcacccgcctggctttaattatttgcaatgaagagttcgatagcattcccaggaggactggcgccgaagtggatattaccggtatgacgatgctccttcagaatctgggctattcagtggacgtaaagaagaatttgaccgcatcggatatgacgaccgagctggaagccttcgcacacagacctgaacataagacaagcgattctacttttctcgtgtttatgtcccacggaattcgtgaagggatttgcggaaagaagcacagcgagcaggtccctgatattctccaacttaacgcaatctttaatatgctgaacacaaaaaactgcccgtcactcaaagataaaccgaaagtgatcattatccaggcttgtcggggtgacagcccaggagtggtgtggttcaaagatagtgtcggcgtgtctggaaacctaagcctgcctaccacagaagagtttgaggatgacgccataaagaaggcgcatatagaaaaagacttcatcgccttttgttccagcacaccggataacgttagctggcgccatcctactatgggaagtgtgttcatcgggaggctcatagagcatatgcaggagtatgcatgcagttgtgacgtcgaggagattttcagaaaggttaggttctccttcgagcaaccggacgggcgtgcccagatgcccacaactgagagagtcaccctcacgagatgcttttatttattcccagggcattag

SEQ ID NO: 14305 - DNA, 792 bp, Artificial Sequence
  Description of Artificial Sequence: Synthetic coding sequence
atggctgacaaagtgcttaaggaaaaacgcaagttattcattcggtcaatgggcgaagcccctcaagcagtgcaggataacccagccatgcctaccagttcggggtctgagggtaatgtgaaattgtgctcactggaggaagcccagcggatatggaagcagaaaagcgccgagatctaccctattatggataaaagctctcgaactcgtttggccctgattatctgcaatgaagaatttgattctatacctaggcggacgggtgcggaagttgacattaccgggatgacaatgttgctgcaaaatttgggctatagcgtagacgtgaaaaaaaacttgacggccagtgacatgaccactgagctggaggcctttgctcatcgacctgagcacaagacaagtgattctaccttcctggtttttatgagtcatggaattcgagaaggtatttgcggaaaaaaacacagtgaacaagtgcccgacatactccagttgaacgctatcttcaacatgctgaacacaaaaaattgccctagcttaaaggacaaacctaaggtaattataatacaggcctgtcgtggagataatgtatcttggcgccaccccactatgggcagcgtgttcatcggtaggttaattgaacatatgcaggaatacgcttgctcatgcgacgtggaggaaatatttagaaaagttcgcttttcctttgagcagcccgacgggcgagctcagatgcctactaccgagagggtcactttgacaaggtgcttttacttgtttccaggacactag

SEQ ID NO: 14306 - DNA, 1152 bp, Artificial Sequence
  Description of Artificial Sequence: Synthetic coding sequence
atggctgacaaagtgctgaaggagaaacggaagcttttcatcagaagtatgggcgagggcacaataaatggcctactcgatgagctcctccagaccagagtcctgaataaggaggagatggagaaggtgaaacgcgagaacgctaccgtgatggacaaaactagagctctgatcgactctgtgatcccaaagggcgctcaagcctgccagatttgcattacctatatttgtgaggaggactcctacctggctgggactctggggcttagtgccgcacctcaagccgttcaagacaacccagcaatgcccacaagcagtgggagtgaaggcaatgtaaagctctgttcactggaggaagcacagcggatctggaagcagaagtctgctgagatctatcctattatggataaatcctctagaaccaggctggccctgatcatatgtaacgaagagttcgactcaatacctcggcgaaccggtgctgaagtggatatcacaggtatgacaatgttattgcagaacctcggttatagcgtcgacgtgaaaaaaaacctaaccgctagcgatatgaccaccgagcttgaagcttttgctcacaggcccgaacataaaacttccgactccactttcctcgtttttatgtcccatgggattagggaaggtatctgtggcaagaagcacagtgaacaggtaccagatatactgcagctgaatgcaatctttaacatgttgaacacaaaaaactgccctagtttgaaagataagcccaaagttataatcatccaggcatgccgcggtgattctcctggcgttgtctggtttaaggactcagtgggtgtctccgggaacctgtccttacccactacagaggaattcgaagatgatgcgatcaagaaggctcacattgagaaggatttcattgctttctgttcctccacccctgacaacgtctcatggcgtcatccaaccatggggtctgtgttcatcggacggttgatcgagcacatgcaagagtacgcctgttcatgcgatgtagaggagatattcagaaaagtgcggttctcctttgagcagcctgatggacgggcccaaatgcctaccacagagagggttaccctcactcgttgtttttatctctttccaggccattag

SEQ ID NO: 14307 - DNA, 936 bp, Artificial Sequence
  Description of Artificial Sequence: Synthetic coding sequence
atggctgacaaagtgctcaaagagaagcggaagctgtttattcggtcaatgggggaggcccctcaggcagtgcaggacaaccccgcgatgccgaccagctctgggagcgaggggaacgtgaagctatgttcactggaagaggctcaaagaatttggaagcagaagagtgccgagatctatccaatcatggataagagcagtagaactcgactcgccttaatcatctgcaacgaagagttcgactctatcccccggcgtaccggggccgaagtcgatatcactggtatgactatgctcctgcagaatctgggctatagcgtcgatgtgaaaaaaaatctgaccgcaagcgatatgactacggagcttgaggctttcgcccatcggcctgagcacaaaacctccgacagtacatttctagtgtttatgtcccacgggatccgcgaaggcatctgtgggaagaagcattctgagcaggttcctgacatccttcagttaaatgctatttttaacatgctgaacaccaagaattgtccttcactgaaagacaagcccaaggtgatcattatccaggcctgcagaggagactctccaggagtcgtatggttcaaagactccgtgggagtctccggcaacttaagcttaccgacaaccgaggagtttgaggacgatgcaatcaagaaggcgcacatagaaaaggacttcatagctttctgctcatctaccccagataacgttagctggcgtcaccccaccatggggtccgtatttattggacgattgattgaacacatgcaggagtacgcctgcagctgcgacgttgaagagatatttaggaaggttcggtttagcttcgaacagcccgacggccgtgcacagatgccaacgactgagcgtgtgactcttactcgctgcttctacctgttcccgggccactag

SEQ ID NO: 14308 - DNA, 906 bp, Artificial Sequence
  Description of Artificial Sequence: Synthetic coding sequence
atggagaaggtaaaacgggaaaatgccacagtcatggacaaaactcgggcactgatcgactctgtgatccctaaaggtgcacaggcttgccagatatgtatcacctacatctgcgaggaagacagctacctggcaggaactcttggtctcagcgccgaccagaccagcggaaattatctgaacatgcaggatagtcagggagtgctgagctccttccccgccccacaggcagtgcaagataatccagcgatgcctacaagcagcggaagcgaaggtaatgtgaagctttgctccctggaggaagcacaaagaatatggaagcaaaagtctgctgaaatttaccccattatggataagagcagccgcacacggctggctttgatcatatgcaacgaggagtttgactcaatacctcggcgaaccggggctgaggtggatataacaggaatgaccatgttacttcagaacctgggatattcagtggatgtgaaaaaaaatctgaccgcaagcgacatgaccacagaattggaggcgttcgctcaccggcccgagcacaaaacttcagactctacatttctagtcttcatgtcacatggcatccgcgaagggatttgtggtaagaaacactcagaacaggtccctgacatactgcaactcaatgcgatctttaacatgcttaacactaaaaactgtccatctcttaaggacaagcccaaagttataataatacaggcttgcagaggggattcaccaggggttgtgtggttcaaagactccgtgggcgtctcagggaacctgtcactcccaactactgaggagtttgaggatgacgctatcaaaaaggctcacatagagaaagactttatcgccttctgctcctctacacccggcaaaagtcagagttag

SEQ ID NO: 14309 - DNA, 333 bp, Artificial Sequence
  Description of Artificial Sequence: Synthetic coding sequence
atggcagataaggtgttgaaggagaagaggaaactctttattcggagcatgggggaagggacgattaacggcttactcgacgaactcttgcaaactcgcgtgttgaacaaggaggagatggaaaaggtcaaaagagagaatgctaccgttatggataaaactcgagctctgattgatagcgttatcccaaagggcgcgcaggcctgccagatttgcattacctatatatgcgaagaagactcatatttagccggtaccctaggactctcagctgacctctccaacaatggccaggtgaagccacacacaagctgtagccactatctccaatag

SEQ ID NO: 14310 - DNA, 267 bp, Artificial Sequence
  Description of Artificial Sequence: Synthetic coding sequence
atggcagacaaggtgctgaaggaaaaaaggaagctctttatccgaagtatgggggaagataatgtctcttggaggcacccaacaatgggaagcgtttttatcggccggttgatcgaacatatgcaggagtatgcatgcagctgcgacgttgaagaaattttccgcaaagtgagattcagctttgagcagcctgatgggcgcgcccagatgcctaccaccgaacgagttaccctgaccagatgtttctacctgttccccggtcactag

SEQ ID NO: 14311 - DNA, 1215 bp, Artificial Sequence
  Description of Artificial Sequence: Synthetic coding sequence
atggcagacaaagtactcaaggaaaaacggaagctgttcatcaggagcatgggtgagggaaccattaacggcctgcttgatgagttgttgcagacaagggtgctaaacaaagaggaaatggagaaggtgaaacgggagaatgctaccgtcatggacaaaacccgggccctgatcgactctgtgatccccaagggggcccaagcctgtcagatttgtatcacctatatctgtgaggaagatagttacctggccggtacacttggattaagcgccgatcagactagtggcaactacctgaatatgcaggactcccagggagtgctctcctctttccccgccccgcaagctgtccaagataacccggccatgcctacgtcctccggttccgagggtaacgttaaattgtgctcattggaggaggcccagcggatttggaaacagaagtccgccgagatctatcccatcatggacaaaagcagcagaaccagacttgccctgattatctgcaacgaagaattcgactccattcctcggcgcacaggcgctgaggtggacatcactggcatgactatgttgctccagaacctggggtacagtgtggatgtaaagaagaatttaacagcgtctgacatgacaactgagcttgaggcttttgcccaccggcccgagcataagacttcagattcaacattcctggttttcatgtcccacggcattcgcgagggcatttgcgggaagaaacactctgagcaagtccccgatatcctgcagctgaacgccattttcaacatgcttaatacaaagaactgtcccagtctcaaggataaacccaaggtgatcatcatccaggcttgccggggcgatagccctggggtcgtgtggttcaaggattctgtgggggtctcagggaacctgtccttgcccacaacagaggaatttgaggacgatgctatcaaaaaagcacacatcgagaaggatttcatcgcattctgttccagcacaccagacaatgtgagctggcgtcatcccaccatgggctccgtttttattggccgccttattgagcatatgcaggaatacgcctgttcatgtgatgtcgaggagattttccgcaaggttcgcttcagcttcgaacagcctgatggacgagcccagatgcccaccacagaacgggtgaccctgacccggtgcttttacctgtttccgggacactag

SEQ ID NO: 14312 - DNA, 792 bp, Artificial Sequence
  Description of Artificial Sequence: Synthetic coding sequence
atggcagataaagtgcttaaggagaaacggaagttattcatacgttccatgggagaagcccctcaggctgtccaggacaatcccgccatgcctacatcttctggatctgagggcaacgtcaagttgtgctctctcgaagaggctcaacggatctggaagcagaaatctgctgagatatatccgatcatggataaatcctcaagaactaggctggcacttatcatttgtaacgaggaatttgattctatacccaggaggaccggcgccgaggtagatatcacaggtatgaccatgttgttgcagaatctcgggtattctgtggatgtgaagaaaaatttgacggcctcagacatgacaacagagttagaagcattcgctcaccgccctgagcataagacaagtgatagcacattcctggttttcatgtctcacggcatcagagaggggatttgtggcaagaagcatagtgagcaagttcctgatattctgcaactgaacgctatatttaacatgctgaacaccaaaaactgtcctagcctcaaggataagcctaaggttatcatcatccaggcctgccgaggagataatgtttcatggcggcatcctaccatgggaagtgtcttcatcggacgattaattgaacacatgcaggagtacgcatgcagctgcgacgtggaagaaatcttccgaaaggtgcggtttagctttgaacagcccgatggcagggcgcagatgcccactacggagagggtgactctgacccgttgtttctacctcttccctggccactag

SEQ ID NO: 14313 - DNA, 1368 bp, Artificial Sequence
  Description of Artificial Sequence: Synthetic coding sequence
atgaagagccagggccagcactggtatagttcttccgacaaaaactgcaaagtttcatttcgcgagaaactgttgatcatagactccaacttaggagtgcaggatgttgaaaatttgaagtttttgtgtattgggttggtgcctaataaaaaacttgaaaaatccagttccgcttcagacgtctttgagcacctccttgcagaggacctgcttagcgaggaggatcctttctttttggccgagttgctctacattatccgacagaaaaaactgctccaacacctaaattgcacaaaggaggaggtggagcggctgctgccaacaagacagagagtgtccctattccgaaacctgctatacgagctctcagagggaatagattccgagaacctgaaagacatgatattcctcctcaaggatagcctcccgaagaccgagatgacgtcactttcgttcctggctttcctggaaaaacagggaaagatcgatgaagataacctgacctgtctggaggacctgtgcaaaacagtggtacccaagctattgcggaacattgagaaatataagcgagaaaaggctattcagatcgttaccccacccgtggataaagaagctgagagttatcaaggtgaggaggagctggtcagtcaaactgacgtcaaaacatttctagaggccctgccccaggaaagctggcaaaataaacacgccggcagcaatgaaattttgtctcacgtctttcagtggctcggattcactgtccacattcacaacaatgtaactaaggtcgagatggaaatggttttacagaagcagaaatgcaaccccgctcacgcagatggggattgtttcgtgttctgtattcttacccacggcaggttcggtgctgtctacagctccgatgaggccctgatcccaatccgagaaataatgtcccacttcaccgctctgcagtgccctcgcctggccgagaagccaaagctgttttttatccaggcttgccaaggcgaagaaatccagcctagcgtgtccattgaggctgatgctttgaatcctgagcaagcacccacttctctgcaggatagcatcccagccgaggccgacttcttgcttggcctagccactgtcccagggtacgtgtctttcaggcacgtcgaagaggggtcctggtacatccagagtctgtgtaaccacctgaagaagcttgtgccccgccacgaagacatactgtccatcctcacggccgtcaatgatgacgttagtcgacgtgtcgataagcaggggacaaaaaaacagatgccgcagcctgcattcaccctgcgaaagaaactggtgttccctgtgccgctggatgctctgagtctgtag

SEQ ID NO: 14314 - DNA, 1437 bp, Artificial Sequence
  Description of Artificial Sequence: Synthetic coding sequence
atgaagtctcagggccaacactggtattcttcatcagacaagaactgcaaggtgagctttcgagagaaactgctgattatagatagtaacctgggcgtgcaggatgtcgagaatctgaaatttctatgtatcggactggtgccaaataagaagcttgagaaatccagcagcgcatccgacgtgttcgagcacttgctggctgaagatcttctgtccgaagaagatcccttcttcctggccgagctcctttacatcatcagacaaaagaagctgctccaacatctgaattgtacaaaagaagaggtggagcgtttactccccacgcgccaacgtgtcagcttatttagaaacctgctatatgaactctcggaggggattgattcggagaatcttaaagacatgatttttctcctgaaggacagtttgcctaaaactgaaatgacttctctgagcttccttgccttcctggagaagcagggcaaaatagacgaagataatctgacctgcctggaggacctgtgcaagacggtggtgcccaagctgctgagaaacattgagaaatataagcgagagaaggccattcaaattgtgactccccccgtagataaagaggccgaaagttatcagggagaagaagagctggtgtcacaaactgacgtaaagaccttcctcgaggcacttccgagagccgctgtctataggatgaatagaaatcaccggggtttgtgcgtaattgtgaacaatcatagcttcacgagcctcaaggatcgacagggaactcacaaggacgctgagatcctgtcacatgtgtttcagtggctgggcttcaccgtgcatatccacaataatgtgactaaagtcgagatggagatggtgttgcagaaacagaagtgcaaccccgcccacgctgatggggactgtttcgtgttctgcatcctgacacatggcagattcggagctgtgtattcgtcagatgaggccctcatccccattcgggagataatgtctcactttactgcactgcagtgcccaaggctggccgagaagcctaagctgttcttcattcaagcctgtcagggcgaggagatacagccaagcgtgagcatagaagcggacgccctgaaccccgaacaagcaccgaccagcctgcaggactctatcccagccgaggccgactttctgctcggcctggccactgtacctgggtacgtctcctttcggcatgtcgaagagggatcatggtacattcaatcactgtgcaatcacctgaaaaagttggtcccgcgaatgcttaagttcctggagaagaccatggagatacgcggccgaaagagaactgtgtggggcgccaagcagatctccgcaacttccctcccaacggccatcagtgcccagacacctaggccgcctatgcggcggtggagcagcgtttcttag

SEQ ID NO: 14315 - DNA, 1566 bp, Artificial Sequence
  Description of Artificial Sequence: Synthetic coding sequence
atgaaatctcaagggcaacattggtattcttcaagcgataaaaattgtaaagtttctttccgagaaaagcttctgatcatagatagcaatctgggggtgcaggatgtcgagaacctgaagtttctgtgcattggcctcgtcccaaacaagaaactcgagaagtcttcctcggccagcgacgtctttgaacacttgctggccgaagacctcttgagtgaagaggacccgttttttctggccgagctactttatattatacgccaaaaaaagctgttgcagcacctcaactgcactaaggaggaggtggagcggctgttacctacacgtcagagggtgagccttttcaggaatcttttgtacgagctttctgaggggatcgacagtgagaatctgaaggacatgatctttctactcaaagattcactgcccaagaccgagatgacctccttaagcttcctcgcctttctggaaaagcaaggcaagattgatgaggataacctgacatgtctggaagatttgtgtaaaactgtggtgcctaaattactgcgcaacatcgagaagtacaagcgcgagaaggctatccaaattgtgactccgccagttgacaaggaagctgaaagctatcaaggtgaagaagagctagtaagtcagaccgatgtgaaaacgttcctggaggctttgccacaggagtcgtggcaaaacaagcatgcaggatctaacggcaatagagcaaccaatggtgccccatccctggtcagtcgagggatgcagggcgcttctgccaacacgctgaattccgagacatccaccaagagagctgcagtttacagaatgaacaggaatcatcgcgggctgtgtgtaatagtgaacaaccactcattcactagccttaaggatcggcagggcacgcataaagacgcggagatcctcagtcatgtgttccagtggttgggctttactgtgcacattcataacaacgtgactaaggttgagatggaaatggtcctgcagaagcagaaatgcaatcccgcgcatgctgacggggattgcttcgtgttctgtattctgacgcacgggcgctttggcgcagtgtattcaagtgacgaggcactgatccccatccgggaaatcatgtcccactttacagccctacagtgccctaggttagccgagaagcctaaactcttcttcatacaagcgtgtcagggagaggagattcagccgtccgtgagtatcgaagctgatgcactcaatccagaacaggccccgacaagtctccaggacagtattcctgcagaagcagatttcctgctgggcttggccaccgtacctggatatgtctccttccgccacgtggaggagggcagttggtacattcagtcactatgcaatcacttgaagaaactggttccgcggatgctgaagtttctcgagaagactatggagatccgcgggagaaagcgtacagtttggggggcgaagcagataagcgccacatctctgcctacagccatatcggcacaaacccctcggccaccgatgaggcggtggtcatcggtgtcctag

SEQ ID NO: 14316 - DNA, 1569 bp, Artificial Sequence
  Description of Artificial Sequence: Synthetic coding sequence
atgaagtcccagggtcagcattggtacagttcttcagataagaattgtaaagtgagctttcgtgaaaaactgttgataatcgactctaacctgggggtccaggacgtagaaaacctgaagtttctctgcattggactggtccctaataaaaaactcgaaaagagttcttctgcgtcagacgtgttcgaacatttgctggctgaggatctcctctctgaagaagatcctttcttccttgctgagctcctgtacataattcgacaaaagaagctcctgcagcatctgaattgtacaaaagaggaggtggaacggcttctccccacacgccaacgggttagcctgttccgtaacctactgtatgagctttctgaaggtatcgattcagaaaatctaaaagacatgatattcctcctcaaagattcactcccaaaaaccgagatgactagccttagctttctcgcatttctcgaaaagcaggggaagatcgacgaagataatctgacctgcttggaggatctatgcaaaactgttgtgcctaagcttcttaggaatattgaaaaatataaaagagagaaggctattcagattgtgacgccaccagtggacaaggaggccgagagctatcaaggggaagaagaattggtgtctcagacggatgtgaagacatttctggaggcactgcctcaggagagctggcagaataaacatgccggcagtaatggtaatagggccaccaacggtgccccatccctagtatcgcgaggcatgcaaggggcaagtgccaacactcttaactccgagacaagcaccaagcgggctgccgtctacaggatgaaccgaaaccatcgaggcctgtgtgtgattgtaaataaccattctttcacaagtctgaaagacagacaaggtacccataaagatgctgagatcctttctcacgtgttccagtggcttggcttcacagtccacattcacaataatgttaccaaagttgagatggagatggtcctgcagaagcagaagtgcaaccccgcacacgctgacggggactgctttgtgttctgcattctgacccacggccggtttggagcagtttactccagtgacgaggcgctgatccctatccgcgagatcatgtcccacttcactgcccttcagtgccccaggctggcagagaaaccaaaattattcttcattcaagcatgccagggggaggagattcaaccctcagttagtattgaggcagacgccctgaatcccgaacaggccccaacttccctccaggactcaatcccggcagaagctgattttctgctgggactggctactgtgccaggctatgtgtcctttcgccatgtcgaggaggggagctggtacatccaatctctgtgtaaccatcttaaaaagctggtcccccgccatgaggacattctcagtatcctcaccgccgtgaacgacgatgtcagcaggcgcgtggacaagcagggcactaaaaaacagatgccacagcctgcgttcacgctgcgcaaaaagctggtgtttccggtgccgctggacgctctgtccttgtag

SEQ ID NO: 14317 - DNA, 1440 bp, Artificial Sequence
  Description of Artificial Sequence: Synthetic coding sequence
atgaagtctcagggccagcattggtactcatcgtcggacaaaaactgcaaagtctcttttcgagagaaactgcttattattgactccaatttgggcgttcaggacgtcgagaatctcaaatttttatgcatcggcctcgtgcctaacaaaaaacttgagaaaagttcttccgcatccgatgtttttgagcatcttctggccgaggacttgttaagcgaggaagatcccttctttctcgctgaactactgtacataatacgtcagaaaaagcttttgcagcacctgaattgcactaaggaggaggtcgagagacttctcccaacccgccagagagtcagtctatttcggaacctgctctatgaactgagcgaaggtatagatagtgaaaacttgaaagatatgatctttctcctgaaggatagccttcccaaaacggaaatgacgagcctgtcgttccttgccttccttgagaaacaaggcaagatagatgaagacaacctcacgtgcctggaagatctgtgtaaaaccgtggtgccaaaactgctgaggaacatagagaaatacaagagagaaaaagctattcagattgtcactcccccagtggacaaggaggcagaatcttaccagggcgaagaggagttggtaagccagacggacgtaaaaacatttttggaagcgctccctagagcagccgtctatcggatgaatcggaaccaccgggggctgtgcgtaatagtcaataatcactcatttacatccctcaaggataggcagggtacacacaaggatgcagaaattctgtctcatgtttttcaatggctggggtttacggtccacattcacaataacgtgaccaaggtggagatggaaatggtactgcagaagcagaagtgtaatcctgcacacgccgatggcgactgtttcgttttttgcatcctgacccatggcagattcggcgccgtgtattcttccgatgaagcactaatccctattcgggagatcatgtctcacttcacagctctccaatgccctcgcctggccgaaaagcccaaacttttcttcatacaggcttgccagggcgaggagatccaaccttctgtatccatagaggccgatgccctcaaccctgagcaagctccaaccagcctgcaggactctatacctgctgaggcagacttcctgctgggactggctacagtacctggatatgtcagtttccgacacgtggaagaaggatcatggtacatccagagcctctgtaatcacttaaaaaagctggttcctagacacgaggacatccttagtatcctgaccgccgttaacgacgatgtctccagaagggtagataaacaaggaacaaagaaacaaatgcctcaacccgcattcacccttcgcaagaagctggtattccccgtccccttggacgccctgagcttgtag

SEQ ID NO: 14318 - DNA, 822 bp, Artificial Sequence
  Description of Artificial Sequence: Synthetic coding sequence
atgaagtctcaaggccagcactggtattcttcttctgacaagaactgcaaggttagcttccgcgaaaagctgctgatcatagacagcaacctgggcgtacaagatgtggaaaacctgaaattcctgtgtattgggcttgtgcctaacaagaagcttgagaagtcctctagtgcttcagatgtgtttgaacacctgctagccgaggaccttctcagtgaggaagatccattcttcctcgctgagctgctatatataatccggcaaaagaagctgctccaacacctgaattgtaccaaagaggaagtggagcgcctcctgcctacaagacaaagagtctccctgttccgaaatcttctgtacgaactctccgagggcatcgatagtgaaaatctgaaagatatgatctttctgctgaaagactcgctgcctaaaacagaaatgacctcgctttctttcctggccttccttgagaagcaaggcaaaatcgacgaagacaacctcacatgcctggaagacctatgtaagacggtggtgcctaagctgttacggaacatagaaaagtacaagagagaaaaggccatccagatagtcactccccccgtggacaaggaggccgaatcgtatcagggggaggaggagctcgtatcacagacggacgttaaaacattcttggaagccctgccacaggagtcatggcaaaacaagcatgccgggtctaatgagggaagttgtgttcaggacgaatcagagcctcaaaggccgttgtgccattgtcagcaacctcagctctatttaccagaggggcagacaagaaatccctag

SEQ ID NO: 14319 - DNA, 1533 bp, Artificial Sequence
  Description of Artificial Sequence: Synthetic coding sequence
atggctgcagccgcgctaagagaccctgcacaggtgcctgttgctgcagatctccttaccgatcatgaagaaggttacgtcaccttcgaggacgtggccgtctatttctcccaggaggagtggcggctgttggatgatgcacagcgcctgctgtatcgcaacgtgatgttggaaaactttacgctgctggcgagtctaggcctagcaagcagcaagactcatgagatcacacagctagaaagctgggaggagcccttcatgcctgcctgggaagtggtgacatctgctattccaaggggctgctggcacggtgcggaagcagaggaggccccagaacaaatagcctctgtcggactgctgtcctcaaatatccaacagcaccagaaacagcattgcggcgaaaagcctctcaagcgccaggaaggacgtgtcccagtcctccgttcatgcaaggtgcacctgtccgagaaatctctgcaaagtcgggaggtcggcaaggcccttctgattagttctggagtgctaaagcaccaggttactcacacaggagagaaatcgcatcgcagtagcaaatctcgtgaggcatttcacgccggaaaaagacactacaaatgttccgagtgtgggaaagcctttggccagaaatatctgctggttcagcaccagcggttacatgccggcaagaagacctacgagtgctccgagtgtggcaagctatttagggatatgtcaaatctgtttatccaccaaatcgtgcataccggggagcgcccttatggctgctctaactgcgggaaatctttcagccggaatgctcacttgatcgagcatcagcgggttcacaccggcgagaaacccttcacctgctctgaatgtgggaaggcctttagacataattctacattggtgcagcaccacaaaattcacactggcgtgcgtccctacgagtgctctgaatgcggtaagctgttttcctttaatagttctctaatgaagcatcaacggatccataccggagaacgaccctacaaatgctctgagtgcggaaagttctattcccacaagagcaacctaatcaaacattggcgagtccataccggcgagagaccctataagtgctctgattgcgggaaattcttcacacagtgctcctctctgatgcaacatcagaaggtacatacaggagaaaagccgttcaaatgcaacgagtgcggacgtttcttccgggagaactctactttagtgcgacaccagcgcgtacatacaggggccaagccttacgagtgtagagagtgcgggaagtttttcagtcaatctagcaccttaatgcagcatcggaaagtacatattggagagaaaccatttaagtgtaatgaatgcggccggctcttcagagagaattcatcactcgtaaagcaccagcgggttcataccggagccaagccctacgagtgtagggaatgcggaaagttttttaggcataactcctcactatttaagcacaggagaattcataccggggagatgcaatag

SEQ ID NO: 14320 - DNA, 729 bp, Artificial Sequence
  Description of Artificial Sequence: Synthetic coding sequence
atgtcaaatcctcgatctctggaagaggagaagtatgacatgagcggcgctagactggcactaatcctgtgtgttactaaagcaagggaggggagcgaggaggaccttgacgctctagagcacatgttccggcagctgaggtttgaatcgaccatgaaacgcgatccgactgccgagcagttccaagaggaactcgagaagttccagcaggcgattgatagtagggaggacccagtgagttgtgcctttgtggtgttgatggcacacggacgggaaggattccttaaaggagaagacggagagatggttaaactggaaaacctgtttgaggccctgaacaacaagaattgtcaagccttgcgagccaagcccaaggtgtacataatacaggcctgccgcggggaacagcgggatcctggcgaaacggtcgggggggatgaaatcgtgatggtgattaaagattccccgcagactatcccaacctacaccgatgcactgcatgtttactcaacagttgagggatatattgcctaccgtcacgaccagaagggatcttgtttcattcaaaccctggtggacgttttcacaaaaagaaaaggccatattctggagttgctaaccgaagtgacgcgtagaatggcagaggcagagcttgtgcaagaggggaaggcacggaaaacaaatccagagatccagagcacactgcgaaagaggctttatctccaatag

SEQ ID NO: 14321 - DNA, 1359 bp, Artificial Sequence
  Description of Artificial Sequence: Synthetic coding sequence
atggccgcaccatctgccggcagttggtcaacgttccaacacaaagagctcatggcggcagatcgcggccgaaggatcctgggcgtgtgtggaatgcatccacatcatcaagagaccctgaagaagaatcgcgtggtgctcgccaaacaattgttgttatccgaactcctagagcacctgctggagaaagatattataactctggaaatgagagaacttatccaggcgaaggtgggctccttttcacagaatgtcgaactccttaacctgttacctaagcgaggtccacaggcgtttgatgccttctgcgaagctctcagagaaactaagcaggggcacctggaggacatgctcctcacaaccctctcgggccttcaacatgtactgccccctctgtcatgcgactacgacctgtccctgccctttccggtgtgtgagagttgtccactatataagaagctccgcctgagcacagatacggtcgagcacagtctcgacaacaaggatggtcccgtgtgcctgcaagtgaaaccttgtacacctgaattttatcagacacactttcagctcgcttatagactgcagagcaggcccagggggctggcccttgtcctgtccaacgtgcatttcacaggcgagaaggaactggaattcaggtctggaggcgatgtagaccatagtacgctggtgacattgttcaaactgttaggctatgatgtgcacgtcctgtgcgaccaaactgctcaagagatgcaagaaaagctgcagaattttgcgcaactccctgcccaccgtgtaaccgattcgtgtatcgtggctctgctgtcccacggtgttgaaggcgctatttatggcgtggacggaaagctcctgcaactacaagaggtctttcagttgtttgacaacgctaattgcccatccctccagaacaagccaaagatgttcttcatccaggcttgccgcggggatgagaccgaccgtggagtggaccagcaggatgggaagaaccatgcagggagcccagggtgtgaagaaagtgacgccggaaaggagaagctcccgaaaatgagattaccaacgaggtctgacatgatatgtgggtacgcatgtctcaaaggcaccgcggcaatgagaaacacaaagcggggcagttggtacatcgaggccctggctcaggtattcagcgaaagagcatgtgacatgcatgtggccgacatgctggtaaaagttaacgctctcattaaagatagagagggatatgccccaggtacagagttccatcggtgtaaagagatgagcgagtattgttctactctctgcaggcatttatatctcttccctggacatccaccaacctag

SEQ ID NO: 14322 - DNA, 327 bp, Artificial Sequence
  Description of Artificial Sequence: Synthetic coding sequence
atggctgcaccatccgccggatcatggagtactttccagcacaaggaactcatggcagcagacaggggacgtcgaatcctgggcgtgtgcggtatgcatcctcaccatcaagaaactctgaagaaaaaccgagtcgtcctggcaaaacaactgttgctgagcgagctgttggagcacctgttggagaaggacatcatcacactcgagatgcgagagctcattcaggccaaggtgggcagcttctctcagaatgtggagctccttaacctgcttccaaagcgtgggccccaggcttttgacgctttttgcgaagctttgcatagttag

SEQ ID NO: 14323 - DNA, 942 bp, Artificial Sequence
  Description of Artificial Sequence: Synthetic coding sequence
atgcacccacatcatcaggaaactctgaagaagaatcgagtcgtgctggccaaacagcttctcctgagcgagttactagagcacctcctcgagaaagacatcatcacgcttgagatgcgagagttaattcaggctaaagttggctcattctcccaaaatgtagaactccttaacctgctacccaaaagaggcccccaagcctttgacgcgttttgtgaagcccttagggagaccaaacaagggcatttagaagacatgctcctgaccaccctgtccggactccagcacgttctgcctccactctcatgtgactacgacttatccctcccattccctgtgtgtgagtcctgtccactttacaaaaaattgcgcctcagtacagatacagtggaacattctcttgataacaaggacggtcctgtctgcctgcaagttaagccttgtacaccagaattctatcagacccactttcagctagcctatagactgcaaagccgacccagggggctcgctctcgtactgtctaacgtgcactttacaggggagaaggagctcgaattccgcagcgggggtgatgttgaccactcaacgctggtgaccctgtttaaactcctggggtacgatgttcacgttctgtgcgatcagactgcccaggaaatgcaggaaaaacttcagaacttcgctcagctccccgctcacagagtaacagacagctgtatagtcgctctgttgtcccacggagttgagggtgccatctatggtgtagatgggaagctgctacaactccaggaagtcttccagctcttcgataacgcgaactgcccttcgttacagaacaaacccaagatgttcttcatacaagcctgccgtggcgctggggcaatcggttccctcggccatttgctgctcttcaccgctgctacagctagtctggccttatag

SEQ ID NO: 14324 - DNA, 993 bp, Artificial Sequence
  Description of Artificial Sequence: Synthetic coding sequence
atgctgaagctgaagacaaagtttgggtcctggcagacactctgcaagcgctccaatgtttggcaagataaatgcttctttaagcctttcaacatcgatcagatttcacctaataagaaagctcatccaaacatggaggccggtcctcccgaatcgggtgaatctactgacgccctgaagctgtgtccccatgaggagttcctccgcctttgtaaagagcgcgctgaagaaatctaccccataaaagaacgcaacaaccggactagactggccttgatcatttgtaacacagagtttgaccatctgccacctcgcaacggcgctgatttcgatataaccggtatgaaagagctcctggaggggttggattatagcgtggatgtcgaggagaatctgaccgcacgggatatggaatctgccttgcgagcgtttgctacaaggccagagcataagtcttctgactctacctttctagtgctgatgtcgcacgggattctcgagggcatctgtggcactgttcacgatgaaaaaaagcctgacgtgctcttgtacgacaccatatttcagatctttaataacagaaactgcctaagtctgaaggataagcccaaggtaatcattgtacaggcctgccggggcgccaaccggggcgaactttgggtccgggactcccctgcttcactggaggtcgcaagctcgcagagctccgagaacctcgaggaagacgccgtttataagacccatgtagagaaagatttcattgccttttgctctagtaccccgcataatgtttcttggcgagattccacgatgggaagcatcttcattactcagctgataacctgcttccagaaatattcatggtgctgtcacttggaagaagtatttaggaaagtgcagcagtctttcgagaccccccgggcaaaggcccaaatgccaaccatagagaggctgagcatgaccagatatttttatctattccccgggaattag

SEQ ID NO: 14325 - DNA, 444 bp, Artificial Sequence
  Description of Artificial Sequence: Synthetic coding sequence
atggcagaaggtaatcacagaaagaagccccttaaagtactggaatctctgggcaaagatttcctaacgggagtgttggataatttggtagaacagaatgttttgaactggaaagaggaggagaagaaaaaatactatgatgcgaagactgaagacaaagttcgtgttatggctgatagcatgcaggagaaacagcggatggcggggcagatgctcctgcagacattttttaacatcgatcagattagtccaaataaaaaggctcaccccaatatggaggctggcccccctgaaagcggggaaagcaccgatgccctgaaactctgcccacatgaggaatttctgcgcttatgcaaggaacgcgctgaagagatatacccaattaaagagagaaacaatagaacacgcctggccttgattatctgcaacaccgagttcgactag

SEQ ID NO: 14326 - DNA, 1134 bp, Artificial Sequence
  Description of Artificial Sequence: Synthetic coding sequence
atggcagaggggaatcacaggaaaaaacccctcaaagtcctggagagcctcggaaaggattttttgactggcgttctggataatctcgtcgaacaaaacgtgttgaactggaaagaagaggaaaaaaagaaatactatgacgccaagaccgaagacaaagtcagggtcatggctgattcgatgcaggagaagcagaggatggcgggtcagatgttactccagacattcttcaatattgatcagatcagccctaataaaaaagcccacccaaatatggaagcaggcccaccagagtctggtgagagcactgacgctctgaagctgtgccctcacgaggagtttctacggttatgtaaagaacgcgccgaggagatctacccgattaaagagcgcaataacagaaccagacttgcccttatcatttgtaacaccgagtttgatcacctcccaccgcgaaacggagctgattttgacataacggggatgaaagagctgttggagggacttgattattcagtggatgtggaggaaaatctgaccgcgagagacatggaatctgccctcagagcctttgctactaggcccgagcataagagctccgatagcacttttctcgtccttatgagtcacggcatcctggagggcatatgtggaacagtgcacgacgagaaaaaacccgacgtgctgctgtatgacactatcttccagatctttaataaccgcaactgcctttcattgaaggacaaacccaaggtgattatcgttcaggcttgtagaggggctaatcggggcgagctctgggttagggacagccccgccagcctggaggtggccagcagccagtctagtgaaaacctggaggaggacgctgtgtacaagactcatgtagagaaggactttatcgctttttgctctagcacacctcacaatgtcagctggagagatagcaccatgggctcaatctttatcacccagctgatcacttgtttccagaagtactcctggtgttgccacctggaggaagtctttcgcaaagtccagcagtccttcgaaacgcctcgtgccaaagcccagatgccgacaatcgagagactaagcatgactagatacttttacctgttccccggtaactag

SEQ ID NO: 14327 - DNA, 1305 bp, Artificial Sequence
  Description of Artificial Sequence: Synthetic coding sequence
atggccgaggactctggcaagaagaagcggaggaagaatttcgaggccatgttcaaaggaatcctacagtcagggctcgataacttcgtaattaaccacatgctcaaaaacaatgtcgccggacaaaccagtattcagacactggtgcctaatactgaccagaaatctacaagcgtaaagaaagataaccataaaaagaagacggtgaaaatgctcgaatacctggggaaggatgtgctacatggagtattcaactacctggccaaacatgacgtcctcaccttgaaagaggaagaaaagaaaaagtactacgatacaaaaatcgaggataaggctctgattctggttgattctttacggaagaatcgggtagcgcaccagatgttcacgcagaccctgttgaatatggaccagaagatcaccagcgttaagcctttgctgcagatagaggcaggcccccctgagtccgcagagtctactaacatcctaaaactatgtcctcgtgaagagttcctgcggctgtgcaaaaagaatcatgacgagatttacccgatcaagaaacgagaagaccggaggcggttggcccttataatctgcaataccaagtttgatcacttgcccgcgcggaacggcgcccactacgacattgtcggcatgaaaagactcttacagggtcttgggtacacagtggttgatgagaaaaacctcactgcccgcgacatggaatcagtgttgagagctttcgccgcccggcccgagcataagagttcagactccaccttcctcgttctgatgagccacggaattctcgaaggtatttgcggcactgcacacaaaaaaaaaaagccggatgtgctcctgtacgacaccatttttcagattttcaataaccgaaattgcctgtccttgaaggacaagccaaaagtgattatcgtgcaagcttgtaggggcgagaagcacggagagctttgggtgagagactcccctgccagcctcgctctaatcagttcacaaagcagtgaaaacctggaggccgatagcgtgtgtaagatccacgaagaaaaagattttatcgccttttgttccagtactccccataacgtgtcttggagggatcgaactcgtggatctatcttcataaccgagctgatcacgtgtttccaaaagtattcctgttgttgtcatctgatggagattttcagaaaagtgcagaaaagctttgaagtcccacaggccaaagcccagatgccgactatcgagagggccactcttacaagagatttctacctgttccctggtaattag

SEQ ID NO: 14328 - DNA, 402 bp, Artificial Sequence
  Description of Artificial Sequence: Synthetic coding sequence
atgctgaagaataacgtcgcagggcagacttcaattcagacactagtcccaaacacagatcaaaagagcactagcgtcaagaaggacaatcacaaaaagaagactgtgaagatgctggaatacctcgggaaggatgtgttgcacggggtctttaactatctagcgaagcacgacgtgctgaccttaaaggaagaggagaagaagaagtactatgatacgaagattgaagacaaagccctgattctggtcgactccctgcgtaagaatagggtggctcatcagatgtttacccagacattgctgaacatggaccagaagatcacctccgttaagcaccttagtaacaagaaagaacgtggcccccagacccctgggtctcatcatatgcagtataaagtgtag

SEQ ID NO: 14329 - DNA, 1344 bp, Artificial Sequence
  Description of Artificial Sequence: Synthetic coding sequence
atggcagcagtgccaagagtggaaggagtgttcattttcctgattgaagatagcggcaagaagaagaggagaaaaaattttgaagccatgttcaaggggattcttcagtctggcctggataatttcgtgattaatcacatgctcaaaaataacgtggccggccagacctctattcagacactcgtgccaaatacagaccagaagagtacaagcgtgaaaaaggataaccacaagaaaaaaacagtgaagatgctcgagtatctaggcaaggacgtgttacacggagtgttcaattacctcgcgaaacacgacgttctgacattaaaggaggaggagaaaaagaagtactacgatactaaaatagaagataaagctttgatcctggtggacagtttgcgcaaaaatcgggtggcacaccaaatgtttacacagacccttctgaatatggatcaaaagatcacttcggttaagcctctgctccagatcgaggccggaccacctgagtccgccgaatcaactaacattcttaagctctgccccagagaggaattcttaaggttgtgcaagaaaaaccacgatgagatatacccgatcaagaagcgagaggataggagacggctcgccctgatcatctgtaataccaaatttgaccaccttcccgcacggaacggcgcgcactacgatatcgtagggatgaagagactgcttcagggcttgggctacaccgtggtcgatgaaaagaatctgactgctagggacatggaatctgtgctgcgagccttcgctgcacgtcctgagcacaagtctagcgactcaacctttctggtgttaatgtcccacggtatcctcgagggaatctgtggaacagcccacaagaaaaaaaagccagatgtactgttgtacgacactatttttcagatcttcaataatcgcaattgtttaagtctcaaagacaaacctaaagtgatcatagtgcaggcctgtcgcggggaaaagcacggggagttgtgggtgcgcgattcgccagcgtctctggcactcattagttcacagtcctcggagaacctggaggccgatagcgtctgtaaaattcacgaagaaaaggatttcatcgccttctgttcttcgacaccacacaacgtgagctggcgggatcgaaccaggggatcgatcttcatcaccgagttaatcacatgctttcagaagtacagctgctgttgccacctgatggaaattttcaggaaagtgcagaaaagcttcgaagtgccgcaggcaaaagctcagatgcctacaattgagagagccaccctgaccagagacttctacctgtttcctggaaactag

SEQ ID NO: 14330 - DNA, 879 bp, Artificial Sequence
  Description of Artificial Sequence: Synthetic coding sequence
atggccgcgttgctccagatcgaagcgggcccccctgagtccgcggaaagcactaatatcctgaagctgtgccctagagaggagttcctgagattgtgtaaaaagaatcatgacgaaatatatccaattaagaaaagggaggatcgccgccgcctggctctgattatctgtaacaccaagttcgaccacctgcccgcccggaatggcgcacactatgacatcgtgggaatgaaacgactgctgcaggggcttgggtacaccgttgtggatgaaaagaaccttacagcccgagatatggaatccgtcctgcgggcttttgcagcacggccggagcataaatccagcgatagtacctttctcgtacttatgagtcacggcattctggagggaatctgcggcacagcacacaagaagaagaagccggacgtgctgttgtacgacaccatcttccagatatttaacaataggaattgtctgagcttgaaagataaaccaaaggtcattattgttcaggcctgtaggggagaaaagcatggcgaactttgggtccgtgactcgcctgcctccctggccctgatttcatctcaatcttctgaaaatctggaggccgacagcgtgtgtaagatccatgaagaaaaagactttatcgctttctgctcctctacgccccacaacgtctcgtggagggacaggacacgaggaagtatttttatcaccgaactgattacatgcttccagaagtactcgtgttgctgtcaccttatggaaattttccggaaggtgcaaaagtcctttgaagtgccacaggctaaagctcagatgcccaccatcgagcgtgccacactaacacgggatttttatctttttccaggaaactag

SEQ ID NO: 14331 - DNA, 1131 bp, Artificial Sequence
  Description of Artificial Sequence: Synthetic coding sequence
atggcagaggataatcataaaaagaagaccgtgaaaatgttggagtacctcggaaaggacgtgctgcatggcgtgtttaactatctcgccaaacacgatgtgcttactttgaaggaggaggagaaaaagaagtactacgacaccaaaatcgaggataaggcactgatccttgtagactctcttcggaagaatcgcgtggcacaccagatgtttactcaaacgctgctcaacatggaccagaagatcacctccgtgaagccccttctccagattgaagctggccctcccgagagcgcggagtccacgaacattctcaagttgtgcccccgcgaagaattcttgcggctgtgtaagaagaatcatgacgagatatatcctatcaaaaagagggaagacaggcggcgactggccttgataatctgtaacacaaagtttgaccaccttcctgctagaaacggcgcccactacgatatagtggggatgaaacgtcttctgcaaggcttaggatacaccgtggtggacgagaagaatctgactgcccgggatatggagtctgttctgcgtgcctttgccgctcggcctgagcataaatctagtgactcaacattcctcgttctgatgtcccacggcatcctggagggcatctgcggaactgcacataagaaaaaaaagcccgacgtcctcctgtacgatacaatcttccaaatctttaataacagaaattgtctgtctctcaaggataaaccgaaggtcatcattgtgcaggcatgtagaggagagaaacatggagagctttgggtgcgcgacagcccggcgagcttggcactgataagctctcagtccagtgagaatctggaggccgactctgtttgcaagatccacgaagaaaaggactttattgcattttgcagctcaacgccacacaatgtgagctggagagatcggaccagaggaagtattttcattacggagcttatcacttgctttcagaagtatagctgctgctgccatctaatggagatctttagaaaagttcagaaatccttcgaggttcctcaggcaaaggcgcaaatgccaaccatcgagagagccacacttacccgggatttttatcttttccctggaaattag

SEQ ID NO: 14332 - DNA, 1344 bp, Artificial Sequence
  Description of Artificial Sequence: Synthetic coding sequence
atggcagcagttccccgggtggaaggggtctttatcttcctgattgaggactctggcaaaaagaaaaggaggaagaattttgaggcgatgttcaagggaatcctgcagagcggactggacaacttcgttattaatcatatgctaaaaaacaatgttgccggtcagacttctatccagactctagttccgaacaccgaccaaaagtcgactagcgtcaaaaaagacaaccataagaagaagaccgtgaagatgctggagtacttaggcaaagatgtactgcacggtgtgtttaattacctcgctaagcatgatgtgctaacccttaaggaggaggagaagaaaaagtattatgatacgaagatcgaagacaaggccctgattctggttgattccctgaggaaaaatcgcgtggcccatcagatgtttactcagactctcttaaatatggatcagaaaataacatcggttaagccacttttgcaaatcgaagccggacctcccgagagtgccgaaagtactaatattttaaagctgtgcccacgggaggagttcctgaggctgtgtaaaaagaatcacgacgaaatttacccaatcaagaaaagggaggaccggaggaggctagctctcattatttgcaataccaaatttgatcacctgccagcccgcaatggagctcattatgacattgtcgggatgaaacgcctgttgcagggactggggtatacagtcgttgacgaaaaaaatctaactgcacgggacatggaatctgtgttgagagcattcgctgcgaggcccgaacacaagtccagcgactcaactttccttgttttaatgtcacatggcatattggagggcatctgcggtactgcacataagaagaagaaaccagatgttctgctgtacgacacaatctttcaaatcttcaacaatagaaattgcttgtcgcttaaagataaacccaaggtgattattgtgcaggcttgtcgcggcgagaaacatggggagttatgggtgcgggactcccccgcatccctggctttgattagtagccagtccagtgaaaacctagaggccgatagtgtctgcaaaattcacgaagagaaagacttcattgcgttctgtagttcgactcctcataacgtatcttggagagatcgcactcggggctcaattttcatcactgagctaataacctgtttccaaaagtattcgtgctgctgtcacctgatggagattttcagaaaagtgcaaaagagtttcgaggtcccacaggccaaggctcaaatgcccaccatagagagagccaccctcactcgggacttttacctgttccctgggaattag

SEQ ID NO: 14333 - DNA, 879 bp, Artificial Sequence
  Description of Artificial Sequence: Synthetic coding sequence
atggccgccctgcttcaaatagaagcagggcctccagagtcagctgaatccacgaatattctaaaattgtgtcccagggaggagttcttgcggctgtgtaagaagaatcacgatgagatatatccaatcaaaaaaagagaagaccggcgccggctagccctaatcatttgtaatacaaagttcgaccaccttcctgctcgcaacggcgcacactacgatatcgtaggcatgaaaaggctgctgcagggcctgggctacacagtcgtagatgagaaaaatctgaccgcgcgggacatggagtctgtgctcagagcatttgccgcaagacccgagcataagtcatccgattctacattcctggtcctaatgtcccatggcatcttagaggggatatgcggcactgcccacaagaagaaaaagcccgatgtcttactgtatgacaccatttttcagatatttaataatcgaaattgtctatctttaaaggataaaccaaaggtcatcatcgtgcaggcctgccggggcgagaagcacggggagttatgggtaagggacagtcctgcttccctcgccctcatttcgagccaaagtagcgaaaatttagaggcggacagtgtctgcaagatccacgaggagaaggattttatcgctttctgtagtagtaccccacataatgtgtcctggcgcgacaggaccagaggtagcatattcattacagaactgattacatgctttcagaaatactcttgctgttgtcatctaatggagatctttcgcaaggttcaaaaaagcttcgaggtcccacaggccaaagcccagatgcccaccatagagcgggctactcttactagggatttttacctcttccccggtaattag

SEQ ID NO: 14334 - DNA, 882 bp, Artificial Sequence
  Description of Artificial Sequence: Synthetic coding sequence
atgagctctgctagcgggctgcggcgaggccatcccgccggaggagaagaaaacatgaccgagacggacgccttctacaagagagagatgttcgaccccgccgaaaagtacaagatggaccatagaaggcggggcattgccctgatatttaaccatgaacggtttttctggcacttgactctccctgaaagacgagggacatgcgctgatcgggataacctaacaaggcgattttctgacctggggtttgaggtcaaatgtttcaacgacctcaaggcggaggaactgttattgaagatacacgaggtttcaaccgtctctcacgccgatgccgactgttttgtttgtgtttttctgagtcatggggaagggaatcatatctatgcctatgatgctaagattgagatccaaactcttaccggcctcttcaaaggagataaatgccactctctggtcgggaagccaaagatttttataattcaggcctgccggggcaatcagcatgatgttcccgtcattcctctggacgtcgtggacaatcagacggaaaaactcgacaccaatattacagaggtggacgctgcgtccgtgtacacacttccagccggagccgatttcttgatgtgctactcggtagccgagggttactactctcatcgagaaaccgtcaacgggtcttggtatatacaagacttgtgcgaaatgctgggcaaatatggtagctctttagagttcacggagttgcttacactggtcaatcggaaagtcagtcagcgacgggttgatttttgtaaggacccatcggccattggcaagaaacaggtgccctgcttcgcatccatgctcactaagaagcttcacttttttcccaagtccaactag

SEQ ID NO: 14335 - DNA, 615 bp, Artificial Sequence
  Description of Artificial Sequence: Synthetic coding sequence
atgtccagcgcatctgggctgagacggggccaccctgcggtgtccactgttagtcacgcagatgctgattgcttcgtttgcgtatttctctcacacggagaaggcaatcacatctacgcatacgatgctaaaattgagattcagacactgaccggactttttaaaggagataaatgccattccctagtcggaaaacctaagatcttcatcatccaagcttgtcgcggcaatcagcatgatgtgcccgtgatccccctggatgtggtggacaaccagaccgagaaactggatactaacatcaccgaagtggatgcagcaagcgtgtatacactgcctgccggtgcagactttctgatgtgctattctgtagccgaaggatactatagccatcgtgagaccgtgaacggaagctggtacatacaagatctttgtgagatgctcggtaaatacgggtcatccctagagtttaccgaattactcacattagttaataggaaagtgtcccaacgtcgggtggatttctgtaaagacccctccgctattgggaagaaacaagtgccttgttttgcttctatgttaactaaaaagctgcatttttttccaaaatcaaattag

SEQ ID NO: 14336 - DNA, 912 bp, Artificial Sequence
  Description of Artificial Sequence: Synthetic coding sequence
atggcagatgatcaaggatgcattgaagaacagggagtcgaggatagcgccaacgaagattcagtggacgccaaacctgataggtcatctttcgtgccctccttatttagcaagaagaaaaaaaacgtcaccatgaggagcatcaagacgaccagggaccgcgtgcccacctaccagtacaacatgaactttgaaaagctcgggaaatgcatcatcatcaataataaaaactttgataaggtcacaggaatgggggtcaggaacggcactgacaaggatgcggaggcactcttcaagtgtttcagatcccttggtttcgacgtcatagtatataacgactgcagctgtgcaaaaatgcaggacctgctgaagaaggccagtgaggaagaccacaccaatgcggcatgcttcgcctgcatcctcctgtcccacggggaggaaaacgtcatttacggaaaagatggggtgactccaatcaaagatctgaccgctcacttccggggagacaggtgcaaaaccttactagaaaagcccaagctgttcttcatccaggcatgcaggggcacagaactggatgacgggattcaagccgatagcggccccataaatgacaccgacgctaacccacgttacaaaatccctgttgaagccgatttcctgtttgcctatagtactgtgccaggttactatagctggcgtagtccgggacggggatcctggtttgtccaggccttgtgctccattttggaggagcatggcaaggacctggaaatcatgcagatcctaacacgggtgaatgatcgagtggcgagacactttgagagccagtcagacgatccccatttccacgaaaaaaaacagattccctgcgtggtgtccatgctgacaaaagagctttacttttcccagtag

SEQ ID NO: 14337 - DNA, 912 bp, Artificial Sequence
  Description of Artificial Sequence: Synthetic coding sequence
atggctgatgatcagggttgtatcgaggagcagggagtagaggactctgccaacgaagactctgtggacgcgaaacctgaccggtccagcttcgttccatcacttttttctaaaaaaaaaaaaaatgtgacaatgcgtagcataaaaacaacccgcgatagagtgcctacctaccagtacaatatgaatttcgagaaattgggtaagtgcatcatcattaacaacaaaaattttgataaagtgaccgggatgggagtgcggaatgggactgataaggacgcagaggccctttttaagtgcttccggtctcttggcttcgacgtgatagtgtacaacgactgctcttgcgccaaaatgcaggacttgctgaagaaagcaagtgaggaggatcataccaacgccgcctgtttcgcctgcatcctactgagtcatggagaagaaaatgttatctatggaaaggatggagtgaccccgatcaaagatctcactgcccatttccgaggtgatcgatgtaagaccctgctggagaagccgaagctgttcttcattcaggcatgtaggggcacagaactggatgatggcattcaagcggacagtgggcccatcaacgatactgatgccaatcctcggtataaaatccctgtggaagctgacttcttatttgcctactccacggtccctggctactacagctggcggagccctggtcgtgggagctggttcgtgcaggctctgtgttcaattttggaagaacacgggaaagacctcgagatcatgcagattctcacaagagtgaatgaccgggtcgcccggcactttgaatcccagtcggacgacccacacttccacgaaaagaaacagattccatgcgttgttagtatgctgaccaaggagctttacttttctcagtag

SEQ ID NO: 14338 - DNA, 663 bp, Artificial Sequence
  Description of Artificial Sequence: Synthetic coding sequence
atggccgacgatcaaggatgcattgaggaacagggggttgaggacagcgccaacgaggactccgtcgatgcaaagcccgaccgttcctctttcgtgccaagcctgttttcaaaaaaaaagaagaacgttacgatgcggtctattaagacaacacgagaccgggtacctacatatcaatataacatgaacttcgagaagttgggcaaatgcatcatcattaataataaaaatttcgataaggtgacagggatgggcgtgcggaatgggaccgataaggatgccgaggctttgttcaagtgctttagatccctggggtttgatgttatcgtgtacaatgattgtagtgtcacgcaggccggtgtgcagcggagagacctggggaggttacagcccccaccccctcgttttaaacaatactcgtgcctctctctcctctcatcttgggattataggcatgctcctcctagactggccaacttctgtatttttaggcgggagggattccgccacgttgggcaagctggcctgaagcttctggcctcgtctgaccccccaaccagcggatcgcagagcgcgggaatcactggggtctctctccacacccaaccacaaatcatgaaagtctcattgcgtcactgcaatactttcatttgcttcgcctag

SEQ ID NO: 14339 - DNA, 912 bp, Artificial Sequence
  Description of Artificial Sequence: Synthetic coding sequence
atggccgatgatcagggatgtattgaggagcaaggagtcgaagactccgcaaacgaggacagcgtcgacgctaagcctgacagatccagcttcgtgccctccctgttctcaaaaaaaaagaagaatgttaccatgcgaagtatcaaaacaacacgggatcgtgttcctacttaccaatacaatatgaattttgagaaactgggaaaatgcatcattattaataacaaaaacttcgataaagttacaggcatgggagtcagaaatgggaccgacaaagacgctgaagcgctctttaagtgcttccggtcactaggcttcgacgtcatagtgtataacgactgcagctgtgccaaaatgcaggacctgcttaagaaggcaagcgaggaagaccacacgaatgccgcctgctttgcctgcatactccttagccatggggaggagaacgtgatctacggaaaggacggcgtgactcctatcaaagacctgacagcccactttcgtggggatagatgcaagactttactggagaagcccaaactgttttttatccaggcttgcagaggcactgagttggacgacgggatccaagcagatagcggaccaattaatgatactgacgccaatcctaggtataagatcccagttgaggcggacttcttgtttgcatacagcacagtgcccggctactactcatggaggtcacctggccgtggatcctggttcgtccaggctttgtgctctatccttgaggagcatggtaaggatctggagattatgcagattctgactcgtgtcaatgatcgtgtcgctcgccattttgaatctcagtccgacgatccccacttccatgaaaagaagcagattccctgtgtcgtatccatgttgacaaaagaactttacttctcccagtag

SEQ ID NO: 14340 - DNA, 663 bp, Artificial Sequence
  Description of Artificial Sequence: Synthetic coding sequence
atggcagacgaccagggctgcatcgaagagcaaggagttgaggactcagccaacgaggatagcgttgacgccaagccagaccggtcctccttcgtgcctagcctcttttcaaagaaaaagaaaaatgtcactatgcgtagcattaagaccaccagagatcgcgtacctacgtaccagtacaacatgaattttgagaaattgggaaaatgtatcatcattaataacaagaactttgataaggtcacaggaatgggcgtccggaatggcaccgacaaggacgcagaggccttgtttaagtgcttcaggtccctggggtttgacgtgatcgtctataatgattgttcttttacccaggcaggggtgcagcggcgagatttagggaggctgcagcccccacctcctcgctttaaacaatacagctgcctgagtctgctaagctcttgggattaccggcacgcccctccacgcctggccaatttctgtatcttccggcgggagggatttcgtcatgtgggacaggccggactcaagctgcttgcgtcaagcgaccctcctacttccgggtctcagtcagccggtataactggagtctctctgcacacccagccacagatcatgaaggtcagcctgagacactgtaatactttcatctgtttcgcttag

SEQ ID NO: 14341 - DNA, 1011 bp, Artificial Sequence
  Description of Artificial Sequence: Synthetic coding sequence
atggattgcgtgggctggcccccagggagaaaatggcacctcgagaagaacacctcttgtggcgggtcctctggaatatgtgcatcttatgttacacagatggcagacgaccaagggtgcatcgaagagcaaggagtggaggacagtgccaacgaggacagcgtcgatgccaagccagaccgctcatcattcgtacctagcctgttttctaagaagaagaagaacgtcacaatgagatctatcaaaacaacccgagaccgcgtccccacataccagtataatatgaattttgaaaagcttggcaaatgcataattattaacaacaaaaatttcgataaagtgactgggatgggagtacgaaatggaactgacaaagatgcagaggctttgttcaaatgtttccgaagcctgggcttcgacgtgattgtctataacgattgcagttgcgcaaaaatgcaggacttgctaaaaaaagctagcgaggaggaccacaccaacgctgcctgcttcgcctgcatcctgctcagccatggtgaagagaacgtgatctacggcaaagatggggtgactcctatcaaggacctcaccgcccattttagaggagatcgctgcaaaactctgttggagaagccaaaactgttctttattcaagcctgtaggggcaccgagctcgacgacggcatccaagcagactcggggcctatcaatgatacagacgctaatcccagatataagattccggtggaggcggatttcctattcgcctacagcaccgtgcccggatattattcttggaggtcccccggtcgaggcagctggttcgttcaggctttgtgtagcattcttgaggaacatggcaaggaccttgaaatcatgcagattcttacccgggtgaacgatcgcgtggcccgtcacttcgaatctcagtcggacgatccccactttcatgaaaagaagcagatcccctgtgttgtgtcgatgctgactaaagaactctatttcagtcagtag

SEQ ID NO: 14342 - DNA, 762 bp, Artificial Sequence
  Description of Artificial Sequence: Synthetic coding sequence
atggctgacgatcagggatgtattgaggaacagggagttgaagacagcgctaacgaagatagtgttgatgcaaagcctgacaggtcatctttcgtgccctccctgttctctaagaagaagaagaatgtcactatgaggagtataaaaactacacgcgacagggttccaacgtaccaatacaacatgaactttgagaagctgggaaagtgcattatcattaataacaagaatttcgacaaggtcaccggaatgggcgtgcgcaatggaacagataaggatgctgaagctctgttcaaatgttttagaagtctggggtttgacgtcattgtttataatgactgctcatgcgcaaagatgcaggatctgttaaagaaggcgtccgaggaggaccatacgaacgccgcatgctttgcatgcatcctgctgtcacatggagaagagaatatggaaagttgctccgtgacccaggctggggtgcagcggcgagatctgggacgcctacaacctccacccccccgcctggccgagggccctagcctgatgatggcatctagaccaacgagggggccctccatgacacagatgctcatactcgacacaagaagccagtggaagctgacctctagctctcctataccccgcttccaagctatcacccgaggcggtgcccaggaagaggcaccagggctctgtaagccatcagcaccatcctggaggtctactgaaaagacatggaagtcctgtaggtcttctcccggttag

SEQ ID NO: 14343 - DNA, 669 bp, Artificial Sequence
  Description of Artificial Sequence: Synthetic coding sequence
atggctgatgatcagggttgcatcgaggaacagggcgtagaagactcagccaatgaggattcagttgacgctaagcctgatcgttccagttttgtgcctagccttttctcgaagaaaaaaaaaaacgtcactatgcggtctattaaaactacccgcgaccgcgtacccacataccagtataacatgaatttcgagaaactcggaaagtgcattatcatcaataacaagaattttgataaagtaaccggcatgggagtcaggaatgggactgataaagatgcggaagccctgtttaaatgttttcggtctctcggatttgacgtgatcgtttacaatgactgttcatgtgccaaaatgcaggatctcctgaaaaaggcatcagaagaggatcataccaatgccgcctgctttgcttgtattctgttgtctcacggagaagaaaatgtgatctacggaaaagacggcgtaaccccaatcaaggacctgactgcccatttccgtggggatagatgtaaaaccctgttagagaagccaaaattatttttcattcaggcttgtcggggcacggaactggatgacgggatacaagcagacagtggacctatcaatgatacggacgcaaatccgaggtataaaattcctgtggaagccgacttcctgttcgcctag

SEQ ID NO: 14344 - DNA, 795 bp, Artificial Sequence
  Description of Artificial Sequence: Synthetic coding sequence
atggctgatgatcaggggtgtatcgaagaacaaggtgtcgaagattccgcgaacgaggattccgtggacgctaagcctgatcgcagctcttttgtgccttcgttatttagcaagaaaaagaagaatgtgactatgaggtccataaaaactacccgagacagagtccctacctaccaatataacatgaatttcgaaaaactgggcaaatgcataatcattaacaacaagaattttgataaagtgacaggtatgggagtgagaaacggcactgataaagatgctgaagccctgtttaaatgttttagaagccttggatttgacgtgatcgtctacaacgactgctcctgcgccaaaatgcaggatctgctcaaaaaagcgtcagaagaagatcatacaaatgctgcatgcttcgcttgcatcttattcttcatacaggcatgccggggcacggaactggacgacggtattcaggcagactccggtccaatcaacgacaccgatgcaaaccctcgatataagatccccgtggaagccgattttctgttcgcttactccacagtcccaggctattactcatggaggtcccctggcaggggaagctggttcgtgcaggccctgtgcagcatactagaggagcacggtaaagatctagagatcatgcaaatcctgaccagagttaacgatagagttgcccgccactttgaatcacagagtgatgacccgcatttccacgagaaaaagcagattccttgcgttgtatctatgctgaccaaggagttatatttctcacagtag

SEQ ID NO: 14345 - DNA, 837 bp, Artificial Sequence
  Description of Artificial Sequence: Synthetic coding sequence
atgcaaagaggactgtttagtgatggagacacctctaagaagaaaaaaaatgtcacaatgaggtctatcaaaacaacgcgggatcgcgtgcccacctaccagtacaatatgaacttcgagaagttggggaagtgcatcatcattaataataagaatttcgataaagtcactggcatgggggtccgcaacggcacagataaggacgccgaggccttgtttaagtgcttccgcagcctgggatttgacgtcatcgtgtacaacgattgctcctgtgccaaaatgcaagacctgcttaagaaggcctctgaggaagaccacactaatgctgcttgttttgcttgcatcctgctgagtcacggggaggaaaacgtaatctatggcaaagacggcgtgactcctattaaggacttaacagcacacttccggggcgaccgctgcaagacactgctggagaaacccaagctttttttcattcaggcctgcagaggtactgagttggacgatggtattcaggccgacagtggcccaattaacgatacagacgctaacccccgctacaaaatacctgttgaagcagattttttattcgcatattcaaccgttcccgggtactacagctggcgcagtccaggcagaggaagttggtttgtccaggccctatgttcaatcttggaggagcacggaaaagaccttgagatcatgcagatcttgactcgggtaaacgacagagtagctcggcactttgaatcccaatctgatgaccctcacttccatgaaaagaagcagattccatgcgtggtttccatgcttacaaaggaactctacttcagccagtag

SEQ ID NO: 14346 - DNA, 1188 bp, Artificial Sequence
  Description of Artificial Sequence: Synthetic coding sequence
atggacttctccaggaacctgtatgatatcggagaacaactggatagcgaggatcttgccagcttaaaatttctaagcctggattacattcctcagcgcaagcaagaacctatcaaggatgctctaatgttatttcagcggctgcaagagaagagaatgctcgaggagtccaatctgtccttccttaaggagctcctgtttcgaatcaatagattggatttgctaattacgtatttgaacacaagaaaggaagagatggagcgcgagcttcagacacctggtagagctcagattagcgcatacagggtgatgctttaccagatttccgaggaagtctcgcggtccgagctgagatcctttaaatttctcttgcaagaggaaatctccaagtgtaagttggacgacgacatgaatctcctggacatttttattgagatggagaagcgggtgattttaggagagggtaagctcgacattctgaagagggtctgcgcccagatcaataagagcctattgaagatcattaacgattacgaggagttctccaagggcgccctcaccacaacttttgaggaactgcacttcgagatcaaaccgcacgatgattgtactgtagagcagatctacgagattctcaagatatatcagttgatggatcactccaacatggattgtttcatctgctgcatcttgtcccacggcgacaagggaatcatttatggaacagacggtcaagaagctcctatttatgaactcacctcccagtttacaggtctcaagtgtccttcactcgcgggaaagcctaaggtgttcttcattcaggcttgccagggggataactaccaaaaaggcataccagtagagaccgattccgaggagcagccctatctggagatggacctgtcctccccgcagaccagatacatacccgacgaggctgacttcctgttgggcatggcaaccgtgaacaactgcgtctcgtatcgcaatcccgcagaggggacatggtacattcagtctctttgtcaatcactgcgtgagaggtgccctcgcggggatgacatcttgacaatcttgaccgaagtcaattacgaggtgtcaaacaaggacgacaagaaaaacatgggaaaacagatgccccagcccacctttacccttaggaaaaaacttgtgttcccatccgattag

SEQ ID NO: 14347 - DNA, 1491 bp, Artificial Sequence
  Description of Artificial Sequence: Synthetic coding sequence
atggatttcagcaggaatctgtatgacattggcgagcagctggactcagaagatttggcgtcactcaagttcctgagtctggattatatcccacagcggaagcaggagcctatcaaagatgccctgatgttgtttcagcggttacaagaaaagcggatgctggaggagtctaatttatctttcctcaaggagctgttgttccgaattaacaggctggatttactgattacttatctcaacacacggaaggaagagatggagcgtgaactgcaaacaccaggacgcgcccagatctctgcttatcgctttcacttctgccgtatgtcctgggccgaggcgaattctcagtgtcagacacagagcgtgcccttttggagaagggtggatcacttactgatccgggtcatgttgtatcagatatccgaggaggtgtcacgatctgaattgcgatcatttaagtttttgctgcaagaggaaattagcaagtgtaagttggacgacgatatgaacctgttagatatttttatcgaaatggaaaagagggtgattctgggtgagggaaaactggatatcctcaagcgcgtgtgtgcgcagattaacaagtccctgctaaagatcattaacgattacgaagaatttagcaagggtgaggaattatgcggagtaatgaccatctcagactcccctcgagagcaagattccgagagccagaccctggacaaggtctatcaaatgaagtcgaagcccaggggctattgtctcattatcaacaatcataacttcgctaaagccagagagaaggtccctaaactacactccattcgggatcggaacggcacacacctggatgccggcgccctaaccaccacatttgaggaactgcacttcgaaattaagcctcacgacgactgtacagtggagcagatctacgaaatccttaagatataccagctgatggatcactctaatatggactgctttatctgttgcattctgtcccacggtgacaaggggatcatttacggcacagatggccaggaagcccctatttatgagctgacttcccagtttacagggctgaaatgtccaagtctggcagggaagcctaaagttttcttcatacaggcttgccagggggataattaccaaaaaggcattcccgtggagaccgattcagaagagcaaccatacttggagatggatttaagctccccgcagacaagatacattccagacgaggcagactttctattaggcatggctaccgtgaacaactgtgtaagttacagaaatccagccgaaggaacttggtacatacagtccctgtgtcagtcacttagggaaagatgccctcgaggggatgacatcctgaccattcttaccgaagtcaattatgaggtaagcaataaggatgataagaaaaatatgggaaagcagatgccccagcccacatttacccttcggaaaaaactggtgttcccatccgactag

SEQ ID NO: 14348 - DNA, 1395 bp, Artificial Sequence
  Description of Artificial Sequence: Synthetic coding sequence
atggacttttcaagaaacctctatgatatcggagaacaactcgattctgaggacttggctagtcttaaatttctcagcctcgactatatcccacaacgcaaacaggagccgatcaaggatgctttgatgctctttcagaggttacaagagaagcgcatgctcgaagaatcgaacctgagcttcttgaaggagttgctcttccgtattaaccgtctggatctgctcattacttatctgaacactcgcaaagaggagatggaaagggaacttcaaacacctggcagagcacagatctctgcatacagagtaatgctgtatcagatctctgaagaggtctcccggagtgaactgagaagcttcaagttccttctgcaagaggagattagtaagtgcaagctcgatgatgacatgaacctgttggatatcttcatcgagatggagaagagggtgattctcggggaagggaaattagacatcctcaaacgcgtgtgtgctcagatcaacaaatcactcctgaaaatcatcaacgactatgaggagttttccaagggtgaagagctctgtggtgtaatgacaatttcagattctcctcgtgaacaggactcagagtctcagactctcgacaaagtctatcaaatgaagtccaagcccagaggctactgtctgatcattaataaccacaatttcgccaaggcccgcgaaaaggtccccaaactccacagcatccgtgataggaatggtacacatctcgatgccggcgctctcacgacaaccttcgaggagttacatttcgaaataaagccgcacgatgactgcaccgtggaacaaatttatgaaatcctcaagatctatcagctgatggatcattcgaatatggactgtttcatctgctgcatacttagccacggagacaaaggcataatttacgggaccgacgggcaagaggctcctatttacgagctcaccagccagttcaccggtttgaaatgccctagcctcgcagggaagccgaaggtcttcttcatacaggcttgccagggggataattaccagaaaggtatccctgttgaaactgactccgaagaacaaccctatctggaaatggatctcagctcaccacagacgagatacatcccagatgaggcagacttccttctgggtatggcgaccgttaacaactgcgtcagttacaggaaccccgctgagggtacgtggtacattcagtctctgtgccagagcctccgggaaaggtgtcctcgaggggatgacattctgacaattttaactgaagtaaactacgaggtgagcaataaggatgacaaaaaaaatatgggaaagcagatgcctcagcctaccttcaccctaagaaagaaactcgtgttcccgtctgactag

SEQ ID NO: 14349 - DNA, 1617 bp, Artificial Sequence
  Description of Artificial Sequence: Synthetic coding sequence
atggagggggggagacgggctagagtggtcatcgagagcaagcgaaatttttttttgggagcctttccaaccccgtttcccgccgagcacgtggagctcggccgactgggtgactctgaaacagccatggtacctgggaagggtggggctgactacatactgctgccatttaagaagatggatttcagccgaaatctgtacgacatcggggaacagcttgatagcgaagatctggcctccctcaaatttctgtccctggattacatccctcagagaaaacaggaacctatcaaagacgcgctgatgttgttccagcgacttcaagaaaagcggatgttagaggagtcgaacctttccttcttgaaggagttgctcttccgcatcaatcgactggatctactcatcacctacctgaatacgagaaaggaggagatggagagagagttgcagacaccaggccgggcccagatctccgcatacagggtgatgctgtaccagatttctgaagaggtgagcaggtctgaacttcgaagctttaaattcctcctgcaggaggagatttcgaagtgtaaactggacgacgacatgaacttattggacatcttcatcgaaatggagaagagagtgatcctgggtgagggtaaactggatattttaaagagggtttgcgctcaaatcaataagagcctgctgaagatcattaatgactatgaagagttttctaaggagcgttcctcatcactcgagggctcacccgacgaattctcaaatggcgaagagctgtgcggtgttatgacaatcagcgactctcctcgggagcaggatagtgagtcccagactctggacaaagtttatcagatgaaaagcaagccgcggggctattgtctgattataaataatcacaactttgctaaggctcgtgaaaaggtgccaaaactgcactccattcgggaccgcaacggtacacacctggatgccggggctctgaccactacgttcgaagaactgcacttcgagattaagccacatgacgattgcacagtggagcaaatctacgagatcctgaaaatctatcaactgatggatcactctaacatggattgtttcatctgctgtattctgtctcacggcgataaaggtataatctacggcacagacggccaggaagccccaatttatgagctcaccagtcaatttacggggctaaagtgtccctcactggccggaaaaccaaaagtgtttttcatccaggcttgccagggcgacaactaccagaaaggtattcccgtcgaaaccgacagcgaagaacaaccgtatctggaaatggatctatcaagtccccagacccgatatatccccgacgaggccgactttttactcggcatggctactgtcaacaattgcgtatcctaccgcaatccggcggaaggcacctggtatatccagagtctgtgtcagtcgctacgagagcgctgcccaaggggtgatgacatcttgacaatcctaactgaggtaaattacgaagtctccaacaaggatgataaaaagaatatggggaagcagatgccgcagcccacgtttacactgcgaaaaaagttagtgttcccatctgattag

SEQ ID NO: 14350 - DNA, 708 bp, Artificial Sequence
  Description of Artificial Sequence: Synthetic coding sequence
atggatttctcccgaaacctctacgacataggcgagcaactggactctgaggacttggcctcgctcaagtttctgtccctggactatatcccgcaacggaagcaggagccaattaaggatgctctcatgcttttccaaaggctacaggagaagagaatgctggaagagagtaacctgtcattcctgaaggagttgctatttcggattaaccgcctggacttgcttatcacctatttaaatacccggaaggaagaaatggaaagagagcttcagactcccggacgggctcagatttccgcctacagggtgatgctctatcagatttccgaggaggtcagtaggtctgaattacggtcttttaagtttctgctgcaggaagagatcagcaagtgcaaattggatgatgatatgaacttgcttgacatcttcatagaaatggagaagagagttatcctcggggagggaaaacttgacattctaaaaagagtgtgtgcccagattaataagagcctgctcaagatcataaatgattatgaagaattctcaaaagagcggtcatcctcactagagggctctcctgatgagttctcgaacgactttggccagtcccttcctaatgaaaaacagacctcaggcatcctatcggaccaccagcagagtcaattctgtaaaagcacaggcgaatccgcccagacctctcagcactag

SEQ ID NO: 14351 - DNA, 708 bp, Artificial Sequence
  Description of Artificial Sequence: Synthetic coding sequence
atggacttctcccgcaacctctacgacataggtgagcaactcgattccgaagatctggcgagtcttaaatttttgtcactggattatattccacagcgaaagcaggagcctattaaggatgctctcatgttgttccagcgtctccaagagaagaggatgctggaggagtctaatttgagctttctgaaagagttgctgttccgcatcaatagactagatctgctgattacatacctcaatacccggaaggaggagatggaacgagagctgcaaactccaggacgcgcacaaatatctgcttatagagtgatgctgtatcagatttcagaggaggtctctaggtctgagcttcggtcatttaagtttttactacaggaggagattagcaagtgtaagctcgacgacgacatgaacttgctggatatattcatcgaaatggagaagcgagttattcttggcgaaggtaagctggacatacttaagagggtgtgtgcacagatcaacaagagtttgcttaagatcatcaatgattacgaagagttttctaaagagaggtcctcttctctagagggatctccggatgagttctccaacgactttggccagtctctgccgaacgagaagcagacttctggtattttgagcgatcaccagcaaagtcaattttgcaaatccaccggcgaatcggcccagacctctcagcactag

SEQ ID NO: 14352 - DNA, 837 bp, Artificial Sequence
  Description of Artificial Sequence: Synthetic coding sequence
atggatttttcgcgaaacttgtacgacattggcgagcagcttgactccgaggacctggcttctttgaaattcctgagtcttgactatatcccccagcgaaaacaagagccaatcaaagacgccctaatgctgtttcaacgtttgcaagagaagagaatgcttgaagagtcaaatttgagcttcctgaaggaattacttttccgcattaacaggctggacctcttgataacttatctgaacaccaggaaggaagagatggaacgagagctccagacccctggccgggctcagatcagcgcgtatagggtcatgttataccagattagcgaggaggtttcccggtcagaacttcgctcatttaagtttttgcttcaggaagagattagcaagtgtaaactggatgatgacatgaacctgctggatatttttatagagatggagaagcgcgttatcctgggagagggaaaactagacattctaaaaagagtatgcgcacaaattaacaagagcctcctgaagatcataaatgactatgaggaatttagtaagggagaggaattgtgcggtgtcatgacaatctccgatagtccacgcgagcaggacagcgaatcgcagacccttgataaagtctatcagatgaagagtaagccccgaggttactgcctcatcattaacaaccataatttcgccaaggcacgtgagaaggttccaaagctgcatagtatcagggacaggaatggaactcatctggatgccggctcccatagtgtggcccaggccggggttcagtggtgtgacctttcttcgctgcagccaccacccccgtggttcaaatag

SEQ ID NO: 14353 - DNA, 1395 bp, Artificial Sequence
  Description of Artificial Sequence: Synthetic coding sequence
atggactttagtcggaacctttacgacatcggcgagcagctcgattctgaggacttggcctctctgaaattcctgagtttggactatatcccacaacgtaaacaggagccaatcaaagacgcgttgatgctgttccagcgcttgcaggagaagaggatgctggaagaatcgaatctgagtttcctgaaggaacttctgttccggattaacaggcttgacctgctaattacatacctaaacacgaggaaagaggaaatggagcgagaactgcaaaccccgggcagagcccagatttctgcgtatagggtcatgctttaccaaattagtgaggaggtgagcagatcagaactgcgatcattcaagtttctgttacaggaagagatcagtaaatgcaagctggatgacgatatgaatctgttggacatttttatagagatggaaaaaagagtgatactgggggaggggaagttggatattctcaagcgagtatgtgcccagataaacaaatcactcctgaagatcatcaatgactatgaggagttttcaaagggcgaggagctgtgcggcgtcatgactattagtgactctccacgggagcaggattccgaatctcaaacactggacaaggtatatcagatgaaatccaagccccgaggatactgtctaatcatcaacaaccataacttcgcaaaagctcgggaaaaggtgccgaaactccactctattagggatcgtaatgggacccacttggatgccggagccctcaccacgacctttgaggagctacactttgagattaagcctcatgacgactgcacagtcgagcaaatctatgagatacttaagatctaccaactgatggatcacagcaatatggactgctttatctgctgcatcctctcgcacggcgacaagggcattatctacgggacagacggtcaggaggctcccatttatgagctgacgtctcagtttaccggactaaaatgcccaagtctcgccgggaaacccaaggtattctttattcaggcctgccagggggataattaccagaaagggatcccagtggaaaccgatagcgaggaacagccatatctcgagatggatttgagctcacctcagacacggtatatacccgatgaggcggattttctgctagggatggccaccgtcaataactgtgtgagctatagaaatccagccgaagggacctggtatattcagagtctgtgtcagagtctaagagagcgctgtcctcgcggagatgacatactgaccatacttacggaggtgaactatgaggtttccaacaaggatgataaaaagaatatgggcaaacagatgccccagcccaccttcactcttcggaaaaagctagtgtttccctctgactag

SEQ ID NO: 14354 - DNA, 663 bp, Artificial Sequence
  Description of Artificial Sequence: Synthetic coding sequence
atggatttttcacgcaatctctacgacatcggggaacaactagactcagaggatcttgcctcgctgaaatttctgtccctggactacatccctcagaggaaacaggagcctattaaggacgctttgatgctgtttcagcgcttacaagaaaagcgtatgctggaagaaagtaatttaagcttcctcaaggaacttctctttagaatcaaccggcttgatctattgatcacctatttgaatacccgcaaagaggagatggagcgcgaactgcaaactcctgggagagctcagattagcgcttatagagtgatgctgtatcagatctccgaggaggtgtcaagaagcgagctaagatccttcaaattcctgctgcaggaggagatatccaagtgtaagcttgacgacgatatgaacctactcgatatctttatcgaaatggagaaaagggtgattctaggcgaaggcaagctggatatcttaaagagggtgtgtgctcagattaataagagtctgctcaagattataaatgactacgaggagttctccaaggatttcgggcaatccctgccgaacgagaaacaaacaagcggcattcttagcgatcatcagcagtcccagttttgcaagtctacaggtgagtctgcacagacatctcagcactag

SEQ ID NO: 14355 - DNA, 597 bp, Artificial Sequence
  Description of Artificial Sequence: Synthetic coding sequence
atggacttttcccgtaacctatacgatatcggcgaacagttggattctgaggacctggcgtctctgaagttcctgtccctggattatatcccacaaaggaagcaggagccaatcaaagacgccttaatgctgtttcagaggctgcaggaaaaacggatgctggaggaaagcaacctgtcattcctgaaggaattactgttcagaatcaatcgactcgacctactgatcacctacctgaacacccgtaaagaagaaatggagcgtgagctccagacccctggtcgggcccagatatcagcctatagggtgatgttgtatcagatctccgaagaggtatcccgcagtgagctgagaagtttcaagttcctgcttcaggaggaaatcagtaagtgcaagctggatgacgatatgaaccttctggatatttttatcgaaatggagaaacgcgtgattctgggcgaaggtaaactagatatcctcaagagagtgtgcgcccaaattaataagagtctgctgaaaataatcaatgactatgaggagttctcgaaggaacgatcttctagcctggagggctctcctgacgagttttccaattag

SEQ ID NO: 14356 - DNA, 351 bp, Artificial Sequence
  Description of Artificial Sequence: Synthetic coding sequence
atggatttctctcgtaacctttatgacattggagagcaactggatagtgaggatctagcctcccttaaatttctctctctggattacatcccccagagaaaacaggaaccaattaaggacgccctcatgctgtttcagaggctgcaagaaaaacgtatgttggaggagagtaacctgtcatttttgaaagaactgcttttccgaataaacagactcgacttgctaatcacctacctgaacactagaaaggaggagatggaaagagaactgcagacccccggacgggcccagatcagcgcttacagagtcatgctctatcaaatcagcgaggaagtgtcccgttccgaatag

SEQ ID NO: 14357 - DNA, 1440 bp, Artificial Sequence
  Description of Artificial Sequence: Synthetic coding sequence
atggatttcagcagaaatctgtatgatattggtgagcagttagactcagaggatttagccagccttaagttcctctcactggattatattccccagcggaaacaggagcccatcaaggatgccctgatgctgttccaacgcctgcaagaaaaacggatgctggaggaatcaaacctctcgttcttgaaggagttgctttttcgcatcaatcgactagacctgctcataacatatctgaacacgcgcaaggaggaaatggaacgagagctgcagacccctgggagggcccagatctccgcgtatcgcgttatgctgtatcagattagcgaggaagtatctagatccgaactccggtcgttcaagtttttgctgcaggaagagatttccaagtgtaagctagacgacgacatgaacttgctggacatctttattgagatggagaagagagtgatcctgggcgagggcaaacttgacatcctgaaacgcgtttgtgcccaaattaacaaatccctcttaaagatcatcaacgattatgaggagttctcaaaagagcgctcctcttccctggaaggatccccagatgagtttagtaatggtgaggaactgtgtggagtaatgactatttctgactcacctagggagcaggacagtgagagccagactctggacaaggtgtatcagatgaagtctaagcctcgcgggtactgtttgatcataaataaccacaactttgcaaaagcgcgcgagaaagttcctaagctgcattccattcgggacagaaacgggactcatctagatgctggagcactcaccacaactttcgaggaactccactttgagatcaaacctcacgatgattgcacagttgagcaaatttacgagatcctaaagatctaccagctcatggatcactccaacatggactgcttcatttgctgtattttgagccatggcgacaaagggattatctatggcacagatggccaagaggctccaatctacgaattgactagccagtttacagggctcaaatgtccctcactcgccggcaagcctaaagtcttttttatccaagcttgtcagggggataactatcagaaaggtatccccgtagagaccgattctgaggaacagccgtacctggagatggatctatcaagcccgcaaacgcgctacatccctgatgaagccgattttctgctagggatggctaccgttaacaactgcgtaagctaccgcaatccggccgaggggacatggtacattcagtctctgtgccagtccctgagagaaagatgtcccagaggcgacgacatcctcaccatcctaactgaggtaaactatgaggtgagcaacaaggacgataagaaaaacatgggcaagcagatgccacagcccacattcacattgcgcaagaagctcgtctttccatctgactag

SEQ ID NO: 14358 - DNA, 375 bp, Artificial Sequence
  Description of Artificial Sequence: Synthetic coding sequence
atggacttctccagaaatctgtacgacataggtgagcagctcgacagcgaggacctggcgtcattgaagtttttatcccttgactatattccccagcggaaacaggagcctataaaggacgcactgatgctgttccagcgactccaggagaagcgcatgctggaagagtccaatctgagctttctgaaggagctactgtttcgcatcaacagactggatctgctcattacttacttgaacacacgaaaggaggaaatggagcgggagctgcagaccccagggcgggcccagatcagcgcctatcgggtgatgctctaccagatctcagaggaggtgagcagatcagagctccggagttttaagttcttgctgtag

SEQ ID NO: 14359 - DNA, 630 bp, Artificial Sequence
  Description of Artificial Sequence: Synthetic coding sequence
atggatttttccaggaacctttacgacataggcgaacaactggactctgaagacctggcttcactgaagtttctgagtctagactacattccccaaaggaaacaggaacctattaaagatgcactgatgttgtttcagcgactgcaggaaaagcgtatgctagaggagagtaatctgagcttcctgaaggagctgctttttaggattaaccgcctggatttgctgataacgtatctgaatactcgaaaagaagagatggaacgagaactgcagactcccggacgagctcagattagcgcctaccgcgtcatgctctaccagattagtgaagaagtatcccgttcagagctaagaagtttcaaatttctcctccaggaggaaatctctaaatgcaaactggatgatgatatgaacctgctggacatcttcatcgaaatggaaaagagggtgatccttggtgaaggaaaattagacatcctgaaacgtgtctgtgcgcaaatcaataaatccctactgaagatcattaatgattacgaagaattttccaaagatttcggccaatcactgcccaacgaaaagcaaacatccgggatcttgtcggaccaccagcagagccagttttgcaaatag

SEQ ID NO: 14360 - DNA, 1251 bp, Artificial Sequence
  Description of Artificial Sequence: Synthetic coding sequence
atggatgaagcagatcggcgcctgctcaggcggtgcaggctgcgcctcgtcgaggagctccaggtggatcaactttgggatgctctcttgtctcgggagctcttccggccacacatgatagaggatatccagagggccgggtccggaagcagacgcgatcaggcaagacaactaatcatcgacctcgaaacgagaggcagccaggccctccctctgtttatcagttgcctcgaggacacagggcaggatatgctggcctcctttctgcgcactaatagacaggccgctaaactcagtaagccaaccctggagaatctgacccccgttgtactgaggcccgaaatccggaaaccggaggtcctgagacccgagacccccagaccagttgacattggatctggcgggttcggcgatgtgggcgccctggagtcccttcgcgggaacgctgatcttgcctatatcctgagtatggagccatgcggacactgcctaattattaataacgtcaacttttgtcgggagagtggtctccgcacacggacgggtagtaacattgactgcgagaagcttcgacggaggttcagctcgctccacttcatggtggaggtcaagggcgacctaacagccaagaagatggtactcgcactgctggaactggcacagcaggaccacggggcactggactgttgtgtcgtcgtgatcctgtctcacgggtgccaagcctcccacctccagttccctggcgccgtatatggcaccgacgggtgtccagtcagcgtcgaaaaaattgtgaatatttttaacggcacctcatgccccagcctggggggaaaaccgaaactgtttttcattcaggcttgcggcggggaacagaaagaccatgggttcgaagtcgcatccacttctccggaagatgagtcacccggcagtaacccagaaccagacgcgactccgttccaggagggcctgcgcactttcgaccagttggacgccatcagctccctcccaacaccgtccgacatcttcgtaagttactcaacattccccggcttcgtgtcgtggcgggacccgaagtcaggcagttggtacgtcgagacccttgacgatattttcgagcaatgggcacatagtgaggacctgcagtctctgttgttgagggtcgccaatgcagtgtccgtgaaggggatttacaaacagatgcccgggtgttttaacttcctcaggaagaaactgttcttcaaaacaagttag

SEQ ID NO: 14361 - DNA, 801 bp, Artificial Sequence
  Description of Artificial Sequence: Synthetic coding sequence
atggacgaggccgataggagattgctgcgtcgatgtcgcctccgcctcgtagaagagcttcaggtggaccagctgtgggacgctcttctgtctagggaattgtttcgtccccacatgattgaagatatccaacgagccgggagcggatcgagaagagatcaggcaagacagctgattatagaccttgagaccagaggctcccaagctctcccgctctttattagttgccttgaggacactggccaggatatgctggctagcttcttacgaacaaatcggcaggccgcaaaattatctaagcccacgctagaaaatcttacccccgtggtattgcggcccgaaatccgcaaacctgaagtgctgcgtcccgagactcctcgccctgttgatattgggtctggcgggtttggggacgtggaacagaaggaccatggttttgaagttgcctcgacctcgcctgaggatgagtctcctggatctaatcctgaaccagacgccaccccatttcaagaagggctccgtacctttgaccaattggacgcaatctccagcctccctaccccttcagacatctttgtgtcctattcaaccttcccaggcttcgtttcctggagggaccccaagtcagggagctggtacgtggaaacattggacgacattttcgagcagtgggctcattccgaggacctgcagagtctgctgctgcgggtcgccaatgccgtcagtgtcaaggggatttataagcaaatgcctgggtgctttaactttctgcggaaaaagctcttttttaagacgtcctag

SEQ ID NO: 14362 - DNA, 603 bp, Artificial Sequence
  Description of Artificial Sequence: Synthetic coding sequence
atggagccctgtggacactgcctcatcatcaataacgtaaatttctgcagggaatcgggcctgaggacaaggaccggcagtaatatcgattgtgaaaagcttcgccgcagattctcctccctacattttatggtggaggtgaagggcgatctgactgcaaagaagatggtactggcactgctcgaactggcccagcaggaccatggagctctcgactgctgcgtggtggtcatactctcccacggctgccaggccagccacctgcagtttccgggagccgtgtatggcacggacggctgtccagtttctgtcgagaaaatcgtaaacatattcaacggaacttcgtgtccgtctttaggggggaaacctaagctctttttcatccaggcgtgtgggggtggctttgtgtcatggcgtgatcctaagtccgggagttggtacgttgagaccttggacgatatcttcgaacaatgggcacattcagaggatctccagagtctgctgttaagggtggccaacgccgtttctgtcaaaggaatctacaaacagatgccaggttgctttaactttctccgaaaaaagttgtttttcaaaacttcctag

SEQ ID NO: 14363 - DNA, 1002 bp, Artificial Sequence
  Description of Artificial Sequence: Synthetic coding sequence
atgttggcctcatttctgcgaacaaacagacaggccgcaaagctgagcaaacccacactcgagaatctgaccccagtcgtcctgagaccggaaatacgcaaacccgaggtgttgaggccggagacaccgagacccgtggacattggcagtggggggttcggggatgtcggcgccctggagtccctgcgggggaatgcagacctcgcatacattttaagcatggagccctgtggccactgtcttatcatcaataacgtaaatttttgccgagagtctgggctgcgaactagaacgggtagcaacattgactgcgaaaaattgaggcgtcggtttagtagtctgcactttatggtggaggtcaagggagatctgaccgccaaaaaaatggtgctcgcgttgttagagctcgcccagcaggaccatggggcactagactgttgtgtggtcgtgattctgtcccatggttgccaggcaagtcacttgcagtttccaggtgcggtgtacggaaccgatggatgccctgtaagtgtagagaagattgtaaatatattcaacgggacatcatgcccttcactagggggcaaacccaaactctttttcatacaggcctgtggcggagagcagaaagaccatggctttgaggtggccagtacttcacctgaggacgaatccccaggatctaatcctgagcctgatgcgaccccgttccaggagggtctacggactttcgatcagctggacgcgatttcatccctgcccacccctagcgacatctttgtcagttattctacttttccaggcttcgtatcctggagagaccctaagtctgggagctggtacgtggaaacattggacgacatctttgagcagtgggcgcactctgaagacctccagagccttctcctacgggtggccaatgccgtatcagtgaagggtatatataagcaaatgcctgggtgctttaacttcctgaggaagaagctgttctttaagactagctag

SEQ ID NO: 14364 - DNA, 765 bp, Artificial Sequence
  Description of Artificial Sequence: Synthetic coding sequence
atggacgaggcagatcgcagactgcttagaagatgtcggctgagactggtcgaagagttgcaggtggaccagctgtgggacgccctattgagccgagaactgttcaggccacacatgatcgaagacatccagagagctgggagcggatcgagaagggaccaggcaaggcagctcatcatcgatctggagactaggggatctcaagcactgccactatttataagttgtctggaggataccggtcaagatatgctcgcaagttttttgagaacaaatcggcaggcggcaaaactgagcaagccaacacttgagaatttaacacctgtggtgcttaggccagagatccgaaaacccgaagtactgagacccgaaactcctcggccagtcgatattggatctgggggcttcggcgacgtgggtgccctggagtcacttcgtggaaacgccgacctcgcatatatcctgagcatggagccgtgtggccactgcctcattatcaacaacgtcaatttttgccgggagagcggtctgagaacaagaaccggctccaacatcgactgtgagaagttaaggagaagattctctagtctgcacttcatggtcgaagttaaaggtgatttaactgcaaaagccagtcatttgcaattccccggcgcggtgtacggcacggacgggtgcccagtgtcagtggaaaaaatcgtaaacatttttaacggcacttcatgtccttccctgggcgggaagcccaagctcttttttatttag

SEQ ID NO: 14365 - DNA, 801 bp, Artificial Sequence
  Description of Artificial Sequence: Synthetic coding sequence
atgctggcgtcttttttgaggaccaaccgccaagccgcaaaattatctaaaccgaccttagaaaacttgaccccagtggttctgcggccagagataaggaaacccgaagtgctccggcctgagacgccacgcccagtcgacataggaagtggcggcttcggggatgtgggcgcactggagagcctccgcggcaatgcagacctcgcttacattctgtccatggagccatgtggtcactgtttgatcattaataatgtcaatttttgcagggagtcagggttgcggacccggacggggagcaacatcgactgtgagaagttgcggcggcgattttcgagcctgcactttatggtggaagtcaaaggcgacctcacagccaaaaaaatggtgttggccctcctagaactcgcgcagcaggaccatggtgccctggactgttgtgtcgtcgtgattctttcccatggctgccaggcttctcatctgcagttcccaggcgctgtgtatggaacagacggctgcccagtgagcgtagagaaaattgtgaacatctttaacggcacttcctgtccttccctgggcggcaagcccaagctctttttcatccaggcctgcggaggagaacagaaggaccacggcttcgaggtggcctctacttcacctgaagacgagtcccctgggtctaaccccgaaccagacgcgactccattccaggaagggctgcggacttttgaccagctggatgccatatcgagcctgcctacacccagcgatatttttgtctcctattctactttcccatag

SEQ ID NO: 14366 - DNA, 1266 bp, Artificial Sequence
  Description of Artificial Sequence: Synthetic coding sequence
atggatgaagccgaccgccgcctcttgcgcaggtgccgcctcaggttggtggaggagctacaggtcgaccagctctgggacgccctcctctcgcgtgagctcttcagaccgcatatgattgaggacattcaacgggctggcagcggcagccggagagatcaagctaggcagctgattattgacttggaaactagaggctcacaggcactccccctgttcatcagttgcctcgaagacacaggccaggatatgttagcttcctttctgcggacaaatcggcaggctgcaaagctgtcaaagccaacgttggaaaatcttacccccgtggtgctgcggccagagatcagaaagcccgaagtcctacggcccgaaacgcccaggcctgtggatattgggtccggaggatttggagatgtgggcgccctggaaagccttagaggaaacgccgacctggcatatattctttccatggagccctgcggccactgtctcattatcaacaatgtcaatttctgcagggagtctggcctacgaacaaggaccggcagtaacatcgattgtgagaaattacgccgcagattctcctcactacacttcatggtagaagtgaagggcgacctgacagcaaaaaaaatggtgctcgctctgctggaattagcacagcaagaccacggggctcttgattgctgcgtagttgtgattctgagccatggttgccaggcctctcacctgcagtttcctggagctgtttatgggactgacgggtgccctgtaagcgtagaaaagatagtgaatatcttcaacggtaccagctgtcccagccttggaggcaagcctaagcttttttttatccaggcatgtggcggtgagcagaaagaccatggattcgaagtcgccagcacttctcccgaagacgagagtcccggatcaaaccctgagcccgatgctactcctttccaggagggcttgcgaaccttcgaccaactagacgccatttcttctctacctacaccctccgacatattcgtgagctactcaactttcccaggcttcgtcagttggagggatccgaagtctggctcatggtatgtggagactctggacgatatcttcgagcagtgggcccactcggaagacctgcaatcgctgctccttcgtgtgagtgccgccttcctctgtaaaggcgaaggacgtctattaagggggtcagtctctagctggggctggggcttcggtgttagcagagccgggcccaatcagggatag

SEQ ID NO: 14367 - DNA, 2721 bp, Artificial Sequence
  Description of Artificial Sequence: Synthetic coding sequence
atgactgccgtgcacgctgggaacattaacttcaaatgggatccaaagtctcttgagattcgcacactcgcagttgaacgtttgttggagccgctggtgactcaggtgactactctggtaaataccaactctaagggaccatcaaataaaaaaaggggccggtccaagaaggcacatgtgctggccgcgagtgtggagcaggccactgagaacttcttagagaagggcgacaaaattgccaaagagagtcagttcctgaaagaggagctggtcgccgccgtggaagacgtccgcaaacagggagacctcatgaaggccgcggcgggcgaattcgccgacgatccttgtagttccgtaaagcgggggaatatggtgcgggccgcaagggcacttctctctgccgtcacacggttgttaatcctggctgatatggcggacgtgtacaagttactggtccagttaaaagtggtcgaggatgggatcttgaaacttcggaacgctggcaatgagcaagaccttggtattcaatataaggctctcaagccagaagtagacaaattaaacatcatggccgcgaaaaggcagcaggagctgaaggacgttggacatcgcgatcaaatggctgcagctcgcggtattttgcaaaagaatgtacctatattgtacactgcttcccaggcctgcttacagcatccggatgtcgcagcctataaggctaaccgcgatttaatctacaagcaactacagcaggccgtcacgggaatcagtaacgcagcacaggccacggctagtgacgacgcctcgcaacaccagggagggggaggcggtgagttggcctacgctctgaacaactttgataagcagatcatcgtcgacccactgtccttttcagaggagcgcttccggccatctctggaagagcgtctggagagcatcatttctggggctgccctgatggcggactccagttgcactagggatgataggcgggagaggattgtggccgaatgcaacgctgtcaggcaagccctccaggacttgctttcggagtacatgggaaatgcaggacgcaaagaacggtctgacgcacttaacagtgccattgataaaatgaccaaaaaaaccagagacttgagacggcagttaagaaaggcagttatggaccacgtgtccgatagttttcttgaaacaaatgtgcctctgcttgtacttattgaggcagccaaaaacggaaacgaaaaagaagttaaggagtatgctcaggtgttccgggagcacgccaataaacttatcgaggtggccaaccttgcctgtagcatctccaacaatgaagagggagtgaagctagttaggatgtctgcctcgcagcttgaagcactatgccctcaagtcatcaatgctgccctggctctcgccgccaagccacagtccaagctggctcaagagaatatggacttgttcaaggagcagtgggaaaagcaggtccgtgtcctgaccgatgccgtggacgacattacaagtatagacgatttcctggctgttagcgagaatcatattctcgaggatgtgaataaatgtgtcatcgccctccaggagaaagatgtggacggcctggataggacggccggcgccataagggggagagccgcgcgggtaatccacgtagtgacttccgagatggacaactacgaacctggggtgtataccgagaaagtccttgaagcgacgaaactgttgagtaatactgtcatgcctaggtttactgagcaggtggaggctgccgtggaagccctgtcttctgatcccgcgcagccaatggatgagaatgagtttatcgacgctagccggcttgtctatgacggcatacgagacatacgcaaggctgttctgatgatccgaactcccgaggaactagatgattccgactttgaaacagaggacttcgatgttagatctcggacgtctgttcagaccgaagatgaccagttgatagctggccagtccgccagggcaattatggcccagctgcctcaggagcaaaaggccaagattgccgaacaagtggcatcattccaggaggagaagagtaaactagatgcagaggtcagtaagtgggacgactcagggaacgatatcattgtgctcgcaaaacaaatgtgcatgattatgatggaaatgacagatttcactagaggcaagggccctctgaagaataccagcgatgtgatatctgccgctaagaaaatcgccgaagctggcagtaggatggataagctggggcgaacaatcgctgatcactgccctgactccgcctgcaaacaggatctcctggcttatcttcaaaggatcgctctgtattgccaccagctgaatatttgcagcaaggtgaaagccgaagtgcagaatctcggcggcgagctggttgtgtccggcgtagactctgcgatgtctctcattcaagccgctaagaacttaatgaatgccgtggtgcaaacagtcaaggcctcatatgtcgcaagcaccaagtatcagaagtcacagggaatggcttccctcaatctccccgctgtgtcgtggaagatgaaggcccccgaaaagaaaccattggtgaaaagggagaaacaggatgaaacgcagacaaagatcaagagagccagccaaaaaaagcacgtcaatcctgtccaggcactgtctgaatttaaggcaatggatagcatctag

SEQ ID NO: 14368 - DNA, 2412 bp, Artificial Sequence
  Description of Artificial Sequence: Synthetic coding sequence
atgaaggccgcagcaggtgaatttgcagacgacccctgttcttccgtgaagaggggcaatatggtgcgagcagcaagggctctgctttcagccgtcacacgactgctgatcctggccgatatggctgacgtgtataagctcttagtgcaactcaaagtggttgaagacggtatactgaaattaagaaatgccgggaacgagcaagacttgggcatccaatacaaagcactgaaacctgaagttgataaactgaacattatggccgccaaacgacagcaagagctgaaagacgtgggacacagggaccagatggcagccgcaagaggcattctgcaaaaaaatgttccaatcctgtacaccgcctcccaggcgtgtttgcagcaccccgatgttgctgcttacaaggccaacagggatttgatctataaacaactgcagcaagccgtgaccgggatttctaatgcagctcaagcaaccgccagcgacgatgcgtcgcagcaccagggtggtggggggggcgaactggcgtatgcactcaataacttcgacaagcaaatcatagtcgatccactgagcttcagcgaggagagattccgcccatccctcgaagagcggctggagtcgattatttcaggggcagctctgatggccgattctagctgtacaagggacgaccgccgtgagcggattgttgcagagtgcaacgcagtgcgccaggctctgcaggatctcctgtctgagtatatgggaaacgctggtaggaaagagcgctccgacgccctgaactcggccatagacaagatgaccaaaaagacacgcgatttacggcggcagcttcgcaaggcggtaatggaccacgtaagcgatagcttcctggagaccaatgtgcctctgctggtcctgattgaagcggctaaaaatggcaatgaaaaggaggttaaggaatatgcgcaggtgtttcgcgaacatgctaacaagctcatcgaggtggcgaacttggcttgttccatttccaacaatgaagagggggttaagctggtgagaatgtctgctagtcagctcgaggccctgtgtcctcaggtcattaacgctgcacttgctctcgccgccaagccacagtctaaactcgcccaggaaaatatggatctcttcaaggagcagtgggagaagcaggtgcgagtgctcacagacgccgtggatgatattacttccatcgatgatttcttggctgtatccgagaaccatatcctggaggatgtaaataagtgcgttatagcactgcaagagaaggacgttgacggtctggaccggacagccggagcaattaggggccgagccgccagggtgatacacgtcgttacttctgagatggacaactatgagccaggggtctacactgagaaggtgctagaggccacgaaacttctgagtaatactgtaatgccccgattcacagagcaggtcgaagcggctgtagaggccctcagttctgatcccgcacagcccatggatgaaaatgagtttatcgacgcaagtagactggtgtacgatggcatccgagatatccgtaaagcagtattgatgatccgaactcctgaggaactggatgattccgattttgaaacggaagactttgatgtccggtccagaaccagtgtgcagactgaagatgaccagctgattgcgggacagagcgcaagagcaatcatggcccagctcccacaggagcaaaaggctaagattgcagagcaagttgcctcatttcaggaagaaaagagtaaactcgacgcagaagtctccaaatgggatgactcgggaaacgatatcatcgtccttgccaaacaaatgtgcatgattatgatggaaatgactgattttacccgaggcaagggtcctctcaaaaacacctcagatgtaatttctgctgctaagaagatcgcagaggctggaagtagaatggataaacttggacgcaccatcgcagaccactgccctgacagtgcttgcaaacaggatttattggcctacctgcagcgcatagcactgtattgtcaccagctgaacatttgcagcaaggtcaaggcagaagtgcaaaacctcggaggagaattggtagtctccggcgttgatagcgccatgagtctgatacaagccgccaagaacctgatgaatgctgtcgtccagactgtgaaggcgagctacgtcgcctccactaaataccagaaatctcaggggatggcttcactgaacctcccagcagttagctggaaaatgaaggcccccgaaaagaaacccctcgtgaaacgcgagaaacaggacgagactcagacgaagatcaagcgcgcctctcagaagaaacacgtaaatccagtccaggcactctctgagttcaaggctatggatagcatctag

SEQ ID NO: 14369 - DNA, 357 bp, Artificial Sequence
  Description of Artificial Sequence: Synthetic coding sequence
atgacagcggtccatgcaggtaacattaattttaaatgggaccctaagtcattagagatcaggaccctagctgtggagagactcctggagcccctggtgacccaagtgacaaccttggtcaacactaactcaaaaggtccgtctaataagaaacgagggcgctccaagaaggcacacgttctagccgccagtgtggagcaggccacggagaacttcctggagaaaggggacaaaatagcaaaggaaagccaattcttgaaagaagagctagtcgccgccgtggaggacgtccgaaaacagggggatttgatgaaagctgccgcgggggagttcgccgatgacccatgctctagttag

SEQ ID NO: 14370 - DNA, 420 bp, Artificial Sequence
  Description of Artificial Sequence: Synthetic coding sequence
atgactgcggttcatgcaggaaatataaatttcaagtgggaccctaaatccttggaaatccggacacttgctgtcgaaagactgttggaaccactcgtcacacaggttacaactttagtaaataccaactccaaaggaccctccaataaaaaaagaggtcgatcaaaaaaggcacacgtgctggctgccagcgtagaacaggctaccgaaaatttcctagaaaagggtgataagatcgctaaggagtcccagtttctaaaagaagaacttgtggctgccgtggaagacgtacggaagcagggagatttaatgaaggccgctgctggagagtttgcggatgacccctgctcctctgttaagcgtggaaatatggtaagagccgccagagcgctgctgtctgccgtgactcgactattgtag

SEQ ID NO: 14371 - DNA, 648 bp, Artificial Sequence
  Description of Artificial Sequence: Synthetic coding sequence
atgacagcagtgcacgccggtaatatcaactttaagtgggacccaaaaagcttggaaatcaggacccttgctgttgaaagattactggagcctctcgtcactcaggtcacgacactagtgaatacaaatagcaagggccccagcaacaagaaacgtggaagaagtaaaaaagcccacgtactagcagccagcgtggagcaggccacggaaaatttcctggaaaaaggagacaagatcgccaaagaatctcagttcctgaaggaagagttagtggcagctgtggaggacgtgcgcaagcagggcgacttgatgaaggcggcagcaggtgaattcgccgacgacccttgttcttccgtaaagcggggcaatatggttcgcgccgcaagagccctcctatccgcagttaccagactgctcatactggccgacatggccgatgtgtataagttgctggtacagctgaaggtggtggaagatggaattctgaagctgaggaacgcagggaacgagcaagacctcggcattcagtataaagctctcaaacctgaggtggataaactcaatattatggctgctaaaaggcagcaggagctcaaggacgtgggacatcgggatcagatggccgctgcccgaggaatactgcagtag

SEQ ID NO: 14372 - DNA, 306 bp, Artificial Sequence
  Description of Artificial Sequence: Synthetic coding sequence
atgaccgcagtccacgcagggaacattaattttaaatgggatccaaagagcctggagatacggacgctcgcagtggagagactgctggaaccccttgttacccaggtgactacactcgtaaacactaatagcaaaggaccttccaataagaagcgaggcagatccaagaaggcccacgtcctcgccgcatcagtggaacaagcaacggaaaactttctggagaaaggcgataagatagccaaagagagtcagttcctgaaagaagaactggtcgccgccgtcgaagacgttcgaaagcaggggtag

SEQ ID NO: 14373 - DNA, 372 bp, Artificial Sequence
  Description of Artificial Sequence: Synthetic coding sequence
atgaccgctgtccacgccggaaacatcaacttcaaatgggatccgaaaagtctggagatcagaacacttgctgtagaacgtctcctggagccactagttacccaggtaacaactcttgtcaatacaaactctaaaggtcctagtaacaaaaagagaggaaggtccaagaaagcacacgtcttggccgctagtgtggagcaggcaaccgagaattttctggaaaagggggacaaaattgcaaaagaatcacaattcctgaaagaggagttggtcgccgccgtcgaagacgtacgcaagcagggagacctgatgaaggcagcggccggggagtttgccgatgacccttgcagtagcgtcaagcgaggcaattag

SEQ ID NO: 14374 - DNA, 471 bp, Artificial Sequence
  Description of Artificial Sequence: Synthetic coding sequence
atgacagccgtgcacgcaggtaatatcaacttcaagtgggatccgaaatctctagagatccggaccttggcggtggagagactgttagaaccacttgtgacacaagtcacgaccctagtaaataccaactctaagggcccttcaaataagaagagagggcggagcaaaaaagcccacgtcctagctgcctccgtggagcaggccacggagaacttcctggaaaaaggcgataagattgcaaaggagtcacagttcctgaaggaagagctggtcgctgcagtcgaggacgtaagaaagcagggagatctcatgaaagctgctgccggcgagttcgctgatgacccgtgcagttccgtaaagaggggaaatatggtgcgggccgccagggcactcctcagtgcagttacacgcctgctcatcttggcagacatggctgacgtctacaagttgctcgtgcagctgaaggtttag

SEQ ID NO: 14375 - DNA, 285 bp, Artificial Sequence
  Description of Artificial Sequence: Synthetic coding sequence
atgacggccgtccacgctggcaatattaatttcaaatgggatcccaagagtcttgagatccggaccctcgcagtggagagactgctggaaccattggtgacccaagtcacaaccctcgttaacactaatagcaaggggccaagtaacaagaagagaggacgctcaaagaaagcacacgtgctagccgcatccgtggagcaagccacagaaaatttcttggagaaaggcgataagattgccaaagagtcccaattccttaaagaagagctggtggctgcagtgtag

SEQ ID NO: 14376 - DNA, 2790 bp, Artificial Sequence
  Description of Artificial Sequence: Synthetic coding sequence
atgaccgcagtgcacgctggaaacatcaactttaaatgggacccaaagtcccttgagatccggacactggcggtagaacgtcttttggagcccctggttacccaggtgacgaccctggtcaataccaacagtaaaggaccgtccaataaaaaaagaggacgaagtaaaaaggctcacgtcttggccgcttctgtggagcaggctacagagaactttctggagaagggggacaagatagctaaggagagtcagttcctgaaagaagagctggtggcagctgtggaggatgtcaggaagcagggcgacttgatgaaggcagcagcaggcgagttcgctgacgatccttgttcttccgtcaagaggggaaacatggtgagggccgctagagccctcttatctgccgtaaccagacttcttatcctggcagatatggcagatgtgtacaagttgcttgtacagctcaaggtggtcgaggatggcatcctgaaactgaggaacgccggtaatgagcaggacttgggtattcaatacaaagctttaaagcccgaggttgacaagttaaacatcatggcagcaaaaaggcaacaggagcttaaggacgtgggtcaccgcgaccagatggcagcagccaggggtattctccagaagaacgtacccatattgtacaccgccagtcaggcttgtcttcagcatcccgacgtcgccgcgtacaaggctaatcgagatctgatatataagcagctccagcaggcagtgacaggaatatccaatgctgcccaggcaaccgcgagtgacgatgcatcccagcatcaaggcggtgggggaggtgagttagcctacgccttgaataacttcgacaaacaaataattgtagatcccctatcattctccgaagagcggtttcgaccatcattagaagaaagactggagagcattattagcggagccgcacttatggctgactcaagttgcacaagggacgaccgtcgggaacggatcgttgctgagtgtaatgccgtaaggcaggccctacaggatctgcttagtgaatatatgggaaatgcgggccgcaaggaaagatctgacgccctgaattctgcaatcgataagatgactaaaaagacacgtgacctaaggaggcagctgaggaaggccgtgatggaccacgtttcagattccttcttggagactaatgtgcccctgctcgtgttaatcgaggccgcaaagaacggcaacgaaaaagaagtcaaggaatacgctcaagtttttagggagcatgcaaataaactcatagaagttgccaatctggcctgttccatctcaaacaatgaagaaggggtaaaactggtgagaatgtcagcaagccagctggaagctctctgcccccaggttatcaacgcagcactggcccttgcagcaaagccccagagtaagttggcacaggagaacatggacctgttcaaggagcagtgggaaaaacaagtgagggtcttgactgatgctgtggacgacattaccagcattgacgatttcctggccgtgagtgagaatcatatcctggaagatgttaataaatgtgttattgcactgcaggagaaagacgtggatgggctggacaggacagcaggagccattagaggacgtgccgcccgggtaattcacgtcgtcactagcgagatggataactacgagcctggcgtatacaccgagaaagttctggaggccaccaagcttcttagcaatacagtgatgcccaggtttacagagcaagtggaggctgcagtggaggcgcttagctcagatcctgcccagccaatggatgaaaacgagtttatcgacgcttcccggcttgtgtacgacgggatacgggatattcgcaaggctgtgcttatgataagaaccccggaggagttagatgatagcgatttcgaaaccgaggacttcgacgtcaggagcaggacttcagtgcagacagaagatgaccagcttatagcaggccagagcgccagggcgataatggcacagctgcctcaggaacagaaagcaaaaatcgctgagcaggttgccagctttcaggaagagaaaagtaagctggacgccgaagtgtccaagtgggacgactcaggtaacgatattatcgtcctagccaaacagatgtgtatgatcatgatggaaatgaccgatttcacccgaggaaaggggccccttaagaatacttcagacgttattagcgcagcaaagaagattgctgaggccgggtcccgaatggataagctgggccggacaatcgcagatcactgtcccgactcagcttgtaagcaagatctgctggcatacttacagagaattgcgttgtattgtcaccagttaaatatttgtagtaaggtgaaggcagaggtccagaatcttgggggggaactggtggtaagcggtaactgcgacacatgcggagctcttcaagggctgaaaggctggcctcctcctctttgcgctactcactgggtcgattctgccatgtccttaatccaggcagccaaaaacctaatgaacgccgtggtgcagacagtcaaggcatcctacgttgcaagcacaaagtaccagaagtcacaagggatggcatctctgaatctccctgccgtgtcctggaagatgaaggctcccgaaaagaaacctctggtcaaacgcgagaagcaagacgagacacagaccaagatcaagcgggctagtcaaaagaagcacgtgaacccagtccaagccctatctgaatttaaggccatggattccatctag

SEQ ID NO: 14377 - DNA, 1611 bp, Artificial Sequence
  Description of Artificial Sequence: Synthetic coding sequence
atgaccaagaaaacaagggatctgcgaaggcagctgcgtaaagccgttatggaccacgtgagcgattcattcctggagacaaatgtgccccttctggtactaatcgaggctgctaaaaacggcaacgaaaaggaagttaaagaatatgcccaggtgtttagggagcacgccaataaattgatcgaagtcgctaacctagcctgctccatctcaaacaatgaggagggggtgaagctggtgcgcatgtctgcatctcaactcgaggccctatgcccccaggtgataaacgcagcactggcattagcagccaagccacaaagcaagctggctcaggagaacatggacctgtttaaggaacagtgggaaaagcaggtgcgcgtcctgaccgacgcggtagacgacatcacctcaatcgatgactttttggcggtgagtgaaaatcatatcttggaggacgttaacaagtgtgtcatcgccctgcaagagaaggatgtcgacggtctggaccgcacggcaggcgctatcagaggaagggcggccagggtgatccacgtggtgacttccgagatggataactatgaaccaggagtctatacagagaaggttctggaagcaaccaagctgttgtccaataccgtcatgccaaggtttaccgagcaggtagaggccgctgtggaggctctcagtagtgaccctgcccagcctatggatgagaatgagtttatagatgctagcagactggtctatgatggtatcagggatatccggaaagcagtcctcatgatacgtactccagaagagctggacgacagcgatttcgagacagaggattttgacgtgcgatcgcgaacgtctgtccagacagaggatgatcagctgattgctgggcagagtgctcgggctatcatggcccagctgccacaggagcaaaaggcaaaaatcgctgaacaggtcgcatcattccaggaggagaagtccaaacttgatgcggaggtaagcaaatgggatgatagtggcaatgatattatagtgctggcaaaacagatgtgcatgattatgatggaaatgacggattttacccggggaaaaggacccctgaaaaacactagtgacgtaatttcggcagctaagaagatcgccgaagcaggtagccggatggacaaacttggtagaaccattgcggaccattgtccggacagcgcctgtaagcaagacttactggcttaccttcaaaggatcgctctctattgtcaccagctcaacatctgttccaaagtgaaagccgaggtgcagaacctaggcggagagctggtcgtcagtggcgtcgacagcgcaatgagcttgatccaagccgccaaaaacttgatgaatgctgtggtgcagacagtgaaggcctcatacgtcgccagcactaagtatcagaaaagccaaggcatggcctctctgaacctgccagctgtttcctggaaaatgaaagccccggagaagaagccgttagtgaaaagagagaagcaagacgaaactcaaactaagattaaacgcgccagtcaaaagaagcatgtgaaccccgtgcaggcccttagtgaatttaaggcaatggattccatttag

SEQ ID NO: 14378 - DNA, 2676 bp, Artificial Sequence
  Description of Artificial Sequence: Synthetic coding sequence
atgacagccgtccacgccggtaatattaacttcaaatgggacccaaagtctctcgagatccggactctggccgtggagcgcctgttagagccactggtcacacaggtgaccactctggttaatactaactccaagggcccctccaacaagaagagaggccgaagtaagaaggcccacgtgctggctgctagtgtagaacaagccactgaaaattttctagagaagggtgataagatcgcaaaagagagtcaatttctgaaggaagagctcgtggccgcagtggaagatgtccgaaaacagggggacttgatgaaagcagccgcaggggaatttgctgacgatccatgttccagcgtcaagagaggaaacatggtgcgtgccgcgcgcgccctcctcagcgcggttacgaggctgctgaaagtggtggaggatgggatccttaagctgcgcaatgcaggcaatgaacaggacctgggcattcagtacaaggccctcaagccagaggtagataagcttaatattatggccgctaagcgccagcaggaactgaaggatgttgggcatagagaccaaatggcagctgccagagggatcctccagaagaacgtgccgatcctgtacactgccagccaggcctgtctgcagcacccggatgttgccgcctacaaagcaaatcgagacctgatctacaaacaactgcagcaggctgtcactggaatctctaatgccgctcaagcaacagcttctgatgatgcgtctcagcatcaaggaggaggcggcggcgaactggcctatgccctcaacaattttgataagcagattattgttgatcctctgtctttttctgaggagaggttcaggcctagcctggaggagagactcgagagcatcatctcaggagccgccttaatggccgactcctcttgcactagagacgacagaagagaaaggatagtggcagaatgcaatgcagtccgtcaggcgctccaggatctgctctcagagtatatgggcaatgcaggccggaaggaaagatcagatgccctgaactcagccatcgataaaatgaccaaaaagactagggacctccggcgtcaactgagaaaggcagtgatggaccatgtgagcgattcatttttggaaactaacgtgcccctgctggtactcattgaagcggccaagaatggcaacgagaaagaggtaaaggagtacgcccaagtcttccgggagcacgccaacaaactgattgaagtggcaaacctggcatgcagtatctcaaacaacgaagagggggttaagctcgttcggatgtccgcgtcacaacttgaagccctgtgtccacaggtaatcaacgctgcactggctctggctgctaagccgcagtctaaactcgctcaggagaatatggatctgttcaaagaacaatgggagaagcaggtccgagttcttactgatgccgttgatgacatcacctccattgatgacttcttagccgtatcagaaaatcacatactcgaggacgtgaataagtgtgtcattgccctgcaggaaaaagatgtggacggcttggacaggacggcaggtgccattagggggcgcgctgcccgggtgattcacgtcgtgacctcagaaatggacaactatgagccaggagtctataccgagaaggtgttagaagcaaccaaattactttccaacacagttatgccccggtttaccgaacaggtggaggctgctgtggaggctctgtctagtgatcctgcccagccaatggatgagaacgaatttattgacgccagtcgtttggtgtacgatggcatcagggatattcgcaaagccgtgctcatgataagaacacctgaagagcttgatgattccgactttgagacagaggattttgatgtgagaagtcgaacctcagtgcaaacagaggatgatcaattgatcgcaggccagtccgcacgcgcgatcatggcccagctgcctcaggaacagaaagcgaaaatcgccgagcaggtggcgagcttccaggaagaaaagtctaagcttgacgccgaagtatccaagtgggatgactccggaaacgacatcattgttctggcaaaacagatgtgcatgatcatgatggagatgaccgattttacaagagggaaaggccctctgaagaatactagcgacgttatctctgccgcaaaaaagatcgctgaggctgggagccgcatggataagctggggcgtaccattgctgatcactgcccggattctgcatgtaagcaagatctgcttgcttaccttcaaaggatcgctctttactgccatcaactgaatatttgttccaaggtcaaggccgaggtgcagaaccttggcggagaacttgtggtttctggtgttgactctgctatgagtctaatccaggcagctaaaaatctgatgaatgcggtagtgcagactgtaaaggcctcttacgtggcgtccaccaagtaccagaaatctcagggcatggcaagtctgaacctgccagctgtgtcgtggaagatgaaggcaccagagaaaaaaccactggttaagagggagaagcaagatgaaacccagacaaagatcaaacgagcttcacagaagaaacacgtgaatccagtgcaagcgctgtctgaattcaaagccatggactctatttag

SEQ ID NO: 14379 - DNA, 2346 bp, Artificial Sequence
  Description of Artificial Sequence: Synthetic coding sequence
atggctacacaggctgatctcatggaactggatatggccatggaacctgaccggaaggctgctgtgagccactggcagcagcagagctatctcgacagcggaatccactcaggggctaccacaacagctccatctctgtctggaaaagggaatcccgaggaagaggatgttgatacatctcaggtgctgtatgagtgggagcagggcttcagtcaatcgtttactcaggagcaggtcgcagacattgatgggcagtatgcaatgactagggcacagagggtgcgagctgcgatgtttcctgagacgctcgatgaagggatgcagatcccgagtacccagttcgacgctgcccaccctacaaacgttcagcgacttgccgaacccagtcagatgctcaagcacgccgtagttaacctcattaattaccaggacgacgcagaactcgccaccagagcaatacctgagttgacgaagctgttgaatgatgaagatcaagttgttgttaataaggccgctgttatggttcaccagctctcaaagaaagaggcctcacgacatgctataatgcgttccccccaaatggtgtccgccatagtacgtacaatgcaaaacaccaacgacgtggagacagcccggtgtaccgccggaacactccacaacctctcccatcacagagaggggcttctcgccatttttaagtctgggggcattcctgccttggttaaaatgctgggctcacccgtggactctgtgctgttttatgcaataacaacactgcacaacctcttgctgcaccaggagggcgccaagatggccgttcggctggctggaggacttcaaaagatggtggccttgctgaataagactaatgtcaagtttctcgcaataacaaccgattgcctccagatcttagcctatggaaatcaggaatccaagttaatcatcctggcaagcggagggccacaagcgctggtaaatattatgaggacatatacatatgagaaattgctatggacaacctcccgtgtcctcaaggtgctctcagtgtgtagctctaataagcctgccatcgtcgaggccggaggcatgcaggctctcgggcttcaccttacggacccctcacagaggctagtgcaaaattgtctttggactctgagaaatttgagtgacgccgctaccaagcaggagggtatggagggactgctaggaacactggtacagctgcttgggtctgatgacataaacgtggtcacatgtgctgcgggaatcctgtcaaacctgacctgtaacaactataagaacaaaatgatggtctgccaagtgggtggaatcgaagcactggtacggaccgttctacgggccggagatcgggaggacatcactgaaccagcgatttgtgccctgcgccatctgacaagccggcatcaggaggccgagatggcacagaatgccgtacggctgcactacggactgcccgttgtggtgaagctgctgcatcccccatcccattggcccttaatcaaagccaccgttggattgatcagaaacctggccttatgtccagcgaaccatgctccccttcgagaacaaggtgcgataccccgcctggtccagttgttggtaagggcccatcaggacactcaaaggcggacatctatgggaggtacacagcagcagtttgtcgagggggttaggatggaggagattgtggaaggttgtactggggcacttcatatcctagcccgggacgtgcacaacagaattgttatcagaggcctcaatactattccattgtttgtgcagctgctatattcgcccatcgaaaatatccaaagggttgcagccggggtcctgtgtgagttggctcaggacaaagaagcggcagaggctatcgaagcagagggcgctaccgctcccttgactgagctgttgcactccaggaacgagggggtggccacttacgcagctgctgtgctttttcgaatgtccgaggacaaacctcaggattataaaaagaggctgagcgtggagcttacttcctccttatttaggacggagcccatggcttggaatgagaccgctgaccttgggctcgacatcggggcacaaggcgaaccccttggctacagacaggatgacccttcatacagatctttccattctggaggatacggccaagacgccctcggaatggaccctatgatggagcacgagatgggggggcaccacccaggggccgactaccccgtagacggtttacctgatctaggtcatgcccaggacctcatggatggcctaccacccggggactcaaaccaactggcgtggtttgacaccgacctgtag

SEQ ID NO: 14380 - DNA, 2346 bp, Artificial Sequence
  Description of Artificial Sequence: Synthetic coding sequence
atggctactcaggcagacctgatggaacttgatatggccatggagcccgaccgtaaagccgccgtgtcacactggcagcagcaaagctaccttgattccggaattcactccggcgccaccacaactgctccctccctttccgggaaggggaatcctgaggaagaggacgtggatacgtctcaggtgctttatgagtgggagcagggcttcagccagtctttcacgcaggagcaagtcgccgatatagacggacagtacgctatgactcgagcccaaagagtccgggctgctatgttcccagagactcttgacgagggaatgcagatcccttctacccagttcgatgccgcacacccaaccaacgttcaaaggttagctgagcccagtcagatgctcaagcacgcagtcgtgaacttgatcaattatcaagatgacgctgagctggccacacgagcgataccggagctgactaaactgctgaatgatgaagaccaggtcgtggtgaataaggcggccgtgatggttcaccagctgtcaaaaaaagaagccagccgccacgctataatgcgcagcccccagatggtcagtgcaatagttagaactatgcagaatactaacgacgtggagaccgctcgctgtaccgctggaaccctgcataacttatcccaccacagggaaggccttctggctattttcaaatctggtggcattccagcccttgtcaagatgctgggttcgcccgtcgactccgttctgttctacgcgattaccacattacacaatttgttgcttcaccaggaaggcgctaagatggcagtcaggcttgctgggggtcttcaaaagatggtggctttgctgaataagactaatgtgaagttcttggctattaccacggactgtctgcagattctggcttacggtaatcaggagtccaagctcattatactggcaagtggaggcccccaagcgcttgtaaatatcatgcggacttatacttatgaaaaactactgtggacaactagtagggttcttaaagttctgtcagtgtgcagtagcaacaagccagccatcgtggaagcgggaggtatgcaggcccttggattgcacctaactgatcctagtcagcgtctggtgcagaattgcttgtggactctgcggaatctgtccgatgctgccaccaagcaggagggtatggagggccttttgggaacgctagtgcagcttcttggctctgacgacatcaacgtggttacgtgcgcggcagggatcctctccaacctcacttgtaacaactataaaaataaaatgatggtttgccaggtgggaggtattgaggccttggtgagaaccgtgttgcgggctggcgatcgcgaagacattacagagccagctatctgtgccctgaggcatctcacttctaggcaccaggaggcagaaatggcacagaacgccgtgagactgcattacggactgccggtagtcgtcaaactgctgcatcccccttcgcactggcctctgataaaagctaccgtgggcctcatcaggaacctggcattgtgtcccgccaatcacgctcctctaagggaacaaggcgccatcccgagattggtgcaactcctcgtgcgcgcgcaccaagatacgcagcggagaacctccatgggcggcacacaacagcagttcgtggagggggtgagaatggaggagatagtagaagggtgcaccggggctctgcatatcctagccagggacgtgcacaataggatcgtgatccgtggtctcaacaccattcctctgttcgttcagctgctctatagccccatcgagaacatccagagggtcgcagccggggtgctttgcgagcttgcacaggataaggaagccgctgaagccatagaggctgaaggtgcgactgctcccctgacagaattgttgcactcccgcaacgaaggcgttgctacgtacgctgcagctgtgctcttcaggatgagtgaagataaacctcaggattataaaaaaagactgtctgttgagctgactagctcactgttcagaacagagccgatggcctggaacgagacagccgatttaggcctggacattggggcacagggggagcctctgggatatcgccaggacgacccttcatatcgtagtttccattctggtggctatggccaggatgccctgggtatggatccaatgatggagcacgaaatgggaggtcatcatcccggggccgattatcccgtggatgggctccccgatctcggtcatgcccaggatctgatggatgggctcccgcccggtgactctaatcagctggcttggtttgataccgacctctag

SEQ ID NO: 14381 - DNA, 2346 bp, Artificial Sequence
  Description of Artificial Sequence: Synthetic coding sequence
atggctactcaggcagatctgatggaactggatatggctatggaacctgataggaaagcggctgtctcccactggcaacaacaatcttatcttgactccgggatccattcgggtgccactactacagctcccagtctttctggcaagggaaaccccgaggaggaggacgtagacacctctcaggtgctttacgagtgggaacaggggtttagtcagagttttacccaggaacaggtcgccgacatcgatggccagtacgcgatgactcgggcccagagagtgcgagctgccatgttccctgagacccttgatgagggaatgcagattcccagtacccagttcgacgccgcccatcctacaaatgtgcaacgcctggccgagccatctcagatgctcaaacacgcagtggtaaacctcatcaattatcaggatgatgcagagctcgccacccgggccatacctgaattgacaaaattgttgaacgacgaagatcaagtcgtcgttaataaagcggctgtgatggtgcaccagctgtccaaaaaagaggccagcaggcatgcgatcatgcgaagcccacagatggtatcagcgatcgtacgtactatgcagaacacaaacgatgtggagactgccaggtgtaccgccggcaccctgcacaatctgagccaccaccgcgaaggactcctggccatcttcaagagtgggggtatcccggctctggtgaaaatgctcggctcccctgtggattctgtgctcttctacgctatcaccactctgcacaatctgcttctccatcaagaaggggcgaagatggcagtgcgacttgccggcgggctgcaaaaaatggtcgctctacttaataaaacgaatgtcaagtttctggccattacaactgactgccttcagatcttagcatatggaaatcaggaatccaaactgataattcttgcttcgggcggaccgcaggcgcttgtaaatatcatgcgcacctatacttacgagaaactactttggactaccagtagagtgctcaaggtgttgtccgtttgttcttcaaataagcctgcaatcgtcgaggccggaggcatgcaggcacttggactgcaccttacggacccctcacagagactggtccagaattgcttatggacacttcgaaatctgagcgatgccgcaactaaacaggaggggatggagggcctgttgggaacactggtgcagctgcttggatccgatgatatcaatgtcgtaacctgtgccgccggaatcctaagcaaccttacatgcaacaactacaagaataagatgatggtttgccaggtgggcggcatagaggccttggttcgcacagtgctcagagccggcgaccgcgaagatatcaccgaacccgccatctgcgcacttcggcaccttaccagcaggcaccaggaagcagaaatggcccaaaacgctgtgcggctgcactatggcctgcccgtcgttgtcaaacttctgcatccgccttcccactggcccctgatcaaagctaccgtcgggttgatccgcaatctggctctgtgtccagccaatcatgcccctctgagagagcaaggagctataccccggctggtgcaactgctggtgagagcccatcaggacacccagcggcggacatccatgggagggacccagcagcaatttgtcgaaggtgtgagaatggaggagatcgtcgaaggttgtactggcgcccttcacattttagcaagggacgtacataacagaatcgtgattaggggtctgaatactattcccctcttcgtgcagctcctgtatagccctatagaaaacatccagagagtggcagcaggggtgttgtgtgagttggcgcaggataaagaagctgcggaggccatcgaggctgagggcgctaccgctcccctgactgagctgctgcattccagaaatgaaggcgttgccacctacgctgccgcggtgctctttcggatgtcagaagacaagcctcaggattacaaaaagcggctcagtgtggaacttacgtcgagcttatttcgcactgaacctatggcttggaacgagacagctgacctaggattggatatcggcgctcagggggagcccctgggttataggcaggacgatcctagctaccgaagctttcatagcggcgggtacggacaggacgccttaggaatggacccaatgatggaacatgagatgggtggacaccaccccggagcagactatccagtggatggcttgccggacctgggacacgctcaagacctaatggacggcctacccccaggcgactccaatcaattggcttggtttgacacggacttgtag

SEQ ID NO: 14382 - DNA, 2346 bp, Artificial Sequence
  Description of Artificial Sequence: Synthetic coding sequence
atggctactcaggcagatcttatggaattggatatggcgatggaaccagaccggaaggctgcagtgtcccactggcaacagcagtcatacctggattccggcattcactctggcgccactacgacggcccccagtctgagtggcaaaggaaacccagaagaggaggatgttgacacctcacaggttctgtacgagtgggagcaggggttttcacaatccttcactcaagagcaagtggctgacatagatgggcaatatgcaatgacacgcgcacagcgggtccgcgctgctatgtttcctgagactttggatgagggcatgcaaatccccagtacccaatttgacgccgcccatcccacgaatgtccaaaggctggcagagccttcacagatgctgaagcacgcagtggtgaatcttataaactaccaggacgacgctgagctggccacaagagctattcccgagctgaccaaactcctcaacgacgaggaccaggtggtcgtcaacaaggcagctgtcatggtgcaccaactaagcaaaaaggaggctagccgtcacgctataatgagatcgccacaaatggtctcggcaattgtaagaacgatgcagaatacaaacgacgtggagactgcaagatgcaccgcgggcaccctccataacttatcacaccaccgggagggactccttgctatatttaaatcaggtggcatccctgcgctagtgaagatgctcggcagtcctgttgacagtgtccttttctacgcaataactaccctccacaaccttttgctgcatcaggagggggctaaaatggccgtccgtctcgccggcggcctgcagaagatggtagccttgctcaacaagaccaatgttaaatttctggctatcaccaccgactgcctgcagattctcgcttacggaaatcaggagtccaagctcataattttggcaagcggcggaccacaggcactcgtcaatataatgaggacctatacctacgagaagctgctctggactacctctagggtgctgaaggtactcagcgtctgcagcagtaacaaacccgctatcgtggaagctgggggcatgcaggcacttggactgcatttaacagacccgagtcaacgcttggttcaaaattgcctctggaccctcagaaatctgagcgacgcagcaactaaacaggagggcatggagggcttgctcggtactctggttcagcttctgggcagcgatgatataaacgtagtcacttgcgcagctgggattcttagcaatctaacttgcaataattacaaaaataagatgatggtatgccaagtgggaggtattgaagccctcgtacgtacagtcctccgggcaggggatcgtgaggatatcaccgagccagcaatttgcgccctcaggcacctaactagtcgccatcaagaggccgagatggcccagaatgcggtcagactgcattacggtctgccagtggttgtgaagcttctccacccaccttctcattggcctttaatcaaggccaccgtcggacttatcaggaacctcgccctctgcccggctaatcatgctcccctgcgagaacagggggcgatcccccgactggtgcagctgctcgttagagctcaccaggacacccagaggcgaacctccatgggcggtacccagcagcagtttgtggaaggtgttaggatggaggagatagtagaggggtgcaccggcgccctccatatactcgccagagatgtgcataatcgtatcgtgattagagggctgaatacgattccactgtttgtgcagctcttgtattcacccatagagaacatacaaagagtggctgcgggagtgctgtgtgagctcgcccaggataaggaagctgctgaggcaattgaggcagagggagctaccgctcctctgactgagctgctccacagccgtaacgaaggcgtggctacctatgccgccgccgtcctgtttcgcatgtcagaagacaaaccacaagactacaagaaacggctttcagtcgagttgacctcctctctctttaggactgagcccatggcttggaatgaaacagccgatcttggtcttgacattggtgcgcagggggagccgctgggttacagacaagacgaccctagctaccggtcttttcattccggcggatacggacaagacgctttaggtatggatcccatgatggagcatgagatgggggggcaccaccctggtgcggattacccagtggatggactccccgacttgggacacgcccaggaccttatggatggacttcctcccggagactccaaccagctcgcatggttcgacacagacctgtag

SEQ ID NO: 14383 - DNA, 453 bp, Artificial Sequence
  Description of Artificial Sequence: Synthetic coding sequence
atggccacacaggcagacttgatggaactggacatggctatggagccagacagaaaggctgccgtgtcacactggcagcagcagagctatctggactcagggatacacagtggagccactacaaccgctcctagccttagcggaaagggaaaccccgaggaggaagatgtcgatacttctcaggtgttatacgaatgggaacaggggttctcacagtcgtttacccaggaacaagtcgcagatattgatgggcagtatgctatgactagagcgcagagagtgcgggcagccatgttcccagagaccctcgacgaaggtatgcaaattccaagcacccagtttgatgcggcacatcccacaaatgtccaacgattggctgagccaagtcagatgctgaaacatgctgtggtaaacttgatcaattatcaggatgacgcagagctcgcgacttag

SEQ ID NO: 14384 - DNA, 42 bp, Artificial Sequence
  Description of Artificial Sequence: Synthetic coding sequence
atggctacccaggccgacctgatggagctagacatggcgtag

SEQ ID NO: 14385 - DNA, 303 bp, Artificial Sequence
  Description of Artificial Sequence: Synthetic coding sequence
atggccacacaggcagacctgatggagctcgacatggccatggaacccgacaggaaagccgctgtgagtcattggcagcagcagtcttatttggattcgggaatacactctggagcaaccacgactgctccttccctgtcagggaagggcaacccagaggaagaggacgtcgacaccagccaggtactctacgaatgggagcagggattttcacagtcatttactcaagagcaggtggccgacatagacgggcagtacgcgatgaccagagcccagcgagtgcgagcagcgatgtttccctag

SEQ ID NO: 14386 - DNA, 327 bp, Artificial Sequence
  Description of Artificial Sequence: Synthetic coding sequence
atggcgacacaggcagacctcatggagctggatatggctatggagcccgaccgcaaggccgcagtgagccactggcaacagcagagctacctggacagcggtatccatagcggagccaccactaccgctccttccctgagtggaaaagggaaccccgaagaagaggacgtggatactagtcaagtactctacgagtgggaacaaggcttctcacagagttttacgcaggaacaggtggccgatatcgatggacaatatgccatgacccgcgcacagagggtgcgggcggccatgtttcctgaaacacttgacgaagggatgcagtag

SEQ ID NO: 14387 - DNA, 2325 bp, Artificial Sequence
  Description of Artificial Sequence: Synthetic coding sequence
atggaattggacatggccatggaaccagatcgcaaagccgccgtttcccattggcagcaacagtcctatctggacagtggcattcacagcggtgccacgacaactgcgccttcgctgtcagggaagggcaatcccgaggaggaagacgtggacacctcccaggtattgtacgaatgggagcagggattctctcagtcttttacacaggaacaagtggcagatatcgacggccaatacgcgatgacacgggcgcaaagggtgcgggccgctatgttcccagagacactcgacgaaggtatgcaaattcccagtacacagttcgatgcagctcacccaacaaacgttcagagactcgccgagccctctcaaatgcttaagcacgcagtggtcaaccttatcaactatcaggacgatgcggagctagcaactcgggcgatcccagaactgaccaagctcttgaacgatgaggaccaagtggttgtcaataaggccgcagtgatggtgcatcaactttcaaaaaaggaagcctctcgccacgccatcatgcgttccccccagatggttagcgccatcgtacgcaccatgcagaacactaatgatgtggagactgcaagatgcaccgccggaaccctccacaacctgtcccaccacagggaggggctgctagccatatttaagtctgggggtattcctgcccttgttaagatgctcggaagtcccgttgactcagttctcttctatgccataactactcttcacaatcttcttctgcatcaagagggagccaaaatggcagtgcgtctcgcaggagggttgcagaagatggtcgccctgttaaacaaaactaacgttaagttcctcgcaatcactaccgattgcctgcagatattagcctacgggaatcaagaaagcaagctaatcattctcgcttcgggcgggcctcaggcactagtcaacatcatgcggacatatacctatgagaagctcctgtggactacgtccagagtactgaaagtgctgagcgtttgctcctctaataaacctgctatcgtggaagctggcggcatgcaagcactcggcctccacttgactgatccttcccagaggcttgtgcagaactgcctttggacactgcgtaatctgtccgatgccgccaccaagcaggaagggatggaagggcttcttggcactttagtgcagttgctcgggagtgacgatatcaacgtggtgacgtgtgctgctgggattctctccaacttgacgtgcaataactacaaaaataagatgatggtttgtcaggttggcggcatcgaggctctcgtgaggaccgtgctccgcgcaggcgacagggaggatatcaccgagcctgctatctgtgcactgcgtcacctcacctccagacatcaggaggcagaaatggcccaaaacgctgtcaggcttcattatggactgcccgtcgttgtgaaactgctccacccacctagtcactggcccctgattaaagccactgtagggctcatccgaaaccttgctctgtgcccagcaaaccacgcgccactgagagagcagggggccattcctagactagtccagttgctggtcagggcacatcaagatactcaaagacggacctctatgggcggcacacagcagcagtttgtggagggcgtaagaatggaggagattgtggaggggtgcacgggcgctttgcacattttggcacgtgacgtgcataacagaattgtgattcggggcctgaacacgatcccccttttcgtgcagctgctttactcgcctatcgaaaacatccagagggtagccgccggcgttctgtgcgaactggcacaggacaaagaggccgctgaggccatagaggcagagggggccaccgctcctttgacagaactcctccactcacgaaacgaaggcgtggcaacctatgccgccgctgtcctgttccgcatgtcagaggacaagccccaggactacaagaagagactcagcgtagaactgacatcctccctgttccgtaccgaacccatggcatggaatgagacggcagatctcggtctggacataggggcccagggcgaaccactggggtatcgacaggatgacccatcttaccgaagcttccatagcgggggctacggtcaggatgcgctcggcatggatccgatgatggagcacgagatggggggccatcatccgggagccgactaccccgttgacgggttacctgatctgggtcacgcccaggacctaatggatggactgccccccggggattccaaccagctcgcctggtttgacacagacctgtag

SEQ ID NO: 14388 - DNA, 1020 bp, Artificial Sequence
  Description of Artificial Sequence: Synthetic coding sequence
atgtggcagctgtgggcctccctgtgctgtctgctcgtccttgccaatgctcgcagcagaccaagctttcaccccctctcggacgagctggtcaactacgtaaataagcggaatacaacttggcaggctggccacaacttttacaacgtggacatgagctaccttaagcgactgtgtggcacattccttggaggacctaagccaccccagcgggtgatgttcaccgaagatctcaagctgcccgcctcttttgacgctcgcgaacagtggccccagtgtccaactattaaggagatccgggatcaagggagctgtggcagctgttgggctttcggcgcagtcgaagccatctctgatcgcatctgtattcatactaatgcacatgtgagcgtggaagtgtcagcggaggatctcctgacctgctgcggcagcatgtgtggcgatggttgtaacgggggctacccagccgaggcttggaacttttggacacggaagggtcttgtgtccggaggactgtatgagtcacacgtggggtgccgcccttattcaatacccccatgtgaacaccatgtgaacggcagccgccctccatgtacaggagagggcgacacccctaaatgcagcaagatttgtgagcccggttattccccaacttacaagcaggacaagcactatggatataattcatactccgtgtccaattctgaaaaggacatcatggcagaaatctacaaaaatggtcccgtggagggggcattcagtgtctactccgatttcctgctgtacaagtctggtgtctaccagcatgtgaccggagaaatgatgggcggccacgcaatcaggatcctgggatggggagtggaaaacggcacgccgtattggctggtggcgaactcctggaacacagactggggtgacaatggcttttttaaaatcctgagaggtcaagatcattgcggcatcgaaagcgaagtagtggccggcatccctcgtaccgaccagtactgggagaaaatctag

SEQ ID NO: 14389 - DNA, 1020 bp, Artificial Sequence
  Description of Artificial Sequence: Synthetic coding sequence
atgtggcagctatgggcatctttgtgttgtcttctggtgctagccaatgcccgttcgcgacctagtttccatcccctgagcgacgagctggtaaactatgtgaataagagaaacaccacgtggcaggctgggcataatttctacaacgttgacatgtcttatttgaagcggctttgcggtacattcctggggggcccaaagcccccccagcgggtgatgttcactgaagatctgaaactgcccgcttcttttgacgcccgtgagcagtggccgcaatgccccacgatcaaagaaatcagggatcagggttcatgtgggagctgctgggcttttggcgctgtggaggctatttctgaccggatttgcatccatactaatgcccatgtctctgtggaagttagtgcagaggacctacttacgtgctgcggttcaatgtgcggcgatggttgcaatggaggctatcccgcagaagcttggaacttctggacccgcaaagggcttgtgagtggcggcctctacgaatcgcatgtaggatgccgcccatacagcatcccgccttgtgagcaccacgtaaacgggagtcggcccccttgcaccggcgagggtgatacccccaaatgcagtaaaatctgtgaacctggctacagtccaacctacaaacaggacaagcactatggatacaattcttactcagtgtctaactccgagaaggatatcatggccgaaatctataagaatggcccggtggagggggcttttagcgtgtattcggactttctgctctacaagagcggcgtgtaccaacacgtgactggggagatgatgggagggcacgcaattcggattttgggatggggagtggagaacgggaccccctactggcttgtcgccaattcatggaataccgactggggggataatggcttctttaaaatacttcgcggccaggaccactgcgggatcgagtctgaggttgtggcaggtatcccaagaacagaccaatactgggagaagatttag

SEQ ID NO: 14390 - DNA, 333 bp, Artificial Sequence
  Description of Artificial Sequence: Synthetic coding sequence
atgtggcagctgtgggcttcactgtgctgcctactcgttctagctaacgccagaagcaggcccagctttcaccctttaagcgacgagcttgtcaactacgtgaataaaaggaacaccacctggcaggccggccataacttctataatgtggatatgtcctaccttaaaaggctgtgtggtacttttctcggtggacccaaacccccccagcgcgtcatgttcacagaggacctgaaactaccggcaagttttgacgctagagagcagtggccacagtgtcctacaattaaagagatccgagatcagggatcctgcgggagctgttggctctag

SEQ ID NO: 14391 - DNA, 1020 bp, Artificial Sequence
  Description of Artificial Sequence: Synthetic coding sequence
atgtggcagctgtgggccagtctgtgctgccttctggtgcttgcgaatgctagatcccgcccatcatttcaccctctttctgatgagctcgtcaattacgtcaacaagagaaacacaacatggcaggcaggacacaacttctataatgtggatatgtcatatctcaagcgcctctgcggcacgtttttaggaggaccaaagcctccgcaacgcgtcatgtttactgaagacctcaagctcccggcttctttcgacgcacgcgagcagtggccacagtgtcctacaattaaagaaatccgcgatcaaggctcctgtgggagctgctgggccttcggcgcagtcgaagctattagcgacaggatctgcatccatacaaacgcacacgtgtcagtggaagtctctgccgaggatttgctgacatgctgtggctcaatgtgcggagatggctgtaatggagggtacccagctgaggcctggaacttttggacccgaaaaggcctagtaagtggcggactatatgaaagccatgtgggttgcagaccttattctatccctccctgtgagcatcatgttaatggaagtcggccgccttgcacgggagagggtgatactcccaagtgttccaaaatttgtgaacctggctactccccaacttataaacaggataagcattatggctacaacagttacagcgtttctaactctgaaaaagatattatggccgaaatttataagaatggacctgtggaaggcgctttttctgtgtactccgattttctgctctacaaaagcggagtgtaccagcacgtcaccggagagatgatgggcggacacgctatcagaattttgggctggggagtagaaaacggtacgccttactggctggtcgcgaacagttggaatacagactggggggataatggcttctttaagatcctgagaggtcaagatcattgcgggattgagtctgaagtcgtcgccggaataccgcgaaccgaccagtattgggagaagatctag

SEQ ID NO: 14392 - DNA, 1020 bp, Artificial Sequence
  Description of Artificial Sequence: Synthetic coding sequence
atgtggcagctttgggcctccttgtgctgcctcctggtcctggcaaatgctcgctcccgtccgagttttcacccgctgtccgatgagctggttaattatgttaacaagagaaatacaacttggcaggctggccataacttctacaatgtagacatgagctatttgaaacggctttgtgggacatttctgggaggccccaagcccccacaaagggtcatgttcactgaggatctcaaattaccagctagcttcgatgcaagagagcaatggcctcagtgccctactatcaaagagattagggatcaagggtcatgcggctcatgctgggccttcggcgctgtggaagctatctctgatagaatctgcattcacactaacgcccacgtctctgtcgaagtgagtgccgaggacctgctcacttgttgtggaagcatgtgtggagatggttgcaatggggggtaccctgctgaggcgtggaatttctggactcgcaagggtttggtatctgggggcctttatgagtctcacgtcggttgtcgaccctattccatccctccctgcgaacaccatgtgaacggatcacgtcctccctgcactggcgaaggcgatacacctaagtgcagcaagatttgcgaaccggggtattcacctacttataaacaagataaacattatggttataacagttatagcgtgtcaaattctgagaaggacatcatggcagagatctacaaaaatggacccgtggaaggcgcctttagtgtgtactctgatttcttactgtataaaagtggcgtgtaccagcatgtcaccggcgaaatgatgggagggcacgcaattagaatcctgggctggggcgttgaaaacggtaccccgtactggttagtcgcaaactcctggaatactgattggggcgacaatggtttctttaaaatccttcggggacaagaccattgtgggatcgagtccgaagtcgtcgcaggtattccccggactgatcaatactgggagaaaatctag

SEQ ID NO: 14393 - DNA, 1020 bp, Artificial Sequence
  Description of Artificial Sequence: Synthetic coding sequence
atgtggcaactctgggcctccctgtgttgcctgctggtcctcgccaacgccaggtctaggcccagctttcaccccctcagcgacgaactcgtaaactacgttaataaaaggaatactacctggcaggctgggcataacttctataatgtggatatgtcatatctgaaacggctctgtggtacctttctggggggcccaaaaccaccacaacgcgtgatgtttaccgaggacctgaaattaccggcctcttttgatgcccgggagcagtggccacagtgcccgactatcaaagaaatccgggatcaaggatcatgcggctcatgctgggccttcggggccgtcgaagctatctctgaccggatctgtatccacactaacgctcatgtgagcgtcgaagtgagcgccgaggatctactaacctgctgtgggagtatgtgcggggatgggtgcaatggaggttatccagcggaagcttggaatttctggacccgaaagggtctggtcagtggcggactgtacgagtctcatgtgggatgccgcccatacagcattcctccatgtgagcatcacgtaaacggtagccgcccaccctgcactggagagggagacactccaaaatgcagcaagatctgcgagcctggctacagccctacctataaacaggacaagcattatgggtataactcatattcagtcagtaactcagagaaagatataatggctgagatttacaagaacggaccggtggagggggccttctctgtgtactctgacttcctcctgtacaaatctggggtttatcaacatgtcacgggggaaatgatgggaggccatgcaatcaggattctcggatggggcgtggaaaacggcactccctactggctagtcgctaatagctggaatacagactggggagacaacgggttctttaaaatcctgagggggcaagatcactgcgggattgaatccgaagtagtcgccggaataccacggaccgatcagtattgggagaaaatctag

SEQ ID NO: 14394 - DNA, 1020 bp, Artificial Sequence
  Description of Artificial Sequence: Synthetic coding sequence
atgtggcaactctgggcatctctttgttgtctgcttgtactagctaatgctcggagtcggcccagctttcaccccttatcagacgagttagtcaattatgttaataagagaaatacaacctggcaggctggccacaatttctacaacgtcgatatgtcatatctaaagcgcttgtgcgggacattcctaggaggccctaaaccccctcagcgggtgatgtttacggaggatctcaagctgcccgccagtttcgatgcccgtgagcagtggccacagtgccctacgataaaggagataagagatcagggatcctgtggaagttgttgggcatttggggctgtggaagccatctcggatagaatatgcatccacaccaacgcccacgtttctgtggaggtctcggccgaagaccttctgacttgctgcggctcaatgtgtggcgacggatgtaacggtgggtaccccgccgaggcttggaacttttggactagaaagggacttgtctccggcggcttgtacgaaagccacgtgggctgccggccttactctattcctccttgcgagcatcatgtaaatggctcccgccccccctgtactggcgagggggacacaccaaagtgctctaaaatctgcgagcccggttacagccccacatacaaacaggataaacattatggatacaacagctactccgtctccaacagcgagaaggacatcatggccgagatctacaagaatgggccggtggaaggcgcattctccgtgtatagcgatttccttttgtataagtcaggtgtgtatcagcacgtaaccggagagatgatgggaggtcatgcaataaggatcctcggctggggcgtcgaaaacggcactccctattggcttgtcgccaatagctggaatactgattggggagacaatggatttttcaaaattctccgcgggcaggaccactgcggaatcgagagtgaggtggtggcgggaattcctcgaaccgatcagtactgggagaagatttag

SEQ ID NO: 14395 - DNA, 1020 bp, Artificial Sequence
  Description of Artificial Sequence: Synthetic coding sequence
atgtggcaactgtgggcatcactctgttgccttctggtactcgccaatgcacgctccagacctagctttcacccgctgtcagatgagctggtgaattatgtaaacaagagaaatacaacatggcaggctgggcataacttctataacgtggatatgtcctaccttaagcggttgtgtggaacctttttgggcgggcccaaaccacctcagcgtgttatgttcaccgaggatctaaagctgcccgcatcattcgatgctagggagcaatggcctcagtgcccgacaattaaggaaatcagagatcaaggctcgtgcggatcctgctgggcattcggcgccgtggaggctattagcgaccggatctgtattcacacaaatgctcacgtctccgttgaggttagcgccgaggacttgttaacttgttgcgggtcgatgtgcggagatggatgtaacgggggttaccccgcggaggcctggaacttctggacccggaagggccttgtgtcagggggattgtacgaaagccatgtgggatgccggccctattccatccctccctgcgagcaccatgtgaatggcagccggcccccatgcacaggcgaaggtgacaccccaaaatgttccaagatctgtgagcctgggtatagtcctacatacaagcaggacaagcactacggctataatagctacagtgttagcaacagcgaaaaggacattatggccgaaatctataagaacgggcctgtggaaggggcattttccgtttattccgattttttactctacaagagcggagtgtaccagcatgtgaccggcgaaatgatggggggccatgcaataaggatcttaggatggggcgtggagaacgggaccccctattggcttgttgctaacagctggaacacagactggggggacaatggcttctttaaaatcctcaggggacaggatcattgtggaatcgagtcagaggtcgtggcaggaattcctcgaactgatcagtactgggagaagatttag

SEQ ID NO: 14396 - DNA, 1020 bp, Artificial Sequence
  Description of Artificial Sequence: Synthetic coding sequence
atgtggcagctttgggctagtctttgctgtctgctcgttctggctaacgctagatccaggccttcctttcatcccctctctgatgagttggtgaattacgtaaataaaagaaacactacatggcaggcaggacataacttctataacgtggatatgagttacctgaaacgactgtgcggcacgttcctcggcgggccaaaacccccacaaagagtaatgttcactgaggatcttaaactgcccgcgtccttcgacgctagggagcaatggccccagtgcccaaccatcaaggaaatccgtgatcagggctcatgcggtagctgctgggccttcggcgccgtcgaggccatttccgacagaatttgtattcacacgaacgctcacgtgagcgtggaagtatccgctgaggatttgctgacttgttgtggttccatgtgcggagacggctgtaacggaggttacccagcagaggcttggaacttctggacaaggaagggcctagtctcaggaggattgtacgagagccatgtaggatgcaggccctacagcatacccccttgcgaacaccatgttaacgggtccagacctccctgtacgggggagggagatacaccgaagtgctcaaaaatttgcgagccggggtactcccccacctacaaacaggacaaacactacggctacaacagttactctgtgagcaattccgagaaagatatcatggctgaaatatataagaacggcccggtagagggtgccttcagtgtgtatagcgacttcctgctgtacaagagtggtgtttaccagcacgtcaccggagagatgatggggggtcatgccattagaatccttggttggggagtggaaaatgggacaccttattggctcgttgcaaactcgtggaacaccgattggggtgacaatggattcttcaaaattctaaggggccaggaccactgtggcatcgagtctgaagtcgtcgccggcatcccacggaccgaccaatattgggaaaagatttag

SEQ ID NO: 14397 - DNA, 831 bp, Artificial Sequence
  Description of Artificial Sequence: Synthetic coding sequence
atggacatgaataggcgagctagctgcctactcccagatctgtgtggtcagggatggggctggcgcctgttcccagcctcttgcgcctatttgggcagtgtgccctggagagtttggggcctgggtggcctgctagccccgctggccgccgcaggaggcggctctacatctgggcttggtcatctggggtccacacagtggtcaggcgagctggtggtgcttctgagtgaagtttttatccggggatgtctgttcagctgtaacggagggtacccagcagaggcctggaacttttggacgcggaaggggctggtgtctggagggctttacgagtcccacgtgggttgtaggccatactccataccaccatgcgagcaccacgtaaatggtagtaggcctccatgcaccggtgagggcgataccccgaaatgctctaagatctgcgaaccaggatatagccccacatacaagcaggacaagcattatgggtacaatagttattccgtaagcaacagtgagaaagacatcatggcagagatttataaaaacggacccgtggaaggtgcatttagcgtttacagtgatttcctcctgtataaaagtggcgtgtaccaacatgtgactggcgagatgatgggtggtcatgctattcgcattctgggatggggcgttgagaatggtacaccttattggcttgtggcgaactcctggaacacagactggggcgataacgggttctttaaaatacttcgcggtcaagaccattgcgggatagagagtgaggtggttgccgggatccccaggacagatcagtattgggagaagatctag

SEQ ID NO: 14398 - DNA, 738 bp, Artificial Sequence
  Description of Artificial Sequence: Synthetic coding sequence
atgcccggcgcaggccccttgtctatcccgtgtagaatgagctgggcatttggcgcagtggaagcaattagcgatcgcatctgtatccataccaatgcacatgtctcagtagaggtctctgccgaggatcttcttacatgttgtggcagcatgtgtggcgacgggtgcaacggagggtacccagcagaggcttggaatttctggacccgaaaggggttggtaagtggcggtctatatgaatcccacgttggctgtcgaccgtatagcattccaccgtgcgaacaccacgtgaacggttcccgcccaccctgcaccggagaaggagatacgcctaaatgtagtaagatatgcgagcccgggtactcccccacgtataagcaggataaacactatgggtacaattcatattcagtgtctaactccgagaaggacatcatggccgagatttacaagaacgggcccgtggagggagccttcagtgtgtactctgacttcctgctttataagtccggcgtgtaccaacatgtgaccggggagatgatgggcggtcatgcaattcggattctcggctggggcgtcgagaacggaacaccttactggctcgtcgccaattcctggaataccgattggggcgacaatggtttcttcaagatccttcgggggcaggaccactgcgggatcgagtcggaagtggtcgccgggattccacgaacagaccagtattgggagaagatctag

SEQ ID NO: 14399 - DNA, 1239 bp, Artificial Sequence
  Description of Artificial Sequence: Synthetic coding sequence
atgcagccatctagtctgctccctctagcattatgcctcctggcagcacctgcctcagctcttgtgcgcattccgctgcacaagttcacaagcatcagacgaactatgtcagaagtggggggatcagtagaagacctgatcgcgaaggggccagtttccaagtattctcaggccgtgccagccgtcactgaaggacccatccctgaggtcttaaaaaactatatggacgcacagtactacggcgagatcggaatcgggactcctccacagtgcttcacagtggtctttgataccggatcttcaaacctttgggtccctagcatccattgcaagctgttagacattgcttgttggattcaccataaatataactccgataagagcagtacttacgtgaagaacggtactagcttcgatatacactatggcagcggatctctatccggatatctcagccaggacaccgtatctgtgccctgtcagtcagctagctccgccagcgccctgggaggcgtgaaagtcgagaggcaggtgtttggcgaagctaccaaacaaccaggcatcactttcattgcagccaaattcgacggcatacttgggatggcttatcccagaatctcagtcaacaatgttctccccgtcttcgataatctgatgcagcaaaagctcgtggaccaaaatatcttctcattttacttaagtagagatcctgacgcccagcctggcggagagctgatgctgggggggaccgacagcaagtattacaagggctccctgtcctacctgaacgttacacggaaggcttattggcaggtgcacttggatcaagttgaggtggctagtggtctgactctttgtaaggagggatgcgaggccattgtcgacaccggcacaagtcttatggtgggtcccgtagatgaagttcgggagttgcagaaggcgatcggtgcggtgccacttatccagggtgagtacatgattccttgtgagaaggtctctacactgcccgccatcacactcaaactgggaggcaaaggctataaactgtcacctgaagactataccctgaaggtctcacaggctgggaaaactttgtgtctgtcagggttcatgggcatggatatccccccccccagcggcccactgtggatcctaggggacgtgttcatcgggcgatattacacagtgtttgacagagataacaatcgagtgggctttgcagaagccgcccgattatag

SEQ ID NO: 14400 - DNA, 1002 bp, Artificial Sequence
  Description of Artificial Sequence: Synthetic coding sequence
atgaacccaactctgattctggccgctttttgtctgggcatcgcttcggcaactttaacctttgaccatagtttggaagctcagtggacaaagtggaaggccatgcataacaggctgtatggaatgaacgaagagggatggcggcgtgccgtttgggagaaaaatatgaagatgatagaactgcacaatcaggaatatagagagggtaaacactctttcaccatggcaatgaacgctttcggggatatgacctccgaagaattccgacaggtgatgaacggttttcagaatcggaaaccaagaaaaggcaaggtctttcaggaacctctgttctacgaggccccccgaagtgtggattggcgagagaagggctacgtcaccccagttaaaaaccaaggtcagtgtggcagctgttgggcctttagcgcgacaggagcccttgaaggccagatgtttaggaaaaccgggagactaatctctctgtccgagcagaacttggttgattgttctgggccccagggaaacgagggatgtaacggcgggttaatggactatgcattccagtatgtgcaagacaacggcggcctggactctgaagagtcatatccatatgaggctacagaagaaagttgtaaatacaaccccaaatactctgtggctaacgataccggctttgtcgacatccctaagcaagagaaggcgctgatgaaggcggtagctacagttgggccaattagtgtcgccatcgacgccgggcatgagagcttcttattctacaaagaggggatttattttgaacccgactgttctagcgaggatatggaccacggggtgttggtcgtcggatacgggttcgaatccacggaatctgacaataataaatactggctggtcaagaatagttggggcgaagagtggggtatggggggttatgtcaaaatggcaaaagaccggagaaatcattgcggaattgccagtgcggcttcttaccccacggtttag

SEQ ID NO: 14401 - DNA, 678 bp, Artificial Sequence
  Description of Artificial Sequence: Synthetic coding sequence
atgaacccgacactgatattggccgctttctgtctgggtatcgcctccgccaccctgaccttcgatcacagcctagaggcacagtggacaaagtggaaggctatgcataaccgcctatatggcatgaatgaagaggggtggaggagggccgtgtgggagaaaaatatgaagatgatcgaattgcacaaccaggagtatcgagagggtaaacatagtttcacaatggcgatgaacgcctttggtgacatgacaagtgaggagttcaggcaggtgatgaacggcttccagaatcgcaaaccaagaaaaggcaaggtatttcaggagccactgttctatgaagcccctaggtcggttgactggcgcgagaagggttacgttactcctgtcaaaaaccagggtcagtgcggcagctgctgggcctttagcgcgacaggggcgctggaaggccagatgttcaggaagaccggtcgcctgattagtttgtccgagcaaaacctcgtcgactgcagtggaccccagggcaatgagggctgtaacggaggcctcatggactatgctttccagtatgtccaggataacggaggactggattcagaggagagctacccctacgaggccacagtttctggcgccccatgccatcatagttcgtccgcctttggccgttggaccctgtag

SEQ ID NO: 14402 - DNA, 1002 bp, Artificial Sequence
  Description of Artificial Sequence: Synthetic coding sequence
atgaaccctaccctcattttggccgccttctgcctgggcatcgcctccgctacactcacttttgaccatagtctggaggcacagtggaccaagtggaaggcgatgcacaataggttatatggcatgaacgaggaaggatggagacgggccgtatgggagaaaaatatgaagatgatagagctccacaaccaggagtaccgagaaggcaagcattcattcaccatggctatgaatgcttttggggacatgacatctgaggaattcagacaggtaatgaatggcttccagaaccgtaaaccgaggaaaggcaaggtatttcaagagcccctgttctatgaggccccaagatccgtggactggagagagaagggttatgttacaccggtcaaaaaccaagggcagtgcggaagttgctgggccttttcggctaccggtgccctggagggccagatgttccggaaaacggggcggctgatctcactctcagagcagaatctcgtggactgctcaggcccacagggcaacgagggatgcaacggcgggctaatggattacgctttccaatacgttcaagataacggaggtttggattctgaagaatcttatccatatgaggcaacggaggaaagctgtaaatataaccccaaatacagtgtcgccaacgacacaggtttcgtcgatatcccaaaacaggaaaaggccctcatgaaggccgtggcgaccgtcggaccgatcagcgtggcaatcgacgcaggacacgagtccttcctgttctacaaggagggaatctacttcgaaccagattgtagctcagaagatatggaccatggtgttctggtggtaggttacgggtttgagtctaccgaatcggacaacaataagtactggctcgtgaagaattcctggggagaggaatggggcatggggggctacgtaaagatggctaaggaccgacggaaccattgtggaattgcgagcgcagcttcttaccctacagtctag

SEQ ID NO: 14403 - DNA, 120 bp, Artificial Sequence
  Description of Artificial Sequence: Synthetic coding sequence
atgaatccaaccttaatcctggctgccttctgtcttggaatcgcctcagctactctgacctttgatcactcccttgaagcccagtggacaaaatggaaagccatgcacaataggctgtag

SEQ ID NO: 14404 - DNA, 444 bp, Artificial Sequence
  Description of Artificial Sequence: Synthetic coding sequence
atggctgatgaactttctgagaagcaggtttatgacgctcacaccaaggaaattgatctcgtgaatcgcgaccccaagcacctcaatgacgacgttgttaaaatcgactttgaggatgtgatagccgaaccagagggcacccacagtttcgatggcatatggaaagcttcgtttaccacatttaccgtaaccaaatactggttctatcgattactgtccgcactgtttggaattccgatggcattaatctgggggatatattttgccattctcagctttcttcacatatgggctgtcgtcccttgcatcaagagtttccttatagagatccagtgcatttcccgtgtgtactcaatttacgtccatactgtgtgtgaccccctgttcgaggccgtggggaaaatcttctccaacgtcagaatcaatctgcagaaggaaatttag

SEQ ID NO: 14405 - DNA, 444 bp, Artificial Sequence
  Description of Artificial Sequence: Synthetic coding sequence
atggcggacgaactctccgaaaagcaggtttacgatgcccacaccaaggagattgacctagtcaatcgcgatcctaaacatcttaacgatgacgtcgtcaaaatcgacttcgaggatgttattgccgagccagagggaacacacagcttcgacggcatatggaaggcaagtttcacaactttcacagtcactaagtactggttctatagactgctgtcagccctgtttggcatcccaatggcccttatttggggcatttatttcgcaatcctgagctttcttcacatctgggccgtcgtgccatgtatcaagtctttcttaatcgagatacagtgtatctcccgcgtgtattctatctacgttcatacggtgtgcgatcccctcttcgaggcagtcggcaaaattttttcaaacgtaaggattaatctgcagaaagagatctag

SEQ ID NO: 14406 - DNA, 537 bp, Artificial Sequence
  Description of Artificial Sequence: Synthetic coding sequence
atgtctgggggaaagtatgtcgacagtgagggtcacctttataccgtgcccattcgagagcagggcaacatctacaaacccaacaacaaggcgatggctgacgagttgagcgagaaacaggtgtacgacgcccacacaaaggagatagaccttgtgaatagggatcccaagcatcttaatgatgatgtcgtaaagatcgactttgaagatgtcatcgccgaaccagaaggcacacattctttcgatgggatttggaaggcaagtttcaccacattcacagtcaccaaatattggttttacaggctgctgagtgccctgttcggcatccctatggccctgatctggggcatctattttgccattctgtcctttctgcatatctgggctgtagttccttgcattaagtctttcctcatcgaaattcagtgcatcagtcgcgtgtactcaatatatgtccatactgtatgtgatcctctcttcgaggctgtgggtaagattttcagcaacgtaaggattaatctgcagaaagagatatag

SEQ ID NO: 14407 - DNA, 345 bp, Artificial Sequence
  Description of Artificial Sequence: Synthetic coding sequence
atggccggtgggaaagccggtaaggactctggcaaggcaaaggccaaagccgtatccaggtcacaacgggccggactccaatttcctgtgggaagaattcaccgccatctcaagactagaacaacatcacacggacgggtcggtgccactgccgctgtttatagtgccgcaattcttgagtacctgaccgctgaagttctggagctagcagggaatgcatctaaggatttgaaagtcaagcggattacccccagacatcttcagctggccatccgcggagacgaagagctggactctctgattaaggctaccattgctggcggcgagaagagacgttgtagctag

SEQ ID NO: 14408 - DNA, 339 bp, Artificial Sequence
  Description of Artificial Sequence: Synthetic coding sequence
atgggcctcgaaaccgagaaagctgacgtgcaactgttcatggacgacgattcttacagtcaccactctgggctggagtacgccgaccccgaaaaatttgcggactcggaccaagatagagacccgcaccgcctgaattctcatctcaaagattttaatgcattttgcaaagatctccctaatggcagtgcattttctgccgataacatggaagaatgcgatcggtgctatcactgcagcattgtgtatgagagacggaccatgttgctcttttgtcagcctgccacagaacctggacttaacacctggacgcctggactagaaattggcattctttag

SEQ ID NO: 14409 - DNA, 342 bp, Artificial Sequence
  Description of Artificial Sequence: Synthetic coding sequence
atgggtttagagacagaaaaagccgatgtgcaattgttcatggatgacgattcctattctcatcactcgggcctcgagtacgcagatccagagaaattcgcggactccgaccaagaccgagacccacaccgactgaatagccacttgaagctgggatttgaagatgtgatcgctgagccagtgacaactcatagctttgacaaagtgtggatctgctctcatgctctgtttgaaatctccaagtatgttatgtacaaattcttaactgtctttctggcaatccctctggccttcatcgcaggcattttgtttgccacactgtcttgtttacacatctggtag

SEQ ID NO: 14410 - DNA, 1038 bp, Artificial Sequence
  Description of Artificial Sequence: Synthetic coding sequence
atgcaacggctcgtcgcctgggatcctgcctgcttgcccttacccccccccccgcctgctttcaagtcaatggaggtagccaatttctactacgaggccgattgtctcgccgctgcttacggagggaaggccgcccctgctgcaccccctgccgcccgtcctgggccgagacctcctgccggagagctggggtctatcggagatcatgaaagagctatcgattttagtccttacctggagcccctcggagccccccaggcaccggcacctgccactgccactgatacttttgaagcggcacctcccgcaccggcccccgcacccgcctccagcggccagcatcatgactttttaagtgatctgttttcagatgactacggcggaaagaattgcaaaaaaccagctgaatatggatacgtgagcctggggcggctaggggccgcgaaaggcgcgctccatcccggctgtttcgctccactgcacccgcctcctcctcccccacccccacctgcggagctgaaggccgagcctggcttcgaacccgccgattgtaagagaaaggaagaggcaggagcgcctggagggggggccgggatggcagcgggattcccttacgccctgcgcgcttatctcggataccaggcagtgccaagcggttcgtccgggtcactgtcaacgagctctagctccagtccaccgggaacacctagccctgctgatgcgaaggcaccacccaccgcctgttacgctggcgctgcaccggccccttcacaagtgaagtcaaaagccaagaaaactgtagacaagcacagtgatgaatacaagatccgcagggaacggaacaacatcgcggtgcggaaatcacgagacaaggccaaaatgagaaatttggagacccagcacaaggtgcttgaactcactgccgagaatgagaggcttcagaagaaggtcgagcaactgagtcgggaacttagcactttaaggaatctattcaagcagctccccgaacccttgctcgcatcgtcagggcactgttag

SEQ ID NO: 14411 - DNA, 2184 bp, Artificial Sequence
  Description of Artificial Sequence: Synthetic coding sequence
atggaaggcgatgcggtagaagcaatagttgaggagagtgaaacgtttataaagggcaaggagaggaagacgtaccagaggcgtcgcgaggggggacaggaggaagatgcttgccacctgccccagaaccagaccgacggtggcgaagttgttcaggatgtcaattctagcgtgcagatggtaatgatggagcaattagatccaaccctgctccagatgaagaccgaagtcatggaaggtacagttgcaccggaagccgaggccgcagtcgacgatacccaaattataacactgcaggtggtgaacatggaagagcagcctattaacatcggagaactgcaactggtccaagtgcctgtgcccgtgacagttcccgtggctaccacttctgtggaagagttacagggggcatatgagaatgaagtctccaaggagggcctggcagaatctgagcctatgatctgccatacactgccgctccctgaggggttccaggtggtgaaagtcggcgccaatggagaggtcgagaccctcgaacagggagagcttcctccgcaggaggacccatcttggcaaaaggacccagactaccagcccccagcgaagaagaccaagaagacaaagaaaagcaagcttagatacaccgaggaaggaaaggatgtggatgtatccgtctatgacttcgaggaggaacagcaggagggcttactgtctgaggtgaatgcggaaaaagttgtggggaatatgaaaccgcctaaacccacaaagattaaaaaaaagggagttaagaaaacatttcagtgcgagctatgctcttacacctgccccagacgatccaacctggataggcatatgaagtcacataccgacgagcggccccacaagtgtcatctgtgcggtcgagcattccggaccgtcaccttactgcgcaatcatcttaacacgcatactgggactcgacctcacaagtgtcccgactgtgacatggccttcgtcacatctggcgagctggttaggcacaggaggtataagcacacgcatgagaagccattcaagtgcagtatgtgcgattacgcctctgtggaagtgagtaagctgaagcgccacatccgttcccacacaggggagaggcccttccagtgctccctgtgtagctatgcaagcagagacacatacaaactcaagcggcatatgcgcacacattcaggagagaagccatacgaatgctatatttgccatgctaggtttacccagtccgggactatgaaaatgcacattctacagaagcataccgagaacgtggctaagttccactgcccacactgtgacacagtcatcgccaggaaatcagaccttggtgtgcatctgcggaagcaacattcttacatcgagcaaggtaagaagtgccgttattgtgatgcagtgttccacgagcgttacgccctcatccaacaccaaaaatcccacaagaatgaaaaacggttcaagtgtgaccagtgcgattacgcatgtaggcaggaaagacatatgatcatgcacaaacggacacacaccggcgaaaagccatatgcttgttctcactgcgacaagacctttcggcagaagcaactgttagatatgcatttcaagcgttatcacgatcctaactttgtgccagccgcatttgtttgtagtaaatgtggcaagacctttacgagacggaacacaatggcacgccacgctgacaactgcgccggacctgatggggtcgaaggtgaaaacggcggggagaccaagaaaagcaagaggggtcggaagagaaagatgaggtcaaagaaggaggatagcagtgactctgagaatgccgagcctgatctcgatgataacgaggatgaggaagagccagccgtggaaatagagcccgaacccgagccacaacccgtcactccagccccgccaccagctaaaaagagaaggggaagaccaccaggtaggactaatcagccaaaacagaaccagcccacggctatcatacaagtggaggaccagaataccggagccatcgagaatatcatagtggaggtcaaaaaggagccagatgccgagcctgcagaaggcgaggaagaagaggcacagcccgctgctacagacgcaccgaacggcgacctcacacccgaaatgatcttaagcatgatggaccgctag

SEQ ID NO: 14412 - DNA, 1200 bp, Artificial Sequence
  Description of Artificial Sequence: Synthetic coding sequence
atggccttcgtcacctcaggggaactcgttaggcatagacggtacaagcacactcatgagaaaccattcaaatgttccatgtgtgattatgcatccgtcgaggtttctaaactcaaaaggcatatcagatcccacactggagaaaggccatttcagtgctctctgtgttcttacgcttccagagacacctacaaactcaaacgtcacatgaggactcatagtggggaaaaaccctatgaatgttatatctgccatgcacgctttactcagagcggtacaatgaagatgcacatcctccagaaacacacagaaaacgtcgccaaatttcattgcccacactgcgacactgttattgcaaggaaatctgatttgggtgtccatctgcggaagcagcatagctatatagagcaggggaagaagtgcagatattgtgacgcggtctttcacgagcgatatgcgctcattcagcatcagaagagtcacaaaaacgagaaacgctttaagtgtgatcagtgtgactacgcctgcaggcaggaaaggcatatgatcatgcacaaaaggacacacacaggcgaaaaaccatacgcttgctcccactgtgacaagacctttaggcagaaacagctgctggatatgcatttcaaacgatatcatgaccctaactttgtgcctgcagccttcgtgtgctctaaatgcggtaagacatttacccgaaggaacaccatggctcgtcatgctgacaactgtgcagggcccgacggggttgaaggcgagaacggaggtgaaacgaagaagtcaaagaggggcagaaaaaggaagatgcgctccaaaaaagaagatagcagcgactccgagaacgcagaaccggacctggacgacaacgaggacgaggaggaacctgccgtggagattgaaccagaaccggagcctcagccagtgacgccagcccctccaccagcaaagaagcggcggggccgtccccctgggcgcactaaccaacctaaacagaaccagcctactgcaatcatacaagtcgaagaccagaatacaggcgcaattgagaacatcattgtcgaggttaaaaaagagcctgatgccgagcctgcggaaggcgaagaagaggaagcgcagccagcagcaaccgacgccccgaacggtgatctcactcccgaaatgatcctcagcatgatggataggtag

SEQ ID NO: 14413 - DNA, 1128 bp, Artificial Sequence
  Description of Artificial Sequence: Synthetic coding sequence
atggagcgcgcttcttgccttttgctgttgctgctgcctctcgtgcacgtcagcgcaaccacaccagagccctgcgaacttgatgacgaagattttaggtgcgtgtgcaacttttcggagcctcagccggattggagcgaggcctttcaatgcgtcagcgccgtagaagtcgagatacacgctggaggcctgaacctggaaccatttcttaagcgtgtagacgccgacgcagatccccggcagtacgccgacacagtgaaagctttaagagtgagacgtttgactgttggagccgcccaagtccctgctcagctgctggttggcgctcttagagttctcgcatattctcgcctgaaggaactgacattggaagatctcaagatcaccggcactatgccacctctgcccctagaggctactggacttgctttgtcctctcttcgactgcgaaacgtgtcttgggccaccgggagatcatggcttgctgagctgcagcagtggctgaaacctgggctcaaggtgctctcaattgcgcaagcacacagccccgccttctcttgtgaacaggtgagggccttccccgcactgaccagcctggacctgagtgacaacccgggactcggcgaacgaggattaatggctgccttatgtccccacaaatttccggctatacagaaccttgcactcagaaacactgggatggaaacccctacaggggtgtgcgccgctttggccgctgcaggagtccagccccactctttggaccttagtcataattccttacgggctacggttaatccttcagctccccgatgcatgtggtcttcagctctgaatagtttgaacttgtcttttgcaggcctcgagcaggtccccaaagggctcccggcaaagctacgtgtgctcgatctttcctgcaacagactcaatagagctccgcagcctgacgagctccctgaagtcgataatctcaccttggatggcaatccgttcttagtgcccggaactgctctgccacatgagggtagcatgaattccggggtggtccccgcctgtgcaaggtcgacactgtccgttggcgtttccggcacgctggttctgctccagggcgctcggggatttgcctag

SEQ ID NO: 14414 - DNA, 1128 bp, Artificial Sequence
  Description of Artificial Sequence: Synthetic coding sequence
atggaacgagcaagttgcctcctactgctccttctcccattggtgcatgtgagtgctactacacccgagccctgcgaactagacgacgaggattttaggtgcgtgtgcaatttcagtgaacctcaaccagactggtccgaggctttccaatgtgtctccgccgtagaggtggagatccatgcgggcgggctgaatcttgaaccattcctgaaacgggttgacgccgacgccgatcctcggcagtatgccgatactgtgaaggctctgagggtgagaaggctgacagtgggcgctgcacaggtccccgcccagctgctggtgggcgcactgagggtacttgcctactcacggctgaaagaacttacgcttgaggatctgaaaatcacaggaaccatgcctccactccctctggaggccaccggtctggccctgtccagcttgcgacttaggaatgtgtcttgggcaactggtaggtcctggctcgccgagctgcagcagtggctgaaacctgggttaaaagttttaagcatcgctcaggcgcattctcccgcattttcatgcgagcaagtgagggccttccctgctctgaccagtctggatctctctgacaatcctggactgggcgagcgagggctcatggccgctctttgccctcataagttccccgcaattcaaaatctcgctttaagaaacacaggtatggaaacacccacgggagtgtgcgccgcccttgcggccgcaggggttcagccacatagtctggacctctcacataattcattacgcgccacagtcaatcctagcgcccccagatgcatgtggtcctcagcgctcaacagcctgaatctgagtttcgcgggactggagcaggtgcccaagggcctgccggctaagctgcgggtgttggacctgtcttgcaaccgactgaaccgcgccccacaacctgacgagctaccagaagttgataatctgactctggatggtaacccttttctcgtcccggggacggccctgccccacgaggggtcaatgaacagcggtgtggttccggcgtgcgcacggtcaactctgtctgtgggcgtcagtggaactctcgtacttctgcagggtgcccgagggtttgcctag

SEQ ID NO: 14415 - DNA, 402 bp, Artificial Sequence
  Description of Artificial Sequence: Synthetic coding sequence
atgagtttcccttgcaagtttgttgcatcgttcctattgattttcaatgtgtcttccaagggcgctgtgagcaaagagatcaccaatgcactggaaacctggggcgcgctcggccaggacattaacctggacataccctcgttccagatgtcagacgacatcgacgatatcaagtgggaaaagacctctgataagaagaagatcgctcagtttcgaaaggagaaggaaaccttcaaggaaaaggacacatacaaactattcaagaacggcaccctaaaaattaaacatctgaaaacggatgaccaggacatttataaagtaagtatatacgatactaaaggaaagaatgttctggagaagattttcgatctgaaaattcaagggaagtgctcttttccgtag

SEQ ID NO: 14416 - DNA, 1056 bp, Artificial Sequence
  Description of Artificial Sequence: Synthetic coding sequence
atgagcttcccatgcaaatttgtagcctctttcctgcttatcttcaacgtgtcttctaaaggggccgtcagcaaagaaattaccaatgccctggaaacatggggcgccctgggtcaagatatcaatctggacatcccatcatttcagatgtcagatgatatcgacgacattaaatgggagaagacatcggacaagaagaaaatagctcagttccggaaggagaaggagacgtttaaagaaaaagacacatataagctgtttaagaacggaacactgaaaatcaagcacctcaagacagatgatcaagatatttataaagtgtccatctatgacaccaagggcaaaaacgtgctggagaaaatattcgaccttaaaatccaggaacgggtcagcaagcctaagattagttggacctgtatcaataccacacttacgtgtgaggtgatgaatgggactgacccagagttgaacctgtatcaggacggaaaacatctgaagctctcacagcgggtgatcactcataagtggaccacgagtctgtcggcaaagtttaaatgcacagctggaaataaggtcagcaaagaatcgagcgtggagcccgtgtcctgtccagagaaaggcctggatatctacttgatcatcggcatctgcggcggtggcagcctccttatggtttttgtggccttgctggtattttatatcacaaagaggaaaaaacaaagatcgagacgaaatgacgaggagctagaaacccgtgctcacagagtcgctacagaagaacggggacgtaaaccccatcagatccccgcctcgacgccacagaatcccgccacatctcagcacccgccacctccacccggtcacagaagccaggctcccagccaccgacctcccccacccggacatagagtgcagcatcagccccagaaacgcccgccggcaccttcaggaacgcaggttcatcagcagaagggtcccccgttgccccgaccaagagtacagccaaaacccccccatggcgccgccgagaactctctgagccctagtagtaactag

SEQ ID NO: 14417 - DNA, 2544 bp, Artificial Sequence
  Description of Artificial Sequence: Synthetic coding sequence
atgcatctgttgggcccctggctgctgcttctggtacttgagtacctggccttttccgacagctccaagtgggttttcgagcaccctgaaacattgtatgcgtgggagggcgcatgcgtgtggataccctgtacttacagagccttagatggcgatctggaaagctttatcctttttcacaacccggaatataacaagaatacctccaaatttgatggtacgagattgtatgagtctacaaaagacgggaaggttccttctgagcaaaaacgggtccaattcttaggtgataagaacaagaactgcacgctctccatccaccctgttcatctgaacgatagtgggcagctcggcttaaggatggagagcaagacagagaagtggatggagaggatccacctaaacgtgagcgagcgtccctttccccctcacatccagctgccccccgaaatacaagaaagccaagaagtcacgctcacatgtcttctcaattttagttgctatgggtaccctattcaactccagtggctgctggagggagtccctatgcggcaagccgctgtgacctcaacctccctcaccatcaagtccgtttttacacgttcagagctcaagttctcccctcagtggtctcaccacgggaagattgtcacatgccagctgcaggacgccgacggcaagttcctgtccaacgacacggtgcaattaaacgtgaagcacactccgaagcttgagattaaggtgaccccgtcggacgctatcgtccgagagggggattcagttacaatgacctgcgaggtttcatccagtaaccccgagtataccacggtgagttggttaaaggatggcacttctctgaagaaacagaatacttttactcttaacctgagagaagtaacaaaggatcagagcggaaagtattgctgccaggtgtcaaacgacgtaggacccggccgctccgaggaagtatttctccaggtccaatacgcccccgagccctccacagttcagattttgcacagcccagcagtagaggggagccaagtggaattcttgtgtatgagtctggctaaccccctgccgacgaattacacttggtaccacaatggaaaggagatgcagggcaggactgaggaaaaggtgcatattccaaaaattcttccatggcacgccggaacttattcctgtgtagctgagaacatcctgggcacaggtcagagaggcccaggcgcagaactagatgtgcagtacccaccaaaaaaagttacaaccgtcatccagaatcctatgccaattagggagggtgataccgtgacactctcatgtaactacaatagcagcaatcctagtgtcacccgatacgaatggaagccacacggggcatgggaggagccgagcctgggcgtgctgaagatccagaacgtggggtgggacaacacgactatcgcttgcgccgcgtgcaacagttggtgttcctgggcgagtccagtggcccttaacgtgcaatacgccccgcgagatgtcagggtaaggaagataaagccactttcggagatccactccggcaacagcgtcagtctccaatgtgatttttcttccagtcaccccaaagaggtgcagttcttctgggagaagaacggcagactgctcgggaaagagtcacagttgaattttgactccatttcgcccgaggatgctggctcctacagttgttgggtgaacaactcaattgggcagactgcctccaaggcctggaccctggaggtgctttacgctccccggagactgagggtgagcatgtccccgggtgaccaggtgatggaaggtaagagcgccaccctcacatgcgaatcagatgccaatcctcctgtaagccattatacgtggttcgattggaataatcagagtttgccttatcactcccagaaattgaggttagagcccgtgaaggtccagcattctggagcatactggtgccagggcaccaattccgtgggaaagggacggagccctctgtcaaccctcactgtgtattatagccctgaaaccataggaagaagggtagccgttgggctagggagctgcctagccatactcatccttgccatctgcggcctaaaattgcagagaagatggaagcggacacaatcccagcagggtctgcaggaaaacagttccggtcaatccttcttcgtccgcaataaaaaggttagacgcgcacctctgtccgagggtccccactccttgggatgttacaatcccatgatggaggatggaatctcatacaccacgctgcgattccccgaaatgaacatccccaggactggagatgcagaatcctccgaaatgcaacggcccccccccgattgcgacgacaccgtgacctacagcgctcttcacaagagacaggtaggcgactacgagaatgtgatcccagactttcctgaagacgagggcattcactactcagaactaatccagttcggggtcggagaaaggccccaagcccaagaaaacgtggactacgttattttgaaacactag

SEQ ID NO: 14418 - DNA, 1989 bp, Artificial Sequence
  Description of Artificial Sequence: Synthetic coding sequence
atggagtccaagaccgagaaatggatggaacgcatccatcttaatgttagtgaaaggccttttccccctcacatccaattaccgcccgaaatccaggagtctcaggaagtaacactgacatgcctgttgaacttcagttgctacggttatcccattcagctgcagtggttgctggagggggtgccaatgagacaggctgcagtcacaagtacctccctgacaataaagtcagtgtttactcgatctgaactcaagttttctccccagtggagccaccacgggaagattgtcacctgtcagcttcaggatgccgacggaaagttcctatcgaatgataccgtccagctcaatgtgaagcacactccaaaactggagatcaaagttacaccaagcgatgcaattgtgagagaaggggactcagtaactatgacttgcgaagtctcttccagcaatcctgagtacaccacagtgagttggctgaaggacgggacatcactcaagaagcagaataccttcactttgaatctgcgggaggtaactaaagatcagagcgggaaatactgctgtcaagtctccaacgacgtggggcccggacggagcgaagaggtgttcttacaagtgcaatacgcgccagagccatctactgtgcagatcctgcactccccagccgtagaggggtcacaagtggaatttctgtgcatgagtctagctaacccattacctaccaactacacctggtaccataacggcaaagaaatgcaggggcgtaccgaagagaaggtacatatcccaaaaatcttgccctggcacgctggaacatatagctgcgtggccgagaatatattgggaactggacagagaggtcctggggccgagcttgatgtccagtatccccctaagaaagtgaccactgtcattcaaaaccctatgcctattcgtgagggagacactgtgacactgagctgcaattataatagctcaaacccctccgtgactcggtatgagtggaaaccacatggagcttgggaagaaccttcccttggcgtcctcaaaatccagaacgtgggatgggataataccaccatcgcctgcgctgcttgcaactcctggtgtagctgggcctcaccggtggcgctcaatgtacagtatgctcccagagacgtgagagtgcgaaagatcaaacccctgtctgaaatacactcaggaaactccgtgagcttacaatgtgacttctcctcaagccatcccaaagaagtgcaatttttctgggagaagaatgggcgcctgcttggcaaggagagccagttaaacttcgattccatctctcccgaggacgcgggctcatatagctgttgggtcaataactctattggacagacagcctctaaggcatggacgttagaagtcctttacgccccccggcgcctgcgcgtttccatgagtcccggggatcaggttatggaaggaaagagcgcaacgttgacatgcgagtccgacgctaatcctccagtctcccactacacatggtttgactggaacaatcagtcattgccttatcatagtcagaagttacgacttgagcctgtgaaggttcaacactctggggcttactggtgccaggggacaaattcagtaggaaaaggcagatcgccgcttagtaccttaacagtttactattctcccgagacaattggcagaagagtggccgtaggtctgggatcttgtctggctatcttaatcctcgcaatctgcggcctcaaactccagagacgtgacgccgaatccagcgaaatgcagcggccaccacctgactgtgatgataccgtcacctacagcgctcttcacaagagacaggtgggagactacgaaaacgttatcccggacttccccgaggacgagggaatacactactctgagcttatccagttcggcgtcggagagcggccacaggctcaggagaacgttgattacgtaatccttaaacactag

SEQ ID NO: 14419 - DNA, 2013 bp, Artificial Sequence
  Description of Artificial Sequence: Synthetic coding sequence
atgcacctcctcggcccatggctgctgctgttggtgttggaatatctggccttctccgattcgtccaagtgggtgtttgagcatccagagactctctacgcatgggaaggcgcttgtgtgtggatcccgtgcacttacagagctctcgatggcgatctggagtctttcatcctcttccacaatcctgagtacaataaaaacaccagtaagttcgacggaacaagactgtacgagtccaccaaagatggcaaggtgccatcagaacagaaacgcgtgcagtttctcggcgataagaataagaattgcacactgagcatccatccagtgcacctcaatgacagcggtcagctgggcctgcgcatggaaagcaagaccgaaaagtggatggaaagaatccatctgaacgtgagcgaaagaccattccccccccacattcagcttccaccagaaatccaggagtcacaggaggtgaccctcacctgtctgttgaactttagctgttacgggtatcccatccagctgcaatggctgctagagggcgtccccatgcggcaagccgccgttacgagcacatctctgaccatcaaaagcgtgttcacccgctccgagctgaagttcagcccacagtggtcacatcatggcaaaatagttacgtgccagctccaggacgctgacgggaagttcctgagtaacgacacagttcagttgaatgtcaaacacccccctaaaaaagtgactaccgtgattcagaatcccatgcccattcgcgaaggcgacaccgtgaccctctcatgcaactataactctagtaatcccagcgtgactcggtacgaatggaaaccacatggggcgtgggaagagccctctctgggcgtattgaagatccagaacgtgggatgggacaatactactatcgcctgtgctgcctgtaactcctggtgcagctgggctagccccgtcgccctcaatgtgcaatatgcccccagggacgtcagagtgcgcaagataaaacctctgtccgagatacacagtgggaatagtgtgtcattacagtgtgacttcagctcatcccaccctaaggaagttcagtttttctgggagaaaaacggacggcttctgggaaaggaatctcaactcaatttcgattcaatttcacccgaggacgccggatcttatagctgctgggtcaacaatagtatcggacaaacggctagcaaggcctggaccctggaggttctttacgctccgcgaagactgagggtctcaatgtcacctggtgatcaggttatggaaggcaagagtgccacactgacttgtgaatccgacgcaaatccacccgtatctcactatacttggttcgattggaataatcagagcttgccctatcattcccaaaagctccgcttggaacctgtgaaagtccagcactccggcgcatattggtgtcaggggaccaatagtgttggaaagggacgaagtcccctcagcactctcaccgtgtattatagccccgagactatcggccgccgggttgcagtaggcctgggctcatgcctggccatccttattctcgccatctgtgggttgaagcttcagagacggtggaaaaggactcagtcccagcaagggctgcaggaaaatagcagcggccagagcttctttgtgcgcaataagaaagtgagacgagccccgctttcagaaggacctcactctcttgggtgttataatcctatgatggaggacggtatctcctatacgactctcaggtttcccgagatgaatattccgcgaacaggggacgctgaatcttctgagatgcagcgtcccccacccgattgcgacgacacagttacatattccgctctacataaaaggcaggtaggagattacgagaacgtcatacctgatttccccgaggacgaaggcatccactattcagagctcatccagttcggcgttggcgaacggccccaggcccaggagaacgtggactacgtaatactaaaacactag

SEQ ID NO: 14420 - DNA, 2028 bp, Artificial Sequence
  Description of Artificial Sequence: Synthetic coding sequence
atgagcttgtggctgctagagggcgtgcccatgaggcaggccgcagtgacaagcacatccttgacaattaagagtgtcttcacaaggtcagaactgaaattctctccccaatggtctcatcatggaaaaatcgtgacttgccagctccaagacgccgacgggaaattcctttcaaacgatactgtgcagcttaatgttaagcatactccaaaactggagatcaaggtgaccccgtccgacgcaattgtgagggaaggcgatagcgtgacaatgacgtgcgaggtatcatcttccaaccccgaatacacaaccgtatcctggcttaaagatggcacaagcttgaaaaaacagaacacttttactcttaatctgcgagaagtaacaaaggaccagagtggcaagtactgctgccaggtatccaacgacgtgggacccgggcggtcggaggaagtatttctgcaagtgcagtatgccccagagccgtcaactgtgcagatcctacactcaccagcagtagagggctcacaggtggagtttctgtgtatgagtctggccaatcccctgcccaccaactacacctggtatcacaacggaaaggagatgcagggaaggaccgaggagaaggtacacatacccaagatcctgccgtggcatgctggaacatatagctgtgtggccgaaaacatacttgggacgggacagcgcgggcccggggccgagctggatgtgcagtatcctcctaaaaaggtgactacagtaattcagaatcccatgcccatacgggagggcgatacagtgacactgtcctgtaactataactcttctaatccctctgtgactagatacgagtggaagcctcacggcgcctgggaagagccttctttgggcgtattgaagattcagaacgtgggctgggataacacaaccatagcctgcgccgcctgtaactcttggtgttcttgggcgagcccggtggctttgaatgtgcagtacgcacccagggacgtgagagttcgcaaaattaagccactgtcagagatccactccggcaacagtgtctctttgcagtgtgatttctccagcagccatcctaaggaggtacaatttttttgggaaaagaatggtcgtttgctcgggaaggagagtcagctgaattttgattcaatttcaccagaagatgccggcagctattcctgctgggtgaataactcaatcggacaaacagcctccaaagcttggaccctggaggttttatatgcccctcggcgactgagggtgtctatgtccccaggcgaccaggtgatggagggcaagagtgctactctcacttgtgaaagtgacgccaatccacccgtgtcacactacacttggtttgactggaataatcagtccctcccctaccactctcaaaagctgaggctcgagccagttaaggtccagcactcaggagcatactggtgtcaagggacaaatagcgtaggcaagggacgcagccccctctcaactctcactgtctattatagtcctgaaacaattggccgaagggtggccgtcggacttggcagttgcctggcaatcctgatcctggcaatttgcggcctcaaattacagcggaggtggaaacggacccagagccagcagggtcttcaagaaaactcatctgggcagtccttttttgtgcgcaacaaaaaagtgcgacgggcccccctaagcgaagggccccactcattgggctgctataatcccatgatggaggacggtattagctataccactttgaggtttcctgagatgaacatacctaggacaggtgatgccgaatcatctgaaatgcaacgaccacctccggattgcgacgacacggtgacctactccgcccttcacaagcgtcaagtgggtgactacgagaatgttatcccggacttcccggaagacgagggaatacactatagtgaactgattcagttcggggtcggtgaacgtcctcaggcccaggaaaacgttgactacgttatcctcaagcattag

SEQ ID NO: 14421 - DNA, 2280 bp, Artificial Sequence
  Description of Artificial Sequence: Synthetic coding sequence
atgcacctactggggccatggttgctcctgttagttttggagtacctggcattttcggattccagcaagtgggtttttgaacaccctgagacactgtacgcctgggagggagcatgcgtctggattccctgtacatacagagccttggatggcgatctcgagagtttcattctgttccataacccagagtataataaaaacacctccaaatttgacggcacacgcctctacgaaagtacgaaagacggcaaagtgccaagcgaacagaagcgcgttcagtttttaggtgataagaacaagaactgcacgctgtcaattcatcctgtgcatttaaatgactctggccagttgggactgcggatggagagcaaaactgaaaagtggatggaaagaatccacctgaacgtgtcagaaagaccattcccacctcatatacaattgccccctgagattcaggagtcccaggaagtaacacttacctgcttactaaacttttcatgctacggatatccgatacaactccaatggctgctcgaaggagttcctatgaggcaagctgcagtaactagtactagccttactattaaatcagtatttacccggagcgagctgaaattttctcctcagtggagccaccatggaaagatcgtaacctgccagctccaggatgctgacggcaagtttttgtctaatgatacggtacagctgaacgttaagcacactccaaagcttgaaatcaaggtcactcctagcgacgcaatcgtgcgggaaggggactccgtaactatgacctgcgaagtgtctagctccaaccctgagtatactactgtcagttggctgaaggatggtacttcgctgaagaagcagaatacatttactctgaacctgcgagaagttacgaaagatcaaagcggcaagtactgttgccaggtgagtaacgacgttggacctggacgatcagaagaagtattcctccaagtacagtacccgccaaagaaagttactaccgtcattcaaaatccaatgccaatcagagagggggacaccgttaccctgagttgcaactataacagttctaaccctagtgttacccgctatgagtggaagcctcacggagcgtgggaggaacccagcctcggcgtcttgaaaatacagaacgtcggctgggataatactactattgcttgcgcagcctgcaacagctggtgctcatgggcctctccagtagctctcaatgtgcagtatgccccacgggatgttagagtgcgaaagattaagcctctttctgaaattcattctgggaactctgtgtccctgcagtgtgatttttccagcagtcatccaaaagaggtccagtttttttgggagaaaaatgggcggctgttgggcaaggaaagtcaactcaattttgactccatcagtccagaagatgcaggctcctattcatgttgggtcaataacagtattgggcagactgcctctaaagcatggactttggaggtcctctacgccccaagaaggctccgtgtctcaatgtcccccggagatcaggttatggagggaaaatccgccacattaacatgcgaaagcgatgctaacccgcctgtgtcacattacacctggtttgactggaacaaccagtctctgccatatcacagccagaagctacgcctcgagcctgtgaaagtgcaacacagcggagcgtactggtgccagggaaccaatagcgtggggaaggggcgctctcctctctctaccctgaccgtgtactacagccccgagacaattgggcggcgggttgcggtggggctaggaagctgcctggccattcttatcctagctatctgtggacttaaactacagcgccgctggaagaggacccagtctcagcaaggattgcaggaaaactccagcggacagtcttttttcgtacgtaataaaaaagttaggcgggctcctcttagcgaaggccctcatagcttagggtgttataaccctatgatggaagatgggatatcttataccacgctgcgatttcccgagatgaacataccccgtacaggggatgctgagagtagcgagatgcagcggccccctccggactgcgatgatactgtaacttactccgctctccacaagcgccaagtcggggactatgagaatgtcatccccgattttcccgaagacgaaggaatccactacagcgagctgatccagttcggggttggcgaacgcccacaagcacaagagaatgtggactatgtgatcttgaagcactag

SEQ ID NO: 14422 - DNA, 2256 bp, Artificial Sequence
  Description of Artificial Sequence: Synthetic coding sequence
atgcatctcctcggcccctggcttcttctgctggttctggaatacttggctttttcagacagcagtaagtgggttttcgaacatccggaaacgctgtacgcttgggaaggagcctgcgtttggatcccctgtacttatcgtgcgctcgatggcgatctcgagtcgttcatcttgttccataatccagaatacaacaagaacacatcgaagttcgacggaacccggctttatgaaagtactaaggatgggaaggtcccaagcgagcagaaacgcgtacaatttctgggcgataagaacaagaattgtaccttgtcgatccacccggttcaccttaacgatagtggccagcttggccttcgaatggagtccaaaaccgagaaatggatggaaagaattcacttaaacgtgtcagaaagacccttcccgccccacattcagcttccccctgagatccaggaaagtcaggaagtgaccctcacctgtctcctcaatttcagttgttatgggtatcccatccagcttcagtggctgctggaaggcgttccaatgagacaagcagcagtgacaagcacctctcttacaatcaagtctgtctttacccgcagtgagcttaaattttcgcctcagtggagccatcatgggaaaattgttacctgtcagctgcaggacgctgacggcaaatttctttccaacgacactgtacagcttaacgtgaaacatacgccaaagctggaaataaaagtgaccccttccgacgccatagtccgggagggagatagtgtgacaatgacttgcgaagtgagctctagtaatccagagtacacaactgttagctggttgaaggatggaacctcacttaagaagcagaacacctttactcttaacctcagggaggtgaccaaggatcagtccgggaaatactgctgccaggtgtccaacgatgtcggtcctggaagatctgaggaggttttcctgcaggtgcagtatgcccctgaaccaagtacagtccagatcctgcatagtcctgccgttgagggatctcaggtcgaattcctctgtatgtccttagcaaatccactcccaactaactatacttggtaccacaacggtaaggagatgcagggcaggaccgaggaaaaggtacatatccccaagatcctgccttggcacgccggaacctattcctgcgtggctgagaatatcctcggtaccggacagcggggacctggagccgaactggatgtccagtacccccccaaaaaggtgacaaccgtgattcagaaccccatgcctattcgtgaaggggacacagtaacactgtcatgcaattataactcaagcaacccctctgtgacacggtacgagtggaagcctcacggggcctgggaggaaccaagtctcggcgtattaaagattcagaatgttggctgggacaacaccacaatcgcgtgcgcagcctgtaactcttggtgcagttgggcgagtccggtggccctgaacgtgcagtacgccccccgtgatgttcgtgtgcgcaaaattaaacctttgtcagagattcactctggtaactcggtctccttgcagtgcgactttagcagctctcaccctaaagaggtgcaatttttttgggagaagaatggtagactgcttggcaaggaatcacaattgaacttcgacagcatcagtcccgaggatgcgggaagttatagttgttgggtcaataattctatcggacaaactgcttctaaagcctggaccctcgaggtgctgtatgctcccagaagacttcgggtctctatgagccctggtgaccaggtgatggaagggaaaagtgcgacattgacttgcgagagcgacgcaaacccacctgtgagtcactacacctggtttgactggaataatcaaagtttgccatatcattcccaaaagctcagactggaaccagtcaaggtccaacacagcggcgcgtactggtgtcaaggcacaaatagcgtcggtaaagggcgctcaccactatctacgcttactgtctactattctcccgaaaccatcggccgtcgtgttgcagtgggcctgggttcctgcctggcaattctgattctcgctatctgtggtctgaaactgcagagaaggtggaagagaactcagagccagcagggcttgcaggaaaattcgagcggtcagtcctttttcgttcgcaataagaaacgctgcagggtcctgcgggatgctgaaactagcccagggctgcgttag

SEQ ID NO: 14423 - DNA, 783 bp, Artificial Sequence
  Description of Artificial Sequence: Synthetic coding sequence
atggcacggccccatccctggtggctctgcgttctgggtactctagtaggcttgtctgccactccagcacccaaatcttgtccagagcggcactactgggcccagggaaaactgtgttgccagatgtgcgagcccgggacatttctggtcaaggactgcgatcagcatagaaaggcggcccaatgtgacccctgcatccctggggtgtcgttcagtcccgatcaccatacccgcccacattgtgaatcttgccggcattgcaatagtggtcttttagtgaggaattgcaccataaccgccaacgctgaatgtgcatgtcgcaacggttggcaatgccgggataaagagtgtaccgaatgtgacccgctacctaacccctccctgaccgctagaagttcacaggctctttctccccatccccaacccacacacctgccatacgtgtcagagatgctggaggcgcgtactgctggtcacatgcaaacactggccgatttccggcagctgcctgccaggaccctgtctacgcattggcccccacagagatcgctgtgctccagcgacttcatacggatacttgtaatcttctctgggatgtttctagtctttacattggcgggagctttattccttcatcagcggcgaaagtatcgtagtaataaaggtgagtccccagtggaacctgccgagccgtgccactacagttgtccacgcgaagaagaaggctccacaatccccatccaggaagattataggaaaccagaacccgcgtgttcgccgtag

SEQ ID NO: 14424 - DNA, 1158 bp, Artificial Sequence
  Description of Artificial Sequence: Synthetic coding sequence
atgctagtgcggcgtggggccagagccggcccacgaatgccaaggggctggacggctttatgtctacttagtttattgccttctggattcatgtccctcgacaacaatgggaccgcgacacccgaactcccaactcagggcaccttttctaatgtctctacaaatgtttcttatcaggaaacaacaacaccgagcacactgggctcaacaagcttacatccggtgtcccaacacggtaatgaagcgacaactaatattacggaaaccacggttaagtttacctcgacttccgtcattacttcggtgtatggtaacaccaactcaagcgtccagtcccaaacatcggtcattagcacagtgtttaccacgccggctaatgtcagtactccggagaccacccttaaaccctcgttgtcaccagggaatgttagtgacctgtctaccacctcaaccagcctagccacaagtcccacaaagccctacacgtcctcttcccctatactcagcgacattaaagctgaaataaagtgtagcgggattcgtgaggtcaaactgactcaggggatctgtctggagcagaataagacatcaagctgtgccgaattcaagaaggatcgcggcgagggcttggctagagtactctgtggcgaggaacaagccgatgccgacgccggcgcccaggtgtgctcactgctcctcgcacagtctgaagtgcgtccacagtgccttttactggtactggctaatagaactgaaatctcctcaaagctgcagcttatgaagaagcatcagtctgacttgaagaagctgggaatcctcgactttactgaacaagacgtcgctagtcatcagtcttatagccagaagactcttattgcgcttgtgaccagcggcgccctccttgcggtactgggcatcacaggatattttctcatgaatcgccgttcgtggtctcctactggcgaaagattgggtgaggacccctactatacagaaaatggcggagggcaagggtacagtagcggccccggtacgagtccagaggcccagggtaaggctagtgtaaatagaggggcccaagagaacgggacgggtcaggccacctccaggaatggacactccgcacgacagcatgtggtcgccgataccgagctgtag

SEQ ID NO: 14425 - DNA, 987 bp, Artificial Sequence
  Description of Artificial Sequence: Synthetic coding sequence
atgctcgtgaggcggggcgctcgtgcgggccccaggatgccaaggggatggaccgctctttgcctgctgagtctgctgccatcaggattcatgtctctggacaacaatggcaccgccacaccggagctccccacccaaggtaccttcagtaatgtaagcacaaacgtcagttatcaggaaacaaccactccttcaaccttggggtccacatcgttgcaccccgtgagtcagcacggaaatgaggccacaactaatataactgagacaacggtgaagttcacctctacttccgtaatcactagcgtgtatggcaatacaaattcttcggtccagtcccagaccagcgtgatctccaccgtttttacgaccccagcaaatgtttcaactccggagactaccctgaagccttcactgtccccaggaaatgtgagtgacttatctacgacttccacgtctctcgccactagcccaaccaaaccttatacctctagctctcccattcttagcgacatcaaggcggagataaagtgctcaggaataagggaagttaagcttacgcaagggatatgcctcgaacagaataaaacctccagctgcgcagagttcaagaaggatagaggggagggactcgcacgtgtcctctgtggcgaggagcaggcggacgccgacgctggtgcgcaagtgtgctctctgctgctggcccaatcggaagtcaggccccagtgcttactcttggtattggccaataggactgaaatctcttccaagcttcagttaatgaagaaacaccagagcgacctcaagaaattgggaatcttagattttacggagcaagacgtcgcttcacatcaatcatatagtcagaagactctcatagccttagtgacgtccggcgccttgctcgcggttttgggtatcaccgggtattttcttatgaaccgcaggagttggtccccgaccggggagagactagagttggagccttag

SEQ ID NO: 14426 - DNA, 684 bp, Artificial Sequence
  Description of Artificial Sequence: Synthetic coding sequence
atggacttcggacctggaaggctatttcggtttttctcatactgcgtagtggcccatattcagttagcagtgttctttttctctgtcggcattcttgaaacaagaatcctgctcgcagacggcgccgagttcaagaaggataggggggaaggcctcgcgagggtgctttgcggagaggagcaggcagacgcagatgctggcgcacaggtgtgttcactgctcctagcgcagtccgaggtacgaccccagtgtcttctcctggtattggcaaatcgcacggagataagctctaaactccagttgatgaagaaacaccagagtgatctaaagaagttggggatccttgactttacagaacaggacgtggcttcacatcaatcctattcccagaagacacttatagccctggtaacgtccggcgcactgctcgctgtcttgggcatcacaggttatttcctaatgaaccggcgctcatggtctccaacaggggaaaggctcggtgaagatccctactacaccgagaatgggggaggccagggctatagttctggccccggtacatccccagaggcccagggaaaggcatccgtcaacagaggggcccaagaaaatgggactggacaagcaacctctagaaacgggcatagcgcacgacagcatgtagtagcagataccgagttatag

SEQ ID NO: 14427 - DNA, 1068 bp, Artificial Sequence
  Description of Artificial Sequence: Synthetic coding sequence
atgtctttggacaacaatggcaccgctacacctgagctgccaacacaaggaacgttttccaacgtcagcactaatgtgtcttaccaggagaccacaacacctagtacattagggagcacctccctgcaccctgtgagtcagcatggtaatgaggccactacaaatataacggagactactgttaaatttactagcacaagcgtgataacatccgtgtacgggaatacgaactcctccgtgcagagccagacttccgtgatttcaacagtctttacaacccctgctaatgtatcaacccctgagaccactctaaagccatcactctctccaggcaatgtgtctgacttatcaaccacatctacttctctggcgactagccccaccaagccgtataccagttcttcacccattctgtctgacatcaaggctgaaatcaagtgcagcggcattcgggaggtcaagctcacgcaggggatatgtctggagcagaacaaaactagctcctgtgcagaattcaaaaaagaccgaggggaaggcctggcccgggtgctgtgcggggaggagcaggcggatgccgacgccggggcgcaggtctgctcgctgctcctagcccaatccgaggtccgcccccagtgtctgctgctcgtgcttgccaataggaccgagatttcaagcaagctgcagctcatgaagaaacaccagagcgacctgaagaagcttggcatccttgatttcaccgaacaggatgttgcgtcgcatcagagctactcccaaaaaactctcatcgcccttgtaacctccggtgccttacttgcagtccttggcattacaggctactttctgatgaaccggcggagctggtcacctaccggcgaaaggttaggagaggacccctactacacagagaatggcggtgggcagggctatagctctggtcccgggacctcgccagaagcccagggcaaggcctccgtgaatcgtggtgcacaggaaaatggcacaggccaggccacgagccggaacggccactccgccaggcaacacgtggtggcggacacagagctgtag

SEQ ID NO: 14428 - DNA, 753 bp, Artificial Sequence
  Description of Artificial Sequence: Synthetic coding sequence
atgtttttgcagatgtatccaaccaagaagcttcaacatctcgtccccctggaggtacccgcgtgcactttgtgtcttaatatggctatgaggccccagcagacgagccaagccgagataaagtgctccgggattagggaagtgaagctcacacagggcatatgtttggaacaaaacaagacctccagctgcgccgaatttaagaaagatcggggcgaaggcctcgcgcgcgtgctgtgcggcgaggagcaagcggatgctgatgcaggcgcccaggtttgctctctgttattagcccaaagcgaggttaggccacaatgcctcctgctcgtgctagcaaatcggacagagatcagcagcaagttgcagttaatgaagaagcaccaatctgacctgaagaagcttgggatacttgatttcaccgagcaggatgtggcctcccatcagagttactctcagaagaccctgatcgcattagtcaccagtggcgccctactagcagtgcttggaatcacagggtatttcctcatgaaccggcgatcctggtcccccactggcgagcgactgggcgaagacccttactatacggagaatggcgggggacagggatactcctctgggccaggaacatcccctgaggctcagggcaaagcgagcgtcaaccgcggcgcacaagagaacggaactggacaggctacttctagaaatggccatagcgcccggcagcacgtggttgcggatacggagttatag

SEQ ID NO: 14429 - DNA, 516 bp, Artificial Sequence
  Description of Artificial Sequence: Synthetic coding sequence
atggagcatagcacgtttttgtcgggccttgtcttagctaccctgttgagccaagtgagcccctttaagatacccatcgaagagctcgaggaccgagtctttgttaactgtaatacaagtattacttgggttgaaggcactgttgggaccctgctgtcggatatcaccagactggatctcgggaaacgcattttagatccaaggggaatctatcgctgcaatggcaccgacatttacaaagacaaagagagcaccgtgcaggtgcactacagaatgtgccagtcgtgtgtcgaacttgatcccgccacagtcgccggcattattgtgactgatgtgatcgccactttattactggccctcggagtattttgtttcgccggacatgagactggacggctcagcggcgccgccgacacacaggcactgctgagaaacgatcaggtgtatcagccattgcgcgaccgcgatgacgcacagtacagtcacctaggaggcaattgggcaagaaacaaatag

SEQ ID NO: 14430 - DNA, 384 bp, Artificial Sequence
  Description of Artificial Sequence: Synthetic coding sequence
atggaacatagcacctttttgtctggccttgtgttggccactttgctctcccaagtgagtccctttaagataccaatcgaggaactggaagacagagttttcgtcaactgcaacacatctattacctgggtggaggggacggtgggcactctcctgtcagacatcacaaggcttgatttaggaaagcggatcttggacccgagggggatctaccggtgtaatggcacggacatctacaaagataaggagtcaaccgtgcaagttcactacaggacggccgacactcaggccctgctgagaaatgatcaagtttaccaaccattgcgggatcgagacgacgctcagtacagtcacttgggcggaaattgggccagaaacaagtag

SEQ ID NO: 14431 - DNA, 1377 bp, Artificial Sequence
  Description of Artificial Sequence: Synthetic coding sequence
atgaatcgaggagtccccttcaggcatctgctgctagtcttacagctcgctttgctaccagcggccactcaggggaagaaggtggttctgggcaaaaaaggcgacaccgttgaactaacgtgcaccgcatcacagaagaagtcaatacagtttcactggaagaatagcaaccagatcaagatccttggaaaccaagggtcttttttgacaaaagggccatccaagctaaatgatcgggcagactcccgcagaagcctgtgggatcagggaaactttccactgatcattaagaatctgaaaattgaggatagcgatacctacatttgcgaggttgaagatcagaaggaggaggttcaattgctcgtttttgggctaaccgcgaactctgatactcatctcctgcagggacagtctctcacgctgacgctcgaatccccaccaggctcttctcctagcgtacagtgcaggtcgccccgtggaaagaatatccaggggggcaagactctcagtgtgtctcagttggaattgcaggattccggaacatggacatgtacagttttacagaaccagaaaaaagtggagtttaagatagacattgtggttctggcgttccagaaagccagttccatcgtctacaagaaagaaggcgaacaggtggagttctccttcccactcgcttttaccgtcgaaaagctgactggctctggcgaactctggtggcaggctgagagagcatcttctagtaaatcgtggattacatttgacctgaagaacaaggaagtctctgtgaaaagggtcacccaggatcctaagcttcagatgggtaagaagctccctctccacttaaccctgccacaagcgctcccccagtatgcgggatcaggcaatttgaccctggccctcgaagcgaaaaccgggaagctccaccaagaggtgaacctggtggtgatgcgcgccactcaactccagaagaaccttacttgtgaagtctggggccctacgtctcccaagttgatgctctcactgaagttagaaaataaggaagctaaagtgagcaaacgggagaaagcagtctgggtgttaaacccggaggccggcatgtggcagtgcttgctctctgacagcgggcaagtgctgctggagagcaatatcaaggtactgcctacatggtctactccagtccagccgatggcccttattgtcttagggggagtggctggcctcctgctgtttataggcctgggtatttttttttgtgtgcgttgccgtcataggagaagacaggccgagcgcatgtcacagatcaagaggctgttgtctgagaagaaaacatgccagtgtccgcatcggttccagaagacttgctctccaatttag

SEQ ID NO: 14432 - DNA, 723 bp, Artificial Sequence
  Description of Artificial Sequence: Synthetic coding sequence
atgatcgagacttacaaccagaccagccctcggagcgccgctaccggtctaccgatcagcatgaagatcttcatgtatctcctaacagtgttcctgattacacagatgattggctcggccctcttcgcggtctacctgcaccgccgcctagacaagattgaggatgagagaaatcttcacgaggattttgtgttcatgaagaccattcagcggtgtaacacaggggagagatcactttcactgctgaattgtgaagaaatcaagagccagtttgaaggattcgtgaaggacattatgttaaacaaggaagaaacaaaaaaagagaacagcttcgaaatgcaaaaggtgttacagtgggccgagaaagggtattacacaatgtcaaacaacttggtgacacttgagaacggtaaacagctgacagtcaaacggcagggtctgtattatatctatgcccaggtcacattttgctctaacagggaggcctcgtcacaggccccattcatcgccagcctatgtctgaaaagcccgggccgcttcgagaggatactgttgagggctgctaatacacatagttctgctaaaccctgcggtcagcagtccatccacctgggcggcgtgtttgaacttcaaccgggcgcatccgtatttgtcaacgtgacggatccatcccaagtttcacacggaactgggttcacaagttttggcctgctcaaactctag

SEQ ID NO: 14433 - DNA, 786 bp, Artificial Sequence
  Description of Artificial Sequence: Synthetic coding sequence
atgatcgagacatataaccagacctccccaagatccgcagctaccgggctgcctatcagcatgaaaatctttatgtacttgttaacggtgtttttgatcacgcagatgatcggaagcgccctctttgcagtgtatctgcatagaaggcttgacaaaattgaagatgagagaaatctgcacgaagacttcgtgtttatgaaaaccatccaacggtgtaacaccggggagcggtctcttagcctgctgaattgcgaagagattaagagccaatttgagggttttgtgaaagacatcatgctgaacaaagaggaaaccaagaaagaaaactctttcgagatgcagaaaggtgaccagaaccctcagatcgccgcccacgtgatctctgaggccagttccaagactacatctgtgctccaatgggccgaaaaaggctactacactatgtccaataacttggtgaccctagagaacggaaagcaactgaccgtgaaacggcagggactgtactacatttacgcccaggtgacgttctgctccaaccgcgaagccagttctcaggctccttttatcgccagtctttgcctcaaaagccccgggcgattcgaaagaatcctgttgagggcagcaaacacacactcatccgctaaaccttgcgggcagcaatcgatccatcttggcggagtctttgaactgcagcccggcgcctctgtattcgtgaacgtcacggacccaagccaggtgagccatggaacagggtttacatcatttggactgctaaagctgtag

SEQ ID NO: 14434 - DNA, 612 bp, Artificial Sequence
  Description of Artificial Sequence: Synthetic coding sequence
atggtacggctgcccctacagtgtgtcctctggggttgcctgctgacagcagtgcacccagagccgcccaccgcatgccgggaaaagcaataccttatcaactcgcaatgctgctccttgtgccagcccggtcagaaacttgtatcagactgcactgagttcaccgaaaccgagtgcttaccatgcggggaatctgaattcctcgatacatggaaccgagagacacattgtcatcagcataagtactgtgacccaaacctaggattacgcgtccagcagaaaggaacctcagaaacggacactatctgtacatgcgaagagggatggcactgtacctcagaagcatgcgagagttgtgtgctccaccgtagttgttctcccggctttggcgtgaagcaaatcgcgactggggtatctgacaccatttgtgaaccatgtccagtcggtttctttagcaatgtttcttctgcgttcgagaaatgtcacccctggacgcgatcccccggctctgcggaaagccctggcggcgatcctcatcaccttcgagatccagtgtgccatccactgggcgcgggtctttatcaaaaaggcggacaggaggccaaccagtag

SEQ ID NO: 14435 - DNA, 786 bp, Artificial Sequence
  Description of Artificial Sequence: Synthetic coding sequence
ggccgctcaccccttagaacacgcgatcgggttctgacaaattgggaggatgggttgaccgtcgcttatggggcagtgaagctgattcagagcctgtctttgcaacccgtcgggtggcagcagaactggggactgtcaagccctcccacaatgctgctgccctccagagctcagtcccccactgagctgcccctggcccctttagcagaacctaacaccggctgttcttcgctgctgtcttggcacagcacccgaggcgaactgcatctatgggctttgggcctggggcagatgggtggctccaagtgtgggagtccactcagtcccttagcccctacgttggaggcactgcgacgaccctggtgcggccagcaaggtgctggcggcactcggggcatttcgaccgatccaccaagcggtaagggagggagagcatggggccgcgatccccttccacgggaaggactactgagaggtaccgccgccccagctgctgggggagatctaacaccttgcctgtctagaccacccacacctagtagaaatcctcgccggagtatattcccgacaatctttctggctccaacactgctactacagtgccggcgtctgtatatggacgccaatagaagtccacgcagaatggcgaagagggtcgcctctcaatgccgtagggattcagaggccgcccccacacaggagtgcggccatgtgggtaagcaggctgtcggacagcgtgcctggtgctgctgttgctgcggagttagggtgaggggatggcactag

SEQ ID NO: 14436 - DNA, 834 bp, Artificial Sequence
  Description of Artificial Sequence: Synthetic coding sequence
atggtaagattaccactgcagtgtgttctgtggggctgcttgcttacagccgtgcatccagagccccctacagcgtgcagagaaaagcagtatctcattaattcacagtgctgctcactctgccagccggggcagaagcttgtgtctgattgtacggaatttaccgaaacagaatgcctcccttgcggggaatcggagtttctggacacctggaacagagagacacattgccaccagcataaatactgtgatccaaacttgggcctgcgtgtgcagcaaaaaggcacctcagaaaccgacacaatttgtacatgtgaagaaggctggcactgcacatctgaggcgtgtgagtcctgtgtgctgcaccgtagctgttctcctgggttcggagtcaagcagattgccaccggcgtaagtgatactatctgcgagccatgccccgtgggtttctttagcaacgtgtcttccgctttcgaaaagtgtcatccttggacaagttgtgagactaaggatttggtggttcagcaagcaggcacaaacaaaactgatgtggtgtgcgggcctcaggatcgcctgagggccttggtggttatcccaattattttcgggattctgttcgcgatcctccttgtgcttgttttcatcaaaaaggttgccaaaaaaccaactaataaagcgccccacccaaagcaagaacctcaggaaatcaacttcccagacgacctgcctggctccaatacagcagcgccagtgcaggagactcttcacgggtgtcaaccagtgacccaggaagacggcaaggagagcagaattagtgttcaggaaaggcagtag

SEQ ID NO: 14437 - DNA, 1086 bp, Artificial Sequence
  Description of Artificial Sequence: Synthetic coding sequence
atggataaattttggtggcacgctgcctgggggctctgcctggtccctttgtctttggcccaaattgacctgaatattacgtgcaggtttgcgggggtgtttcacgtcgaaaaaaacggccggtatagtatcagtcggacggaggcggccgatctgtgcaaggcctttaattctacattgccgactatggcgcagatggaaaaggctctgtcgatcgggttcgagacttgtcgctacggatttatcgaaggccatgtggttatcccaaggattcacccaaactctatctgcgctgccaacaacaccggagtctacatattgactagtaatacctctcagtacgatacatactgttttaatgcaagtgctcctcccgaagaggactgcaccagtgtgacagatctgccaaacgccttcgacggacccatcacaataactatagtcaaccgggacggcacaagatatgtccagaaaggggagtacagaacgaatcccgaagacatctacccttcaaaccccactgacgacgatgtctcttccgggagttcttctgagcggtcctccacaagcgggggttacatcttttataccttttcaacagtccatcctatccccgacgaggatagcccctggatcacagactctacagaccgcatcccagctactcgtgatcaagataccttccatcccagcgggggcagtcacacaacccacggtagtgaaagtgacggccactcccatgggtcccaagagggaggcgcaaacacaacgtccggccctattcgcacaccacagatccctgagtggctcatcattctcgcatctttgctggcgcttgctctgattctggccgtctgtatcgcggtcaactctcgcagaaggtgcgggcaaaagaagaagctcgtgatcaactccggtaatggagctgtcgaagatcgaaagcctagcggtctcaatggggaagctagtaagtcacaggaaatggtccacctcgtgaacaaggaatcaagcgagacaccagaccagttcatgacggctgatgaaactcgcaacctgcagaatgtcgatatgaagattggcgtttag

SEQ ID NO: 14438 - DNA, 420 bp, Artificial Sequence
  Description of Artificial Sequence: Synthetic coding sequence
atggacaagttctggtggcatgcagcttggggactgtgcctagtgcccctatctctggcccagatcgatctgaacatcacctgccggttcgcgggagtgttccacgtcgagaagaacggaagatattcaatctcaagaacagaagccgccgatctgtgtaaggcattcaatagtaccttaccaacgatggcgcagatggaaaaggcactttccatcggctttgagacatgctctttgcactgtagtcagcagtccaagaaagtatgggcggaagagaaagcgagcgatcaacagtggcaatggtcttgcggtggtcagaaagcaaagtggacacaaaggcgggggcagcaggtcagcggcaatggcgctttcggagaacagggggtggtgaggaacagtcgcccagtctatgatagctag

SEQ ID NO: 14439 - DNA, 1023 bp, Artificial Sequence
  Description of Artificial Sequence: Synthetic coding sequence
atggacaaattttggtggcacgccgcttggggcctgtgcttggtgcccctgtctctagcacagatcgatctgaacatcacctgccggtttgcaggcgtgtttcacgtagagaagaatggccggtattctatttccagaaccgaagccgctgacctgtgtaaggcctttaattccacgctcccaacgatggcccaaatggaaaaggcactgtctatcggcttcgagacatgtcgctatggtttcattgaagggcatgtggtgatcccacgaatccacccaaattcgatttgtgccgctaataatacaggcgtttatatactcacctctaacacgagtcagtatgatacttattgtttcaatgccagcgccccacctgaagaagactgtacttcagtgacagatctgcctaacgcattcgacggcccaatcaccatcaccatagtcaatagggatggtacgcggtacgtccaaaaaggggagtatagaacaaatcccgaggacatctacccttccaatccgacagacgacgatgtcagctctggaagcagctccgaacggtcttcaaccagtggcggctatattttttataccttcagcactgtacacccgatccccgacgaggacagcccgtggattacagatagtacagaccggatcccagcaacaaggcatagtcacggttcccaggagggcggggccaacaccaccagcggccccatcaggaccccacagatacccgagtggctgatcatcctggcttccctgcttgctctggccctgatattagccgtgtgtattgccgtgaattctcgtcgcagatgtgggcagaagaagaagctggtgatcaacagtggaaatggtgctgtcgaggaccggaagccttcaggactcaacggggaggcgagtaaatcccaagagatggtgcaccttgtcaacaaggagtcatctgaaacccctgatcagtttatgactgccgatgagacacgcaacctccagaacgtagatatgaaaataggggtttag

SEQ ID NO: 14440 - DNA, 1191 bp, Artificial Sequence
  Description of Artificial Sequence: Synthetic coding sequence
atggataaattctggtggcacgcagcctggggtctgtgtcttgtccctttgtcccttgcccagattgacctgaatattacctgcagattcgccggagttttccatgtggaaaaaaacggacgatatagtatcagccgtaccgaggctgctgatctttgtaaggcctttaacagtactcttcccactatggcacagatggaaaaggccctgtctataggtttcgagacctgccgctatggcttcatagagggccacgtggtgattcccagaattcacccaaactctatttgtgcagccaataacacaggagtgtacattctcacaagtaacacttcacagtatgacacatattgcttcaacgccagtgcacctcccgaggaggactgcactagtgtcaccgatttgcccaatgctttcgatggtcccattacaattaccatcgtgaaccgggacggcacaagatacgtgcagaagggggaataccggacgaatcccgaggacatatacccaagtaacccaactgatgacgatgtgagttcagggtcgtcctctgaacgctccagcacatccgggggctatatcttttacacatttagcaccgtacatcccatcccggacgaagattcgccatggatcaccgatagcaccgaccgaattcccgcgactaatatggattctagccattccattactctgcagcctacagctaacccaaataccgggctggtcgaggatcttgacagaacgggccctctctcgatgaccacccggagggaccaggataccttccatccttctggaggctcacataccacacacggtagcgagtccgacggccattctcatggctcgcaggaaggcggcgccaacacaacctcaggtcccatcaggactcctcaaataccagaatggctgatcattcttgcttctcttttggccttggctctcatattggctgtgtgcatcgctgtgaactcgcgaagaaggtgcgggcagaagaaaaagctagtcatcaattcaggcaacggtgctgtggaggacaggaagcctagtgggctcaatggtgaagctagcaagagccaggagatggtacacctagtcaataaagagtcctcagagacccctgaccaattcatgacagccgacgaaacccgaaacctgcaaaatgttgacatgaaaatcggggtgtag

SEQ ID NO: 14441 - DNA, 2100 bp, Artificial Sequence
  Description of Artificial Sequence: Synthetic coding sequence
atggacaagttttggtggcatgccgcctggggcctttgcctcgttccactgagcctcgcacagatagatctgaacatcacttgtcgctttgccggcgtgtttcacgtcgagaaaaacggtagatactctatctccaggacagaggctgccgacctgtgcaaggcattcaacagcaccctccccacgatggcacagatggaaaaagccctttccattggcttcgagacctgccgctatgggtttatagaaggtcacgttgtcatcccacggatccatccaaactctatctgtgccgcaaacaacacaggggtctacattttaaccagtaacacctcccagtacgatacgtattgttttaatgcgagcgcccccccagaggaggactgcacaagcgtgacggatctgccgaacgctttcgacggacctatcacgattactattgtgaacagggacggaactaggtacgtgcagaagggagaatatcgcaccaaccctgaggatatttatccaagcaacccaaccgatgatgacgtctcaagtgggtcaagctctgagcgctccagcacttccggtggatatattttttatacattttcaactgtccacccaatcccagatgaggacagcccatggatcactgactcaacggatcggatacccgctactagcacgtcatcgaataccatctccgcaggatgggagcctaacgaggagaatgaagacgaacgcgatcggcatctcagctttagtggatctgggattgacgacgatgaagacttcatctcgagcaccatcagtacaaccccaagggcctttgatcacaccaagcaaaatcaggactggacacagtggaatccaagccactctaatcctgaggtgctgctccaaacaaccactcggatgactgatgtggaccggaacggcactacagcatacgagggaaactggaatcctgaagcacacccccccctcattcatcatgagcatcacgaagaggaagaaacccctcatagcacctcaaccatccaggcgactcctagctcaaccaccgaggaaaccgcaacccagaaagaacagtggttcggcaacaggtggcacgagggttacaggcagacgccgaaagaggattcacattcaactactggtacagctgccgccagtgcgcacaccagtcatcctatgcaggggagaactaccccttccccggaagactctagctggacagatttctttaatcctatcagccacccgatgggaaggggacaccaggccgggagaaggatggatatggacagtagtcactctatcactctgcagcctactgctaatccgaacaccggcctggtagaggacctcgatcgcacaggtccgctctctatgactacacagcaatcaaactctcagtcgtttagtacttcacatgagggattggaagaggacaaagaccatcctaccacatccactcttaccagcagcaatagaaatgacgtgacgggggggagacgggaccctaaccacagcgagggcagcacaacactgttggaagggtacacttctcactacccccacacgaaggagtccagaacgttcattcctgttactagtgccaagacaggatccttcggcgtgaccgctgtgactgtgggagacagcaattcgaacgttaacagatccctgagcggggaccaggatacatttcatccatctggcggatcccacacgacacacgggtcagaaagtgacgggcactctcacggctcacaagaggggggagctaacaccaccagtgggccgatccgaacccctcagattcccgaatggctgattattctggcatccctacttgcactggccttgattttggcagtgtgtatagccgttaattctcggcgtagatgcggacaaaagaagaagctggttatcaactccggaaatggtgcagtggaggaccgaaagccaagcgggctcaacggagaggccagcaaatcccaggagatggtgcatctcgtcaataaggagtcttcagagaccccagatcaattcatgacggctgatgagacccgtaacctgcaaaacgtggacatgaagattggagtgtag

SEQ ID NO: 14442 - DNA, 243 bp, Artificial Sequence
  Description of Artificial Sequence: Synthetic coding sequence
atggacaagttctggtggcatgctgcgtggggactgtgcttagtgcccctttcactggcacagatcgacctgaacatcacatgccggtttgctggcgtcttccacgttgaaaaaaacgggagatactcaatcagcaggaccgaggccgccgacttgtgtaaggcctttaacagtacactccccaccatggcacagatggagaaggctctgtccatcggctttgagacatgctcatccacttag

SEQ ID NO: 14443 - DNA, 2229 bp, Artificial Sequence
  Description of Artificial Sequence: Synthetic coding sequence
atggataagttttggtggcatgccgcgtggggactctgtctggtacccctgagtctcgcccagattgatttaaatattacatgtcggtttgccggcgtctttcatgttgaaaaaaatgggcgttattctatcagtcgtacagaggccgcagatctctgtaaagcttttaactctacgctcccaactatggcacagatggagaaggcgttgtccatcgggttcgaaacctgtagatacggcttcatcgaggggcacgtcgtgatccctcggattcaccctaactcaatatgtgctgcaaacaacacaggagtctatattctcacttcaaataccagccaatatgacacctattgttttaacgctagcgctcctcctgaagaggactgtacttccgtgaccgatcttcctaatgcttttgacggcccaatcacaattacaatagtgaatagagacggaacgcgctacgttcagaaaggtgaataccggaccaacccggaggacatatacccttctaatcctaccgacgacgacgttagcagcggttcttcaagtgaacgttcatcgacgtctggtggttatatcttctatacattctcgacagttcacccaattccagacgaggatagtccatggatcacagacagcacagaccgcatccccgctactacattaatgtcaacttccgcaactgccaccgagaccgccacgaaaagacaggagacatgggactggttctcatggctgtttctgccctccgaaagcaagaatcatctgcacacaaccacccaaatggccgggacctcctctaatacaatctccgcaggctgggaacccaacgaagaaaacgaggacgagcgggatagacaccttagcttctcaggtagtgggatagatgacgacgaagatttcatttcatctacaatctctaccacacctagagcgtttgaccatacaaaacagaaccaggattggactcagtggaatccttctcacagcaatcctgaagtcctgcttcagactacaacccgcatgaccgatgtggataggaacgggacaaccgcttatgaaggcaattggaatcctgaggcacatcccccactcatccaccacgaacaccatgaagaagaagaaactccgcacagtacttctaccattcaggcgaccccaagttcaacaacagaagaaacagcaacgcagaaggagcagtggtttggcaaccgatggcacgaggggtatcgccaaacgccaaaagaggattcccacagcacgacgggcaccgctgctgccagtgctcacacatctcaccccatgcaaggaaggacaactccgtcccctgaggactccagctggacagatttcttcaatcccatcagccaccccatgggcaggggacaccaggcaggaagacgtatggatatggactcttcccacagcattacgttgcagcctacggccaacccaaatactggattggtggaagacctggaccgtactgggcccttatccatgaccactcagcagtcaaatagtcagtccttttctaccagccacgaaggcctggaagaagacaaagatcacccaacaacaagtaccctcacttccagtaatcgcaatgatgtcaccggaggtaggcgagatcctaaccactcagagggctccaccacactgttggaagggtatacaagccactatccccacacgaaagagtcgcgcacctttatccccgtgacctccgccaaaacaggttcctttggtgtgactgccgtgacagttggagacagcaactctaacgtgaataggagcctctccggggatcaggatacattccacccgagcggaggcagccacaccactcatggatccgagagcgacggtcatagccacggctcacaggaaggcggtgctaataccacctcgggccccatacggacccctcaaattcctgaatggctaattattctggcttcactcttagccctagccctgatcctggccgtgtgcattgccgtcaattctcggaggaggtgtgggcagaagaagaagctggtgatcaactccggaaatggggccgtggaggacagaaagccttccggtctgaatggcgaagcctctaaatctcaggaaatggtccacttggtgaacaaagagtcttctgagacacccgatcagttcatgaccgcagatgagacccgcaacctccagaacgtcgacatgaagatcggagtgtag

SEQ ID NO: 14444 - DNA, 2145 bp, Artificial Sequence
  Description of Artificial Sequence: Synthetic coding sequence
atggacaaattctggtggcacgccgcatggggcctctgtttggtgcccctgagtcttgcccagattgatttaaatatcacttgcaggttcgcaggtgtgtttcatgtcgaaaagaacggacgttattccataagtagaaccgaggccgcagacctctgtaaagctttcaactccacccttccaacaatggctcaaatggaaaaggcactctccattggcttcgagacatgtcggtacggatttatagaggggcatgtcgttattcctaggatccatcccaattctatttgtgccgctaataataccggggtgtacatcctcaccagtaataccagccaatatgacacctactgcttcaacgcttctgccccccctgaggaagactgtactagtgtcactgatctcccaaatgcattcgatggaccaattacaatcacgatcgtgaaccgcgatggcacaaggtacgtccaaaaaggggagtatcgcacaaatcccgaggacatctacccaagtaaccccacggacgacgacgtgagtagcggaagctcaagtgagagatcctccacttctgggggatatatcttttacactttctctaccgtgcatcccattccggacgaggactccccctggatcaccgactcaactgatagaatcccagccaccacgctgatgtctacctctgctaccgcgactgaaaccgccaccaagcggcaggaaacgtgggattggtttagttggttgttcctgccctcggagagcaagaatcacttgcacactacaactcagatggcgggcacgtcttcaaataccatatccgccgggtgggagcccaatgaggagaatgaagacgaacgggacaggcacttgtcctttagtggctctgggattgacgatgacgaggattttatttcaagcacaattagtacaacaccacgagcctttgaccataccaaacagaatcaggactggacgcaatggaatccatcccatagcaacccggaggtgctgctgcagaccacgacaagaatgaccgctgacgtggatagaaatggcaccacagcatacgaaggtaactggaatccagaggcccatcctcctctgattcaccacgagcaccacgaggaagaggaaacaccgcatagcacttcaaccatccaggccacaccatcatccaccacggaggagaccgcaacacagaaggagcagtggttcggcaacagatggcatgaaggctacaggcagacgcctaaggaggactcccacagcactactggtacagcagctgcctccgctcacacctcccacccaatgcagggccggactactccgagcccggaggactccagctggactgatttttttaatccaattagccacccaatgggacgcgggcaccaggccgggcgacgcatggatatggatagcagccattcgatcaccctacagccgacagccaaccctaatacaggcctcgtcgaggatctggacaggactggtcctctctccatgacaacccgtaatagaaatgatgttaccggtgggcgccgagatccaaaccactccgagggatccacgacactgctggagggctatacaagccactatcctcacacaaaggagtcacggacctttattccagtcacatccgcaaagactggttcctttggtgtcaccgcagtaacagtaggcgactccaactcaaatgtcaatcgatcgctgtctggagaccaggacacatttcatccatccgggggctcccacaccactcacggctccgagagtgatggccatagtcatggtagtcaggaaggaggggctaacacaacgtcaggcccaatcaggactccccagattccagagtggctcatcattctggcttccttactggcactggctctcattctcgccgtttgcattgccgtaaatagcagaaggaggtgcgggcagaaaaagaagcttgtcataaacagcgggaacggggcagttgaagatcgaaaacccagcggcctgaatggtgaagccagtaagtcccaggagatggttcatctggtcaataaggagagttctgaaacccccgatcagtttatgacagcagacgaaacccgcaatctgcagaacgtggatatgaagatcggcgtctag

SEQ ID NO: 14445 - DNA, 1482 bp, Artificial Sequence
  Description of Artificial Sequence: Synthetic coding sequence
atggataagttttggtggcatgcagcctgggggttgtgcctggtacccctgtctttggcccagattgacctcaacatcacttgtcgcttcgccggagtgttccatgtggagaaaaatggaagatattccatatcgagaacggaggcggccgacttgtgcaaggccttcaactcaaccttgccgacaatggcacagatggagaaggccctatccattggattcgaaacatgccgatatggctttatcgaggggcacgtggtcatcccccgcattcaccctaattccatatgtgctgccaataacaccggcgtgtacattcttaccagcaacacgagtcagtatgacacatattgttttaatgcaagcgcacccccagaggaggattgcaccagcgtaacagatcttcctaacgctttcgatgggccaattacaattacaattgtgaacagggatgggaccagatatgtccagaaaggagagtaccgcaccaatcctgaggatatttaccccagtaatcctacggacgacgatgtgtcaagtggctccagctctgagcgtagtagcacttccgggggttacatcttttacacattctctactgtccacccaattcccgacgaggactcaccctggattaccgactccacagaccgcattcccgcaacgaacatggactcatcccactcaattaccctccagcctaccgccaatcctaatactgggctggtcgaggatttggaccgtactggccccttaagtatgacaacccagcagagcaattcccagtctttttcaacttcccacgaaggtctggaggaagacaaagaccaccctacaacctcaacccttacttcatctaatcggaacgacgtcaccggaggcaggcgggatcctaatcattccgaaggcagcactactctgctggagggctatacctcgcactatccccatacgaaagagagccgaaccttcatccccgtgacctcagcaaaaaccggctctttcggcgtgactgcagtgaccgtgggggacagtaattcaaacgtaaatagaagtctttccggagatcaggacacatttcacccttccggggggagccatacaacacacggctctgagagcgatggccactcacatgggtctcaggagggcggggctaacacgaccagtggaccaatcaggactccccagattccagaatggctaatcatcctggcgagcctgctggcactggctttgattctggccgtgtgtattgccgttaatagcaggagaaggtgtggacaaaagaagaagcttgtaataaattcagggaatggggctgtagaggaccggaaacctagcggtctgaacggcgaagcttcgaagagccaggagatggtacatctggtaaacaaagaaagcagcgagaccccagatcaattcatgaccgccgatgagactcgtaacctccagaatgtggatatgaaaattggcgtctag

SEQ ID NO: 14446 - DNA, 1290 bp, Artificial Sequence
  Description of Artificial Sequence: Synthetic coding sequence
atggacaagttttggtggcacgccgcctggggtctgtgtctggtccctctttcactggcacagatcgatctgaacataacttgccggttcgcaggagtgtttcacgtagaaaagaacggaaggtattccataagtaggacggaggccgctgatctgtgtaaggccttcaactctaccctacctacgatggcgcagatggagaaggcactgagcatcggcttcgagacatgtcgttacgggtttatcgaggggcacgtcgtgattccgcgaatccaccccaactcaatctgcgccgctaataataccggtgtgtatatattgacaagcaataccagccagtacgacacatactgttttaatgcctcagctcctcccgaagaggactgcacttcagtgactgatttgccaaatgcttttgacggccccatcactattaccatcgtcaaccgcgacggaactaggtacgtccagaaaggcgagtatcgcacgaaccccgaagacatctacccctcgaaccccaccgacgacgatgttagctccgggtcatcgtccgagcggtcttccaccagcggcggatatatcttttacacattttccacagtgcatcccattcctgacgaagactccccatggattactgactcgaccgataggattccggctacgaacagaaatgacgtgaccggaggaaggagggatccgaaccattccgaaggttcgaccactctgctcgagggttatactagccactacccccacacaaaggaatcaaggaccttcatcccggtgaccagcgccaagactggcagtttcggcgttaccgcagttacagtcggcgactctaacagcaatgtaaataggtcattgtcgggggatcaggacacattccatccttcaggcggcagtcacactacacacggaagtgagagcgacgggcattcccacgggtcccaggaaggtggggctaacactacaagtggacccattcgaacaccacagatccctgaatggctaatcattttggccagtttactcgccctcgcactgatcttggcagtgtgtatcgcagtgaattcccgcagaaggtgcggacagaaaaagaaattggtgattaatagcggtaacggggctgttgaggacagaaaacctagcgggctgaacggggaggcttcaaagtctcaggagatggtacatctggtcaataaagaatccagcgagactccagatcagttcatgaccgccgatgaaactcgaaatctgcagaatgttgatatgaagattggcgtttag

SEQ ID NO: 14447 - DNA, 2025 bp, Artificial Sequence
  Description of Artificial Sequence: Synthetic coding sequence
atggataagttttggtggcacgccgcctgggggctgtgccttgtccctttgtcactcgcgcagatcgatttgaacatcacctgtcggtttgccggagtgttccacgtggagaaaaacggacgctactctatttcacggacagaggccgctgatctgtgcaaggcatttaattctacgttgcccactatggcccagatggaaaaagccttatctataggttttgagacttgccgttatggtttcatcgaaggacatgtagtcataccccgcatacacccgaactccatctgtgctgcaaacaatacaggggtgtatattctaacgagcaacacttcccagtacgatacatactgctttaacgcaagcgccccccccgaagaggactgcacatcagtgactgacctccccaacgcctttgatgggcccatcactatcaccattgttaaccgcgatggaacccgatacgtgcaaaaaggtgagtacagaactaaccctgaagatatctaccctagcaacccaaccgatgacgacgtttctagcggcagctcctccgaacgttcaagcacttctggaggctacatcttttacacattcagcactgtccaccccattcctgatgaagactccccctggatcacggactctaccgatcgaatccccgccaccaccctgatgtcaaccagcgcaacggccaccgaaaccgctacaaagcggcaggaaacgtgggattggttcagctggctgtttttgccttctgagagcaaaaatcacctgcataccaccacccagatggcgggtacaagctccaacacaatctcagccggatgggagcccaatgaagagaatgaagacgagcgcgataggcacctctccttttctgggagcggcattgacgacgacgaagactttatatcatctacaattagcaccacgccaagagccttcgaccatactaaacaaaaccaggactggactcagtggaacccttcccactcaaatccagaagtcttgctgcagacaactacccgaatgacagacgtggatagaaacggcacaaccgcatacgaagggaactggaatccagaagctcaccctcccctaatccatcacgagcatcacgaggaggaagaaactccccacagtacttcgacaatccaggcgacaccgagctctacaaccgaagaaacggcaactcagaaggagcaatggttcggtaacaggtggcacgaggggtatcggcagacccccaaagaagactctcattccaccacgggtactgctgccgcatccgcccatacgtcgcatccaatgcaaggccgaacaaccccctccccagaggacagtagctggacagacttcttcaatccaattagccacccgatgggtcggggccatcaagcaggccggcgcatggacatggattcatctcacagtatcaccctgcaaccaacagcgaaccctaacacaggtctggtggaggacttagacagaaccggccccctttccatgaccacacagcagtcgaattcccagtctttctccaccagccacgaagggctggaagaagacaaggaccatccaacgacctcaacactcaccagtagtagagaccaagacacattccaccccagcggcggctcacacacgactcacggaagcgagtccgacggtcatagtcacggctctcaggaaggaggcgccaacactacttcagggcctatacggactccacagatccctgagtggcttatcatccttgcaagcctattggccctggctctgatattagccgtgtgtattgctgttaacagtcgacgtcgatgcggtcagaagaagaaactcgtcataaattctggaaacggcgccgtcgaggataggaaaccatctgggcttaatggagaggcctcgaaaagccaagagatggtgcatctagtgaacaaggagagctctgaaacccccgatcagttcatgacagccgacgaaacacgtaatttgcagaacgtggacatgaagatcggcgtatag

SEQ ID NO: 14448 - DNA, 2100 bp, Artificial Sequence
  Description of Artificial Sequence: Synthetic coding sequence
atggataaattttggtggcacgcggcctggggactttgtttggtgcccctaagcctggctcagatcgatttgaacattacttgccgtttcgctggcgtgtttcacgtcgagaagaacggaagatattcaattagtagaacggaggcagccgacctctgtaaggctttcaactctacactgccaaccatggcccaaatggaaaaagccctgtcgataggttttgaaacctgccggtacggctttatcgaaggtcacgttgttataccacggatccacccaaactccatctgtgctgcaaataataccggcgtgtacatcttgaccagcaacacaagtcagtacgatacatactgcttcaacgccagcgccccgccagaagaggattgtacgtcagtaactgacctgccaaacgcctttgacgggcctattaccatcaccattgtcaaccgagatggtactagatatgttcaaaagggcgaatatcgcacaaatcctgaggatatctaccccagtaaccctactgatgatgacgtgagttctggctcaagcagtgaaagatcctccaccagcggcggctatatcttttataccttctctaccgtccatccaatcccagatgaggactctccctggatcacagactcaacagatagaatcccggctaccaccctcatgtccacttcggcaaccgcgacagaaacagccacaaagcgccaagagacgtgggactggttttcctggctgtttctaccaagtgaatccaagaatcacctgcacacaaccactcaaatggcgggaacttcctccaataccatctccgccggatgggaacctaatgaagagaatgaagacgagagagatagacacttatcctttagtggtagtggaatcgatgacgatgaagatttcatctcatccacaatcagcactacacctcgcgcctttgaccatacaaagcagaaccaggattggacacaatggaatccctctcactcgaatcccgaggtgcttcttcagactacgacacgaatgacagatgtggaccggaacggcaccacagcatatgaaggcaactggaaccccgaggcgcatccacctcttattcaccatgaacatcatgaagaggaggagactccccactcaactagcactacagctagtgctcacactagccacccaatgcagggacgcaccaccccatcacccgaagattcctcatggacagacttcttcaatccgatcagccaccccatggggagggggcaccaggccggcagacgcatggatatggattcctcacattcaattactctgcaacccacagcaaacccgaataccgggctggtcgaggatctcgacaggacgggcccactcagtatgactacccaacaatccaactcccaaagcttctctactagccacgagggactggaagaggataaagaccatcctacaacttctaccctgacctcatccaaccggaacgacgtaactggagggaggcgagaccccaatcatagcgagggtagtacaaccctgctcgagggatatacttcccactatcctcacacaaaggagtccaggacattcattcccgtcacatcggctaaaaccgggagttttggcgtgacagcagtgacagttggagattccaactccaacgttaatcgatccctctctggagatcaggacacctttcatcctagcggcggctcccacacaacacacggaagcgaatcagacggtcacagccacggtagtcaggagggcggggccaatacaaccagcggccccatccggacacctcagattcccgagtggctgataatactggctagtttgctggctcttgcccttatcctggcggtctgcatcgccgtcaactcacgaaggaggtgcgggcaaaaaaaaaaactcgtgatcaatagcgggaacggcgcggtggaagaccgcaagccctccggcctgaacggggaggcttccaagagccaggaaatggttcatctggtgaacaaagagtctagtgaaacccccgatcagtttatgactgcagacgaaacacgtaatttgcagaacgtagatatgaagatcggcgtttag

SEQ ID NO: 14449 - DNA, 237 bp, Artificial Sequence
  Description of Artificial Sequence: Synthetic coding sequence
atggataaattttggtggcatgcggcctggggcctgtgccttgtccccctctcgcttgcacaaattgatcttaatattacctgcagattcgcgggggtcttccatgtcgagaaaaacggtcgatactctatatccaggactgaggctgctgacttatgtaaagctttcaactctaccctgcctacgatggctcagatggaaaaggctttgtccattggtttcgagacatgccggtag

SEQ ID NO: 14450 - DNA, 885 bp, Artificial Sequence
  Description of Artificial Sequence: Synthetic coding sequence
taggacaaattttggtggcacgcggcctggggactatgtctcgtcccgctcagtctagcccagatcgatttgaacattacctgccgctttgccggagtcttccatgtggagaaaaacggacgctattctatatccaggacagaggctgcagacctgtgtaaggcattcaactctaccctccccaccatggctcagatggaaaaagctctctctattggctttgaaacctgtcgttatggcttcatcgaaggacatgtcgttattccgaggatccatccaaactcaatttgtgccgccaataatacaggcgtttacattctgactagcaatacgagccagtacgatacctactgtttcaacgcatcggcgcccccagaagaagactgcacatccgtgaccgatctgcctaacgcattcgatggccccatcactatcactattgtgaatcgggatggaacacgatacgtacagaagggtgaatacaggacaaatcccgaggacatttacccatccaatcccacagatgacgacgtatcttctggctcctccagcgaacgtagctctacaagtggcggctacattttctacaccttctctaccgtgcatccaattcctgacgaggacagcccatggattactgacagcaccgatcggattcctgcaacacgagatcaggacacatttcacccttctgggggcagccacacaactcacggctcagaatccgatgggcatagccatgggtcccaagagggtggggcaaacacaactagcggacccattcgcacgccacagataccagagtggcttattattcttgcctcactcctggctctcgccctgatcctagcggtgtgtattgctgtgaacagtaggcggtcttag

SEQ ID NO: 14451 - DNA, 918 bp, Artificial Sequence
  Description of Artificial Sequence: Synthetic coding sequence
atgtggccattggtcgcggccctcctgcttggaagcgcctgttgcgggtccgctcagttactttttaacaaaactaaatccgtggaatttaccttttgtaacgatactgtcgtgatcccttgcttcgtgaccaacatggaagcccagaacacaacagaggtctacgtcaagtggaagtttaaaggcagagatatttacacattcgacggcgcgctcaacaagagtactgtgccaactgatttctcctctgctaagatagaagtgtcccagctattgaaaggggacgcctccctgaaaatggataagagcgacgcagtaagccacactggaaactatacctgcgaagtgacagaactcactcgtgaaggggaaacgataatcgagttgaagtatcgcgtggtgagctggttctcgccaaacgagaatatcttgatcgtgatctttccaatctttgcgatcttgctgttctggggccaattcgggatcaagacactaaaataccggtctggaggaatggacgagaagacaatcgctttattagttgctgggttggttatcacagtcatcgtgattgtgggtgcaattctgtttgtgcctggagaatactcactcaagaacgccacaggccttggcctgatcgtgacaagcactggcatactgatactgcttcattattacgtgtttagtaccgcaattggattgacaagttttgtaatcgccatcctcgttattcaggtgatcgcctacattcttgcggtagtaggactgagcttgtgcattgcagcttgtatccccatgcatggaccgctgcttatttcagggctatccattctagcgctggcccagctgcttgggctcgtttatatgaagtttgttgctagtaatcaaaagactatccagcctccccggaacaattag

SEQ ID NO: 14452 - DNA, 972 bp, Artificial Sequence
  Description of Artificial Sequence: Synthetic coding sequence
atgtggccgcttgtagcggcgctgcttttgggaagcgcttgctgcgggagcgcacaactgttattcaacaagacaaaaagcgtggagtttactttctgcaacgacacagttgtgattccctgctttgtgacgaacatggaggcccagaataccacggaggtctacgttaagtggaagttcaaaggtagagatatttatacattcgacggcgccctcaacaaatctacagtgccaaccgatttctcctccgcgaaaattgaagtatcacaattactaaagggcgatgcaagtctgaaaatggataaatccgacgcggtgtctcacacggggaattatacatgcgaggttacggagctgacgcgggaaggagagactatcattgaattaaagtatcgggtagtctcatggttctcaccgaacgagaatatactgatcgtgattttcccaatcttcgccatacttttgttttggggccagtttggaatcaagactcttaaatataggtctggcgggatggacgagaagaccattgcccttctggtggcgggcttggtgatcacagtcatcgtaattgtaggggcaatccttttcgttcctggcgaatactccttgaaaaacgctaccggccttggactgatagtcaccagcactggtatactgattctgctacactattatgtcttttccacagccatcggtttaactagctttgttatcgctatcctggttatccaggtcatcgcttacatccttgccgtcgttggcctgtccttgtgtatagctgcatgcatacccatgcatgggcctttgctcatctccggattgtctattctggctctcgcgcagttgctgggactggtttacatgaaattcgtcgcatccaaccagaaaacaatccagccacctaggaaagcggtggaggagcccttgaacgctttcaaggagtccaaggggatgatgaacgatgagtag

SEQ ID NO: 14453 - DNA, 1488 bp, Artificial Sequence
  Description of Artificial Sequence: Synthetic coding sequence
atgccaatgggcagtctgcagccacttgctactctgtaccttctcggaatgctcgtcgctagttgtctaggtcgcctgtcatggtacgatcccgatttccaggcccgcctgacgcggtctaacagcaaatgccagggccaactcgaagtgtatctgaaggatggatggcacatggtatgcagccagagttggggtcggagttctaagcaatgggaagacccgtcacaggcttccaaggtctgccagcggttgaactgcggcgttccgctctctttaggccccttcttagtgacgtacacccctcagtcaagtatcatctgctacgggcagctaggcagtttcagcaattgttctcacagcaggaacgatatgtgtcattctctgggactgacttgccttgagcctcagaaaaccactcctcctactacacgaccccctcctactaccactcccgaaccgaccgccccccctagattgcagcttgtggctcaatcaggcgggcagcattgtgcgggggttgtcgagttctatagcggaagtctcggaggtacaatttcctacgaggcccaggataagacccaggatttggagaatttcttgtgcaataacttacagtgcggaagtttcctgaaacaccttccggagaccgaagccgggagggcccaagacccgggcgaacccagagaacaccagccgcttcccatccagtggaagatacagaattcctcctgcactagcctcgaacactgctttaggaagatcaagccccaaaaatctggaagagtgctagccctactgtgctcaggattccaacccaaagttcagtccagattggtgggcggttcttccatatgcgagggaaccgttgaggtccgacaaggcgcccagtgggctgccctctgtgattcatcctcggcacgctcatctcttcgctgggaggaggtctgccgagaacagcaatgtggatctgtcaactcttatagggtgttggatgctggcgacccaactagccgcggactgttctgtccacaccagaagttatcgcagtgtcacgagttgtgggaacggaactcatactgcaaaaaggtgttcgtgacctgtcaggatcccaatcccgctggactggccgcagggacagtggctagcatcattctggctctggtgctgttggtcgttctgctggtcgtgtgtgggccgctggcgtataaaaaactagttaaaaagttccgacagaaaaagcagaggcagtggatcggccccaccggcatgaaccaaaacatgagcttccatcgaaaccacactgccaccgttcggtctcatgcagaaaaccctacagcatcgcatgttgacaacgaatactcacaacccccgaggaatagtcacctatcggcatacccagcactggagggcgctctgcatcgctcaagtatgcagcctgacaacagttccgacagcgattacgacctgcatggcgcacagagactgtag

SEQ ID NO: 14454 - DNA, 582 bp, Artificial Sequence
  Description of Artificial Sequence: Synthetic coding sequence
atgcccgaggaaggatccgggtgtagcgtgaggcgccggccctatgggtgcgtactgcgcgcggccctggtaccactggtcgccgggctggttatctgccttgtggtgtgcatccagaggttcgcccaagcacagcaacagctcccactggaatctctcgggtgggacgtcgccgaattgcagcttaaccatactggcccacagcaggatcctcggctgtactggcagggaggacctgccctcggcaggagctttctgcacggaccagaactggacaagggacagctcaggatccaccgagacggaatttacatggtccacattcaggtgacccttgcaatctgcagtagtacaacagcctctcggcatcatcccacgactctggcagttggcatctgctccccagctagccgctctattagcctccttcgcctgtcatttcatcagggatgtacaattgccagtcagcggttaacaccactggcccggggcgataccctatgcacgaacctcactggaaccctgttgccctcccgcaacacagacgagactttcttcggcgtgcaatgggtgagaccttag

SEQ ID NO: 14455 - DNA, 627 bp, Artificial Sequence
  Description of Artificial Sequence: Synthetic coding sequence
atgcccgaagaagggtccggatgttctgttagacgccgaccgtacggatgcgtcctccgtgctgccctggtgcccctagtcgctggtctggtgatttgcctggtcgtgtgtattcagcgcttcgctcaggcccagcagcagctgcctctggagtcactcgggtgggatgtagccgagttacaattgaaccacaccggaccccagcaggacccccgattgtattggcagggtgggccggctctcggccggtcttttcttcatggtcctgagcttgataaaggccagctccggatccacagagatggcatctatatggtccacatccaagtcactttagccatctgtagttctacgacggctagccggcatcatccaaccaccctggccgtagggatttgctctcctgcatcccgaagcatttcactgctgcggctgagcttccatcaaggactgtttggcttctggaattggggcctgaaagtcaagtgcttcctgcgccacctcatttggaccgcccactgcttcatacctttgacccagctggtgtttatgcaggcgctgcagtcctggaggaaccaccactgttctcacttcacagacgaagaaaatagaggcgtcaatagatag

SEQ ID NO: 14456 - DNA, 1305 bp, Artificial Sequence
  Description of Artificial Sequence: Synthetic coding sequence
atgagtgccgacggggccgaggccgatggatcaactcaggttacagtcgaagaacccgtgcagcagccatcagtggtagatcgtgtcgcctctatgcctctcataagctctacctgcgacatggtcagtgccgcctatgcctcaaccaaagagagttaccctcacataaaaaccgtgtgcgacgctgccgagaaaggtgtaagaaccttgactgcagcggctgtttccggggcccagccgatactgagcaagctggaaccgcagattgctagtgcctcggagtatgctcacagaggcctggacaaacttgaggaaaacctgccaatattgcaacagcccacagagaaggtccttgcagataccaaagagttggtctcctctaaagtctccggagcccaagaaatggtgagttctgcaaaggacactgtggccacccagctgagtgaagctgtcgatgctacacgcggagcagttcagtccggcgtagacaagaccaaaagtgtggtaaccgggggggtgcagagcgtgatgggatccagactgggccagatggttctaagcggagtcgatactgtgctaggcaagtctgaggagtgggctgacaatcacctgccactcaccgatgctgaactggccaggatcgccactagcctggatggcttcgacgttgctagcgtgcagcagcagcgtcaggagcagtcatactttgtgcgacttgggtccctctctgaaagactccggcagcacgcctacgaacactctctgggcaagctgagggcgacaaagcagcgtgcccaagaagcgcttttgcaactgagccaggtcctaagcctgatggagactgtaaagcagggagtcgatcagaaattggtggagggtcaggagaaactgcaccaaatgtggctaagctggaaccagaagcagcttcagggacctgagaaggagccccccaagccagaacaggttgagtccagggcactcaccatgttccgcgatatcgcccagcaactgcaggctacgtgcaccagcctcggaagtagcattcagggcctgcctacgaacgttaaggatcaagtgcagcaggcaagacgacaggtcgaggatctacaagccactttcagttcgattcacagtttccaggaccttagctcaagcattctcgctcaatctagggaacgggttgcgtcagcccgggaggcccttgaccatatggtggaatacgtagctcagaacacacccgtgacctggctggtggggccttttgcccctgggattaccgagaaggctcccgaggagaaaaaatag

SEQ ID NO: 14457 - DNA, 567 bp, Artificial Sequence
  Description of Artificial Sequence: Synthetic coding sequence
atgcccggcggccccggagtgttgcaagctctgcccgcaactatatttttgctgtttcttctgtcggcggtctaccttggaccaggttgccaggcactgtggatgcataaggttcctgcatccctgatggtctccttgggggaagatgcccattttcaatgcccccacaatagttcaaacaacgcaaatgtgacttggtggagagtactgcacggaaactacacatggcctcccgagttcttgggtccaggagaggacccaaacgagcccccgccacggcccttcctggacatgggagaaggtaccaagaacagaatcatcacggccgaaggtataattttactgttctgtgccgttgtccctggcacactgctgctttttagaaagcggtggcagaatgagaagttggggctggacgccggcgacgaatatgaggatgagaatctctatgagggtctcaacctggacgattgttcgatgtacgaagacatctcccgcggattgcaggggacgtaccaggacgtgggctctcttaatataggcgatgtgcaactcgagaagccctag

SEQ ID NO: 14458 - DNA, 867 bp, Artificial Sequence
  Description of Artificial Sequence: Synthetic coding sequence
atgggtcacacgcggaggcagggcactagtccatcaaaatgcccctatctgaatttcttccagctgttggtcctggccggcctctcacacttttgcagcggcgtgatccatgtcaccaaggaagtcaaggaagtcgcaaccctgtcttgcgggcataatgttagcgtggaggagctggcccagactcgaatttactggcaaaaagagaagaagatggttctcacaatgatgtcaggcgatatgaacatttggcccgaatacaaaaaccggacgatctttgacattaccaacaatctttccattgtcatattagctctgaggcccagcgacgaagggacatacgagtgcgtcgtgcttaaatatgagaaggatgcatttaaaagggagcaccttgcagaagtgacgctcagtgtcaaggcagactttccgacccccagcatcagtgatttcgaaattccaacatccaatatacgtagaatcatttgttcgacgtccggaggctttcccgagccacatctctcctggctggaaaacggcgaggagcttaatgccatcaacaccacagtgtcacaggatcctgaaaccgagctttacgccgttagctctaagctggatttcaatatgaccacaaaccacagttttatgtgtttaattaagtacgggcacctgagagtgaatcagaccttcaattggaataccaccaagcaagagcacttccctgataacttgctcccgtcctgggcaattactctcatttcagtgaacggcatatttgtcatctgttgtcttacctactgtttcgcaccgaggtgcagagaacgcagaaggaacgaaagactccggcgggaaagcgtcagacctgtttag

SEQ ID NO: 14459 - DNA, 489 bp, Artificial Sequence
  Description of Artificial Sequence: Synthetic coding sequence
atgggacatactcgtcgacaagggacatccccatcaaagtgcccttaccttaacttttttcagttgctggtcctcgccgggctgagccatttttgttcaggtgttatccacgttacgaaagaagtgaaagaagtggctactctgtcatgtgggcataacgtttccgtggaagaactggcccagacccggatctactggcaaaaggaaaaaaagatggtgcttaccatgatgagcggggatatgaacatctggccagaatataaaaatcgaactatctttgatataaccaacaatctgtctatcgtgattctggcattacggcctagtgacgagggtacatacgaatgcgtagtgctgaaatacgagaaggacgctttcaaacgggaacatttggccgaagtcactctgtccgttaaaggattcgctcctcgatgtcgggagaggcggagaaatgaacgccttcggagagagagcgtgaggcctgtctag

SEQ ID NO: 14460 - DNA, 771 bp, Artificial Sequence
  Description of Artificial Sequence: Synthetic coding sequence
atggggcacacaaggagacaggggactagtccgagcaagtgtccttatctgaatttcttccagctgctggtgctggccggcctcagtcacttttgtagcggggtgatccatgtcactaaagaggtgaaggaggtagccacgctttcttgtggacacaacgtgtctgtggaagagctagcccagacccggatttactggcaaaaagagaagaagatggtgctgacaatgatgtcaggggacatgaacatttggccagaatacaagaacagaaccatatttgacatcaccaataacctaagcattgtgatccttgccctgagaccatcagacgagggcacatacgaatgcgtggtcttaaagtacgagaaggacgcatttaagagagaacatctggctgaggtgaccctgtccgtgaaggcagatttcccaaccccttccatctccgactttgagattccaacaagtaacatcaggcggattatctgtagtacaagcggaggatttcccgaaccccatttaagctggcttgagaacggagaggaactgaatgccatcaatacgacagtgtcccaggatccagagacagagctgtatgctgtatctagcaagttggatttcaacatgactactaaccacagttttatgtgcctgataaagtatggccacctaagagtgaatcagacatttaactggaatacctctttcgcccctcggtgcagggaaagacggaggaatgagaggcttcgccgcgaaagcgtcaggccagtctag

SEQ ID NO: 14461 - DNA, 867 bp, Artificial Sequence
  Description of Artificial Sequence: Synthetic coding sequence
atgggccacacccgccgacaaggcacaagcccaagcaaatgtccttacctcaattttttccagctacttgttctcgcaggactctcgcacttctgctctggggtgattcatgtgactaaagaggtcaaagaagttgcaaccctgtcatgtggccacaacgtgtctgtggaagaactggcacagacccgaatttattggcagaaggagaagaaaatggttctcacaatgatgagtggggacatgaacatctggcctgagtacaagaacaggactatctttgacatcacaaacaacctttcaatcgtcatactggctctcagaccatccgacgaggggacatatgaatgcgtggtgctgaaatatgaaaaagatgcctttaaacgtgaacaccttgcagaagtgaccctctctgtgaaagccgactttcccacacccagcatcagcgattttgaaatcccaaccagcaacatccgccgcattatatgtagtacaagcggtggattccccgaaccacacctgtcttggctggaaaatggagaggaactcaacgccatcaacacgactgtgtctcaggaccccgagacggagctttacgcggtgagctccaaactggattttaatatgacaacaaaccactccttcatgtgcctcatcaagtatggtcatctgcgggtgaatcagacattcaattggaacaccaccaaacaagagcactttccggacaatctactcccgtcctgggctataactctgattagcgtgaatggtattttcgtgatttgttgtctaacctactgttttgcgccaaggtgtcgtgaaagacgccgcaatgaacggctgagaagggaatccgtgcggcccgtctag

SEQ ID NO: 14462 - DNA, 456 bp, Artificial Sequence
  Description of Artificial Sequence: Synthetic coding sequence
atgtctataccattctcaaatacacactacaggattccacagggcttcggcaatcttctggaaggactgaccagggagattctccgggaacagcctgacaatattcccgcgtttgcggcagcctacttcgagagcctcctcgaaaaacgcgaaaagacgaattttgatccggcagaatggggctcaaaggtcgaggatcgcttttacaataaccacgccttcgaggaacaggagccaccggagaaaagtgaccctaagcaagaggaaagccagatttccggaaaagaagaggaaacatctgtaacaattctcgactcatcagaggaagataaagagaaggaggaggtcgcagcggtgaagattcaggctgctttccgcgggcatatagcccgagaggaagctaagaaaatgaagactaatagcctccaaaacgaggaaaaggaagaaaacaaatag

SEQ ID NO: 14463 - DNA, 729 bp, Artificial Sequence
  Description of Artificial Sequence: Synthetic coding sequence
atgggaagtgcatgtatcaaagttacaaagtatttcctgtttttatttaatctgatcttctttatcctgggcgcagtgatcctggggtttggggtctggatcttagcggataagagctccttcatttcagtcctgcagacaagttcaagctcccttaggatgggcgcctatgtctttatcggggtcggagcagtgacaatgctcatggggttcctgggctgcatcggagctgtaaatgaggtgcgatgcctccttggcctgctgaaacaggaaatgggaggaatagtcactgagctgatacgagattacaactccagccgagaagactccctgcaggacgcctgggactacgtccaggcgcaagtcaaatgctgtgggtgggtttcgttctacaattggacagacaacgcagagcttatgaacaggcctgaggtaacgtacccttgcagctgtgaggtgaagggagaagaagacaactctctgtccgtgcgcaagggcttttgcgaggcccctggaaaccgtacccagagtggaaaccatccagaagactggcccgtgtatcaggagggatgtatggagaaagttcaagcttggctccaagagaacctggggatcatcctgggggtgggcgtcggggtcgcaatcattgaactcctagggatggttttgtcaatttgcctatgccgccacgtgcattcagaagactactcgaaagtgcctaagtactag

SEQ ID NO: 14464 - DNA, 207 bp, Artificial Sequence
  Description of Artificial Sequence: Synthetic coding sequence
atgggctctgcttgcatcaaggtgacaaagtatttcctgttcttgtttaatctcatatttttcattctgggcgccgtgatactgggcttcggagtatggatcctggccgataagtcatccttcatttccgttctccagacgtcttccagttctctcaggatgggcgcctatgttttcatcggtgttggggccgtcaccatgctctag

SEQ ID NO: 14465 - DNA, 117 bp, Artificial Sequence
  Description of Artificial Sequence: Synthetic coding sequence
atgggcagtgcctgcataaaagttacaaagtatttcctttttctctttaatctcatctttttcattcttggggcagttatcctcggattcggagtgtggattttagccgacaagtag

SEQ ID NO: 14466 - DNA, 318 bp, Artificial Sequence
  Description of Artificial Sequence: Synthetic coding sequence
atggggtccgcatgcatcaaagtcacaaaatactttctgtttctctttaatctgattttttttatcctgggagccgtcatcctgggctttggggtgtggattctggcagacaagtcttcttttattagtgtcctgcaaacaagctcttccagtttgcggatgggtgcatacgtattcattggcgtcggggcagtcaccatgctcatgggatttctggggtgcattggagctgttaatgaggttaggtgtctgttggggctctactttgcctttttgctgctgatcctgattgcccaggtcaccgccggtgctctctag

SEQ ID NO: 14467 - DNA, 327 bp, Artificial Sequence
  Description of Artificial Sequence: Synthetic coding sequence
atgggctccgcatgtatcaaggtgactaagtattttctgttcctgttcaacttgatatttttcatccttggtgcggttattctggggttcggggtgtggatcctggccgacaaatcgagtttcataagcgtcctccagacgagttccagcagtctacgaatgggagcgtatgtgttcatcggggtcggtgcagtcacaatgctgatgggcttcctgggttgtatcggtgccgtcaacgaggtgcgatgcttgctcggattgtactttgccttccttttgctgattctgatcgcccaggtgacggctggcgcccttttctacttctag

SEQ ID NO: 14468 - DNA, 708 bp, Artificial Sequence
  Description of Artificial Sequence: Synthetic coding sequence
atggccctgcctgtcactgcactgctcctaccccttgcccttcttttacatgcagctagaccttcccagttccgcgtgtcccccttggaccgcacctggaatctcggagagacggtcgagctgaagtgccaggtgctcctgagtaacccaacgtcaggatgttcatggctttttcagccccgtggcgccgccgcctccccaaccttcctgctgtacctgagccagaataaacctaaggccgcagagggcctggacacacagagattcagcgggaagcgcttaggtgatacttttgtccttacactctctgatttcagacgcgagaatgagggatactacttctgtagcgcactgtccaacagcatcatgtacttctcgcatttcgttccagtgttcttgcctgctaaacccacaacaactcccgctcctcgccctccaactcccgccccaactatcgcatcacagcccctgagcctcagacccgaagcgtgtcgcccagctgccggcggcgctgtgcatacaagggggcttgactttgcttgcgacatttacatttgggctcctctggccggcacctgtggggtgctcctgcttagcctggtgattacactctattgtaatcataggaatcgccgtcgtgtatgcaaatgcccgagacctgtcgtgaaaagtggagacaagcctagcctgagcgccaggtatgtctag

SEQ ID NO: 14469 - DNA, 597 bp, Artificial Sequence
  Description of Artificial Sequence: Synthetic coding sequence
atggctttgccagttacagccctgttgctgcctctggcactactgctccatgccgcgagaccatcccaattccgggttagtccccttgaccggacctggaatctcggtgagaccgtggagctgaaatgtcaggtactgctgagcaacccaaccagtggctgttcatggctattccagccccgcggggccgcagcctctccgacttttctgctatacctttcccagaataaacccaaagccgccgaaggcctcgacacacagcgttttagtggcaaacgtctgggcgacacattcgttttgacactgtccgatttccgaagagaaaatgagggatattacttctgcagcgcactcagtaactccatcatgtacttctcacacttcgtgcctgtgttcctcccggctaagcctaccacaacacctgcccctcgccccccgacaccggcccccacaatcgcttcccaacctctgtccctccggcctgaggcttgcaggcccgctgccggcggcgcaggtaacaggaggcgcgtgtgcaagtgtccgaggcccgtggtcaaatccggagacaaaccaagtctgtctgctcggtacgtctag

SEQ ID NO: 14470 - DNA, 708 bp, Artificial Sequence
  Description of Artificial Sequence: Synthetic coding sequence
atggcgttgccagtcactgccctgttgctgccattggctctactgcttcacgcagcccgaccgtcacagttccgagtctccccccttgaccgtacatggaatctcggagagaccgttgagctgaagtgtcaggtgcttttaagcaatcccaccagtggttgtagttggctattccagcctaggggggccgctgcttccccgacgtttcttttatacctctctcaaaacaaacctaaagccgcagaagggttagatacacagagatttagtggaaagaggctgggtgataccttcgtcctgacactgagtgacttcaggcgtgagaatgaaggttattacttctgctctgctcttagcaattccattatgtactttagccacttcgtgccagtcttcctccccgcaaaacctacaaccaccccagcccctagacccccaacccccgcaccgaccatagccagccagcctctgtctttgagaccagaagcatgccgcccagccgctgggggggccgtgcacacaaggggactcgacttcgcttgtgatatctatatttgggcacccctggcagggacctgtggagtgctgctgctgtctctcgtgattaccctctactgcaaccataggaaccggaggcgagtgtgtaagtgtccacgccccgtagtgaagtcaggcgataagccctctcttagcgctcgctatgtctag

SEQ ID NO: 14471 - DNA, 597 bp, Artificial Sequence
  Description of Artificial Sequence: Synthetic coding sequence
atggccctccctgtaaccgcactgctactgcctcttgccctcctcctgcacgccgctaggccctcacaatttagagtttctccgttagacaggacctggaatctgggggagacagtggagctaaaatgccaggtgctcctgtctaacccaactagtggctgctcatggttattccagccacgaggtgcagctgcctcccccacctttctgctctatctgagtcaaaacaagccaaaggcggccgaaggtctggatacacagaggttttccggtaaacggttaggcgatacctttgttcttaccttgagcgacttcagaagagagaatgaaggatattacttctgctccgcattgtccaactcaatcatgtacttttcccattttgttccggtcttcctgcccgtgcacacacgcgggctggacttcgcctgcgacatctacatctgggctcctctagctgggacctgtggagtcctgcttttgtcccttgttattaccctttactgcaaccaccgcaatcggaggagggtttgcaaatgtccgcggccagtggtgaagtcaggagacaaacccagccttagcgcacggtacgtctag

SEQ ID NO: 14472 - DNA, 663 bp, Artificial Sequence
  Description of Artificial Sequence: Synthetic coding sequence
atggcactgcccgtgaccgctttgctgcttccattggcactacttttacatgccgcccgccccagtcagtttagagtgtcccctttagatagaacttggaatctcggtgaaactgtggagttaaagtgtcaggtgctactctccaaccctactagtggttgctcctggttgttccagccacgcggcgccgcagcctctcccacctttctcctgtacctgagccaaaacaaaccaaaagcggcagagggcctggacactctgagcgatttccgcagagaaaacgaaggatactacttttgttctgcacttagtaattcgatcatgtatttttcacactttgtccctgtgtttcttcccgcaaagccaaccacgactccagctccccgcccgccaacccctgccccaacaatagccagtcagcccttgtccctgcgaccagaggcctgcagacctgctgctggcggggcagtgcacacaaggggactggacttcgcttgtgatatttacatctgggcgccactcgcaggtacatgtggtgtcctgctgctttccctggtgataaccctgtactgcaatcatcggaacaggaggagagtgtgcaagtgccctagaccagtggtgaagtcaggagacaagccctccctgagcgcccgatacgtctag

SEQ ID NO: 14473 - DNA, 597 bp, Artificial Sequence
  Description of Artificial Sequence: Synthetic coding sequence
atggccctgcctgtcaccgcactcctgctgccattggccctactgctccatgcagcccggccctcacagtttcgcgtgagccccctggaccggacgtggaatctaggcgagactgtggagctgaagtgtcaggtgctgttgtccaatcccacaagcgggtgctcgtggctcttccagccgcgtggagccgccgcttccccaactttcctgctgtacctgtcgcagaataaacctaaggccgcagaggggctggatactcaaaggttctccgggaaacggctcggcgatacattcgtactgaccctgagtgattttcgccgcgagaacgagggatattacttctgtagcgccctttccaactcaattatgtacttctcccattttgttccggtgtttctccccgcaaaacccactactacacccgcccccagaccccctacccccgccccaactattgcttctcagcctctgagtctgcgaccagaagcttgtaggccagcggctggcggcgccgggaacagaaggagggtgtgtaaatgccctagaccggtagtcaagtctggagacaaaccctccctcagcgccaggtacgtttag

SEQ ID NO: 14474 - DNA, 831 bp, Artificial Sequence
  Description of Artificial Sequence: Synthetic coding sequence
atgcgaaatcaggcccctggcagacctaagggagccacattcccccccaggcgcccaacaggcagtagggctcccccgctggctcctgagctgagggccaagcaacggcccggagagagggtcatggccctccctgtaactgccctgctgcttccactcgcacttcttctccacgccgcacgtccgagccagttcagagtctcgcctctggatcgcacatggaacctcggcgaaacggtggaactgaaatgccaggtgctgctcagtaaccctacgagcggttgctcttggctctttcaaccccggggtgctgcagcttcccccacatttttgctttatctttcccagaataaaccgaaggcagcggaagggttggacactcaacggtttagcggaaaacgcctcggggacacgttcgtgctcacactatccgattttcgcagggagaatgagggctactacttttgctcggccctgagtaacagtattatgtacttctctcacttcgttccagtttttctgcccgctaagcctactactactcccgcacctcgcccccctacaccggcacccacaatagccagtcagccactctcactgcgcccggaggcgtgccgccctgcagccggaggagctgttcatacccgggggctggatttcgcgtgcgacatatacatctgggcccccttggcagggacctgtggcgttcttctcttgtcactggtcatcaccctatactgcaatcaccgcaaccggcggcgggtttgtaagtgtccaaggcctgttgtcaagtctggcgacaaaccctcgctttccgcacgctatgtctag

SEQ ID NO: 14475 - DNA, 240 bp, Artificial Sequence
  Description of Artificial Sequence: Synthetic coding sequence
atgtcccacaaacagatatactactccgacaagtatgacgatgaggaatttgaataccgtcatgtcatgttgcctaaagatattgccaagctagtgccaaagactcacctcatgtccgaatcagagtggcgtaacctcggagtccagcagtcccaaggatgggttcactatatgattcacgagcctgagccccacatcctgcttttcaggagacctctccccaagaagcccaaaaagtag

SEQ ID NO: 14476 - DNA, 204 bp, Artificial Sequence
  Description of Artificial Sequence: Synthetic coding sequence
atgtcacacaagcaaatctattactcagacaagtatgatgatgaggaattcgagtacaggcacgtaatgctccctaaggacattgccaaattagtgccaaaaacacacctaatgtccgagagcgagtggagaaatctgggagtacagcagtcacagggctgggtgcactatatgatccacgagcctggtcagtgtacgggctag

SEQ ID NO: 14477 - DNA, 192 bp, Artificial Sequence
  Description of Artificial Sequence: Synthetic coding sequence
atgaggacgcgccacgtcatgctgcccaaagacatagccaaactcgtgcccaaaacccacctgatgtctgagtctgagtggagaaacctgggtgtccagcagtcgcagggatgggtgcactatatgattcacgaacccgaaccccacattttgttgttccggaggcctcttcctaagaaacctaagaagtag

SEQ ID NO: 14478 - DNA, 240 bp, Artificial Sequence
  Description of Artificial Sequence: Synthetic coding sequence
atggcacacaagcagatctactactcagataagtacttcgatgagcattacgagtatcgacatgtaatgcttccgcgggagctatccaagcaggtccccaaaacccaccttatgtccgaagaagagtggcggcgtctgggggtgcagcagtcactcggttgggtgcattacatgatacacgaacctgagccccacatcctgctcttccggcgtccgctccctaaggaccagcaaaagtag

SEQ ID NO: 14479 - DNA, 1533 bp, Artificial Sequence
  Description of Artificial Sequence: Synthetic coding sequence
atgcatcctcttcaatgtgtgctgcaggtccagcgctccctgggatggggcccgctagcatcagtttcctggctgtccctgcgaatgtgccgcgcgcattcaagcctgtcttccaccatgtgcccctctcccgagcgccaggaggatggcgcccgcaaggatttctcctccagactggcagccggtccaacatttcaacactttctgaaatctgcttcggcaccccaggagaagctgagttccgaagtcgaggatcctcccccttatctgatgatggatgagctgctcggccgtcaaaggaaggtttatctcgagacatacggatgtcagatgaacgttaacgatacagaaatcgcttggagtatcctacagaagagtgggtatctgaggacgtccaatctccaggaggccgatgtgatcctgctcgtgacctgttccatcagagagaaggccgaacagaccatttggaatcggctgcaccagctgaaggctctgaaaacccgcaggcctagaagcagagtgcctttgaggattggcattctaggttgtatggcagaacggctgaaagaggagatcctcaatcgagaaaaaatggtcgacatactcgcaggacccgatgcttaccgcgacctcccacggctcctggcggtcgcagagtctgggcagcaggcggcaaacgtgctcttaagtctggacgagacttacgccgatgttatgcccgtccagacatctgcatctgcaacaagtgcgttcgtgagtatcatgcgggggtgcgataatatgtgctcctattgcattgttccttttaccagggggcgtgagcggagtaggcccatcgccagtatcttggaagaagtgaagaaacttagtgagcaggtgctccagctgatacacgagcgcgacaacatttgcaagcagatccatcttccagcacagagcggttccagtcgtgtgttagaagccatgaggcgcggttattctagggaggcttatgtggagctggtgcaccatatcagggaaagtatccccggagtgtccttgtcttcggattttattgcgggattctgtggggagactgaggaggatcacgtgcagacagtgtctttgcttcgagaggttcagtataacatgggttttctattcgcctacagcatgcgtcagaaaacgagggcgtaccacaggctcaaggacgacgtcccagaggaagtgaaattgaggagactggaggaactgatcacaatctttcgggaagaagccacaaaagccaatcaaacatcagtgggatgcacacaactggtcctcgtagagggactgagcaagaggtccgccaccgacctgtgcggccgaaacgatgggaacctgaaggtgattttccccgacgccgagatggaagacgtcaacaaccctgggttgagggtgagagcccaacccggagactacgtgctcgttaaaatcacgagcgcatcgtcacaaacactgagagggcacgtgctgtgtcggacaactctcagagacagcagcgcctattgctag

SEQ ID NO: 14480 - DNA, 1764 bp, Artificial Sequence
  Description of Artificial Sequence: Synthetic coding sequence
atgcacccactgcagtgcgtgctacaggtgcagaggagcctaggctggggacccttagccagcgttagctggctctctctgaggatgtgtcgcgcccactcttctctttcctcgactatgtgcccaagccctgagcgccaggaggatggtgctagaaaggacttttcctcccgcctcgccgcagggccgacttttcagcacttcctgaagtccgccagtgccccccaggaaaagttgtccagcgaggtagaagacccacccccatacctgatgatggacgaactgctgggcaggcaacggaaggtctatctggaaacttatgggtgccaaatgaatgttaatgacaccgaaatcgcctggtccatcctgcaaaagtccggttacctgaggacctctaacctgcaagaggctgatgttatcctcttagtgacatgcagtatccgtgaaaaggctgaacaaaccatatggaaccgacttcaccagctgaaggcattgaaaacacgccgacccagaagcagagtgccactccgaatagggatcctcgggtgcatggcggagaggttaaaggaagagatcctcaatcgggaaaagatggtggatatccttgcaggcccagacgcataccgggatctcccaaggctgttggctgtggctgagagtggacagcaagctgccaacgtcctcttatccctcgatgaaacatacgcggacgtgatgccagtccaaacctctgcttccgccaccagcgccttcgtgtctatcatgcgtggctgcgacaatatgtgtagctactgcatagtaccatttactagaggacgagagcgctcaaggcccatcgcaagcatacttgaggaagtcaaaaagctcagtgagcagggcctgaaggaagtcaccctgttggggcagaacgtgaatagctttagggataacagcgaagtccagtttaactctgctgtcccgactaacctgagcagaggattcacgaccaactataaaactaagcaaggtgggctacgttttgctcacttgcttgaccaagtcagtagagtggaccccgagatgcgcattagatttacgtcaccccacccaaaggactttccagacgaagtgctgcaacttatccacgaacgggacaacatttgtaagcagatccacctccccgcccagtcaggcagcagccgcgtcttggaggcaatgcgtagagggtatagtcgtgaggcctacgtagagctagtgcatcatattcgtgagtcaatcccgggcgtgtcattgagtagtgatttcatagccggattctgcggagagaccgaggaagatcacgtccagacagtgagcttgcttagggaagtgcaatataacatgggatttctcttcgcatattcaatgcggcaaaagacaagggcctaccataggctcaaggatgatgtacctgaagaggtcaagctcaggaggctcgaggagttaatcaccatcttcagggaggaggctacaaaagcaaaccagaccagcgtaggctgtactcaattagtgttagtcgaaggattatctaagagatctgccactgacttgtgtggacggaatgacgggaaccttaaagtaatattccctgacgctgagatggaggacgtgaataatcccggactccgggttcgagcccaaccgggggattacgtcctggtcaaaatcaccagcgccagctctcaaaccctgaggggccatgtgctttgtcggacaaccctgcgggactcctctgcctactgctag

SEQ ID NO: 14481 - DNA, 1806 bp, Artificial Sequence
  Description of Artificial Sequence: Synthetic coding sequence
atgcatccactgcagtgcgtgctgcaagtgcagcgaagcttaggttggggacctttagcttccgtcagttggctgagtcttagaatgtgccgggcccatagcagcctcagctcaactatgtgcccttcgcctgaacggcaggaggatggggcccggaaggacttttcatcaaggctggccgcaggccccaccttccagcattttctgaaatctgcgtctgcacctcaggagaagctaagtagcgaagtcgaagacccccctccatacctcatgatggacgagctcctgggccgtcagcgaaaggtttatctggaaacctacggatgtcagatgaacgtaaatgacaccgaaatcgcatggagcattttgcagaaaagcgggtacttgagaaccagcaacctgcaggaagctgacgtcatccttttggtaacatgttccattagagaaaaggccgagcaaaccatatggaatcggctgcaccagcttaaagccctgaagaccaggcgacctcggtcaagggttccgctgcggatcggcatcctggggtgcatggccgagagattaaaagaggaaatcctgaaccgtgaaaaaatggtggatatcctggcaggtcctgatgcgtatcgcgatctgcccagacttctggctgtggcagagtccggccagcaagctgcgaatgtacttctctccctggatgagacgtatgccgatgtaatgccagtgcagacgtccgcatcagcaacatccgccttcgtgtcaatcatgcgggggtgcgataacatgtgttcctactgtattgttccctttacccgtggaagagaaagatctcgtcctattgcgagcattctagaggaggtcaagaagctgagcgagcaggtgtttctcccccctcggcccccaaaagtcttgggcctccaaggcctcaaagaggtcaccctccttggccagaacgttaactcttttcgtgataatagcgaggtgcagttcaactcagcagtacctaccaatctttcccgtggcttcaccaccaattataaaaccaagcagggggggctgcgatttgcccacctcctggaccaggtaagcagggtcgacccagagatgaggatcaggtttacatcacctcatccgaaagattttcctgatgaagtgctgcagctgattcacgaaagagacaacatctgtaaacagatacatcttccagcccagtcggggtctagccgtgtgttagaagccatgcgccggggctacagtagagaagcatatgttgaacttgttcaccatatccgtgagtccatcccaggagtttcactgagctctgattttatagccggtttctgtggagagaccgaggaagaccacgtgcagacggtctcacttcttcgagaggtgcagtacaacatgggcttcctcttcgcgtacagcatgagacaaaagaccagggcttatcatcggctgaaggacgatgtgccagaggaggtgaaattgaggagactagaggagctgatcacaatcttccgggaggaagccacaaaagccaatcagacgtccgttgggtgtacccagctcgtgcttgtggaaggactgagtaagcgatcagctactgatctctgcggtcggaatgatgggaacttgaaggtgatcttccccgacgctgaaatggaggacgtcaacaatcctggcctgagggtgcgggcgcaacctggggactatgtactcgtgaagattacctccgccagctctcagacccttagggggcacgttttgtgtcgaactaccctgcgcgattcttccgcctattgttag

SEQ ID NO: 14482 - DNA, 984 bp, Artificial Sequence
  Description of Artificial Sequence: Synthetic coding sequence
atgaacgtgaacgacacagaaatagcatggtcaatcctacagaagtcgggctatttaaggacctcgaacttgcaagaggccgacgttattttactggtgacctgttcaattcgggaaaaagctgagcagaccatttggaatagattacatcagctgaaggcacttaaaaccagaaggcctaggtccagggtgccactgcggataggaatactgggttgtatggctgaacgtctgaaggaggagattctaaaccgagaaaaaatggtggatatccttgccgggccggatgcttaccgagatttgccgagactgctcgctgtggcagaatctggacagcaggccgcgaatgtgctgcttagtttagatgagacttatgccgatgttatgcctgtgcaaacctcagcaagcgcgacatcagcatttgtgtatagccgggaagcttacgtcgaactcgtacaccacattcgggaatcaatccccggcgtgagccttagttcagacttcatcgcagggttctgtggagaaactgaggaggaccacgttcaaacggtgtccttacttcgggaagtgcaatataacatgggattcctgttcgcctatagcatgaggcagaagacacgggcctaccaccggttgaaagacgacgtgcctgaggaggttaaacttcggcgcttggaggaactcatcacaatttttagggaagaggctacaaaagccaatcagacttccgtcggctgtacgcagcttgttcttgtagagggcctctcaaaacgctctgccaccgacctctgtggaagaaatgacggcaacttaaaggtgattttcccagacgcggaaatggaggatgtcaataaccccggtttacgtgtcagggctcagccgggagactatgtactagtgaaaatcactagtgcatcttcacagacactgagggggcacgtgctctgtcggaccacactgcgggactctagtgcttactgctag

SEQ ID NO: 14483 - DNA, 1494 bp, Artificial Sequence
  Description of Artificial Sequence: Synthetic coding sequence
atgatggatgagctgctgggccggcagcgcaaagtttacttggaaacgtacggctgccagatgaacgttaacgataccgaaattgcctggtcgatattacagaaatcagggtacttacgcacctcaaaccttcaggaggctgatgttattctgctagtgacgtgtagcattagagaaaaggctgaacagaccatctggaaccgcctgcaccaactcaaagccctgaagactagaagaccgcgaagccgggtgcccttacggatcgggatcctaggttgcatggcggaaagactgaaggaagagattctgaaccgtgagaagatggtggatatcctcgccggcccagatgcctaccgcgaccttccacgtctgctggctgtggccgaaagcggtcaacaggctgctaacgtgctgttgtctctggacgaaacctatgccgacgttatgcccgttcagacaagtgcctctgccacctctgcatttgtttccataatgcgaggctgcgataatatgtgctcatactgtattgtgccattcactaggggccgggaaaggagccggccaatcgcatctatcctggaggaggtcaaaaagctgagcgagcagggattgaaagaggttacactcttggggcagaacgtcaactccttccgcgacaacagtgaggttcaattcaattccgctgtgcctacaaacttatccagaggcttcactactaactataagactaaacaaggtgggctccgctttgctcatcttctggaccaggtaagcagagtggacccagagatgaggataagatttacaagcccgcaccctaaagacttcccagacgaggtgctgcaactcatacatgagcgggacaatatctgcaaacagattcatctgcccgcgcagtcaggaagcagtcgggttctcgaggccatgcgacggggttatagccgggaagcttacgtcgagcttgtccatcacatacgggagtctatccctggggtgagtcttagttcagatttcatcgccggcttctgcggcgagactgaggaggatcacgtgcagaccgtgtcactgctgcgcgaagtccagtacaacatgggattcctcttcgcctactcaatgagacagaaaaccagagcatatcatcgtctcaaggacgatgtgcctgaggaggtgaaactgagacggctggaggaattaatcactatctttcgggaggaggcgacgaaggccaaccagacttccgtgggatgcacacaactagtgctggtggaaggtctgagcaagaggtctgctaccgacctgtgcggtcgcaatgacgggaacctgaaagtgatcttccccgatgccgaaatggaggatgtgaacaatcctggccttagagtgcgcgcccaaccaggcgactatgtgctggtgaagattaccagcgcaagctctcagaccctcagagggcacgttctctgtaggacaacactgcgtgactccagcgcttattgctag

SEQ ID NO: 14484 - DNA, 1281 bp, Artificial Sequence
  Description of Artificial Sequence: Synthetic coding sequence
atgcacccactacagtgtgttctgcaagtgcagcggtctcttggctggggccctttagccagcgtgagctggctcagcttgcgcatgtgcagggcccactcaagcctgtcgtcgacaatgtgtccatcccccgagcgccaggaggatggtgcaaggaaggatttttcatctcgtttggctgctggccctactttccaacactttttaaaatccgcctctgccccccaggagaaactgagtagtgaagtggaggacccccctccatacctgatgatggatgagttactcgggagacagagaaaggtttatctggaaacatatgggtgtcagatgaacgtgaacgataccgagatcgcctggtccatcctgcagaagagtgggtacctgagaacatcaaatctacaggaagccgatgtgattctgctggtcacatgttctattagagagaaggcagagcagactatctggaatcgcctccaccaactgaaggcactgaagaccaggagacctcgctcaagggtgcccctcaggatcggcattctgggctgtatggccgaacgcctgaaagaagaaatcctgaatagagagaagatggtagacatccttgctgggcccgacgcctatagagacttgcctagactgttggcagttgctgaatctggacagcaagccgcaaatgtgttgcttagtctggatgagacatacgccgatgtcatgccggtccaaacttccgcctcagccacatcagctttcgtcagcatcatgcggggttgcgacaatatgtgttcatattgcatcgttccatttacccgcgggcgggagaggagtcggccaattgctagtatactcgaagaagtgaagaagttgagtgagcagggcctgaaggaggtcactctattgggccaaaatgtgaattccttcagggacaattctgaagtgcagtttaattcagcggtgccgacaaacttgtctaggggctttacgactaattacaaaaccaaacagggcggacttagattcgcacacctgctggaccaggtcagccgggtggatcccgaaatgcggattcggttcactagcccgcacccaaaggattttcccgacgaggtgctgcaactgatccatgagcgggataatatttgtaaacagatccatctgcccgcccagagcggatcgagccgcgtactggaggccatgaggcgtggatattcgcgagaggcctatgttgagttagttcaccacatcagagaatcaattcctgaggacactggtatatcttag

SEQ ID NO: 14485 - DNA, 1122 bp, Artificial Sequence
  Description of Artificial Sequence: Synthetic coding sequence
ggtgatggacagaatctcttcaccaaggatgtgacagtgatcgagggcgaggtggctactatatcctgtcaagtcaacaagagcgatgacagcgtgatccaattactgaaccccaaccgtcagacaatctattttcgggattttcggcctttgaaggactccaggtttcaactactcaatttttcttcatcagaactgaaagtgagtctcacaaatgtgtccattagcgacgaggggcgctatttttgccagctatataccgatccaccacaggagtcttatacgaccattaccgttctagtgccgcccaggaacctcatgatcgatattcagaaagacacagccgttgagggagaagagatagaggtgaactgtaccgccatggcctctaagccggccacgacaatcaggtggtttaagggtaacaccgaactgaaaggcaagagcgaagttgaagagtggtcagacatgtacacagtgacctctcagcttatgctgaaggtgcataaggaggacgatggtgtaccagtgatttgccaggttgaacacccagcagtcacgggcaacctgcagactcagaggtacctcgaagtgcagtacaaaccccaggtccatatccaaatgacataccctctgcagggattaactcgtgaaggcgatgcactggagctaacatgcgaggccattggaaaaccccagccggtaatggtgacttgggtgagagtagacgacgagatgccacagcatgcagtcctgagtggtcctaatctgttcatcaacaacctcaataaaacggataatggaacgtacagatgcgaggctagcaacatcgttggaaaagcacatagtgattatatgctatatgtctacgatagccgggccggcgaggaaggctcaatccgggccgtagaccacgcggtgataggcggcgtagtggctgtggtagtgtttgccatgctctgcctcctcatcattcttggccggtacttcgcaagacataagggcacatattttacccacgaagctaagggagccgatgatgccgcagatgcagacacagctataatcaatgcggaaggcgggcagaacaacagcgaggaaaagaaagagtattttatttag

SEQ ID NO: 14486 - DNA, 1329 bp, Artificial Sequence
  Description of Artificial Sequence: Synthetic coding sequence
atggcaagcgtcgtgttaccgtccggctcccagtgcgccgccgccgccgcggcagcagctccaccggggctgcggctcagattattgctcctcctgtttagcgctgcagcgctaatcccaaccggagacggacagaatctgttcactaaagacgttaccgtcatcgaaggtgaggtagccaccataagctgccaggtcaacaagtctgacgatagcgttattcaactcctgaaccccaaccgccagacaatttactttcgggactttcgcccactgaaggactctcgattccagctcttgaacttttcatcgtcagagttgaaagtgagcttaaccaatgtcagcattagcgacgaaggccggtacttctgccagttgtatactgatcccccccaagaatcctacaccacaatcactgtgttggtgcccccgcggaaccttatgatagatatccagaaagacacagccgtggaaggggaagagatcgaagtgaactgtaccgccatggcatccaagcccgccacaacaatccggtggtttaaggggaacacagagctgaaagggaagagcgaggtggaagaatggagtgacatgtacacagtgacttcccagcttatgctgaaggtgcataaggaagacgatggggtccccgttatttgccaagtagaacaccccgccgtgaccggcaatttacagacgcagaggtatctggaggtacagtataagcctcaggtgcatatccaaatgacctaccctctgcaaggccttacacgagagggcgatgctctagagctaacttgcgaggcaatcggcaaaccacagcccgtgatggtaacgtgggttcgggtggatgacgaaatgccccaacacgcagttctctctggccctaatctgtttatcaacaatttaaacaagactgacaatgggacttaccgttgcgaggctagtaacatcgtgggtaaagctcattcagactatatgctgtatgtgtatgaccccccaacgacgattccccctcctaccaccactacaacgactaccaccactacaactactacaatactgacaataatcacggattcgagggccggagaggagggctcaatcagagccgtcgatcacgctgtgatcggtggggtcgtggcagttgtcgttttcgcgatgctgtgtctcctcatcatcctcggaagatattttgcacgccacaagggcacatattttactcatgaagcgaagggggcagacgacgcagcggacgcggacactgcaattattaatgccgagggagggcagaataactcggaggaaaagaaggaatattttatttag

SEQ ID NO: 14487 - DNA, 384 bp, Artificial Sequence
  Description of Artificial Sequence: Synthetic coding sequence
atgttatacgtgtacgatcccccaacaactattcccccccccacaaccacgactacaactactacgaccacaaccacgactattctgactatcatcactgatacaaccgccacaacagaacctgccgtgcatgatagcagagccggcgaggagggcagtatccgagcagtcgaccacgccgtgattggaggtgtcgtagcagtggtagtgttcgctatgctgtgcttattaataattctggggcgctatttcgcaagacacaaagggacctactttacccacgaggccaagggcgcagacgacgccgcggatgccgatactgccatcatcaacgcagagggaggccagaacaactctgaggagaagaaggagtactttatctag

SEQ ID NO: 14488 - DNA, 1245 bp, Artificial Sequence
  Description of Artificial Sequence: Synthetic coding sequence
atggcttctgtggttcttccaagcgggagccagtgtgccgccgctgccgctgcggctgcaccccccggccttcgtttaagactgcttctgctgcttttcagtgccgccgctcttattcccactggggacgggcaaaacctgttcacaaaggatgtgaccgtgattgaaggcgaggtagctaccatcagctgccaggttaataagtctgatgattcagtaattcagttgctgaaccccaatcgccaaaccatctattttcgagactttagacccttaaaggattcacgcttccaactgctaaactttagcagcagcgagcttaaggtcagccttactaatgtaagcatttcagatgagggacgatatttttgtcaactgtacacagatccgccacaggagtcctacacgactataaccgtccttgttccccctaggaacttgatgatcgacatccagaaggacacagcagtagaaggggaggagatcgaagtcaactgcacagcaatggcttcgaaacctgcaaccacaatcagatggttcaaaggaaacaccgaactgaaaggcaagagtgaggtcgaagagtggtctgatatgtatactgtaacgagccagctgatgctgaaagtccacaaggaagatgatggcgtgcccgtcatatgccaagtggagcatcccgcagtgaccggcaatctgcagacgcagcggtatttggaggtgcagtacaagcctcaggttcacattcagatgacttatccgctgcagggcctgacccgagagggtgacgctctggagctgacgtgtgaggcaatcggcaagccccaacctgttatggtgacttgggtgcgggtagacgatgaaatgccacagcacgcagttctctcaggtcctaacttgtttatcaataacctcaataagaccgacaacggtacatataggtgtgaagcaagcaatatagtgggcaaggcccacagcgattacatgctctacgtatacgacagtagagccggggaagagggcagtatcagggccgtcgaccacgccgttataggcggagtcgtggccgttgtagtattcgccatgctctgcttactcataatcttgggacgctacttcgccagacataaagggacatactttactcacgaagcaaaaggagctgacgacgcagccgatgccgataccgccatcatcaatgctgagggtggacagaataattcagaggaaaaaaaagaatatttcatttag

SEQ ID NO: 14489 - DNA, 5346 bp, Artificial Sequence
  Description of Artificial Sequence: Synthetic coding sequence
atgaccacctatcgcgcaatcccatcggatggggtcgatctggctgcatcttgtggagctcgggttggggacgttttacccggacctcacacaggcgactacgcacccctgggattttgggcccagaacggctctatgtctcagcccttgggcgaaagcccagccaccgccacagcaactgcaactgccaccaccaggccgtctcccacgactcctgcaatgccgaagatgggcgtgcgggcgagagtggccgattggccgccaaagagagaggccctgcgtgagcactctaatccttcgccaagtcaggatactgacggtacgaaagctacgaaaatggcccactcaatgaggtctatccagaatggacagccccccaccagcacacctgccagtagcggatccaaagcattccatagattgagcaggaggcgatccaaggacgtcgagtttcaggacggctggccaaggtcacctggtagggcctttctgcctctgcggcatagaagtagttccgagataacactgtctgagtgcgacgcggaggacgctggggagccacgcggagctaggcacacaggggccctacccttattcagggagtacgggtcaacgtcttccatcgacgtgcagggaatgcccgaacagtcattttttgacatcctaaacgagttccgtagcgagcaacctgacgcgcgtggttgtcaggctctaaccgaactgctgcgggccgatcctggcccacacctgatggggggagggggcggcgcaaaaggagattcccacaacgggcaacctgccaaggatagcctcttgccgctgcaacccaccaaggagaaagagaaggccagaaaaaagcctgcacggggcctgggaggcggcgatacggtagacagtagtatcttccggaaattgcgcagttccaaaccggaaggagaggccggccgcagcccgggcgaggcggacgagggcaggagcccacccgaagccagtcgaccctgggtatgtcagaagtcatttgcccactttgacgtccagtccatgctattcgacttgaacgaggccgctgccaatcgagtgtcagtgtcacagaggaggaacaccaccacaggcgcctccgccgcaagcgccgcgtcagcaatggcgagtctgaccgctagtagggcccactctctggggggcttagatccagcctttacaagtaccgaagatctcaactgtaaggaaaatttggaacaagatctgggggatgataactccaacgatctgttattatcctgtccacatttccgaaatgagattgggggcgagtgcgaaaggaacgtgtctttttctagagcttctgtgggcagtccatcatctggggagggacacctggccgagccagcactgagcgcctaccgtaccaatgcatcgatcagcgtgctggaggtaccaaaggaacagcaacggacccaaagccgtcccagacagtatagcatagaacatgttgacctgggcgcgcggtactaccaagattactttgtcggcaaggagcacgcaaactattttggtgttgacgaaaagttaggacccgtcgcggttagtattaaacgggaaaaactggaggatcacaaggagcatggcccccaatatcagtacagaatcatatttcggacccgggagttaataaccctgagaggaagcatactcgaggacgccactcccactgccaccaaacacggcacaggtcgcggactcccactcaaagacgctctcgaatacgtaatccccgaactgaatatccattgcctccgactggccctcaacacccccaaagtcaccgagcagcttttaaagttagatgagcagggactgtgtcgaaaacacaaggtggggattctgtactgcaaagctgggcagagttccgaggaagagatgtataacaatgaggaagcgggacctgcatttgaggaattcctctcactgattggcgagaaggtctgcctgaaaggtttcacaaaatacgctgctcaactggatgtgaagacagactctaccggaacacattcactgtatactatgtaccaggattatgagatcatgtttcatgtgtccaccctgctgccctatactcctaacaaccgtcaacagctgctccgcaaacgtcacatcggcaatgatatagtcaccatcatcttccaggagccaggggcgctgccctttaccccaaagaacatcagatcccattttcagcatgtcttcattatcgtccgcgtgcataacccatgcacagataatgtctgctactccatggctgtcaccaggtcgaaagacgcccccccattcggacctcccatcccctctgggacaactttccggaagtctgacgtttttagagattttctgttggccaaggtgataaatgcggaaaatgcggcccataagtccgacaaatttcacacaatggccacacgcactcggcaagaatacctgaaagacttagccgaaaattgtgtctccaatactcccatcgactccactggtaaatttaatctgatctcactgaccagcaaaaaaaaggaaaaaacaaaggcacgagcaggggcggagcagcactccgcgggcgcaattgcctggcgagtcgttgcccaggactacgcccagggagtggagatcgactgtatactaggtatttctaatgagttcgtggtgctgctcgacctccgtaccaaggaagtcgtgttcaactgttattgtggtgacgtgatcggttggactccagattcttccacactgaaaattttttatggccgcggggaccacattttcttgcaggcaaccgagggcagcgtggaagatatccgcgaaattgtccagcggctcaaggtgatgaccagcggctgggaaactgtcgatatgaccctgagaaggaatggtctcggacaactgggcttccacgttaagtacgacggcactgttgctgaggttgaggattatggttttgcctggcaggctggccttcggcagggcagccggcttgtcgagatctgcaaggtggccgtggttaccctgacacacgatcagatgatcgacctgctcaggactagtgtgacagtgaaagtagttattatacccccattcgaggatgggacccctcgccgcggctggccagagacatacgacatgaatacaagcgaacccaaaactgagcaggaatctatcactcccggaggacgacccccctacaggtctaatgccccgtggcagtggtcaggccccgcaagccataatagcctgcctgcttcaaaatgggccacccctacaacaccgggacacgcgcagagtctcagccgcccactcaagcagacacccattgtgcccttccgtgagtcccagccactacactccaagcgccccgtgtccttcccagaaactccatacaccgtgtctcctgcaggggctgatagggtccccccctatagacaacccagcggaagtttctctaccccaggtagcgccacctacgtgcggtacaaaccctctcccgagcgctacacagccgcgccccatcccctgctgagtctggaccctcacttctcccatgatggtacttcaagtggtgactcatcctccggcggactgacgagccaagaatcaactatggagcgacagaaacctgaaccactgtggcacgtgcccgcgcaagcccgcctcagcgccattgccggctcttcggggaataaacatccatccagacaggacgcggctggcaaggacagccctaataggcactctaagggagagcctcagtactctagccactcttcttcgaataccttatcatctaacgcctccagctcccattcagacgatcgatggttcgaccctctcgatccactggaacctgagcaggatcccctctcaaaaggcggctcgagcgactcaggaattgacactaccctgtacacttcttcaccctcatgtatgtccctggctaaagccccaagacccgccaagccacacaaaccccctgggagcatggggctttgtggaggaggtagagaagcggcagggcgaagtcatcacgctgacaggcgacgggaagttagtcccgccccagccgttgccggccaatctaagggctatcgccccaagctttatagtagcgggagtagtactccaactggtcttgcaggcggcagcagagatcctcctaggcaaccctctgacatgggatctcgtgtgggctatccggctcaggtgtataaaaccgcttctgccgagacaccccgcccaagtcagttggcccagccatctccatttcagctttccgcttccgtgccaaagtcatttttctcaaaacaaccagtgcggaataaacacccaacaggatggaaacggacggaggaaccgcctcctcggccactgcccttcagtgatccgaagaaacaggtcgacactaatacaaaaaatgtttttggtcagcccagactcagagcttcacttagggatctgcggtccccaaggaaaaactataagtctacgattgaagacgacctgaagaagctgatcattatggataaccttgggcctgaacaagagcgggataccgggcaaagtcctcaaaagggcctgcagagaaccttgtctgacgagagcttgtgttccggcaggagagagccctctttcgcatctccggcaggtctcgagcccggccttccatcagacgtgctgttcacatcaacatgcgcgttcccaagctcgactctgcccgcgagacgccaacatcagcatccccacccgcccgtagggccaggcgctaccccagccgccggcagtggatttccagagaagaagagcaccatctctgctagcgagctctcactggcggacggtcgggacaggccactgaggcgcttagaccccgggcttatgcccctgcccgacaccgccgcagggctggagtggtcctccctggtgaatgcagcgaaggcatacgaagttcagcgcgctgtttccctgttttcactcaacgacccggccctctccccagatatacccccagcccattctcctgtgcactctcatctgtcgcttgagcgcggtcctcctacccccaggactaccccaaccatgagcgaagagccccccctggacctgaccgggaaggtgtaccagttggaagtcatgctaaagcaactgcataccgatctgcagaaggagaagcaggataaggtggttctacaaagcgaagtggctagccttcgtcagaataaccagcggctgcaggaggagtctcaagccgcatccgagcagcttcgaaagtttgccgagatcttctgtagagagaaaaaagaactgtag

SEQ ID NO: 14490 - DNA, 660 bp, Artificial Sequence
  Description of Artificial Sequence: Synthetic coding sequence
atggaagcggcaagagactatgccggagccttgattaggccacttactttcatgggatctcagacgaaacgcgtactgtttacgccactgatgcacccagcccgaccgtttcgggtgtctaatcatgaccgatcaagtcgccgcggcgtgatggcgtcttcacttcaggagctcatctcaaaaacgctcgatgcgctggttattgctacaggcctggtgaccctagtattagaggaggacgggaccgtggtcgacaccgaagagttttttcagactctgggggataatacgcacttcatgattctggagaagggacagaaatggatgcctggctcccagcatgtgcctacatgttcaccaccgaagcgatccgggattgctcgtgtcaccttcgacctctataggctgaatccaaaggattttattggttgcctgaatgtcaaagcaactatgtatgagatgtattcagtgtcctatgatatcaggtgcaccggcctcaagggtctgctgagaagcttactgagatttctctcttacagtgcccaagtgactggccagtttctgatatacctgggcacatatatgctacgcgtcctggacgataaggaggaacgaccaagtctgaggagccaggctaagggccgcttcacttgcggatag

SEQ ID NO: 14491 - DNA, 660 bp, Artificial Sequence
  Description of Artificial Sequence: Synthetic coding sequence
atggagtatctctccgcccttaatcccagtgacctgttaagaagtgtgagcaacatcagttccgagttcggcaggagggtgtggacttctgccccccccccccagcggccctttcgagtctgtgaccacaagcggaccattcgcaaaggactcacagctgccacacggcaggaattgctggcaaaagctttggagactctgctgctcaacggagtgctgacgctggtgttagaggaggatggaacagcggtggactctgaggattttttccagctcctcgaggacgacacgtgcctgatggttctccagagcggtcagagttggtctcccacacgctccggtgttctcagctacggacttggacgcgagaggccaaaacatagtaaagacatcgccagatttacattcgatgtgtacaagcagaacccccgtgacctgttcggctcactgaatgttaaagcgactttttacggactctacagcatgagttgcgatttccagggccttggtcctaagaaggttctccgcgagctcctgcgttggaccagcactctactgcagggcctaggccacatgctgctcggcatctcaagcaccctgaggcatgctgtggaaggcgcggaacaatggcagcaaaagggacgcctgcattcgtattag

SEQ ID NO: 14492 - DNA, 660 bp, Artificial Sequence
  Description of Artificial Sequence: Synthetic coding sequence
atggaatacctttctgcgctaaatccttctgatcttctccggtcagtttccaacatttctagcgagttcgggaggcgcgtgtggaccagtgcgcccccgccacaaaggcccttccgtgtgtgtgatcacaaaaggactattcgaaaaggcctcaccgcagctacacgccaggaattactagctaaagccttggagacattgctcctcaatggggttctcactctcgtgctcgaagaggatgggactgccgtcgatagtgaggacttttttcaactgcttgaggacgatacttgcttgatggtacttcagtccggtcagagctggagtccaaccaggtccggagttttgtcctacggcctggggcgcgagcggcccaagcactcgaaggatatcgcaaggtttaccttcgatgtttataaacaaaatccccgggatctctttgggagcctaaatgttaaggctactttctatggactttacagcatgagctgcgactttcaagggctgggccccaagaaggtattgagggaattactccggtggacttcaacgttgttgcaggggctgggccatatgctgttaggaatttcgtccaccctgagacatgcagtggagggtgctgagcagtggcagcagaagggtcggcttcatagttactag

SEQ ID NO: 14493 - DNA, 660 bp, Artificial Sequence
  Description of Artificial Sequence: Synthetic coding sequence
atggaatacctgagcgctctgaatccgtccgatttgctccggtctgtctctaatatctcttcagagttcggccgacgtgtctggacttctgctcccccaccacagaggccttttagagtctgcgatcacaagcggaccatccgaaaagggctaacagcagccacaaggcaggagctgctggctaaggctctagagacacttctgctgaatggagttctcaccttggtgcttgaggaagatggaacagcagtcgacagcgaagacttctttcagttgctagaggatgacacctgtctcatggttctgcagtccgggcagtcctggagccccacaagatccggagttctgtcatacggactgggccgtgaacggcccaaacattctaaggacatcgccaggttcacatttgacgtgtacaagcagaatcccagggatctctttggatctctaaacgtcaaggccacgttttacggactgtactcgatgagttgtgacttccaaggtctcggcccgaagaaggtattgcgcgagctcctgaggtggacatccactcttttgcagggacttggacatatgctactggggataagctctacgctcagacatgccgtggaaggagcggagcagtggcagcaaaaaggccgacttcacagttattag

SEQ ID NO: 14494 - DNA, 660 bp, Artificial Sequence
  Description of Artificial Sequence: Synthetic coding sequence
atggagtatctgtctgcactgaacccctctgatctgctgaggtcggtctccaacattagctcagaatttggcaggcgggtctggacgtccgctcccccgccccaaagaccatttagagtgtgtgaccataagagaacaattcggaaaggcctaaccgcggcaacccgccaggagctgctcgctaaagccctggaaacactactcttaaatggcgtgttaaccctggtgttagaggaggacggaaccgcagttgacagcgaggacttcttccaactactggaagatgatacctgcctgatggtcctgcagtcaggccagtcatggtctcccactaggagcggcgtcctgagctatggtttgggtcgagagcgtccaaagcattctaaggacatcgccagatttacttttgacgtctacaaacagaatcctagggacctgtttggttccctaaatgtgaaagctaccttttacggcctgtacagcatgagttgcgacttccaggggctggggcctaaaaaagtattgcgggagttgttgaggtggacctctaccctgttacagggcctcggtcacatgttgcttggcatttcctccactctccggcacgccgttgaaggagcagagcagtggcagcagaagggcagactacacagttactag

SEQ ID NO: 14495 - DNA, 1860 bp, Artificial Sequence
  Description of Artificial Sequence: Synthetic coding sequence
atgaacctggagaggttaaggaaacgtgtgcgacagtatttagatcagcaacaataccaatcggccctgttctgggccgacaaggtcgcctctctcagtcgcgaaccacaggacatctactggctggcacagtgcttgtacctgacagcgcagtatcaccgtgccgcccacgctcttcgatcccgtaagctggacaaattgtacgaagcctgtagatacctcgcagctaggtgccattatgccgccaaggaacatcagcaggcgctcgacgtcctggatatggaagagccaattaataaaagactgttcgagaaatacctcaaggacgaaagtggctttaaagatccgtctagtgattgggagatgtctcagtcttctattaagagttctatttgcttattgaggggtaagatctacgatgctctagacaatcgcaccctcgcaacttattcctacaaagaggctctgaaacttgacgtctattgctttgaggcattcgacttgctgactagccaccacatgttgacagctcaggaagagaaagagttgttggaatcacttccgctgtctaaactctgcaacgaggagcaggagctgttgcgcttcctgttcgagaacaaactaaagaagtataataagccaagcgagacagtgatccctgagagcgtggatgggttgcaagagaatcttgacgtcgtcgtgtcactggccgaacgccactactacaactgtgacttcaaaatgtgttacaagctgacgagcgtcgtgatggaaaaggatccattccatgcaagctgcttacccgtccatattggtacattagtagagttgaataaagccaacgaactgttctatctgtcccataaactggtggacctgtatcctagcaatcctgtcagttggttcgctgtgggatgctactacctcatggtggggcacaagaacgaacacgcccgaaggtacctgtccaaggcaactaccctggagaaaacctatgggcccgcctggatcgcgtatggacactcatttgctgtcgagagcgaacacgaccaggcgatggctgcttattttacggctgcacagctgatgaagggctgtcatctcccaatgctgtacataggcttggaatacggactgacaaataattctaagctggctgaaagattctttagccaggctctcagtattgccccagaagatccattcgtgatgcacgaggtgggcgtagttgctttccagaacggtgaatggaaaactgccgagaagtggtttctagacgcactcgagaaaatcaaagctattggtaacgaggtcactgtcgacaaatgggagcccttgctgaacaaccttgggcatgtgtgtagaaaactcaaaaagtatgcagaggccttggattatcacagacaagctctggtgttgattccacagaatgcctccacatacagtgctattggctacatccactcactcatgggcaacttcgagaacgcggtggattattttcacaccgcgctgggcctccgtcgcgatgacacattctccgtgactatgctcggtcactgcattgagatgtatattggagactcggaggcttacattggagcagacataaaagacaagctgaaatgctatgattttgatgtgcatactatgaaaaccttgaagaacatcatctcgcccccttgggattttcgcgagttcgaggtggagaaacagaccgcagaggagaccggtttgactcccttggagactagcaggaagacccccgattccagaccgtctctggaggagacattcgagatagaaatgaacgagagtgacatgatgttagaaacttccatgtccgatcactctacatag

SEQ ID NO: 14496 - DNA, 1428 bp, Artificial Sequence
  Description of Artificial Sequence: Synthetic coding sequence
atggaggagcctatcaacaagaggctgttcgaaaaatacctaaaagacgagtcaggttttaaggatccctcatctgattgggagatgtcgcagtcctccatcaagtcttctatctgcctcttgaggggcaaaatctacgatgcgctcgataaccggaccctggccacctattcatacaaagaggccctgaagctggatgtgtactgctttgaggcctttgacctgcttaccagccaccatatgttaacagcacaggaagagaaagagctgctggagtctctgcccctgtccaaactgtgtaacgaggaacaagagctcctgcgcttcctgtttgagaataaattaaagaaatataacaagccatcagagaccgtcatccccgagtctgtggatggactgcaggagaatcttgacgttgttgtgagcctggccgagcgtcactattacaactgcgacttcaagatgtgctataaattaacgtccgtcgtgatggaaaaggatcccttccatgcgtcatgtttacctgtgcacatcgggactctcgtagagctaaacaaggccaatgagttattttacctatcccataagctggtggatctgtatcccagtaacccagtgtcatggtttgcggtaggatgttactatctgatggtcggacacaagaacgagcacgcaagaaggtacctgtccaaggcgaccactcttgagaagacctatgggcctgcctggattgcctatggacattcctttgccgtcgagtccgagcatgatcaggccatggcagcatattttacggccgctcagctgatgaagggctggaagacagcagagaaatggtttctggacgcccttgagaagattaaggcaatcgggaatgaggttactgtggataagtgggagcctctattgaataacctcgggcatgtgtgcaggaagttgaagaaatacgccgaagccctggattatcatcggcaggctctggtgctcattccccaaaatgcctcgacctactctgccatcggctatattcactcactgatggggaacttcgagaacgcagttgattattttcacaccgctttggggttgagacgtgacgacactttttcggtgacgatgctgggccactgcatcgagatgtacattggtgactctgaggcctatatcggagcagacatcaaggataagctcaaatgctatgatttcgatgtacacacgatgaagacactcaaaaatattatttctcccccctgggacttccgcgagtttgaggtggagaagcagactgctgaggaaacaggccttacccctttagaaacttcaagaaaaacacccgactcacggccgtctctggaagaaacctttgaaatcgaaatgaacgagtctgacatgatgcttgagacctccatgagtgaccactccacgtag

SEQ ID NO: 14497 - DNA, 1863 bp, Artificial Sequence
  Description of Artificial Sequence: Synthetic coding sequence
atgaatttggagaggctgcgcaagcgcgttcgccagtatctagaccagcagcagtaccaatcagctcttttctgggctgataaggtagccagcctgtctcgggaggagcctcaagatatctactggcttgctcagtgcctttatttgaccgcccagtatcatagagctgcgcatgctctgagatctagaaagctggacaagctctacgaagcctgtcgctatctggcagcccggtgtcattatgcagccaaagagcatcagcaggctctggatgttctggatatggaggaacccatcaataaacggctgttcgaaaaatatctcaaagatgagtccggctttaaggacccatcttcagattgggaaatgagtcagtcctctattaaatctagtatttgtttactacgcggcaagatttatgatgcgttagataacaggactttggccacttacagctacaaggaggcattgaagctcgatgtctactgctttgaagccttcgatctgctgacctcgcatcacatgttgaccgcccaggaggagaaagaattactggagagcttaccgctctctaagttgtgcaatgaagaacaggagctgttgcgtttcttatttgaaaacaagctgaagaaatataataagccctcggagacggttatcccagaatctgtcgacggcctacaggaaaatttggatgttgtggtttctctggccgaacggcactactacaattgtgatttcaagatgtgctacaaattgaccagcgtggtgatggagaaggacccattccacgcaagctgcctaccagtgcatatcggcacccttgtagaacttaacaaagcaaatgaactgttctatctcagccataaactggtggatctgtaccccagtaatcccgtgagctggttcgctgtgggatgttattacttgatggtgggccacaagaacgaacacgctcggcgctacctttcaaaggccacgaccctagagaagacatatggaccggcgtggatcgcgtatggacacagcttcgccgttgaatctgaacacgaccaggctatggctgcatacttcacggcggctcaactcatgaagggttgtcatctgccaatgctgtacattgggttagagtacggcctcacgaataattctaagctcgcagagagattttttagccaagcactcagcatcgcccctgaggaccctttcgtgatgcatgaagttggcgtggtcgcatttcagaacggcgaatggaaaaccgccgaaaaatggtttttggatgcccttgaaaaaattaaagccatagggaacgaggtgaccgtagacaaatgggagccactgctgaataatctggggcatgtatgcagaaaactgaagaaatacgccgaggccctggattaccacaggcaggccctcgtgcttattcctcaaaacgccagtacgtactccgccattggctatattcattcattgatggggaacttcgagaatgcggttgactattttcacacagcattggggctgcgccgggatgataccttttccgtgaccatgctgggacactgtatagaaatgtatatcggggattcagaggcttatattggagctgatattaaagataagttgaagtgctacgacttcgacgtccacaccatgaagacccttaagaacatcatttctcctccctgggacttcagagagttcgaagtggaaaagcagacggctgaagagactgggctcacacccttggaaacgtctcgcaagacaccagactccagaccctctctggaagaaacttttgagatcgaaatgaacgagtccgacatgatgcttgagacaagtatgtccgatcattctacatag

SEQ ID NO: 14498 - DNA, 1863 bp, Artificial Sequence
  Description of Artificial Sequence: Synthetic coding sequence
atgaatcttgaaagactgcgcaagagggtacgtcagtatctcgatcagcagcagtaccagagcgctctgttttgggcagataaggtggccagcctaagcagggaggaacctcaggatatttattggttggcccagtgtctctatcttacagctcagtatcatagagctgctcatgccctgcgcagccgtaaactggacaagctctatgaggcctgtcgatacttagctgcgcgctgccattacgctgctaaggaacaccaacaggccctggacgtactcgatatggaagagcctatcaacaagaggctgttcgaaaaataccttaaggatgagtccggcttcaaggatccctcatctgactgggagatgtcacaaagctcgatcaaatctagtatttgcttactaagagggaaaatttatgatgccttggacaaccggacactggctacatacagttacaaggaagcattgaaacttgatgtatattgctttgaggcgttcgatctgcttacatcacatcacatgttgaccgcacaggaggagaaagagctcttggagagtttacctctgtccaaactgtgcaacgaggagcaagagctgctgcgattcctgttcgaaaataagctcaagaagtacaacaagcctagtgagacagttatccctgagtcagtggatgggctacaggaaaatcttgacgtggtggtttctctggctgaaaggcactactacaattgcgattttaaaatgtgttacaagctgacgagcgtagttatggagaaagacccatttcatgcgagctgcctccccgtgcatatcggtactctcgtagagctgaacaaggccaatgaactgttctatctgagccacaaattggtcgacttgtacccatctaatcccgtgagttggttcgcggtgggttgttactacttgatggtgggccacaaaaacgagcatgctcgcaggtatctctctaaggcaacaaccttagaaaaaacatacggccccgcctggattgcgtacgggcatagttttgcagtagagagcgagcacgatcaggccatggccgcctattttacagcagcacagctcatgaaggggtgtcatttgcctatgttatacatcggacttgagtatggtctcacaaataactccaagcttgctgagcggtttttcagtcaggctcttagcattgcacctgaagacccctttgtgatgcacgaggtgggggtcgtcgcattccagaatggcgaatggaagactgcagagaagtggttcttggacgcactcgagaagataaaggcgatcggcaacgaggtgactgtggacaaatgggagcctttgcttaacaacctcggccatgtgtgtcgaaaactgaagaaatacgccgaggcgttagattaccaccgtcaagctctggtgttaatcccgcagaatgcatctacatattcggctataggctatattcactccctgatgggcaactttgagaatgccgtcgactactttcacactgccctcggcctgcggcgcgacgacacttttagcgtaaccatgttggggcactgcattgagatgtacatcggcgatagcgaggcctatattggcgctgacattaaggacaagctgaagtgttacgacttcgatgttcataccatgaagaccctgaaaaacatcattagccctccatgggacttccgtgaatttgaagtcgagaagcagacagcggaggagactggcttgacaccattggaaacttcacgaaagacaccggattctagaccgtccctcgaggaaaccttcgaaattgaaatgaacgagtcggatatgatgctggaaacctccatgtctgatcacagcacatag

SEQ ID NO: 14499 - DNA, 1581 bp, Artificial Sequence
  Description of Artificial Sequence: Synthetic coding sequence
atggaagaaccaattaataagaggctgtttgaaaagtatcttaaggacgaatccggcttcaaagatccatcatcagactgggaaatgtctcagtcctctattaaaagtagtatatgtctgctaaggggcaagatctacgacgccctggataatcgcaccctcgcaacctacagttacaaggaggcactgaaactcgatgtttattgttttgaagccttcgatctgctgaccagccatcacatgcttacagcccaggaggagaaggaactactggagagcttgccattatctaagctctgtaacgaggaacaggagctgctccggttcctgtttgaaaataagctgaaaaagtataataaaccttccgagacagtgattccagagtcagtggacggcctccaggagaatcttgatgtggtcgtgagtctcgccgagaggcactactacaattgcgacttcaagatgtgctacaagttaacgtccgtcgtgatggaaaaagacccttttcatgcatcatgcctgccagttcacatagggactttggtggaactaaataaggctaacgagcttttctacctgtcgcacaaactcgtggatttataccctagtaacccggtgtcatggttcgcagtcgggtgctactatctcatggtgggccacaagaacgaacacgcgagacggtatctctccaaggcgacgactctggagaaaacttatggacccgcgtggatcgcttacgggcatagtttcgccgtggagtcagagcacgaccaagctatggctgcatattttacagcagcccagcttatgaagggctgtcacttgcccatgttgtatattggacttgaatacggcctcaccaacaactctaaacttgccgagcgctttttttctcaggccctgagcatcgcccccgaggacccttttgtgatgcacgaggtgggagtggtggctttccaaaacggcgagtggaagacagctgagaaatggtttctggacgcccttgagaaaatcaaggccatcggaaacgaggttactgtcgataagtgggaacccttactcaacaatcttggccacgtttgcagaaagctgaaaaagtatgctgaggctctggactaccacaggcaggcactggtcttgattccccaaaatgctagcacatactccgcaatcggctacattcatagcctaatgggtaattttgagaatgccgtagactacttccataccgccctgggccttcgccgcgacgacaccttcagcgtaaccatgctcggtcactgtatcgagatgtacattggagatagcgaagcgtacattggtgccgacataaaagacaagctgaagtgctatgatttcgatgtgcataccatgaaaaccttgaaaaatattatctcgccaccgtgggactttcgggagtttgaagtggagaaacagaccgccgaggagacaggccttaccccccttgagacctccagaaaaacccccgacagccggccatctttggaggaaacttttgagatcgaaatgaacgaatccgacatgatgcttgaaactagcatgagcgatcattcaacctag

SEQ ID NO: 14500 - DNA, 1581 bp, Artificial Sequence
  Description of Artificial Sequence: Synthetic coding sequence
atggaggagcctatcaataagcggctgtttgagaaatatttgaaggatgagtctggttttaaagatcctagctcggattgggagatgtcacagagctccataaagtcctccatctgcttgttacgggggaaaatttatgatgcgctcgacaatcgaacccttgcaacttactcttacaaagaggccttgaagctcgatgtgtactgtttcgaggcgtttgacctgctcacaagccatcacatgttgaccgcccaagaggagaaggagttacttgaatcactgcctctcagtaaactctgcaacgaagaacaggagctgttgagatttctattcgagaataagcttaaaaaatataacaagccttcagagaccgtaattccagaatccgtcgatggcttacaagagaatttggatgtggtggtcagcttggctgagcggcactactataattgtgacttcaaaatgtgctacaaactgacaagtgttgtaatggagaaggacccattccacgcctcttgtcttcccgttcacattgggacactcgtggagctgaacaaagctaatgagttattctatctgtcccacaaactggtcgatctgtatcccagtaaccccgtttcatggttcgccgtaggatgttattatctgatggtgggtcataagaacgaacatgcccggcggtacctgagtaaggccacaactcttgaaaaaacctatggacctgcttggatcgcctatggacactcatttgccgttgagagcgagcatgatcaggctatggccgcctactttacagctgcacaactcatgaaaggctgtcatttgcctatgctatacattgggctggaatatggactcaccaataacagcaaactggcagagcgcttttttagtcaggcattgtcaatcgccccagaggaccccttcgtgatgcacgaagtaggcgttgtggcctttcagaatggtgagtggaagaccgctgaaaaatggtttctggacgcactagaaaaaatcaaggctatcggaaacgaagtcactgttgacaagtgggagccactgcttaacaacctaggccatgtttgtaggaagctcaaaaaatacgccgaagccctcgattaccaccggcaagccctcgttctgattcctcagaacgctagcacgtacagtgccatcggctatatccactctctgatgggcaattttgagaatgcggtcgattacttccataccgccctggggttacgacgcgacgacacgttttccgttaccatgctgggacattgtatcgagatgtatataggagactccgaagcctatataggagccgatatcaaggacaagctgaagtgttacgacttcgacgtgcatacaatgaagaccttgaagaacatcatttccccaccttgggacttcagggaattcgaggtggaaaagcagactgccgaggagaccggcctgactcccctggagactagtcgcaaaacaccagatagtaggccgtccctcgaggaaaccttcgagatcgagatgaacgagtccgacatgatgttggagacatccatgtctgaccactcaacgtag

SEQ ID NO: 14501 - DNA, 1428 bp, Artificial Sequence
  Description of Artificial Sequence: Synthetic coding sequence
atggaagaacctataaataagaggctgtttgaaaagtatttaaaggatgagtcagggtttaaggacccttctagcgattgggagatgtcccagtccagtataaagagctctatctgcctactgcgaggaaagatctacgacgccctggataaccggaccttggctacgtacagttataaagaagccttgaagctggacgtgtattgctttgaagccttcgacttgttgacatcacaccacatgcttacagcccaagaggaaaaagaattactagaaagtctgcctctgtcaaaactgtgtaatgaggagcaggagctgctgcgcttcctcttcgagaacaaactcaagaagtataacaaaccatccgagacggtgattcctgaatcagttgacggcctccaggagaacctggacgttgtcgtgtctctcgctgaaaggcattactacaactgcgatttcaaaatgtgttataagctcacctcagtggtgatggagaaggaccctttccacgcctcatgtctgcctgtacatatcggcacactggtcgagttaaataaagccaatgaacttttctatctttctcataagttggttgatctgtatcccagcaatcccgtcagctggttcgcggtcgggtgctattatctcatggtaggccacaaaaatgagcacgctagaaggtatctttctaaagctacaactttggaaaaaacttacgggccggcctggatagcttacggacacagcttcgcggttgagtcagaacatgaccaggccatggcagcctattttacagcggcacagttgatgaagggatggaaaaccgctgagaagtggtttctcgatgcgcttgaaaaaataaaggctatcggaaatgaggtcaccgtggacaagtgggagccactgctgaacaacctcggccatgtttgtaggaagctgaaaaaatatgctgaagctcttgactatcaccgacaagctctggtcctcatcccgcagaacgcttccacctattccgctattgggtacatccattccctgatgggtaacttcgaaaatgctgttgattacttccacaccgcccttggccttaggagagacgataccttctccgtcaccatgctcggccactgtattgagatgtatattggagacagcgaggcatatatcggcgccgatatcaaggacaaactcaagtgttacgactttgacgtgcatacaatgaagacgctcaaaaatatcatatctccaccctgggatttccgggaattcgaggtggaaaagcagaccgccgaggaaaccggcctcacaccgctggagacttccaggaaaacaccagacagtaggccaagcctggaagagacctttgagatagagatgaacgaatctgatatgatgcttgagacgtcaatgtcagaccattctacgtag

SEQ ID NO: 14502 - DNA, 1500 bp, Artificial Sequence
  Description of Artificial Sequence: Synthetic coding sequence
atggcccagttcgctttcgaatccgacctccattcgttgctgcaactcgatgcacctattcccaacgccccacccgcgaggtggcaacggaaggccaaggaagcggctgggcccgcaccttcccccatgagggccgccaacaggtctcatagcgccggcagaaccccaggccggactccagggaaatctagtagcaaagtccagactaccccaagtaaaccaggaggggataggtatatccctcacagatctgctgcacagatggaggtggccagttttctgctcagtaaggagaaccaacccgagaactcacaaacacccacaaaaaaagagcatcagaaggcatgggcgctgaatctgaacggatttgatgtagaggaggcgaagattttgcgcctatctggaaagccacaaaatgcccctgagggatatcagaaccgcctgaaggtcttatacagccagaaagccaccccaggtagctctcggaaaacctgtcgatacataccatccctgcccgatcgcatactggacgcccccgagatcagaaacgactattacttaaatctcgttgactggtccagcggcaacgtcctggcagtggctctcgacaactccgtgtacctgtggtctgctagttccggtgacatcctacagttgcttcagatggagcagccaggcgaatatatttccagcgtagcctggatcaaagaaggaaactacctcgccgtcgggacctcaagcgccgaggttcagctgtgggacgtgcaacagcagaaacgcctgaggaacatgacctcacatagcgcacgggtgggctctctttcatggaacagttacattttaagcagcggcagcaggagcgggcacatccatcatcatgatgtccgtgtcgctgaacatcacgtcgccaccctttctgggcactctcaggaagtttgcgggctcaggtgggctcctgatggccgacacttggcaagcggcggcaatgacaacttggtaaacgtatggccatcggcaccaggagaaggcggttgggtcccacttcagactttcactcaacaccagggagctgttaaggcagtcgcatggtgcccatggcagtccaacgtgctggccacaggcggagggacatctgaccggcacattcgtatttggaacgtttgctccggcgcctgtctgtctgctgtggatgcacattctcaggtgtgtagcattctctggagcccccactacaaagaattaatcagcggacacgggtttgctcagaatcaattagtaatctggaaatacccgacaatggcgaaagtcgccgagctcaagggtcatacctcgcgtgtgctgagtctgacaatgagtcctgatggggccaccgtggcatccgccgcggccgatgaaaccctccggctatggagatgttttgaacttgatccagctcggcggcgggagagagaaaaagccagtgctgctaaaagttcactcatacatcagggcattcgctag

SEQ ID NO: 14503 - DNA, 1500 bp, Artificial Sequence
  Description of Artificial Sequence: Synthetic coding sequence
atggctcagtttgcttttgaatctgatctccactcccttctgcagctggatgctcccattccaaatgcacctccagcccggtggcaacgcaaggcgaaggaggccgccggacccgcccctagtccgatgagggccgctaatagaagccacagcgcgggccggacgcccggccggacaccagggaaatcgagttctaaggttcagacaacaccttcaaaacctggcggcgatcgatatatacctcaccgtagcgccgctcaaatggaagttgcctcctttcttctgtcaaaggagaatcagcctgaaaacagccagacccctaccaagaaggagcaccagaaggcttgggccctgaatttgaatggctttgacgtcgaggaagccaagattttaagattgtctgggaagccacagaacgccccggaagggtatcagaataggctaaaagtcctgtattcacagaaagcaacgccaggaagttctcgaaaaacctgtaggtatataccttccttacctgataggatcctggatgctcctgagataaggaacgactattatctaaacttggtagattggagttcaggtaacgttttggcagtggccctcgataattctgtatacctgtggtccgcttccagcggcgatattctccagttactgcagatggagcagcctggggaatatatctcaagtgtcgcatggattaaggaggggaattacttggcggtgggcacaagtagcgccgaggtacaattatgggacgttcagcaacaaaagaggctccgcaatatgacatctcatagcgcccgcgtgggttccctatcctggaatagctacatactttcgtcagggtctaggtctgggcacatccatcatcatgatgttcgtgtcgcggagcaccacgtggccacgctgtccggccacagccaggaagtgtgcggcctgagatgggctcccgacgggcgtcacttggcttctggagggaatgacaatcttgtaaacgtttggccttccgcccccggcgagggagggtgggtccctctgcagacatttacccagcatcaaggtgctgtcaaggctgtggcatggtgtccatggcagtccaatgtcctcgccaccggaggggggactagcgacaggcacatcagaatttggaacgtgtgttcaggggcttgcctgtcagcagtggatgcacactcgcaggtgtgcagtattctttggtctccgcattacaaagaactgatttccggacacggattcgctcagaatcagttggtgatctggaagtaccctactatggccaaggtcgccgaactaaaaggccatacttctcgggtccttagcctgaccatgtctcccgatggcgcaacagttgccagtgcagccgcggacgagaccctgcgactctggcgctgctttgaactggaccctgcgagacggcgagaacgggagaaggcctctgctgcaaaatcctccctaatacaccaagggatacgctag

SEQ ID NO: 14504 - DNA, 1428 bp, Artificial Sequence
  Description of Artificial Sequence: Synthetic coding sequence
atggcccagttcgccttcgaatccgatcttcactctcttctgcagctagacgcgcccattccaaacgctcctccagctcggtggcaaagaaaggccaaagaagccgcagggccagcaccatcccctatgagagcggctaatcgctcccatagcgctggaagaactcccggccgcactcctgggaaatcctctagcaaggttcaaacaacaccctctaaagagaaccagcccgagaactctcagactcctaccaaaaaggagcaccagaaagcatgggccctcaatctgaatggcttcgacgtggaggaggccaagattctccgcctgagcgggaagcctcagaacgctccagagggataccagaaccggttaaaggtgctttactctcaaaaagccaccccaggatcctctcgtaaaacttgccggtatattccaagtttgccagaccgcattctcgacgctcccgagatcaggaacgattactacctcaacctcgttgactggtctagcggaaatgtcctggccgtcgccctcgataacagcgtatatctctggtccgcctcctcaggggatatcttacagttacttcagatggagcagccaggcgaatacatctcctcagtagcatggatcaaggagggtaactatctcgccgtcggaacttcttccgcagaggtccagctctgggacgtgcaacagcaaaagaggcttaggaatatgacctcccattctgcccgcgtcgggagcctgtcctggaacagctatattctctcttccgggagccggagcggccatatacaccaccacgatgtgcgcgtggcagagcatcacgtcgctacgctctccggacactctcaggaggtctgcggtctgcgctgggcacctgatggccgtcacctagcgtcagggggcaacgacaatctggttaatgtttggccatccgctcctggggaaggtggttgggttcctttgcagacctttactcagcaccagggtgctgtgaaggccgtcgcctggtgcccgtggcaatccaatgtgcttgcaacgggaggtggaacttcagacagacacattaggatctggaacgtgtgtagcggtgcatgcctatcagcggtagacgcccactcccaggtgtgcagcatcctgtggtcgccacactacaaggaattgatttcaggacacgggtttgctcagaaccaactagtgatctggaaatacccgacaatggctaaagtggcggaattgaagggacatacctcacgagtgctgtcgctgacaatgtcgcccgacggcgccaccgtggcatcagcggccgcagatgagacattacgcctctggcgctgtttcgaactggatccggcccgccggcgtgagcgggaaaaggcttccgcagcgaagtcctctctgattcaccaaggtatccggtag

SEQ ID NO: 14505 - DNA, 1422 bp, Artificial Sequence
  Description of Artificial Sequence: Synthetic coding sequence
atgagcactgaactgtttagcagtactcgggaggaagggagttccgggagcggacctagtttcaggtcgaatcagcgcaagatgctgaatctcctgctcgaacgcgatacctcatttaccgtttgccctgacgtccctaggacgcccgtggggaagttcctgggcgacagtgcaaatctgagtattctttccgggggtactcctaaacggtgtcttgacctcagtaacctatccagcggggagattactgcgactcagctaacaacctccgctgacctcgacgagaccgggcacctcgactcgtcaggtctgcaggaggtgcatctcgccggaatgaatcatgatcagcatctgatgaagtgttctccagcacagctgctgtgctccactcctaatggattggatcgcggtcaccggaagagggatgctatgtgtagctcttccgccaataaagagaacgataatggaaaccttgttgacagcgaaatgaagtacctgggatctcctatcaccacagtgccaaagttagacaaaaaccctaacctgggcgaggatcaggcagaggagatttccgatgagctgatggagttttccctcaaggaccaggaggccaaggtatcgcggtcaggcctctaccgaagtccatctatgccagagaacctgaatcgtccacggttgaaacaggtagagaagttcaaggataacaccattccagacaaggtcaagaagaaatattttagcggacaagggaaattgagaaaagggctgtgtctgaaaaaaacagtcagtctgtgtgacatcaccatcacacagatgctagaggaagactccaatcaaggacacttgataggcgactttagcaaggtgtgcgcactgccaaccgtgagtgggaaacatcaggatctgaagtatgtgaatcctgagaccgtcgccgccctgctctccggaaagttccagggcctgatcgaaaaattctatgtgattgattgtcgatatccgtacgaatacctgggtgggcacattcagggtgccctgaacctttactcccaggaagagctctttaatttctttttgaagaagccaatcgtgcctttggacacacagaagaggattatcatcgtgttccattgcgagttttcatccgagcgcgggcctagaatgtgtagatgcctgagagaggaggacagaagcctgaaccagtatccagccttgtactacccagagctctacattcttaaggggggctacagagatttcttccccgaatacatggagctgtgtgagcctcagagttactgccccatgcaccatcaagaccataagacagagctgctgcgctgtcggtctcaaagtaaggtccaagagggcgaacgccagctccgggaacagattgccctgttggtaaaagacatgtctccgtag

SEQ ID NO: 14506 - DNA, 1203 bp, Artificial Sequence
  Description of Artificial Sequence: Synthetic coding sequence
atgtccaccgagctgttctcgtcaacgagagaggagggcagctctgggagtggaccttcattccggagtaaccagcgcaaaatgctcaatctgttactggagcgggacacctcgttcacagtatgtcccgacgtgccaagaactcccgtgggtaaattccttggggatagcgccaatctctctattttatctggctcccccggtttctttcgcacttcagggtccgcgtttagctgggatgataacggtaatctagtggattcagaaatgaagtaccttgggtcacccatcaccacagtcccaaagcttgacaagaacccgaatctgggagaagatcaagcggaggaaataagtgatgagcttatggaattctcgctgaaggaccaggaggctaaggtcagccgatctggattatacagatctccaagtatgcccgaaaatctaaatcgacctcgccttaaacaggtggagaagttcaaagataatacaattccggacaaggttaagaaaaagtacttttcaggccagggaaaactgcgcaaaggattgtgcctcaagaaaaccgtgtcactctgcgacatcaccatcacacaaatgttagaggaggactccaaccagggccacctcattggagatttctccaaagtctgtgcccttccaactgtaagcggcaagcatcaggacctgaagtatgtaaatccggagaccgttgcagcactgctttcggggaaattccaaggcctgattgagaagttctatgttatagactgtcggtacccatatgaataccttggtggacacattcaaggagctcttaatctatactcacaggaggagctgtttaattttttccttaagaagcctattgtacccctcgatactcagaagagaatcataatcgtgttccactgcgagttctcctccgaacgaggcccaagaatgtgcaggtgccttcgggaggaagacaggtctctgaatcagtacccagctctgtattaccctgagctttatatcctcaaggggggttatcgcgatttttttcctgaatacatggaactgtgtgaaccgcagagctactgtcctatgcatcatcaggatcacaagaccgaacttctgcgctgtaggagccagtccaaggtgcaggagggagaaagacaactaagagagcagatcgcgttgctggtcaaagatatgtctccttag

SEQ ID NO: 14507 - DNA, 1332 bp, Artificial Sequence
  Description of Artificial Sequence: Synthetic coding sequence
atgtctactgaactcttctcctctacccgggaagaggggtcctctggtagtggtccctctttccggagcaaccagcggaaaatgctcaatctgcttctggagcgggacaccagcttcactgtgtgtcccgacgtgccacggaccccagtcggcaagttccttggcgactctgccaatcttagtatactgtctggcgggactccaaaacgttgtctcgatcttagcaatctgagctccggagagatcactgccacccaattgactacgagtgccgatcttgatgagactgggcacctggactccagtggattgcaggaagtgcacctcgccggcatgaatcatgatcagcatctgatgaagtgcagccctgataatggcaatctggttgattcggagatgaagtatttaggctcacccattaccacagtccccaagctggacaagaaccctaacctgggtgaggaccaggccgaggaaatcagcgacgagctaatggaatttagcctgaaagaccaggaagccaaggtgtcacgtagcggcttgtatcggagtcctagtatgcccgaaaacttgaatcgccctcggctcaaacaggtggaaaagtttaaagataatacgatacccgacaaagtcaaaaagaagtacttcagtggacagggaaaactgcggaagggcctctgccttaagaagacagtgtctctgtgcgacatcaccattacccagatgctggaagaggactcaaaccagggccacctcattggagatttttccaaagtgtgcgccttaccaaccgtgtccggcaaacaccaagaccttaagtacgtgaacccagaaactgtggcagcactcctgagtggtaaattccagggtcttattgaaaagttttacgtgatcgactgcagatacccgtatgagtaccttggaggccacattcaaggcgctttaaatctgtatagccaagaagagttattcaatttcttcttgaaaaagcccatcgtcccattagatacccagaagaggattatcattgtatttcattgcgaattctctagcgaacgagggccccggatgtgccgctgtcttagagaggaagacaggagcttgaaccaataccccgcactctattatcccgagttatatatcctgaagggcgggtaccgagatttcttcccagagtacatggagctgtgtgagccgcaatcctactgcccaatgcatcatcaggaccataagaccgaactgctccgctgcagaagtcaatctaaagttcaggagggtgaacgtcaacttagagagcagatagcgcttcttgtgaaagacatgagtccatag

SEQ ID NO: 14508 - DNA, 1293 bp, Artificial Sequence
  Description of Artificial Sequence: Synthetic coding sequence
atgtccaccgagctcttctcctcgactcgggaagaaggatctagtggatccggaccatccttccgttccaatcagagaaagatgctcaacctcctactggagagggacaccagtttcaccgtgtgccccgatgtgccccgtacccctgtgggcaaatttttaggggattcagccaatctgtccatactgagcggcagccccgggttcttcaggacctccggcagcgcattctcttgggacgctcagttgctttgttctactccaaatgggttagaccgcgggcatagaaaacgggacgcaatgtgctcctcctctgctaataaggagaatgacaacggaaacctggtcgatagcgagatgaaataccttggctcccctatcaccaccgtgccgaagctagacaagaatccgaacctcggagaggatcaggcagaggagatcagcgacgagctgatggaattcagcctgaaagatcaggaggcaaaagtttcacgcagcggtctatacagaagcccaagtatgccagagaacttgaatcgaccccggctgaagcaggtggagaagtttaaagataacacaattcccgataaggtcaaaaaaaaatatttttctgggcaggggaagctgcgaaagggactgtgcctgaagaaaacggtgtctctctgtgacatcacgattacccagatgctggaagaagactctaatcaaggacatcttatcggagatttctctaaggtgtgcgcgcttcccactgtttccggcaagcatcaggatctgaagtacgtcaaccctgaaaccgtggcggcactgcttagcggtaagtttcaggggctgattgaaaaattctatgtcatagattgtcgctatccatatgagtatttgggcgggcatatccaaggcgctctaaacctctatagtcaggaggagcttttcaacttcttcttgaaaaagcccatcgttccactcgatacccagaagcgcataatcatagtgtttcactgcgaattttcatctgagcgcggccccagaatgtgccgctgcctacgcgaggaagaccgttctctgaatcagtatcccgctctctactaccctgagctgtatatcctcaaaggtggctatagggatttcttccctgaatatatggagctgtgtgaaccgcaatcttactgccccatgcatcaccaagatcacaagacagaactgctgcgctgccgctctcagtctaaggtccaggaaggggagaggcagttacgagaacagatagccctcttggtgaaggacatgtctccttag

SEQ ID NO: 14509 - DNA, 1203 bp, Artificial Sequence
  Description of Artificial Sequence: Synthetic coding sequence
atgtctacggagctgttcagctctaccagggaagaggggtcatctgggagtggcccctcgttccggtctaatcagcggaagatgctgaatctcctgttggagcgtgatacctcgtttactgtgtgccccgatgtccccagaactcccgtcgggaaattcctcggtgatagtgccaacctctccattctatcgggttctcccggctttttcaggacctccggtagcgcattctcttgggacgacaatggaaatttagtggattcagaaatgaagtacctaggatctcctatcaccaccgtgcctaaactggataaaaatcctaatctgggagaggaccaagctgaagagatttcggacgaactgatggagttctctcttaaggaccaagaagcaaaagtcagcagatccggcctgtatagaagcccttccatgcccgaaaatctgaataggccacgtctgaaacaggtagaaaaattcaaagataatactattccagataaggtcaaaaagaaatactttagcgggcaggggaagctccggaaagggctttgcttgaaaaagaccgtctcattgtgtgacattaccataacacaaatgctagaggaggacagtaatcaaggtcatttaatcggcgacttctccaaagtgtgtgcgcttcccactgtgtctgggaaacatcaggacctaaaatatgtgaaccctgagacagtggcggccctgctatcaggtaaatttcagggactcatcgaaaagttttacgttattgattgcagatacccatacgaatatctgggcggccacatacagggagcactgaatttatactcccaagaagagctcttcaatttttttttgaagaaaccaatcgttccccttgatacacagaaacgcatcataattgtgttccattgcgagttttcttcagaacggggaccgcgaatgtgtcggtgtctcagggaggaagatcgttctctcaatcagtaccccgccctgtactaccctgagctgtatattcttaaaggagggtatagagacttttttccagaatacatggaactgtgtgaacctcaatcatactgcccaatgcaccaccaagaccacaaaacagagctccttaggtgcaggagccagagtaaggtccaggaaggggaacggcagctgcgggaacagatcgcgctgttggttaaggatatgagtccgtag

SEQ ID NO: 14510 - DNA, 750 bp, Artificial Sequence
  Description of Artificial Sequence: Synthetic coding sequence
atgtctacagaacttttctcctcaacacgagaggagggatcaagcggatccggcccatcgtttcgttccaatcaacgaaaaatgcttaatctactcctagaacgtgatactagcttcactgtgtgccccgacgtgccaaggacacctgtgggaaagtttctcggcgattcagctaacttatcgatcctgtccggaggaaccccaaaaagatgcctcgacctgtctaacctgtctagtggtgaaataaccgccacccagctcacgacgagcgcggacttagacgagaccggacacttggattctagtggccttcaagaagttcacttagccggtatgaatcacgaccagcatttaatgaagtgctctccagctcaactactttgttcaaccccaaatggactcgatagggggcaccggaaacgtgatgctatgtgctcttccagcgccaataaggaaaacgataacggtaatctggtagattcggagatgaagtacctggggagccccatcactacagttccaaaattggacaaaaacccaaatctaggggaagaccaggctgaggagatcagtgacgagcttatggaattcagccttaaagaccaggaagcgaaagtttcaaggtcaggactgtacagatctccaagtatgcctgaaaaccttaatcgtccccgcctgaaacaggtggagaagtttaaggacaacaccatccctgacaaggtgaaaaagaagtacttctccgggcagtag

SEQ ID NO: 14511 - DNA, 1422 bp, Artificial Sequence
  Description of Artificial Sequence: Synthetic coding sequence
atgtcaaccgaactcttttcgtctacccgcgaagagggttcttctgggtccggtccttcttttaggtcaaatcagaggaaaatgctgaatctgctcttggagcgagatacaagcttcaccgtttgtccagacgtgccacggactccagttgggaagttcctaggagattctgctaatctgtcaatcctctcagggggaacaccgaagaggtgcctggacctgagtaatctgtccagcggagagatcacagctacacagctgacgactagcgccgacctcgatgagaccggccatctcgatagctcaggcctgcaagaagtccacctggccggcatgaatcacgatcagcatttgatgaaatgctcccctgcacagctgctgtgtagcactccaaatggcttagaccgggggcaccgcaaacgtgacgccatgtgctcttccagcgcaaataaagagaacgacaacggaaatcttgtagactccgagatgaaatatttggggtcccccatcacgacagttcctaaattagacaaaaaccccaacctcggcgaggatcaagccgaagaaatcagtgacgaacttatggaattcagtctgaaggaccaggaagccaaagtatcccgcagcggcctctaccgcagcccctctatgcccgaaaatctgaacagaccaagacttaagcaggtagagaaattcaaagacaacacgatccccgataaggtcaagaaaaagtacttcagcgggcaaggtaaactccgcaaagggctatgcctgaagaagaccgtgagcctgtgtgacatcaccattacacagatgctggaagaagattccaaccagggccacctcattggtgacttctccaaggtatgcgcccttcccaccgtttcaggcaagcaccaagacctgaaatacgtgaaccccgagactgtggccgcccttttgagcgggaagtttcagggactcatcgaaaaattttatgtgatcgattgtcggtatccttatgaataccttggcggccatatccagggcgcattaaacctgtacagccaggaagaattatttaatttcttccttaagaaacccatcgttcccttggacactcagaaacggatcattatagtctttcactgcgagttcagcagtgaaagaggcccaaggatgtgtcggtgcctcagagaagaggatcggagcctaaaccagtaccccgccttgtactatccggaactgtatatcctgaagggcgggtatcgtgacttcttcccagagtacatggagctctgcgaaccccagtcctactgtcctatgcaccatcaggaccacaaaaccgagcttctgcgctgccgatctcagagcaaggtgcaggagggcgaacggcagttgagagagcagattgccctgcttgtcaaggacatgtccccctag

SEQ ID NO: 14512 - DNA, 1473 bp, Artificial Sequence
  Description of Artificial Sequence: Synthetic coding sequence
atgtcagaagaggccaggttttgtttctccccaggggagaatagtaagaccatgtccacggagctgtttagtagtacaagagaggagggtagctcgggttctggcccatctttcaggtccaaccagcggaagatgctgaatctactcctcgagagggacacttcctttacggtgtgcccagacgttccccgcaccccagtaggaaaatttctgggcgatagcgcaaacctaagcatcctgagtgggggaacacccaaacgatgcctcgatctatccaatcttagtagcggagaaataacggccactcagcttaccacttcagccgacctcgatgagactggccacctggattcttcaggactgcaggaagtgcacctagccggaatgaaccacgatcaacacctgatgaaatgttcccctgctcagctactatgttcaactccaaatggcctggacaggggtcaccggaagcgggatgccatgtgtagcagttctgccaacaaagaaaatgataacggtaatctggtggattccgaaatgaagtacctcggcagtccaatcacaacagtgccaaagcttgataaaaacccaaacctgggcgaggaccaggctgaggagattagcgacgaattaatggagttctctctgaaggatcaagaggcgaaggtaagtagatcaggattgtatagatctccttctatgcctgaaaaccttaaccggccccgcctaaagcaggttgaaaagtttaaggataacacgatcccagacaaagtgaaaaagaagtacttctccggtcaaggcaaactgcggaagggtctctgtctcaaaaaaaccgtgtcactgtgcgatattacaataacacaaatgctcgaggaggatagcaatcagggtcatctcattggagacttcagcaaggtgtgcgcactgccaacagtatccggcaaacaccaggaccttaagtacgtgaatccagagaccgtcgctgccctcctctcaggtaaatttcagggcctgattgaaaaattctacgttattgattgccggtatccatacgagtaccttggaggccacattcagggagccctgaatttatactcacaagaggaattgttcaacttctttcttaaaaaacccatagttccacttgatacccaaaagcgcatcatcatcgtcttccactgtgaattcagcagtgagcgagggccccgtatgtgcagatgcctgagagaagaggatagatcactcaaccagtatcccgccttgtactatccagagttgtatatcctcaaaggtggatatcgggatttttttcccgagtatatggagttatgcgagcctcagagctattgccctatgcaccatcaggaccataagaccgagctcctgcggtgtaggtcacagtccaaggtacaagagggagagcggcaactgagggagcagatcgccctgctggtgaaggacatgagcccttag

SEQ ID NO: 14513 - DNA, 288 bp, Artificial Sequence
  Description of Artificial Sequence: Synthetic coding sequence
atggaggggggcttcggcagtgacttcggcggatctggcagtggtaaactcgatcccggccttataatggaacaggtgaaagtccaaatcgccgtagcaaacgcgcaagagctcctccaacgcatgactgataagtgcttcaggaagtgtataggcaaacccgggggctcactcgacaacagtgagcagaagtgcatcgcaatgtgtatggatagatatatggacgcctggaacacagtttcccgcgcctataactccaggttgcagcgcgagcgggctaatatgtag

SEQ ID NO: 14514 - DNA, 576 bp, Artificial Sequence
  Description of Artificial Sequence: Synthetic coding sequence
atgcagacaattaagtgcgtagtggtgggagacggcgccgtgggcaaaacgtgcttgcttatctcttacactaccaataagttcccatccgagtatgtgcccacagttttcgataactacgccgtgactgtgatgattgggggcgagccctacaccttagggctgttcgacactgcaggccaggaggactacgatcgactccgcccactgtcctacccccagaccgacgtgttcctggtgtgtttcagcgtggtcagtccaagcagcttcgagaacgttaaagagaaatgggttccagaaatcacccaccattgcccaaaaacacccttcctgcttgtgggtacccagatagatctgagggacgatccaagcaccatcgagaagctggctaaaaacaaacaaaaacctatcacacctgaaaccgccgaaaagctcgcaagggacctcaaggctgtgaagtatgtggaatgctctgcccttacacagcgaggactgaagaacgtgttcgacgaagctatcctggctgccctggaacctccagagacccagcccaaacgtaaatgctgcatcttctag

SEQ ID NO: 14515 - DNA, 576 bp, Artificial Sequence
  Description of Artificial Sequence: Synthetic coding sequence
atgcaaactattaaatgtgttgtggtgggcgatggagctgttggcaaaacgtgcctgctgattagctatactacgaacaagttcccgagtgagtacgtgccaactgtgtttgacaactacgccgtcactgtgatgattggaggcgagccctacactctcggccttttcgacaccgccgggcaagaggactatgaccggctgaggcccctgtcttacccccaaactgacgtattccttgtttgttttagcgtcgtgtccccatcgagtttcgagaacgtgaaggagaagtgggtgcccgaaatcacgcaccactgtcctaaaaccccttttctgctggttgggacacagatagacctacgagatgatccctcgacaatagagaagctggctaaaaacaagcagaaacctattacgcccgagacagctgagaagttggctcgcgacctgaaggcggtcaaatatgtggagtgtagtgccctgacccagaaaggcttgaagaatgtgttcgacgaggccatattggctgcacttgagcctccagagcctaagaaatcccggcgctgtgtccttctctag

SEQ ID NO: 14516 - DNA, 576 bp, Artificial Sequence
  Description of Artificial Sequence: Synthetic coding sequence
atgcagacgattaagtgcgtggttgtcggagacggtgcagtgggcaagacttgcctacttataagttacacaacaaataagtttccatcggaatacgtcccaactgtgtttgacaactatgccgtaacagtgatgatcgggggagagccttatactcttgggctattcgacacggccgggcaggaagattatgacaggctgaggcctctgtcctatcctcagaccgatgtgttcctggtatgcttctcagttgtttctcctagttccttcgagaatgtaaaagaaaagtgggtgcctgagataacccaccactgcccaaagaccccctttctgctggtcggcacacagatagaccttcgcgacgacccctctactatagaaaagctcgcaaagaacaagcagaaaccaattactcctgagactgccgagaagcttgcccgagacctaaaggcagtgaaatatgtggagtgttcagctctaacccagaagggcctcaagaatgtgtttgatgaagcgatcttggccgccctcgagcctccggagcccaagaagtcacgtaggtgcgttctgttgtag

SEQ ID NO: 14517 - DNA, 411 bp, Artificial Sequence
  Description of Artificial Sequence: Synthetic coding sequence
atgcaaacaatcaagtgcgtggtggtcggcgacggagcagtgggcaagacctgtctgctgatctcttatacaacgaacaaatttccttccgaatacgtcccaaccgtgtttgataactacgcagtcaccgtaatgatcgggggggagccctatacactgggcctcttcgataccgcgggccaggaagattacgaccgcctgcgtcccttgtcttaccctcagaccgatgtgtttctggtgtgcttcagcgtcgtgtcccccagttcattcgaaaatgtgaaagaaaaatgggtgcctgaaatcactcaccattgcccgaagacacctttcctactggttggtactcagatcgatcttcgagatgatccttccactatcgagaagctagcaaagaacaaacagaaaccttag

SEQ ID NO: 14518 - DNA, 702 bp, Artificial Sequence
  Description of Artificial Sequence: Synthetic coding sequence
atgtcaccagatatcctgcacaacaagcagatatctataggtatttgcaccgattacttggatttttcgtgggtgaattacatacactttaagcaactgaaaaatcagtggaaggttcgcaggggcgacacaggcttcgcgagaagcgccggacggcagaactcaagtcggcaggactctaacgagtggtggagccagtttggcgaagtttgccctacgtcttggaacgaagtcttcgacaactacgccgtaaccgtgatgattggaggtgaaccctatacactggggctgtttgacaccgctgggcaggaggattatgaccgcctccgcccactttcttatccccaaaccgacgtcttcctcgtgtgtttcagtgtggtcagtcccagtagcttcgagaacgtaaaggaaaaatgggttccggaaattacgcaccattgccctaaaacaccatttctgctagttggcacccagatcgatcttcgcgacgacccatctaccatcgaaaaattagcaaaaaataagcagaaacctataacacctgaaacggccgagaagctggctcgagatctaaaagcagttaagtacgtagaatgcagtgcactgactcagaagggcttaaaaaatgtgttcgacgaagcgatcctcgcagccttagaaccaccggaacctaagaaatccagacggtgcgtcttgctttag

SEQ ID NO: 14519 - DNA, 1269 bp, Artificial Sequence
  Description of Artificial Sequence: Synthetic coding sequence
atgaattctggacatagttttagccagacgccttcggcttcttttcacggagccggagggggctggggtaggcctaggtcttttccacgagctcctaccgtgcacggtggtgccggtggagccagaatatcgctgagttttaccactcgatcgtgccccccacccgggggcagctgggggtccgggcggtctagtcctctcctgggaggcaatggtaaagccactatgcaaaatcttaacgacagactagcatcttatctagaaaaggttagggccctggaggaagctaatatgaaactggagtcgaggatcctgaagtggcaccagcaacgtgaccccgggtctaagaaagactattcccagtatgaggagaatatcacccatcttcaggaacaaatcgtggacggcaagatgacaaacgcacagataatcttgctgatagacaacgcaaggatggcggttgacgacttcaacctgaagtatgagaacgagcactcctttaagaaggacctcgaaatcgaggttgaaggcctgcgaagaacactggacaacctgacaattgtcactaccgatctggagcaggaagtcgagggtatgcgaaaagagttgatacttatgaaaaagcaccatgagcaagagatggagaaacaccatgtcccctccgattttaatgtcaatgtaaaagtggacactgggcctagagaagatctgattaaagtgctggaagacatgcgccaggagtacgaattgattataaaaaagaagcatcgggatctggatacatggtataaagaacagagcgcggctatgtcccaggaggcagcaagccctgcaaccgtgcaatcgcggcagggagacatccatgaattgaagcgcacctttcaggccctagaaatcgatttgcagacccagtatagtaccaaatctgcactggagaacatgctgtcagaaactcagtcgcgatatagctgtaaattgcaggacatgcaggagatcatatcccactacgaggaggagctgacacagcttcggcacgagctagagaggcagaataacgagtatcaggtgttactggggatcaaaacacaccttgaaaaggagattacaacataccgcagacttctggaaggggagtcggaggggacaagggaagagtcaaagtctagcatgaaggtctcggccacccctaagatcaaggcaatcacgcaggagactatcaatggccggctggtcctgtgtcaggtgaatgagatccagaaacatgcttag

SEQ ID NO: 14520 - DNA, 1596 bp, Artificial Sequence
  Description of Artificial Sequence: Synthetic coding sequence
atggcagacgtcctcagtgtcctgaggcagtataacatccagaaaaaggaaattgtggttaagggagacgaggtcatatttggcgagttctcctggcctaagaatgtgaaaactaactatgtggtatgggggacgggcaaagagggccagcctagagagtattataccctggatagtatcctcttccttcttaacaatgtgcaccttagccaccccgtttacgtgcggagagcggccacagaaaatattccagtggtgcgccgcccagaccggaaggacttactgggttatcttaacggggaggcatccaccagcgcttcaatagatcggtccgcacccctcgaaatcgggttgcagcgcagcacccaagttaagcgcgccgctgacgaagtgttagcagaggccaaaaaacctcgcatcgaggacgaggagtgtgtgcgtctcgataaagagcgtctagccgctagattggagggtcataaggagggaatcgtgcagacggagcagattaggtccctgtctgaagcaatgagtgtagaaaagatcgccgctattaaggccaagatcatggccaagaaacggtcaaccataaaaactgatctcgacgacgatattactgcactgaaacagaggagctttgtcgatgccgaggtcgatgtgactcgggacattgtgtctcgggagagagtgtggcggacgagaacaactatcttgcagtcgactggcaagaacttctcgaagaacattttcgcaatactgcaaagcgtaaaagccagggaagaaggaagggcccctgagcaacgaccagcacccaatgccgcccccgtcgatcctacactccggacgaaacaacccattcccgctgcctataacaggtatgatcaggagagatttaaaggtaaagaagagaccgagggctttaaaatagatactatgggtacctatcatggaatgacactcaagagcgttactgagggcgcttccgccaggaaaacccagacccccgcggctcaacccgttcctcgcccagtcagccaggccagaccccctccaaaccaaaaaaaaggctcacgaacgccgatcattatcatacccgcggccaccacctccctgatcaccatgctcaacgccaaggatctgctccaggacctcaagtttgttccctccgacgaaaagaaaaaacaaggctgtcagcgggaaaatgaaactttaattcaacgccggaaagatcagatgcagccgggcgggaccgccatcagcgtgaccgtcccatacagagtggtcgatcagccactcaaacttatgccccaggattgggatcgcgttgtcgccgtattcgtgcagggaccagcctggcagtttaagggctggccttggctgctgccggatggttcccccgtggatatatttgccaaaatcaaggcttttcacctcaagtacgatgaagttagattggatccgaatgtccagaagtgggacgtaacagtgcttgagttgagttaccataagcgtcatttagaccgacccgtttttctgaggttctgggagacgctggacaggtatatggtcaagcacaagtcccatctccggttctag

SEQ ID NO: 14521 - DNA, 951 bp, Artificial Sequence
  Description of Artificial Sequence: Synthetic coding sequence
atggccgatgtcttgtctgtactcagacaatataatatccagaagaaagagattgtcgtgaaaggggatgaggtgatcttcggcgagttctcttggccaaaaaatgttaaaaccaactatgtggtgtggggtacaggcaaggagggccaaccaagagaatactatactctcgactccattctatttcttttgaacaacgtccacctctctcatccggtgtacgtcagacgggcggccacagaaaatatcccggttgtgagaaggcccgatcgcaaagatctcctgggatatctaaatggtgaggcttctactagcgcctccatcgacagatcagccccattggagataggactccagagatccactcaggttaaaagggctgctgacgaagtgctggctgaggcaaagaaacctagaatcgaagacgaagaatgcgtaagactagataaagagcgcctggcagccagactcgagggtcacaaagaaggtatagtgcagaccgagcagataaggagcctatccgaggcaatgagcgtagaaaagatagcagccatcaaggctaagatcatggctaaaaagaggtctaccatcaaaacagacctcgacgacgatatcactgccctcaagcagcggtctttcgtggatgccgaggtggacgtcaccagagatatcgtgagtcgcgaacgcgtgtggcgcactcgcacgacaatcttacagagcaccgggaagaattttagtaaaaatatcttcgcaatcctgcagagtgtgaaggctagggaagaaggacgggctccagaacagcgaccagcaccaaacgcagcgcctgttgaccccacactccgcactaagcaaccaatccctgccgcttataacagatacgatcaggagcgcatcagtaatacccattatcacaattcttgcagctaccacctctttaataatcatgcctag

SEQ ID NO: 14522 - DNA, 1317 bp, Artificial Sequence
  Description of Artificial Sequence: Synthetic coding sequence
atgggaggttgtgccggatccaggaggcgatttagcgattcagaaggcgaggagacagtacccgagcctcggttgcctctacttgaccatcaaggagcccattggaaaaatgccgtgggtttttggctcttgggtctctgcaataacttctcctacgtggtcatgctgagcgctgcacacgacatcttgtctcacaaacgcacatccggaaaccagagtcacgtggaccctggaccaacgccaatcccacacaattcatcgtcacgctttgattgtaactcagtgtctacagccgctgttttattagcagatatactgcccacactggttataaagctcttggcacccctcgggcttcacttactgccatacagtccgagagttctggtgtctggaatctgcgcagcaggatcttttgttctggtggctttttcccatagcgtcgggacctcattatgtggtgtcgtcttcgccagcatttcatcagggctgggggaagtgacatttctcagcctgaccgccttctatccgagagccgtgatcagttggtggtcgtctgggactgggggagcaggactgctcggggcactgtcctatctcggtcttacacaggccgggctttctccccaacagacattactcagcatgctcggcatacccgcccttttgctggcctcttactttctgctgctgacttccccagaagctcaggatcctggtggggaagaggaagcagaatccgctgctcggcaacccttgatcagaactgaggcgccagagtctaaaccaggatcctcatctagcttgagcttgcgagaacgctggaccgtgttcaaggggttactctggtatatcgttcctctggtcgtggtttattttgccgaatacttcattaatcaggggttgtttgagctgctcttcttttggaacacatcgctgtcccatgcccagcagtaccgatggtaccagatgctctaccaggccggagtcttcgccagtcgatcatcactaaggtgttgtcgtatccgcttcacctgggccttggcgctgctccagtgtcttaacttggtcttcctgctggccgatgtatggtttggtttcctcccttctatctacctcgttttccttattattctgtatgagggtctgctaggaggggctgcatatgtgaatactttccataatattgctctagaaacctctgatgagcacagggaatttgcaatggccgcaacatgcatctctgacaccctaggcatctccctctcaggcttgctggccttgcctctccatgacttcctgtgccagcttagttag

SEQ ID NO: 14523 - DNA, 504 bp, Artificial Sequence
  Description of Artificial Sequence: Synthetic coding sequence
atggggggctgtgccgggtctcgaaggagattcagcgactctgagggggaggagactgtccccgagccacgattacccctcctcgaccatcagggggcccactggaaaaatgcggttggcttttggctgctgggcctctgcaataacttcagttatgtcgttatgctctcagccgcgcatgatattttatcccataagcgtaccagtgggaatcaatctcacccccccggctccaggcaatgggatctgtgctgttggaagctccgtcctggctgtctcttctcattttgtggggaccagcccgtgtgttattttctgctgctgaccagtccagaggctcaagaccccggaggcgaagaggaggctgaaagcgcggctagacagccgcttattagaaccgaggcccctgagagcaagcctggctcttcctcatctcttagtctccgcgagagatggaccgtcttcaaaggattattatggtacatcgtcccccttgtcgtctag

SEQ ID NO: 14524 - DNA, 1266 bp, Artificial Sequence
  Description of Artificial Sequence: Synthetic coding sequence
atgggaggttgcgcagggtcccgccgtcgattttcagattccgaaggcgaggagaccgtgcccgaaccgagactgccacttctggaccatcagggtgctcattggaaaaacgccgttggtttttggctgctggggctatgcaacaatttttcatacgtggtcatgttatcagcggcacatgacattctctcccataaacgaacttcaggaaatcagtcccatgtggaccctgggccaacgcccatcccgcacaactcctcctcacgattcgactgcaacagcgtgtctacggctgcagttctcttagccgacattctgcccaccctcgtaattaagctgctggcccctctgggacttcacctgctaccgtattccccgcgcgttctggtcagcggaatttgcgccgctggtagtttcgtgttggtagctttcagccactccgtgggcacttcactgtgcggcgtggtctttgctagcatttcctcaggtttaggagaagtcacttttctgtccctcaccgctttttatccccgggccgtgataagttggtggagtagtggcacaggtggtgctgggctgctgggggccttatcatacctggggttgacacaggcaggcctatctccccagcagacgctgctgagcatgttaggcattcccgccctcctcctcgcttcctactttctgctgttaacatcacccgaggcacaggacccaggcggcgaggaggaggccgagagcgctgcccggcagcctctcatcaggactgaggcacctgaaagcaagccagggtctagctcttcattgagtctgcgcgagcggtggaccgtgtttaaagtcagaatgatggccggattcgaacttctcttcttttggaatactagcttgagccatgctcaacaatatcgatggtaccagatgttgtaccaggcaggagttttcgcttccaggtctagcctacgatgctgtagaattcgcttcacctgggcactcgctctcctgcagtgtctcaatctcgtgtttcttctggctgatgtgtggttcggcttcctgccgtccatctacctggtgttccttattattctgtacgagggacttctcgggggtgccgcctatgtgaacaccttccataatatcgccctcgaaacatccgacgaacatcgtgagtttgccatggccgcgacttgcatcagtgacaccctgggaatctccctttctggactgttagctcttccattgcacgatttcttatgtcagctctcctag

SEQ ID NO: 14525 - DNA, 1173 bp, Artificial Sequence
  Description of Artificial Sequence: Synthetic coding sequence
atgggcggctgtgccgggtcacgacgacggtttagcgactctgaaggggaggaaactgtgccggagcctcggctgccactattggaccatcagggtgcccattggaaaaatgccgtaggattttggttgctgggtttgtgtaataacttttcatacgtcgtgatgctgtctgccgcacatgacattttgagtcataaaaggactagcggaaatcagtcccacgtcgatcctgggcccacacccattccacataactcatcttctagatttgattgcaatagcgtgtccaccgctgcagtgctgctcgcagatattttacctactttggtgattaaactgctcgcccctcttggcctgcacctactcccctattcaccaagggtgctggtaagtggcatctgtgctgccgggagctttgtcttagttgccttttcccactcggttggaaccagtctgtgcggcgttgtgttcgcttcaattagtagtggactgggggaggtaacattcctttcactcactgcgttttatcccagctattttctgctattaaccagtccagaggctcaagaccctggcggcgaggaggaggcggagagcgccgccagacaaccactcatccgaacagaggctccagagagcaagcctgggtcgtcctcttctctttccctacgagaaaggtggacagttttcaagggtctgctatggtatatagtgcctcttgtcgtcgtatacttcgcagaatatttcatcaaccaagggctcttcgagttgctgttcttttggaacacatcattatctcacgcccagcaatataggtggtatcagatgctttatcaggcaggagtgttcgcttctcgatcttcactgcggtgctgtaggatcaggtttacgtgggcactcgccctactccaatgcctgaatctcgtgttcctcctggcagatgtttggtttgggtttttgccttccatctacctggtgttcttgataattttgtatgaaggcctcctgggaggggcggcgtacgtgaatactttccataacattgccctcgaaacatccgacgaacacagggaatttgcgatggccgctacttgcatatcagacacactgggcatatcactgagcggcctcctggccttgccgctgcatgatttcttgtgccagctgtcttag

SEQ ID NO: 14526 - DNA, 762 bp, Artificial Sequence
  Description of Artificial Sequence: Synthetic coding sequence
atgggcggttgtgccgggagtcgtcggcgtttctcggatagtgagggtgaggaaaccgttcctgaacctaggttacccctgctggaccaccagggcgcccactggaagaatgccgtgggtttttggctgttgggcctgtgtaacaatttctcttatgtcgtaatgctgtccgccgctcatgatatactcagtcataaacggacttccgggaatcagtcacacgtggatccagggccaactcctattccacacaactcctccagtaggtttgactgcaatagtgttagtactgcggcagtcctgcttgctgacatcctgcctacactagtcattaaactgctagccccacttggactgcaccttctgccttatagtcctagagtcctcgtaagcgggatttgtgctgccgggagcttcgtcttggttgccttttcccactcagtgggtacgagtctgtgcggaagctcttctagcctgtcgctcagggagcggtggaccgtgttcaagggactgctgtggtacatagtgcccttggttgtggtctacttcgccgaatactttatcaaccagggcctcttcgaactactattcttttggaacacctccctgagccacgcacagcagtacaggtggtaccagatgctctatcaggccggagtctttgcaagtcggtcatccctgaggtgttgccgaatccggtttacatgggctctggctctgctgcagatggaatcgagaagcgtggctcaggcaggtatgtag

SEQ ID NO: 14527 - DNA, 1020 bp, Artificial Sequence
  Description of Artificial Sequence: Synthetic coding sequence
atgggtgggtgtgcaggtagcaggcgacgtttttctgattccgaaggggaggagaccgttcccgaaccgaggctcccccttctcgatcaccagggggcacactggaagaacgcagtgggcttttggctgctgggcttatgcaacaacttttcctacgtggtgatgctgagcgcagcacacgacatactatctcacaagaggacaagtggaaaccagtcacatgtggatcccgggcctaccccgattccccataacagctcctctcgattcgattgcaatagcgtgtcaacggccccccctggaagcaggcaatgggatctctgttgttggaaactgaggccaggatgcctgttttctttttgcggtgatcagccggtctgttacttcctgttgctgacctcgcctgaagcacaggatccaggcggcgaggaggaggctgaaagtgccgcccgacagccattgattcggactgaggcccctgaaagcaaaccaggctcaagctcctctcttagcctgcgcgaacgctggaccgtgttcaagggcctgctctggtatattgtacccctggttgtagtgtatttcgcagagtatttcattaatcaggggcttttcgagctgctgtttttctggaacaccagccttagtcatgctcagcaataccgctggtaccagatgttgtaccaggcaggcgtcttcgcgtctagaagcagcttacgctgttgtcggatccgctttacctgggcactcgcactcctgcagtgcctaaatctggtgttcctcctggcagatgtgtggtttggctttctgccatcaatctatctggtctttctgattatactctacgaagggctgctaggaggcgccgcttatgtaaacacctttcacaacatcgccctggagacttccgacgagcaccgagaattcgccatggccgctacatgcatttccgacactcttgggatatctctctcagggctcctcgcactcccactccacgattttctctgccagttgagttag

SEQ ID NO: 14528 - DNA, 1155 bp, Artificial Sequence
  Description of Artificial Sequence: Synthetic coding sequence
atgctatccgcagcacacgacattttgagtcataagcgtacatctggcaaccagtcccacgtcgatccaggacctacccccatccctcataacagctcgtctagatttgactgtaactccgtgtctacggccgctgtattactggcagacattctgcctacccttgtcattaagctgctggcccctttggggcttcacctgctgccctattcccccagagtactggtcagcggcatatgcgccgcaggctcgttcgtgctggtcgcatttagtcacagcgtcggcacctcgctttgtggagttgtttttgcctcaatttccagcggcctcggtgaggttacgtttctaagcctcaccgccttttacccccgggctgtgatctcttggtggtcatcgggcacgggaggagcaggcctgcttggcgctctgtcttacctagggctgactcaggctgggctcagcccccagcagacactcctcagtatgctggggatcccagccttactgctggcctcttacttccttttactgaccagtccagaggcacaggacccggggggtgaggaggaggcagagtcggccgccagacaaccattgatacgcactgaggcaccggagagcaagcccggctctagttccagtctgtctttgcgcgaaagatggactgttttcaagggtcttctctggtacattgttcccctagtggtggtgtattttgcagagtattttatcaatcaaggcctgttcgaactgttatttttttggaacacaagcttatctcacgcacagcaatacagatggtaccagatgctttaccaagcaggcgttttcgcttcccgatcatctttacgatgttgccgcatccggttcacctgggccctagccctgttgcagtgtctgaatctggtgttcctgttggccgacgtgtggtttggctttctgcctagcatctatttggtgttcctgattattctgtacgaaggacttcttggcggagctgcatacgtgaacaccttccacaatatcgcccttgagacctccgacgagcaccgagaattcgccatggccgccacctgtatttcagacaccctgggaatcagcctttctggacttctcgctttgcccctgcacgactttctgtgtcaattgtcttag

SEQ ID NO: 14529 - DNA, 1317 bp, Artificial Sequence
  Description of Artificial Sequence: Synthetic coding sequence
atgggggggtgtgctggcagccggcgccgcttttccgacagcgaaggggaagaaacggttcccgagccaaggctgcctctgctggaccatcagggtgctcactggaagaatgcagtgggtttctggcttctgggactttgcaacaatttcagttatgttgtaatgttaagtgctgcacacgacattctatcccacaagcggacctccgggaaccagtcccacgtcgatcccgggccaacacccatccctcacaactctagctcgcgctttgactgtaactccgtgagcactgcagctgtgctgttggcagacatactgccaacactcgttatcaaactgctggctccactcggtttacacttgctaccttactctcctagagtgcttgtgtccggaatttgcgctgcaggcagtttcgtgctagtcgccttcagccatagtgtaggaacatcattgtgcggggttgttttcgctagtatttcttccggtctgggcgaggtcacctttctatccttaactgccttctatccgcgcgccgtaatttcctggtggagctcaggtaccggaggcgctggtctgttgggtgccctgtcgtacttaggattgactcaggcaggactctcaccccaacagactttgctgtctatgctgggcattcccgccttgcttctggcctcctactttctgctgctgacctcaccagaggctcaggaccccggcggggaggaggaggctgagtctgccgcccgtcagcctctcatcaggaccgaggctccagagtctaagcccggttcctcttccagtcttagcttaagggaacggtggacagtgtttaaagggctcctgtggtacatcgtgcccttggtcgtcgtgtacttcgccgagtattttatcaatcaggggctgtttgaactgctgttcttctggaatacttcactttcgcacgctcagcaataccgctggtatcaaatgctttaccaggccggtgtctttgcttctcgttcctcattgcggtgttgcagaattcgattcacctgggccctcgctctgctccagtgtctgaacctggtctttctgctcgcagatgtttggttcggattcttgccaagcatatacctggtgtttcttatcattctgtatgaggggctgcttggaggcgctgcatacgtcaatacattccataatatcgccctcgagacctccgatgaacacagggagttcgccatggccgccacctgcatttctgacaccctggggatcagtcttagcgggttgctggcactccctttacacgattttctgtgccagctgtcctag

SEQ ID NO: 14530 - DNA, 1317 bp, Artificial Sequence
  Description of Artificial Sequence: Synthetic coding sequence
atgggcgggtgcgccggatctcgaaggagattcagtgactctgagggggaggagaccgtgccagaaccgcgcttacctcttctcgatcatcaaggcgcccattggaagaatgctgttggtttttggcttctgggtctctgcaataacttttcctacgtggtcatgctctcagccgcacacgacatactttctcataagcgtacttcgggcaaccaatcccacgttgacccaggtccgacgcctataccccataattcttcttcacggttcgactgcaatagtgttagcactgctgctgtgctcctggccgacatcctgcctacactcgtgattaagcttttagcgcctctgggattgcacctcctcccctattctccacgggttcttgtcagtggcatatgtgccgctggtagtttcgtactcgttgcgttttcccactcggtaggtacaagtctttgtggagttgtatttgcctctatatcaagtggactaggagaagtcacgttcctgtccctgaccgccttttaccctcgggctgtgatttcatggtggtcttccggaacggggggagcaggcctgctgggggcactctcatacctggggctgactcaggctggtcttagtccccagcagacactactctctatgctggggattccggccctactgcttgctagctacttcctgcttttgacatcccccgaggcccaggatcccggcggcgaagaagaggccgagtccgcagccagacagccattaattaggactgaggcacctgaaagcaagccaggtagctccagttcactctctctgcgcgagcgatggacagtgtttaagggtctgctttggtacatagtcccgctcgtggtggtgtattttgccgagtatttcattaatcaggggcttttcgagctgctatttttttggaatactagcctgtcccacgcccaacagtatcgctggtaccagatgctttaccaggccggcgtgttcgccagtcggtcctctcttcggtgctgtagaattcgctttacatgggccctagcactcctgcaatgcctgaatctcgtgtttcttcttgcagatgtgtggttcggctttctgccatccatttacctggtatttttaattatcctttatgaaggcttgctgggaggggctgcctacgtgaacactttccacaacattgccttggaaacctctgatgaacaccgggagtttgcaatggccgccacctgcatcagcgatacgctgggcattagcctaagcggattgcttgcccttcctctccacgatttcctgtgccagctcagttag

SEQ ID NO: 14531 - DNA, 1017 bp, Artificial Sequence
  Description of Artificial Sequence: Synthetic coding sequence
atgtggacacaagctcagaggcgcagccccactacagcccaccatgacttaactgccaccctaagcctccgattaccgagggtattagtctccggcatatgcgcggctggttcttttgtactggttgcttttagtcattctgtggggacgagcctttgcggcgtggtgtttgctagcatctccagtggtctgggggaggttacgttcctgtccttgaccgccttttatccaagagcggtcattagctggtggtcctcaggaacaggcggcgcaggcctgctcggcgccctgtcttatctaggattaactcaggctgggctgtcgccgcaacagactctgttaagtatgttaggtattcccgctctgctgctcgcgtcgtacttcctattgcttacctctcctgaggctcaggatccggggggagaagaagaggctgaatctgctgccagacagcccctgattcggacagaggcccctgagagcaagcccgggagctctagtagcctctccttgagagagcgttggaccgtcttcaagggattgctttggtatatagtccctttggtcgtggtatatttcgcagaatattttattaatcagggattgttcgagctgctgttcttttggaatacatctctgtctcacgcacaacagtacaggtggtatcaaatgctctaccaggctggcgtgttcgcttctagaagcagtctcaggtgttgcagaattaggttcacttgggccctggcactgctgcagtgtctgaacctggtctttctcctggctgatgtgtggtttggcttcctacccagtatatacctagtgtttttgatcattctgtacgaagggttactcggcggggcggcctacgttaatacattccataacatcgccctggagactagcgacgagcatcgggagtttgccatggcagcaacctgcatctctgatacgcttggcatttcactgagcggtctgctggccttacccctacatgactttctgtgtcagctcagctag

SEQ ID NO: 14532 - DNA, 1083 bp, Artificial Sequence
  Description of Artificial Sequence: Synthetic coding sequence
atgttatcagcggcccacgatattctttcccacaagaggacaagtgggaaccagtcccacgccgtactgcttgccgacattcttcctactctggtcatcaaactgctcgccccactcgggctgcatctgttgccatactcccccagggtcttggtcagcggcatctgtgctgccgggtcctttgtcctagtggcgttctcacatagtgttggaacctccctctgcggcgtggttttcgccagcatttcgtccggcttgggcgaagtgacctttctctctcttaccgcgttttatccacgagccgtaattagctggtggtcttcaggtactggcggggccggcctgttaggtgccttaagctacctcggactgacacaagcaggactatcgccgcagcaaaccctgctgagcatgctgggcattcccgctcttttgcttgccagctattttttactactgacctccccggaggcacaggacccaggcggagaggaggaggcagaaagtgccgccaggcagcctctgataagaaccgaagcgcctgagtccaaacccgggagctcttcctctctgtccctgcgcgaacgatggacagtgttcaagggccttctgtggtacattgtgccacttgtggtggtgtatttcgcagagtacttcatcaatcagggcctgtttgaactgttgtttttctggaatacctcattgtcacacgcacagcaatacaggtggtatcagatgctttaccaggcaggagtgttcgcttcccgaagcagtctgaggtgctgccggattcggttcacttgggccctggctttgctgcaatgcctgaacctcgtattccttttagcggacgtgtggtttgggtttctcccctctatctatctcgttttcctgatcattctctatgagggcctgctgggaggcgcagcctatgtgaatacattccacaacatcgcattagagaccagcgacgagcaccgggagttcgcaatggcagctacctgcatatcagatacgctgggtataagcctttccggcttgttggctctaccactccatgactttctctgccaattgtcttag

SEQ ID NO: 14533 - DNA, 1299 bp, Artificial Sequence
  Description of Artificial Sequence: Synthetic coding sequence
atggccgtgccattcgtggaggactgggatctggtgcaaaccctaggtgagggagcgtacggggaagtccagttggctgtgaaccgcgtgacagaagaggctgtagctgtaaaaattgttgacatgaagagggctgtggattgccctgagaatattaagaaagagatttgcattaacaaaatgctgaatcatgagaacgtcgtcaagttttatggacatagaagggagggcaatatccagtatctgtttctggagtattgcagcggtggcgagttatttgatcggattgagcctgatataggcatgcctgagcctgacgcacaacgattttttcaccagctcatggccggcgtggtgtatctccatggtattggaatcacccacagggacatcaaaccagagaatctccttcttgatgagcgggataacttgaaaatttccgacttcggtctcgcgaccgtattcagatacaacaatcgagaacgccttttgaataaaatgtgcggaacccttccctatgtcgccccggagctgctgaaaagaagggaatttcacgcagagcccgtcgacgtgtggtcctgcgggatcgtgctgaccgccatgctcgcaggtgaacttccttgggatcagccttctgactcctgccaggagtactccgactggaaggagaagaagacctatctgaacccttggaagaaaattgacagcgcacctctcgctctcctgcataagatactagttgagaacccttccgcacgcattaccattcctgacatcaagaaagaccgatggtataacaagccgctgaagaagggcgccaagaggccacgcgtgacatccggcggagtctctgagtcaccttctggcttctctaagcacattcagtctaacctggattttagccctgtaaacagtgcgagtagcgaggaaaatgttaaatattcgagctcgcaaccagaacctagaacagggttatcattatgggacaccagcccatcctacattgataagcttgttcaggggatatccttctcccagcccacatgcccagaccatatgctgctgaacagtcagttactgggaactccaggcagctcccaggttacaatatctaccaccgaccggcgcaataacaagttgatctttaaagtgaacctgttggagatggatgataagatcctcgtggattttaggttgtccaagggtgatggactagaatttaagcgccactttcttaaaattaaaggcaagctgatcgatattgtgtcttcccagaagatttggctgccagcaacctag

SEQ ID NO: 14534 - DNA, 1431 bp, Artificial Sequence
  Description of Artificial Sequence: Synthetic coding sequence
atggctgtgccattcgtggaggactgggatctcgtccaaacgttgggagaaggcgcatatggagaggtccaactggccgtcaacagagtgacggaagaagcagtggccgtgaagatcgtagatatgaaacgcgctgtcgattgccccgagaacattaaaaaggaaatatgtatcaacaagatgcttaaccacgaaaacgtggtcaagttctacgggcatagacgcgagggaaatattcagtacttattcctagaatattgctcaggcggcgaactgtttgacaggattgagcctgacatcgggatgccggagcctgacgctcagaggtttttccaccagcttatggcgggggtggtctatctgcacgggattggcatcacccacagagacataaagcccgaaaacctgctgctggatgagagagacaatctaaagatttccgacttcggtcttgccacagttttccgttacaataatagggagcggctgcttaataagatgtgcggtaccttgccttatgtggcaccagaactcctaaagcgccgcgaatttcacgccgagcctgtggatgtgtggtcttgcgggatcgttttgaccgctatgttagcgggggagctgccatgggatcagccaagcgattcatgtcaggagtactccgactggaaagagaagaagacctacctcaacccgtggaaaaaaatagatagtgcgccgcttgccttacttcacaagatattagtggagaacccatccgcacggataaccatccccgatatcaagaaagatcgctggtataataagcccctgaagaagggcgcaaaacggccccgagttactagtgggggtgtttccgagtccccctcgggcttcagtaaacatatccagtccaacctcgatttttccccagtcaacagcgcctcctcagaggaaaacgttaagtactcttcttctcagccagagcccagaacagggttgagcctctgggacacgagtccaagttatatagataaactggtgcaggggatatcatttagtcagcctacctgcccggaccatatgctgctgaattcccagcttctcggcacgcccggctcttctcagaacccatggcaacgtctggtgaaacgtatgaccagattctttacaaaactggatgcggacaagtcctaccagtgcctcaaggaaacctgcgaaaagttggggtatcagtggaaaaagtcttgtatgaaccaggtaactattagcacaacagatcgacgcaacaataaactgatttttaaggttaatttgctcgaaatggatgacaagattctcgtggacttccgactctccaaaggtgacggactggaattcaaacggcatttcctgaaaatcaagggaaaactgatcgatatcgtgtccagccaaaaaatctggctacccgcaacctag

SEQ ID NO: 14535 - DNA, 1431 bp, Artificial Sequence
  Description of Artificial Sequence: Synthetic coding sequence
atggccgtgccatttgtagaagactgggatctggtgcagactctgggtgagggcgcatatggggaggtgcagttggctgtcaaccgagtaacagaagaagccgtggctgtaaagatagtcgatatgaagcgggctgtggattgtccagagaatattaaaaaggagatttgtattaacaaaatgctgaatcacgagaacgtcgtgaagttttatggccacaggcgcgagggaaacatccagtacctgttcctggaatattgctcgggcggcgaactcttcgatcgtattgaacccgacattgggatgcccgagcctgatgcacagcgcttcttccaccaactgatggctggggtggtttacttacacggcatcggaataacccacagagacatcaaacccgaaaacctgcttctggatgagcgggacaatctgaaaatcagcgacttcggccttgctaccgtcttcagatacaacaaccgtgagaggctactgaacaagatgtgtggcactctgccctatgtcgcccccgagctcctgaagcgcagagaattccatgccgaacccgtggatgtgtggtcctgcggcatcgtgctgacagctatgctcgcaggcgagctgccctgggatcagccgagcgattcttgtcaggagtactcagactggaaggagaagaagacttacctgaacccttggaaaaaaattgatagcgcacctttggcactgctgcataagattctggttgaaaacccctcagcaaggatcacgatccctgacattaagaaggatagatggtataataagcctctcaaaaaaggcgccaaacggcccagagtgacgagcgggggagtatccgagagcccctcaggcttcagcaagcacatacagagtaaccttgactttagcccagtcaatagtgccagcagtgaggagaatgtgaagtacagcagcagtcagcctgagccccggacaggcctctcgctgtgggatacttcacctagttacatcgacaaactggtacagggcatcagctttagccagcccacctgcccggatcatatgttactcaactcacagctgttgggtaccccaggcagcagccagaacccctggcagcgtctcgtgaagagaatgacaagattcttcactaagttggacgcagataagagctaccagtgcttaaaggagacctgcgagaaactcgggtatcagtggaaaaaatcttgcatgaatcaagttacaataagcacaaccgatcggcggaataacaaactaatatttaaagttaacctgcttgagatggacgataagatcctagttgacttcagactatctaaaggggacggtttggaatttaagagacattttctcaagataaagggcaagttaattgacattgttagttctcagaagatttggctcccggctacctag

SEQ ID NO: 14536 - DNA, 1431 bp, Artificial Sequence
  Description of Artificial Sequence: Synthetic coding sequence
atggcagttccgtttgtcgaggactgggacctggtccagactcttggcgagggagcatatggcgaagtgcagctcgcagtcaacagagtcacagaagaggccgtggccgttaagatcgtggacatgaagcgggcagtggactgtccagaaaacatcaaaaaggagatctgcataaacaagatgctgaaccacgagaatgtggtaaaattctacggccacaggcgggaggggaacatccagtaccttttcttagagtattgttccggcggtgaactattcgacaggatagagcctgacattgggatgcccgaacccgatgctcagaggttctttcatcagctgatggcaggagtggtttacctgcatgggataggcattactcaccgtgacattaaaccggaaaatctgctgctggacgaacgtgacaatttgaagatctccgacttcggcctggctacggtctttaggtataacaatcgcgagaggttgctaaataagatgtgtggtaccctgccttatgtcgctcctgaactgctcaaacgcagggaattccacgccgaaccagtcgacgtctggtcctgtggcatagttctaacagccatgctcgccggggagttaccctgggaccagccctcagactcctgccaggagtacagcgattggaaggaaaagaagacttatctgaatccgtggaagaagatcgactccgccccactggcactgctacataaaatcttggtggagaacccatcagcccgcatcacaatccccgatattaagaaagatcgatggtacaacaaaccactgaaaaagggggcaaagcggccacgggttacgtctggcggcgtatccgaaagtccatccgggttttccaagcacatccagagtaatctcgacttttctcccgtgaactctgcttcaagcgaagaaaacgtcaagtactctagttctcaaccagaaccaaggactgggctttcactgtgggacacgtctccttcctacattgacaagctcgtgcaggggattagcttcagccagcctacatgcccagaccacatgttactgaattcccagcttctgggaactcccggctccagtcagaatccctggcagaggctagtgaaaagaatgactcgttttttcactaagctggacgccgacaagtcgtaccagtgtctcaaggaaacctgcgaaaaacttggttatcaatggaagaaatcctgcatgaatcaagtgactattagtacaaccgaccggaggaacaataaactgatctttaaggttaacctgttagaaatggatgataaaatcttggtcgatttccgactgtctaaaggggacgggttagagtttaagcgacacttccttaagatcaaagggaaactaatcgacatcgtttcaagccagaaaatttggctccccgcaacctag

SEQ ID NO: 14537 - DNA, 402 bp, Artificial Sequence
  Description of Artificial Sequence: Synthetic coding sequence
atggccgttccctttgttgaagactgggacctggtgcagaccttaggggaaggagcctacggagaagttcagctggctgttaatcgggtgactgaagaggccgtcgcggtgaagatcgtcgatatgaagagagcagttgactgccccgagaatattaaaaaggaaatctgtatcaacaagatgttgaatcatgaaaacgtcgtaaagttttatggccataggcgggaaggaaacatccagtacctcttcttggagtattgttctggcggggagttatttgacagaattgaacctgacattggcatgcctgagcccgatgcccagaggttttttcaccagcttatggctggcgtcgtttacctgcatggtattggaattacccatagagacattaaaccctag

SEQ ID NO: 14538 - DNA, 513 bp, Artificial Sequence
  Description of Artificial Sequence: Synthetic coding sequence
atggccgttccgtttgtcgaggattgggatctggtgcaaacgctgggggaaggtgcctacggcgaagtgcagctcgctgtgaatagagtcacggaggaggccgtcgcagttaaaatcgtggatatgaaacgggccgtcgattgccccgaaaacataaaaaaagagatatgcatcaacaagatgcttaaccatgaaaacgtcgtgaaattctatgggcatcggagagaaggcaacatccagtatctttttctagagtactgttcaggaggcgagctctttgacaggatcgagccagatattgggatgcctgagcctgacgcacagaggtttttccaccagctgatggcgggcgtcgtgtacttgcacggaatcggaataacgcatagggacattaaacccgagaacctgcttctggacgagcgggacaatttaaaaatctcagacttcgggcttgcgacagtgttccgatataacaatcgcgaacggcttctgaataagatgtgcggcacttag

SEQ ID NO: 14539 - DNA, 615 bp, Artificial Sequence
  Description of Artificial Sequence: Synthetic coding sequence
atggcagttcccttcgtggaggactgggatctggtacaaacattaggcgagggggcatacggggaagtccagcttgcggtaaaccgagtcactgaggaagcggtcgctgtcaagatcgttgacatgaagcgagcggtcgactgccccgaaaacatcaagaaagaaatttgcatcaataaaatgctaaaccacgagaacgtggtaaaattttacggccataggcgggaaggcaacattcagtacctatttctagaatattgctccggcggagaactgtttgacaggatcgaacctgacattggtatgcccgaacccgacgcccagaggttctttcatcagctgatggcgggggtggtttacctgcacggaatcgggatcacgcacagggacattaagcctgagaatctgctcctggacgagagggataaccttaagattagcgactttggtcttgccaccgtcttcaggtataacaaccgggagcggctactaaataaaatgtgcgggaccctgccctacgtggccccagagctgctgaagcgccgggagtttcacgcagagcctgtggatgtgtggtcctgcggcattgttctgactgcaatgctggccggatag

SEQ ID NO: 14540 - DNA, 129 bp, Artificial Sequence
  Description of Artificial Sequence: Synthetic coding sequence
atggccgtgccttttgtggaggattgggacctagttcaaaccctgggcgagggtgcctatggggaagtccaactggctgtaaacagagtgacagaagaggccgtggccgtaaagattgttgatatgtag

SEQ ID NO: 14541 - DNA, 1431 bp, Artificial Sequence
  Description of Artificial Sequence: Synthetic coding sequence
atggctgtgcccttcgttgaggactgggacctggtacagacattgggcgaaggtgcgtatggtgaggtccaactcgccgtgaatcgggtaaccgaggaggcagtggccgttaaaatcgtggacatgaaacgggcggtggactgccctgagaacattaaaaaagagatctgcataaacaaaatgctgaatcacgagaatgtggtcaagttttatggtcaccgcagggaggggaatatacagtatctcttcctggagtactgctcgggcggcgaactcttcgaccgaattgagcctgacattggaatgcctgaacccgatgcccaacgattctttcaccagctgatggctggagttgtttatctgcacggcattggaatcactcatcgcgatattaagcctgagaatttgctgcttgatgagagagataatttaaaaatttccgactttggactcgccactgtgtttcgctacaataatagggaacgactgctgaacaaaatgtgcggcacacttccatacgtggcacccgaactgttgaagcgccgagagtttcacgctgaacccgtggacgtatggagttgtggaatcgttctgaccgcgatgctcgcaggagagctgccctgggatcagcctagcgactcttgccaagaatacagcgactggaaagagaaaaagacgtacctgaacccatggaaaaagatagatagcgcccccctggcgcttctgcataaaatcttagtggagaacccttccgctagaatcacgatcccagacatcaagaaggaccgttggtataataaaccattgaagaagggggctaagaggcctcgggttactagcgggggagtctctgaatccccgtccggtttctctaaacacatccaatctaatcttgacttcagtcctgtgaattcggcgagctcagaggagaacgtcaaatactcatcttcccagcccgagccacgaacaggcttgagcctttgggacacatctccctcttatattgataaactggttcagggcatctctttttcacagcccacttgcccggatcacatgctgctgaatagtcaattgctgggcactcctggctctagccaaaacccatggcaacgacttgtgaagaggatgaccaggtttttcacgaaactggacgccgataagagttaccagtgccttaaggaaacttgtgagaaactcggctaccagtggaagaagtcctgcatgaatcaggtgaccatttccacaactgaccggagaaacaacaagctaatcttcaaggtgaatctcctggaaatggatgataaaatactggtggattttcgtctttccaagggcgacggtctggaatttaagcgccactttttaaagataaaggggaaacttatcgacatcgtcagtagccagaaaatctggctgcctgcaacatag

SEQ ID NO: 14542 - DNA, 384 bp, Artificial Sequence
  Description of Artificial Sequence: Synthetic coding sequence
atggctgtgcctttcgtagaggactgggacctagtgcagaccctgggagaaggagcatacggagaggtgcagttggccgtgaacagagttaccgaggaagccgtcgcggttaagatcgtggacatgaagcgagccgtcgattgcccagagaatattaagaaagaaatctgtatcaacaaaatgctgaaccatgaaaatgtcgtgaaattttatggccatcgacgcgagggcaacatacagtatctttttctggagtattgcagtgggggggagttgttcgatcgaattgagcccgacattggcatgcctgagccagacgcacagaggttcttccaccagctgatggcgggcgtcgtctaccttcatggcatcggcataacgtag

SEQ ID NO: 14543 - DNA, 1329 bp, Artificial Sequence
  Description of Artificial Sequence: Synthetic coding sequence
atggccgtgcccttcgtcgaagattgggatctggtgcaaactctaggcgagggagcctatggcgaagtccagttagctgtgaacagggtcacagaagaggctgttgctgtcaagattgtagacatgaagagggccgtggattgcccagaaaatattaaaaaagagatttgcataaacaaaatgctgaatcacgaaaatgtcgtgaaattctacggacatcgacgggagggcaacatccagtatctgtttcttgagtactgctctggcggcgagttgttcgacaggatcgaacctgacatcggaatgccagagcccgacgcccaaaggttctttcatcagcttatggccggcgtggtctatttacacgggatcggtataacccatcgcgacattaaacctgagaaccttctgctggatgaaagagacaatctgaagatttcagattttggtctggctaccgtattccgatacaataaccgcgagaggctgctgaataaaatgtgtgggacattgccttacgtcgcgcccgagctgttgaaaagacgagagtttcatgccgagcccgtggacgtgtggtcctgcggaatcgttctgaccgcgatgctggctggggaattgccatgggaccagccctccgactcttgccaagagtacagcgactggaaagagaagaagacatatttgaatccttggaagaaaatcgatagtgcccccttagctctactacacaagatcctggtcgagaatccttccgcaagaatcaccatcccagacataaagaaggatagatggtataacaaacctctcaagaaaggagcaaaaagacctcgcgttacctccggaggggtgagcgaaagtccatctggattttcaaaacacattcaatctaatctggactttagtcctgtaaactccgcctcttctgaagaaaatgtgaagtacagcagttcgcagcctgaaccgcgaacaggcctgagtttatgggacacctcccctagctatatcgataagctggtgcaaggaataagcttcagtcagccgacctgcccagaccatatgctgcttaacagtcagttactgggaactcccgggtccagccaaaatccatggcagagattggtcaaacggatgactagattttttacaaaactggacgctgataagagctaccagtgtctcaaggagacgtgcgagaagttgggctatcaatggaaaaagtcctgtatgaaccagggagacgggctcgagtttaaacgacactttctgaaaatcaaaggtaagttaattgacatcgtctcatcacaaaaaatctggctgcccgccacttag

SEQ ID NO: 14544 - DNA, 1632 bp, Artificial Sequence
  Description of Artificial Sequence: Synthetic coding sequence
atgagtagggagtccgatgttgaggctcagcagagccacggctccagcgcgtgtagccagccacatggctctgttactcagtctcaaggatcctcttcacaatcacaaggcatttcgtcatcctccacctccaccatgccgaacagctcccagagttctcactcctcttccgggaccctgagttccctggaaaccgtgtctacacaggagctgtacagtatacctgaagatcaagaacctgaagatcaagagccagaagagcctaccccagccccctgggcacgcctatgggcacttcaagacggctttgcaaatctcgagtgcgttaatgacaactactggtttgggagggataaatcttgcgagtactgctttgacgagcccctgcttaagagaactgataaatatcgaacctacagcaaaaagcactttagaatcttccgggaagtggggcccaaaaattcttatatcgcctacattgaggaccatagcggtaatggcacctttgttaacactgaattggtcgggaagggtaagcgccgccctctcaacaacaattcggaaatcgcgttgtcgctcagccgcaataaggtctttgtcttctttgatcttactgtggacgatcagtctgtatatcccaaagccctcagggacgagtacattatgtccaaaactctcggaagcggggcgtgcggcgaagtaaagttagcattcgagcggaaaacctgtaaaaaagtcgctatcaaaatcatcagcaagagaaaattcgcaatcggctcagcccgcgaagctgatcccgccctgaatgtggaaactgaaattgagatcttgaaaaagctgaaccatccctgcatcattaagattaagaacttcttcgacgcggaagattactacatcgtccttgaactgatggaagggggagaactattcgataaggtggtgggaaacaagagactgaaggaagcgacctgtaaactgtacttttaccagatgttgctcgccgtacagtatctccacgagaatgggattattcacagagatcttaaaccagagaatgtgctactgtcttctcaagaagaggattgcttgatcaaaattactgatttcggccattccaagatcctgggggaaacaagcctcatgcgtactctgtgcggtaccccgacatacctcgctccagaagtgctggtgtctgtaggtactgcaggctataacagagcggtcgattgctggtccctcggggtaattctgttcatctgcctgagtggttatcccccgtttagtgagcatcgcacccaggtttctctgaaagaccagatcacatctggaaaatacaacttcatcccggaagtttgggcagaggttagcgaaaaggcgctggatctggtgaagaaactcttggttgtcgacccgaaggctcgcttcaccaccgaagaagctctcaggcacccgtggctccaggacgaggacatgaagcgcaaattccaggatctactgtcagaagaaaacgagagcaccgcattgccgcaagtgttggctcaaccctcaaccagcagaaagagaccgcgagagggagaggccgaaggcgctgaaacaacaaaaaggccagccgtctgcgcggccgttctttag

SEQ ID NO: 14545 - DNA, 1545 bp, Artificial Sequence
  Description of Artificial Sequence: Synthetic coding sequence
atgtcccgggagtcagacgtcgaggcccagcagagtcatggcagctccgcttgtagccagccccacggtagcgtaacccaaagccagggttcctcctcacagagccagggaatttccagctctagtacctcgacaatgccgaactccagccaatcttcgcattctagtagcgggacgctctcctcgctggagacagtatcaacccaggagctctattcaatacccgaggatcaggaaccggaagatcaagagcccgaagaacctaccccagcaccatgggcacgactgtgggctctccaagacgggtttgcgaacctcgaatgcgtcaatgacaactactggttcggacgggataagtcttgtgagtactgctttgacgaacctctattaaaaagaactgataaatatagaacatattccaagaaacattttcgcatcttcagagaggtggggcctaagaacagttatatcgcatacatcgaggaccattcaggtaatggcacatttgtcaacaccgagttggtgggaaaaggcaagaggagacccctgaacaacaactccgagattgccctctccctgagccgcaataaggtttttgtttttttcgacttgactgtcgacgaccagagcgtgtaccccaaggccctgagggacgaatacatcatgagcaaaacgcttgggtccggagcatgtggtgaagttaaactcgctttcgagagaaagacatgtaagaaagttgccattaagattatcagcaagcggaaattcgccattggcagtgcccgggaagctgatcctgccctgaatgttgagaccgaaattgaaatcctgaaaaaattaaatcatccctgtattattaagatcaagaattttttcgatgcagaagattactacattgttctggagctgatggaaggtggagagcttttcgataaggtggtcggtaataaaagactaaaagaagccacatgcaaactgtacttctaccaaatgttgcttgcagtccagattacggattttgggcacagcaaaattttgggagagaccagtctcatgcgtaccctctgcggcactcccacctacttggctcccgaggtgctggtgtccgtggggactgcaggctacaaccgggccgtggactgctggtcattgggtgtaatacttttcatctgtctgagtggctatccccctttttcagagcacaggacccaagtgtcccttaaagaccaaatcacctccgggaagtacaactttattccagaagtctgggccgaggtttctgaaaaggccctggacttagtgaaaaaacttcttgtagtagatcctaaagcacggttcactaccgaggaggccttgcgacatccatggctgcaagatgaggatatgaaacggaaattccaggacctgctcagcgaggagaatgagtccacagcactcccccaggtgctcgctcagcccagcacctcaaggaagaggccgcgagagggcgaagctgaaggtgctgaaacaactaagcggcctgctgtctgcgcagccgtgctgtag

SEQ ID NO: 14546 - DNA, 681 bp, Artificial Sequence
  Description of Artificial Sequence: Synthetic coding sequence
atgagtcgcgagagcgatgtagaggctcagcaaagccacggctcatccgcatgtagtcaacctcacgggagcgtgactcaatctcagggctctagttctcaaagccagggcatcagctcatccagcacatctaccatgccaaactccagtcagagcagccactctagttcaggtactctttcttctctcgaaacagtgagcactcaggagctgtatagcattcctcctgaggtattggtaagcgtagggaccgccggatataaccgagctgtggactgctggtccttaggggtgattctctttatctgtttgagtggctaccctccttttagtgagcatcgaactcaggtgtctctgaaggatcagattaccagtgggaagtacaattttatccccgaggtttgggctgaggtgtcagaaaaggctttagacctggtgaagaagctgttggtggttgaccccaaggcccgctttactactgaggaagctctgaggcatccttggctacaagatgaggacatgaagcgaaaatttcaagatctattgtccgaagagaacgagtcaacagcactgcctcaggtgctggcacagccttctacaagtcgcaagcggcctcgagagggtgaagccgagggggctgagaccaccaagcggcccgccgtgtgcgccgcggtactctag

SEQ ID NO: 14547 - DNA, 492 bp, Artificial Sequence
  Description of Artificial Sequence: Synthetic coding sequence
atgagccgtgaaagtgacgtagaagcgcaacagtctcacggctcctctgcatgctcccagccccacggcagcgtgacacagtcccagggctctagttcacagagccagggtataagtagttcatccacgtcaaccatgcccaacagcagccagtcaagccactcgagctctggtactctgagctcactggaaacagtgagtacccaggaattgtacagtatccctgaagaccaggagcctgaggaccaggagcccgaggaaccaaccccggctccttgggctcgcttgtgggcgctccaggacggttttgccaatctgggggacgaggacatgaaacgcaaattccaggatctgctctctgaagagaatgagagcactgctctgccacaggttttagcccaaccttcaacctcccgtaaaaggcctcgggaaggagaggccgagggggctgagaccactaaacgaccagccgtgtgtgcagctgtgctatag

SEQ ID NO: 14548 - DNA, 870 bp, Artificial Sequence
  Description of Artificial Sequence: Synthetic coding sequence
atgtcccgcgagagtgatgtagaggctcagcaatcccatgggagctcggcctgcagccagccccatggatcagtcacgcagtctcagggttcttcgtcacagagtcagggaatctcctcatcttctacatcaactatgcccaactcttctcagagtagccattcaagctccggtaccctgtcctctctggagactgtttcaactcaggagctttactccattcctgaagaccaggagcctgaggaccaagagcccgaagaacccacaccggcaccatgggcccggttgtgggcccttcaggacgggttcgcaaatcttgaatgcgtcaatgataattactggtttggacgggataagagttgcgagtactgcttcgacgagccattgctgaaacgcaccgataagtatagaacttatagtaaaaaacacttcagaattttccgcgaggtgggcccaaagaacagctacatcgcctacatcgaggaccacagcggtaacggcacattcgtgaatactgagttggtgggtaagggcaagagacgaccattaaacaacaacagcgaaatcgcactgtctctctcacgaaataaggttttcgttttcttcgacttgactgtggacgaccagagtgtctatcccaaagcgctgcgggacgagtacatcatgtccaagaccctgggaagtggcgcctgcggcgaagttaaactggcatttgaaaggaagacatgcaagaaggtggcaattaagataatttcaaaaagaaaattcgctataggatcggcccgcgaggccgatcctgccctgaacgtggagacagagatagaaattctaaaaaaactcaaccatgacggacgaggccgcgccgtgtag

SEQ ID NO: 14549 - DNA, 1359 bp, Artificial Sequence
  Description of Artificial Sequence: Synthetic coding sequence
atgagtcgtgaaagcgatgtggaggcacagcaatcacatgggtcctctgcctgctcccaacctcatggttccgttacgcaaagccagggctcatctagtcagagccaaggcatctcttcctcttctacatctacaatgccaaactctagtcagagttcccactcatctagtggtaccctcagcagcctggagaccgtttccacgcaagaactgtattcaatacctgaagaccaagaaccagaggaccaggagcctgaggaacctactccagccccctgggcccgcttgtgggcactacaggatggtttcgcaaatttggtcttcgtctttttcgatctgacggtggacgatcaatctgtttatcctaaggccttgcgggacgagtacattatgtccaagaccttaggtagcggcgcatgcggtgaagtaaagcttgcttttgagcgaaagacttgtaagaaagtggccataaaaatcatttcaaaaaggaaattcgcaatcggatccgccagggaagcggatcctgcccttaatgtggagactgaaatcgaaatcctgaaaaagctcaaccacccctgcataatcaagattaagaatttctttgacgcggaagattactacattgtgctcgagctcatggagggcggcgagctgttcgataaggtggtcgggaacaagcgcttgaaggaggcaacatgcaaactgtacttctatcagatgctgctggccgttcagtacttgcacgagaatggcataatccaccgagacctaaagccagaaaacgtgctgctgtcaagccaggaggaggattgtctcatcaagataaccgatttcggtcattcaaagatactaggcgaaacgtctctcatgcggacattgtgcggcacccctacctacctggctccagaagtgctggttagtgtaggcaccgccggctacaatcgggcggtggactgctggtcccttggggtgatcttgttcatttgtctctctggctatccaccctttagtgagcacaggactcaggtgtcactgaaagaccaaattacctcaggcaagtataacttcatccctgaggtctgggccgaagtaagcgaaaaagcactagatttagttaaaaaattgctagtggtggatcccaaagcgaggtttactacggaagaggctctcagacatccatggttgcaggatgaggatatgaagcggaaattccaggacctcttatcggaggagaacgaatcaaccgctttaccgcaggtgctggcccagccttccacaagtcgaaagcggccaagggaaggcgaagccgaaggcgcagaaaccacgaaacggccagctgtgtgcgcggccgtgctgtag

SEQ ID NO: 14550 - DNA, 1761 bp, Artificial Sequence
  Description of Artificial Sequence: Synthetic coding sequence
atgtcacgggaatccgatgtggaagcacaacagtctcacgggagttcagcgtgctcacaaccccatgggtccgtcacgcagagccaggggtcctcatcgcagagccagggaatcagctcctccagcacaagcacgatgcccaatagttcacaaagcagccattcctcctcaggaacactgtcctcgttggagacagtttctactcaagagttatacagtattcccgaggaccaggaacctgaagatcaggaaccggaagaacctactcccgccccttgggcccggctctgggctttgcaggacggttttgcaaacctcgaaacagagagcggtcacgtaacccagagcgacctcgagctgcttttgagctctgaccctccggcttccgcctcacagagtgcaggaattaggggagtgagacatcacccccgccctgtttgctcactcaagtgtgtgaatgacaattattggttcgggcgagataaaagttgcgaatactgtttcgacgaacccctcctcaagaggactgacaagtaccgaacctattcaaagaagcatttcaggatattccgggaggtaggccctaaaaactcttatattgcatatatagaggaccacagcggcaacggaacatttgtcaacactgaactggtgggcaaagggaagcggcgcccactcaacaacaattcagaaatcgcattatccctttctcgtaacaaggtgttcgtgttcttcgacttgaccgtagatgatcagtccgtgtatcctaaggcccttcgagatgagtatatcatgtcaaaaacccttggttctggagcctgcggggaagtgaagctcgcatttgagaggaagacgtgtaagaaggttgccatcaaaattatatctaagcggaaattcgccatcgggtctgcgagggaggctgaccccgctttgaacgtggagactgaaatagagatattaaaaaaactgaatcatccgtgcattattaaaatcaaaaacttctttgatgctgaggactattatattgtgctagaactcatggaaggaggagaattgtttgacaaagtcgtgggaaataaaagattgaaggaggccacctgtaaactgtatttttatcagatgctgctggctgttcagtacctgcacgaaaacggcatcatccatagagacttgaaaccagagaatgttttgttaagttcacaagaggaggactgcttaattaagataactgatttcgggcacagcaagatcctgggcgaaacctcactcatgcggactctctgtgggacacctacctatctggcccccgaagtgcttgtgagcgtgggcactgctggctacaatcgggctgttgattgctggagcctgggagtcattctgtttatctgtctctctggataccctcctttttccgaacatcggacacaggtgagcttgaaggaccaaataacttctggcaaatataatttcatcccagaggtctgggctgaggtgtctgagaaggcgctcgatctggtgaagaaattgcttgttgttgacccaaaggccagatttacaaccgaagaggcactccgccatccatggttgcaggacgaagacatgaagaggaaattccaggatctgctttccgaagaaaatgaaagtacggctctgcctcaggttctcgcccagccctcaaccagccgaaagcgcccaagggagggggaagctgaaggcgccgagacaacaaaaaggcccgccgtgtgcgctgcggtgctgtag

SEQ ID NO: 14551 - DNA, 1545 bp, Artificial Sequence
  Description of Artificial Sequence: Synthetic coding sequence
atgagtagagaatctgatgttgaagcccagcagtcccacggtagctcagcttgctctcaaccgcacggaagcgtaacccagagccagggttcttcttctcagtcccaaggaatcagttctagctctacctcaaccatgcccaattcttcccagagctcccactccagctctggcaccctcagcagccttgagaccgtttccacccaagagctctactctatacctgaggatcaggaacccgaagatcaggagcctgaggaaccaacccccgcaccgtgggctcgtctctgggccttacaggatggttttgccaacctcgaatgcgtcaatgataactactggttcggtcgcgacaaaagctgcgaatattgctttgatgagcccctgctgaaacgcacagacaagtataggacttactctaaaaagcacttcagaatctttcgagaagtcgggcccaagaactcttacatcgcctacattgaggatcacagtggaaatggaaccttcgtgaacaccgaactggtgggtaaaggcaagagacgccctttgaacaataattcagagattgccctgagcctctcacgaaataaggtcttcgtgttttttgacctcaccgtggatgaccagtccgtgtaccctaaagccctgcgagacgaatacatcatgtctaaaaccctcggaagcggcgcatgcggggaggtcaagcttgccttcgaacgtaaaacatgcaaaaaggtggccattaagatcatttcaaagcgaaagttcgccattggatccgctcgggaggctgatcccgctctcaacgtagagaccgaaatcgaaatcttgaaaaaactgaaccatccctgtataatcaaaatcaagaactttttcgacgctgaggattattatatcgtcctggagcttatggaaggcggagagctgttcgacaaggtggtcgggaacaaacgcctcaaggaagccacttgtaaattatacttttaccagatgctcctggccgtccagattacagactttgggcatagcaagattctgggagagacttcactcatgcgcacactgtgcggaacccctacctatctggcacctgaagttttagtctcggttggtaccgccggatacaacagagcagttgactgctggagtctgggggttattttatttatctgcctgtccggctacccaccattttccgaacaccgtactcaggtgtcactcaaagatcagatcacctcggggaaatacaatttcatcccagaggtgtgggctgaggtcagcgagaaggccctcgatctggtcaaaaaactcctggtcgtagaccctaaggccagattcaccaccgaggaagccctgaggcatccatggctgcaggacgaggacatgaagcggaagttccaggatctgctgtccgaagagaacgaaagtacagccctgcctcaggtcctggcgcagcccagcacctccaggaagaggcctcgggagggagaggctgagggcgccgagaccacaaagaggcctgcagtgtgcgctgcagtgttatag

SEQ ID NO: 14552 - DNA, 1359 bp, Artificial Sequence
  Description of Artificial Sequence: Synthetic coding sequence
atgtcgagggaaagtgatgtggaggcccagcagtcccacggatcatcagcctgctctcagccccatggctcagttactcagtcacagggatcttcctcccaaagccaagggatttcaagttccagcacgagcaccatgcccaacagctcccaatcatctcacagcagctcaggtacattgagtagcctggagacagtctctacacaggagctatactccattcccgaggatcaggagcctgaggaccaggagcctgaagaaccaactccagctccatgggctagactctgggctctgcaggacggctttgctaatctggttttcgtattctttgatctgacagtggacgatcagtcagtatatccaaaagcacttcgggatgagtacataatgtcaaagactctcggcagcggcgcctgtggcgaggtgaagttggcgttcgagaggaaaacctgcaagaaggtggccataaagatcatctccaagagaaaattcgcgatagggtctgctcgggaagccgatcctgccctcaacgttgagaccgagattgagatacttaaaaagttaaaccatccctgcataattaaaatcaaaaacttctttgacgccgaagattattatattgtcttggagttgatggaaggaggggaattatttgataaggtagtcgggaacaagaggctgaaagaggctacctgtaagctttatttttatcaaatgctgctggctgtgcaatacctgcatgaaaatggaatcattcaccgcgatttaaagcctgagaatgtgctgctgagttcacaggaggaggactgcctgatcaaaattacagacttcggacacagtaaaatattgggggagacatccctgatgcggacactttgcggaacccctacttatttagccccggaggtgctcgtgtctgttggaacagctgggtataacagagccgtggattgctggagcctcggtgtaattctttttatttgcctgagtggttacccccctttttccgaacataggacacaagtctctctgaaagaccagataacttccgggaaatataactttattccagaggtgtgggccgaggtctcagagaaggcactggacctggtgaaaaaactgttggtcgtggaccccaaagcccgcttcactactgaggaggcactgcggcacccatggctgcaagatgaagatatgaagagaaagtttcaggacttactgagcgaagaaaacgagtcaacagcactgccccaagttcttgctcaaccatccacaagcagaaaacggcctcgagagggggaggccgagggggcggaaacaacaaagaggccagccgtttgtgctgccgttctttag

SEQ ID NO: 14553 - DNA, 1632 bp, Artificial Sequence
  Description of Artificial Sequence: Synthetic coding sequence
atgtccagggaatcagacgtggaagctcagcagtcccacggcagctctgcttgctctcagccccatgggtctgtgacacagtcccaggggagctcctctcaatctcagggtatatccagcagcagcacatctaccatgccaaacagcagtcagagttcccacagctctagcggtacactaagtagtttagaaactgtgagcacccaggagctctactcaattcccgaagatcaggagcctgaagatcaggaacctgaagagcccactcccgcaccgtgggctcgcctgtgggccttacaggacggattcgctaacctcgagtgcgtcaacgacaattattggttcgggcgggataagtcatgcgagtattgctttgacgagcctctgttgaaacgcactgacaagtataggacctatagcaaaaagcactttaggatctttcgtgaggtgggccctaaaaactcttatatagcctatattgaggaccattccgggaacgggacttttgtcaataccgagcttgttggcaaggggaagcgcaggccactgaataataattctgaaattgcactgtccctcagtcgaaataaagtcttcgttttttttgatttgacagtggacgatcaatcagtttacccgaaagcgcttagagacgaatacatcatgtctaaaactctcggcagtggggcctgtggtgaggtaaaactggcattcgaaagaaagacatgtaaaaaggtcgctatcaaaattatttccaagaggaaattcgccattggtagcgcacgtgaggcagaccctgcccttaacgtggaaaccgagattgagattctgaagaaactcaaccacccctgtataatcaagatcaagaatttcttcgacgcggaggactattatattgtgctggaactgatggagggtggcgagctttttgacaaagttgtgggcaacaagagactgaaggaggcaacctgcaaactgtatttctatcagatgctactggccgtccagtatctccacgagaatgggattatccaccgcgacctgaaacctgaaaacgtgctcctcagttcccaagaggaggattgcctgatcaagattactgatttcgggcattctaaaattctcggggaaacctcgctgatgagaacactgtgtggaacccccacctacctcgctcccgaggtgctcgtaagtgtgggaaccgccggatataatcgggcagtggattgctggagcctgggcgtgatactgtttatctgcctgagtggttatcctccattctccgaacaccgaacgcaagtctctcttaaggaccagatcacttccggtaagtataactttatccccgaggtctgggcggaagtgagcgagaaggccctggacctggtcaaaaaattattggtagttgatcccaaggcccgtttcacgacagaagaggcgctgcgtcacccctggcttcaggatgaggacatgaagagaaaatttcaggatctgctatccgaagagaatgagagcaccgccctcccccaagtgttggcccagccatcaaccagccgcaagcgtcctagagaaggagaagctgagggtgcggagactaccaagcgaccagccgtgtgcgcagctgtgctttag

SEQ ID NO: 14554 - DNA, 1632 bp, Artificial Sequence
  Description of Artificial Sequence: Synthetic coding sequence
atgagcagggagtccgacgtggaggcccagcagtcccatggcagctccgcctgcagtcaaccgcatggatctgtaacccagagccagggcagctcttcacagtcacaggggatctccagctcatctacgtcaaccatgcccaacagtagccagtcctcacactctagcagtggcacactttcttctctggaaaccgtaagcactcaggaactgtactctattccagaggatcaggaaccagaggaccaggagcctgaggaacctacacccgcaccctgggcccgcctgtgggctctccaggatggatttgcgaatttggaatgcgttaacgacaactactggttcggtagggacaagtcctgcgaatattgcttcgacgaaccgctattgaaaaggaccgacaagtaccggacctactccaagaagcactttagaatcttccgggaggtggggccaaaaaactcttacatcgcttatattgaggatcattcaggcaacgggacatttgttaacacggagttggtaggcaagggcaaaagacggccgctcaataacaactccgagatagcactttccctgagccgcaataaggtgtttgtcttttttgacctgactgtggacgatcaatctgtctacccaaaggccttaagggacgaatatatcatgtccaagacgctcgggtcgggagcttgcggagaggtcaaacttgccttcgaacgtaagacatgcaagaaggtcgccataaagatcatttcgaaaagaaaattcgctattggttctgctagggaggcagatccagctctgaacgtagagactgagattgagattctaaaaaagctcaaccacccatgcatcattaagatcaaaaatttttttgacgcagaggattattacatcgtgctggagctcatggagggtggtgagctgttcgataaggtcgtggggaataaacgtctgaaagaggctacatgtaaactctatttctatcagatgctcttagctgttcagtatctgcatgagaatggcatcatccatcgggatttaaagccggagaacgttctgctttctagccaagaggaagactgcctaattaaaataaccgatttcggccactcaaaaattttaggggaaacgtccctcatgcgcactctgtgtggaacacccacctatctggccccggaggtcctagtttctgtgggtaccgctggctataatagggcggtggattgctggagcctcggagtgattcttttcatctgcttgagtgggtatcccccattcagcgaacacagaacacaggtaagtctcaaggatcaaattacctcaggtaagtataacttcattcccgaagtgtgggccgaggtgtctgaaaaggcactagaccttgtgaagaagctgctggttgttgatccaaaagccaggttcacaaccgaagaggccctgagacacccctggcttcaggatgaagacatgaaacgtaaatttcaggacttactgagtgaggagaacgagtcaactgctctcccccaagtgctagctcaacccagcacatcaaggaagagaccacgagaaggcgaagctgaaggggcagagaccaccaagagacccgccgtgtgcgcagccgtactttag

SEQ ID NO: 14555 - DNA, 969 bp, Artificial Sequence
  Description of Artificial Sequence: Synthetic coding sequence
atgagcaaaactcttggatccggggcctgcggggaggtgaaactcgcctttgagagaaagacttgtaaaaaggttgccattaagataattagcaaaagaaagtttgctatcggcagcgccagagaagccgacccagccctgaacgtcgaaactgaaattgagatactgaaaaagttgaaccatccttgtattattaagatcaagaattttttcgatgcagaggactattatatagttctggagcttatggaaggcggggaattgtttgacaaagttgtgggcaataagagactcaaggaggccacatgcaaactgtatttctaccagatgctgctcgccgtacagtatctacatgagaacggcattatccatagggacctgaaacccgaaaatgtactcctgtcttcccaggaggaagactgcctgataaaaatcaccgatttcggccacagtaaaatcctgggggaaacaagcttgatgcgaacactatgcgggaccccaacatacctagcgcctgaagtgctggttagcgttgggaccgccgggtacaatcgggccgtagactgctggtccttgggcgtgatcctgtttatttgcttaagcggatatcccccctttagcgagcacaggacacaggtgtctcttaaggatcagataacaagcggtaagtataacttcatacccgaagtatgggcagaggtgtcagaaaaggcactcgatctggtcaagaagctgctggtggtggaccctaaagctagatttacaacagaggaagctcttaggcacccatggctccaggatgaggacatgaagcgaaagtttcaggacctgctgagcgaagagaacgagtccaccgctctgccccaggtattagcacaaccctcgacaagccgcaagcgcccacgcgagggggaggcagaaggggctgaaaccacaaagcggcctgctgtgtgcgccgccgttctgtag

SEQ ID NO: 14556 - DNA, 624 bp, Artificial Sequence
  Description of Artificial Sequence: Synthetic coding sequence
atgtcccgagaaagcgatgttgaagcgcagcaatcccacggcagcagcgcatgctcgcagccgcacgggagcgtcacacagagccaaggcagtagctctcagtcccagggaatttcttcgtcaagcacgtctaccatgcccaactcctctcagtcatcacactcatccagcggaaccctgtccagcctggagacggtgtcaacacaggagttgtatagtattcctgaagaccaggagccagaggatcaggagccggaggagccaacccccgcaccttgggcccggctgtgggccctacaggacggatttgccaatctggaatgcgtcaacgataactattggtttggcagagacaagagctgcgaatactgctttgacgagcctctgctgaaacggactgacaagtatcgcacctacagcaaaaagcactttaggatcttccgggaggtgggaccgaagaatagttatatcgcgtatatcgaggatcacagcggcaatgggacctttgtgaacaccgaactggtcggcaaaggaaaacgccggcccctgaacaacaactccgaaatcgcactatctctcagccgcaataaagagaaaattctgaagatatactctttatcttag

SEQ ID NO: 14557 - DNA, 294 bp, Artificial Sequence
  Description of Artificial Sequence: Synthetic coding sequence
atgaaagtcagcgccgcccttttatggcttctcttgatcgcagccgcattttccccacagggattggctgggccagcttcagtgccaaccacatgctgtttcaatctggcgaatagaaagatccctctgcagcgcctcgaatcatataggcgcataacctccggtaaatgccctcaaaaagctgtgattttcaaaacaaaattagctaaggatatttgtgccgatccaaagaaaaaatgggtgcaagactctatgaaatatctcgaccagaagtctcccacacccaaaccctag

SEQ ID NO: 14558 - DNA, 1692 bp, Artificial Sequence
  Description of Artificial Sequence: Synthetic coding sequence
atgagccgcatcggcggggcaggactgcctgccgcggccctaacaggacctgggaggtttcggatggcacgggaagagcctgcccccgcggcactcgccgctgctggacagcccggaggtgggcgagggggcgagcgagcactgcagggaccaggagtagcgcgtcgcgggaggccaagtttgtcgcgagctaagctgcacggattgcgtcatatgtgcgcgggtcgaaccgctgctggaggatctttccagagacgcgctctgtgggtgctcgccttttgtacgtccttcggcttactgttgagttggtcctccaataggctgctgtactggctttcatttccttctcacacacgggtccatcgagaatggtcaagacaactgccctttcccgccgtgaccgtctgtaacaacaacccgctgcgattcccccgactttcgaaaggcgatctgtattacgctgggcactggctagggctgttgttgccaaacaggacagccagaccgctagtcagcgaattgctgagaggagatgagccacgacgtcaatggttcaggaaactggcggacttcaggttgtttctccctccacgccactttgaggggatctccgccgctttcatggatagactgggccaccagcttgaggacatgttgttgtcatgcaaatataggggcgaactgtgtgggccacacaacttttctagtgtgttcacgaagtatgggaaatgttatatgttcaacagtggggaggacggcaaaccactgttgacaactgtgaagggaggcaccggaaacgggctcgagatcatgctggacatccagcaggacgagtatctgccgatttggggggaaactgaggaaactacattcgaagcgggtgttaaagtccagattcattcccagagcgagccgccttttatccaggagctcggctttggtgttgcgcctggtttccagactttcgtcgccacgcaggaacagcggctcacataccttccccctccctggggcgagtgtagaagctccgagatgggcctggattttttccctgtttactccattaccgcatgtcggattgattgtgaaacacggtacatcgtagaaaattgtaactgccggatggtccatatgccaggggacgcacctttttgtacacccgaacaacacaaagagtgtgccgaacccgcccttggtctcctggccgaaaaggacagtaattattgcttgtgtcgaacaccatgcaatcttacccggtacaataaagaacttagcatggtcaaaatcccctctaagacatctgcaaagtatctagaaaaaaaattcaacaagtccgagaagtatatctctgagaatatcctggtgttggatattttctttgaagcattgaactatgagaccatcgagcagaagaaagcttatgaggtcgctgccctgctcggggacataggtggtcagatggggctgtttatcggagcatccattctcaccatcctggaactgttcgactatatctacgagcttattaaagagaagcttcttgatttactcggcaaagaggaagatgaaggctcacacgatgaaaatgtgagtacatgtgacacaatgccgaaccattccgaaacaatatcacatactgtcaatgtcccactgcagaccacgcttgggaccctcgaggagatcgcttgctag

SEQ ID NO: 14559 - DNA, 2328 bp, Artificial Sequence
  Description of Artificial Sequence: Synthetic coding sequence
atggtcgggcccgaagatgccggagcttgttcaggccgcaatcctaagcttctcccagtccccgccccagatcccgttggtcaggatcggaaggtaattcgggccaccggaggcttcggcggtggtgttggggcagtggagccacctgaggaagctgacgaagaggaagaggctgatgaggaggaagagacgcccccaaggcaactgctgcagaggtacttagcagcagccggcgagcagctggagccaggtctgtgctattgtcctctccccgcgggacaggcaggggctccgcctccctcagcagccccccgaagcgatgcatgtctgctgggctcggggagtaagcatcgaggagccgaggttgccgatggccgggccccccgtcacgagggtatgactaacggggatagcggcttcctgcccgggcgggactgtagggaccttgaggaagcccgcggactagctcgggctggcggacgcgaatctagacgtaggagaccttacgggcgcctcagactagaaggtcctggggatgaagacgcagacggggccggatctccttctgattgggcgagcccactggaggacccgcttcgaagttgttgccttgtggctgctgatgcccaggagccagagggcgccggctccgactcaggtgactcacccgcttcttcatgctcctcatcagaggatagtgaacagaggggtgtgggtgcaggcggccctgaggaaggcgccccaccagccacaagcgcggaaaggactaatgggggggccgagccacgcctcggctttagcgacatccacttcaactcacgaaatacgtttcaggtctctcgcggtcaaagcgcacgcgatcatctcccccctgccggtcctcctgtgccactgcctgctgcggagcagggtcccgccggcgcgtccgcccgcgctagaagatcaggcggatttgctgatttcttcacacgaaacttgtttccaaaaaggactaaggagctgaagtcagtcgttcatagcgccccgggatggaaactgtttggtaaagtccccccaagagagaatttgcagaagacaagcaaaatcatccagcaggaatacgaggcacgcacaggccgaacgtgcaagcccccacctcagtcttccagaaggaaaaattttgagttcgaaccgcttagcacgacagccctgatactggaagatcgcccgtctaatctcccagcaaagtcagtggaggaggccctacgacatcggcaggagtacgacgagatggttgccgaagctaaaaagagggagattaaagaggcgcacaaacggaagcgaatcatgaaggaaaggttcaaacaggaagagaacatcgcgtccgcaatggtaatctggatcaacgagattctgcctaattgggaagttatgagatccactagacgtgtgagagaactgtggtggcaagggctgccccccagcgtgcgcggcaaagtctggtcactggcggttggaaacgaactgaacatcacgcccgagctttatgagatctttttatcgcgggctaaggagcgatggaagtctttttctgaaactagttctgaaaatgatacagagggtgtatccgtagccgacagggaggcatcactggagttgatcaagctcgatatcagccggactttccccagcctctacatttttcagaaggggggcccttatcatgacgtactgcactcaatcttgggggcttacacgtgctacagaccagatgtggggtacgtgcagggaatgtcctttatcgcagcagtgctcatccttaacctggaggaggctgacgcattcatcgctttcgctaacttgttgaataagccatgccagctagcctttttccgcgtagatcactctatgatgcttaaatattttgcgaccttcgaggtcttctttgaagagaatctcagtaaactgttcctgcactttaaatcttatagcctgaccccagacatctatttaattgactggatttttacactttacagcaaatctctaccactcgatctggcatgcagagtttgggacgttttttgccgcgacggggaagagttcctatttagaactggtttaggaattttgagactgtatgaagacatactgctgcagatggacttcatccatatcgcacagtttttaaccaagctaccagaggatatcacatccgagaaacttttttcatgtattgcggctatccagatgcagaacagcacaaaaaagtggacccaggtgttcgcctctgtgatgaaagacattaaggagggtgacaaaaatagtagccctgctttgaagtcttag

SEQ ID NO: 14560 - DNA, 276 bp, Artificial Sequence
  Description of Artificial Sequence: Synthetic coding sequence
atgaaagtatcagcggccgcgctggccgttattctgatagccactgccctgtgcgcccccgcttccgcttctccttatagctctgacacaactccctgttgttttgcatatatcgcccgaccactacctagggctcatatcaaagaatacttctatacctctgggaagtgtagtaatccagccgttgttttcgtgacgcgcaagaataggcaagtctgcgccaatccagaaaagaaatgggtccgagagtacattaattcattggagatgtcatag

SEQ ID NO: 14561 - DNA, 276 bp, Artificial Sequence
  Description of Artificial Sequence: Synthetic coding sequence
atgaaagtgagtgccgctgctctcgctgtgattcttatcgctaccgcactttgcgcccctgcctccgctagcccatatagttcggataccacaccttgttgctttgcatatatcgcaagacctctgccccgagcacacatcaaagagtacttctatacctctggcaaatgttccaatccagctgttgtattcgtcacgcggaaaaatagacaggtctgcgccaatcccgaaaaaaaatgggtccgggagtacatcaatagcctggaaatgtcctag

SEQ ID NO: 14562 - DNA, 300 bp, Artificial Sequence
  Description of Artificial Sequence: Synthetic coding sequence
atgaaggcctccgctgccctgctttgtctcctgctgaccgcagccgccttttcaccccagggactggcacagccagtggggattaatacgagcaccacttgttgctaccgcttcatcaacaagaaaattcccaaacagagactggagtcataccggaggactacctcatcgcattgtcctcgagaagccgtgatcttcaagacaaagttggacaaagagatctgcgcggaccctacgcaaaaatgggtgcaggacttcatgaagcacctggacaaaaagacacagacccccaagctctag

SEQ ID NO: 14563 - DNA, 330 bp, Artificial Sequence
  Description of Artificial Sequence: Synthetic coding sequence
atgtggaagcctatgccctcaccttctaatatgaaggcaagcgcggctcttctgtgtcttcttctgacagcagctgctttttcaccacagggtctggcccagccagtgggcatcaatacctccacaacgtgctgttaccgctttattaataagaagatacctaaacagagactggagtcctatcgaagaaccacttccagtcattgcccacgggaagctgtaatctttaagacgaaactggacaaagagatctgcgctgacccgacgcaaaaatgggtgcaagattttatgaaacacctggacaagaaaactcagacccccaaactgtag

SEQ ID NO: 14564 - DNA, 276 bp, Artificial Sequence
  Description of Artificial Sequence: Synthetic coding sequence
atgtggaaaccgatgccgtcaccgagcaacatgaaggcgagcgcagcactcctctgcttgctacttactgcggcagcgttttccccccaaggacttgcacaacctgagcggcctagaacacacccacagtggacctttcttctcgtggtctcactccagctcggacttattcttcaattgccagctgccaccgacctctccataagaaagtctctttcccgagggtggcgggcaaccgaaggtccaccagtggctacagtccccggtaagctgtag

SEQ ID NO: 14565 - DNA, 174 bp, Artificial Sequence
  Description of Artificial Sequence: Synthetic coding sequence
atgtggaagccaatgccaagtccctctaacatgaaagcttcagctgctcttctttgcctcctgctgactgctgctgctttctccccccagggactggcgcagccggcatctaggcccaattggactcgaagatctgtgctcacccctcataggagcggctcccgaacactttag

SEQ ID NO: 14566 - DNA, 297 bp, Artificial Sequence
  Description of Artificial Sequence: Synthetic coding sequence
atgaatcaaacagccattctaatctgttgcctgatctttctgactctatcgggcatccagggcgtgcctctgtcaagaaccgtgagatgtacctgcatctctatttccaaccagcccgtcaacccacggagtctggagaaactggagattatcccggcctctcagttctgtccacgggttgagatcattgccactatgaaaaaaaagggggaaaaaagatgtctgaatcctgaatctaaagccataaagaacctgctaaaagccgtgagcaaggagaggtcaaaacgttctccatag

SEQ ID NO: 14567 - DNA, 270 bp, Artificial Sequence
  Description of Artificial Sequence: Synthetic coding sequence
atgaacgccaaagttgtggtcgtgctggtgctggtgttgacagcactgtgcctaagtgatggcaagcccgtgagtttgtcttataggtgtccctgtagatttttcgaatcacatgtcgcccgggctaatgtcaaacatttgaagattctgaatacccccaattgtgcgctgcagatcgtagctagattaaagaataacaacagacaggtgtgtatcgatccgaagctaaagtggatccaagaatacctggagaaagccctcaataaatag

SEQ ID NO: 14568 - DNA, 360 bp, Artificial Sequence
  Description of Artificial Sequence: Synthetic coding sequence
atgaatgctaaggtggtggtcgtgctggttttggtgcttacagccctctgtctgagtgacggcaagccagtttcactgtcctatcgttgcccatgtagattttttgagtctcatgtcgcccgggccaacgtaaaacacctgaagatactgaatacgcctaattgcgcactacagatcgttgcgcgcctcaagaataacaaccgccaggtgtgtattgatccaaagctcaaatggattcaggagtacctagaaaaggccctgaataagggtcgacgggaagaaaaagttggtaagaaggagaaaattggcaagaagaagcggcaaaaaaagcgtaaggccgcacaaaagagaaagaactag

SEQ ID NO: 14569 - DNA, 282 bp, Artificial Sequence
  Description of Artificial Sequence: Synthetic coding sequence
atgaacgctaaggtggtggtggtcctcgtattggtcttgactgccctgtgccttagcgacggcaaacctgtgtcattgagttaccgctgtccttgccgcttcttcgaaagtcatgtggcaagggccaacgtcaagcacttgaagattctgaacacccccaattgcgccctgcaaatcgttgctcggctcaagaacaacaaccgacaggtgtgcattgatccgaaactgaaatggattcaggagtatctggagaaggccctgaacaaaagattcaagatgtag

SEQ ID NO: 14570 - DNA, 423 bp, Artificial Sequence
  Description of Artificial Sequence: Synthetic coding sequence
atgaatgcaaaagtcgtggtagtcctggtcctggtgctgaccgctttatgtctatccgatggcaagcctgtttcccttagctacagatgtccttgccgattttttgagagccacgtagcacgcgctaatgtcaagcacctgaagatactaaataccccaaactgcgcactgcagattgtggctcgtctcaaaaacaataatcggcaagtgtgcatagatccaaagttaaaatggatccaggaatacctcgaaaaggcccttaacaatctgatttcggctgctcctgcaggcaaacgtgtcattgcaggtgcacgggccttgcaccctagtcccccccgggcatgtccaacggccagagctctgtgcgagatacgcctttggccccccccggagtggtcttggccatcccccggagacgtctag

SEQ ID NO: 14571 - DNA, 273 bp, Artificial Sequence
  Description of Artificial Sequence: Synthetic coding sequence
atgaatgctaaagttgttgtggttctggtcctcgttttgacagccctatgcctgtcagatggaaaaccagtatcactgagttatagatgtccatgccgcttctttgagtctcacgttgcaagggccaacgtcaagcacctgaaaatcctaaacactccgaattgcgcccttcagatcgttgcccggctgaaaaataataacaggcaggtttgtatagacccgaagctcaagtggatccaggaatacctagagaaagcgctaaataactgttag

SEQ ID NO: 14572 - DNA, 330 bp, Artificial Sequence
  Description of Artificial Sequence: Synthetic coding sequence
atgaagttcatcagtacatcgctgttactcatgctcttggtttcctccctcagccccgtgcagggtgtattggaggtgtattacacctctctgcggtgtcgctgcgtgcaggaatcgagtgtgtttatcccacggagattcatagataggatccagatactgcccaggggaaatggctgcccgagaaaagagatcattgtgtggaaaaagaataagagtatagtgtgcgtggatcctcaagccgagtggatccagcgtatgatggaggttctgcgcaagcggtcaagctcaaccctgccggtgcctgtgttcaagcgcaagatcccgtag

SEQ ID NO: 14573 - DNA, 1560 bp, Artificial Sequence
  Description of Artificial Sequence: Synthetic coding sequence
atgttcttgcttcccctcccagctgccgggagagtcgtggtgcggcgcctggcagtccgccgcttcggtagcagatccctcagtacagctgatatgacaaagggactggtactcggtatctactcaaaagaaaaggaggacgatgtcccccagtttacctctgccggcgagaacttcgacaaactgctcgccggcaagctacgtgagacgttgaacattagtgggccaccactgaaggccggaaaaacccgcacattctatggcttgcaccaggatttcccctctgtcgtgcttgtcgggctgggaaaaaaggctgctgggatagatgagcaggagaactggcacgagggaaaagaaaacatcagggccgcggtggccgcagggtgcagacagatccaggatctggagttgtcctcagtggaggtggatccttgcggcgatgctcaggcagccgccgagggcgctgttctcggactctacgaatatgatgatctgaaacagaagaagaaaatggccgtgagcgctaaactgtatggttccggtgatcaggaggcatggcaaaagggggtcctgttcgcttctggtcagaatctggccagacaactgatggagaccccagctaacgagatgaccccaacgcgcttcgcggagatcattgaaaagaatcttaagagcgcctcctcaaagaccgaagtgcacatacgacctaagtcatggatcgaggagcaggccatggggtcatttctgagcgttgccaagggatctgacgagcctcctgtcttccttgaaattcactataaaggtagcccgaatgctaacgagccccctctcgtcttcgtcggcaagggtatcactttcgattccggcggtatcagcatcaaggcttcggcaaacatggacttgatgcgggccgatatggggggcgctgccaccatctgctctgcaatcgtcagcgccgccaagttaaatctgcctatcaacataataggcctggcccccctgtgcgagaacatgccaagtgggaaagccaataagcccggtgacgtggtgcgggccaaaaatggtaagactatccaggttgacaacaccgacgccgaaggtaggctcatactggcagacgccctgtgctatgctcacactttcaatcccaaagtaatcctcaacgctgcaactctgaccggtgcaatggacgtggccctggggtccggtgcaacgggggtattcacaaacagttcttggctttggaataaactgtttgaggcatccattgaaaccggagatagggtttggcggatgccactgttcgaacattatactagacaggtggtggactgtcagctggcagatgtgaataatatcgggaaataccgctccgccggggcgtgtaccgcagcagccttccttaaagagtttgtgactcatcctaaatgggcacacctcgacatcgctggcgtcatgaccaacaaggatgaggtgccttaccttcgcaaggggatgacagggagaccaactcggacactgatcgagtttttgttacgattttctcaagataatgcttag

SEQ ID NO: 14574 - DNA, 378 bp, Artificial Sequence
  Description of Artificial Sequence: Synthetic coding sequence
atgaagaaaagcggcgtcctgttcttgttgggcatcattctgttggtgctgataggtgtacagggtactccagtcgttagaaagggccggtgctcctgcattagtactaaccaaggaaccatccacctgcaatccctgaaggacctcaagcagttcgccccatcaccatcatgcgaaaagattgagataattgctaccctgaagaacggagtgcagacttgtcttaaccctgactcggccgacgtgaaagagctgatcaagaagtgggagaagcaggtgtctcagaagaagaaacaaaagaacgggaagaagcatcagaaaaaaaaggtgctgaaagtgagaaagtcccagaggagccgccaaaagaagaccacgtag

SEQ ID NO: 14575 - DNA, 1083 bp, Artificial Sequence
  Description of Artificial Sequence: Synthetic coding sequence
atggaggacttcaacatggagagcgactcgtttgaggacttttggaagggagaggatctcagcaactattcctatagctctaccctgccaccttttctattggatgcagccccctgcgaaccagaaagtttagagataaataagtattttgtcgtcatcatttatgctttagtgttcctactgtctctgctgggcaacagtctcgtgatgctggtgattctctattccagggtgggaaggagcgtcactgatgtttacttgttaaacttggccctggccgacctcttattcgcgctgaccctcccaatttgggcagctagcaaagtcaatgggtggattttcggtacctttctgtgcaaagtcgtgagtctgctgaaggaggtcaatttctatagcggtatactgttgctggcatgtatttccgtagacagatatctcgcaatagttcatgccaccaggacattgacgcagaagcggtatctggtcaagtttatttgtctgtccatctggggcctgtccctgctgcttgcacttcccgttctgttgttccggcggaccgtctacagcagcaatgtgtctcccgcatgctatgaagacatggggaacaatactgcaaactggaggatgctactccgaatcctcccccagtctttcgggtttatcgtgcctctgttgatcatgctgttttgttatggtttcacacttaggaccctatttaaggcccatatgggtcagaagcaccgtgctatgagggtcatttttgctgtggtcctgatctttctcctttgctggctcccatacaacctcgtattactggctgatacactaatgagaactcaggtcatacaggaaacctgtgagagacgtaatcacatcgacagggcactggatgctaccgagattttgggaattctccactcttgcctgaacccattgatttatgcattcatcggccaaaagtttaggcatggcctgctcaagatactggcgatccatggcctgattagtaaagactccttacctaaggactctcggccttcctttgttggatcctcctccgggcacacgtcaacgactctgtag

SEQ ID NO: 14576 - DNA, 417 bp, Artificial Sequence
  Description of Artificial Sequence: Synthetic coding sequence
atggaggacttcaatatggaatccgatagcttcgaggacttctggaagggggaagaccttagtaattattcatattccagtacactgccgcctttcttgctggatgccgcgccctgcgagccagagagcttggagatcaacaagtattttgtggtgatcatatacgcactcgtgttcctcctctccttgctgggaaactctttggtaatgctcgtgatcctctactcacgcgtcggccgctccgttactgatgtgtaccttctgaacttggccttggcggatctgctgttcgctctgactctgccaatctgggccgcgagcaaggtgaacgggtggatcttcggaacctttctgtgcaaagtcgtgtcactgctgaaagaggtgaacttttactccgggattttactgctggcatag

SEQ ID NO: 14577 - DNA, 48 bp, Artificial Sequence
  Description of Artificial Sequence: Synthetic coding sequence
atggaagacttcaacatggagtccgactccttcgaggatttttggtag

SEQ ID NO: 14578 - DNA, 519 bp, Artificial Sequence
  Description of Artificial Sequence: Synthetic coding sequence
atggaggacttcaacatggagtccgacagcttcgaggacttctggaagggagaggatctaagcaattacagctatagcagcaccctgcccccattcctcttagacgccgcgccctgtgagccggagtccctggagattaataaatattttgttgtcatcatatacgccctcgtgttcctgctctctctgctcggtaattcactggtcatgctggtcattctgtatagccgcgttggccggagcgtcactgatgtctatctcctcaatctcgccctggctgacttgctcttcgccttgactcttccaatctgggctgcttccaaagtgaatggatggattttcggaacttttttgtgcaaggtggtgtccctgctgaaggaggttaatttctactccggcatcctccttcttgcatgtatttccgtggatcgctacctcgctatcgttcacgccactaggaccttgacacagaaacgatacttggtcaagttcatttgcctcagcatctggggcctgtag

SEQ ID NO: 14579 - DNA, 48 bp, Artificial Sequence
  Description of Artificial Sequence: Synthetic coding sequence
atggaggatttcaacatggagtctgatagtttcgaagatttctggtag

SEQ ID NO: 14580 - DNA, 606 bp, Artificial Sequence
  Description of Artificial Sequence: Synthetic coding sequence
atggaggattttaatatggagtcagattcttttgaggatttttggaagggcgaggacctgtccaactactcttacagcagcacacttccaccctttctacttgacgcagcaccatgtgaacccgaaagtctggaaatcaataagtattttgtagtgatcatctacgccctggtatttctgctttcactacttgggaatagtcttgtaatgttagtgattctgtattcaagagtggggcggtcagttactgatgtctatttactcaatctggccttggccgacctgctgtttgcgcttacgcttccaatttgggcggcatcgaaagtgaatggttggattttcggaacattcctttgtaaggtggtatccttgctaaaggaagtgaatttttacagcggtatcctgttgctggcctgcatctccgtggaccgatacctcgcgatcgtccatgccacccgcacactcacccagaagagatatctggtgaagttcatctgcctatcgatatggggactgtccctactgctggctctaccagtactcttgttcagacgcaccgtgtattcatccaacgtgtccccagcatgctatgaggatatggggtag

SEQ ID NO: 14581 - DNA, 411 bp, Artificial Sequence
  Description of Artificial Sequence: Synthetic coding sequence
atggaagattttaacatggagagcgattccttcgaggacttttggaagggagaggacctctctaattattcgtacagcagcaccctgccccctttcttgctggatgccgccccctgtgagcccgagtctctggagataaataaatactttgtcgttattatctatgccctagtgttcctcctcagcttgctcgggaactctctggtcatgctggtcattctctactcacgagtcgggaggtcggtgactgacgtttatctgctaaacctggccctggctgatttactgttcgcactcacactccccatttgggccgcaagcaaagtcaatggatggatattcggcacgtttctgtgtaaggtcgtttccctcctcaaggaggtgaatttttacagcggaatcctgctgtag

SEQ ID NO: 14582 - DNA, 1059 bp, Artificial Sequence
  Description of Artificial Sequence: Synthetic coding sequence
atggaaggcatctccatctacacctctgacaactataccgaagaaatgggatcaggcgattacgactctatgaaagagccgtgtttcagagaggaaaacgccaacttcaataagattttcttgcccacaatctactccattatattcctaacaggaatcgtcgggaatggcttagtgattctggtgatgggctatcagaaaaaactgaggtcaatgaccgacaaataccgtttacatttgtcggtggctgacctattattcgttatcactctgcctttttgggccgtcgacgccgtggcgaactggtacttcgggaactttctttgtaaagccgtgcacgtaatttacaccgtgaacctttactcttctgtgctaattctggctttcatttcccttgatcgatatctcgctatcgtgcacgccaccaactcccagcgtcctagaaagctgcttgcagaaaaagttgtgtacgtgggagtctggattcccgccttgttactgacaatacccgatttcatatttgctaatgtgagcgaagccgacgacaggtatatttgtgatcggttctacccaaatgacttgtgggtagttgtatttcaattccaacacataatggtaggcctgattttgcctggaatcgtgattctctcctgctactgcatcatcatctcaaagctgtctcacagtaagggtcatcaaaaaagaaaagcacttaagaccacagtcatcctcatcctagcatttttcgcatgttggcttccctactatatcggaatcagcatcgatagcttcattctgctggagatcatcaagcaggggtgtgaatttgagaatacagtacacaaatggatcagtatcaccgaggcactcgccttctttcactgttgcctcaacccaatcttgtacgcgttcctcggtgccaagtttaagacgagcgcccagcacgccctgacgtctgtgtcccggggctcatctctgaagattcttagcaaagggaagaggggcggacattcctccgtttccactgagtctgaatcttctagcttccattcttcgtag

SEQ ID NO: 14583 - DNA, 1071 bp, Artificial Sequence
  Description of Artificial Sequence: Synthetic coding sequence
atgtcaatcccactgcccctgttgcagatatacacttccgataattacaccgaggagatgggttcaggcgactacgacagcatgaaggagccttgcttcagagaagagaatgccaactttaataagatctttctcccgactatttattcgattatatttctaactgggatagttggtaacgggctggttatactggtcatgggttaccagaaaaaactgcggtctatgactgataaatacaggcttcatctaagcgtcgcggatctgctgtttgtgatcactcttccattctgggcagttgatgccgtggcaaactggtatttcggcaatttcctgtgcaaggcggtccacgtcatctataccgtgaatctttattccagtgtgctcatacttgcttttatcagcttggatagatacttggctattgttcacgccacgaattctcaacggccccgaaagctgcttgccgagaaagtggtttacgttggggtgtggatccctgccctgttgctcacaatccccgacttcattttcgcgaacgtgagcgaagccgacgaccggtacatctgtgatcggttctatcctaatgatctatgggtagtggtttttcagtttcagcatatcatggtgggcttgatcctgccaggaatagtgatcctctcctgctattgcataattatcagtaagctgtctcacagtaaagggcatcaaaagcgcaaggccctgaagaccaccgttatcttgatcttagctttcttcgcctgttggctgccctactacatcggcatcagtattgactctttcattctattggagattataaaacaaggctgtgaattcgagaacaccgtccacaagtggatttctatcaccgaagctctggccttcttccactgttgtctaaatccaattttgtatgctttcctcggggcaaaattcaaaaccagtgcccagcatgccctgacatccgtctcccgggggtcatctctgaagatcctctctaaaggtaaacgcggtggccatagttccgtgtccacagagagcgaatcaagctcattccattccagctag

SEQ ID NO: 14584 - DNA, 669 bp, Artificial Sequence
  Description of Artificial Sequence: Synthetic coding sequence
atgccctggcagacaggaactttggggacctcttacgccaggcagtcaatgagtagtacccagtccacttccacggctgtgtccagttcctggattcccgccctcctgttaacaatccccgacttcatattcgctaacgtaagcgaagccgacgaccggtatatttgcgacagattttaccctaatgacctctgggtggtagtgttccaattccagcatatcatggttggcctgatcctgcccggaatcgtgatcctgtcatgttactgtatcataatctccaaattatcacattcaaagggacaccagaaaagaaaggcactcaaaacaaccgtaatccttattctcgccttcttcgcatgctggctgccctactacattggaatatctattgatagctttatactactggagattatcaagcaaggctgcgagttcgagaacacggtgcacaaatggataagcatcacagaggccctcgcgttcttccattgctgtctcaaccccatcctttatgccttcctgggagccaaattcaagacctcagcccagcacgccctgacatccgtgtcaagaggtagcagcctgaaaattcttagcaaggggaagagaggcggacattcatccgtaagcacagagtcggagtcctcttcattccattccagttag

SEQ ID NO: 14585 - DNA, 2832 bp, Artificial Sequence
  Description of Artificial Sequence: Synthetic coding sequence
atgacccagaggtcaattgccggccctatatgcaatttaaaattcgtcactttacttgtggctttaagttctgaactgccatttctgggggccggagtccagcttcaggataacgggtacaatgggctgcttatcgccatcaacccacaggtgcccgaaaatcagaacttaatctccaatatcaaagaaatgattaccgaggcctccttttaccttttcaacgctacgaaacgcagagtcttttttcgcaacattaagattttaatcccagccacttggaaagctaacaataatagcaagatcaagcaggaatcatatgaaaaggccaatgttattgtgacagattggtacggagctcacggagatgacccgtatacactgcaatacagaggatgtggtaaggaaggcaaatatattcacttcacccctaacttcctgcttaatgacaatctgacagctgggtacggctctagagggagagttttcgtccacgagtgggcacacctgaggtggggcgtgttcgacgaatataacaacgataagccgttctacatcaatgggcaaaatcagatcaaggtgactcgctgtagtagtgatattactggaatttttgtgtgcgaaaaaggtccctgtccccaggagaattgcattatttcaaagctctttaaggaaggatgcacattcatctataattcaactcagaatgccaccgcttccatcatgttcatgcaaagtttgtctagtgtggttgagttttgcaacgctagtacgcataaccaggaagcgcctaatctgcagaatcagatgtgcagcctccggtcagcctgggacgttatcactgatagcgctgatttccatcacagtttcccaatgaacggcacagagctacctcccccccctactttttcgttggtccaagcaggagacaaagtcgtgtgcctggtcttggacgtaagctccaaaatggctgaggccgatcgactgctgcaacttcagcaggccgccgaattctacttgatgcaaattgtcgaaatccatacctttgtggggatcgcctcttttgactctaagggcgaaattcgggcgcagttgcaccagatcaatagcaatgacgacaggaagctcctcgtgtcatatctacctactacagtgtctgctaagacagatatcagcatttgtagcggcctgaagaaagggtttgaagtggtggagaaactgaatggcaaagcctacggatcagtcatgattctggtgaccagtggtgacgacaagctactggggaactgtctgcccacggtcctgtcctcaggcagcactatccactcaattgcattgggctcttcggccgctcccaatctggaggagcttagcagactaactggtgggctaaagtttttcgtgcccgatatctctaactccaatagcatgattgacgcttttagccgcatcagtagcgggaccggggatatctttcaacagcacattcaactagagtctaccggagagaatgtaaagcctcatcaccaactgaaaaacacagttaccgtggacaatactgtaggtaacgataccatgtttcttgtgacctggcaggccagtggcccgccagagatcattctctttgaccctgacggcaggaagtattatacgaataatttcatcaccaatctgacatttcgcacagcttcactctggatcccaggcacagctaaaccaggacattggacttacactctgaacaacacacaccacagtttacaagcccttaaagttaccgtcacctctagggcatcgaactcagccgttccccctgcgacagtggaagcatttgtggagagggactccctgcatttccctcaccctgtgatgatttatgctaatgtgaaacaaggattttaccccattttgaacgctacagtgactgccaccgtcgagcccgaaactggcgatcctgtgactctgcgtctgttggacgacggagcaggggccgacgtgattaagaatgatggaatctattcccggtatttcttttcctttgccgctaatgggaggtacagcctaaaggtgcatgtaaatcattcgcctagcatctctacacccgcccactctataccaggctcacatgcaatgtacgtcccgggatatacggccaacggaaatatccagatgaatgctccccgcaaaagcgtcggcagaaatgaggaagagaggaagtggggattttcgcgagtgtcaagcggcggaagctttagcgtcctgggcgtcccggccggccctcacccagacgtgtttccgccctgtaaaattatcgacttggaagccgttaaggtagaggaggagctgaccctctcctggacagccccaggcgaggactttgaccaggggcaggccacctcttacgagatccggatgagcaagtccctacagaatattcaggacgattttaataacgccatccttgtcaatacttcgaaaagaaatccgcaacaggctggtattagggaaatcttcacattcagtccgcaaattagcacgaatggcccagaacaccagccgaacggcgaaacccatgagtcacataggatctatgtggcaatccgggcaatggatagaaactccctgcaaagcgcagtttccaatatcgcccaggcccctctgttcatccctcctaattccgatcccgtcccagcacgagactacctcatcctaaagggggtactaacagcgatgggcctgatcgggatcatttgcctgatcattgtcgtgactcatcacactctaagtaggaaaaagcgcgccgacaagaaggagaacgggaccaaacttttatag

SEQ ID NO: 14586 - DNA, 423 bp, Artificial Sequence
  Description of Artificial Sequence: Synthetic coding sequence
atgacacaacgctctatagccgggccaatctgcaatctgaagttcgtgacactcctggtcgccctgagctctgagctacccttcctaggtgccggagtacaactgcaagataacggatacaacggactcttaatcgctattaatccacaggtgcctgagaatcaaaatctgatcagtaacattaaggagatgataactgaagcaagtttttatctgtttaatgctacaaaacgcagggtcttttttagaaatatcaaaatcctcattccagctacgtggaaggccaataacaactctaagataaaacaagagagttacgagaaagccaacgttatcgttacagattggtatggcgcacacggcgatgaccaaggtgtggaaaaaagagagaacacatttatatcgcatctgattagctactag

SEQ ID NO: 14587 - DNA, 1233 bp, Artificial Sequence
  Description of Artificial Sequence: Synthetic coding sequence
atgaatgacgaggattattcaaccatctacgacacgatccagaacgaaaggacctacgaggtcccagaccaaccggaggaaaacgaatctccacactacgatgacgtgcacgagtatttgaggcctgaaaatgatttatatgcgacccagctcaatactcatgagtacgacttcgtgagcgtctatacaatcaagggcgaagagactagcctggcctcagtccagagcgaagatagggggtacttactccctgacgagatctattccgaactgcaagaagcccaccccggagagccgcaggaggacaggggaatttcaatggaggggctgtattcatccacgcaggaccaacagctttgtgccgctgagcttcaagaaaatggctcggttatgaaggaggacctcccatccccctcctcctttacgatccagcacagtaaggccttttccactactaagtacagctgctacagcgacgcagaaggtctggaagagaaggagggcgcccatatgaaccccgagatctacctatttgttaaggctggaatcgatggcgagtctatcggaaactgtccatttagccagcggctttttatgatactctggttgaagggagtggttttcaatgtgaccacggtcgacctcaaaagaaagccagcagacttacataacctcgctccagggacccatccccccttcctgacatttaatggggacgttaagacagatgtgaacaagatcgaagagttcctggaggaaaccttgactccagaaaaataccccaaactagcggctaaacaccgcgaaagcaataccgccggaatcgacattttctcaaaatttagtgcctacatcaaaaatacaaaacagcaaaacaatgcagccttagaacggggtctgacgaaggctctgaaaaagttagacgactatctcaataccccattacccgaggagatcgacgctaacacctgcggagaagacaaaggatcacgccgcaaattcctggatggcgatgagctgaccctggcagactgtaacctcctgcctaaactgcacgttgtaaaaattgtagcaaagaaatacagaaattatgacatcccagctgaaatgactgggttgtggcgctacctaaaaaatgcgtacgctcgggatgaattcactaacacttgcgctgcggatagtgaaattgaacttgcttacgctgatgtggcaaagagactatcacgatcatag

SEQ ID NO: 14588 - DNA, 756 bp, Artificial Sequence
  Description of Artificial Sequence: Synthetic coding sequence
atgactgatagtgccacggcaaatggcgatgatagggacccggagatcgagctctttgtgaaagccggtattgacggagaatccatcggcaattgccccttcagccaaaggctgtttatgatactttggctcaaaggcgtggtcttcaatgtgaccacagtggacctaaaacgcaaacccgctgacctgcacaacctggctcccggcacccatccaccattcctaacatttaatggcgatgtgaagacagacgtgaacaaaatcgaagaattcctggaggagactctgactcctgagaaatatcctaagctggctgccaagcatcgagagtccaacaccgctggaattgacatcttttccaaattcagcgcctatataaagaataccaaacaacagaataacgcagccctggagcggggcctgaccaaagctcttaaaaaactggacgactatctgaatactccactacctgaggagatcgatgcgaacacctgcggtgaagacaaaggtagtcgaaggaagttcctggatggagatgaattaaccctggcagattgcaatctgctgccaaaattacacgtggtgaagatagtggcaaaaaaatacagaaactacgatatccccgccgaaatgacaggcctctggcggtacctgaagaatgcctacgcccgggacgaatttacgaatacatgtgccgctgattccgagattgaacttgcatacgcagatgtggcaaagcgcttgagccgctcgtag

SEQ ID NO: 14589 - DNA, 618 bp, Artificial Sequence
  Description of Artificial Sequence: Synthetic coding sequence
atgacagactctgctaccgccaacggcgatgatcgggaccctgagattgagctgttcgtgaaggccggtatcgacggcgagtctatcggtaactgtcctttttctcagaggctatttatgatactgtggcttaagggagtggtattcaatgtcacaaccgtggacctgaaaagaaaaccagcagacctccataacctcgccccgggcacccatcccccttttctgacgttcaacggggacgtgaagaccgacgtgaataagatagaagagttcctcgaggagacccttacaccagagaagtatcccaaactggctgctaagcatagagagagtaatacagcggggatagacatatttagcaagttcagcgcttacatcaaaaacaccaagcagcagaataacgctgctctcgagcgtggactaactaaggccctgaaaaagctggatgattacctgaacacacctctgccggaagagatcgatgcgaacacctgtggggaagataaaggctccaggaggaaatttcttgacggtgacgaattgacgctggccgactgcaacctgctgcccaaactgcatgttgtcaaggagcaggttccattaaagggcatgatctag

SEQ ID NO: 14590 - DNA, 5823 bp, Artificial Sequence
  Description of Artificial Sequence: Synthetic coding sequence
atggcgtcagggctgggatcaccttctccctgttcagcaggtagtgaagaagaggacatggatgcactgctgaacaactcattacctcctcctcacccagagaatgaggaggaccccgaagaggatctgtctgagactgagactcccaagctcaagaagaagaagaagcccaagaagccgagggaccccaagatcccaaagtccaaacgacagaaaaaagagcgtatgctgctgtgccgacagctaggagatagttcaggggagggaccagagttcgtggaggaggaggaggaagtcgcacttcgaagcgactccgaggggtccgattacacccccggaaaaaaaaaaaaaaagaaacttggtcctaagaaagaaaagaaatcaaagagcaaacgcaaagaagaagaagaagaggaagatgacgacgacgattccaaggagccgaaatcttcagctcaactgctggaggactggggcatggaggacatcgaccatgtttttagcgaggaagattaccgcacacttaccaattacaaagccttcagccagttcgtgcgaccgctaatagccgccaagaacccgaagatcgccgtctccaaaatgatgatggttctcggggccaagtggcgggagtttagcacaaacaacccgtttaaaggcagcagcggcgcatcagtggccgccgccgcggccgccgctgtggccgtggtggagtcaatggttaccgcgacagaggtcgccccacctcctccacctgtcgaggtcccaatccgtaaagccaagactaaggagggcaagggacctaacgcccgtcggaaaccaaaaggatctccaagggtccctgatgctaagaagccaaaaccaaagaaagttgcccctcttaagatcaagctcggggggttcggctcgaagcgaaaaagaagttccagcgaagacgacgatctggatgtcgaaagcgacttcgatgacgcaagtataaacagctacagtgtcagcgatggtagcacgagccgaagcagcagatccagaaaaaagctgagaacaacaaagaagaaaaagaaaggagaggaagaagtgacagccgtggatggctacgaaacagatcatcaagattactgcgaggtatgccagcagggcggtgaaatcattttatgcgacacctgcccacgcgcttatcatatggtctgtctggaccccgatatggagaaggctccggaggggaaatggtcgtgccctcattgcgagaaagagggcatccagtgggaggcaaaggaggacaactctgaaggtgaagaaatcctggaagaggtgggaggagacttggaagaggaagatgaccatcatatggaattctgccgcgtatgcaaggacggtggtgagctgctgtgttgcgacacttgccccagtagttatcacatccactgtcttaatcctccactgccagagattcccaacggggagtggctctgccctcgttgcacttgccctgcactaaagggcaaggtgcagaagatcttgatttggaagtggggacaaccaccatctcctacacccgttccacgaccgcctgatgcagatcctaacacaccctccccgaagccgctcgaaggacgacctgagagacagttctttgttaagtggcagggaatgtcatactggcactgcagttgggtttccgagttacagctggagttacactgccaggttatgtttcgaaattatcagagaaagaacgatatggacgaaccccccagcggtgattttggtggggatgaggaaaagtctagaaagagaaaaaacaaggatccgaaattcgccgaaatggaagaacgcttctatcggtacggcatcaagcccgagtggatgatgattcatagaattctgaatcactctgtggacaagaaggggcacgtgcattatctcatcaaatggcgggatttaccctacgatcaagctagttgggagtccgaggacgtggaaatccaggactacgacctgtttaaacagtcttactggaatcacagggaactaatgaggggcgaagaaggaagaccgggaaagaaactgaaaaaggttaagctacggaagcttgaaaggccccccgagacaccaacggtagatccaaccgtgaagtatgagagacaaccagaatacctggacgctaccggtggaactctgcatccctaccagatggagggtctgaactggcttcgctttagttgggcacaggggacggatacaattcttgcggacgagatgggtctcgggaaaaccgtgcagacagctgtcttcttgtacagtctttataaagagggacactccaagggccccttcctcgtctccgcccctctctcaaccattatcaattgggagagggaatttgagatgtgggcacctgacatgtatgtggtgacatacgtgggtgacaaagactctcgggccatcatccgcgaaaacgaattcagtttcgaagacaacgcgatccgaggcggaaagaaggcctcccggatgaaaaaggaagcgtcagtgaagttccacgttctactcacgagctatgagctcattactatcgatatggccattctcggatcaattgattgggcttgcctcattgtcgatgaagcacacaggctgaaaaacaatcagagcaagttcttccgggttctgaacggctactcgcttcagcataaattactgttgacaggtacccctctgcagaataatctcgaggaactcttccatcttttaaactttctgacacctgaaaggtttcacaatctcgaaggattcttggaagagtttgcggacatcgctaaggaggaccagattaagaagctgcacgatatgctcggtcctcatatgttgcgaagattaaaagccgacgtttttaagaacatgcctagcaagaccgaactgatcgtcagggtagagcttagtcccatgcagaagaaatactataaatatatcctcactcgaaactttgaggctctgaacgcccgtggaggtggcaatcaggtgtccttgttgaacgtggtgatggatctgaaaaaatgttgcaaccatccatacctgttccctgtggcagccatggaggcacccaaaatgccaaatggaatgtatgacgggagtgccctaattcgggcttccggtaagttgctactgctgcagaaaatgctgaagaacttgaaagaaggcggccaccgcgttcttattttttcacagatgactaaaatgctcgacctgttggaggactttctggagcacgaaggctataagtacgagaggattgacggaggtatcacgggcaatatgcggcaggaagcaatcgataggttcaatgcccctggggctcagcagttttgcttcttgctgtctacacgggccgggggcctgggaatcaacctggccacagccgatacagtaatcatctatgactctgattggaatccacacaacgacatccaagccttctctcgcgcacatcgtattggacagaataagaaggtaatgatctatcggtttgttactcgagcttccgtggaagaaagaattacccaggttgccaagaagaagatgatgctgacccacctagtggttagacctggcctggggtctaagaccgggtcaatgtctaaacaggagctggacgatatcctcaaattcggaacagaggaattgtttaaagatgaggccacagacggcggcggtgacaacaaggagggcgaagatagctctgtgatccattatgacgataaagctatcgagcgcctgctcgatcgaaaccaggacgagacggaggacaccgaactgcagggtatgaacgagtacctgtcgtccttcaaggtggcacagtatgttgttagggaagaagaaatgggtgaggaagaggaagtggaaagagagattataaagcaggaggagagcgtggaccccgattactgggagaaactgttgcggcaccactacgaacaacagcaggaggatctggcacgaaatcttggaaagggaaagcggataaggaagcaggtgaactacaatgatggctcgcaagaagatcgcggggtctgcggtcggcctagacctcctccaatggggagaagtacgcgggccgtcggacccgcccatctcccatccctgccacccgactggcaggatgaccagagtgataaccaaagcgactattctgtggcaagtgaagaaggagatgaggacttcgatgagagaagcgaggccccgcgtcggccatccagaaaagggctacggaatgataaggataagccactgccacccttgctggctagggttggcgggaatatcgaggtgctcggattcaatgcccggcaacgtaaggcattccttaacgccattatgaggtacggtatgccaccacaggatgcatttaccacacaatggttggtaagagacctgcgcgggaaatcagagaaagagtttaaggcttacgtctctttatttatgcgccacctgtgtgagcctggggctgatggggccgaaacctttgccgatggggtgcctagagaaggcctgagccgccaacacgtgctgacgaggatcggggtgatgtcactcatacgcaagaaagtgcaggagttcgagcacgtgaatgggcgctggagcatgccagagctcgccgaggtcgaagaaaataagaagatgagccaaccagggagtccctcccccaaaacacccactccctctaccccgggggacacacagcccaacaccccagccccagtgccacctgcagaagacggaataaagattgaggagaattcactgaaagaagaggagtctatcgagggggagaaggaagtgaaatccaccgctcccgaaacagcgatcgaatgcacccaggctcctgcgcctgcctccgaggatgaaaaagtggtggtggagcctccagaaggcgaagagaaggttgagaaggcagaggttaaggaaagaactgaggaaccaatggagactgaaccaaagggagccgctgatgtggaaaaagtcgaggaaaagtctgccattgacctcactccaatcgttgtggaggacaaggaagaaaaaaaagaggaggaagagaaaaaagaggtaatgctccagaatggggagacaccaaaagatcttaacgatgagaaacagaaaaagaatataaaacagcggtttatgtttaacatagccgatggtggattcactgagctgcatagcctctggcagaacgaggagcgagcagcgaccgtaaccaaaaagacatacgaaatttggcacaggagacatgactactggttgctggccggtattatcaatcatgggtatgcccggtggcaggacattcagaatgacccacgctacgccatcttgaacgaaccctttaagggggagatgaatcgtggcaacttccttgagatcaagaacaagtttcttgcaagacggtttaagctcctggagcaggcactcgttatagaggaacagctcaggcgagccgcctacttaaatatgtcagaagacccttcacacccctccatggccttgaatacacgcttcgccgaagtggagtgtctggccgaaagccatcagcatctttcaaaagagagtatggcgggtaacaaaccagcaaacgctgtgttgcataaggtcctgaaacagttggaagaacttttgtcagacatgaaagctgacgtgaccagattgcccgccacgattgccaggattccacctgtcgcagttcggcttcagatgagcgaaaggaacatcctgagccgcttggctaacagggcacccgaacccactccacagcaggtggctcaacagcagtag

SEQ ID NO: 14591 - DNA, 5739 bp, Artificial Sequence
  Description of Artificial Sequence: Synthetic coding sequence
atggcatccggtctcggaagtccatcgccatgcagcgccggttcagaagaagaagacatggatgccctactgaacaatagcctgcctccgcctcacccagaaaacgaggaggatcctgaggaagacctgagcgagactgaaacccctaagctaaaaaaaaaaaagaagcccaagaaaccccgagatcccaagattccaaagtccaagaggcagaaaaaagagcgcatgctgctttgtcgacaactgggagacagcagcggagaaggacctgaattcgtggaggaggaagaggaggtcgcactgaggtctgatagtgagggctctgattataccccaggaaaaaaaaaaaaaaaaaagctcggccccaaaaaggaaaaaaaatctaaaagtaagagaaaagaagaagaagaggaggaagacgacgatgatgatagcaaggagccaaagtcatccgcccagctgttagaggattggggcatggaggatatagatcatgtcttttccgaggaagactatcgcacattgactaattacaaagcgttcagccagtttgttagacccctcatcgcagctaagaatccaaaaatcgctgtctccaaaatgatgatggtactgggggccaagtggcgcgagttttccacaaataacccctttaagggaagcagcggggcctccgtcgcggcagctgccgccgccgccgttgccgtggttgaaagtatggtgacagcgacagaggtggcccctccaccacctccggtggaagttccaatccgaaaggcaaaaactaaggagggtaaggggcccaacgcaagacggaagccaaaggggtcgcctcgcgtaccagatgctaaaaaacctaaacctaagaaggttgctccgctgaaaatcaagttgggcggatttggaagcaagcgcaagcgaagcagctccgaggatgatgatctcgacgtggagtcggatttcgacgatgcatctattaattcttactctgtatctgatggatccacctctcgctcaagtcgtagcaggaagaagttgcgcacgacaaagaaaaagaaaaagggtgaagaggaagtaacggcggtggacggctatgagaccgatcaccaggattattgcgaagtgtgccagcagggaggagaaatcatcctgtgcgacacctgtcccagagcgtatcacatggtgtgtctggatcctgatatggaaaaagcccctgaaggcaaatggtcctgcccccattgcgagaaagaggggattcagtgggaggccaaggaggacaactcggaaggagaggagattctggaagaagtgggaggagacctggaagaagaagacgatcatcatatggaattctgtcgggtgtgtaaggatggtggagagctgctgtgctgcgacacttgtccctcttcatatcatatccactgtttgaatcctccattgccagaaatccccaacggggagtggctctgtccgaggtgcacttgtccggctctcaagggcaaggtccagaaaatcctgatatggaagtggggacaaccaccttcaccgacgccagtgcctagacctcccgatgccgacccgaacacaccttctcctaagcccctggaagggagacccgagaggcagttctttgtcaagtggcagggaatgagttactggcactgctcgtgggtttccgagctgcagttagagctgcattgtcaggttatgtttaggaactaccagaggaaaaacgacatggacgaaccaccttctggggattttggaggagatgaagaaaagagccggaagcggaagaacaaagatccgaagtttgccgagatggaagagagattctacagatacggcattaagcctgaatggatgatgatccacaggatcctcaaccacagtgtcgacaaaaaggggcacgtccactacctcattaaatggcgcgatcttccttacgaccaggcctcttgggagtctgaggacgtggagattcaagactatgacctgtttaagcaatcttactggaaccaccgggaactaatgcggggggaggaaggccgccccggcaaaaagctcaagaaggtgaaactgcgcaaactggagaggccgcctgagaccccaactgtggatcctactgtgaagtacgagcggcagccggaatatctcgatgcgaccgggggcaccttgcacccctaccaaatggaagggctaaactggctacggttttcatgggcccagggcacagacactatcctggcggatgagatgggcttgggcaaaacagttcagacagccgtttttctctattcactctacaaggagggccattccaaggggccctttctcgtgagtgcgcctttaagtactatcatcaattgggaacgagagttcgagatgtgggctcctgacatgtacgtggtcacctacgtcggtgacaaggattcacgcgccatcatcagggagaacgagttctcatttgaggataacgcaattcggggtgggaagaaggcctcacggatgaaaaaggaagccagcgtgaagttccacgtcctgctcacgagctacgagctcatcacaattgatatggcaattcttggctcaattgattgggcctgcctgatcgtggacgaagcacaccgcctgaagaataaccagtcgaaatttttccgcgtcctgaacggatactccctgcagcacaaattgctcctcacaggcacaccactgcagaataacctggaggaattgttccacttattaaatttcctgaccccagaacgatttcataacttggagggttttctggaagaatttgctgacatcgccaaagaggaccagatcaagaagctgcacgatatgctgggaccacacatgcttagacgtctcaaggccgatgtcttcaagaatatgccatctaaaactgagcttattgttcgcgtggaactatcccccatgcagaaaaaatattacaaatatatcctgacccgaaattttgaggccctcaatgccaggggtggaggaaaccaagtgtcactgctcaatgttgtgatggatcttaagaagtgttgtaatcacccatacctcttcccagttgccgccatggaagccccaaaaatgcctaacggcatgtatgatggctcagccctgattcgcgccagtggcaaactgctgcttctccagaagatgttaaagaacctgaaggagggtggccatagggttctcatcttttcacaaatgacaaagatgcttgatctcctggaggattttttagagcacgaaggctacaagtacgagcgaattgacggaggcatcacgggcaacatgcggcaggaggccatcgaccggttcaatgcaccaggcgcccaacagttctgttttcttctatctacacgggctggagggctcgggatcaatctggcgacagccgatacagtgatcatttacgatagcgactggaacccccataacgacattcaagctttctcacgagctcatagaattggccaaaacaagaaggtcatgatatacagattcgtgaccagggccagcgtcgaagagcgcatcacccaggtcgcaaaaaagaaaatgatgcttacccacttggtcgtgcgtcctggcctgggctctaagacaggctcaatgtccaaacaggagttggatgacatcctgaaattcggcactgaagagctgtttaaggatgaggctacagatggtggtggagataataaggaaggagaagattcttccgtgatccattatgatgataaggctatcgagcggctgctagaccgcaatcaggatgagaccgaagacaccgaactgcagggtatgaacgagtacctgtccagttttaaggtagcccagtatgtggtccgagaagaggagatgggagaggaagaagaagtagaacgggagattatcaaacaagaagaaagcgtggatccagactattgggagaaactcctcaggcaccactatgagcaacagcaggaagatttggcgcgcaatcttggtaaaggaaagcgtatacgaaagcaagttaattacaacgatggttcgcaagaagaccgggattggcaggacgaccagtctgacaatcaaagcgactattccgtagccagcgaggaaggagacgaagacttcgacgagcgctctgaagctccacgcaggcccagccgtaaaggcctccgcaacgataaagacaagccgctcccaccactcctggccagagtgggaggaaatattgaggtcttggggtttaacgcaagacagcgcaaggcctttctgaatgccataatgaggtacggaatgccccctcaagacgcattcacaacccagtggctcgtgagagacctgcgtggaaagtccgagaaagaatttaaggcttacgtgagcctgtttatgcgacacctgtgtgagcctggtgctgacggcgcagagacattcgcagatggcgttcccagggaggggctgtcccgtcaacacgtgctcacccgcatcggcgtgatgagtctcattagaaagaaagtgcaggagttcgagcacgtgaatgggcgctggagcatgcctgaactagctgaggtagaagaaaacaaaaagatgtcccagcccgggagcccttctccaaagacaccaaccccgagcaccccaggggacactcaacctaatacccccgcccccgtgccgcctgctgaggatggcatcaaaatagaagagaattctctgaaggaggaggagagcattgaaggcgagaaggaggtcaagagcactgcccctgagactgcaattgaatgcacccaggccccagcccctgcatccgaagacgagaaggtcgtggttgagccccccgagggggaggagaaagttgagaaggccgaagtcaaagagagaaccgaggaaccaatggaaactgagcctaagggcgcagctgatgtggagaaagtggaagaaaaaagcgccattgatctcacccctattgttgtggaggacaaagaggagaagaaagaggaggaggagaaaaaggaggtgatgctccaaaatggagaaacccccaaagacttgaacgacgagaaacagaagaaaaatataaagcagaggttcatgtttaatatagccgacggcggattcaccgaactgcacagcctgtggcagaacgaagagcgggcagctaccgtgacgaagaaaacttacgaaatctggcaccggagacacgattactggctcctcgctggcataattaatcacgggtacgctcgatggcaggacatccagaacgatccacgatatgctattctaaacgagcctttcaagggggagatgaatcgtgggaattttctggagataaaaaacaagttcctggccagaagattcaagctgctggagcaagctttggtcatcgaagaacagcttaggcgcgcagcttatctgaacatgtctgaggatccatctcatccctctatggcattgaacaccagattcgccgaagtcgaatgtctggctgaatcccatcagcacctgtccaaggagagcatggccggcaacaaaccagccaatgcagtgctacacaaagtattgaaacagctcgaggagctgctgagcgatatgaaagcagatgtcacgagactccccgccactatcgctcgtattccccctgttgcagtccgattgcagatgagcgaacgtaatattctgtctcgactggctaatcgagctccagaacccacccctcagcaggtcgctcagcagcagtag

SEQ ID NO: 14592 - DNA, 5661 bp, Artificial Sequence
  Description of Artificial Sequence: Synthetic coding sequence
atggacgctctgctcaataactcattacctccaccacacccagagaacgaagaggatcccgaggaggatcttagcgagactgaaactccgaaactgaagaagaaaaagaagcccaagaagcccagagaccccaaaattccaaagtctaaacgacaaaagaaggagcttggagatagcagtggagaagggcccgagttcgtggaagaggaggaagaggtagctctcagaagtgacagcgagggctccgactacacacccggtaaaaaaaagaaaaagaaattgggacccaaaaaggagaagaagtccaaaagtaagcgcaaagaagaagaggaggaggaggatgatgatgacgattcgaaagaacctaagagcagcgcacaattgctggaggattggggtatggaggatatcgaccatgtcttcagtgaggaggactacaggactctcacgaattacaaggcttttagccagtttgtgcgcccactcatagcagccaaaaatcccaagattgcagtatccaaaatgatgatggtcctgggcgccaagtggcgggaattcagtaccaataatcctttcaaaggatctagcggcgctagcgtcgctgctgccgcagctgcagccgtagccgtggtggaatccatggtgacagctacagaagtagcaccaccacctcctccagtcgaagttccaattcgaaaggcgaagaccaaagaagggaagggaccgaacgcaagaaggaagccaaagggtagtccccgggtccctgatgccaagaagcctaaaccaaagaaggtggcgccccttaaaatcaagctgggtggattcggctcaaagcggaaacgcagctcctcagaagacgatgatctggatgtcgagtctgattttgacgacgcgtccataaacagttattcggttagcgacggttctacctctagatcaagccggagcagaaaaaaactgcgcaccactaagaagaagaaaaagggggaagaagaggtgacagccgttgacggctacgagactgatcaccaagactactgcgaggtgtgtcagcaaggtggagagatcatattgtgtgacacttgccccagggcataccatatggtgtgtctcgaccctgacatggaaaaagcgcccgaagggaaatggtcctgcccccactgcgaaaaggagggcatccagtgggaggcaaaggaggacaattctgaaggggaggaaattttggaggaggtggggggagatctcgaggaagaggatgaccaccacatggagttttgtagagtgtgcaaagacggcggggaactgctctgttgtgatacctgtccctcatcttaccatatccattgtctcaaccctccattgcctgagattccaaacggggagtggctgtgcccccgctgtacatgtcccgccctgaaagggaaagtgcagaaaatcttgatttggaaatggggtcagcccccgtccccaacaccagtgcctcgacctcctgatgcagatcccaatactccttccccaaagccactggaaggacgacccgaaaggcaattctttgtaaagtggcaggggatgtcttactggcactgttcatgggtgtcggaactgcaactggaactgcattgtcaagttatgttccgaaactatcaacgcaaaaatgacatggacgagccccctagtggagatttcggaggagacgaagagaagtcacgaaagcgcaaaaataaagatcccaaatttgcggagatggaggagcggttttatcgctatgggatcaaacctgaatggatgatgatacaccgcatactcaaccactctgtggacaagaaaggacacgtacactatctgatcaaatggagggatttgccatacgaccaggcctcatgggagagcgaggacgtcgagattcaggattacgacctgttcaaacagagctactggaatcacagggagcttatgagaggggaagagggccgcccaggcaaaaagctcaagaaggtcaagctgcgcaagctggagaggcctccagaaacaccgaccgttgatccaacggtgaaatatgagagacagccggagtacctcgatgcaaccggcgggacactgcacccataccagatggagggtctgaattggcttcgattttcttgggcccaaggcaccgacacaatcttggccgacgagatgggccttgggaaaactgtgcaaacggctgtattcctctactctttatacaaggagggccactccaaggggcccttcctcgtttcagctcccctgtctaccattattaattgggagcgagagttcgagatgtgggccccagacatgtacgtggttacatacgttggagataaggactctcgcgctattatccgcgaaaacgagttctcctttgaggacaatgccatacgagggggcaagaaggctagccgtatgaagaaagaggctagcgtgaaattccacgttcttctcacgtcatacgagttgattacgatagacatggccattctgggttcgatagattgggcctgtctcatcgtggacgaagcccaccgcctgaaaaacaatcaaagcaaattttttcgggttctcaatggttactcgctgcagcataaactgcttctcacagggacacctctgcagaacaacctcgaggagctgtttcacttgctcaatttcctgacaccagagagatttcacaacttggagggatttttagaagagttcgctgatatcgctaaagaagatcagattaagaaactccacgatatgctgggtccccacatgttgaggaggttaaaagcagatgtgtttaagaatatgccctcaaaaaccgaactgattgtgagagtcgaactttccccgatgcagaaaaaatactacaaatacattctgaccaggaacttcgaagctctgaatgctcgaggcggtggaaatcaagtctctctgctgaacgttgttatggatctgaagaaatgctgcaaccatccatacctgttccctgtggctgcgatggaagcgccaaagatgccaaatggcatgtacgacggatcagcgctaatccgagcatccgggaaactgctcctgctgcagaaaatgttaaagaaccttaaagaaggcggccatagggtgctgattttttctcagatgacgaaaatgctggaccttttggaagacttcctggagcatgaaggctataagtatgaaagaatagatgggggtattacagggaacatgcggcaagaggctatcgaccgcttcaacgccccaggtgctcagcagttctgtttcctgttatcaacacgggccggaggcttgggcattaatttggccaccgcagatactgtgattatatacgattcagattggaatcctcataacgatattcaggcattttccagggcacacagaatcggacagaacaaaaaggtcatgatctatcgattcgttaccagggcctctgtcgaggagaggatcacccaagtcgccaagaaaaagatgatgctaacacatctggtggtgaggccgggcctcggaagtaagactgggtctatgtctaaacaggagctagacgatatcctgaagtttggcaccgaagaactatttaaggatgaggccacagacggtgggggtgataacaaggagggtgaggatagctccgttatccattacgatgacaaggctatcgagcgccttcttgaccgcaaccaggatgagacagaagacaccgaactgcaaggtatgaatgagtatctctcttcgttcaaggttgcacagtacgtcgtgcgcgaggaggaaatgggagaagaggaggaggtcgaacgtgaaataatcaaacaagaagaatccgttgaccccgactattgggaaaagctcctgcgacatcactacgagcagcaacaagaagacttggccagaaacctgggaaaaggcaagagaattcgaaaacaggttaattacaatgatgggagccaggaggaccgggactggcaggatgaccagtctgataatcagtcagattattcggtggccagcgaggagggcgatgaggactttgacgagcggtcggaggcccccaggagaccttcccgcaaagggctgcgaaacgacaaggacaagccgctccctccccttctggcacgggtgggcgggaatatcgaggtgctgggatttaacgccaggcaacgcaaagctttcctgaatgctatcatgaggtacgggatgcccccccaagatgctttcacaacccagtggctcgtgagagatctgaggggtaagtctgaaaaggaatttaaggcctacgtttcattgtttatgcgccacctctgtgaacccggcgccgatggcgctgagacctttgccgacggagtcccccgggaaggattgtctaggcagcatgtgttgactcgaatcggcgtcatgtccctgatccgcaaaaaggtccaggagttcgagcacgtcaatggtagatggtctatgccggagctggctgaagtggaggaaaacaagaaaatgtcgcagcccggttccccctctcccaagactcccacgccctctacgcccggggatacacaacctaacaccccagcccctgttccccccgcggaagacgggataaaaatagaagagaacagcctgaaggaagaggaatccattgagggcgagaaagaggttaaaagcaccgctccagagacagctattgagtgtacccaggcacccgcccccgcctccgaagatgaaaaggtggtggtggagcctccggagggggaagaaaaggttgagaaagcagaggtgaaggagaggacagaggagccgatggaaaccgaacccaagggtgcagcagatgtcgagaaagtcgaagaaaaatctgccatcgaccttactcccatcgttgtggaggacaaggaagaaaaaaaggaggaggaggagaagaaggaggtgatgcttcagaacggcgaaacaccaaaggatctgaacgatgaaaaacagaaaaagaatattaaacagcgcttcatgttcaatattgccgacggaggctttactgagctgcactctctttggcagaatgaggagcgagcagcgacagtcacaaagaagacttatgagatatggcatcggagacacgattattggctcctcgcaggcatcattaaccatgggtacgcgagatggcaagacatccagaatgatcctcgctatgcgattctcaatgaaccatttaaaggtgaaatgaataggggtaatttcctggagatcaagaataaattcttagcaaggcgctttaagctgctggaacaggccctggtcatagaggaacagttacgacgagctgcgtacctaaacatgagcgaggaccctagccacccttcaatggccctcaacaccagatttgccgaggtggaatgcctggcagagtcccatcagcatctgagcaaagagtctatggcgggaaataagccagccaacgccgtgctgcataaagtcctcaaacaactagaggaactcttgagcgatatgaaggccgatgtgacaagactcccagccactattgcccgcatacctcccgtcgccgtccggctgcagatgagcgaaaggaatatcctttcacggctcgccaatcgcgcccccgagcccacgccacagcaggttgcccagcagcagtag

SEQ ID NO: 14593 - DNA, 5718 bp, Artificial Sequence
  Description of Artificial Sequence: Synthetic coding sequence
atggcttcaggactgggtagtccgtcaccatgcagcgccgggagcgaagaagaggacatggacgctctcttgaataattcacttccaccccctcatcctgaaaatgaggaggatcccgaagaggacctgagcgagaccgaaacgcctaagctgaaaaaaaaaaaaaaacctaagaagcccagggatcctaagatcccaaagagcaaacgccagaagaaggagctgggcgactcatccggcgagggtcctgagttcgtcgaagaggaagaggaagttgcgcttcgaagtgactcagagggcagcgactatacccccggcaagaaaaaaaagaaaaaactgggtccaaagaaggagaagaagagtaagtccaagcgcaaagaggaagaagaggaggaagacgacgacgacgacagtaaggaacccaagtcctcagctcagttgctggaggattggggaatggaagatatcgaccatgtgttctcagaggaggactacagaacactgacaaactacaaggccttttctcaatttgtcagaccacttattgcagccaagaacccgaaaatcgccgtctctaaaatgatgatggttttgggggccaagtggcgggaattttccacaaataaccctttcaaggggtcaagcggggcctctgtggcggctgccgctgcagccgcagtggccgttgtagaatctatggtgacggcaacagaggtggccccccccccacctccggtcgaggttcctatcaggaaggcaaagactaaagaggggaagggtcccaatgccaggagaaaacccaagggaagccccagggtgccagatgccaaaaagcccaagcctaaaaaggttgccccgcttaaaatcaagctgggaggctttggcagcaagcggaaacgtagctcttctgaggacgacgacctcgatgttgaaagcgactttgacgacgcatctattaacagctactcggtgagtgacggcagcaccagtcggtcctcccggtcaaggaaaaaactgcgaactaccaaaaagaagaagaagggagaggaggaggtgactgcggtcgatgggtacgaaaccgaccatcaggactactgcgaggtctgtcagcagggaggtgagattattttgtgcgatacctgtccccgggcctaccatatggtatgtctggacccagatatggaaaaagcccctgaagggaagtggtcatgccctcactgcgagaaggaaggaattcagtgggaagccaaagaggataatagcgaaggagaggagattctggaggaggttggaggagacctggaagaagaagacgaccaccatatggaattctgtcgcgtctgcaaggatgggggagaactcctctgctgtgatacatgtccctcgagctatcatatacattgtctgaacccccctctgcctgagattccgaatggtgaatggctctgcccgcggtgcacttgtcctgccttaaagggcaaggtccagaaaatcttaatctggaagtggggccagccaccatcacccacaccagtaccccgccctccggacgccgatcctaacactcccagccccaagcccttggaggggagacccgagcggcagttcttcgtgaagtggcaaggaatgagctactggcattgctcctgggtaagcgagctgcagctggaacttcactgccaggtcatgtttaggaactatcaacggaagaatgacatggacgagcccccatcaggcgatttcggaggcgatgaagagaaatccagaaagcgcaaaaataaagatcccaagttcgccgagatggaggaacgtttttatcgctacggtattaagcccgagtggatgatgattcaccgaatcttgaaccacagcgtggataaaaaaggacacgtccactatcttattaagtggagagacctgccatacgatcaggcctcttgggaatctgaggacgttgaaattcaggactatgacctgttcaagcagtcctactggaatcacagggagctcatgcgcggcgaggagggcagacccggaaaaaaactgaagaaggtaaagctgaggaaactcgaacgacctccagaaacccccactgttgaccccactgtaaagtacgagagacagcctgagtatctggatgccacagggggcactcttcatccgtaccagatggaaggtctaaattggttgagattcagttgggcacagggaacagacactatcctcgccgatgagatgggcttaggcaaaactgtgcaaactgccgtttttctgtacagcctgtacaaggagggtcactccaagggaccgtttctcgtgtctgccccactaagcactatcattaattgggagcgagagtttgagatgtgggcgcccgacatgtatgtcgttacttatgtgggcgacaaagattcgcgcgctatcatcagagagaatgaattttccttcgaagataacgccatacggggtgggaagaaagcgagtcgcatgaaaaaggaagcctctgttaagtttcacgtgctactcaccagctatgaattgatcaccatcgatatggccattcttggatcaatcgactgggcctgcctgatagtggatgaggctcacagattgaagaacaatcaatctaagttcttcagagttcttaacgggtacagtctccagcacaaactgttgctgaccggaactccgttgcagaacaacctcgaagagcttttccatcttctcaactttctgactccagaaaggttccataacctggaaggatttttggaagaattcgccgacatagccaaggaggatcagatcaaaaagctgcacgacatgctaggcccccacatgctgcgtaggctcaaagcagacgtgtttaagaacatgccgtccaagaccgaactcattgtacgcgtggagctgtccccgatgcagaagaaatattataaatacattctcacgcggaatttcgaagcactgaacgcacgaggggggggtaatcaggtttctttgctgaatgtggtcatggacttgaagaaatgttgcaaccacccatatctgtttccagtggccgcaatggaagcaccgaaaatgccgaatgggatgtacgatgggagcgctctgattagggccagcgggaagctgctgctgttacagaagatgttgaagaacctgaaagagggtggacacagggtgctaatcttttcccagatgactaagatgctagatttgttggaggattttctagagcatgaggggtataaatacgagaggatcgatggggggatcactggcaatatgcgacaagaggcaattgaccgtttcaatgccccaggcgctcaacagttttgttttctcctgtctacacgggcgggtggactgggtattaatctggccactgccgatacagtcatcatctacgattccgactggaatccacacaatgatatccaggcattttcacgggcccacagaatcggccaaaataagaaggttatgatctatagatttgtcacccgggcatctgtggaggaacggatcactcaggtggccaagaaaaaaatgatgcttacccacctcgtcgtgaggccgggtttaggttctaaaaccggtagtatgtctaagcaggagctcgacgatatcctgaaatttggaaccgaggagctgttcaaggatgaggccaccgatggggggggggataataaggaaggggaggatagctccgttatccactatgatgataaagccatcgagaggttgcttgatcgtaatcaggatgaaaccgaggataccgaactgcagggtatgaatgaatatctgtcttcgttcaaagtagcccagtatgtggtgcgcgaagaggagatgggtgaagaggaggaggttgaaagggagatcattaagcaggaagagtccgttgatcctgactattgggagaaactgcttcgtcatcactatgagcagcagcaggaggatctggcccgcaatcttggcaagggaaaaagaatccgtaagcaggtaaattacaatgacggtagtcaagaagaccgggactggcaggacgaccagtccgataaccagtccgactatagtgtggcttccgaggagggcgatgaggactttgatgaacgatcagaggccccaaggaggcctagccggaaaggactccggaatgataaggataaaccactaccacccctgttagcccgggtgggagggaacatcgaagtcctgggttttaacgctcgacaaaggaaagcctttctgaatgcaataatgcgctatggcatgcccccacaggacgcttttaccactcagtggctggttagagatctaagaggcaaaagcgagaaagaattcaaggcatacgttagcctgtttatgaggcatctgtgtgaacctggagcagacggcgccgagacctttgccgatggcgttcccagggagggattgagccgccagcatgtcttgacaaggattggcgtgatgtccctcatccgtaagaaggttcaagaatttgagcatgtgaacgggcgatggtctatgccagagctagcagaagtcgaggagaataaaaaaatgtctcaacccgggtcccccagccccaagaccccaacaccaagtacacctggtgatacgcagccgaacacacctgctcccgtgccgcccgcggaggatggtatcaaaatagaagaaaattctctgaaggaggaagagtcgattgagggggaaaaggaggtgaaaagcacggctcctgaaaccgctatcgaatgcacccaggctccagcaccagcctcagaggacgagaaagtggttgtggagccaccggaaggcgaggagaaggtggagaaagctgaagtgaaggagaggacagaagagcccatggaaaccgaacctaaaggtgccgctgatgttgagaaagttgaagagaagagtgcgatcgacttgacgcccattgtagtggaagacaaagaggaaaagaaagaagaagaggagaagaaggaggtgatgttgcagaacggagagacgcccaaagatctcaacgacgagaagcagaagaagaatatcaagcaaagattcatgttcaacatcgctgacggcggatttaccgagttgcatagcttgtggcagaatgaggagcgcgctgcaaccgtgaccaagaagacttacgagatctggcatcgccgccacgactattggcttcttgctgggattataaaccatgggtatgctcgctggcaggacattcagaatgatcctaggtacgctatattgaacgagccattcaagggagagatgaaccgcggcaatttcttggagatcaagaacaaattccttgcaagacggttcaagctccttgagcaggccctggttatcgaggaacagctcagaagggcagcctatttgaacatgagcgaggaccccagccacccttctatggctctgaatacaagatttgccgaagtcgaatgcctggctgagagccaccagcatctgtcaaaggagtccatggcaggtaacaagcccgctaatgccgtactgcacaaggtgctgaagcagctagaggaacttctgtctgatatgaaggcggatgtgacgaggttgcccgccacaatcgcccggattccccctgtagcggtgcgactgcaaatgagtgagaggaatattttgtcacgacttgcgaacagagctcctgagcccaccccccagcaggtggctcagcagcagtag

SEQ ID NO: 14594 - DNA, 5814 bp, Artificial Sequence
  Description of Artificial Sequence: Synthetic coding sequence
atggcttcaggccttggatccccgtcaccatgctcagccggatctgaagaggaagacatggacgccctgctaaacaattctctgcctcctccgcacccagaagaccctgaagaggacttgagcgagacagagacacctaagctgaagaaaaagaagaagccaaaaaaaccccgtgaccctaaaattccaaagtccaaaaggcaaaagaaggagcggatgttgctctgcaggcagctgggagattcctccggagaagggcccgagtttgtggaggaggaagaggaggttgccctccgatccgattctgaagggagcgactacactccaggcaagaagaaaaagaaaaagctgggaccaaagaaggaaaaaaaaagcaaatcgaagcgaaaggaagaggaggaagaggaggatgacgacgatgacagtaaagaacctaaaagctcagctcagctcctggaggactggggaatggaggatattgatcacgtcttctccgaggaggattaccggaccctcactaattataaagcattttcccagtttgttcgaccacttatcgccgccaagaaccctaaaatcgctgtcagtaaaatgatgatggtactaggggcaaagtggcgcgagttcagcactaataatcctttcaaaggttccagcggtgcgagtgtcgcagctgctgccgcagcagctgtggccgtggttgagagcatggtcacagccaccgaggttgcccccccacccccccccgtggaagtcccaatacgaaaggcaaagactaaggagggaaaaggcccaaacgcccggaggaaaccaaagggttccccccgcgtgccagacgccaagaaacctaagccaaagaaggtcgcacctctaaagataaaactgggaggtttcgggagcaagcggaagagaagctctagtgaagatgacgatcttgacgtggaaagtgacttcgatgacgccagcatcaattcttattcagtatcagacggaagtacatccaggtcctcccgctcccggaagaagcttaggactacaaagaaaaagaagaaaggcgaagaggaagtcacagccgtcgatggctacgaaaccgaccaccaggattactgtgaggtgtgccagcagggcggagagataatactgtgcgatacctgtcctcgggcttaccatatggtctgtctcgaccctgacatggagaaggcgcccgagggtaaatggtcttgtcctcactgtgagaaggagggcattcagtgggaggctaaggaagacaattccgagggagaggagatcctggaagaagtaggcggggacttggaggaggaagacgatcatcatatggagttctgtcgcgtctgcaaagatggtggtgagctgctgtgctgcgacacttgtccaagctcctatcacattcattgcctcaacccaccacttcctgagatccccaatggcgaatggctttgcccgagatgtacctgccctgcccttaaggggaaagtgcagaaaattctgatctggaagtggggtcaaccacctagtcccacgcctgtaccacgacccccggacgcagacccgaataccccatcaccgaagcctctagagggtcgtcccgaaagacagttcttcgtgaagtggcaggggatgtcttattggcactgtagctgggtctcggaactccaactcgaactgcactgccaggtcatgttccggaactatcagagaaagaatgacatggatgagccgccatcaggcgactttggaggcgatgaggaaaaaagccgcaaaaggaagaataaagatccaaagttcgccgagatggaggaaagattctatagatatgggataaagccggagtggatgatgattcatcggattttgaaccacagcgttgacaagaagggccatgtgcattacctcataaagtggcgggacctgccctacgatcaggcatcttgggagtcagaggatgtggagattcaagattacgacctgttcaaacaatcctactggaaccaccgagagctaatgaggggcgaagaggggagacccgggaaaaagctgaaaaaagtgaaattgcgtaagttggagagaccccccgaaacacctacagtcgacccaactgtgaagtacgaaaggcaaccggaatacctggatgcaaccggcggtaccctgcacccctatcagatggaaggcttgaattggctacgcttctcttgggcacagggaaccgacactatccttgcggatgagatgggcctcggtaagacggtgcagactgccgttttcttgtatagcttatataaagagggacattccaaggggcctttccttgtgtctgcacctctatctacgataatcaactgggaaagggagtttgagatgtgggccccagacatgtacgtcgtgacatatgttggtgataaggatagcagggccatcatccgtgaaaacgagttttcctttgaggataatgcaatccgaggggggaagaaggccagccgtatgaagaaggaggctagtgtcaagtttcatgtgcttttgactagttacgaactgattaccatcgacatggccattctcggctcaatcgattgggcatgtctgatcgttgatgaggcacacaggctgaagaataatcagtctaagtttttcagagtcctaaatggttactccctgcagcacaagctcttgctcaccggcacacccctgcagaataatctggaggagctgttccacctgctgaattttctgactcctgaaagattccataacttggaggggtttctggaggagttcgctgacattgccaaagaagaccagattaagaagctgcacgacatgctgggacctcatatgctgcgccggttaaaagcagatgtgttcaagaacatgccctccaaaacggagctgattgttcgagttgagctcagcccgatgcagaaaaagtactacaagtatatacttacccgaaatttcgaagctctgaatgctcgtggaggtggaaatcaggtttctttattgaacgtcgtgatggacttgaagaagtgttgtaaccatccatatctgttccccgtcgcagctatggaggcccccaaaatgccaaacggcatgtacgacggcagcgccctaatacgagctagtggtaaactccttctgctccagaagatgctgaaaaatttgaaggaaggcgggcatcgggtactcatctttagccagatgacaaaaatgctcgatcttcttgaggacttcttggaacacgagggctacaaatacgaaaggattgacggcgggatcacggggaacatgcgtcaggaggcaatcgatcggtttaacgcgccaggggcccaacagttttgctttctactgtccaccagggccggcggcttgggcatcaatttggcaactgcggatacagttattatctacgacagcgattggaatccccacaacgacattcaggccttctcccgggcacataggattgggcagaataagaaggtgatgatatatcgatttgtgacccgcgcctctgtggaagaaagaattactcaagtggccaagaagaagatgatgcttacccacctcgtggtgagacccggactaggctcaaaaacagggagtatgagcaaacaggagctggatgacatccttaaattcggtacggaagaactcttcaaggatgaggccaccgacggcggcggagacaataaagagggtgaggactcttccgtcatacactatgatgacaaggcaattgaaagactcttggatcgcaaccaggacgaaaccgaggacacagaactgcagggcatgaatgagtacctctcttcatttaaggtcgcccagtatgtggtgagagaggaggagatgggagaggaggaagaggtggaacgggagattatcaaacaagaggaatccgtggatccggattactgggagaaactcctccggcatcactacgagcagcagcaagaagatctggctcgcaacttgggaaaaggaaagaggattcgaaagcaggtaaattacaatgatgggtctcaagaagatcgtggtgtgtgtggacggcctcggccaccccccatggggcgcagcaccagggccgtgggtcccgcgcaccttcctagtctgccaccagattggcaggatgatcagtcggataaccaaagcgattattccgtggcttcagaggagggagatgaggatttcgacgagcgcagtgaggccccacgccgcccctcaaggaaggggctgaggaacgacaaagataagcctcttccccctctcctcgcgagggtaggcggaaatatcgaggtgctgggctttaatgccagacaaagaaaagcgtttctgaacgccatcatgagatatggcatgccccctcaggacgccttcacaacccagtggctggtacgtgacctgcgggggaagagtgagaaagaattcaaggcctacgtgtccctgtttatgcgacacctgtgtgagcccggcgccgacggggcggagacctttgccgacggcgtccctcgcgaaggtttgagcaggcagcacgtgctgacccgtatcggcgtcatgagcctgattcgcaaaaaagtccaggagttcgagcatgtgaatgggcggtggagcatgccagaactggccgaggtcgaagaaaacaagaagatgtctcagcctggaagtcctagccctaaaacacctacgccatcgaccccgggagatacccagcccaacactcccgctcccgtgccacccgccgaagacggtattaaaatagaggaaaattcactgaaggaagaggaatccatagagggagaaaaagaggtcaaaagtaccgcccccgagaccgcaattgaatgtacacaggccccagccccggcaagtgaggatgagaaagtggtcgtagagccccccgaaggggaagaaaaggtcgagaaagcggaagttaaagagcgcacggaggagcctatggaaactgagcccaagggagccgccgatgtggaaaaagtcgaagagaagtctgctatcgacctcacccccattgtagtagaggacaaagaggagaagaaagaagaggaggagaaaaaagaagtgatgctgcagaacggagaaacaccgaaagaccttaatgacgaaaaacagaaaaaaaatataaaacagcggtttatgttcaacatcgccgacggcggatttaccgaactgcacagtctctggcaaaatgaagagcgagcggccactgtcaccaagaaaacttatgaaatttggcaccgtcgccacgactactggttactggccggtattattaatcacggatacgcaaggtggcaagacattcagaacgaccccaggtacgcgattcttaacgagccctttaaaggagagatgaacagaggaaatttcttagagatcaagaacaaattcctcgcaagaaggtttaagctgttggagcaagcactggtgatagaggagcagctgagaagggccgcataccttaatatgagtgaggaccccagccatccctctatggcactgaacactaggtttgcggaggtggaatgtctcgctgaaagccaccagcatctcagcaaggagtccatggccggcaataagccggctaacgccgtgctccataaagtcttaaagcagttagaggagctcctgagtgacatgaaggccgacgtgacccgactccctgccacaatcgcaagaatcccacctgtggcggtaagactgcagatgagcgaaaggaatattctgagcagactcgctaaccgggctccagagcctaccccacagcaagtggctcagcaacagtag

SEQ ID NO: 14595 - DNA, 1065 bp, Artificial Sequence
  Description of Artificial Sequence: Synthetic coding sequence
atggcaagcggcctgggatctcccagcccatgctctgccgggtctgaggaggaagatatggatgcactattgaataattccctaccgcccccccatccagagaatgaggaagaccccgaggaggatctctctgaaacggagacaccgaagttgaagaaaaagaagaagccaaagaagccccgcgaccctaaaatcccgaagagtaagagacagaagaaagagaggatgctactctgtcgacagctgggcgacagttctggcgaaggccccgaatttgttgaggaggaggaagaggttgcgttgagatcagacagtgagggatcagactacacccccgggaagaaaaaaaagaagaagctgggccctaaaaaggaaaaaaaatccaaatctaagcgaaaggaagaggaggaagaagaggacgacgatgacgactcgaaggagcccaaatccagcgcacagctgctggaggattggggtatggaggatatcgaccacgtgttcagtgaggaagactaccgcactttaacaaactataaggcattttcccagttcgtaagacccctcatcgccgcaaaaaacccaaaaatcgcagtatccaagatgatgatggtcctgggggcaaaatggagagaattcagcactaataatccatttaaagggtcaagtggcgcaagtgttgcagccgcggctgccgcagccgtggctgtagtggagtctatggtgactgccacagaggtcgcgccaccacccccacctgtggaggtgcctatccgaaaggctaagaccaaagaagggaaaggcccaaatgcccggaggaaacccaaagggtcaccccgggtgccagacgctaaaaagcccaaaccaaagaaggtggctccccttaaaatcaagctcggaggattcggttccaaaaggaagagaagctcgtctgaggacgacgatctggatgtcgaatccgactttgacgacgcttcaattaattcgtacagcgtttcagacggctccacctcgagatcttccaggtcgcgcaaaaaactaagaacaacaaaaaagaagaagaagtag

SEQ ID NO: 14596 - DNA, 1065 bp, Artificial Sequence
  Description of Artificial Sequence: Synthetic coding sequence
atggctagcgggttgggatctccttcaccttgttctgccggctctgaggaagaagacatggacgccttactgaataactctctcccccccccacaccctgaaaatgaggaggaccctgaagaggacctgtctgagacagagacgcctaagctgaaaaaaaagaaaaaacctaaaaaacctcgggaccccaaaatacccaaatctaaaaggcagaagaaggagcgtatgctgctgtgtcgtcagctgggagattcatcaggcgaaggccctgagtttgtagaagaagaagaagaagtggctctgagaagcgattccgaggggtcagattacaccccaggtaagaaaaaaaaaaaaaagctggggcccaagaaggaaaaaaagtccaagtcgaagcgcaaggaggaggaggaagaagaggatgatgacgacgactctaaggaaccaaaatccagcgcccagctactcgaagactggggtatggaggatattgatcatgtgttctccgaagaagattaccgaaccctgaccaactacaaagccttctcccagttcgtcagacctctgatcgctgccaagaatcctaaaattgctgtgagtaaaatgatgatggttctgggcgctaaatggcgagaattttcaaccaataacccattcaaaggttcatctggggccagcgtggctgccgcagcggcggctgcggtagcagttgtggagtccatggttaccgctactgaggtcgccccgccgccccctcctgtagaagttcccattcgcaaagccaagacaaaggagggaaagggcccaaacgcccgaaggaaaccaaagggaagccccagggtgcctgacgccaagaagcccaaaccaaagaaggttgcaccgctgaaaattaaacttggcggcttcggatcgaaaagaaagagatccagctcagaggacgacgatctggatgtagagagtgacttcgacgacgcttcaattaactcatattcagtctccgacgggtccacatcccgttcatcccggtcccggaagaagctgagaaccaccaaaaaaaaaaaaaaatag

SEQ ID NO: 14597 - DNA, 2562 bp, Artificial Sequence
  Description of Artificial Sequence: Synthetic coding sequence
atgtttctgccccacatgaaccatctgacattggagcagacatttttttcacaggtgctccccaaaacagtgaaacttttcgatgacatgatgtatgaactcacctcacaagcccgtggcctgtccagtcaaaacctggagatccagacaactctcaggaatatcttgcagaccatggtgcaactgctcggggctcttacgggctgtgtgcagcacatctgcgcaacccaggagtccatcattctggagaatatccaaagcttgccatcatctgtgttgcatattataaagtcaactttcgtacattgtaaaaacagcgaatctgtctacagcggttgcttgcatcttgttagtgacttgctgcaagctctgttcaaggaggcgtatagcctccaaaaacagcttatggaacttcttgacatggtctgcatggacccccttgtggatgacaatgatgacattttaaacatggtcatcgtcatacacagcctgcttgacatctgctcagttatttcttcgatggaccatgccttccatgccaatacatggaagtttatcatcaagcaatctcttaaacaccagtcgattattaagtcacagctaaagcataaagacatcattacctcactgtgcgaggatatcctgtttagcttccactcctgcttgcaactggctgagcagatgacacagtccgatgctcaagacaatgcagactatcgactcttccagaagacactgaagctgtgccggttcttcgccaactctttgcttcactacgctaaggagttcctgcccttcttatccgatagctgctgcacactgcaccaactttacctgcagatacattcgaaattccctccgtcgctgtacgcgaccagaataagtaaggcacaccaggaagaaatcgctggcgcctttctagtgacgttggacccgctgatctcacagctgctgaccttccagccatttatgcaggttgtccttgacagcaagcttgatcttccctgtgagctgcagttccctcagtgtctgctgcttgtcgtggttatggacaaactgccctcccagcccaaggaagtccaaaccctctggtgtacagattctcaggtgtctgagaccacaacacgcatcagtctcctcaaagcagtgttttattctttcgaacagtgctccggagagttatccttaccggtgcacctgcaaggcctgaaaagtaaagggaaagctgaggtggccgtcacactgtatcaacatgtttgcgtccatctgtgcacgtttatcacatctttccatcctagcttgtttgccgaacttgatgcagcccttctgaatgccgttttgtctgctaacatgattacatctctccttgcaatggacgcttggtgctttctcgctagatatgggactgcggagctttgtgcccatcatgttacgattgtcgcgcaccttataaagtcatgtcccggtgaatgttatcaactgatcaatttatcgatcctgctgaaacgcctgttcttctttatggccccaccacaccagttggaattcatccaaaaattcagcccgaaagaagcggagaatttacccctatggcagcatatctctttccaagctttgcctcccgagctcagagagcagaccgttcacgaggtgaccactgtaggtactgctgagtgtcggaaatggttgtcccgttcccgtactttgggggagttggagtctctgaacactgtcctctctgccctcctcgcggtctgtaatagcgccggggaagccctcgacactggcaagcagaccgctattatcgaagtggtatctcaactgtgggcattcctgaatattaagcaggtggccgaccaaccttacgtgcagcagactttttcactcctgctcccactgctcgggttcttcatacagactttggatccaaaactgatacttcaagccgtgaccctgcagacttcattgttgaagctggaactgcccgactatgtgagactggcaatgctcgattttgtgtcaagcctcgggaagttgtttatccctgaagctattcaggatcggatcctgccaaacctaagttgcatgttcgccctgctgttagccgacagaagttggctgctggaacaacatactcttgaagctttcacccaattcgcagagggaacaaatcacgaagagatcgtcccgcagtgcctgagcagtgaggaaacaaagaataaggtagtgtcattcttggagaaaaccggattcgtggatgaaacagaagcagctaaggtggaaagagtgaagcaggagaaagggattttctgggaacctttcgctaatgtcaccgttgaggaggccaagcggtcaagcttgcagccctatgctaaacgcgcccggcaggagttcccctgggaggaggaatatcgcagtgcactccataccattgccggagctctggaggcaactgagtcgcttctgcaaaagggacccgcccccgcctggctgagtatggaaatggaagccctgcaagagcggatggacaagttaaagcggtacatccacactttaggatag

SEQ ID NO: 14598 - DNA, 2562 bp, Artificial Sequence
  Description of Artificial Sequence: Synthetic coding sequence
atgttccttccccatatgaatcacctcaccttggaacaaacctttttttcccaggtactcccaaaaacggtaaagctttttgatgacatgatgtatgagctgacaagtcaggcccgggggctatcttcacaaaatctggaaattcagactaccttacgcaacattctgcagaccatggtgcagttactgggagcattgactggctgtgttcagcacatttgcgcaacccaagagtctattattttagagaatatacaatcccttccaagttccgttttgcacataattaagtcaaccttcgtccattgtaagaattcggagtctgtgtactcggggtgtctgcacctggtttcagatctgctgcaggccctgttcaaagaagcctattcacttcagaagcagctgatggagctcctggatatggtctgtatggatccgctggtggatgacaatgacgatattctgaacatggtgatcgtgatccactccctgctggacatttgctctgtcattagctccatggaccatgccttccacgcaaacacctggaagttcatcattaagcaatcccttaaacaccagtccatcatcaaaagccaacttaaacacaaagacattataacctcgctgtgtgaggacatattgtttagcttccactcctgtctgcaactggcagaacagatgactcaaagcgacgctcaggacaatgctgattacaggctatttcaaaagacgctgaagctctgtcgattttttgcaaactctttgctccattacgcaaaggagttcctgcctttcctgtcggactcgtgttgtaccctgcaccagctttacctgcagatccactccaagtttcctccctccctgtatgcaactcgcattagcaaggcccatcaggaagaaatcgccggggccttcctcgtgacactggatccccttatctctcaactgctcacctttcagccttttatgcaggtcgtgcttgacagtaagcttgaccttccctgtgaacttcagttcccccagtgtctcctgctcgtcgtggtgatggacaagttgccatcacaaccaaaagaagtacagacattgtggtgtactgattcccaggtctccgaaactaccacccgaatctctctccttaaagccgtcttttattcttttgagcaatgttccggagagctgagcctcccagtgcacctgcagggtttgaaaagcaaaggaaaggctgaagtggctgtcacactgtaccaacacgtgtgtgtccacctgtgcacatttataacgagctttcatccctctctgttcgcagaattggacgccgcccttctcaatgcagtgcttagcgcgaacatgatcacctctttgctcgctatggatgcttggtgctttctggcacgctacggcaccgcagaactttgtgctcaccatgtaacgattgtggctcatcttatcaagtcttgcccaggagagtgttaccagttaattaatctgagcattctgttaaagcggctcttctttttcatggcacccccacaccagctggagttcattcagaagttctcccctaaagaagccgagaatttgccactatggcagcatatttcattccaggccctcccaccagagctacgtgagcagactgtgcacgaggtgacgaccgtgggaacagcagagtgcagaaagtggctgagccggtcccggactctcggtgagcttgaatctctgaacacagttctctccgcccttctggccgtgtgcaatagtgcgggcgaggccctcgacaccggcaaacagacagctattatcgaggtcgtcagccagctctgggcctttttgaatatcaaacaggtggctgaccagccctacgtgcagcagacgttcagcctcttgctgcccctgctgggtttcttcatccagacactcgatccaaaactcattctccaagccgttacactccaaacttccctactgaagctcgagctgcctgactacgtccgtttggccatgctggatttcgtgtccagtctggggaaactgttcatccccgaagccatacaggatcgcatcctgcctaatttgtcctgtatgttcgccttactgctggctgatcggtcctggcttctagagcagcacaccctggaagcattcacccagttcgccgaaggcacaaaccatgaagagattgtcccgcagtgtttgtcaagcgaggagactaagaacaaggtggtgtcatttctggagaaaactgggttcgtggacgagaccgaggctgcgaaagttgagcgggtgaagcaggaaaagggtattttctgggagcccttcgctaacgtgaccgtcgaagaggcgaagcgctcaagtctgcagccatacgctaaaagagcacgacaagaattcccctgggaggaagaatataggtctgcgctgcacactattgctggggccctggaagcaacagaaagtttattgcagaaggggccagcccccgcttggttgtccatggaaatggaagctctgcaagaacgcatggataagttaaaacggtatatacatactctgggttag

SEQ ID NO: 14599 - DNA, 993 bp, Artificial Sequence
  Description of Artificial Sequence: Synthetic coding sequence
atgatgtacgagcttactagccaagcccgcgggcttagtagtcagaacctcgagatacagactacacttagaaacattcttcagacaatggtgcagttgctcggggccttgaccggatgcgttcagcatatttgcgccacgcaggagtctatcatcctggagaacattcagagcctcccttcttctgtactgcacatcattaaatctacattcgttcactgcaagaattccgagtctgtgtatagcggatgcctgcatttagtaagcgacctcctacaagctctgtttaaggaggcctatagtcttcaaaagcaactcatggaactactcgatatggtatgcatggaccctcttgtcgacgataacgacgatattctgaatatggtgatcgtaattcactccctattggatatctgttcagtgatcagcagcatggaccacgctttccacgctaacacgtggaaattcatcatcaaacagtcgttgaaacaccaaagcatcatcaagtctcagctaaagcacaaggatataattacatcactttgcgaggacatactttttagcttccatagttgcctgcaactagcagaacagatgacccagtctgatgcccaagataacgccgactaccggttgtttcagaaaactttgaagttatgtcgattcttcgctaattccctgttgcactatgcgaaagagtttctcccctttctcagcgacagctgttgtactcttcaccagctgtacttacaaatccatagcaagtttcccccttctctgtacgccacgagaatctctaaagctcatcaagaagagattgcgggagcattcctggtgacactggatccgttaatatcccagcttctaaccttccagccatttatgcaggtagtcctagactcaaagcttggatatctgtattcaaaacccttttccactgtgctgagtagtgttctcgttaacagcctgtatctctttatttatagagactag

SEQ ID NO: 14600 - DNA, 1047 bp, Artificial Sequence
  Description of Artificial Sequence: Synthetic coding sequence
atgtcacaggaaggggctgtccctgcctccgctgtgcccctggaggaactgtcgtcatggcctgaagaattgtgcaggcgggagcttccatcagtcctgcctaggctcctttccctttcccaacattctgattcctggatcgaacatattcaaattctcaagatcatcgtggagatgtttctgccccatatgaaccatctcactctcgagcagacattcttctcacaggtgctacccaaaacagttaagctctttgatgacatgatgtacgaattaacaagccaggctaggggactgtcctcccagaatctcgagatccagactactttacggaatatactgcagacaatggtgcagctgctgggggcgctgacagggtgtgtccagcatatctgcgcgactcaggaatccatcatcctcgaaaatattcagtcactgccctccagtgtgttacatatcatcaagtcaacgtttgtgcattgtaagaatagcgagtccgtctatagcgggtgtctgcatctagtctcagatctgctccaggcgttgtttaaggaggcgtactccctgcagaaacaactgatggagctgctcgacatggtgtgcatggaccctcttgtcgacgacaatgatgatattctcaacatggtgatagtgattcattccttattagatatctgcagcgttatatcatcaatggaccacgctttccacgcaaatacttggaagttcatcattaagcagagcctgaagcaccagagtattatcaaatcacagctcaaacacaaagatatcatcacttcactttgcgaggatattctgttttcattccactcctgcctccaactggccgagcaaatgactcaatccgatgcccaagacaacgcagattatcgactgttccagaagaccctgaaactttgcaggttctttgccaactcattgctgcattatgccaaggagttcctgcccttcctttctgattcatgctgcaccttgcaccagctttatctgcagatccataggtggtcattcgcccttgctgtctag

SEQ ID NO: 14601 - DNA, 2100 bp, Artificial Sequence
  Description of Artificial Sequence: Synthetic coding sequence
atgctgaagctttcaggtgagggtctccgggacagttaccactcacgacgagatcagatagccctgaaaaatctccagagtgatgtcacagaggccaaatctgacttcaccaaggaaactcttgcctcacagaatacaaaaatgattagcagcattgttatctctcagatgatcgacgagaataaatcgagagaaaacagagcttccctccccctgccatgtgcaatcgctcagagtcgtgcccaccatgcaaaacagagtctggctaatcggtcgggtgtcaacatccaccgggcattcgctcttctgccaggccggcttggcattcccgcgccctccgacgagaggggacctgaggctgaacttccacccaaggaggagcgcccgtgcggaggccctaggcgcggcttcgcctccataaccatcacagcccgtcgagtgggaccgcccgcccgagcactggtgtggggaacagccggcgatagtttgtgtcccaagtgtcgtgccgaggatacgcttttccaggctccacctgctctggcgaacggagcccatcctggccgccaccagcgtagctttgcgtgcacggagttttccaggaactcgagtgtagtgcgcctgaaggttccggaggctcacaccgggctgtgtgagcggcgcaaatattgggtgacacatgcagacgacaaggaaacatcatttagccccgataccccgttgtctggaaagagtccactcgtgttttcttcatgtgtacatttgcgcgtgtcccagcaatgcccagacagtatctattacgtggacaaatccttgtccgttcccattgaaccacctcagatcgcttcacccaagatgcatcgcagcgtcttgtcactaaatctgaattgtagttcgcatcggctgaccgcagatggcgtcgacggactcgtcaacagggaaccgataagcgaagcgcttaagcaagaactccttgagggggatcaagacctcgtgggacagcggtggaacccaggattgcaggagagccatcttaaggaaacaccctccctcaggcgggttcacctcgggaccggcgcctgtccatggtcgggctcttttcccttggaaaataccgagctggctaatgtaggcgctaaccaggtgactgtccggaagggagagaaagatcataccactcactgccatgcatctgatcatgctaaccagctcagcatacacattcccgggtggtcataccgggcggtccacacaaaggtcttttcaggcagttcgaagcgccagcagggtgaggtctgcatgacagtgtctgctccccctgtagaacagaagcctacccgtcacttcctgccgattggggattcatcccctagcgacgattgtctgagtcgggatttgagcgaaccaaccgaacgacgacaccagtcattcctaaagcccagaatcctattcccaggattcctttgtccgctgcaggacgtgtgtgcctctttgcaggaagacaacggagtgcagatcgaaagtaaattcccgaagggcgattatacctgctgcgacctggtggtgaagattaaggagtgtaagaagagtgaggaccccaccacaccagagcctagccctgctgcaccaagccctgcaccaagggatggggccggaagcccaggcctgtctgaagactgctcagagagccaacagaccccagcccggtccctgacactgcaggaagccctcgaagtgcggaagccacagtttatctctaggtcacaagaacgattgaaaaagctggagcacatggtgcagcagcggaaagctcagcgtaaggaagacttgcgccagaaacagtctctgctcccaatcagaacctcaaaaaagcagttcactatccctcaccctcttagcgacaatctcttcaaacccaaggaacggtgcatttcagagaaagaaatgcatatgagatctaagcggatttacgacaatttgcccgaggttaagaagaaaaaagaagaacagcgaaaacgggtcatactccagagtaacagactccgggccgaggtcttcaagaaacagctgcttgaccagctactgcagaggaacgctgtctag

SEQ ID NO: 14602 - DNA, 1959 bp, Artificial Sequence
  Description of Artificial Sequence: Synthetic coding sequence
atgatcagcagcattgtaatctctcagatgatcgacgagaacaagagccgggagaatcgtgcgtcattgcctctgccgtgcgctattgctcaaagtagggctcaccatgctaaacagtcgctcgcaaaccgctctggagtgaacatccacagggcgttcgccctgcttccgggcaggctgggaataccagccccgtccgatgaacggggccccgaggccgagctccctcccaaggaagagcggccatgcggcgggccccggagaggtttcgcgtctatcacaatcactgcgcgccgggttggcccgcccgcgagggcactcgtctggggaactgctggggacagcctctgccctaagtgccgggctgaagatacacttttccaagctccacctgcactcgccaacggtgcccacccagggagacaccagaggagtttcgcttgcacagaattctcccggaattcttcagtggtgcgcctgaaggttccggaagcccataccggcctatgtgaacgtcgtaagtactgggtaactcatgccgacgataaggagactagcttttcgccagatacccccctctccgggaagagtccactcgtgtttagttcctgtgtgcatcttagggtgagccagcaatgtcccgatagcatttattacgtggacaagagtctctccgtgcctatcgaaccaccacagattgcgtcacctaagatgcaccggtcagtgctttccctcaatctgaattgtagcagtcatcgactaacagccgacggtgtggacggccttgtcaaccgggaacctatctccgaagccctgaaacaggagctcctggagggcgatcaggacctagtgggccagagatggaatccgggcctccaggagagccatcttaaggaaactcctagcctcagacgagttcatttaggaacaggcgcttgcccatggagtggctccttccctctcgaaaacacagagctagcaaatgtaggcgccaaccaggttacggtcagaaaaggggaaaaggaccatacaactcactgccatgcgagcgatcacgcaaaccagctctccattcacattcccggatggtcttacagggccgtgcatacaaaggtgttcagtggttcgtctaaacgtcaacagggggaggtgtgtatgacagtgtcagcccctcccgtggaacagaagccgactcgccactttttgccaatcggcgattctagtccttctgacgactgtctgtctcgcgacctatccgagcctaccgaaaggcgccatcagagctttctcaaaccacgaatcttattccctggtttcctctgtcccctccaggatgtatgcgcctctctgcaggaggacaatggcgtgcagatagaatcaaagtttccgaaaggcgactatacatgttgcgatttggtggtgaaaattaaggaatgcaagaagtcagaagatcccacaacgccagagccgtcaccagccgctcccagtccagcaccccgcgatggtgccgggtctcccggcctcagcgaggactgctccgagagtcaacagacgccagccaggagtctcacactccaggaagccctagaggtaaggaagccccaatttatttcacggagtcaggaaaggctgaagaaattagaacatatggtgcaacagcggaaagcccagcggaaggaggacttgcgtcagaaacagtcactgctgcccatccgaactagcaagaagcaatttactatcccacacccccttagcgacaatctgtttaagcctaaggagcgatgtatatccgagaaagaaatgcacatgagatcgaagaggatttatgataacctccccgaggtgaagaaaaaaaaggaagaacagcgcaagcgggtgatcttgcagagcaatcgtctccgagccgaagtattcaaaaagcagcttctggaccagttattgcaaaggaacgctgtctag

SEQ ID NO: 14603 - DNA, 1152 bp, Artificial Sequence
  Description of Artificial Sequence: Synthetic coding sequence
atgattagttccattgtcatctcccagatgatcgacgaaaacaaaagccgagagaacagggcatccctgccactgccttgtgctattgctcagtcccgtgctcaccacgccaagcaaagccttgccaataggtcgggggtcaatatccaccgagcattcgctctgctgcccggtcgcttaggcatccccgcgcctagcgacgagcgaggaccagaggcagagctgcctccaaaggaggaacgcccatgtggcgggcctagacgaggatttgcaagcattacgatcacagctagacgcgtcggacctcccgctcgcgcccttgtgtggggaaccgcaggcgactctctatgccctaaatgccgggctgaggatactctgttccaggctcctcctgcattggccaatggtgctcatcctggaaggcaccagcgtagcttcgcatgcacagagttctctagaaactcttccgttgttaggctcaaagtgccagaagctcatactggtctgtgcgaacggaggaagtactgggtgactcacgcagatgataaggaaaccagcttcagccctgacactccattaagcggtaagagtcctctggtcttttccagttgtgtgcacctcagagtgagtcagcaatgtcccgatagtatatattatgtggacaagtctttatctgtccctattgaacccccgcagatcgcaagccctaagatgcacaggtccgtccttagcctcaacctgaattgttcaagtcatcgccttacagctgacggggtagatggtcttgttaatagagaaccaatctccgaggccctgaagcaggaactgttggagggggatcaagatctggtggggcagagatggaatcctggacttcaggagagtcacctcaaggagactccgagtttgagacgcgttcacctggggaccggagcatgtccatggtccgggagtttccccctcgagaataccgaactggccaatgtcggggccaatcaggttactgtcaggaagggagagaaggatcatacaactcactgccacgccagtgatcacgcaaaccagctgagcatccacatacccgggtggtcttaccgggctgacctactccaggagggccagcataaacagctgtccatgtttcagcgatag

SEQ ID NO: 14604 - DNA, 1152 bp, Artificial Sequence
  Description of Artificial Sequence: Synthetic coding sequence
atgatatcatcaatcgttatctcacagatgattgacgagaacaaatcacgcgaaaatagggccagcttgcctcttccctgcgctatcgcccagtcaagagcacaccatgccaagcagtcactggccaataggagcggtgttaatattcatcgagcctttgcgcttttgcccggaagactgggcattcccgccccttccgacgagcggggcccagaggctgaattgcccccaaaggaggaaaggccatgcggaggccctcggcggggcttcgcctccattacaattacggcgcgccgagttgggcctccagcaagagccctcgtctggggaacagccggcgactccctatgtcccaaatgcagggcagaggacaccctcttccaggccccacccgcgctggcaaatggtgcccaccccgggcgtcaccagaggtcttttgcctgtacagagttctcaaggaactcttccgtagtccgactgaaagtcccagaggcacacaccggcctttgcgaacggaggaagtactgggtgactcacgctgatgataaagaaaccagtttctcacctgatactccattgagtggcaagagtccacttgtattctctagttgtgtgcatctcagagttagccagcagtgccccgactctatatattacgtcgacaaaagcctcagcgtgcccatcgaacctccgcagattgcatctccaaagatgcacaggagtgttctgtctctgaatctgaattgctcttctcatcgactgaccgccgatggggtcgacgggcttgtgaatagagagcccatctcagaggcactgaaacaggaactgctcgagggagatcaagatctggtagggcagcggtggaaccctggcctccaggagtcccacctaaaagagacacccagtctccggagggtccatctagggaccggggcctgtccatggagcggatccttcccactcgagaacaccgagttagctaacgtcggggccaaccaggtgaccgtaaggaaaggcgaaaaggaccacactacgcactgccacgcctctgatcacgctaaccagctctcaattcatatccctgggtggtcctatagggccgaccttctgcaggagggccagcataaacagctgtcaatgttccagcggtag

SEQ ID NO: 14605 - DNA, 729 bp, Artificial Sequence
  Description of Artificial Sequence: Synthetic coding sequence
taatggagcggctcgttcccactggaaaacactgaactggccaacgtcggagccaatcaagtgactgttaggaaaggagaaaaagaccacacaactcactgtcatgcttctgatcacgctaaccagctgtcaatccacatccccggatggagctacagagccggagattacacctgctgcgacctagttgtgaaaatcaaggagtgcaagaagtcagaggacccaacaacgccagaaccatctcccgcggctccaagccctgcaccccgagatggagccggatctcctggactttcagaggactgcagtgagtcacaacagacacctgctagaagcctgactctgcaggaggccctagaagtgcgaaaaccccagttcatcagcaggtcacaagagaggcttaagaagttggaacacatggtgcagcaaaggaaggctcagcggaaggaggatcttaggcagaaacagtcactgctccctatacgcaccagcaagaaacaatttacgatccctcatccactgagcgataatttgttcaaacctaaggaacgttgtatctcggagaaagaaatgcatatgcgcagtaagcggatatatgataacttgccagaagtgaaaaagaagaaggaggagcaacgtaagagagtgatcctgcagagtaaccgattaagggcagaggtattcaagaagcagctgctggaccagcttctgcagaggaacgctgtgtag

SEQ ID NO: 14606 - DNA, 1989 bp, Artificial Sequence
  Description of Artificial Sequence: Synthetic coding sequence
atgctgaagctatctggggagggcttgagggactcgtaccactcacgaagagaccaaatcgctctgaaaaatctgcagtctgacgttacagaggcaaagtctgatttcaccaaggaaactctcgccagtcagaataccaagatgatttcaagcatcgtgattagtcagatgattgacgagaataagtcccgcgagaatcgcgcttcacttccccttccctgcgctatcgctcagtcaagggcacaccatgccaaacaatccttagcaaatagatctggtgttaacatccatcgagcttttgccctcctaccagggaggctgggcataccagcaccatcagacgagagaggacccgaagcagagctgccccctaaggaggagagaccttgcggcggtccccggagaggctttgcttccataaccattaccgcacgcagggtgggaccccccgctagggcactggtgtggggcaccgctggagactccctgtgccctaaatgccgcgctgaggacaccttgtttcaggctcctccggccctggctaatggggcacaccccgggcggcaccagaggtccttcgcatgtaccgagttcagccgtaattccagcgtagtgcgcctgaaggtcccagaggcccatacagggttgtgcgagcgccgcaaatactgggtcacacacgccgatgataaggagacctcttttagccctgatactcctctctctggcaagtctccactagtgtttagctcatgcgtgcatttacgcgtgagccagcaatgcccagactccatatactatgtcgacaaatcgttgtccgtccccatcgagccaccacagatagcttcacccaaaatgcatcgttccgtattgtccctaaatctgaactgcagctctcaccggctcacagctgatggcgtcgacgggctggttaatcgtgagccaataagcgaagcactgaagcaggaactactggaaggagaccaggacctcgtaggacaacgttggaacccaggcctgcaggagtctcacttaaaggagacaccttccctgcgaagagtgcacctgggaactggggcctgtccctggtccgggagtttccctctggagaacactgaactcgctaacgttggggctaatcaagtaacagttcggaaaggcgagaaggatcacaccactcattgccacgcctctgatcatgcgaaccagctgtctattcatatacccgggtggtcttacagagcagtccatactaaagtgttcagtggatcctctaagagacagcagggcgaggtctgtatgaccgtgagcgcacccccagttgaacagaaaccaactaggcatttcctgcccattggagattcctctccttccgatgattgtctgtcccgggatttaagcgagccaaccgagagaagacaccagtcttttctgaagcccaggattctatttcccggcttcttgtgcccacttcaggatgtgtgtgcctcactgcaggaggacaacggtgtgcaaattgagtccaagtttcccaaaggtgattacacctgttgtgaccttgtcgtgaagataaaggaatgtaagaagtccgaggatcccaccacccctgaaccttcccctgccgctcccagcccagccccaagggatggcgccggatcccctggactgagcgaagactgctcagagagtcagcagaccccggcgcggagtcttactctccaggaggctctagaggtccggaagccccaatttataagtcgctcccaggagaggttgaaaaaactcgagcacatggtacagcagcgcaaggctcagaggaaggaggacttacgccagaagcagtcccttttacccatccggacctctaagaagcagtttacaatacctcaccccctgtccgataacctcttcaagcctaaggagagatgtataagcgaaaaggagatgcatatgaggtctaagcggatctatgataacctgccggaggtgtag

SEQ ID NO: 14607 - DNA, 1809 bp, Artificial Sequence
  Description of Artificial Sequence: Synthetic coding sequence
atgcttaagcttagcggagaagggctgagagatagttaccactccagaagggatcagattgctttaaaaaacttgcagtcagacgtgaccgaagcaaaatcagattttacaaaggaaaccctggccagtcagaacacaaagatgattagctctatcgtaatttcgcagatgatcgacgagaataagtctcgagaaaatagagccagcctgcccctcccttgcgcaattgcacagagccgcgcgcaccatgccaagcagtccctcgcgaatagatctggcgttaatatacacagagcattcgccctgcttccagggaggttgggtatccccgccccatccgacgaaaggggtcccgaggccgaactgccacccaaggaagagcggccctgcggaggcccacgcagaggattcgctagtattaccatcacagcaaggcgtgtcggtccacctgcccgtgctttagtctggggcacagcgggcgacagcctctgccctaagtgcagggcggaggacactctcttccaggcccctccagcacttgctaatggggcccaccctggcaggcaccagcgaagttttgcctgcactgagttttcaagaaattcctcagtcgtccggcttaaggtacccgaggctcacactggcctttgtgagcgtaggaagtattgggtgacacatgctgatgataaggagacttccttctctccagacacgcccctcagtggtaaatcgcctctggtcttctcgtcttgtgttcatctccgcgtttctcagcaatgccctgactccatttattacgtggataagtcgctgtcggtccccatcgaacctccccagatcgcatcacccaagatgcatcggtccgtgctgagcctgaaccttaattgtagctctcacagactgactgccgacggagtggatggcctcgttaatcgggagcctataagcgaggctttaaagcaagaactgctggaaggagaccaagacctggtcggacagcgatggaacccagggctccaagagtcccatcttaaggaaaccccttcattaagaagagtccatcttggcaccggcgcctgcccttggagcggcagtttcccactggaaaatactgagctggcaaacgtgggggccaaccaggtgacggtccggaaaggcgagaaggaccacactacccattgtcatgccagcgatcatgcaaaccaattgtccatacatattcccgggtggagctatcgggcaggagactacacatgttgcgatcttgttgtgaaaattaaagaatgcaagaagtccgaggaccctaccacaccagagccgagcccggctgctcctagcccagctccgagagacggcgccgggtctccaggcctctccgaggactgttcagagtctcagcagacacccgctaggtccctcaccctgcaggaagctctggaggtgcgcaaaccccagtttatcagccgttcacaggaaaggcttaagaaactggaacacatggtccagcaaagaaaagcgcagcggaaggaggacctgcgccaaaagcagagtctactgcccatccggacgtcaaaaaaacaattcacaatcccgcacccgctgtctgataatctgtttaaacctaaggagagatgcattagcgaaaaggagatgcatatgcgcagcaaaaggatctatgataacttgcctgaggtaaagaagaagaaagaggagcagcggaagcgagttattctgcagagtaatcgcctgcgggcagaggtcttcaagaagcaattgctggaccaactgttacagagaaacgccgtgtag

SEQ ID NO: 14608 - DNA, 2391 bp, Artificial Sequence
  Description of Artificial Sequence: Synthetic coding sequence
atgcagcacagcggcatccctaccaagacccacccccagggatatgctgcacggtatactgagaccgcagtgcatcggactttccagataaaaaccttttctaccgagttgaagaatcacgtgatggtgatggatttcgttaaaagcaactggttccctagccagagacgggccaaagtgtgtataattcatatgtgccagggacttaaaaccgcagaacagactgcctctcggtatgagattcactctcgtctctttagctccccaaaggaccactctgcctgggagagaaatgagtccctgagtaacgcaggcctgcgcgactcttaccactcccgccgagaccagatagcccttaagaaccttcagtctgacgtgacagaggccaagtcagattttactaaggagactctggcctcccagaacaccaaaatgatctcaagtatcgtcatttctcagatgatcgacgagaacaaatcccgggaaaatcgggcatcccttccccttccatgcgccattgcccagagtcgcgcacatcacgctaagcaatccctcgccaaccgctcaggcgtgaacatccacagggcatttgcccttctgccaggcagacttggcattcctgcaccctctgacgagcggggtcctgaagctgaattgccccccaaagaggaacgcccatgtggaggcccaagaaggggatttgcaagcattacaataactgcccgaagagtggggcctccagctcgagccctggtgtggggtaccgcaggtgactctctgtgtccaaaatgccgagctgaagacactctatttcaggcaccacctgcattggccaacggggcacacccaggtagacatcagagaagctttgcatgtacagaattttcccgcaatagctctgtcgtacgcctcaaagtgccagaggctcatactgggttgtgcgagcgtagaaagtattgggtaacccacgctgatgacaaggaaactagcttctcaccagatacccccctgtctggcaagagcccactcgtgttctctagctgtgtgcacctgcgggtgagtcagcagtgcccggactctatttactacgtcgacaagtcactgtcagtgccaatcgaacctcctcagatagcgtctcccaagatgcaccggtccgtcctctcccttaacttaaattgcagctcgcacaggctcacagctgatggagttgatggtctcgtcaatagagagccaatttcagaggcgctaaagcaggagctgttagagggcgatcaggatttagttggccaacggtggaacccaggactgcaagagagccatctgaaggaaacacctagtctaaggagagttcacctggggactggagcatgcccatggagtggttcgttccctcttgagaacaccgaacttgctaatgtaggggcgaatcaggtcaccgtgaggaaaggagaaaaagaccacacgacccattgccacgctagcgatcacgcaaatcagctctcaatacatataccaggctggtcctatcgggcagttcacaccaaggtgttttcgggcagcagcaagagacagcagggtgaggtgtgcatgaccgttagtgccccccccgtcgagcaaaaaccgactcgccattttctgcccattggcgatagtagtccaagcgatgattgtctcagcagggacctatccgagccaactgaacggcgccatcagagcttcttgaagccaaggatcctgttccccggattcctgtgcccactgcaagatgtgtgcgcgtccctgcaggaggataacggggtgcagattgagagcaaattccctaaaggtgattatacatgttgtgacttggttgttaaaataaaggagtgcaaaaaatctgaggatccgactaccccagagcctagcccggctgcgccttcccccgcaccccgggatggcgcagggtcacccgggctgagtgaagattgtagcgagagccagcagacaccagcaagatctctgacactccaggaggccctggaggtccgcaagccacagtttatctcccgatcccaggaaagactgaagaagctcgaacatatggtacaacagaggaaggcacagagaaaggaggatttaaggcaaaagcaaagcctcctgcctattaggacgtcaaagaaacagttcacaataccacatcctctgtcggacaacctgtttaagccgaaagagcgatgtatctccgaaaaggagatgcacatgagatctaagagaatctacgataatcttcccgaagtgaagaagaaaaaggaggaacagcgcaagcgtgtcattctgcagtctaacaggctcagagccgaggtttttaagaaacagctgcttgatcagctgttgcaaagaaacgccgtgtag

SEQ ID NO: 14609 - DNA, 786 bp, Artificial Sequence
  Description of Artificial Sequence: Synthetic coding sequence
atgtcgactactacgtgccaagtagttgcctttctgctgtcaattctcgggcttgctggctgcattgcagctactggcatggacatgtggagtactcaagatctctatgacaaccctgtgactagcgttttccagtatgaaggattgtggcggtcctgcgtacggcagtcgtctggtttcaccgagtgccgcccttacttcacaatcctaggactgccagctatgttacaggctgtgcgggcccttatgattgtgggcattgttttgggcgcgattggattactcgtgtctattttcgcattaaagtgcattcggatcggtagtatggaggatagcgccaaggctaacatgaccttgacgtccggtattatgttcattgtgtcagggctctgcgcgattgccggcgtgtcagtgtttgccaatatgctggtcacgaatttttggatgagcacagccaacatgtacaccggcatgggcgggatggttcagacagtgcagacgagatatacttttggagctgctttgttcgtgggttgggtggccggcggcctgacattgattggaggggtgatgatgtgcattgcgtgtcgcggactcgcaccagaagaaacaaattacaaagcagtcagctatcatgcaagtgggcactcagtagcgtacaagcctggcgggttcaaggccagcaccggcttcggatctaatacaaagaataaaaaaatttacgatgggggagcgcggaccgaggatgaggtgcagtcctacccgagtaaacacgattacgtgtag

SEQ ID NO: 14610 - DNA, 786 bp, Artificial Sequence
  Description of Artificial Sequence: Synthetic coding sequence
atggcagtaactgcttgtcaggggttgggctttgtcgtgtcacttatcggaatcgccggcattattgccgccacctgtatggaccagtggtctacgcaagacctttataacaacccagtcacggctgtgttcaattatcagggactctggcgttcctgcgtgcgagagtcgtccggctttaccgaatgtcgaggatactttaccttactgggccttcccgccatgcttcaggccgtcagggctcttatgatcgttggcatagtgctgggcgcaattggattgttagttagcatttttgcactgaagtgtattcgcatcggctccatggaggactctgctaaggcaaacatgacgctgacaagcgggatcatgttcatcgtgtccgggctgtgcgcaatcgcaggagttagtgtgttcgccaatatgttggtgacgaacttttggatgtctacagcgaacatgtacacggggatgggtggaatggtacagacagtgcaaactaggtacactttcggagcagctttatttgtgggatgggtcgccggggggctgacactcatcggaggggtgatgatgtgcatcgcttgccgcggactagctccagaggagaccaattataaggccgtttcctaccacgcatcagggcattctgtggcatataaacctggaggattcaaggcctcgactggctttggctccaatacgaagaacaagaaaatatacgacggcggcgcccggacagaggacgaagtgcagtcctaccctagtaaacacgattacgtgtag

SEQ ID NO: 14611 - DNA, 753 bp, Artificial Sequence
  Description of Artificial Sequence: Synthetic coding sequence
atgtcgacaaccacctgccaggtggtggcttttctgctgtcaattctgggcctggccgggtgtattgccgctaccggcatggacatgtggtcaacgcaagatctgtatgataatcctgttacctccgtattccagtatgagggattgtggaggtcctgcgtccgccagagctccggctttacagaatgcaggccgtatttcactatcctgggactgccagcaatgcttcaagccgtgcgagccttgatgatcgtcgcgatattcgctctgaagtgcatccgcattggctctatggaggattctgctaaagcaaatatgacactcacatcaggaattatgttcattgtgtccggcctgtgcgccatcgcaggagtgagcgtcttcgctaacatgctagtgactaacttctggatgtcaacagccaatatgtacaccgggatggggggcatggtgcagacagttcagactcgctacacgtttggcgcggcactgtttgtgggatgggtcgcaggaggcttgactctgattgggggcgtcatgatgtgcattgcctgccgtggtcttgctcctgaagagaccaattataaggcagtgtcctaccacgccagcggtcactctgtggcctataagcctggaggcttcaaggcatccacaggtttcggttccaatacaaaaaacaagaagatttacgatggcggagccaggacagaggatgaggtgcagtcataccctagtaagcacgattacgtctag

SEQ ID NO: 14612 - DNA, 3000 bp, Artificial Sequence
  Description of Artificial Sequence: Synthetic coding sequence
atgggaccagctccactccccctattgttgggtttatttctgccggccctatggcgacgtgctattaccgaggcaagggaagaagccaagccctacccactcttcccaggtccttttcccgggagcctacagacagaccacacacccctcttgtctcttccacacgcttctgggtatcagcccgcgttaatgttttcacccacccagcccggtaggcctcacaccgggaacgtggcaattccgcaggtaacctcagtggaaagcaaacctctaccccctctggctttcaaacacactgtgggccacattatattatctgaacacaagggagtcaagtttaattgctcgatcagcgtgcccaatatctaccaggacaccacgatctcttggtggaaggacggcaaagagctcctgggggcacaccacgccataactcagttttatccggacgacgaggtcaccgccattatcgcatctttctctattacgtcggtgcaacggtccgataacggctcctacatatgtaaaatgaaaataaataacgaggagatcgtgtctgacccgatctacattgaagtgcagggactgccacacttcactaaacagccagagtccatgaatgtgaccaggaataccgcctttaacctgacatgtcaagccgtcgggccacccgagccggtcaacatcttttgggtgcagaactccagccgggtgaacgaacagccagagaaaagcccctccgtcctcacagttcccggcttgacagaaatggccgtgtttagctgcgaggcccataatgacaagggcctcacagtgagcaaaggggtgcaaatcaatattaaggcaatcccaagccctccaaccgaagtctctattagaaacagtaccgcacactcgatcctaatttcatgggtaccaggttttgacgggtattctccctttagaaactgctcgatacaggtgaaggaggcagatcctctcagcaacggctctgtcatgatcttcaacacaagtgcactcccccatctctatcagataaagcagctgcaggcgctggcgaactatagcatcggcgtcagctgtatgaatgagattggttggtctgcggtatcaccctggattttggctagtactaccgaaggcgcacccagcgtggcgccactgaacgtgactgtctttctcaatgagtctagcgacaatgttgacatacggtggatgaaaccacccaccaagcagcaagatggggaacttgtcgggtaccgcatctctcatgtctggcagtccgctgggatctcaaaagagctcttggaagaggtgggtcagaatgggtccagggccagaatttcggtgcaggtgcacaatgctacttgtactgttcgaattgcagcagttactaggggcggcgtgggtcctttttcggatccagtcaaaattttcataccagcacatgggtgggtggactacgccccatctagtacaccagctccaggaaacgctgatccagttctgataattttcgggtgcttctgcggattcatccttattgggctcattctctacattagccttgccatccgcaaacgagttcaagaaactaaattcgggaatgcctttacagaggaggacagtgaactagtggtgaactacatcgcaaagaagtcgttctgccgcagggccattgaactcacccttcactcattgggagtgtctgaggaactccagaacaagctggaggatgtggtgatcgaccggaacctgctcattcttgggaagattctgggtgaaggcgaatttggcagtgtgatggaaggaaatcttaagcaggaagatgggacctcactgaaggttgcagtaaaaactatgaagttagacaactccagccagagagagattgaggagtttctgtcggaagcagcttgcatgaaagacttctcccaccccaacgtcatacggctgcttggcgtgtgtattgagatgagcagccagggaatcccaaaacccatggttatcttgcctttcatgaagtatggcgaccttcacacctaccttctgtatagccgacttgaaaccggtccaaaacacatcccattacagacccttctgaaattcatggtggacattgcattaggaatggagtacctttccaaccggaacttcctgcacagggacctggccgcccgaaattgcatgttgagggacgacatgaccgtatgcgtcgccgattttggactatccaagaagatatactctggcgactattatagacagggccgaatcgccaagatgcctgttaaatggatcgccatcgagagcttggccgacagggtctacacttcgaagtcagatgtttgggcgtttggcgtaacgatgtgggagatcgcgacgcggggcatgactccctatccgggcgttcagaatcacgaaatgtatgactacctgctgcacggtcaccgcctgaagcagccagaagactgcctggacgaattatatgagatcatgtattcatgctggcggactgaccctctcgatcggcccacattctctgtcctaagactgcaactcgagaagctgctggaatcactgcctgatgtcaggaaccaggctgatgtgatttatgtgaatacccagctgctggagtcctccgagggcctggcccagggcagtactctggctccactagatcttaacattgacccagactccataattgcatcgtgcacaccccgagctgcgatctctgtggttacagcggaggtccatgactccaaaccacatgaagggcgctacattctgaatggaggctcggaagagtgggaggatctgacctcagcccccagcgctgccgtgacggcagagaagaacagtgtgttaccaggggaaagactggtccggaacggggtgagctggagccactcgtccatgctccctctcggtagctcactccctgacgagctgctgttcgccgacgactcaagcgaaggctcggaggtgttgatgtag

SEQ ID NO: 14613 - DNA, 1671 bp, Artificial Sequence
  Description of Artificial Sequence: Synthetic coding sequence
atgaaacctcccactaagcagcaggatggggaacttgtgggctatagaatctctcatgtctggcagtccgcaggcatatcgaaagagctccttgaggaggtcggtcagaacggctcacgggcccgcatctcggtccaggtccataacgcaacctgcactgtcagaattgcagccgtgacacgtggaggcgtaggcccattttcagaccctgtgaagatcttcattcccgctcacggggaatcttacacacatgcccaaatagcacgaaatctgcataaggtgagacccgcttacatcagtttaacgatatgcagtagtctcctgcaggcgagtgtttctcacatctttcagacaatgactgggctgttggtttctacacggcttggtaggctgtgtcctctctttaatagcggcgcctggcagcgcagaagttgtgctcaccacttatggttgctcctctggatccttatcggtctcatactgtatatctccctggccattcggaagcgggtgcaagaaaccaagttcggcaacgcctttacggaggaagattcagagctggttgttaattatattgccaagaagtcgttttgtcgtcgggccatcgaactgacactccatagtctgggggtgagtgaggagttgcagaacaaattggaagatgtagttatcgaccgtaacctactgatccttggcaagattctgggagaaggagaatttggttctgtgatggaaggcaatctgaagcaggaggatggtacctctctaaaagtggccgtgaaaaccatgaagctggataactcgagccagagagaaatagaggagttcttatcagaagccgcatgtatgaaggatttttcccatcccaacgtgattcgtcttctgggcacttcggagaaatgcaggtgggtggctaagcgggcgctattgatttgcagcgtcccaaaagaaaagatctctggtgtcgacaagaattgccttcaaatacacattcccctgcagacacttctgaaatttatggttgacatcgcgctgggcatggagtacctgtcaaacagaaactttctgcacagggatcttgctgcgcgcaactgtatgttgagagatgacatgaccgtgtgtgtcgctgactttggactttcgaagaaaatatattcaggggattattatcggcagggaagaatcgccaagatgcccgtgaaatggatcgctatcgaaagcttagccgaccgggtgtatacttcgaagtcagatgtgtgggcctttggtgtgaccatgtgggaaatcgccacgaggggcatgaccccctatcccggtgtgcagaatcacgagatgtacgattacttgctacatggccaccggcttaagcaaccaactgcttggatgaattgtgatcaggtcggcatgtgtagaggggtggaacctacagacacccccgcacaggaaccatttctcatgtgggaaattgtctatgaatgcactctagcgggagaacccatccccgacagaccaaccttctctgttctgcgcctgcaattggagaagctcttagagagcctaccagatgtgcgcaaccaggctgacgtcatctacgtcaatacccagctcctggagtcctctgaagggctggccctgcacccatgctctactggcctcgagcacagaccctag

SEQ ID NO: 14614 - DNA, 2472 bp, Artificial Sequence
  Description of Artificial Sequence: Synthetic coding sequence
atgaagatcaacaatgaagaaatcgtgtccgaccccatttacatcgaggtgcagggtcttccacatttcaccaaacagcccgaatctatgaatgtgacaagaaatacggcatttaacctgacctgtcaagccgtgggtcccccggagccagtcaatatcttttgggtgcagaattccagccgagtcaatgagcagccagagaagagtccatccgttttaacagttccaggcctgaccgaaatggccgtgttctcctgcgaggcccataatgataagggactaacggtgtccaagggagtccagatcaacataaaggccattccctcccctcctaccgaagtgagcattcgcaattcaacagcccactcgatcctaatcagctgggtgccgggcttcgacggatacagtcctttccgcaactgcagcatacaggtcaaagaagcagatcccttaagtaatggaagtgtgatgatcttcaatacttcggctctgccccatctctaccaaatcaaacagctgcaggccctggcaaattattctatcggcgtgtcctgtatgaacgaaatcggatggagtgccgttagtccctggatcctcgcctccaccaccgagggtgctccatccgtagctcctcttaacgtgacagtgttcctgaacgagtccagcgataacgtggatatccggtggatgaaaccccccaccaaacagcaggacggtgagctggttgggtatagaatctcccatgtgtggcagtccgccggcatcagcaaggaattgcttgaggaggtcggccagaatggctcgagggctcggatcagcgtgcaggtccacaacgctacctgcacggtgcgtatcgcggccgtcacccggggcggcgtgggacctttctcagatccggtaaagatctttattcctgcgcacgggtgggtcgattatgcccctagctctacccccgcacccggcaacgcagatcctgtattgattattttcggatgcttctgtggctttatcctgattggcctgatattgtacatttcccttgcgatcagaaagcgggttcaggagacaaagttcgggaacgccttcacagaggaggatagtgaactggtggtcaactacatcgctaagaaatctttctgccggagagcaatcgagctaacactgcactcgctgggggtgagcgaggaactccagaataagctggaggacgtggttattgatagaaacctgctgattcttggaaaaatccttggcgaaggcgaattcggcagtgtcatggagggtaacctaaaacaggaggacgggacttctctgaaggtggccgtcaagacaatgaagcttgacaactcctcccagcgagaaatcgaggagttcctctccgaggccgcgtgcatgaaggacttttcacaccctaacgtgatacggttactgggagtctgtatagaaatgagctcccagggaatccctaagcctatggtgattcttcccttcatgaaatatggagatttacatacatatctcctgtattctcggttggaaaccggcccaaagcatatccctctgcagactttactgaaattcatggtagacattgcattagggatggaatatctgtccaatcgaaattttctgcaccgagatcttgcagctcggaactgcatgctgagagatgacatgactgtgtgcgtcgcggacttcggactttcgaagaaaatctactccggcgattattaccgccagggacgaatcgccaaaatgccagtaaagtggatcgccatagaaagcttagccgaccgcgtgtacacttctaagagtgatgtttgggcctttggagtgactatgtgggagattgccacaaggggcatgacgccgtatcccggggtccagaaccatgagatgtatgattatctgctgcatgggcataggctcaaacagccagaggactgcctggatgaattatatgagatcatgtacagctgttggcgaaccgacccccttgaccggccaaccttttccgtgctccggctccagttggaaaagcttctcgagagcctacctgatgtcagaaaccaagccgatgtgatctatgttaacacgcagctactggaaagtagtgaaggcctggcccagggaagtaccttggcccctctggatctgaatatagacccggacagtataattgcttcttgtaccccacgcgccgcaatttctgtggtgaccgctgaggtgcatgactctaaaccacatgagggacgttacatcttaaacggaggaagcgaagaatgggaggacctcaccagcgcaccaagcgctgctgtcaccgccgaaaaaaatagcgtcctgcctggcgaaagacttgtacgcaatggggtgagctggtcacattcaagcatgctccctctcggtagttcattgccggatgaactgctcttcgcggacgactccagcgaaggctccgaggtgctcatgtag

SEQ ID NO: 14615 - DNA, 3000 bp, Artificial Sequence
  Description of Artificial Sequence: Synthetic coding sequence
atgggaccagcgcccctcccgctgttactgggcctgttcttaccggcgctgtggagacgcgcaataactgaggctagggaagaggcaaagccctatcccttatttcctgggcccttccccggctctctgcagacagatcataccccgctgctgagcctcccacacgctagcgggtaccagccggctctgatgtttagtccaacccaacccggccgtcctcacactggcaatgtggcgattccccaggtgacctccgtggaatccaagccattgccacctttggcctttaagcataccgtaggacacataattcttagtgagcacaaaggtgtgaagtttaactgcagcatttccgttcctaacatctaccaggacacaactatcagctggtggaaggacggtaaggaattgttaggcgcacaccacgccatcacccagttctacccagatgacgaggttaccgctatcattgcatccttttccattaccagcgtgcagcgcagtgacaacggtagttatatatgtaagatgaagattaacaatgaagaaatcgtaagcgatccaatctacattgaggtgcagggacttcctcacttcacaaagcagccagagtctatgaacgtcacgaggaatactgccttcaacctgacttgtcaggcagtggggcctccagagcccgtgaacatcttctgggtgcagaacagctcccgagtcaacgagcaaccagaaaaatcaccctccgttctcacagtgcccggtctaaccgagatggccgttttctcttgcgaggctcacaacgacaagggccttactgtttcaaagggggtgcagataaacataaaggcaattccctcaccccctactgaggtgtctattcgcaatagtaccgcccactccattctcattagctgggttccagggttcgacggttacagtccattccgcaactgttcgatccaggtgaaagaggctgacccattgtccaatggctccgtcatgattttcaatactagcgccctgccgcacctgtaccaaatcaagcaactccaagctctcgcgaactattccatcggcgttagttgcatgaatgagattggctggtccgcggtatcaccctggattctggcatcaacaactgagggcgcacccagtgtcgcccccttgaacgtgaccgtgtttctaaatgaaagctccgataacgtggatattaggtggatgaaaccaccgactaaacaacaagacggcgaattggttggataccgcatctcgcatgtttggcagtccgccgggatcagcaaagagctgcttgaagaagtagggcagaacggctcgagagcgcgcatctccgtccaggtccacaacgctacgtgtaccgtgagaatcgcagcagttacccgcggcggggtgggccccttctctgatccggtaaagatctttatcccagcacacggctgggtggactatgcccctagtagtactcctgctccagggaacgctgaccccgtcttgattattttcgggtgcttttgtggatttatcctgatcggactcatcctctatatcagtctggctattaggaagcgggtgcaggaaacaaaattcggaaacgcctttaccgaggaagattccgagctcgttgtgaactatattgctaaaaaatctttttgccggagagcaattgaactgacgttgcatagtttgggggtaagtgaagagctgcagaacaagctcgaggacgtggtgattgatcggaacctcctgatccttggcaagattttgggcgaaggcgagtttggctccgtgatggagggaaacctaaaacaagaggatggaacctccctgaaagtggcggttaagaccatgaaactggataatagttctcagcgcgagatagaggagttcctgtccgaagccgcttgcatgaaggactttagccacccgaacgtgatacggctcttgggcgtgtgtattgagatgtcgtcccaggggatcccgaagcccatggttattcttcccttcatgaagtacggggatctgcatacttaccttctctattcgcggttggagacaggtccaaagcatattcccctgcagacccttctaaaatttatggtggacatagccctcggtatggagtacctgagtaacagaaactttcttcaccgtgatttggccgcgcgcaactgcatgctccgggatgacatgactgtgtgcgtcgcagatttcggtctgagtaaaaaaatctacagcggcgactactatcgtcaaggtagaattgccaagatgcctgtcaaatggatagcgatcgaatccctggccgatagggtctatacatccaagagcgacgtgtgggcctttggagtgaccatgtgggaaatcgccacacgaggcatgactccctacccaggcgtgcagaaccatgaaatgtacgattatctgctacacgggcacaggttaaagcaacctgaggactgcttggacgagctgtacgaaataatgtactcatgttggcggacagacccacttgatcgtcccacgtttagcgttctgcgcctccagctggaaaagctgctcgagtctttgccagatgttcgtaaccaggccgacgtcatctacgtcaacacccagctgctggaatcctctgagggactcgcccaaggcagtactctggctcccctggacctgaatatcgatccagatagtatcattgcaagctgcactccgagagctgcgatctctgtcgtgactgccgaggtccacgactccaaaccacatgaaggcaggtacatccttaatggaggatccgaggagtgggaggatctaacctctgccccaagtgcagccgtaacagccgaaaagaactcagtgttgcccggtgaacgcctcgtacgtaatggggtctcctggagtcatagttctatgcttcctctcggcagctcgctgcctgatgagcttctgtttgcagacgatagttctgagggttcagaggtgctcatgtag

SEQ ID NO: 14616 - DNA, 501 bp, Artificial Sequence
  Description of Artificial Sequence: Synthetic coding sequence
atggcctccggcgtggccgtgtcagatggagtgattaaagtcttcaatgacatgaaggtgcggaaatcaagtacaccagaagaggtaaaaaagcgtaaaaaagccgtccttttctgcctctccgaagacaagaaaaatatcatattggaggagggaaaagaaatccttgtcggtgacgtgggacaaactgtggatgatccatatgccacctttgtcaaaatgctccccgataaagattgccggtacgctctttacgacgccacctacgagacaaaggaatcgaagaaggaggatctggtgtttattttctgggcaccagaatccgctcctctcaaatccaagatgatctacgcatcttcaaaggatgctatcaaaaaaaagcttacaggaattaaacacgaattacaggccaattgttatgaagaggtgaaggaccggtgcactctagccgagaaactaggtggctccgccgttattagcctcgagggaaaaccactttag

SEQ ID NO: 14617 - DNA, 501 bp, Artificial Sequence
  Description of Artificial Sequence: Synthetic coding sequence
atggcttccggcgtggccgtgtccgacggagttataaaggtctttaacgacatgaaagtgaggaagtctagtacacccgaagaggtgaaaaaacgcaaaaaagccgtcctcttttgcctgtcggaggacaagaaaaacatcattttggaggaaggtaaagaaattctggtgggagatgtaggacagactgtggacgacccttatgcaacgtttgtcaaaatgctccctgacaaggactgtagatatgctttgtatgacgcaacttacgagacaaaagaaagcaaaaaggaggatcttgtgtttatcttttgggcaccagaaagcgcgccccttaaatcgaaaatgatttatgcatcatctaaagatgcaattaagaagaagctgacaggcattaagcacgaactgcaggccaactgttatgaggaagtgaaggatcgctgcaccttggcagaaaaactgggcggttcagccgtgattagcctagagggcaagccgctctag

SEQ ID NO: 14618 - DNA, 276 bp, Artificial Sequence
  Description of Artificial Sequence: Synthetic coding sequence
atggcttcgggggttgccgtcagcgatggggttatcaaggtgttcaacgatatgaaggtcaggaaatccagtacaccggaagaggtgaaaaaacggaaaaaggccgttttgttttgcctgtctgaggataagaagaatattatccttgaagagggcaaggaaatcctcgtcggagacgtgggtcaaacggttgacgatccatacgctaccttcgttaaaatgctccctgacaaggattgtaggtacgctctctacgatgccacctatgaaacatag

SEQ ID NO: 14619 - DNA, 4101 bp, Artificial Sequence
  Description of Artificial Sequence: Synthetic coding sequence
atgctgtctttcgtggatactcggaccttacttctgctggcggtgacgctgtgcttagctacttgccagtctttacaggaagaaacagtgcggaagggaccggctggcgaccggggaccccggggcgagcggggccctcctggcccacctggtcgcgatggggaggacggccctactggacccccaggcccaccaggtccccccggcccccctggactgggtggtaattttgccgcacaatacgatggcaaaggagttggtttagggcctggccctatgggcctgatgggccccagaggccctcctggggcagccggagcaccgggtccacagggttttcaaggccccgccggtgaacccggcgaacccggacagactggtcccgcaggtgcccgaggccctgccggccccccaggtaaagccggggaagacggacacccgggaaagccaggccgccccggcgaaaggggagtcgtcggacctcagggcgcgcgggggttccccggcactcccggactacccggcttcaaggggatacggggtcacaatggcttggatgggctcaagggccaaccgggggcaccaggagtaaagggggagcctggtgctcccggagagaacgggacgcctggtcaaactggggctcgggggctgcccggcgagaggggacgcgtaggcgctcctggacccgcgggggcacgtggttcagatgggtccgtggggcctgtaggccctgcgggccccataggttcggctgggccgcccggattcccaggtgcccccgggcctaagggagagataggtgcagtcggcaatgccggccctgctggccccgctggacctcgtggggaagtaggtctgccaggactgtcagggcccgtcggacctcctggcaaccccggcgctaacggactgaccggcgcaaagggagctgccggactgccaggcgtggccggagctcctggattgccaggccctcgtgggatacctgggcctgtgggggccgctggtgccacaggagcacgtgggctggtgggagaaccgggacccgccgggagtaagggcgaaagcggtaataagggcgagcccggttccgctggcccacaaggcccgcccggtccctcgggtgaagaaggaaagcggggcccaaatggggaggctggctcagctggtccccctgggcctccggggctccgagggtccccagggtccagaggactccccggagcagacggacgcgccggagtgatgggacctccaggttcccggggggcaagcggtcccgcaggggtcagagggcccaacggtgacgctgggaggccgggggagccaggactgatggggcctcgaggcttacccggttctccaggtaatattgggcctgctgggaaagaaggccccgtcggcctgcccgggattgatgggagacctggacccatcgggccggccggggcaaggggcgagcctgggaatattggattccccggccccaagggcccaactggcgaccctggaaagaacggagataaggggcacgctggtttggctggcgctcgcggagcccctggtccggacggcaataatggggcacagggccctcccggtcctcagggagtgcagggcgggaagggcgaacagggccctcccggacctcccggctttcaaggcctaccaggcccaagtggcccagccggagaagtggggaagccgggcgagcgaggcctgcatggcgagttcgggttacccgggcccgcagggccccgaggggaacgcgggccccctggcgagagcggggcagcaggcccaactggacccataggttcaagggggcccagtggcccaccggggcctgatgggaataaaggggagccaggagtagtgggcgctgtgggaactgcaggacccagcggaccttctggcctgccaggcgagcgtggcgctgccggcatccccggcggcaaaggcgaaaagggcgaacctgggctgcgaggggagattgggaacccagggagagatggcgccagaggagcgcctggagccgtgggcgctcctggaccggcgggcgcgaccggggatagaggcgaggctggcgcggcgggccctgccggacccgcggggccacgcggctctcctggcgaaaggggtgaggtgggccctgctggcccgaacgggtttgccggaccagccggtgcggctggccaaccaggagctaagggcgaacgaggcgcaaaaggacctaaaggggaaaacggtgtagtgggccccacaggaccagtcggggctgcgggaccagcaggaccaaacggaccgcctggtcccgctggcagcaggggagatggaggtccgcccggtatgaccgggttcccaggggcagcaggacggacgggccctccaggtccctccgggattagcggaccacctggaccaccgggaccagctggtaaggaagggctgaggggacctcgtggcgatcaaggacccgtaggacgcactggggaagtcggagcggtcgggcctccgggcttcgccggggaaaaaggcccttccggcgaggccggcacagcgggtcccccgggtacccccgggccgcagggactgctgggcgcccccggcatccttggcctgcctggttcccggggggaaaggggcctgccaggcgttgctggagcagtaggcgagcccggaccgttggggatagccggcccccccggcgctagggggccacctggggccgtcggcagcccgggggtcaacggtgctccgggagaagccggaagggacggtaaccctggtaatgatggtcctccagggcgggacggccagcctgggcacaagggcgagcgcgggtaccccggtaatattggacccgtcggcgcagccggtgcgccaggtccccacggcccagtcggccccgctggaaaacacggaaatcggggtgagaccgggccttccgggcccgtgggtcctgccggtgccgtgggccctcgcggaccctcaggtccccagggaatccgcggggataaaggagaacccggcgagaaaggcccccggggactgccaggattaaagggtcacaatggcctgcaaggactccccggaattgctggccatcatggcgatcaaggcgctccgggctccgtggggccagcaggcccccggggacctgcagggccatccggtcctgcgggcaaggatggaaggaccggccatcctgggacagttggtcccgctggaataagggggccgcagggtcaccaaggtcctgctggcccacctggaccaccaggcccacccggacctcctggagtttctggaggtgggtatgactttggctatgatggcgatttctacagggccgaccaaccaagaagtgcacccagcctccggcccaaagactatgaagtggacgctaccttgaagagcctcaataaccagatagagacattattaactcccgaaggcagcagaaagaacccagcaagaacctgtcgtgaccttcggttaagtcaccctgaatggtcaagtggctactactggattgatcccaaccagggctgcacaatggatgctattaaggtctactgcgatttcagtacaggggagacgtgcatcagagcccagcctgaaaatatcccagccaagaactggtacaggtccagtaaggataagaaacatgtgtggttgggcgagacaattaatgcaggttctcagtttgagtataacgttgaaggcgttacttcaaaagagatggcgactcaactggcttttatgaggctgctcgctaattatgcatcgcagaatatcacgtaccattgcaagaatagcatcgcgtacatggatgaagagactggaaacctgaagaaagcagtaatcctgcagggctctaacgacgtggagttagtcgcggaagggaacagccggttcacgtatacagtgctagttgacggttgtagtaagaagacaaatgagtggggcaaaacaattatcgagtataagacaaataagccatcccgactacccttcctggatattgcccccctggacattggtggcgctgatcaggagtttttcgttgatattgggccagtttgcttcaagtag

SEQ ID NO: 14620 - DNA, 4104 bp, Artificial Sequence
  Description of Artificial Sequence: Synthetic coding sequence
atgttgtcatttgtggacacgcgcacactgctgctcttagctgtgactctgtgtctggccacatgtcagtgcacccttggcggccagacactgagcaagttccctccataccttcacatcgagcgctccgaacagggccctcccggaccccctggtcgcgacggcgaagatggccctacggggccaccggggccaccaggccctccaggaccaccgggcttgggcgggaactttgccgcgcagtatgacgggaagggcgtgggtcttggacctggacccatgggccttatggggcctcgcggtccgcccggcgccgcaggggcccccgggccacagggctttcaaggacccgcaggcgaacccggtgaacccggccagacaggtccagccggagcccgcgggcccgctggcccacccggaaaggccggcgaggacggccaccctggaaagcctgggcgacccggtgagcgcggcgtagtcgggcctcagggcgcccggggttttcctggtacaccaggcttacccggtttcaagggtatccgaggacataatggacttgacggtcttaagggtcaacctggagcacctggggtgaagggggaaccgggcgcccccggtgagaatggcacaccaggccaaactggggcccgcggcttgccgggtgagcgtggaagggtgggggcacctggccctgccggtgcccgcggctcagacgggagcgtaggccccgttggccctgcggggcccatcgggtctgcaggtccgcccgggtttccaggagctccaggtcccaagggggaaatcggagccgtgggcaatgcagggcccgccggccctgcgggtccaagaggtgaagtaggactgcctggcctgtccggtccagtcgggcctccaggaaatcccggggcaaatggccttacaggcgcaaagggagcggccggccttcccggagtggccggtgccccgggattgcccggcccacgcggaattccaggcccggtaggggcggccggagctaccggcgcacgcgggttggtaggcgagccaggcccagctgggagtaagggcgaatccgggaataaaggtgagcctggtagtgcgggaccacaaggtcccccaggcccatcaggtgaagaaggtaagagagggcccaatggggaggccggttcagcgggacctccgggccctccgggtctccgagggtcccctgggagtagagggctgcctggagccgatggccgagccggcgtcatgggcccgcccggatcccggggcgctagtggacccgcaggagtgcgaggacctaatggcgatgcaggcagaccgggcgaaccggggctgatgggaccaaggggactgcccggatcccctgggaatatcggccccgccggcaaagagggacctgtcggactaccaggtatagatggccggcccgggcctatcggtcccgccggcgctcgcggagagcccggaaacatcggcttcccaggcccgaagggccctactggagatcccgggaaaaacggtgataagggacacgccggcctggctggcgcgagaggtgcccccggacccgatggcaacaacggcgcccagggcccacccggccctcagggggtccaaggcggaaagggggagcagggcccccccggcccacccggatttcagggactgcctgggccctcaggccctgctggagaagttggcaagccaggggaaagaggtctgcatggagaatttgggctgccgggccccgccggacctagaggcgaacgcggacccccaggggagagtggcgcagctggccctactggtcctattggctccagaggtccgtcagggcctcccggacccgatggaaataagggagagcccggggttgtgggggctgtaggtaccgctggacctagtggacccagcggactcccaggggagaggggggccgcaggcattccaggaggcaagggcgagaagggtgagccaggcttgcgtggcgagatcgggaatccaggccgggatggagctcgaggagcgcccggagcagtaggagccccaggtcccgcgggggccactggcgaccgaggagaggcaggagctgctggaccggccggccccgccggcccacgaggctcgccaggagaacgcggggaggtggggccagcgggacccaacggcttcgccggaccagccggcgctgcgggccaacctggcgccaaaggagagcgtggggccaaaggacccaagggagaaaacggtgttgttggccccaccggcccggtgggcgctgcaggcccagccgggcctaacggcccaccaggcccagcaggatccaggggtgacgggggtccccctggaatgactggattcccgggcgcagcaggccgcactggtccacctgggcccagcggcatttccggtcccccggggcctcctgggcctgccggcaaagaaggactgaggggacctcgcggggatcaaggtcccgtgggtcggacgggagaagtgggggccgttggaccccccggcttcgctggtgaaaaagggcccagtggggaggcaggaaccgccggccctccggggactcctggtccgcaggggttattgggcgcccctgggattctaggactcccaggcagccggggtgaacgaggtctccctggtgttgccggagctgtaggagaacccggaccactgggaattgccggcccccccggcgccaggggcccacccggcgcggtgggatctcccggcgtgaacggtgcaccaggggaagcaggcagggatggaaatcccggaaacgatgggccacctgggcgcgacggtcaaccagggcacaagggcgagcgcgggtatcctggtaacatcggccccgtaggggccgcgggtgcacccggaccccacgggcccgtggggccagctggtaagcatggcaatcgcggtgaaaccggcccctccggacccgtgggcccagcaggcgcagttggtcctagaggcccatccggcccccagggcattcgcggggataagggagaaccgggggagaagggcccaaggggtttacctggtctgaaaggccataacggactgcaggggctccctggaattgctggacatcacggcgaccaaggagcccctgggtcagttgggccagcaggcccgaggggtccagcaggtcctagcggtccggccggtaaggatggccggactggccaccccggcacagtcgggccggcaggcattagagggccccagggccaccagggacctgccgggcctcccggcccgcccggtccccctggcccacctggagttagtgggggggggtacgactttgggtatgatggtgacttttaccgggcagatcagccaagaagcgcaccaagcctccgtcccaaagattacgaggtggatgccaccctcaagagcctaaacaatcagatcgagaccctattgacaccagagggatcccgtaagaaccccgcccgtacatgccgggacctgcgactttcccatccagagtggtcgagcggatattactggattgatccaaatcaagggtgtactatggatgcgataaaggtgtactgcgatttcagcaccggagagacctgcattcgggcccaaccggagaatatcccggctaaaaattggtatcgaagctccaaggacaagaagcacgtctggcttggcgagacaattaatgctggatcacaattcgagtataacgtggagggcgttacgagcaaagaaatggccacacagctggcatttatgcggctgctggcaaattacgcctctcaaaatataacttaccattgtaaaaattcgatcgcctatatggacgaagagaccgggaacttgaaaaaggctgtaattttgcaagggtcaaatgatgtagagctagtggctgaggggaatagtcgttttacttacactgtcctggtggacggttgttcaaagaagaccaacgaatggggcaaaactattatagagtacaagactaataagccatccaggctgccttttctcgacatcgccccattagacatcggcggcgccgaccaggagttttttgtggatatcggaccagtgtgttttaaatag

SEQ ID NO: 14621 - DNA, 4401 bp, Artificial Sequence
  Description of Artificial Sequence: Synthetic coding sequence
atgatgagtttcgtacagaaaggatcttggttgctactcgcgctgctgcaccctaccattattttagctcaacaggaagctgtagaaggcggttgttctcacctgggtcaaagctacgctgaccgtgatgtctggaaacccgagccttgccagatctgtgtgtgcgactcaggatcagtcttgtgcgatgatatcatctgcgacgaccaggaattagattgtccaaatcccgagattccatttggggagtgctgtgctgtgtgcccccagcccccgacagcccctactaggcctccgaacgggcaggggccccagggccctaagggggatcccgggcccccaggcatacccggtcgaaatggcgatcccggaatcccaggccagccgggcagccctgggagccctggccccccaggaatctgtgagtcttgccccactggtccccagaactacagcccacagtacgattcttatgatgtcaagtcaggagtggctgtgggtggactcgctggataccccggacctgcaggtccccctgggccccctggtcccccgggcactagcggacacccaggttctccaggctctcccggttaccaaggcccaccgggtgagcccggacaagcaggcccttcagggccccccggcccacctggggcgataggccccagcggccctgctggaaaagacggagagagtgggcgtccagggcgaccaggcgaacggggcttgcccggacctcccggtattaaagggccagctggcattccgggattcccgggaatgaagggtcacagaggctttgatggccgaaacggtgagaaaggggaaaccggagctcccggcctgaaaggggaaaacggcctccccggcgagaacggcgcccctggaccgatgggccctagaggagcccccggcgagcgaggtagacccgggctgcctggagcagctggtgccaggggtaacgatggagctagagggagcgacggacagcccgggccacccgggcccccaggtactgctggattcccaggaagccccggagccaaaggtgaggtgggccccgcaggctcaccggggtccaatggcgccccaggccaacggggggaaccagggccccaaggccacgctggcgcccaaggacctcctgggcccccagggattaacgggtctcccggcggaaaaggtgagatgggccctgccggcatacctggagccccaggactgatgggggccagggggccacccgggcccgccggtgctaacggcgccccaggtttgcgggggggcgcaggcgagccggggaagaacggggccaaaggcgaacccggccccagaggggagagaggagaggccggtattcctggcgtgccaggtgcaaagggtgaggatggcaaagacggaagtcctggagagcctggcgccaacggactgcctggcgctgccggcgagagaggggcacctggctttcgggggccagcaggccctaacgggattccgggcgagaagggcccggccggagaacgaggggcccccggcccagctggaccacgaggggcagccggcgagccaggccgggacggagttccagggggtcccgggatgcgcggcatgccaggaagccctgggggtccaggctctgacggcaagcccgggccgccagggagtcagggggagagtgggaggcctggcccccctgggccgagtggcccccgcggccagcccggggtcatgggatttcccggacctaaaggcaacgatggtgccccaggcaagaatggcgagcggggcgggccgggcggccccggcccccagggccctcccggaaagaacggcgagactggcccccagggaccgcccggacctacagggccgggcggggataaaggtgacaccgggcctcccgggccccagggcctgcaggggctccctgggacaggtggaccccctggcgagaatgggaaacccggcgaaccaggtccaaaaggggacgccggcgcccccggcgctcctggggggaagggcgatgccggagcccccggcgagcggggacccccgggtctagctggagcccctggcctcaggggaggggccgggccgcccggacccgagggaggcaagggggcagcaggaccccctggccccccaggcgcagctggaactcccgggcttcaaggcatgccgggcgaaaggggcgggttgggatcacctgggcccaagggagacaagggcgagcccggcggcccgggtgccgatggggttccgggaaaggatggtcctagagggccgacgggccccatcgggcctcccgggccagccgggcagcccggtgataaaggggaaggcggagcccctggattgcccggaatcgctgggcccaggggttctcctggcgagaggggcgagaccggaccccctggcccagctggctttccgggagctccaggccagaatggcgaacctggaggaaaaggcgaaaggggcgcgccaggggagaagggtgagggtggaccgccaggtgtggctgggcctccgggtgggtccgggcccgccggacctcctggcccacaaggcgttaagggcgaacgaggatctcccggaggccccggtgccgcgggatttcccggtgcccgggggcttcccggacctcccggtagcaatgggaaccccgggccaccgggaccttcagggtccccagggaaggatggccctcctgggcccgctggaaataccggcgcccctggtagccccggggtgtccggtcctaaaggagatgccgggcagcccggcgagaagggtagcccaggtgcccaaggaccgcccggagcccccgggccgctgggcatcgcaggtatcacaggcgcccgaggactcgcggggccaccgggcatgcctggacctaggggatctccagggcctcagggcgtcaagggagaaagtggaaaaccaggggcgaacggactcagtggggagagaggaccacccggcccacaaggactccccggcttagctggcaccgctggggagccagggcgagatggtaatcccggcagcgatggactccctggccgcgatggtagtcccgggggtaagggtgataggggagaaaatggtagtcccggcgcccctggcgctccaggtcacccagggcctccaggtcccgtaggcccagccgggaagtccggggaccgaggcgaaagcggcccggccggccccgccggagcacccgggcctgctggctcccgcggtgcccccggccctcagggtcccaggggtgataagggcgagactggggagagaggagcagcgggcattaaagggcacagaggctttcctggcaatcccggtgccccaggttcgcccggccctgcaggccagcagggagccatcggctcccctgggcccgcagggccccgcggacccgtcgggccttcaggcccccccgggaaagacggcacaagcggtcatcctggaccaatcggtccaccgggcccacgtggcaaccggggcgagagaggctccgaaggctcacccgggcatccaggccagccaggtccgccgggacctcccggcgcgccgggcccgtgctgtggcggagtaggcgccgcagcaattgcaggcattgggggcgaaaaagcagggggcttcgcaccatattacggagatgagcccatggattttaaaatcaatacagacgagattatgacaagcctaaaaagcgtgaacggccaaatcgagagtctgatctctcccgacggatcccgaaagaatcctgcccgcaactgtagagacctgaaattctgccacccggagcttaaatctggggaatattgggttgacccaaatcagggctgcaagctggatgccatcaaagtgttttgtaacatggagactggggagacgtgcatttctgccaatccattgaacgtgccccgcaagcactggtggactgactctagcgccgagaagaaacacgtgtggttcggggaaagcatggacgggggttttcaattctcgtacggaaatcccgagctgcctgaagacgttctcgatgtgcacctcgcctttcttagactgttgagttctcgtgctagtcaaaatatcacctaccactgcaagaactcaatagcatatatggatcaggcaagcgggaatgtgaaaaaggccctgaaactgatggggtcaaacgaaggagaatttaaggcggaaggtaacagtaagttcacctacaccgtgctggaggatgggtgcactaagcacactggggagtggagcaaaaccgtgtttgagtacaggacccgcaaggcagtaagactacctatcgtggatatagccccgtacgatataggaggcccagatcaggagttcggagttgacgtgggaccagtatgtttcctgtag

SEQ ID NO: 14622 - DNA, 3492 bp, Artificial Sequence
  Description of Artificial Sequence: Synthetic coding sequence
atgatgtcctttgttcagaaaggaagctggctgctactggctctgttgcacccgaccataatcctggcgcagcaggaggcagttgaaggcggctgtagccatctgggccagtcatacgcagacagggacgtatggaaaccggaaccctgccagatatgcgtctgcgactcagggagcgtgctctgtgatgatattatttgcgatgaccaggagctggactgtccaaatcccgaaattccgtttggcgaatgttgtgcagtgtgtccccagcccccaactgctcctacccgtcctcctaatggccaaggtccacagggacccaagggagacccaggaccaccaggaataccgggaaggaacggtgaccctggaatcccaggacagcctgggtcgcctggtagcccaggccctccggggatatgtgaatcatgtccgaccggccctcagaattactccccacagtacgactcctacgatgtaaagtcgggggtcgccgtaggcggactagccgggtatcctggccccgcgggacctccaggaccgcctggccctcctggtacatcaggacaccccggatcgcccgggtcccctggttatcagggacctccaggagagcccggacaggcaggtccttctggccctccaggacctccaggcgctataggtccaagcggacccgcagggaaggatggagagagcggaagaccaggtagaccgggcgagcggggtttgccaggaccgcccggtatcaagggccccgccgggatcccgggtttcccgggaatgaagggccaccggggattcgatggacggaacggtgagaaaggtgaaactggggcaccaggcctgaaaggggagaacgggctgcccggagagaacggcgctcctgggccaatgggcccaaggggcgctccaggcgaaagaggccggccaggtctaccaggcgctgccggtgctcgcggaaacgatggagcccgtggaagcgatggacagccgggtccccccggacccccgggcacagcgggtttcccaggatccccaggtgctaagggtgaggtgggccccgcagggtctccaggatctaacggagcaccaggacagcgcggcgagccaggtccccaaggccacgctggagctcaggggcccccaggcccgccagggattaacggtagccccgggggcaagggtgagatgggtcctgccggcatccccggggcacccggcctgatgggggctcggggtcctcccggtcctgccggtgctaacggagctccagggcttcgaggtggggccggagagcctggaaaaaatggtgctaagggcgagccaggtcctcggggtgagcggggcgaagcaggaatccctggggttcccggcgccaaaggagaggacggcaaggatggtagcccaggggagcccggagccaatggcctccccggagccgcaggtgagaggggggccccgggcttcagaggacccgctggacccaacggaattcctggggagaagggacctgctggcgaaaggggagccccgggtcccgctggcccaaggggagctgccggggagccgggtcgagatggcgtccctggaggcccggggatgagaggaatgccaggctccccaggtggcccaggcagtgatggaaagcccgggccgccaggatcccagggggagtcaggacgtcccggccctcctgggccatctggacctaggggtcaaccaggcgtgatgggtttccctggccctaagggaaacgacggagcacctggcaagaatggagagcgcggtggccctggcggccctggcccacaggggcctcccggcaaaaatggtgaaacaggcccccaggggccaccgggacccaccggtcccggtggcgacaaaggagatactggccccccaggaccccaggggctgcaagggttacccgggaccggaggcccccctggagaaaacggtaagcccggagaaccgggaccaaagggagatgctggcgctccaggcgcaccagggggcaaaggagacgccggagcccccggcgagcggggaccgcccggactggctggggcccctggcctgcgcgggggcgctgggccccctggacctgaaggagggaaaggagccgcgggcccacccggcccgcccggggccgccgggacccccggactccaggggatgcctggggagcgtggagggctgggttcacccggtcccaaaggagataagggcgaacctggtggtcctggcgcggacggagttcctgggaaagacggaccccgagggcccactggcccgatcggcccccccgggcctgctgggcagcctggggataagggcgaggggggggctcccggtctgcccggcattgcaggtccccgcgggagtcccggagagcgtggcgaaactggcccccccgggccagccggatttcctggagcccctggccagaatggggagcccggcgggaagggtgaacgaggggcgccgggcgagaagggagagggagggccaccgggactgttcggacctccaggcaaagatggtacctcaggccaccccggccctatcggaccccccggaccacgcggaaatcgcggagagcgaggttccgaaggatctcctggacatccaggtcagcccgggccacccggcccacctggagctccaggaccatgctgcggaggggtcggcgccgcagctattgctggaattgggggtgagaaagccggtgggtttgccccgtattacggtgacgaacctatggacttcaaaattaatactgacgagatcatgactagtctgaagtcagtcaatggccaaatcgaaagcctgatttctcctgacggctcaagaaaaaaccccgcccggaactgccgggacctgaagttctgccatcccgagctgaaatcaggcgagtattgggtcgaccctaaccaggggtgcaagctggatgcaatcaaagtattctgcaatatggagactggagagacatgtattagcgctaaccctctaaatgtgcccagaaagcactggtggaccgacagtagtgccgagaagaaacatgtttggttcggcgagagtatggacggaggatttcaattttcatacgggaacccagagttgcccgaggacgtgctagatgttcatcttgcctttctgcggctgctgagtagcagagcctctcaaaacatcacttatcactgcaaaaactcaattgcttacatggatcaggcttccggcaatgtcaagaaggcgctgaagcttatgggatctaacgagggagagttcaaggccgaaggaaatagcaagttcacatatactgtcttagaggatgggtgtacaaaacacaccggagagtggagtaagaccgtgtttgaatatcgcacccggaaggcggtgcggctgcctattgtcgacattgcaccttacgacatcggcggccccgaccaagaattcggcgtagatgtcggtccagtctgcttcctctag

SEQ ID NO: 14623 - DNA, 5139 bp, Artificial Sequence
  Description of Artificial Sequence: Synthetic coding sequence
atgggccgagaccaaagggcagttgccggccccgctttgaggcgctggctcctgttgggcaccgtgactgtcggctttcttgcccagagtgtgctggccggcgtaaagaaatttgacgtgccatgcggcggtcgcgactgctctggcggatgtcagtgctaccccgagaaaggtggaagagggcagccaggccctgtgggaccccagggttacaatggtccgccgggccttcagggatttcccggtttgcaaggacgcaagggtgataaaggggaacgcggtgcccctggcgtaactggccctaaaggagacgtgggagcacggggcgtgtctgggtttcctggcgccgatggcatccccggtcacccaggccagggcggaccccgcggcagacccggctacgacggctgtaatggcacgcaaggcgattcaggtcctcaggggccgcctggaagcgaggggtttactggtcctccaggcccccaaggtcccaagggccagaagggggagccctacgccctgccaaaggaggagagggaccggtatcggggcgagccaggtgagcccggtctggtaggcttccagggaccaccaggccggccaggtcacgtgggacagatgggccctgtcggtgctcctggtagacccggccccagctctgatgaaagcttcaaaaataagcttaaaaataaaggcctgaactattatacagtcaacagtatgcagggagacgtcggccagccgggccctaatggtatcccgtcagataccctgcatcccataatcgcccccacaggcgttactttccacccagatcagtataagggacccgtgggctggaggggacggccctgggtggccgggatcagtctaaagggcgaggagggcattatgggcttccccggtctgaggggctacccaggcttgtcaggcgaaaaggggtctccaggccaaaaaggatcaagagggctggatggttaccagggtcctgacggcccgcggggccctaaaggcgaagctggcgaccctggtcccccaggtctcccagcctattcaccacacccatctctggctaagggagcaaggggcgaccccggctttcctggcgcgcagggggaacccgggagtcagggcgaaccgggagatcccggactgcccggacctccagggctatcaataggcgacggggaccaaagacgaggcctccctggagagatgggaccaaagggtttcatcggggatccaggtattcccgccctctatggggggcccccaggccctgatggaaagcggggacctcctgggcctccaggcctccccggaccccccggtccagacggatttcttttcggcttaaaaggggccaagggtcgggctgggtttcccggactcccaggctcacctggggcccgtggacccaaggggtggaaaggagacgctggagagtgtcggtgcactgagggagacgaggcaattaagggcctccctggtctcccaggaccaaaaggattcgcaggaattaacggcgagcctgggcggaagggggaccgcggcgaccccggacagcacggattacccggcttccctggattgaagggcgtgcctgggaacattggcgcaccaggcccaaagggcgccaaaggagactccagaacgatcactactaagggagagcgcggtcagcccggggtccccggggtgccggggatgaaaggggatgatggctctccagggcgcgatgggctggatggatttccgggcttgcctggtccgcccggtgacggcatcaagggacctccaggtgatcccgggtatcccggtattccagggactaagggtacccctggcgagatgggacctccaggccttggtctgccaggattaaaaggacagcgcggctttccaggagatgccggcctccccggccctcctggattcttgggacccccagggccagcgggaactcccggccagatagactgcgacaccgatgttaagagggccgtgggaggagatagacaagaagccattcaacctgggtgcataggagggccgaagggcctgcccggcctacctgggccaccaggacccactggggcaaaaggcctcaggggcattcccggttttgctggcgccgatggcggacctggcccccggggcttacccggcgacgccgggagagaaggctttcctggtccaccaggctttataggtcccagaggtagcaaaggggctgtgggtctgccgggacccgacgggtcaccaggtccaattggcttgccaggtcccgacggcccgccaggcgaacgcggccttccaggggaggtattgggggctcaaccgggacccagaggggacgcaggagtgccgggacagcctgggctgaaaggcctgcccggagacagagggcccccagggttccgcggcagccaagggatgcccggaatgccaggcctaaaggggcaacccgggttacccggcccatctgggcagcctgggctttacggccctccaggcctgcatggattccctggtgcacccggccaggagggaccacttggcttgccggggattcctggccgggagggcttacctggtgacagaggtgatcccggagacactggagcccccggcccagtggggatgaaggggctctcaggagatcgaggtgatgctggctttaccggagagcaaggacatcctgggtctcctggctttaaaggtattgacggtatgccaggcactcccggactcaagggagaccggggaagtccaggaatggacggatttcagggcatgcctgggcttaagggcagaccagggttccccggctctaagggcgaagctgggttttttgggattccaggccttaaaggccttgccggcgagcccggatttaaaggaagcagaggggatcctgggccacctggacccccacctgtgattctccctgggatgaaggatataaagggggaaaaaggagatgagggccccatgggcctgaagggttatctgggtgccaaaggtattcagggtatgcccggcatacctgggttaagcgggattcccggtctgccgggccggcccggccacatcaagggggtgaaaggggacattggggtgcccggaattcccgggctacccggcttccctggggttgcggggccgcctggcattaccggttttccagggttcattgggagcagaggcgataagggggcacccggccgagccggcctgtatggtgagattggcgccactggagattttggcgacataggggatacaataaacttgcccggacgtcccgggctcaaaggcgagcggggtacaacggggatcccaggcctgaaaggttttttcggtgagaaggggacagagggagatattggcttccccggtattaccggagtaacaggggtccaggggcctccaggacttaaagggcagaccgggtttccgggactgacagggcctcctggttcacagggcgagctcgggcgcatcggactgcccggggggaagggcgacgacggctggcccggagccccaggcttgcctgggttcccaggtctgagagggatccgagggctgcacggcctgccagggaccaaaggatttcccgggagtccggggtctgatattcacggagaccctgggtttcctgggcccccgggtgagaggggtgatcctggggaagctaatacccttcctggccctgtgggggtgccgggccagaagggggaccagggcgccccaggagagcgggggccccccggctcaccaggcctacagggttttcccgggatcactcctcctagcaatatttcaggcgcacctggcgacaaaggagcaccaggaatcttcggcctgaaaggatatcgcgggccccccggaccaccaggcagtgccgcgttacctggatcaaagggagatactggcaatccgggtgcccccggtacacccggaaccaagggctgggccggcgattcaggaccacagggcagaccaggtgtgttcggcctccccggggagaagggcccgagaggggagcaaggttttatgggaaacactggcccaacgggggcagtgggggatcgaggtccaaagggacccaagggcgacccaggcttccctggagcacccggtaccgtaggggctccgggtatcgctggcatccctcaaaagatcgctgtccagcctggaacagtgggaccccagggtagaagaggccctcccggtgcacctggagaaatgggtccccaggggccacctggcgaaccgggattccgtggagcccccggtaaagccggtccacagggccgcgggggtgtgtctgccgtgcctggatttcgcggcgatgagggtccaattggccaccaaggtcctattgggcaggagggtgctcctggaaggcccggatccccaggattgcctggtatgccaggacggtcagtgtctatcggctacctattggtgaaacatagccagacggaccaggaaccaatgtgccccgtggggatgaataagctttggtcgggctactctttgctttacttcgagggccaggaaaaagcacacaatcaggatctcgggctcgccggttcatgtctggccaggttctcaaccatgccttttctctactgtaatcctggggacgtgtgctattatgctagccggaatgacaagagttactggctatccaccacagctcccttgccgatgatgccagtggccgaggacgagatcaaaccctatatctctaggtgtagcgtctgcgaggctcccgccatagctatagccgtgcattcccaggatgtgagcatcccacactgtcctgcgggatggagatcgctctggatcgggtattctttcctcatgcacaccgccgccggggatgaaggcggaggccagagccttgtctcacccggctcctgtttagaagatttccgtgccacaccattcattgagtgcaatggcggccgggggacttgccattattacgccaacaaatattccttttggttaacgacaattcctgaacaatcctttcaagggtctccctcggccgatactttaaaagccggtttgattcgcacgcacatctccaggtgccaagtttgtatgaaaaacctctag

SEQ ID NO: 14624 - DNA, 5139 bp, Artificial Sequence
  Description of Artificial Sequence: Synthetic coding sequence
atggggcgcgaccagagggccgtcgcaggtcccgcgttacgcaggtggctgcttttgggcactgttactgtgggctttcttgcccagtcagttttggccggcgtgaaaaagtttgatgtgccatgtggaggtagggattgttcaggaggatgccagtgctaccctgaaaaaggagggaggggccagcccggaccggtgggacctcagggatacaatggaccacctggcctgcagggatttcctggcctgcagggaagaaagggagataaaggcgaacggggagcaccaggcgtgacaggacctaagggggatgtcggggcacgcggggtttcaggcttccccggggctgatggcattcctggccacccaggccagggtgggcccaggggaaggcctgggtatgacggttgcaacgggacccaaggagacagcggccctcagggtccccccggatccgaggggttcactggccctccaggcccacagggtcctaaagggcagaaaggggaaccttacgccttgccaaaggaagagcgcgataggtacagaggcgaaccaggggagcccggtttggtgggcttccaaggtcccccaggacggccaggtcacgtcggccagatgggtccagtcggagccccagggagacccgggccacccggtcctcccgggccgaagggccaacaaggtaatcgaggtctcggcttctatggcgtgaaaggcgaaaaaggagacgtggggcagcctgggcctaatggcatacctagtgataccctgcatccaattattgccccaaccggagtgacatttcacccggatcagtacaaaggtgagaagggtagtgaaggtgaacctgggataagaggtatttcactgaaaggggaagagggaatcatggggtttccgggtctcagaggttatcccggactgtcgggagaaaaaggatcacccggccaaaagggcagtcgcggactagatgggtatcaagggcccgacggcccccgaggacccaaaggcgaggcaggggatcccggcccgcccggacttccagcatatagtccccacccatctttggccaagggagctcggggtgatcccggcttcccaggagcccaaggagagccaggctctcagggcgagccgggtgaccccggacttcccggtcctcccggcctgtctatcggagacggtgatcagcggaggggcctgcccggagagatggggcctaagggattcataggcgaccctggcattcctgcgttgtacggcggcccaccaggcccagatggaaagagagggcccccaggcccccccgggctgcccggcccccctggtcccgacgggttcctcttcggactgaagggtgctaaaggcagggccggattccccggtctgccagggtcacccggcgcccgggggcctaaaggctggaagggtgacgccggtgaatgccggtgcactgaaggcgacgaggctatcaagggcctgcctggtttgcccgggcccaaggggtttgccgggatcaacggggagccggggcggaaaggggatcgtggagacccaggccagcatggactgcccgggttccctggtcttaagggcgtgcctggcaacattggcgctcccggtccgaagggcgctaagggggactcaagaacgatcactacaaagggggagcgcggtcagcccggcgtgcctggggtgccggggatgaaaggagatgacggatcccctggacgggacggcctcgacggattccccggccttcctggacctcccggcgatgggataaaggggccccccggagaccccggttatccagggatccccggcacaaaaggcactcccggagaaatgggccctcctggccttggactgccaggcctgaagggccagcgcggttttccaggcgatgcaggcttgccggggccaccgggctttctggggccacccggacccgcggggacacccggacaaatcgactgtgatacagatgttaaacgtgcagtggggggagaccggcaagaagctattcaaccaggatgtatcggtggcccgaagggactgcctggtctgcccgggccaccggggcctaccggggctaagggtttacgcggaatcccaggttttgcaggggcggacggtggtccaggacctcgtggactccctggggacgccgggagagaggggttcccgggacctccgggctttattggtcctcggggctccaaaggggcagtcggactccctggccccgacggttctcctggccccatcggcctgcccgggccagacggcccccccggcgaacgcggtcttcctggcgaggtcctgggcgcacagcccggacccagaggggacgctggcgtgcccggacaaccaggcctcaaggggctgcctggcgatcggggcccacccggattcaggggttcgcagggcatgcctggaatgcccggcctgaaggggcagcccggtctgcctggcccgtcaggtcaacccggcttgtacggccctccagggctgcatggattccccggcgccccaggccaagaaggtccacttgggctccctggtattcctggcagagagggactgcccggggacaggggagatccaggagacactggcgctcctggccccgtgggcatgaaagggctatcaggcgatagaggggacgctgggttcaccggagagcagggtcatcctggtagcccaggattcaaaggaatagacggaatgcctgggactcctgggttgaagggagaccgcggtagtcctgggatggatggctttcagggcatgccaggactcaagggacgcccagggttcccgggatccaagggagaggctggcttctttggaattcccgggctaaaaggcctggcaggcgaaccaggctttaagggatctagaggagatccaggaccccccggcccccctcctgtgatcctccccggtatgaaagatatcaaaggagaaaagggtgatgagggcccaatgggcctcaagggatacctgggcgctaaaggcattcaagggatgccagggattccagggctttccgggatcccagggttgcccggtaggcccggccacataaagggtgtgaaaggggatatcggagtgcccggcatccctggtcttcctggctttccaggagtcgccgggcctccagggattacaggtttccccgggttcataggctctcggggagataagggggcgccaggacgggccgggctatacggtgagataggagctaccggcgacttcggcgacataggtgataccatcaatctccctggacgacccggtctgaagggagaacgcggaacaaccggcatcccaggcctgaagggcttcttcggggaaaaaggtactgaaggagacattggattcccaggaattaccggggtaaccggtgttcagggaccgccaggtctgaaggggcagaccgggttccccggactgacaggtccaccaggctcacagggcgaactcggacgaattggactcccaggcggtaaaggtgatgacggctggcctggagcacctggtttacctggcttccctggcctgagggggattaggggtcttcacggtctgcccggcaccaagggtttcccgggcagccctgggagcgatatccatggagatcctggctttccaggcccaccgggcgaaagaggtgatccaggggaggcaaacactcttccaggccctgtgggagtgccaggccagaaaggggaccagggtgcaccgggcgaacgggggcctcctggctctccaggcttgcagggattccctgggatcaccccaccttcaaatatttcaggagccccgggagataaaggcgccccaggcatcttcggattaaaaggatataggggcccacccggacctcccggcagcgccgcattgccagggagtaagggcgatacaggcaatcctggcgccccaggcacaccaggcactaagggttgggccggggattccggccctcagggcagacctggagttttcggccttccaggcgaaaaggggccaagaggagagcaagggttcatgggaaacactggtcccaccggtgccgtgggcgataggggacccaaggggcccaaaggcgaccctggcttcccgggcgctcccgggacagtgggtgctccaggtatagccggcattcctcagaaaatcgccgtccaacccggaaccgtgggtcctcagggccgaagagggcccccaggagccccaggggaaatgggccctcagggccctccaggagaacccggattccgaggtgcacctgggaaggcagggccccaagggcgcggaggtgtctccgcagtgcctggattccgaggcgatgagggacccatcgggcatcaggggccaataggtcaggagggcgctccaggacggcccggatcccctggactgcctggtatgccaggtcgcagtgtgtcaatcggctacctgcttgtcaagcactctcaaaccgaccaagagcctatgtgtcctgttggtatgaataagctgtggagcggctattcactcctctatttcgaggggcaagagaaagcccataaccaggacttgggactggcaggcagctgcctcgctcgattcagtacgatgcctttcctgtactgtaaccccggagacgtgtgctactacgcatctcgtaacgacaagtcttactggctgtccacaaccgcccccctccccatgatgccagtagcggaagatgaaattaagccttatatcagcagatgttcagtgtgcgaagcgcccgctattgcaatcgcggttcactcccaggacgtaagtattccacactgcccagctggatggagaagcctgtggattggctatagttttttaatgcatacagctgctggtgatgagggtggtgggcagtctcttgtttctcctggaagttgcttagaagatttccgtgctacaccatttattgaatgtaacggagggagggggacatgccattattatgcgaacaagtactccttttggctgacaacaattccggaacagtcatttcaggggtccccctcggcagacactttgaaggccggtctgatacgcacacatattagccgctgccaggtttgcatgaaaaacctgtag

SEQ ID NO: 14625 - DNA, 318 bp, Artificial Sequence
  Description of Artificial Sequence: Synthetic coding sequence
atgggcagggaccagcgtgctgttgccggaccggccctgaggagatggctgttgctcgggaccgtgacagtgggttttctggcgcagagcgtccttgccggagtaaaaaagtttgacgtcccctgtgggggccgagactgttcgggcgggtgtcaatgttatccggagaaaggtggccggggccagcctggccccgttgggccacagggatataatggaccccccggactgcagggcttcccggggcttcaggggcgtaaaggcgacaaaggagagaggggtgcccctggagtaactggtcctaaaggggatgtgtag

SEQ ID NO: 14626 - DNA, 4497 bp, Artificial Sequence
  Description of Artificial Sequence: Synthetic coding sequence
atgtccgcgcggaccgcgcctagaccccaggtactgcttcttcctctgctcttggtcctgcttgccgccgcccccgccgcttccaaaggatgtgtgtgcaaggacaagggccagtgcttttgtgatggtgccaagggagagaagggcgaaaaaggattccccggcccgcccggcagccccgggcagaagggtttcacaggtcccgaaggactacccggaccacaaggacccaagtccttcagagccattccctcatatagcgggggtaagtctttgcagggcatctcaggtctgccgggtttttctggtagcccaggattgcccggaacacccggcaacacaggtccatacggcttggtgggagtccccggttgcagtggttcgaagggggaacaaggctttcctggactcccaggcacactcggataccccggcatccccggaattcacaacctgaaaatcttcaagggagcccccgcaaaagaggaggacatcgagctcgatgctaagggcgatccaggcttacctggtgcaccagggcctcagggcttgccgggacctcctggcttccccggccctgttggaccacctggtccgcccgggtttttcggcttcccaggagcaatgggacccagaggtcctaaaagttttgttttgtcgtctagaatcagcacaaagggagagaagggagtgaaggggctgacaggacccccgggccctcctggaaccgtgatagttactttaaccggaccagacaatcgcaccgacctgaagggcgaaaagggcgataaaggcgctatgggcgagcccgggcctcctggtccatctgggctgcctggagagagctacggttctgagaagggagcacccggcgatccgggcctccagggcaagcctgggaaagacggagtgccaggcttcccaggatcagagggggtgaaaggaaatcggggtttcccgggacttatgggcgaagatggcatcaaagaggaaaaacgggacgtagccatcgtgagctttagttctaagaccgaatactacgatacgtatcaggagaagggggacgagggcacccccgggccacccggccccagaggggcgagaggtccgcagggcaagaataagtttaggtgtatccccggttctcagggctcaagccggcctggactcaggggagctcccgggtggccagggcttaagggttccaaaggtgagcggggcaggcccggtaaggacgcaatggggacccctggcagccccggctgtgctggcagtcctggacttccgggatctccgggtcctcctggcccacctggtgatatcgtgttccgtaagggacctcctggggatcacggcctgccaggatacctggggtcaccaggaattcctggcgtcgatggccccaagggtgagcccgggcttttatgcactcagtgcccgtacatcccgggccccccaggattacctggcctgcctgggctgcacggagtgaaagggatccctgggagacaaggagcagcaggactcaaaggctcaccaggatccccagggaacaccggactgcctggattccccggattccccggtgcccagggggaccctgggctcaagggcgagaagggggagacactccagcctgaggggcaggttggagtgccaggcgacccaggcctccgcggacaacctggcaggaagggactcgacggaattccaggtactccaggtgtcaagggcctcccaggcccaaagggggaactggctctatccggggaaaagggggaccagggccctcccggcgaccctggatcccctggatctccaggacctgccggtccagcaggcccgcccgggtacggaccacagggagagcctgggcttcagggtacccaaggtgtcccaggtgcccctgggccgccgggggaggctggtccccgaggcgagctatcagtgagtacgcctgtacccggtccgccaggccctcccggtccacctggccatcccggtcctcaggggccacccggtattcccggtagcctgggtaagtgtggcgatccaggattaccagggccagacggtgagcccggaattccaggcattggcttcccaggacccccaggcccaaaaggcgatcagggatttcccggtaccaagggatccttgggatgtccagggaaaatgggtgagcccgggctgcccggaaaacccgggttgccaggcgccaagggcgagcctgccgttgccatgccaggtggtccaggaactcccggctttcccggcgaaagaggcaattccggggagcacggagaaatcggattgcccggccttcccggcctacccgggacacccggaaatgaaggactggacgggccacgtggagatcctggacaacccgggccacccggggagcagggaccaccgggaaggtgcattgaaggtcctaggggcgctcaggggttacccggtttgaacggactgaaggggcagcagggacggcgaggaaagaccggaccgaagggggatcccggcataccagggctcgatagatcagggtttccaggggaaacaggttctccagggattccaggccaccagggggagatgggcccacttggccaaagaggctatcctggaaatcctggtatcctcggccccccaggcgaggacggtgttatcggcatgatggggttccctggagccatcggaccccccggacctcctggaaatcctgggaccccaggacagcgcggaagccccggcattcccggcgtcaagggccagcggggtacccctggcgcaaagggagagcaaggcgacaaaggtaacccaggtcctagtgaaatcagccacgtaatcggtgacaagggagagcccggccttaaggggttcgccggcaatcctggggaaaaaggaaaccgcggagtcccaggcatgcctgggttaaagggactcaaggggctgcccggtcctgcaggcccccccggcccgcgaggagatctgggtagtactgggaatcccggagaacctggcctcaggggaatccctgggagcatgggcaacatgggaatgccggggagcaaagggaagagagggacactcgggtttcccggaagggcgggccgcccaggactacccgggatccacgggctccagggagacaagggggagcccggctacagcgaggggacacgaccgggtcctccgggtccgacaggagaccccgggttgcccggagatatgggcaaaaagggcgaaatggggcagcctggtccccccggacatctcgggcctgcaggcccagagggtgccccgggctcgcctggttcaccaggattacctgggaagcccggacctcacggggatctaggcttcaaagggatcaagggtctcctaggaccgccagggattagagggccacccggcctgcctgggttccctggaagtcctggaccaatgggcattcggggcgatcaggggcgtgacggcattccaggacccgcaggagaaaagggcgagacaggcctcctgcgcgcgccacctggacccagagggaatcccggggcccaaggggctaagggtgaccggggagctcccggcttccctgggttgcctggcagaaaaggagctatgggagatgcaggtccaagaggtcccactggcatcgagggcttccccggtcccccagggttgcccggagctatcatacctggccagacaggcaatcgcggaccccctggatcacgcggcagcccaggcgcaccgggacctccaggaccacccgggtcccacgtgattggaattaagggcgataagggatccatgggacaccccggacctaagggcccccccggaaccgccggagacatgggacctccaggacgcctcggggctcctggtactcctgggctgccaggccctcggggggatcctgggtttcagggattccccggcgtcaaaggcgagaaaggaaacccaggattcctaggctcaatcgggcccccaggccctatcggtccgaaaggcccaccgggcgtccgcggggaccctggcacactcaagataatttctttgcccggttctcctggacctcctggcaccccgggcgagccaggcatgcaaggggagcccggaccccccggaccgcccggcaacttaggaccttgtgggccccgtggcaaacctggtaaggacggtaagcctggaacaccggggcctgccggcgagaaggggaacaagggcagtaaaggcgaacccggtcccgccgggagcgacggactccccggtttgaagggcaagaggggagattctggcagccccgcaacatggacgacgagaggctttgtcttcacccgccactcacagactacggccatcccctcctgtcccgagggtaccgtgccactatattccggcttcagtttcctcttcgtccagggcaaccagcgcgcccatggccaagatcttgacgcactatttgttaaggtgctgcgaagcccgtag

SEQ ID NO: 14627 - DNA, 4914 bp, Artificial Sequence
  Description of Artificial Sequence: Synthetic coding sequence
atgtcagcacgcaccgccccccgcccccaagttctgcttctgcccctcctcctggttcttttggcggccgctcctgccgctagcaagggctgcgtgtgcaaggacaaggggcagtgtttttgtgatggtgctaagggagagaagggagaaaagggatttccagggccccctggtagtcctggacagaaagggtttaccggtcccgaagggctgcctggcccacaggggccaaagagctttagagcgattccctcctactctggtggcaaaagcctgcaaggcatttctggactgccaggcttcagtgggagccctggcctccctggcacacccggcaacaccggaccctatggactggtaggggtgccaggctgctccggatcaaaaggggagcagggattccctggtttgccaggcacccttgggtacccaggcatacccgggatccacaacttgaaaatctttaagggggctcccgcaaaggaagaagatatcgagctcgacgctaaaggtgatcctggcctgcctggagcccctgggccgcagggacttccagggccgcctggctttcccgggcctgtcgggccaccgggacctccgggatttttcggattccctggggctatgggccctagaggcccaaagagctttgtgctctcatcacgcatttctaccaaaggcgaaaagggggtgaagggtctgactggacctcccggccctcctggcactgtgatcgtgaccctgaccggcccagataacagaaccgatctgaagggggagaagggggataagggtgccatgggggaacccggacctccaggacctagtggcctgccaggggagtcttacggtagcgagaaaggcgcccctggcgacccaggcctccagggcaaacccggaaaggacggagtccctgggtttcctggctccgagggcgtgaagggcaatagaggttttcccgggttaatgggcgaagatggcatcaaagaggagaaacgcgatgtagcgattgtgtccttctcaagtaaaacagagtactacgacacgtatcaggaaaagggcgatgagggcaccccagggccgcctggtcctagaggcgcacgggggccccagggaaaaaacaagtttcggtgtataccgggctcccaaggcagctctcgacctggactgcgcggtgcccctggatggccgggattgaagggcagcaaaggagaaagaggccggcctggcaaggatgccatgggcacaccaggtagtccaggctgtgcagggagtccgggtctccccggatctccggggccccctggtccgcccggtgacatcgtgtttagaaaaggcccccccggggatcatggacttcccggctacctcgggtcacccggaattcccggtgtcgatggacctaagggagaaccaggcctactctgcacgcagtgtccatacattcccggtccacccggcctgcccggcctcccaggcttgcacggagtgaagggtattccaggacgacagggtgccgccggtctcaagggtagtcccggtagtccaggcaatactggccttcccggattccctggattccccggcgcccaaggcgatccggggctgaagggcgagaagggagaaaccttacagcctgagggccaagtcggggtgcccggcgaccctggccttcgcggtcagccaggacggaagggcctggacggcatccctgggactcccggcgtgaaggggctgcctggacccaagggtgaactcgcactgtctggcgaaaaaggagatcagggtcccccaggcgatccaggaagccccggatccccgggacccgcagggccagccggtccacccggctacggcccacagggtgaacccggactgcaaggcacccaaggagtgccaggtgcacctggaccacccggtgaagctggtccccggggagagttgtccgtgtctacacccgtgcccgggccccccgggccacccggtcctcctggccatcccggcccacagggaccccccggcattccaggctctctgggcaaatgcggggacccagggctgcccgggcctgatggtgaaccaggcattcccggcattgggtttccggggccacctggccccaaaggggatcaggggttcccgggcacgaagggtagcctcggctgtcccggaaagatgggcgagccaggactcccagggaagcccggacttccaggagcgaagggtgagccagccgtggcaatgcccggtggaccgggtactccaggcttccctggcgaacggggcaatagcggcgagcacggggagattgggctaccaggcctccccgggcttcccgggactcctggtaacgagggcctggacggccctagaggagatccaggccaacccggccctcctggtgagcagggcccccccggccggtgtatcgaaggacctcgtggagcacagggactccctggcttaaacggtcttaagggccagcagggacgtaggggcaagacaggacccaagggcgacccaggtatcccaggcttggatcgctccggatttcccggtgaaaccggctccccaggtatcccggggcatcaaggggagatgggacctcttggccagcgcggctatcccgggaaccctgggatcctggggcctccaggagaagacggcgtgataggaatgatggggtttccaggagccatcggtccgccagggccccctggcaacccgggcactcccggacagagaggctcccctggtatccccggcgtgaagggccaaaggggaacaccaggagccaaaggagagcaaggggacaagggaaatccgggcccctccgagatctctcatgttattggagataagggagagcctggtctgaagggcttcgcaggaaatcccggggagaagggcaataggggcgttcctggcatgccaggccttaaaggcctcaaagggctgcccggcccagccggtccaccggggcccaggggtgatctgggatccacgggaaacccgggagagcctggcctaagggggataccggggtcaatggggaacatgggaatgcccggctccaaggggaagaggggcaccctcggattccctggtcgcgccgggcgacctggtctgcctggtatacatggactgcaaggtgacaagggcgagcccggctacagtgaaggcacacggccaggtccccccggcccaacaggcgatcctggattacccggagatatggggaagaagggcgaaatgggacaacctgggccgccgggccatttgggacccgccggacctgaaggcgcccccgggagtcccggttcaccgggcctgcccggcaagcctggccctcacggcgatcttggattcaaaggaatcaagggattgttaggaccacctgggataaggggacctcctggcctgccagggttccctggcagtcctgggcctatggggattaggggagatcagggaagagacggaattcctgggcctgccggcgaaaaaggagagactgggctgctgcgcgcgccgcccggtcctagaggcaatcctggggctcaaggagccaagggcgaccgaggcgccccggggtttcctggcctccccgggaggaagggcgcaatgggggatgcggggcctcgaggccctaccggaattgaaggcttccctgggcctcccggcctgccgggggctatcattcctggacaaaccggtaataggggcccacccggcagccgcggcagcccaggcgccccaggacctccgggtccccccgggtcacacgtgataggtatcaagggtgacaaagggagcatgggacaccctggaccaaagggcccccctggcacagcaggcgatatgggcccgcccggccggctgggggcacctggcacacccgggttacccggcccccgtggcgatcccgggtttcagggcttccctggagtgaaaggtgagaaagggaatcccggctttctgggttccattggtccccccggtcctatcggccctaagggaccaccgggcgttcgcggggacccagggacactgaagataattagtttacctgggtcgcccggcccacccgggacaccgggtgagccggggatgcaaggcgagccagggcctcctgggccacctggcaaccttggcccatgtggtcctcgtggcaagccaggcaaagacggcaaacccggtacacctggaccagcaggcgaaaagggaaacaaggggtctaagggagagccgggccccgccggctccgatggacttcctggtctgaaaggcaagcgcggcgattctggatccccagcaacctggacaactcgaggctttgtgttcacaaggcacagtcagaccaccgccattccatcctgtcctgagggaacagtcccactatattctggtttttctttcctcttcgttcagggtaaccaacgggcccatgggcaagatctgggaacgcttggcagctgcctgcagagatttacaacaatgcccttcttattctgtaacgtcaacgatgtttgcaacttcgcgagccgaaacgactactcttattggctgagcaccccagcgctgatgcccatgaatatggctcccattactggtcgcgccctggagccgtatatcagtcggtgcacagtgtgcgagggcccggccatagccatcgcagtgcatagccagacaacagacatacccccttgtccgcatggttggatatcactgtggaaaggcttttcttttatcatgaaggcttacagcattaactgcgaaagctggggtatccgtaagaataataagagtctcagtggggtccatgaagagaaaacactgaagcttaaaaaaactgccgaactactgtttttcatacttaagaacaaagttatgactgaacatgccgtgatctag

SEQ ID NO: 14628 - DNA, 4485 bp, Artificial Sequence
  Description of Artificial Sequence: Synthetic coding sequence
atgtctgcaagaaccgccccacggccacaggtgctacttctgccactgttactcgttctgttggcggctgctcctgccgccagtaaaggttgtgtgtgcaaagataagggccagtgcttttgcgatggcgcgaagggcgaaaagggcgaaaaggggtttcctggccccccaggttcccctggccagaaaggcttcacagggccagaagggttgcctggtccccagggacccaaatcctttagggcaattcctagctattcaggcggtaagagtctgcagggcattagcggactacctggcttctctggttctccaggtttacctggaacccccggaaataccggtccctacggcctggtaggagtgcctggctgttcaggttctaagggggagcaggggtttccaggactgcccgggactctgggttaccccgggatccctggaatccacaacttgaagatattcaaaggcgctccggcgaaagaagaagacatcgagctagatgctaaaggcgatcctggacttccaggggccccagggccccaaggtcttccgggacctcccgggttcccaggtcccgtggggccgcccggcccaccgggctttttcgggtttccaggggccatgggaccaaggggtccaaaatcatttgtgcttagctcacgcatcagtactaagggcgaaaagggcgttaaggggctgacaggccctccaggaccacccgggacggtgatcgtgacactcacaggcccggacaaccgcactgatctgaaaggggaaaaaggcgataagggggcaatgggagagcccgggccaccagggccatcaggacttccgggagagtcctacggctccgagaagggtgcccctggggacccaggtctccaggggaagcctggcaaggacggcgtgccaggatttccgggaagcgaaggggtcaagggcaatcgcggatttcccgggctcatgggcgaggacggaataaaggaggaaaaacgagacgttgcaattgtgtctttctccagcaagactgagtattacgatacataccaggagaaaggggatgagggcacccctggacctccaggaccaaggggcgcccgagggcctcaggggaaaaacaaatttaggtgcattcctggctctcagggcagcagccggcctgggctgagaggcgctcctgggtggcctgggcttaaggggagtaagggggagcggggccgccccggaaaagacgctatggggactcctggttcgccaggatgtgctggcagtccagggctgcctggatcgccgggccccccaggtcctccgggagatatcgtgttcaggaaaggtccccctggggaccacgggctccccgggtatctgggatcccctggaataccaggtgtagatgggccaaagggagagcccggcctgctgtgtactcagtgcccctacatacctggtccacccggccttcctggcttgccaggactccatggggtcaaaggaattccaggccgccagggggcggcaggtcttaagggtagcccaggctcccctggaaacactggactgcccggtttccccggatttcccggcgcccagggcgaccccggactcaaaggcgaaaagggcgagacactgcagccagagggacaggtaggtgtcccaggtgatccaggactgagaggacaaccagggcggaaaggcttggatggcattcctggcacccctggtgtcaaaggcctgccgggaccaaaaggcgagctcgcgctctccggggaaaagggtgaccagggcccgcctggagaccccggttcccccggaagccctggccctgccggtcctgccggaccaccgggttacggtccacagggcgagcctggtctacagggaactcagggagtccctggggcaccagggccgcctggggaggccggccctcggggtgagctgtcagtcagtacacctgtgcctggcccgccaggaccacctggaccacccgggcatcccggtccccagggcccccccggtatcccgggctcattagggaagtgcggggacccaggcctgcctggtcctgacggggagccgggcatccctggtatcgggtttcctgggcctcctggacccaagggcgaccaagggtttcccggcaccaaaggctctcttggctgcccaggcaaaatgggcgaaccaggactgcctggcaagcccggcctcccaggagccaagggcgagcccgccgtggctatgcccggggggccaggtactcccggatttcctggagaaaggggcaattccggagaacatggcgaaattggtctgccagggttgccaggactcccgggcacaccgggcaatgagggtcttgacggaccccgaggtgacccagggcagcccggcccgcccggtgaacagggacccccgggccgatgcatcgagggaccacgtggagcccaaggactgcccggattgaacggtttaaaaggccagcagggcaggaggggtaagacagggcccaagggcgacccagggattccaggactcgataggtccgggttccctggggaaacgggatcgcccggcattccggggcaccagggggaaatgggccctctgggtcagcgcgggtatcccgggaaccccggtatcctcggaccccctggcgaagatggcgtgatcggtatgatggggttcccaggcgctatcgggccgcctggcccacccggcaacccaggtactcctggacagcgcggcagcccaggaatccccggagtaaaaggccagaggggtacccctggtgctaagggcgagcaaggtgataagggtaacccaggcccgagtgaaatctcccatgttattggggacaagggggaacctgggcttaaaggctttgcaggcaaccctggcgaaaaggggaatcgcggggtgccgggaatgccaggcctcaaggggcttaagggtcttcccgggccggccggccctcctggaccccgaggcgacttaggttctactggaaaccctggcgagccgggcttgagggggatccctggctctatggggaacatgggtatgcccgggagtaagggaaagcgaggcactctcggttttccagggcgggccggacgccctggactccccgggattcacggcttgcagggggacaaaggagagcccgggtacagcgaaggaacaagacccggaccgcccggtccgacaggggacccaggcctgcccggagacatgggcaagaaaggcgagatgggccagccaggaccccccgggcatctgggcccagccggtcctgagggggcaccaggcagccctggtagtcccgggctgcccggcaaaccaggcccccacggagatctcggattcaaggggatcaaagggctgctgggcccaccaggcatccggggtccgccgggtctccccggcttcccaggctcacctggcccaatgggtattaggggcgaccagggccgcgatggcatccctgggcctgcaggagaaaagggagaaacaggcctgctgagggcgccacccggcccaaggggcaatccaggagctcaaggtgcgaagggcgatcggggcgctccaggcttcccaggcctgccgggcagaaaaggtgccatgggagacgctggacctcggggacccaccggaattgagggttttcccggcccccctggcctccctggggccatcattcccggccagactggtaaccggggacctccgggtagcagaggctctccgggcgcaccggggcctcccgggccacccgggtctcacgtgatcgggatcaagggggataagggatcaatgggccaccctggtccaaagggccccccgggcaccgccggcgatatggggcctcctggcaggctcggagctccaggaacccctggattgccaggcccccgcggcgacccaggctttcaaggctttccaggggtgaaaggagaaaaaggcaacccgggatttctgggttctattggtcccccagggccgatcggtcctaaaggccctccaggggtacgcggggaccctggtacactcaagatcatctcacttcctggcagcccgggccctcccggcacccccggagagcccgggatgcagggtgaaccaggcccccctggacctccgggaaacttggggccttgcggacctcggggaaaaccgggaaaagacggcaagcccggaactcccgggccagccggtgaaaagggaaataaggggtcaaaaggagagccagggcccgccggctctgacggactgccaggcctcaagggaaaaaggggcgattccggctcccccgctacatggaccactcgtggatttgtgtttaccaggcactctcaaactaccgcgattcccagttgcccagaggggaccgtgcccctttattctggatttagctttttattcgtgcaaggcaaccaaagggctcacggccaggacctggagagcctcttccaccagctgtag

SEQ ID NO: 14629 - DNA, 4275 bp, Artificial Sequence
  Description of Artificial Sequence: Synthetic coding sequence
atgtcagctcgcactgcccctcgcccgcaggttctgctgctgccactgctcctggtgctgctggctgccgctccagccgctagcaaagggtgtgtgtgcaaggataagggccaatgcttttgcgatggggccaagggtgaaaagggggaaaaggggttcccggggccccctggatctccaggacagaaagggtttactggcccagagggccttcctgggcctcaaggccctaagagttttagagccataccatcctatagcgggggaaaaagcctacaggggatcagtggcctcccaggtttctctggcagccctgggctccctggaactccgggcaatacaggcccctacggccttgtcggggtcccaggctgttcaggttcaaaaggagagcagggtttccccggccttcctggtactctgggttaccctggcattcctgggatacataatctcaaaatttttaagggcgcaccggctaaagaagaggacatcgaacttgacgctaagggagacccaggccttcccggtgctcctgggccacagggcttgcccggcccccccgggttccctggccccgtcggccctccaggccctccaggtttcttcggctttcccggggccatggggccgcgcgggcctaaatcctttgtgctttctagtagaatatctacgaagggcgaaaaaggcgtgaagggactgactgggccccccggacctcctggaactgtgatcgtgactctcactggccccgacaatcgcaccgatctgaagggcgagaaaggggacaagggcgctatgggggagccgggacctccaggtccgtctgggttgcccggtgagagctatggtagtgagaagggcgcccctggcgatccaggcctccaaggtaagcctggaaaagacggggttcccggattccccggatccgaaggcgtgaaagggaatcggggcttcccgggccttatgggcgaggatgggattaaggaggaaaaacgggacgtggcaattgtatccttttctagcaagaccgagtactacgatacatatcaggagaagggggatgaaggtaccccgggacctcccggtcctagaggggcccgggggccacaaggcaagaacaagttcaggtgcattccagggtctcaagggtcatctaggccaggcctcaggggtgctccgggttggcccgggctgaaaggatcaaaaggagagcgaggcaggccaggaaaagacgccatgggcactcccggcagtccgggctgcgcaggctcgccgggccttccaggaagtcctggaccccctggcccccctggagacatcgttttccgaaaaggcccgcctggcgaccatggcctgcctgggtacctggggtctcctggtatccctggggtcgacggtccaaaaggggagccggggttactttgcacacaatgtccctatatccccggaccgcccgggctccctggactacccgggctccacggagttaaaggcatccctgggcggcaaggcgcagcgggcttgaaagggtctccggggtcgcccggcaatactggattacctggcttccctgggtttccgggcgctcagggggatccaggactgaaaggtgaaaagggagaaacactgcagcctgaaggtcaagtgggtgttcccggggacccaggcctgagggggcagccagggcggaagggattggatggtatccctgggacgcccggtgtgaagggcctaccagggcccaagggcgaactggcactgagcggcgagaagggggaccaagggccgcctggagatcccggctctcctggatccccaggacccgccgggcccgccggtccgccgggctacggcccacaaggggagccgggcctgcagggcacccagggagtccccggtgcccccggccctccaggagaagctggcccccggggggagctgtctgtgtccacccccgtgcccggtccccccgggccaccagggccgccgggacatccggggccgcaaggacctcctggaattcctggctccctggggaaatgcggagaccctggcctgcccggcccagatggagagccagggattcccggaatcggctttccggggcctcctgggccaaaaggggatcagggctttcctggaaccaaggggtcactcggatgtcccggcaagatgggcgaacccggtttgcccgggaagcctggactgccgggcgctaaaggagagcccgctgtcgccatgccgggcggtcctgggaccccagggtttccaggtgaaaggggaaattccggcgagcacggagaaatcgggttaccaggactacctggactccctgggacgcccggcaatgagggcctggatggtccaagaggcgatcccggacagccaggcccccccggcgagcaaggcccacctggcaggtgtattgagggccctcgcggcgcccaggggctccctgggctgaatgggctcaaaggtcagcaaggcaggcgagggaaaactggcccaaagggagatccaggaatccccggcttggacaggagcgggttccctggagagaccggaagtccaggcatcccaggccaccagggagagatgggacccctgggacagagaggatatcctgggaatccggggatattggggccacctggcgaagatggtgtcattggcatgatgggtttccccggcgctatcgggccccccggcccccctgggaatcccggaacccctgggcagaggggaagccccgggataccaggtgttaaaggccagcgcgggacccccggagctaaaggcgagcagggtgacaaaggaaatcccgggccatctgagatttcccatgtgataggagataagggcgaacccggactaaaaggcttcgccggcaacccaggcgagaaggggaatcgcggggtgcctgggatgcccggcctaaaagggctgaaagggctgcccggtcctgccggtcctccggggccccggggtgatctcggtagcacggggaaccccggggagcccggccttcgaggcattcccgggtctatggggaacatgggcatgccgggctccaaggggaagagagggacgctgggctttccgggcagggctggacgtcctggactcccaggaatccatggcctgcaaggagacaaaggagagcctggctatagtgagggaaccaggcctggcccccctggacctacaggggaccccggccttcccggggatatgggcaaaaagggagagatgggccaacctggccctcctggccatcttgggcccgcaggacccgagggagcaccaggctcccctggaagtccaggactgccaggtaaacccggtccccatggcgatctgggattcaaagggattaaaggattattgggacctcccggcatcaggggcccacccggcctgccaggttttcctgggagtcccgggccgatggggatcagaggagaccaagggagagatggaatccctggccctgctggggagaaaggcgagaccggccttctgcgagccccgccaggccctcggggtaatcctggcgcgcagggtgccaagggagaccggggcgcccccggtttccccggactcccaggtagaaaaggtgctatgggcgacgctgggccacgcggacctaccggcatagaaggctttcctgggcccccagggttgcctggcgccatcatacctggtcaaacagggaaccgggggcctcctggatccaggggctcacctggcgcccccggccccccaggtccccccggctctcacgttattggcattaaaggggacaagggatccatgggccaccctggcccaaagggcccacccggcaccgccggcgacatgggcccccctggtagactgggcgcacctggcacaccagggctgcctgggccccgaggggatcctggattccagggatttccaggagtgaagggggaaaaaggcaatccaggattcctcggctccattggacctcctggccctatcggtcccaaagggccacccggagtgcggggagatccaggaacactcaaaatcatttcactgcccggatcccctgggccacccgggaccccaggggaacccggcatgcagggggagcctggcccaccaggcccgcccggcaacctggggccttgcggaccacgcgggaaaccgggcaaagatgggaaacctggaaccccaggtccagcaggtgagaagggcaacaagggaagtaagggggagcccgagtccctgttccaccagctctag

SEQ ID NO: 14630 - DNA, 5013 bp, Artificial Sequence
  Description of Artificial Sequence: Synthetic coding sequence
atgtctgccaggaccgctccccgtccacaagtcctcctcctgccactcttgctcgtgctcctggctgcggccccagccgcgtctaaaggctgtgtatgcaaggacaagggccagtgtttctgtgatggcgctaagggcgaaaaaggcgagaagggttttccagggcctcctggaagcccaggacagaaggggtttacagggcccgagggtctgcccgggccccaggggccaaagggattcccgggtttacctggcctcactggcagcaagggcgtgcgcggaattagcgggctgcccggcttcagcggctctcccgggcttcctggcacccctggtaataccggcccatacgggcttgtcggcgttcctggatgttccggcagcaagggagagcaagggttccctggcctgccgggtacacttggataccccgggatcccaggtgccgcgggcctgaagggccaaaagggcgcacctgcgaaagaggaggacattgaactagacgcaaaaggagaccccgggctccctggcgctccaggtccacaggggctgccagggcctccagggttcccaggcccagtcgggccccctggccctcctggattctttggattccccggcgctatggggccacgggggccaaaaggccatatgggcgagagggttatcggccacaagggggaaaggggagtcaagggactgacaggtccccccgggcctccaggaacggttatagtgacacttaccggaccagacaacaggacagatttaaaaggagagaagggtgacaaaggtgcaatgggggaaccgggtccaccgggccctagtggcctccctggagaatcctacgggagcgaaaagggcgctcctggtgatcctggattacagggcaagcccggcaaagatggtgtgcctggtttcccggggagtgagggcgtcaagggcaaccgcgggtttcccggtctgatgggggaggacggcattaagggtcaaaagggggatattggtcctcccggctttagggggccaacagagtattacgatacctaccaagagaagggcgacgaagggactcccggacccccagggcccaggggcgcacgggggccccagggtccttccggcccgcccggcgtaccgggcagtcctgggagctctaggcctgggctgagaggagcccctggttggccaggtctgaaaggctcgaagggggagaggggccggcctggtaaagacgccatgggaactccgggcagtcctggctgtgcaggaagcccaggcttacccggtagtcctggaccccctggcccccccggcgacatcgtcttcagaaaagggccccccggagaccatgggctacctggctacctcggctctccaggcattccgggggtggatggacctaagggcgagccaggactgctgtgcacacagtgcccttacatacctggcccacccgggttgccaggattgcccgggctgcacggtgtgaaaggaatcccgggccggcagggagctgccggactgaaagggtcgcccgggagccccggaaatacaggcctgccaggtttcccggggtttcctggagcacagggggaccccgggttgaagggagaaaaaggtgaaactctccagcccgaggggcaggtcggggtcccaggagaccctggtctgcgaggacagcccggtagaaaaggactggatgggattccagggacccccggcgtcaagggcctgcctgggccaaaaggcgagttagctctgtccggggagaagggcgaccaggggccgcccggggaccctggctcacctggaagcccgggccctgccggcccagcagggccccccggctacgggccgcagggggaacccggtctacaagggacgcaaggcgtcccaggcgcccccgggccaccaggcgaggctgggccacggggagaactgtctgtgtccaccccagtgcctggacctcctggcccaccaggccctccgggacacccaggcccacagggaccccccgggatcccgggtagccttggtaagtgcggtgacccaggattgcctgggcccgacggagagcccgggatccccggaatcggctttccaggaccgccaggccctaagggcgaccagggattcccaggcacgaagggatccttgggatgtcctggcaaaatgggcgagccgggtctgcccggtaaaccagggctcccaggggcgaagggggagccggctgtggccatgccgggcggtcccggtacccccggcttccctggagagcgtgggaattccggagagcacggtgaaatcggccttccgggactcccgggattgcctggaacgcccggcaacgagggcctcgatggcccacgcggggatccgggccagcctggtccacccggtgaacagggcccccctgggcgatgcatcgagggaccacggggagcgcagggtctccctggtttgaacgggttgaagggccagcagggtagaaggggcaagacgggtcctaaaggtgaccccggaattccggggctggaccgttccggtttccccggggagacaggctcccctggaatccctggccaccagggggaaatgggtccacttggtcaaaggggctatcccgggaaccccggcattctgggacccccaggagaggatggggtgattgggatgatgggatttcccggagccatcggaccccccggaccccccgggaacccaggaacccctggacagagagggagtcctggaataccgggcgtgaaaggacagagggggactcctggagcaaagggcgagcagggcgataagggcaacccaggcccttcggagatctcccatgtaatcggagataagggagaacccggattgaagggattcgccgggaaccctggagaaaagggcaatcgtggcgtcccagggatgccgggcctcaaaggcctcaaggggttacctggtccagctggtcctcctggtcctaggggcgatttggggtcaaccggcaaccccggcgagccaggactgcggggaattcccgggtctatgggcaacatgggcatgccgggatcaaagggcaagaggggcaccttgggcttccctggaagagccggcagacctgggctgccgggcatccatggactccaaggggacaaaggggagcccggatacagcgaaggcactcgccctggaccaccgggacctacaggagaccctgggttacccggcgatatgggcaaaaagggagagatgggacagcccggaccccccggccaccttggtccggcaggccctgagggggccccgggcagcccgggctcaccaggcttgcctgggaagcctggacctcacggagacctgggattcaaaggaatcaagggactcctcggcccccctggtataaggggtccccctggtttacctgggttcccggggagcccaggccctatggggatccgcggcgaccagggacgagacggaattcctggaccggccggtgaaaagggcgagacaggtttgctgcgcgcacccccaggtccacgaggcaaccctggcgcccaaggagcaaaaggcgatcgcggagcccccggatttccaggcctgccagggaggaagggcgccatgggcgatgctgggccacgaggacctaccggcatcgagggattccccggcccgcctggactgcccggcgctattatccccgggcagactggtaatcgcggccctcctggctcaagaggaagtcctggagccccaggacctcctggcccccccgggtcccatgtgataggaatcaaaggcgataagggcagtatgggtcatcccggaccaaaaggccctccaggaacagcaggagatatgggacctcctggccgtctaggggcccccgggacccctgggcttccaggcccaagaggcgaccccggtttccaggggttccccggagttaagggggagaagggcaaccctggtttcttggggagcattgggccccccggacccatcggaccaaagggacctcctggagttcgaggggatcctgggacactcaaaataatttctctccccggcagccccggaccacctggcacacctggcgaaccgggaatgcagggcgagcccggtccacccggaccaccaggcaatctgggtccctgtggtcctcgcggcaaacccgggaaagacggcaaacccgggactcccggcccagctggggaaaagggaaataaggggagcaagggtgagccaggcccagcaggtagcgacggcctcccaggactgaaggggaagcggggggattcggggtcccctgcgacatggacaacgagaggttttgtgttcacacggcatagccagaccaccgcgattccctcctgccccgagggtaccgtgccactctatagtggtttctccttcctgtttgtgcaagggaaccagcgagctcacggacaagatcttgggacactcgggtcctgcctgcagaggtttacaacgatgcctttcctgttttgtaatgttaatgatgtgtgcaattttgcgtcacgcaatgattactcatattggctgagcacacctgccctgatgcccatgaacatggctccgattaccggccgggctctcgaaccctatatttcccgttgcacagtgtgtgaggggcccgctattgcaatcgctgttcatagccagactacagatattcccccctgcccccatggctggatcagcctgtggaagggcttctccttcattatgttcacctccgcagggagcgaagggactggccaggccctggcttcaccggggtcttgtctcgaggaattcagggctagtccattccttgagtgccatggccggggcacgtgtaattattactccaactcctacagtttttggttagcatccctcaatccagagcggatgttcaggaagccaattcctagcacagttaaggccggcgagctggaaaagattatttcccgttgccaggtctgcatgaaaaaacggcactag

SEQ ID NO: 14631 - DNA, 4500 bp, Artificial Sequence
  Description of Artificial Sequence: Synthetic coding sequence
atgatggctaattgggcggaagctcgccctcttctcatccttatcgtgctcctgggccagttcgtgagcatcaaagcacaggaggaggatgaagatgagggctacggagaggagatcgcatgcactcagaacggacaaatgtacctgaaccgggatatctggaaacccgcgccatgccagatttgcgtttgtgataatggcgccattctctgcgataaaattgagtgccaggacgttctggattgtgccgacccggtgacaccacctggagagtgttgccctgtttgttctcagacaccaggcggcggaaataccaattttggcaggggcaggaaaggccagaagggggagcctggccttgttcccgtggtcacgggcattagaggaagacctgggccagctggtcccccgggatcgcaagggccccggggtgaaagaggccccaagggacgccctggaccgagagggccccagggcattgacggagagcctggggtgccagggcagccaggtgctccgggtccccctggtcatccctcccatcccgggccagacggtttgtcccgcccctttagcgcccaaatggccgggctcgacgaaaagtctgggctcggctcacaggtaggactgatgcccggatcagtcggaccagttgggccaagagggcctcaggggctgcagggtcagcagggtggagccggtccaacagggccaccgggagaaccaggtgaccctggcccgatgggccctattggatccaggggcccggaaggaccgccagggaaaccaggggaggatggggagcctgggcggaacggaaatccaggcgaggtggggttcgcaggctcgccaggagcccggggcttcccaggtgcccctgggcttcccggactaaaggggcatagaggccacaaggggctggagggaccaaaaggggaagttggtgccccggggagcaaaggcgaggccggccctaccggcccaatgggggcaatgggacctctggggccaagagggatgcccggtgagagaggaaggctgggtccacagggcgccccaggacagaggggagctcatggcatgcctggcaaacccggtcctatgggcccccttggtattcccggaagtagcgggtttcccggcaaccctggaatgaaaggcgaagccggccctaccggggctagggggccagaaggtcctcagggccagcgaggagagactggcccccccggacccgtggggtctccaggcctgcctggagccattggcactgatggaacccccggcgcaaaagggcctactggatccccaggcacttccggcccccccgggtctgctggccctcctgggagcccagggccgcaaggttctacgggcccccagggaatcagaggtcagcctggggacccaggggttcctggattcaagggagaggcagggcctaagggagaacctggcccccatggtatccagggccctataggacctccgggcgaggagggaaagagagggccccgcggagatcctggaacggttgggccccctggccctgtgggcgaacgcggggcccccggcaataggggcttcccaggatctgacggcctccctgggcctaaaggcgcgcagggggaacgcggcccagtcggctcttccggtcccaagggttcacagggtgatccgggaagaccaggtgagccaggcctaccaggagctcgaggtctcactgggaacccaggggtccaagggcccgagggcaagctgggcccgctgggggcgcctggcgaggacggccgcccaggaccccccggctcaattggaatccgggggcaacccgggtctatgggcttgcctggcccaaaaggctcaagcggagacccaggcaagccaggagaggctggtaacgcaggtgttccgggacagaggggcgcgccaggaaaagacggtgaggttggaccaagcggtcctgtcggacctccaggtttagcgggcgaacgaggtgaacagggaccacctggcccgaccggatttcaggggctccctggccccccgggcccacctggggagggagggaagcctggggatcagggggttccgggggaccccggggcagtcggtccattgggccccagaggggagcgcgggaacccaggggaaagaggcgagccaggcatcaccggtctacctggagaaaagggcatggccgggggacacggacctgacggccccaagggtagtcctggcccctctgggacccccggggacactggaccacccggtctgcagggcatgcctggcgagagaggaattgcaggcacccctggcccaaagggcgaccgggggggaataggcgagaaaggagctgagggtacagcagggaatgacggagcccgaggactacccggccctctgggaccaccggggccggctgggcctacaggagagaagggcgaaccgggcccccgggggctggtgggaccaccagggagtagaggaaatcccggcagtcggggtgagaacggccccaccggggcagtaggcttcgcaggaccccaaggacctgacggccaaccaggagttaagggtgagcctggggagcctggccagaagggggacgctggtagccctggcccccagggcctcgcgggttctcccggccctcacggtcccaatggggtacctggcctcaaaggcggacgcgggacccaggggccacccggcgctactggttttccagggagcgcggggcgggttggaccccctgggcctgctggagcccccgggcccgctggtcctttgggggagccggggaaggagggacctccaggactgagaggcgaccccggaagtcacggtcgggtgggcgacaggggcccagcaggcccccccggtggcccaggggacaaaggcgatcccggggaagacggacagcctggtcctgacggcccgcccggccccgccggaactaccggacagagaggcatcgtgggcatgcccggacagcggggtgaaaggggtatgccaggtcttccaggccctgcaggtaccccaggtaaagtcggtcctaccggggctactggcgacaaggggccgccaggccccgtcggcccaccagggtccaacggacccgtgggggaacctgggcctgaggggcccgcagggaacgacggtacccctggacgagatggggcggtgggtgaaaggggcgatcggggcgatcctggacccgcgggcctccctggaagtcaaggagctcccgggactcccggtcccgtaggcgcacccggcgatgctggacagaggggggaccctggatcacggggcccaattgggcctcctgggagagctggaaaacgggggcttcctgggcctcaagggccccgcggggacaaaggggaccacggggaccgcggagatcgggggcagaaggggcatcgcggctttacaggcttgcagggccttcctgggcctcccggtcctaatggtgaacagggaagcgccgggattccaggcccttttggtcctcgtggccccccggggcccgtgggcccctctggcaaagaaggaaatcctggaccactcggacccattgggcctccaggggtgcggggatccgttggagaggcagggcccgagggcccgcccggtgagccaggtccgccaggaccgccaggacctcccgggcacttgaccgccgcccttggcgatattatgggacattacgatgagtccatgccagatcctctccccgagttcacagaagatcaggccgcaccggatgacaaaaataagaccgaccctggcgtccatgccaccttgaaatctctgagtagtcagatcgaaacgatgcggagcccagatggctccaagaaacaccctgcacgaacttgtgacgacctgaagctttgtcattctgccaagcaatctggggaatactggattgatccaaaccaaggcagcgtggaggatgctataaaggtgtattgcaacatggagactggggaaacctgtatttcagctaaccctagcagcgtcccgcggaaaacatggtgggcaagcaagagtcccgataacaaaccagtgtggtatgggcttgacatgaacagagggtcgcaatttgcctacggtgatcatcaatcccccaatactgcaatcacacagatgacctttctcaggctgctgtccaaagaggcttcacagaacattacatatatatgtaaaaatagtgttggttatatggatgaccaagccaagaatcttaagaaggctgtcgtgctcaaaggtgctaacgatttggatatcaaggcagaggggaatatccgattcagatatattgtgctacaggatacgtgttccaaacgcaacgggaacgtggggaagactgtgttcgagtacagaactcaaaacgtagctcgtttaccaattatcgacttagcacctgttgatgtgggcggcaccgatcaagaatttggagtggagattggacccgtgtgctttgtatag

SEQ ID NO: 14632 - DNA, 3420 bp, Artificial Sequence
  Description of Artificial Sequence: Synthetic coding sequence
ctgcccggccgtcgccaccggctgggtcctcctggctctcaaggtccacggggtgagagggggcccaaaggaagacccggaccgcgcggcccccagggtatagacggcgaaccaggggtgccagggcaacctggcgctcctggaggcgcaggcccaacagggcctcccggcgaaccaggtgaccctggaccgatgggacctatcggatctaggggccctgaaggccctccgggcaaaccaggtgaggacggcgagcccggtaggaatggaaatcccggcgaagttggttttgcaggatcccccggcgcgcggggcttccccggagcgccgggcttgcctggccttaagggccaccggggccataagggactcgagggccccaagggagaggtgggagcccccggaagcaagggcgaagcaggaccaactggccctagaggcgacccagggacagtggggcctcccggtcctgttggagagaggggcgctcctggaaatcgcggcttcccaggctctgacgggcttccaggtcctaaaggggcccagggtgaacgcggtccagtcggttcgtccggacccaagggaagccagggcgatcctgggagaccaggtgagcctggactgcccggagctaggggactaacaggtaatcccggcgtgcagggcccagaaggcaagctggggcccctgggggcgcctggggaggatggcagacccggaccaccgggaagcattgggattcggggccagcccggctccatgggtttgccaggccctaaagggagttccggggaccccggtaagccaggtgaggcagggaatgcaggggtgccggggcagcgcggagcccccggtaaggatggggaggtcggcccaagcggacccgtaggcccacctggcctggccggagaaaggggagaacaaggtcccccaggaccgacaggattccagggactcccgggaccccccggcccgcccggcgaaggtggcaagcccggggatcagggcgttccaggagaccctggcgcagtgggcccgttggggcctaggggcgaacggggtaatccaggcgaaagaggcgagccgggtatcacgggcctcccaggggagaaggggatggccggcggacacgggccagatggtccaaaaggcagccctggaccatcaggaacacctggcgacaccggtcctcccggtttgcagggcatgccgggggagcgcggcatcgccggcactcctggcccaaaaggggatcgagggggaatcggcgagaagggcgccgaaggaacagcaggcaatgacggcgcacgtggacttccgggccctttagggcctcccggccctgccggccccacaggcgagaagggtgaaccaggtccaagaggcttagttgggccacctggatcgaggggaaatcccgggtctcgcggagagaatggccctaccggggctgtagggttcgccgggcctcaggggccagacggacagcctggagtcaagggagagcccggcgagcccgggcagaaaggcgacgccggcagccctggaccccaggggttggctgggagccccggtcctcacggaccaaatggggtgccagggctgaagggaggacggggcactcagggaccaccgggtgccacaggttttccagggtcagctgggagggtgggacctcccggccccgctggcgcccccggacctgcgggtccactgggcgaacccggcaaggaaggaccacccggcctgcgaggggatccaggttctcatggcagagtaggagatcgcggaccagccgggcccccaggtgggccaggggacaagggggacccaggcgaggatggacagcccggcccagacggaccgcccggccctgcagggacgaccggccagagaggaattgtgggaatgcctggccagcggggcgagaggggcatgccagggcttccagggccggccggtacaccaggtaaggtcggacctacgggtgccactggtgataaaggcccacccggccccgttgggcctccagggtctaatggtcccgtgggagaaccgggccctgagggaccagctggtaacgacggaacaccgggtcgcgacggagccgtgggtgagagaggcgataggggagaccctggtcctgctggactcccaggcagtcaaggcgcgccaggtacccctgggcctgtaggagcacctggggatgctggccagcggggtgatcccggctctcgcggacctatcgggcccccaggccgggccggaaagcgaggcttgccgggcccccaagggccacgaggagacaaaggtgaccacggagaccggggagacagaggacaaaaaggccacagaggctttacaggcttgcaggggctcccagggccccccggtcctaacggagaacaggggtctgctggaatccccgggccctttggccccagggggcctcccgggcctgttggcccgtctggaaaagagggtaacccagggcctctgggcccgatcgggccaccaggcgtccgcgggtcggtcggagaagcaggaccagagggcccacctggagagccgggccctccaggacctccggggccccctgggcacctaaccgctgcactcggcgatattatgggacattacgacgagagcatgccagaccccctgccagaatttaccgaagaccaggccgcccctgatgacaagaacaaaacagatccaggagtccacgccaccttgaagagtctatccagccagattgaaaccatgcggagcccagatggctctaagaagcacccggcacgcacatgcgacgatttgaagctttgccactccgcaaagcagagtggagaatattggatcgacccaaatcaggggagtgtggaagatgctattaaagtttactgcaacatggagactggcgaaacctgcatcagtgccaatccctcatccgtgccccggaagacttggtgggcctccaagtcccctgataacaagcccgtttggtatggactggatatgaatcggggatcccagtttgcgtacggggaccatcaatctcctaatacggccataacgcagatgacatttttacggcttctatccaaggaggccagccagaatatcacctacatatgcaaaaatagcgttggttacatggacgaccaagcgaagaacctcaagaaggccgtcgtgttgaagggggcaaacgacttggatatcaaggccgagggaaatatcagatttcgctacatcgtactgcaagacacctgtagtaaacgaaacggtaacgtcggaaagaccgtgttcgagtatcgtacacaaaacgtggctcggttgccaatcattgatctagcaccagttgacgtgggcggcactgaccaagagtttggtgttgagatcggcccagtatgcttcgtgtag

SEQ ID NO: 14633 - DNA, 5304 bp, Artificial Sequence
  Description of Artificial Sequence: Synthetic coding sequence
atggagccgtggtcatcccgctggaaaactaagcgctggctgtgggacttcacagtcactaccctggcactaacctttcttttccaggctagagaagtccggggagccgcacctgtggacgtgctcaaagccctggattttcacaacagtcccgagggcataagcaaaacaactggattttgtactaaccgaaaaaattcaaaagggagcgacactgcctatagagtatccaaacaggcgcagctaagcgctcccaccaagcagctgtttcccgggggcacattccctgaggacttctcaatactgtttacagtgaagcctaagaaggggattcagtccttcctgcttagtatttacaatgagcatggcattcagcaaataggagtcgaggtgggtaggtccccagttttcctctttgaggatcatacaggaaagcccgccccagaggactaccccctgttcaggaccgttaatatagcggacggaaaatggcatagagtggctatcagtgtcgagaaaaaaaccgtaacgatgattgtggactgtaaaaagaagaccactaaacccctcgaccgcagcgaacgggcaattgttgatacaaatggcattacggtgtttggaaccagaattttggatgaggaggtgttcgaaggagatatccaacagtttctcattactggcgatcccaaggcagcttatgattactgtgaacactacagccccgattgcgatagcagcgcccctaaggccgcccaggctcaggagcctcagatcgacgaggcaaacattgtagacgacttccaggaatacaactacggcacaatggagagctaccagacagaagcaccacgccacgtgtctggaacaaatgagcctaatccggtggaagaaattttcaccgaggagtacctgacaggagaggattacgattctcagcggaagaactccgaggacacgctgtacgagaacaaagagatcgatggacgggatagtgacctgctggtggacggagatctgggggagtacgacttctatgagtataaggagtacgaggacaagccaacctctcctcccaacgaagagtttgggccaggtgttcctgctgagacagacatcaccgagaccagcatcaacgggcacggcgcctacggcgaaaagggacagaagggcgaacctgcagtggtagaacctgggatgttggtagaaggccccccaggtcctgctggaccggctggtatcatgggcccacccggcctacagggccccaccggtccccccggagacccgggagatcggggacctcctggccggccagggttgccaggcgctgacggactgcccggaccccccgggactatgctgatgcttccattccggtatgggggcgatggcagtaaaggaccaacaatctctgcccaagaagctcaggcccaggctatcctgcagcaggctaggatagcactccgcggacccccagggccaatgggtcttaccggtcgtccaggacccgtgggcggcccaggatcctcaggagccaaaggggagtcaggcgatccagggcctcagggccctcgcggagtccagggaccgcccggccccactggtaagcctggtaaacgcggacgtcctggcgcagacggaggcaggggcatgcccggcgaacctggtgctaaaggcgacagaggctttgatgggttgcccggcctccccggagataaaggacaccggggggagagaggcccacaaggcccccctgggccaccaggcgacgatggaatgaggggggaggacggcgagatcggacccaggggtctcccaggggaagccggccccagagggctgcttggtcccaggggaactcctggagcccccggtcagcccggcatggccggcgtggacggtccccccggaccaaagggcaacatgggcccccaaggagaaccaggaccacctggacagcaagggaatccaggcccccagggcctgccgggaccacaaggacctattggccctccaggagaaaaaggtcctcagggaaagccgggcctcgccgggctgcctggtgcagatggaccccccggccaccccgggaaggaaggtcagagtggagagaaaggcgccttaggcccccctggccctcagggacctatcggttatcctgggccccggggggtcaagggcgccgacggggtgcgggggctgaaaggatcaaagggagaaaaaggggaagatggatttcccgggtttaagggggacatgggcctaaagggagacaggggtgaagtgggtcaaatcgggcctagaggcgaagacgggccagaaggccccaaaggacgggctggcccgaccggggaccctggtcccagtggccaagcaggcgagaaaggcaagcttggggtgcctggtttaccgggttatcccgggcgccaaggtccaaagggaagcactggatttcccggttttccaggggcaaatggggaaaaaggtgcacgaggcgtggcgggcaaacccggacctcgggggcaacggggccctaccggccctcggggatcaagaggggcacgggggcctacgggcaaaccaggtcccaaaggtacctccgggggagatggacccccaggtccacccggggaaagaggaccacaagggccccaggggccggtgggctttcctggtccaaagggccctccaggaccacctggcaaagatgggctaccaggtcacccaggccagaggggcgagacaggttttcagggaaagacagggcccccaggccccggtggggtcgtgggaccccagggcccgactggcgagacagggcctattggggagagaggccacccgggccccccggggccacccggggaacagggtcttcccggggcagctggaaaggagggcgccaagggcgaccccggacctcaaggcatcagtggaaaagatgggcccgccggtttacgggggttccctggcgagaggggcctgcctggagcccaaggagcacccggccttaaggggggagagggcccgcaggggccccccgggcccgtcgggagtcctggagagaggggttccgctggcactgccgggccgatcgggctgccaggacgccccggcccccagggtccccccggaccggcaggagaaaagggcgccccgggggagaagggtccccaagggccagctggacgggacggggtgcaagggcccgtcggcctacccggtcctgccggacctgccgggtcgccaggcgaggacggcgacaagggagagattggcgaacccggtcagaaaggcagcaagggcgataagggcgaaaacgggcctcccggccctccaggcctccagggaccagttggggcacctggaatagcaggaggggatggggaaccaggcccccggggccagcagggcatgttcggacagaaaggagatgagggggctcgcggctttccaggtccacccggaccgataggcctgcaggggctgccggggcctccaggagagaagggagagaacggcgatgtggggcccatgggccctccaggaccccccggaccccgagggccccagggacctaatggggccgacggacctcagggcccgcccggttctgtgggatctgtgggcggtgttggcgagaagggcgaacccggtgaggccggaaaccccgggcccccaggggaggccggagtcggcggccctaagggagagcgaggggaaaagggggaagccggccctcccggagccgcaggccctcccggtgcaaagggtcctcccggtgacgacgggcctaagggaaaccctgggccagtggggtttcccggggacccggggcctccaggcgagccgggtcccgcaggacaggacggcgtgggcggagataaaggagaagacggagaccctgggcagcccggccccccaggtccgtcaggtgaggcaggccctccggggcctcctggaaaaagagggcccccaggtgcggcaggagctgagggacgccagggcgagaagggagccaaaggagaggcaggggccgagggcccacccgggaaaacagggccggtcggtccacagggaccggcagggaagcccggcccagagggcctccggggcattcccggccccgtgggagaacaagggttaccgggtgccgctgggcaggatggtccgcctggacctatgggccctcctgggttgcccggcctcaagggtgacccgggatccaaaggcgagaaaggtcacccaggactcatcgggcttatcgggcctccaggtgaacaaggagagaaaggggatagaggactgccgggtacacagggcagccccggtgctaaaggagacgggggtatcccgggccctgccggccccctggggccaccaggtccgccaggcttacctggcccacagggaccaaaaggtaacaaaggctcaactggacccgctggacagaaaggggacagcggcctgcctgggccaccaggatcacctggccctcctggagaagtgatccagcctctacccatcctctcctcaaaaaaaacgcggagacataccgagggcatgcaggccgacgcggacgataacatcctcgattatagtgatggaatggaagaaatttttggcagtctgaacagcttgaagcaggatatcgagcatatgaagttccccatggggacccagacgaatccggcgcgcacatgtaaggaccttcaacttagccatcccgatttccctgatggggagtattggattgacccaaaccagggctgcagtggcgactcttttaaggtctattgtaacttcactagtggtggtgagacttgcatctacccagacaagaagtccgagggtgttcgtatcagtagctggccaaaagagaagcctggctcctggttctccgagttcaagcgcggcaaattgctcagttatctcgacgttgagggtaacagcatcaacatggtccagatgacatttctcaaactgctgaccgctagcgctaggcagaacttcacctaccactgtcaccagagtgcagcgtggtacgatgtgagctcgggttcttatgataaggcgctgaggttcctaggaagcaacgatgaggagatgtcctatgacaacaatccctttattaagaccctgtacgatggatgcgcaagtcgcaagggatatgaaaagaccgtaattgaaatcaacacccctaagatcgaccaggttcccattgttgacgtgatgatcaatgatttcggcgaccaaaaccagaagttcggtttcgaggttggccccgtctgcttcctaggctag

SEQ ID NO: 14634 - DNA, 5457 bp, Artificial Sequence
  Description of Artificial Sequence: Synthetic coding sequence
atggagccttggtcttccaggtggaaaacaaagcgatggttatgggatttcacagtcaccactctggccctgacctttctgtttcaggcgcgcgaggtccggggtgccgctcctgtcgacgtcctcaaggcactggattttcacaactctccagagggcataagcaagactaccggcttttgtactaatagaaaaaactctaagggaagcgatactgcctatcgagtgtcaaagcaggcacaactttcagctccgacaaagcagctgttcccaggagggacatttccagaggacttctccatactctttaccgtgaaaccaaagaaggggatccaaagcttcctgctgagcatttataatgaacacggcattcaacaaataggagtcgaggtgggtaggagccccgttttcctgtttgaagaccataccggaaaacctgcacccgaagattacccactttttaggactgtgaatatcgcagacggaaaatggcatagggttgctatcagcgtggaaaagaagaccgtgactatgatcgtcgactgcaagaagaagactactaagcctcttgaccgaagcgagagggcaatcgtagatacaaacggtatcacagtgtttggcacacgcatcctcgacgaagaagtgttcgagggggatattcagcagtttctcattactggggacccaaaggcggcctacgattactgcgagcactattctcccgattgcgactcatctgcacctaaggcggctcaggcgcaggaaccacagattgacgaaaagaagaagtccaatttcaagaagaagatgaggaccgtggcaaccaaatccaaagagaaatctaaaaagttcactcccccaaaatctgagaaattctcatccaaaaagaagaagtcttatcaggccagtgctaaggccaaacttggtgtgaaggctaacattgtcgacgacttccaggagtataattacggaactatggagagctaccagaccgaagctccccggcatgtttcaggcaccaacgagccgaatccggtggaagaaattttcaccgaagaatacctgactggcgaggattatgattcccaacgaaaaaacagtgaagacaccctgtatgagaataaggagatcgatgggcgtgacagcgatctcttggtagatggtgatctcggtgaatacgatttttatgaatataaggaatacgaggataaaccgaccagccccccaaatgaggagtttgggcccggagtccccgccgagaccgatatcactgagacttccattaacggccacggcgcctatggcgagaaaggccagaaaggcgagcctgccgtcgtggagccgggcatgctcgtggaaggcccgccgggaccagcaggacctgccggtatcatgggacctccggggttacagggccccactggtcccccaggcgatcctggcgaccggggaccacccgggagacctggcttaccaggtgcggacggactgcctggccctccaggaaccatgctgatgctcccctttcgctatgggggcgacggttcgaagggcccgacaatcagcgcccaggaggctcaggcccaggcaatcctgcaacaggcaagaatcgcattgaggggcccccccgggcctatggggttgacaggtaggcccggtccagtgggtggacctgggtcaagtggcgcaaaaggggagagtggggacccaggtcctcagggccccaggggagtccaagggcctcctggcccaactggtaagccagggaagaggggccggcctggcgctgatggtggcaggggcatgcctggggagcccggggcaaaaggcgaccgagggtttgacggtctgccaggactgccaggcgataagggccaccggggagaaaggggacctcaaggacctccaggcccacctggtgatgatggcatgagaggggaggatggcgaaatcggcccacggggcctgccgggagaggccggtcccaggggtttactgggaccccggggaacaccaggagcgcccggacaacccggaatggcaggagtagatggtccccccggccccaagggaaatatggggcctcagggagaaccgggtcctcctgggcaacagggcaatcctggcccacagggactgccaggcccccagggaccgattggtccccctggtgagaaaggccctcagggcaagccaggtttggccgggttacccggagccgacggacccccaggtcatcctggcaaagagggacagtcaggggagaagggagctctagggcccccaggcccacaaggaccaatagggtatcccggacccaggggggtcaaaggcgcggatggcgtgcgcggccttaaaggctcaaagggagagaagggcgaagatgggttccccgggttcaagggcgacatgggtctcaagggtgacagaggcgaagtgggacagatcgggcctagaggcgaagatggaccggaggggcctaaaggtagggccggtccaacaggcgaccctggaccgtctggacaggctggggagaaggggaaactgggagtgccaggtttgcccggatatccaggccggcagggccccaaaggttcaacaggctttcctggctttcccggcgccaacggggagaaaggagctcggggagtagccggcaagccaggtcctaggggtcaaaggggccccactggcccgcgcggatcgcgcggcgcgaggggaccaaccggcaaacctgggcctaagggcacatccggtggagatggacctccaggaccgcctggggagcgcggacctcagggtcctcaggggcccgtcggctttccgggcccgaaaggaccacccggacctccagggaaggacggcctgccgggccaccccggccagagaggcgaaacaggattccagggcaagactggtccgcctgggccagggggagtggtggggccacaaggacccactggggagactgggcccattggggaaaggggacacccagggccccccggtccccccggcgagcagggattacctggtgcagccgggaaagagggggccaagggcgatcccgggccccaaggaatcagcgggaaagacggcccggctggcctaaggggctttcccggagagcggggtcttcctggcgcgcagggcgcccctggcctcaaagggggtgagggcccacagggaccgccagggccagtagggtcacccggagagcggggctcggccggtaccgctgggccaatcgggctccccggacggccagggcctcagggaccccctggacccgccggagaaaaaggcgcgcccggcgaaaagggcccccagggccctgctggccgagatggcgtgcagggccctgtcgggctgcccgggcccgccggccctgcagggtctcccggggaggacggagataagggcgaaataggggaacctggtcagaagggcagcaaaggagacaagggcgaaaatgggccgccaggccccccaggattacagggacccgttggagcccccggaatagcaggaggcgacggagagcctggaccccgaggtcaacaaggaatgttcgggcagaaaggggacgagggggcgcgggggttccctggtccacccggccctatcggcctccaagggttgcctggtcctccaggcgaaaagggcgagaacggggacgtcggtccaatgggtccccctggccccccaggccctagaggaccccaaggccctaatggagcagacggcccccagggaccacccggaagcgtcggttcagtgggcggggttggagagaagggcgagccaggtgaggctggtaatcctgggcctccgggagaagctggtgtagggggaccaaagggagaacgcggcgagaagggcgaggctgggcctcctggcgcagccgggcccccaggagcaaagggccccccaggcgacgacggccctaaaggaaatccaggcccagttgggtttcctggtgatcccgggccaccaggagaacccgggcccgcaggacaggatggagtcgggggagataaaggagaagatggagaccctggacagccaggcccgcccggtccttcaggtgaagccggcccccctggacctccagggaagagaggtcccccaggggcagcaggagccgaagggagacagggcgaaaaaggggccaagggcgaggcaggtgcagagggacctcctgggaagacgggaccagtcggcccccaaggccctgcgggcaaaccagggcctgaaggtctccggggaatcccgggccctgtcggcgagcaagggttgcccggtgctgctgggcaggacggccctcctgggccaatgggtcctcccggattacccgggctaaaaggagaccctgggtctaaaggggaaaaagggcatcctggactcattggcctgataggaccccccggggaacagggagaaaagggagaccgtggactgccaggcacacaaggatctccaggcgctaagggagatggagggatccccggccctgcaggcccattaggacccccagggccccccggcttgcctggccctcagggaccaaagggcaacaagggctctactgggccggctggacagaaaggggattccgggctgccggggccaccggggtcgcccggtcctcccggagaggtcatacagccactccctattttaagctcaaagaagacaaggcggcacacagaaggaatgcaggccgatgccgatgacaacatcttagattacagcgacggcatggaagagatctttggctcactgaatagcctgaagcaggacatagaacacatgaagtttccgatgggtacacagaccaaccccgccaggacatgtaaggacctgcaattgagtcacccggatttccccgacggcgaatattggattgacccaaatcagggttgctccggggattccttcaaggtttattgtaacttcacatcggggggcgaaacgtgtatttatccagataagaagtccgagggcgtccgaatatcttcttggcccaaagagaagcctggatcatggttcagcgaatttaagcgcggcaagttgctgagttatctcgacgtagagggcaactccataaacatggttcagatgacttttcttaaactgctgactgcctccgctcgacaaaactttacctaccactgccaccaatccgccgcctggtacgacgtctcttccggctcttacgacaaggcactgaggtttctgggaagcaatgacgaggagatgtcctacgataataacccatttattaagactctgtacgatggttgtgcttccaggaaaggatacgagaaaactgtcatagagatcaacactccgaaaatagatcaggttcccatagtggatgtaatgattaacgatttcggcgatcagaatcagaaatttggtttcgaggtgggccctgtgtgttttctcggctag

SEQ ID NO: 14635 - DNA, 3081 bp, Artificial Sequence
  Description of Artificial Sequence: Synthetic coding sequence
atggtgagcgaggtgtcccgagatctcaaagtgaagcgcgaaaagctggtgaaactcgctcaggaaggaaagatggccctgaaggatccaaaggtggaacaggcacagctggagactcaggttttgcaggtgaagcaagagaaacgtgaaaacctcgagttccaagattatcaggatatccaggaggacaaggtccaaagaatcagtgacgtgatcggatctactggttttcccggctttcccggggcaaatggggagaagggagctcggggagtggccggtaagcccggcccccgtgggcagagggggccgacaggacccagaggaagtcgcggagcaagaggtcccactgggaaacctggccctaaggggacatctggaggggacggccctcctggccctcctggcgagaggggcccgcagggaccccagggacctgtcggattcccgggtcctaaaggtcccccagggcctcccgggaaggatgggctgcctggccaccccgggcaaagaggggagactggcttccagggcaagactggaccccctgggcctgggggggtcgtgggaccacagggcccaaccggggagactggccctatcggcgaaaggggtcacccagggccccccggcccccccggtgaacagggactcccgggtgcagcagggaaagagggcgccaagggagaccccggcccacagggcatcagcggaaaggatggtcctgccggccttaggggctttccaggcgaacgtggcctacccggcgcccagggtgctcccggactgaagggtggggagggaccccaaggacctcccggccctgttggcagcccaggcgaaagggggtccgccggtacagccggacctatcgggctgcccggacggcctgggccacaaggacccccaggtccggccggggaaaaaggcgctccaggggagaaaggtccccaggggccagccggcagggatggggtgcaaggccccgtgggcctgcccgggccggccggacccgcaggaagcccaggtgaggatggggataagggggaaatcggagagcccggccaaaagggaagtaaaggagataaaggcgagaatggcccccctggcccaccagggctgcagggtccagtgggtgctcctggcattgcagggggtgatggagaacccgggcctcgaggccagcagggcatgttcgggcaaaagggagatgagggcgcacgtggcttccctggcccacctgggccgatcggtctgcagggcctgccaggaccacctggggagaagggggaaaatggagacgtcggcccaatgggaccacccgggcctccgggcccacgcggtcctcagggtccaaacggcgctgatgggccacagggtccaccgggaagcgtcggctctgtggggggtgtcggagagaaaggtgagcccggtgaagctggaaaccctggaccacctggcgaagctggggtggggggacccaaaggcgagcggggtgaaaaaggggaagccggccctccaggcgctgcaggtcccccaggcgctaaaggaccccccggtgacgacggcccgaagggcaacccaggtccagtgggcttccccggggaccctggaccccctggcgaaccagggccggccggacaggatggagtcggcggcgataaaggtgaagacggggacccaggtcagccaggtccaccaggcccgtctggagaagccggccccccagggccacctgggaagcgtggccctccaggcgccgcaggcgccgaggggcgccaaggtgagaagggcgccaaaggggaagcaggagccgaaggccctcctggtaagactggcccggtgggccctcagggcccggccggcaaaccaggccctgaggggctacgaggcattcctggaccagtgggcgaacaggggctacctggagcggccgggcaggatggacccccaggccccatgggccccccaggtctgcctggactgaagggggaccctgggtccaagggcgaaaaaggccatcccggtctcatcggcctgatcggtccacctggagagcagggagaaaaaggggacagaggcctcccaggcacacaggggtcacctggcgcaaagggggatggtgggattcctggacctgccggcccactcggaccccccggaccaccgggcttgcctggcccccagggcccaaagggcaacaaggggagtaccggtcctgccggccagaagggagactctggcctacctggcccaccaggatcccccggcccacctggcgaagtgatacagcctctccccatcctgtcctctaaaaagacaaggaggcataccgagggtatgcaggcggatgcggacgacaacatcttggattatagtgacggaatggaggagatcttcggatcattgaattctctgaagcaagatatagaacatatgaagttccctatggggacacaaaccaacccggctaggacctgtaaggaccttcagctgtcacacccagacttccctgatggcgagtactggatcgacccaaaccaggggtgctcaggagactcctttaaagtgtattgtaattttaccagcggtggagaaacatgcatttaccccgacaagaagtctgaaggggtgcggattagctcttggccgaaggagaaacccgggtcatggtttagcgagttcaaaaggggtaaacttttgagctatttagacgttgaagggaactcaattaacatggtccagatgactttcttgaaactgctgaccgcctccgcccgccagaatttcacttatcactgccaccagtcagctgcctggtacgatgtctcaagtggcagctatgacaaagctttgcgattccttggttcaaatgacgaggaaatgtcttacgacaacaaccccttcattaagacactctacgatggctgtgcttccaggaagggttacgaaaagacggtgatcgaaattaatactccgaagattgaccaggtgccaattgtcgatgtaatgataaatgattttggcgatcagaaccaaaagttcggctttgaagtggggcccgtttgttttctcggatag

SEQ ID NO: 14636 - DNA, 5421 bp, Artificial Sequence
  Description of Artificial Sequence: Synthetic coding sequence
atggagccatggagcagcaggtggaaaaccaaaagatggttatgggacttcactgttacaaccctggccttgacattcctgtttcaggccagggaggtcagaggagccgcacccgttgacgtgctaaaggccctcgacttccataatagtcccgaagggatatccaagacaaccgggttctgtacgaatcggaaaaattcaaaggggagcgatactgcgtatcgggtctccaaacaggcccagctgagcgctcccacaaaacagctgttcccaggcggcactttccccgaggactttagcatacttttcaccgtcaagcctaagaagggaatccagagcttcttgctgagtatatataatgagcacgggattcagcagattggagtggaagtgggtcgatctcccgtcttcctcttcgaagaccacactggaaaaccggcacctgaggactacccgctgttcaggaccgtgaatatcgccgatggcaagtggcaccgggttgccatctcagtggagaagaagaccgtcacgatgatcgtggattgcaagaaaaagacaacaaagccactcgacagaagtgaaagggctatagtggacacaaacggcataactgtttttggaacacgtatcctggacgaagaggtgttcgagggggacattcagcagttcttgattactggggatcccaaggccgcctatgactactgcgaacactactcacccgattgcgactcctccgcgcccaaggccgcacaggcacaggaacctcagattgatgaatacgcaccagaggacatcatcgaatacgattatgaatacggagaagcagagtacaaagaggccgagtccgtcacagaaggaccaacagtgacagaagaaacaattgcccaaacagaggctaacattgtggacgattttcaggagtataactacggaacgatggagtcttaccagactgaagccccgaggcacgtgagcggaacgaacgagccaaaccctgtggaggagattttcacagaagagtatctcacaggtgaggattacgatagccagcgcaagaacagtgaggacactttgtacgagaataaggaaattgatggtcgtgattccgaccttctggtggacggtgatcttggggagtatgacttctacgagtataaggagtacgaagataagcccaccagtccacccaatgaggagttcggacctggggtacccgctgaaacagatatcaccgagacttctattaacggtcatggcgcctatggggaaaagggacagaagggtgagcccgctgtggtggagcctggcatgttagtggaaggcccacccggacccgctggtccagcgggcattatgggccctcccgggctccagggccccactggacccccaggtgaccccggcgatcggggccctcctgggaggcctggccttccaggtgctgatggcttacccggccctccagggacgatgcttatgctgcccttcaggtacggaggcgacggaagtaagggtccaactataagcgcgcaagaagcccaggcccaggccattctccagcaagctcgaattgctctgcgtgggccgccagggcccatgggcctgactgggcggcccgggcccgtgggggggcctggatcatccggagccaagggtgaatccggagatcctggaccccagggacccagaggagtgcagggaccacctggtccgaccgggaaaccaggcaagagagggcgtccgggcgcagacggaggtcgcgggatgcctggggagcctggtgctaaaggcgaccggggatttgatgggttgccgggcttgccaggcgacaaagggcacaggggtgagaggggcccacagggcccgccaggacctcccggggacgatgggatgagaggcgaggacggcgagatcggtccccgcggcttgcccggcgaggctgggccacgaggcctgctgggaccacggggcacgcctggagcccccggacagcccggtatggccggggtcgacggtcctcccggccctaaaggtaacatgggcccccagggtgagccaggacccccagggcagcaaggcaatccagggccgcaagggctccccggccctcagggcccgataggccccccaggggagaaggggcctcagggtaagcctggactcgctggattgcccggagccgatgggcctccaggccaccccggaaaagagggtcagtccggagagaaaggcgctctgggcccaccgggaccgcagggcccaataggttaccctgggccacgcggggtgaagggcgccgacggagtccgtggcctgaaaggatcaaagggggaaaagggggaggacgggttccctggctttaagggggatatgggtcttaagggtgacagaggggaagttggacagatcgggcctcgcggcgaagatggtcctgagggccctaagggccgagccgggcctactggtgatccagggccctccggccaggccggagaaaaagggaaactgggtgtgccaggtctgcccggttatcctgggaggcaggggcccaaggggtcaactggattccctggctttcctggcgctaatggggaaaaaggggcgcggggagtggcaggcaaacccggccctcggggccaaagagggccgactgggcccaggggtagtcgcggggccaggggcccaaccgggaagcccggcccgaaggggacctcagggggcgatggccctccaggtccacctggtgaacgcggtccacaaggaccacagggcccagtagggtttccgggtcctaaaggcccccctggccctcctggaaaggatggactgcctgggcacccgggccagcgcggagagacagggttccaggggaaaaccggtccgccaggccccggcggagtggtcggcccacaagggcccaccggggagaccggacccatcggcgagcggggacatccaggtcctcccggaccccctggagaacaaggacttcctggcgccgccggcaaggaaggcgctaaaggagatccaggaccgcaagggatctcggggaaagacggcccagctgggttgcgaggcttccccggagaacgcggtctcccaggcgcacagggcgcgccaggcctgaagggtggcgaaggacctcaggggccccccggcccagtcgggtccccaggggagaggggtagcgcagggacggctggccccataggcttgccggggcggccaggaccgcaaggtcctccgggccccgccggcgagaaaggcgcccctggagagaaaggcccccaaggccccgccggcagggatggcgtgcagggtcccgttgggctgcctggtccagccggccccgctggctcccctggagaggatggtgacaagggggaaattggcgaacctggtcaaaagggttccaagggcgataaaggggaaaatggaccaccagggcctcctggactccagggcccggtcggcgcacccggtattgcggggggagatggagaaccaggccccagaggacaacagggtatgttcggacagaagggggacgagggcgctagagggttcccgggacctccaggcccaatcggacttcagggattgccagggcctcccggcgagaaaggcgaaaacggtgatgtggggcccatgggcccgccggggcccccagggccaaggggcccacagggtcctaatggagcagacgggcctcagggcccgcccggcagcgtaggtagtgtaggaggggtgggcgagaaaggcgagcccggtgaggccggaaaccccggccctcctggagaggctggggttgggggccctaagggagagagaggggagaagggggaagccggaccccccggagccgccgggccaccaggagcgaaaggcccaccgggtgatgatggtcctaagggtaatccaggaccagttgggttccccggagaccccggcccacctggtgagcctggtcctgccgggcaggacggcgtaggcggcgacaagggggaagacggggatccaggacagcccggtcctcctggccccagtggtgaggctggcccaccaggcccacccgggaagcgtggcccgcccggcgcagctggggctgaaggtagacagggggagaaaggcgcaaagggggaggctggggcggagggtccacccggcaaaaccgggccagtcggaccacaagggcccgcgggaaagcccgggcctgagggtttgagaggcatccccggcccagtaggcgaacagggtctcccaggcgcggcgggccaggatgggcctccgggaccaatgggacccccaggcttaccggggttgaagggggaccctggcagcaagggagaaaagggccatccgggcctgatcggattaatcgggcccccgggagagcagggcgagaagggagacaggggactcccgggaactcagggctcaccaggcgccaaaggtgacggcgggatccctggccctgcaggacccttaggtccccccggccctccgggtttacccggccctcaaggcccaaaaggaaataaaggcagtactggaccagcaggccagaagggtgacagtggcctaccggggcccccaggatctcccggtccccctggggaagtcattcagcccctgcccattttgagctctaagaagacaagacgacacactgagggaatgcaggctgatgccgacgataacatccttgattattctgatgggatggaagaaatctttggcagccttaatagcttaaagcaggacatcgagcatatgaaattccctatggggactcagacaaatcctgctcgaacttgcaaggacctgcagctgagccatcccgatttccctgacggggagtattggatcgacccaaatcagggatgctctggcgacagttttaaggtgtactgtaactttactagcgggggcgagacgtgtatttatcccgataaaaagtctgagggcgttcggatcagctcttggcctaaagagaaacctgggagctggttctccgagttcaaacgcggcaaactcctgagctacttagacgtggagggtaactctataaatatggtccagatgacattcttaaagctgctgaccgcttctgcccgccagaacttcacgtatcactgtcatcagtctgccgcttggtacgacgtctcctctggttcatatgacaaggccctgaggtttctagggtcgaatgatgaggaaatgagctacgataacaacccttttataaaaaccttatacgacggatgtgcctcccggaaagggtatgagaaaaccgtcatcgaaatcaacacccctaaaatcgatcaagtcccgatcgttgatgttatgatcaatgatttcggcgatcaaaatcaaaaatttggttttgaagtcggaccagtatgtttcctgggttag

SEQ ID NO: 14637 - DNA, 5073 bp, Artificial Sequence
  Description of Artificial Sequence: Synthetic coding sequence
atggagccatggtcaagccggtggaaaacaaagcgttggttatgggacttcacagtaactacattggcccttacctttcttttccaggctagggaggtccgcggggcagctcctgtcgacgttctcaaagcactggactttcacaactcccccgagggcataagcaaaactacgggcttttgcactaacagaaagaatagtaaaggttccgacaccgcctaccgagtctccaaacaggcacaactcagtgcacctacaaaacagctcttccctggcggcacttttcctgaagatttttccattttgttcaccgttaagcccaaaaaggggatccagtcttttctgttgagcatctacaatgaacacggaatccagcaaatcggcgtggaggttgggagatcgcccgtattcttattcgaggatcatacaggcaaacccgcccccgaggattaccctctgttccgcaccgtgaacatcgccgatgggaaatggcacagagttgctattagcgttgagaaaaagactgtaaccatgattgtggattgcaagaagaaaaccaccaaacccttagataggtccgaacgagctattgtcgacactaacggaattactgttttcggcactaggatcctggacgaagaagtgtttgagggagatatacagcaatttctgatcaccggagatcctaaggcggcatacgattattgtgaacactactcacctgactgcgactcttctgcccccaaagccgcccaggctcaagagccacagattgacgagtatgcacctgaagatattatcgagtatgactatgaatatggtgaagccgagtataaagaagcggaaagcgtaaccgaaggtcctactgtgactgaagaaaccatcgcccagaccgaaataaatggacacggagcctatggggaaaaaggccagaagggcgagccagcagtggtggaaccggggatgctggtggaggggccgcctggaccggcagggcccgctggcatcatggggcctcccgggctccaaggccccactggaccccctggcgacccaggtgacagaggccccccagggagacccggactcccgggagccgatggccttccaggcccccccggaaccatgctgatgttaccgttccggtacggaggtgacggatcaaaggggccaacgatcagtgcgcaggaagcccaagctcaggcaattttgcaacaggcacggatcgctttacgtggacccccgggacctatgggcctgactggtaggccagggcctgttggcggtcccggcagttctggcgccaaaggtgaaagtggcgaccctggaccccagggacctcgtggcgtgcaagggcccccagggccaaccggaaaacctgggaagagggggcgtccgggcgcagatggaggcagaggcatgcctggggagcctggagcaaagggggataggggcttcgacggcctcccagggctgcccggcgataaaggtcacagaggcgagcggggaccgcagggacctccggggccacctggagatgatggcatgagaggtgaagatggggagattggtcctaggggactaccaggagaagcgggtcctagaggcctgctagggcctaggggtacccccggcgctccgggtcagcctggaatggccggtgtggatgggccaccaggtccaaaaggcaacatgggacctcaaggcgagcccgggccccctggccaacaaggtaatcccggcccccaagggcttccaggacctcagggaccaataggccccccgggggagaagggccctcaggggaagccgggcctggccggcctgcccggagcagacggcccacccggccatcctggtaaagagggacagagtggcgagaaaggcgcactgggacctccaggccctcagggcccaattgggtaccccggccctaggggcgtgaaaggtgcagacggcgtgcgagggctgaaaggatcgaaaggcgagaaaggagaagacggctttccgggcttcaagggggatatggggctaaagggggaccggggagaggtgggacagatcggccctcggggagaagacggcccggaaggtccaaagggccgcgccgggcctaccggtgaccctggaccctcagggcaggcgggagagaaggggaaactaggtgttcccggactgccaggatatcctggccgtcaaggtcccaaaggtagcaccggctttccgggattccccggagctaacggagagaagggagcacgcggagtggccggcaaacctggcccccgtgggcagcggggacccacaggaccccgagggagccgcggggctcggggtcctaccggaaaaccagggcccaaaggtacatccgggggggacggacctcctggccctcctggtgaaagaggccctcaagggccccagggaccagtgggattccctggcccgaagggaccccctggccccccggggaaggacggcctgcctggacatcctggacaaagaggcgagaccggatttcaaggtaagaccggcccacccggccctggaggcgtggtcgggccccagggcccaaccggagagactggacctatcggggagaggggacatccgggccctcctggcccacctggtgaacaggggttacccggcgccgccgggaaggagggggccaagggggatcctggaccacaggggatttcggggaaagatggaccagccggactccggggctttcctggagagagaggactgcctggcgcccagggagcccccgggctaaagggcggagagggtccccaggggccacccggtcccgtgggatcaccaggggagagagggagcgcgggaactgccggccccatcggtctgcctgggcgtccaggcccccagggccctccggggcctgccggggaaaagggcgcccccggggagaaggggccccaggggcccgctggacgagacggggtgcaagggcctgtgggtctccctggccccgcaggtccagcaggaagccccggagaagatggagacaaaggtgagattggcgagcctggtcaaaagggatctaagggtgacaaaggcgaaaacggcccgccagggccaccaggactgcagggcccagtgggtgctccaggaatcgccggaggcgacggagagccaggaccgaggggacagcagggcatgttcggccaaaaaggggatgaaggagctcggggattcccaggccctcccggaccaataggcctgcaggggctgcccggccctcctggtgagaagggagagaacggagacgtcggccctatgggccctccaggcccccctgggcctcgcggccctcaaggccccaacggtgctgatggaccgcagggacccccgggtagcgtgggaagcgtcggcggagtgggagaaaaaggagaaccaggtgaggccgggaatcccggaccgccaggcgaggccggagtcggaggacccaagggcgaacgaggagaaaaaggtgaagccgggccaccaggcgcagccgggcccccgggtgcaaagggaccccctggcgacgacggcccaaaaggaaatccagggccagttgggtttccaggggacccaggccctccaggagaaccaggaccggcaggtcaggacggtgtgggtggggataaaggcgaggacggcgacccaggccagcccgggccccccggccccagtggagaggctggacccccaggccctccaggcaaaagaggtcccccaggcgctgccggagctgagggccgccagggtgagaagggagctaagggggaggccggggctgagggccctccaggtaaaactgggccagtcgggccacagggtccagccggtaagccaggccccgaaggtttacgcggcatcccagggccagtgggcgagcaagggctgcccggagctgctggccaggacggaccccccgggccaatggggccgcctggtcttccaggcttaaagggagatcctggaagcaaaggcgagaaggggcaccccggacttattggactcatcgggccccccggtgagcagggagaaaagggtgataggggcctacctggaactcaaggatccccgggagccaagggcgatgggggtatcccaggaccagctggacctctcggcccccccggcccaccaggccttccaggcccccagggacctaaaggcaataaagggtctaccgggcccgcgggacagaagggggactcagggttgccggggccacctggctctcctggaccacctggagaggttattcaacctctgccaattttgtccagtaaaaagacaagacgccacacagaagggatgcaggcagacgcggacgataatatcctggattattccgacgggatggaggaaatctttggaagcctaaacagtcttaagcaggatatcgagcacatgaagttccccatgggaacacagactaaccccgctagaacatgcaaggatctccagctttcacacccagacttccctgacggcgagtattggattgaccccaatcagggctgttccggggacagtttcaaggtgtactgcaatttcacctcaggcggagaaacgtgtatctatcccgacaagaagagtgagggagttcggatttccagctggcccaaagagaagcccggtagttggttcagcgagtttaagcggggaaagctattgtcttacttggacgtggaagggaattctattaacatggtgcaaatgacttttctgaaactcttgactgccagtgcacgccaaaattttacttaccactgtcatcagagtgcagcctggtatgacgtgtcgagtggtagctatgataaggcactacggtttttaggttctaatgatgaagagatgtcttacgacaataacccattcataaagactctctacgacgggtgtgctagtcgtaaggggtatgagaaaactgttatcgaaattaacaccccaaagatcgaccaggtgcccatagtggatgtgatgatcaacgattttggagaccaaaatcaaaaatttggatttgaggtgggtcctgtctgctttctgggctag

SEQ ID NO: 14638 - DNA, 4560 bp, Artificial Sequence
  Description of Artificial Sequence: Synthetic coding sequence
atggccccttatccgtgcggctgtcatatcttattactgctgttttgctgtcttgcggccgctcgggccaacctgttaaatctgaattggctctggttcaataatgaggacacaagtcacgcagctacgacaatccccgaaccgcagggcccccttcctgttcaacccacagcagacacaactacccatgtgactccacggaatggctcaacagaacctgccactgcgccagggagccccgaacctccaagtgagctactggaagatggccaggacacaccgacgtctgcagagtcgcctgatgcgcccgaggaaaatatagccggcgttggcgccgaaatcctgaacgtggcgaagggcattaggtcctttgtgcaattgtggaacgacacagtcccaactgagtctctcgctagagccgaaaccctggtgctcgagacacccgtcggccccctggccctcgctggcccttcctctacccctcaagaaaacggtacaaccttgtggccaagccgcggcattccctctagccccggggcccataccactgaagctggtacactgcctgctcccactccttctccaccctccctgggtcgtccttgggctccactcacaggaccctccgtgcctccacctagttctgagcggatttcagaggaggttggactactgcagctgcttggggacccaccacctcagcaggttactcagactgatgatccggatgtaggcctggcgtacgttttcggaccagacgccaactctgggcaggtcgcaaggtaccattttcccagtctcttcttcagagattttagcctgttattccacatcagacccgcgactgaaggtccaggtgttctgttcgccattactgattcagcccaggctatggtgctcctcggcgtgaagctgagtggagtccaggacgggcaccaggacatttcattgctatataccgagcctggcgcgggacaaactcacaccgcagccagctttaggttaccggcatttgtcggtcagtggactcatttagcactcagcgtagcgggaggattcgtcgccctgtatgtggactgcgaggagttccaaagaatgccattggcgaggagctcccggggcctcgagctggagcccggggctgggctatttgtcgctcaggccggcggcgcggatccagacaaattccagggggtgattgccgaattgaaggtccgtagagacccccaggtgagtcctatgcactgtttagacgaggaaggcgatgactcagacggcgcctccggagactccggctccgggctgggggatgcccgggaactcctacgcgaagaaactggcgctgcgctaaaaccaaggctgccagcaccgccaccagtgacgacaccaccacttgcaggcgggagcagcaccgaggatagtagatcagaggaggtggaggagcagacaacagtcgcaagcttaggggcacaaaccctgcctggttcagattctgtgtccacttgggacggcagcgtgaggaccccgggaggaagggtcaaggaagggggactcaagggacaaaagggagaacctggtgttcccggcccccccggtcgagcggggccccccggaagtccttgcctgccgggacctcccgggctgccctgccccgtgagccctctggggccagccggtcctgctcttcagaccgtgcctggcccccagggaccccccggtcctcccggaagggacggtacacccggcagagatggtgagcctggggaccccggagaagacggcaaacccggggacactggcccacaagggtttccagggactccaggcgatgtagggcccaaaggggataagggtgatcccggggtgggtgaacgcgggcctccagggcctcagggaccaccaggtcccccaggccccagcttccggcatgataaactcactttcatcgatatggagggatcaggatttggcggcgaccttgaggccctgcggggaccaaggggattccccggccccccaggcccccctggcgtgcctgggttgcccggcgaacctggacgatttggagttaactcctctgacgtgccgggacccgctgggctgcccggagttcctggtcgggaaggccctcccggctttcccggactgcctggccctcctggacctcctggccgagagggcccgccagggcgcacaggccaaaaagggtctctaggggaagctggtgccccagggcacaaagggtccaagggagcccccggccccgctggggcgagaggggagagtgggctggctggggcccccgggcccgctggccctcctggaccacctggacctcccgggccccccgggcctggactgccagccggatttgatgacatggaaggctcgggagggcctttctggtctaccgcacggagcgcagatgggcctcaggggccccccgggttacccggccttaagggcgatccaggggtcccaggtttaccaggcgccaaaggggaggtcggcgctgatggggtgccgggtttccctggattgcctgggagggaaggtatcgctggacctcagggacctaaaggagatagggggagccgtggggagaaaggtgatcccggaaaagatggcgtggggcagccaggcttgccgggccctcctggcccacctggacccgttgtatacgtcagcgagcaggatggaagcgtcctatcagtacccggccctgaaggccgaccggggttcgctggcttcccaggtccggctggaccgaagggcaatctgggatcaaagggagaaaggggttcaccagggcctaaaggcgagaagggggaaccaggcagcatttttagccctgatgggggagctttaggccccgctcagaagggtgcgaagggtgaacccggattccgaggtcccccaggcccatatggcagacccggatataagggtgagataggcttcccagggcgcccaggccgtccagggatgaatggtttgaaaggagaaaaaggagaacctggggacgccagcttaggtttcggaatgcgggggatgcctggtccacccggcccaccaggtcctccaggacctcccggcacgccagtctatgatagtaacgtcttcgctgaaagcagccgtcccggcccccccggactcccggggaaccagggaccccctgggcccaagggtgccaaaggagaggtcgggcccccagggccgccaggacagttcccctttgatttcttacagctggaagccgagatgaagggggagaaaggcgatagaggagacgccggacaaaagggcgaacggggcgaacccggaggagggggttttttcggttccagcctcccagggccgccggggcctcccgggccccctggacccagaggctacccaggaattcctggcccaaaaggagaatccatcaggggtcaacctgggccccccgggcctcaggggcctccaggaattggctatgagggaaggcaaggtccacctgggcctcctggacctccaggacccccgtcattcccaggcccgcataggcaaactatctcagtacctggcccccctggtcctccagggccgcccgggcctcccggaacaatgggtgcatcctcaggggtgagattgtgggccacgcgtcaagcaatgctgggtcaggttcatgaggtacccgaaggttggctgatcttcgttgccgaacaggaagagctgtacgtgcgagttcaaaacggcttcagaaaggttcaacttgaggcccgcacacccctgccaagaggcacagataatgaggtggcagcgctacagccacccgttgtccaactgcacgactctaacccttaccctcgacgcgagcatccgcaccctacagctagaccgtggcgagctgatgatatcctggcctcgccacctcgactcccggaacctcagccctaccccggcgctccccatcattcctcctacgtgcatctgcggcccgcccggcctacctcgccaccagcacactcccaccgtgatttccagccggtgctccatttagtcgctctcaactcccccctgagcggtggtatgaggggcattcgtggcgcagatttccagtgcttccagcaggcacgcgcagtaggcctcgcgggaacatttagggctttcctgagctccaggctccaagacttgtactcgatcgtacggagagccgatagagctgccgtgcccattgtcaatctgaaggacgagctgttgttccccagctgggaggcgctgttctctggatcagaaggccctttgaaacccggtgcacggatcttttcatttgacggcaaggacgtgctccgccatccgacatggccacaaaagtctgtctggcatggttctgatcccaacggccgccggttgacagaatcgtactgtgagacatggcgcacagaggccccctccgcaacagggcaggcctcctcccttcttggtggccgtctgcttggccagtctgcagctagttgccaccacgcctacatcgtgttgtgcattgaaaattcgtttatgacagcctcaaaatag

SEQ ID NO: 14639 - DNA, 5265 bp, Artificial Sequence
  Description of Artificial Sequence: Synthetic coding sequence
atggcaccttacccctgtgggtgccacatcttgctcctgctgttttgctgcctggctgctgccagggccaatctcctcaacctgaattggctttggtttaacaatgaagacacctcccacgctgcgacaacgatccccgaacctcaggggccacttccagtgcaacccacagcagacaccactactcacgtaacacccagaaatggatctacggagccagcgacagcccccggatcgccggagccgcctagcgagctcctggaagatgggcaggatacccccactagcgcagagagccccgatgcccccgaggagaatatagctggagtgggagctgagatattgaatgtggcaaaaggtatcagaagcttcgttcaactgtggaatgatacagtacccactgagtcactggcccgggctgagacattagtactcgaaacacctgtgggaccactcgctctggctggacctagttccaccccacaggaaaatgggaccacattatggccaagtcggggaatcccatccagcccaggagctcacaccacggaggccggaacattacccgcacctactccctctcccccgtctctcggccggccctgggctccactgaccggtccgagcgtgccacccccttcgtctgggagagccagcctgagcagtctcctaggaggcgcacccccctggggctcactccaagatcctgacagccagggtctctctccagccgcagcagccccaagccagcaactgcagcgcccggatgtgagacttcgtacccctctcctgcaccctctggtgatgggctcattaggcaaacatgctgcgccatctgccttctcttccggactgcctggagcactcagtcaggttgctgtaactaccttgaccagagatagtggggcatgggtgagccatgtagccaatagcgtgggcccaggcctggccaataactccgctcttttaggcgctgaccccgaagctcccgccggcagatgcctgcctttgccccctagcctaccggtttgcggtcaccttggcatctcacggttttggcttccaaatcaccttcaccacgagtctggcgaacaagtgcgtgctggcgcgcgggcatggggcggactgctgcagacacactgccacccgttcctcgcttggtttttttgtctgctgctggtacccccctgcggatctgtgccgccgccagcccctccaccctgctgccaattttgtgaggctttacaagatgcttgttggagccggcttggtggcgggcgcctgcccgtggcatgtgcatccctgcctactcaagaggacggctattgtgtgctaatagggcctgcggccgagcgaatttccgaagaagtgggactgcttcagttgcttggggatccaccacctcagcaggtcacccagaccgacgaccctgatgtaggcctagcctatgtgtttggacctgacgcgaattccgggcaggtggcccggtaccattttccctctctcttctttagggacttctcactgcttttccacataagaccggccactgagggtcctggagtactctttgccatcacagacagtgcccaggcaatggtgctactgggcgtcaagttaagtggagtgcaggatggtcaccaagatatttctcttctgtacaccgagcccggagctggccagactcatactgcagccagttttaggttaccggcattcgtaggacagtggactcatctcgccctgtccgtggcggggggcttcgtagcactttatgtcgattgtgaggagtttcaaagaatgccacttgcacggtcttccagggggctggaattagagcccggcgccgggctcttcgtggctcaggccggaggcgcagatcccgataaattccaaggagtcatcgctgagctgaaagtacgccgagatccgcaggtcagcccaatgcactgcttggacgaggagggcgacgacagcgatggcgctagtggggattctgggtcagggctgggagacgcacgggagttacttcgcgaagagaccggggctgctctcaagccaaggctgccagcccccccgccggtcactacacctccactggcagggggctcgagtacagaagattcaaggtcggaggaagtcgaggagcagaccacggttgctagcctgggtgcacagaccctccccgggtcagattctgtcagcacgtgggatggttccgtgcgcacgccaggcggcagagtcaaggagggtggactgaaggggcagaagggtgagcctggggtgcccgggcctcctggaagagctggtccaccaggctcaccctgcctccccggtccccccgggttgccctgccccgtcagtccactgggacccgcagggccagcccttcagaccgtgcccggcccccaagggcctcctggacctcccggtcgcgatgggacacctggcagggatggggaaccaggtgatcccggtgaagacggaaagccgggcgacacagggcctcaaggctttccggggacccctggagacgtggggcctaaaggagacaagggggatccaggggtaggagagcgcggcccaccagggccccaggggccacccgggcctcccgggcccagtttccggcacgacaaactgacatttatcgatatggagggcagtggtttcggaggtgacctggaagcacttcgcggaccacgagggttcccaggccctcccggccccccaggggtgccaggtctgcccggtgagcctggtagattcggggtcaacagctctgacgtgcccggccccgcgggactgcctggtgttcctggtcgcgagggcccaccagggttcccaggacttcctggtccccccggcccccccggccgcgaaggccctccgggacggaccggccagaagggcagcctgggggaagccggcgcccctggccataaagggtccaaaggcgctccgggccccgccggtgcacgcggtgaatccgggctcgccggggccccaggtcctgccgggccgcctggaccacccggtcctcccgggccacctggtcccggactgcccgctggcttcgatgatatggagggcagcggcggacctttctggtccacagctcgctcagcagacggtccgcaaggaccaccagggctccctggcttaaagggtgatcccggagtccctggactgcctggggcaaagggcgaggtgggtgcagacggggtgccagggttccctgggcttccagggcgtgaagggatagccggaccccaagggccaaagggcgatcggggctccaggggggagaaaggggaccctggaaaggatggcgtgggtcagccaggcttaccaggacctccgggaccaccaggacccgtcgtatatgtcagcgaacaggacggaagtgttctgagcgtgccaggacccgaggggaggcctgggttcgccggctttccgggtccagcgggcccaaaaggaaatctgggttctaaaggagagcggggatcaccaggaccgaaaggagaaaagggagagccgggctctattttcagcccagatgggggggccctcggacccgctcaaaagggtgctaagggcgaaccagggttccgggggcctcctggaccatacgggagacccggatacaaaggggagattgggtttccggggaggcccggtaggcctggcatgaatggcctcaaaggcgaaaagggggaaccaggagatgcctccctcgggttcggtatgcgtggtatgcctggtccccctggtccgcctggtccgcccggtccccccggaacacccgtctatgatagcaacgtcttcgccgagtcatcccgtccaggaccaccaggccttccaggcaaccagggcccacccggtccaaaaggcgccaagggtgaggtcggccccccggggccgccgggtcaattccctttcgacttcctgcagcttgaggccgaaatgaagggtgaaaaaggggatcggggtgacgcaggccagaagggggagcgcggcgagccaggcggaggcggctttttcggttcttctcttcccgggccccctggcccaccaggtccaccgggccctaggggctatccagggattccaggacctaagggggagtctataagaggtcagccaggaccacccggccctcaggggcccccagggatcgggtacgaaggaaggcaaggaccccccggacctcccggccccccgggacctccctctttccctggtccacacagacagacaattagtgttcccggtcccccaggcccccccgggccacccggccctcccggcacaatgggtgcctctagcggagtgcgcctatgggcaaccagacaggcaatgttaggtcaggtccatgaggttccggaggggtggttgatttttgttgcagaacaggaggagctgtatgtcagggtgcagaacggctttcgcaaagtgcagctggaggcccggacgcctcttcctcgtggtactgataacgaagttgcggctcttcagccacccgtcgtacagctgcatgattctaatccatatcctagacgggagcatcctcacccgacagcgagaccctggcgagctgatgacattcttgcctctcccccaaggctgcccgaaccgcagccttacccaggcgctccccatcacagctcttacgtccatctccgcccagcgagacctaccagcccgcctgctcatagccacagggatttccagcctgtcctccatctggtcgccctgaactctcctctgtccggggggatgcgaggtatcaggggagctgattttcagtgttttcaacaggcacgtgcggtggggcttgccggtacatttcgggcatttttatcttcacgcctgcaagatctgtattctatcgtgcggcgggcggatagagcagccgtccccatcgtgaacctgaaggacgaacttctgttcccttcctgggaggcgttattttcaggctcagaggggcctcttaagccaggcgccagaatcttctccttcgacggaaaggatgtgctccgacaccccacatggccccaaaagtctgtctggcacggctctgaccctaacgggagacgtctcacagagagttactgcgagacttggcggacggaggcacctagtgccacaggccaggcgtccagcttacttggcggccgcctgttaggtcagtctgccgcctcatgtcatcacgcctatatcgttctatgcattgaaaactcttttatgactgcctcaaagtag

SEQ ID NO: 14640 - DNA, 4020 bp, Artificial Sequence
  Description of Artificial Sequence: Synthetic coding sequence
atggcccccagatgtccatggccttggccccgtaggaggaggctcctggacgtgctagcacccctggtacttttgctcggcgtccgtgcagccagcgcagaaccagaaaggatatcggaagaggtagggcttctacagcttctgggtgacccacccccacaacaggtgacccagacagacgaccctgacgtaggacttgcttacgtgttcggcccagacgccaattccgggcaggtggcccgctatcattttcctagcctcttcttcagggacttttccctgctgttccacattcgacccgcgacggaaggccccggagtactgttcgccatcaccgacagcgctcaggcaatggtgctgttgggcgtcaagctttccggggtgcaggacggccatcaggacattagccttctgtacactgagcctggcgccggacagacgcacacagccgccagctttcggctcccggcttttgttggccagtggactcacctggctttatcggttgccggggggttcgttgctctttatgtggattgtgaggagttccagcggatgccactcgctagatcttcgcgcgggctggagctggagccaggcgccggcctttttgtagcccaagccgggggggccgatcctgacaaattccagggcgtcattgcggagctgaaagtccggcgcgacccacaggtaagtcccatgcactgtctggacgaggagggcgacgactcagatggtgccagcggcgacagtggaagtggcctcggagatgcccgagaactgctgagagaggagactggtgcagcactgaagccaaggctgccagctccacctcccgtgactaccccaccactggcgggggggtcaagcaccgaggactcacggtccgaggaggtggaagagcagacaactgtggcttcgcttggggctcagacattacctggatctgatagtgtctccacatgggatgggtctgtgagaacgcccggcgggcgcgtgaaggaaggcggtttaaagggtcagaaaggagagccaggcgttcccgggcccccaggacgcgctggaccgcccgggagcccatgtctgcccgggccacctggcctgccctgtcctgtgagtccgctgggacccgcggggcccgccctccagaccgtccccgggcctcagggtccccctggtcccccaggacgggacggcaccccaggcagggacggagaaccgggcgatcccggggaagacgggaaacctggtgatactggaccccaggggttccccggaacacccggggatgtgggtcctaagggggataaaggggatcctggggtcggtgaacggggccccccagggccgcaaggtcccccaggcccacctggcccctcgtttcgccatgacaaattgaccttcatcgacatggaagggtcgggcttcggaggcgacctggaggccttgcgtggacccaggggctttccgggcccacccgggccacccggagtcccaggtctcccgggtgagcctggtcgctttggggtcaatagttccgacgttccaggacccgccggattgccaggggttccaggaagggagggcccgccagggttccccggcctccctggaccccctgggccaccagggagggagggacctccgggaagaacgggtcagaaaggatcattgggcgaggctggcgcccccggacacaagggcagcaagggagcgcccggccccgctggggctcggggagaaagcggtttagctggcgcccccggtcctgccggcccccccggcccccccgggcctcccggacctccagggccgggactgcccgctgggtttgacgacatggagggctccggcgggccattctggtccactgctaggtccgcagacggcccacagggaccacccgggttacccggactgaagggcgatcccggagtcccaggactccctggagccaaaggtgaagtgggagccgacggagtgccaggatttccaggcctcccaggaagagagggaattgcaggccctcaggggccaaaaggggataggggctcaagaggtgaaaaaggcgaccctggcaaagatggcgtgggacagcccggccttccgggcccaccgggtccaccaggaccggtggtatatgtgtctgaacaggacggatcagtgttgtccgtacccggcccagaaggtagaccaggctttgccggctttcctggaccggccggacccaaggggaacttgggatctaagggagagcgaggatcaccaggccccaaaggagaaaaaggggagcccggctccatcttttcacctgacggtggtgcccttggcccagctcagaagggagctaagggagaacccggctttcggggaccaccaggcccttacggccggccagggtataaaggtgagatcgggttccccggcaggcctggcaggccgggcatgaacgggttaaaaggcgagaagggggaacccggtgatgcctccctgggctttgggatgcggggaatgcctggaccccccggcccgccaggacccccaggaccccccgggacaccagtgtacgactctaatgtgtttgcagagtcgtcccgtcctggtcccccaggcctgccgggtaatcaggggccccctggacccaaaggggccaaaggcgaagttggtcctcccggcccaccggggcagttcccttttgacttcctgcagctggaggccgaaatgaagggagaaaaaggggacagaggcgacgctggacagaagggagagaggggcgagccagggggcggcgggttctttggctcgtccctcccaggccccccgggccctcccggcccccctggacccaggggttaccctggcattcctggccccaaaggtgagtctatccgcggtcaaccgggccctcccggaccccagggccctccagggatcggttatgagggaaggcaggggccacctggacccccaggacctccaggccccccttcatttcccggaccgcatcgacagacaatctccgtgccaggccctcctgggccacctggacccccgggcccacccggcactatgggggcctcctctggcgtgcgcttatgggccacaagacaggcgatgcttggccaagtgcatgaggtgcctgaaggctggcttatattcgtcgcagagcaggaggagctgtatgttagagtccagaatggattccgcaaagtccaactggaagcaagaacccctctgccacgaggcacagataacgaggttgcagctttgcagcctcctgtggtccagctccatgacagcaacccatacccgagaagagagcaccctcacccaaccgcccgtccttggcgcgcggacgatatcctggcaagcccaccccggcttccggaacctcagccttatccaggggcccctcatcacagcagctacgtacatctgagacccgccagacccacttcccctcccgctcacagccaccgggactttcagcctgtgctccacctcgtggcgctcaatagtccattaagtggcggaatgcggggcatcagaggtgcggattttcaatgcttccagcaggctcgggctgtaggattggccggcacttttagggcctttctctcttccaggctgcaggatttatatagcatcgtgcgcagagccgatcgcgcggctgtaccaatcgttaatctgaaagatgaactgctgtttcccagctgggaagccctgttctcaggttccgaggggcctctgaagcctggcgcgagaatattctcatttgatggtaaagacgtgctgcgacatcccacttggccacagaaaagcgtatggcatggtagtgatcccaacggccgcagactgacagaatcttattgtgagacgtggcgaaccgaagcaccaagcgctacgggccaagcgtcatctttacttgggggacgcctcctggggcagtcagcggcaagttgccaccacgcctacatcgttctctgcatcgagaatagtttcatgaccgcctccaaatag

SEQ ID NO: 14641 - DNA, 4020 bp, Artificial Sequence
  Description of Artificial Sequence: Synthetic coding sequence
atggcaccccggtgtccctggccatggcctcggcgtcgaagactgctagacgttctggctccactggttcttctgctgggcgtgagggccgcctctgctgagcccgaaagaatcagcgaggaggtcggactgctccaattgttgggggacccccccccgcagcaggtgacccaaaccgatgatccagatgtcggcctggcgtacgtgttcggacctgatgctaacagcggacaagtggcaagatatcattttcctagtctcttctttagagatttctcgcttttgttccatataagaccagccaccgagggtcctggggtcctcttcgcaattacagatagcgctcaggcgatggtgctcctgggagtgaagctgagcggtgtccaggatggtcaccaggatattagtttgctgtacactgagccaggtgcaggtcagacacataccgccgccagtttccgcttacccgcctttgtcggccagtggactcacctagctctgagtgttgctgggggatttgtggccctctacgtcgattgtgaggagttccaaaggatgccgctcgcaagaagtagcaggggcctggagctggaacctggagcgggtctgtttgtagcccaagcaggaggtgctgacccggataagttccagggcgttattgccgaactgaaggtgcgccgcgatcctcaggttagtcccatgcactgcctagacgaggagggcgatgactctgatggtgcaagcggcgattcaggctccggactcggggacgctagagagctgttgcgtgaagaaacaggcgctgccctcaagccccggctgccggctccgcctccagttactactcctcccctcgccgggggatcgagtacagaggattcccggagtgaggaagtggaagagcagaccaccgtagccagtctgggagcccagaccctaccaggcagcgatagcgttagcacatgggatggaagcgttaggactccaggcggtagggtgaaggaaggtggactgaaaggccagaagggggaacccggagtccccggaccaccaggtagagccggaccgcccggatctccttgccttcctggccctcctgggctcccttgtccagtgtctcctctgggccccgcagggccagcactgcagaccgttcctggtccccaagggccccccggtccccctggccgggatggaactcccggcagagatggagagcccgtctcaccccatgtcccaccatctccaggagataccggaccacaaggttttcctgggacgccaggggacgtcggccctaagggcgataagggggatcccggggttggggagagggggcctcccggaccacagggtcctcctggccctcccgggccatcttttcgacatgacaaacttacttttatcgacatggagggcagtggctttgggggcgacctggaggccctacgcggtccacgaggttttccaggccctcctggtcccccaggagtcccagggcttcccggagagcctggacgtttcggtgtgaactccagtgacgtgcctgggccagcaggcctccccggcgtaccaggacgcgagggcccccccggcttccctggcctcccaggcccccccgggcctcctgggcgggagggccctcctggcaggacaggacagaaaggcagtttgcagggagccggagccccaggagttcagggcagtaaaggagctcctgggcccgcaggagcccgcggcgaatccggcctggccggcgccccgggacctgccggaccaccggggcccccagggccccccggcccaccgggtcccggacttccagcaggatttgatgacatggagggctccggagggccattttggagcacagcacgaagtgcggacggaccccaggaaccaccagctctgcacgggattggcggcgatcctggcgtgccagggctcccaggtgctaagggagaggtgggggcagacggagttcccggtttcccaggactacccgggcgggagggcattgctggcccccagggcccgaaaggtgacaggggcagccgcggagagaagggagaccccggcaaggacggcgtgggacagccgggcctgcctggacctcccggccctccagggccagtggtatacgtgagcgagcaggacgggtcagtgttgtctgtgcccgggccagagggccgacccggttttgcgggcttccccggacctgctggccccaaaggtaacctgggctccaaaggcgaacggggaagcccaggcccaaaaggcgagaagggtgagcccggtagtatcttttcacctgacggaggcgcgctgggtcctgcccaaaaaggcgcaaaaggggagcctggattcaggggacctccaggcccgtatggccgccccggctacaaaggtgagatcgggtttccaggcagacccggacggccgggaatgaacggtttgaagggagagaagggagaacctggcgacgcctctctgggcttcggtatgcgcgggatgccggggcccccgggcccgcccggtcctccgggccccccagggactccagtgtatgattcaaatgtgttcgccgaaagcagccgcccaggccctcctggactaccaggcaaccagggcccacctggccccaagggagcaaagggtgaggtgggccctccaggcccccccgggcaattcccatttgacttcctgcagcttgaggccgaaatgaagggagaaaagggagatcgtggcgacgccggtcagaagggagaaaggggtgagccagggggtgggggattcttcgggtcatcccttcccggcccccccggccctcctggaccacccggcccccgggggtaccctggcatacccggcccgaaaggggagagcatcaggggtcagcccgggcctcctggcccccagggccctcctggtatcggctacgagggacggcagggacctccgggacctcctggacctcccggtccccccagcttccctggacctcatcgacagaccatcagcgttcccggcccccccggcccacccggcccgcccggtccaccgggcacaatgggtgcgtcatcaggtgtaaggctttgggccacccgacaagcaatgctaggtcaggttcacgaggtaccagaggggtggctgatttttgtggctgagcaggaggaactgtatgtacgtgtccagaacgggtttcgtaaggttcagcttgaagcccgaacacctctgccaaggggtacagataatgaagttgctgccctccagccacccgtggtgcagctgcatgacagcaatccatacccccgccgagagcacccccaccctactgcccggccatggcgcgcggacgacatcctggccagcccaccgcgactgccggaaccgcaaccctacccaggggcaccccaccattcatcctacgtgcacctaaggccagcgaggcccacctcacctcccgcccactcacaccgcgactttcagcccgtgttacatctggttgccttgaatagtccattatctgggggcatgaggggtatccgaggcgcagacttccagtgctttcagcaagccagggccgtgggcctggctgggacatttcgggcttttctgagcagccggctgcaggatctttactccatcgtccggagagcggatcgcgccgcggtcccaattgtgaatctaaaagacgagctcctgtttcccagctgggaggctctcttcagtggctcagaggggcctctcaagcccggagctagaatcttttctttcgatggcaaggacgtgttgaggcaccccacttggccccagaagagcgtgtggcatggcagcgatcctaatggtcgccggctgaccgagtcatactgcgaaacatggcggaccgaagctccatccgcgaccggacaggcttccagccttctgggtggccgcttgctcggacaatcagctgcatcttgtcaccacgcctacatagtgctgtgcatagagaattcttttatgacggcctccaaatag

SEQ ID NO: 14642 - DNA, 5265 bp, Artificial Sequence
  Description of Artificial Sequence: Synthetic coding sequence
atggccccgtatccttgtgggtgtcatattctgcttctccttttttgctgtttagcggctgcacgagccaacctcctgaacctaaactggttgtggttcaacaacgaggatacctcccatgccgccacgaccatccccgagccgcagggccctctgccggtgcagcccacggccgacacgacaactcacgtgacgccccgaaacggttcgaccgaacccgctacagcgcccggctccccagagcctccctctgaactactggaagacggccaggataccccaacaagtgcagaatcgcctgacgctccagaagagaatatcgccggcgtcggcgctgaaatcttgaacgtggcgaaaggcatccgatcctttgtgcagctttggaacgatactgtgccgactgagagccttgcccgcgctgagaccctggtgctcgaaaccccggtcggtcctctcgctctagctggcccctcatcgacaccacaggagaatggcactacgctctggccaagtagaggcatcccatcatcaccaggcgcacatactaccgaggccgggactctgcctgcccccacacccagtccccctagtctgggccgcccctgggcccccctgaccggaccctctgtccctcccccctcatctggcagagcgagtctgagtagccttcttgggggcgcgccgccatggggatccctgcaggaccccgatagccagggtctctccccagctgccgcagcaccatcacagcagctgcagaggcctgacgttcggcttagaacgcctctcttgcacccgcttgtgatgggctctctcggaaagcacgcggcaccatctgcattcagcagcgggctgccgggtgccctgtcgcaggtggctgtaaccactttgacacgggactcaggcgcatgggtatctcacgttgcgaactccgtggggccagggcttgccaataattctgctctgttaggcgccgacccagaggcgccagctggacgttgtcttccgctgccacctagtctgcccgtgtgcggtcatctcggaatctctcgattctggctccccaaccacctgcaccacgaaagtggtgagcaggtgagggccggggcccgcgcgtggggcggtctgctgcaaactcactgccatccgttccttgcttggttcttttgtttgctgctcgtgccaccctgcggtagtgtacccccacctgctccacctccttgttgccagttctgtgaggcgctccaggacgcctgctggtccaggctaggcgggggtagactgcctgtcgcatgcgcgtcccttccaactcaggaagatggctactgcgtcctgattggccctgccgctgaacgaataagcgaagaggtgggtctgctccagctgctgggggatccaccccctcaacaggtgacacagacagatgatcccgacgtgggtctggcctacgtgtttggacctgacgcaaactctggccaggttgccaggtaccatttcccatccctcttttttagagactttagcctcctgttccacataagaccagccactgaaggtcctggtgtcctgtttgcaattacggatagcgctcaagctatggtgttgctgggagttaaactgagcggggtccaggatggacaccaggacattagccttctgtacacagagccgggcgccggccagacacatactgccgcttcattcaggctccctgccttcgttgggcaatggactcacctggccctgagcgtggcagggggctttgttgccctgtatgtggactgtgaggaattccagcggatgccactggctagatcaagccgaggactggagcttgaacctggagccggccttttcgtggcccaggccggaggcgcagaccccgacaaatttcagggtgtaattgcagaactcaaagtgagacgcgaccctcaggtttccccaatgcattgtctcgacgaagaaggagatgacagtgacggtgcttctggcgactccggttcaggcctgggcgacgctagggagctcctccgcgaggagaccggcgcggctctcaagcctcgactgccagcaccgcctcccgtgactactccacccctcgccggaggaagctcaacagaagatagccggtctgaggaggtggaagagcagacaactgtcgcttccctgggcgcccagacgcttccgggatctgacagcgtttcgacctgggatggctccgtgcggacccctggcggccgcgttaaggagggcgggctgaagggtcagaaaggggagcccggggtgcctgggccgcctggcagagcaggccccccgggatcaccctgcctacctggacccccggggctgccctgcccagtctccccactcgggccagcaggccctgcactccagacagtgcccggcccccaaggaccacctggaccacccggccgagacggcacccccggcagggacggagaaccagttagtccacacgttccgccttccccgggggacaccggcccccagggatttcccggaacacctggggatgtgggacctaaaggtgataagggcgacccaggtgtcggcgagagaggaccgccaggtccgcagggccctccggggccccccggaccatctttcagacatgataaattaacatttatcgacatggaaggtagtggtttcggcggtgacctcgaagcccttagaggaccccgtgggttccctgggccccctggacctcccggcgtgccaggcctgcccggtgaaccgggtcgcttcggagttaacagctccgacgtcccagggcctgccgggctacccggggtgcctggtagagagggaccccccggctttccgggtttgcccgggccaccgggaccgccagggcgggaggggccacctggccggacagggcaaaagggaagtctgcagggcgccggagccccgggcgtgcagggctccaaaggagcacctggtccagctggcgcgaggggggaatccggactggcaggagcccccggcccagccggaccaccaggtcctcccgggccacctggaccaccagggcccggcttaccagcaggctttgatgatatggagggttccgggggccctttctggtcaacagctaggtccgcagatgggccacagggtccaccaggcctcccaggactgaagggggaccctggcgtccccgggttacctggcgccaagggagaggtgggcgcagatggagttcccggtttcccaggacttcccggacgtgagggcattgcagggccccagggacccaaaggagacaggggaagtcggggagaaaaaggcgaccccggcaaggatggggtcgggcagccaggtctgcccggtcctccaggcccgccaggaccggttgtgtacgtatcagaacaagatggctcagtgctctcagtgcctgggccggagggccgccctggcttcgccggctttcctggccctgccggacctaagggtaatttgggtagcaaaggagagcgaggatctcccggccccaagggcgaaaaaggtgagcccggctcaatcttctccccagatggtggggccctgggtcctgcccaaaaaggcgcgaagggcgagccgggcttcagagggcctcccggaccttatggaagacctggatataagggcgagattggatttcccggccgacccggcaggcccgggatgaacggactgaaaggcgaaaagggagaaccaggagacgcgagtctgggattcgggatgcgggggatgcctggaccacccggaccccctgggcctcctggaccgccggggactcccgtctatgacagcaacgtcttcgccgaaagttcaaggcctgggccaccagggctgcccggaaatcagggccctcctggcccgaagggggctaagggggaggtgggacctcccgggccaccaggtcagtttccgttcgacttcctgcagttggaggcggaaatgaagggggagaagggggataggggcgatgctggacagaagggggagcggggcgagcctggaggcggcggatttttcggaagtagtcttcccggcccaccggggccccctggacctcctggcccaagagggtatccaggtatacctggccctaagggagaaagcatcagggggcagcccgggccaccggggccacaagggccccctgggatcgggtacgagggtcgccaaggccctcctggtccacccggcccgccgggtcctccttctttccctggaccccataggcagactatttccgtgcctggaccaccagggccacccggtcccccaggaccccctggcacaatgggggcctcttctggtgtcagattgtgggccactcgacaggccatgttaggccaggttcatgaggtgccagaaggctggttgatctttgttgcagagcaggaggagctgtatgttagggtgcaaaacggctttagaaaagttcaactggaggcgcggacacccttaccacgtggaacagacaacgaggtggcagccctgcaacccccggtagtacagcttcacgactctaatccgtatcccaggagagagcacccacacccgacagctaggccttggcgggcagacgacatcctagcttcaccaccaagactgccagaaccacaaccctatccaggagccccacaccattccagctacgttcaccttaggccggctagacctacatcccctccagcccatagccacagggattttcaaccagtgctgcacttggtcgctcttaattcccccttaagtgggggaatgcgcgggatccggggcgccgacttccagtgcttccaacaggcacgggctgtgggtttggccggcacctttagagcctttctgtcgtccagattgcaggacctgtattctatcgttcgaagagccgatcgtgctgccgtgcccattgtgaacctgaaggacgagctactgtttccctcctgggaagcgctcttttccggaagcgaaggccctctcaaacctggcgctcggatcttctctttcgacggcaaggatgtgctccgtcaccccacttggccccagaagtctgtatggcatggttcggatccgaacggccgcagactcacagagtcatattgcgaaacatggcgcactgaggcccctagtgctacgggccaggcttccagtttgcttggcggcagattactgggccagtcagccgcttcctgccatcacgcatacatcgtactgtgtatagaaaactcctttatgaccgcttccaaatag

SEQ ID NO: 14643 - DNA, 1623 bp, Artificial Sequence
  Description of Artificial Sequence: Synthetic coding sequence
atgggccctggcgagcgcgcaggtggcggcggagacgcaggaaagggaaacgcagctggtggaggcggagggggccgaagcgctacaaccgcggggtcacgggcggtgagcgccctgtgcctcttgctgtcagtcggctccgccgcggcatgcctcctactgggcgtacaggcagcagctttgcagggaagagtggctgcactcgaagaggagcgcgagctcctccggcgcgccgggccacccggggcactggatgcctgggcagagccccatctggaacgtctgctgcgggaaaagcttgacggcctggcgaaaattagaacggcgagagaagccccatccgagtgcgtgtgcccacctggtcctccaggtcgaagggggaaaccgggacggcgcggggaccccggtccccctggccagtccggccgggatggatatcccggtcccctcggactggatggtaagcccggccttccaggacccaagggcgaaaaaggcgcgccaggtgattttggccctagaggcgatcaggggcaggacggggcagcagggcctccagggccgccaggtcccccgggcgctagggggcccccaggcgatacgggcaaggacggccccagaggagcccaagggccggctggaccaaagggcgaacccggccaggacggagagatggggcctaagggtccccccgggccaaagggcgagccaggtgttcccggcaaaaagggagatgacgggacaccaagccagcccggtccccctggcccaaaaggcgagcccggctccatgggacctaggggagagaacggagtagacggtgctcccggccctaagggggaacctggacatagaggaactgacggggctgcgggacctaggggagcccccggactcaagggtgaacagggggacaccgttgttattgattatgacggcagaattctggatgctctgaaagggccccccggtccccagggcccacccggcccccccggaattccaggagccaagggcgagcttggactgccaggggctccaggaatcgacggagaaaaagggcccaaagggcaaaaaggcgatcctggtgagcctggtccagccggactgaagggcgaggccggggaaatgggcctgtcaggcctgccaggggctgatgggctgaaaggagaaaagggcgagagtgcatccgattctctgcaggagtctctcgcgcagttaattgtagagcccggaccacctgggcccccaggccccccaggtcctatggggctgcaaggaattcagggacctaagggactggatggggctaagggtgagaagggagcctccggcgagcgcggcccgagcggtctcccaggccctgtgggcccccccggcctgatcggcctccctggcaccaagggggagaagggacgtccaggagagcccggcctggacgggttccccggcccgaggggtgagaagggggaccgcagtgagcgtggagaaaaaggggaaaggggcgtccctggaagaaagggtgtgaaaggccagaaaggagagcccgggccaccgggactcgatcagccatgcccagtgggacccgatgggttaccagtcccgggctgttggcacaaatag

SEQ ID NO: 14644 - DNA, 930 bp, Artificial Sequence
  Description of Artificial Sequence: Synthetic coding sequence
atggaatcccgttccggtattcaggccggagtgcggtgtcgtgatcttggaagcctgcagcccccacctctcgccctgaagcagttcagttcactgtctttgcccagttcctgggactacaggcggcttccccctcgctgcggatttctctttgaggtttcggaaaccaccaatcctcctgccgggacaaattctagacacaccctgactgtcaaactggacggcctggccaaaattcgcaccgctagggaagctccctctgagtgcgtttgccctcctggccctcccggccgccgaggcaaacctgggaggaggggcgatcccggacccccgggcccgctagggttagacggcaaaccaggactgcctggaccgaaaggcgagaaaggcgcgcctggggatttcggaccaagaggagatcagggacaggatggagccgccggacctccagggccgcctggcccccctggtgctagaggccctccaggagacaccgggaaagacgggccaaggggcgcacaaggccccgctgggcccaagggcgaacctggccaggacggggagatgggccccaaaggcccaccgggcccaaagggagagcctggagtgcccggcaagaaaggggacgatggcaccccatcacagcccggaccccccgggcccaagggggagcctgggtcaatgggccccagaggcgaaaacggggttgacggcgcccccgggcctaaaggggagcctggccaccgcggaacggatggcgcagctggaccgcggggtgatgtccgagacccgggcctgggcagcgtgtcatcgtgttcgcagcgacttgcaagttcttccaagaagaatggcagcgaaccacccccaggctgcgccggttgtcctaggcctcaagggagagccggtcgtcatagcggggatcgcttatag

SEQ ID NO: 14645 - DNA, 1665 bp, Artificial Sequence
  Description of Artificial Sequence: Synthetic coding sequence
atgaccgctcctggagcagcgggcagatgccccccaactacgtggctgggctctttgttgctcttagtgtgcttactcgcatctagaagtataacagaggaggtctccgaatactgtagccatatgataggatccggccacctgcagagtctgcagaggttgatcgacagtcagatggaaaccagctgtcagatcaccttcgagtttgttgatcaggaacagcttaaagatcctgtctgctatctgaaaaaagcctttctcttggtacaagatatcatggaggatacgatgcggtttagggacaacacgcccaacgctattgcaattgtacaactgcaggaactgagcttaagactcaagagctgcttcacaaaggactatgaggagcacgacaaggcttgcgtcaggactttctacgagacccccttgcagttattggagaaggtgaagaacgtgttcaacgaaacaaaaaacctgctggataaggattggaacatcttcagcaagaactgcaataacagttttgccgaatgtagctctcaggacgtcgtcaccaaaccggactgcaactgcctctaccccaaagcaatcccttcttctgaccctgcatcagtaagcccgcaccagcctcttgcaccttccatggctcctgtcgcgggtctgacatgggaggacagcgaaggcactgaaggcagtagcttacttccgggagagcaacctctccatactgtggatcctggatccgccaagcaaagaccacctagatcaacttgtcagagctttgaacctcccgagacaccagtggtgaaagactctactataggtgggtccccccaaccgcgcccctctgtgggcgcctttaatcctggtatggaagatatcctggactctgcaatgggtacaaattgggttcccgaggaagcttctggcgaggcctccgagattccagttcctcaaggcactgagctgagtccaagccgacccggagggggcagtatgcaaaccgagcccgcccgtcctagtaatttcctgtcagcctcttctccattgccagccagtgccaagggacagcagccagccgatgtcaccggaactgccctgccgagggttgggccagtgagacctaccggccaagattggaatcacaccccccaaaagactgaccacccctcggccctcctccgggacccccccgagcccggatccccccgtatctcttcgttgaggcctcaaggcctctccaacccaagcactctctctgctcaaccacaattaagcagatcccatagctcagggtccgtgcttccactgggagaactcgagggtaggaggtctaccagggatcgacgctcacctgccgagcccgagggagggcccgcgagtgagggcgcagcccgcccgcttccccgcttcaatagtgtccccttaaccgacactggtcatgagaggcaatctgaggggtctttcagcccacaactgcaggagtctgtgtttcacctccttgttcccagcgtgattctggttttactcgcagtcggtggactgctgttctacaggtggagacggaggagccaccaggagccacaaagggccgactctcctctggagcagccagaggggagcccgctcacacaagacgaccgccaggtggaactcccagtttag

SEQ ID NO: 14646 - DNA, 1317 bp, Artificial Sequence
  Description of Artificial Sequence: Synthetic coding sequence
atgacagcacccggagcggcaggccggtgcccgccaacgacctggctgggatccctgctgctactggtatgtctcttagcatcccgatccattaccgaagaagtttctgaatattgtagtcatatgatcggctcaggccacttgcagtcgctgcagcggctcatcgactcacagatggaaacttcgtgccagatcacctttgagtttgtcgaccaggagcagctcaaagaccccgtttgttaccttaaaaaagcctttctgctagtgcaggacattatggaggataccatgcgcttcagagataacacaccaaacgctattgccattgtgcagttgcaggaattgtccttaagactgaagagctgctttacaaaggactatgaggagcacgataaggcctgcgttcgcacattttacgaaactcccctgcagctactagagaaggtgaagaacgttttcaacgagacaaaaaatttactggataaagactggaacatctttagcaaaaattgtaataactccttcgccgagtgctcatcccaggatgtagtgaccaagccagactgcaattgcctgtaccccaaggcaatcccttcctccgaccccgcctcagtatctccccaccaacccctagccccatcaatggctccagtggctggtcttacctgggaggattcagagggcaccgagggtagcagcctcctgcctggggagcagcccttacatactgtagatcctgggtctgccaagcagaggccaccgagatctacgtgccagagcttcgaacctcccgaaacaccagtggtgaaagattctacaatcggtgggtcaccccagccgcgcccttcagttggagccttcaacccgggcatggaagatattcttgatagcgcaatgggcacaaactgggttccggaggaagcttcaggagaagcctctgaaattcccgtacctcaaggcaccgagctcagcccgtcacggcccgggggaggcagcatgcaaacggaacccgcacgaccaagcaatttcttaagcgcctctagccccctccccgcctctgcaaaaggccaacagcctgcagacgtcacgggccacgaaaggcagtccgaggggtcattttctccccaactgcaggagtcggtcttccatctcctcgtgccctccgtcatcctcgtgctactcgctgtgggcgggttgctgttttaccggtggcggagaagatctcaccaggagccccagcgcgccgacagcccactggagcaacccgagggctcccccttaacacaggacgaccgtcaagtggaactacctgtgtag

SEQ ID NO: 14647 - DNA, 360 bp, Artificial Sequence
  Description of Artificial Sequence: Synthetic coding sequence
atgacagcgccgggcgccgcaggcaggtgtcccccaaccacctggctggggagcctgctcctgctggtgtgtctcctggcttccaggagcattacagaggaggtctcagaatactgttcacatatgatcggatctggacatctgcagtcactgcagcgtctgattgacagccaaatggagacttcctgccagattaccttcgagttcgttgatcaggaacagctgaaagaccctgtatgttatttgaagaaagctttcctactcgtgcaagatatcatggaagacaccatgcgcttccgggacaacacccctaacgcgattgccattgtgcagctgcaggaactgtcgctgcggttgtag

SEQ ID NO: 14648 - DNA, 1317 bp, Artificial Sequence
  Description of Artificial Sequence: Synthetic coding sequence
atgactgccccaggcgcagcgggtaggtgcccccccacgacttggctaggatcattgctgctgctggtgtgccttctggcatcgcgttctatcaccgaggaagtgtctgagtattgttctcacatgattggttctggccatttacagtcgctccagcggttgatcgatagtcagatggagaccagctgtcaaatcacttttgagtttgtcgaccaggaacagctgaaagaccctgtctgctacctcaagaaggctttcctcctggtacaagatatcatggaagatactatgcggttccgcgacaataccccaaatgctatcgcaattgtgcaattgcaagaactgtccctgcgcctcaagagttgttttacaaaagattatgaggaacatgataaagcatgcgtgagaaccttctatgagactccattgcagttacttgagaaagttaagaacgtgtttaacgagacaaagaacctgctagacaaggattggaacatcttttccaaaaactgcaataactcatttgcagaatgttcgagccaggatgtggtaaccaaacctgattgcaattgcctatatcctaaagccatcccttcctctgatcccgcatcagtgtctccacatcagccacttgcccctagtatggctcccgttgccggtctgacatgggaggattccgaaggcacagagggaagctcactcctcccaggcgagcaacccctgcataccgtggatccagggtcagccaaacagcggcctcctcgcagtacttgtcagagtttcgagccgcccgaaactcccgtggtaaaagatagcaccataggtggaagccctcagcccaggcccagcgtcggcgcctttaatccgggaatggaagacatccttgactccgcaatgggaacaaactgggttccagaggaggcaagcggagaagcttctgagatcccggttcctcagggaacagaattgtctccttctcggccaggtgggggctctatgcagacagaacccgctaggccctctaacttcctttcagcctcttcaccactgcccgcctctgccaaagggcagcagcccgcagacgtcactggccacgaacgacagtcagagggttcttttagcccgcagttacaggagagcgtgttccatttgttagtcccaagcgtcattttagtgctgttagctgtgggaggccttctgttttacaggtggagaagacgctcgcatcaagaaccacagagggctgactccccacttgagcaaccagaaggttcgcctcttacccaagacgatcggcaggtagagctgccggtgtag

SEQ ID NO: 14649 - DNA, 1665 bp, Artificial Sequence
  Description of Artificial Sequence: Synthetic coding sequence
atgaccgccccgggggcggcaggccgctgtcccccgactacatggctagggagtttattgcttctggtgtgcctcctcgcatcccggagcatcaccgaggaagtatcagagtattgttcccacatgatcggctcaggccatctccagtcgctgcagcggctgatcgacagtcaaatggagacatcatgtcaaatcacctttgagtttgtggatcaggagcaactgaaggatccagtgtgttacctaaagaaggcctttctattagtacaagacatcatggaagacactatgcggttccgcgacaacacaccaaacgccatcgcaatagtacaactgcaggaactgtccctgcgcctgaaaagctgtttcactaaagattacgaagagcatgacaaagcttgcgtgcgaaccttctatgagacacccctccagttgctcgaaaaagttaaaaacgtgttcaacgagactaagaacctgctcgacaaagactggaacatcttctccaaaaactgcaacaatagtttcgctgagtgctcctctcaggatgtggtaacaaagcctgattgtaactgtctctacccaaaggcgattccatcctcagaccctgcatctgtgagccctcaccagccgctggccccaagtatggccccagtggccggcttaacttgggaagactcagaaggtacagaggggtcatctctcttacccggagagcaaccactgcacaccgttgatcccggatccgccaagcagaggccacctagaagcacgtgtcaatcctttgagccacctgagactcccgtggtaaaggacagcacaataggcggttctcctcaacctcggccctccgtaggagcctttaatccaggaatggaggatatactggattcggctatggggaccaactgggttccagaagaggcctccggggaggcctccgaaatccccgttccgcaggggacagagctgtcaccgagtcgtccgggaggagggtcaatgcagaccgaacctgctcggcccagtaacttcctgagcgcctcctctccattgcccgcatctgccaagggacaacaacctgcagatgtcacaggcacagcactgcctcgggtaggaccagtgagacccacaggacaggattggaaccacaccccacagaaaaccgaccacccatctgctctgctgagagacccccctgagcccggctccccccgcatctcctcacttcgacctcaggggctatcaaatccatccacactgagtgcccagccacagttatctaggtcccatagcagtggatctgttctccctctgggtgagctagaaggcagaaggagtacacgcgacaggcgaagcccagccgagcccgaaggagggcccgccagcgagggggcagctcggcctctaccccgatttaactcggttccccttacagatactggccacgaacggcaatccgaaggatcttttagcccacagcttcaagaatccgtattccacctgctcgtaccgtctgtgattcttgtgctcttagccgtcggaggactgctattctacagatggagacggcggtctcatcaagagccacagcgggcagacagcccactggagcaaccggaggggagtccattgacacaggatgataggcaagtcgaactccccgtttag

SEQ ID NO: 14650 - DNA, 771 bp, Artificial Sequence
  Description of Artificial Sequence: Synthetic coding sequence
atgactgcacccggcgccgcgggacgctgcccacctaccacctggctgggcagtttgctcctcctggtctgcctcctagccagccggtccattaccgaggaggtgtccgagtactgcagtcacatgatagggtcagggcacttgcagtctctgcaaagactaatcgattcccagatggaaactagctgtcagatcacctttgaattcgtggatcaagaacagctgaaggatcccgtttgctaccttaagaaagctttcttgttggtgcaggacattatggaagatactatgaggttccgggacaacacccccaacgctatcgccattgtccagttacaggagctgtccttgcgcctgaagtcttgtttcaccaaagactatgaggaacatgataaagcttgtgtgcggacattttacgagacacctctgcaactcctggaaaaggttaagaatgtgtttaacgaaactaaaaatcttctcgacaaagattggaatatcttctctaaaaactgcaacaattccttcgctgagtgcagctcgcagggccacgaaaggcagtccgagggcagtttttctccccagttgcaggagagcgtctttcaccttctcgtgccaagcgtgatcctggttctgctggcagtggggggactgctcttttaccgctggagacggcgcagccaccaggagcctcaacgcgcagactcacctctcgagcagccagaagggtcccctttgacgcaggacgaccgccaagtggaactgcccgtatag

SEQ ID NO: 14651 - DNA, 828 bp, Artificial Sequence
  Description of Artificial Sequence: Synthetic coding sequence
ggaagccctggcatggccggagctctttgcgcaggacatatcgctggcctgtatggcgaccgtggcttggtgccaagcacccgaagggaggaacgcgggggaagaaagacgtggcagactggagccgctcgcccccaaggcggggccagaggggccggcgggccttggcatcccgacaggcacccacgtcccaaggaaaccaggggcaatctgggcccactggaaactcctgctcgttgggctacacagggcccagccgcaccaagcgaacccattccagggatcaaggggactaagggcagccccgggaatattaaagaccagcctaggccagcgttctcagcgatcagaagaaatccaaatgggggacaaagagggcacagcacaagatctagcccaactcgaaagaacaggacccgcaccactcctgctgattcaagtgcattgtaccctgctacaacgacatctccatctaggtgctgccccagcggaaagtctgcatgcccctcgtctcccccccagggcgcacgatcggacgccccatgggcctctgttacccccccgacaagaggtagctcgagatggtgtcagggcgcctggtgtttttcatgttctcgagtgaccaggtcaggactcaaaaagacccccaagcgcgtgacattcaccagggccctgcgcccaacagcatctagcgcagccagttcctctagtcacctccccgaacctgggaaagacccgcttccccatccccctctttggcttccttgctccgcttgtaaaatgggagccctgctgttgcagcttctgaaaggtggtgggtggttatag

SEQ ID NO: 14652 - DNA, 738 bp, Artificial Sequence
  Description of Artificial Sequence: Synthetic coding sequence
atggagggtccgagaggctggcttgtgctctgtgtgctggcaatctccttggcctctatggtcacggaggacctgtgcagagcacctgacggtaagaagggcgaagcaggccgccctgggaggagagggcgaccaggcttaaagggggaacagggcgaacctggggcccccggaattagaaccggcattcagggcctgaaaggcgatcagggcgagcctggccccagtggtaacccgggtaaggttggctatccgggcccctcaggtccactgggggctcggggaatccccggcattaaaggaacaaaaggaagccccgggaacattaaggatcaaccaaggccagccttctccgcaatccggcggaaccctccaatgggcggaaacgtggtcatttttgatacggttattaccaaccaggaggagccttatcagaatcacagtggacggttcgtatgtacggtgccaggctactactacttcacgttccaggtgttgtctcaatgggagatctgtctgtccattgtcagttccagccgagggcaggttaggcgaagccttgggttctgcgacactacaaacaaggggctattccaggtcgtatccggagggatggtgctccagctccagcagggggatcaagtctgggtggagaaagatcccaaaaaggggcacatttatcaaggttcggaagccgactccgtgttcagtggctttttgatcttccccagtgcgtag

SEQ ID NO: 14653 - DNA, 738 bp, Artificial Sequence
  Description of Artificial Sequence: Synthetic coding sequence
atggagggaccgcgtgggtggctcgtgctgtgcgtgctggcgatctcactggcgtccatggtcacagaggacttgtgcagggcacccgatggcaagaagggcgaagcaggacggcccgggagacgcggtcgccctggcctcaagggagagcagggagagccaggggctcccgggatccgtacaggaatacagggactgaaaggggaccagggagagccaggccctagcggaaatccaggtaaggtggggtatcccggcccaagcggtccacttggggcgcgaggaatccctggcatcaaagggacaaaaggctctcctggaaacattaaggatcaacctcggcctgctttcagcgccatccgaaggaatccacccatggggggcaacgtcgttattttcgatacggtgatcactaaccaggaggagccctaccagaatcattcggggcgcttcgtgtgcactgtaccaggctactattatttcacctttcaggtgctgagtcagtgggaaatttgcctaagcattgtgagtagctccagggggcaagtgaggcggtctctcggattctgcgacaccaccaacaaaggcttgttccaggtagtaagtggcggaatggttctgcaactacagcagggagatcaagtctgggtcgagaaggatcctaagaaaggccatatctatcagggcagcgaggctgatagtgtcttttctggttttttgattttcccttccgcatag

SEQ ID NO: 14654 - DNA, 666 bp, Artificial Sequence
  Description of Artificial Sequence: Synthetic coding sequence
atggaaggtcctcgcggatggttggtcttgtgtgtgttagcgataagtctcgccagtatggtcactgaagatctctgtagggcgccagatggaaaaaaaggtgaagccggaagaccgggcaggcgcggaagaccgggcctaaagggggagcaaggtgagcctggagcccccggcattcgtacaggcatacaggggctgaagggcgatcaaggcgagcctggacccagtggcaatcctggcaaagttggatatcctggaccttcaggcccattgggcgccagagggattcctgggattaaaggtaccaaagggtcacccgggaacattaaggaccagccacgaccagctttttctgctattcgtcgtaacccccctatgggtgggaacgtcgtgatctttgacaccgttattacaaatcaggaagagccgtaccagaaccactctggcagattcgtgtgtaccgtgccgggctattattactttacatttcaggtgttgagtcaatgggagatatgcctctcaatagtgagcagctctcgcggccaggtgcgtcgtagccttggcttttgtgataccacaaataaggggctctttcaggtcgtatcaggggggatggtgctgcaactgcagcagggagatcaggtctgggtcgagaaggacccgtag

SEQ ID NO: 14655 - DNA, 1050 bp, Artificial Sequence
  Description of Artificial Sequence: Synthetic coding sequence
atgacagcggcctccatggggcccgttagagtggccttcgttgtgctgttagcactgtgcagtaggcccgccgtgggtcagaattgtagcggtccctgccgatgtcctgacgagcctgcaccacgctgccccgcaggagtgagcctcgtgctggatgggtgcggctgctgccgggtctgcgctaaacagctgggcgagctatgcaccgaacgcgacccttgcgacccacacaaggggcttttttgccattttggttctccggccaatcggaagatcggcgtgtgcaccgccaaagatggggccccctgtatttttgggggcacggtgtaccgctctggagaatccttccagtcctcatgtaagtatcagtgtacgtgtttggatggcgcagttgggtgcatgcccttgtgctccatggatgttcgcctcccgagcccagattgtccctttcccaggcgcgtcaaactccccggcaagtgttgtgaagaatgggtctgtgatgagccaaaagatcagacagtcgtcgggcctgcactcgccgcctaccgtctggaggacacgtttggaccagatcctactatgattcgcgccaactgtctggtccagaccacagagtggtctgcatgtagcaaaacctgtggaatgggtataagtaccagagttactaacgataatgccagttgtaggctggagaagcaatctcgcctctgcatggtgcgaccatgtgaagccgacttagaagaaaacatcaagaaggggaaaaaatgtatccggactcctaagatttccaaacccattaaattcgagctgagtggctgcacatccatgaaaacgtaccgggccaagttttgtggcgtgtgcacagacggtagatgttgcactccccacaggacaacaactctgccggttgagtttaagtgccctgacggcgaagtgatgaagaagaacatgatgtttatcaagacctgtgcatgccactataactgccctggagacaacgacatatttgagagtctgtactaccgcaagatgtatggagatatggcctag

SEQ ID NO: 14656 - DNA, 2238 bp, Artificial Sequence
  Description of Artificial Sequence: Synthetic coding sequence
atggaaaggcctcccgggctgagacccggggcaggggggccttgggaaatgcgagagcgcctgggcaccggcggcttcggaaacgtatgcctataccagcatcgcgagttggatctcaaaatcgcgatcaagtcttgccgcttggagctgagcactaagaacagggagcggtggtgccatgagatacagattatgaaaaagttaaaccacgcaaatgtggtcaaggcttgcgatgtgccggaagagttgaacattctgatacatgacgtgcccttgctcgctatggaatactgttccggcggggatctgaggaagctgctgaataagcctgaaaattgctgtggtttaaaagaaagccagattctgtccctgctgagcgacataggaagcgggatacgctacctccacgagaacaaaattattcaccgggacctgaagcccgaaaatatcgttcttcaggacgtgggtggaaaaatcattcataagataatagacttaggttacgctaaagatgtggaccaggggtctttgtgcactagttttgtaggaacgttacaatacctcgcacctgagctcttcgagaacaagccctacaccgctaccgtggattactggagcttcggcacaatggttttcgaatgtatcgcgggctaccgtccgttcctccatcacctgcagcctttcacctggcacgagaaaataaagaagaaagatcccaagtgtatcttcgcatgcgaagagatgtccggggaagtgaggttctcctctcatctgccacagcccaactccctctgctctctcgtcgttgaacctatggaaaattggctgcagctgatgttaaactgggatccccaacagcgggggggccctgtggatctgacactaaaacagcccaggtgttttgtactcatggatcatatcttgaatttgaaaatagtgcacattttaaatatgacaagcgcaaaaatcattagttttcttctcccccctgacgaatctcttcactctctgcagtcgcggatcgagcgggaaaccggcatcaatacaggaagtcaggagttacttagcgaaacgggcatttccctcgatccacggaagcctgcaagccagtgcgtgctggacggtgtgaggggctgcgacagttatatggtttatctcttcgacaagtcaaaaaccgtctacgagggcccgttcgcctcgcggtcactcagcgattgtgtaaactatatcgttcaggactccaagatccaactgcccattatccagctccggaaagtatgggcagaagccgtacattatgtctcgggtctcaaagaggattactcaagacttttccagggacagagagccgcaatgctatccctgctgcggtacaacgcgaacctgacgaagatgaagaacacactcatatcggcctcgcagcagctgaaagccaaactcgagtttttccacaaatcgatccagctggatctggaacgctactccgagcagatgacttatgggatttcctcagagaaaatgctaaaggcctggaaggagatggaagagaaagccatacattacgcagaggtgggggtcatcgggtaccttgaagaccagattatgtccctccacgccgaaatcatggagctgcagaagtccccttatgggcggaggcagggagacctcatggagtcattagaacagcgcgccatcgatctgtacaagcagctcaaacataggcctagcgaccattcttactctgacagtaccgagatggtcaagattatcgtgcacacagtccaatcccaggatcgagttctgaaggaactgtttgggcatctgagtaagctgttggggtgcaaacagaagatcatagatcttctccccaaagtggaagtcgcattatctaatatcaaggaagccgacaacacagtgatgttcatgcaggggaagcgtcagaaggaaatctggcacctcttaaagattgcctgcactcagagctccgcccggtctctggtcgggtcttctctggaaggcgcagtgacccctcaaacatccgcatggcttcctccgacgtccgccgagcatgatcactccctttcctgtgtagtgactccccaggacggagaaacatccgctcagatgatcgaagagaacctgaattgtctaggtcacctgtccaccataattcacgaagccaatgaggagcaaggcaacagtatgatgaacctagattggagttggctcacagaatag

SEQ ID NO: 14657 - DNA, 1653 bp, Artificial Sequence
  Description of Artificial Sequence: Synthetic coding sequence
atgtggaaagctagtgcaggccacgcggtttctattgcccaggacgatgcaggagccgacgattgggagacggatcccgacttcgtgaacgacgtgtctgagaaggagcagcgatggggcgcgaaaaccgttcaagggtctgggcaccaagaacatataaatatccacaagctcagagagaatgtgttccaggaacatcagaccctgaaagaaaaagagctggagaccgggcccaaagcctctcatggttacggtggtaagtttggcgttgagcaggaccgcatggacaaaagtgccgtcgggcatgagtatcagagtaaactgagcaaacattgtagtcaagtggacagcgtgcgagggttcggtgggaaatttggcgtccagatggaccgcgttgatcagtcagccgtcggcttcgagtaccaggggaagacagagaaacacgcgagccaaaaagattatagttcaggattcggagggaagtatggagtccaggcagaccgagtggataagagcgccgtggggttcgactaccaggggaaaaccgagaaacatgaaagtcaacgcgattactcaaaagggttcggtggcaaatatgggatcgataaggacaaagtggacaaaagtgccgtcggcttcgagtatcagggcaagactgagaagcatgagagccagaaagactatgtgaagggatttggcggcaaatttggtgtccaaaccgacaggcaagacaagtgtgcactaggctgggaccaccaagagaagctgcaacttcacgagagccagaaggactacaagactgggtttggaggaaagttcggcgtccagtccgagcggcaggactcggccgccgtgggcttcgactacaaagaaaagttggccaaacacgaatcacagcaggattactcaaaaggcttcggaggcaagtatggcgtacagaaagaccgcatggacaagaacgcctccacctttgaagacgtcactcaagtcagctccgcttatcagaagaccgtacctgtggaggctgtgaccagcaaaacctccaatatccgcgctaatttcgaaaaccttgctaaagagaaggagcaggaagaccgaaggaaagctgaagctgagagggcccagaggatggccaaggaacgacaggagcaagaggaggctagaagaaaactggaggaacaggctcgtgctaagacgcagacaccacccgtatcccctgcaccccagcccacagaagaacgtctgccctcttcacctgtgtacgaagacgcagcctctttcaaggccgagctttcctaccgaggtcccgtgtctggaacagagcccgagccagtatattctatggaggctgccgattaccgagaagcgtcttcgcagcagggactcgcatatgcaacagaggcagtgtacgaatcagctgaagccccaggtcattatccggctgaggattccacatacgatgagtatgaaaacgaccttggcataaccgccgtggccttgtacgactatcaagctgccggggatgatgagatctccttcgatcctgacgacattattaccaacatcgagatgatcgatgacgggtggtggcgcggagtctgtaaaggtaggtatggcttgtttcccgccaactatgtcgaactgaggcaatag

SEQ ID NO: 14658 - DNA, 1542 bp, Artificial Sequence
  Description of Artificial Sequence: Synthetic coding sequence
atgtggaaagcttctgccggtcatgcagtttctattgctcaggatgatgcaggcgctgacgattgggagactgatccggactttgttaacgatgtctctgagaaggagcagcgctggggggctaaaacagtacaggggtccggacaccaggagcacattaatatccacaaacttcgggagaacgttttccaagagcaccagacgctcaaagagaaggagctggagaccggcccgaaagcctcccatgggtacggtggcaaatttggtgtggagcaggatcggatggacaagagcgctgtgggccatgagtaccaatcaaagctgtcaaagcactgctcacaggttgactcggtgcgcggcttcggcggcaaattcggcgtgcaaatggacagagtggaccagagcgccgtgggcttcgagtaccagggtaaaacagagaaacatgcgtcccagaaagactactccagcggttttggagggaaatatggcgtgcaggcagatcgggtcgataagtcggccgttggatttgactaccaaggcaagaccgaaaaacacgagagccaaagagactattccaaaggattcggaggtaaatacgggatcgacaaggataaggttgacaagtcggccgtaggcttcgaatatcagggcaagactgagaagcacgaatctcagaaagactatgttaaaggctttggggggaaattcggtgtgcaaacggatcgacaggataagtgtgccctgggatgggatcatcaggaaaaattacagttgcacgaatcacagaaggactattcaaagggattcggcggcaagtacggcgtacagaaggacagaatggacaagaatgcttccacatttgaagatgtgacccaagtgtccagtgcttaccagaagacggttccggttgaggctgtgacctccaaaactagtaacataagagccaactttgagaaccttgcgaaggagaaagagcaggaagatcggcgaaaggctgaggccgaaagggcccagaggatggccaaggaacggcaagaacaggaagaagcccgtagaaaattggaggagcaggcaagagccaagacccagacccctccagtgtctcccgcccctcagcccacagaagaaagattgccttcgtcgccagtctatgaggacgctgcctcctttaaggccgagctgtcgtaccggggcccggtgagtggcacagagcccgaaccggtttattcaatggaagccgcggactatagggaggcttcctctcagcagggtcttgcgtatgcaactgaagccgtctacgagtccgccgaggcacctggacactaccctgctgaagattctacttacgatgaatacgaaaacgatctcggcattacagccgtggccttgtatgattatcaagccgcaggggatgatgaaattagctttgaccctgacgacattattacgaatattgagatgatcgacgatgggtggtggcgaggagtgtgcaaaggccgctacggactgttcccggcgaattacgtcgaactccgccagtag

SEQ ID NO: 14659 - DNA, 1905 bp, Artificial Sequence
  Description of Artificial Sequence: Synthetic coding sequence
atgtggaaagcttctgctggtcatgccgtgagcattgctcaggacgatgcaggggccgatgattgggaaaccgaccctgacttcgttaacgatgttagtgaaaaagagcagcggtggggcgcaaaaacagttcagggaagcgggcaccaggaacatatcaacatacataagctccgtgagaatgtgttccaggaacaccaaactctcaaggaaaaggaattggagacaggccccaaagcctcccacggatatggaggcaagtttggagtagaacaagaccggatggacaagagtgccgttgggcacgaatatcaaagcaagcttagtaagcactgcagccaagtcgactcagtgcgagggttcggcgggaaatttggggtgcaaatggacagggttgatcaaagcgctgttggattcgagtatcagggaaagacggagaagcacgcttctcagaaggactatagcagcggatttggaggcaagtatggggttcaggccgatcgagtagacaaatcagccgtcggttttgactaccaaggaaaaacagagaaacatgaatcgcagcgcgattattcaaaaggatttggggggaagtatgggatcgataaggacaaggtggacaaaagcgcagtgggcttcgaatatcaaggtaagactgagaagcacgaaagtcagaaagattacgttaagggattcggcggcaaatttggcgttcagacagaccggcaggataaatgcgcgctggggtgggatcaccaggaaaaacttcaactccacgaatcacagaaagattacagcaaaggctttgggggtaaatacggcgtgcagaaggacaggatggacaagaatgcttccacatttgaggatgtgacacaggtcagctctgcctatcagaaaactgtgccagtggaagccgtgacatcgaaaacctctaacattcgcgctaatttcgaaaatctggccaaagagaaggagcaagaggatcgaagaaaagctgaggccgagcgggcacaacggatggcaaaggaaaggcaggagcaggaggaggctagaaggaagttggaggagcaggctagggcaaaaacccagaccccccccgtgtcccctgctcctcagccaaccgaggagcgtctaccgtccagccctgtgtatgaagatgccgcgtccttcaaggcagagctgagttaccgcggacccgtgagcggaactgagccagaacctgtctactcaatggaggctgcagactatcgggaggcgagttctcaacagggtctcgcctatgcgactgaggcagtgtacgagagtgccgaagccccaggacattacccggcggaggacagtacgtatgatgaatacgaaaacgatcttggtattacggcggtcgccctttacgactatcaggcggccggggacgatgagatctcattcgaccctgacgatattataaccaacatagaaatgattgacgatgggtggtggaggggagtgtgtaagggtagatttagggaactggccttttcctgcgtgcgcgttgcgctggttccaattaagtgctccagagatcttccaggccaggctagaggcctgaggtcagccttatggcgagtgggccgcaaagactgtcctcgtcggggtgccagcagccgcgtgagtcttctgggacgaagaggactgggcctgatggaggtgaacccagagctctctcaccccgagcatcgcagttgccatgtccgatgggaaatctgtctgtgtcatacagtgacggccagacgcatcaggaagcttatttccttcttaagatccagggaagctggtcccgtaccaagttgttcacaggttggtggagtcagttttcagaaagtgacctggaaatgcctagggacctgggtgccagagtgtccttag

SEQ ID NO: 14660 - DNA, 945 bp, Artificial Sequence
  Description of Artificial Sequence: Synthetic coding sequence
atggataagaacgcttctacatttgaagacgtgacacaagtgtctagcgcgtaccaaaaaacagttccagtggaggccgtgacatctaaaacaagcaatattcgggcaaactttgaaaatctcgcaaaggaaaaagaacaagaagatagacggaaagctgaggcggagcgagcacaacgcatggcaaaggagcgtcaggagcaggaggaagccaggcgaaagctcgaagagcaggcccgcgccaaaactcagacccctcctgtgtcccccgccccgcaacctacagaggagaggttgccctccagtccggtgtatgaggatgccgcaagcttcaaggccgagctgagctacagaggtcctgtgtcgggtacagagccggagcccgtgtacagcatggaagcggccgactacagagaagcgtccagtcagcaagggttagcttacgcaaccgaggcagtgtacgagtctgccgaagccccgggccactacccagctgaggatagcacctacgacgagtacgagaatgatctcggcatcacagcggttgccctgtatgattatcaggctgccggagatgacgaaatttcattcgatcccgatgacatcatcacaaacatagagatgatagatgacgggtggtggcgaggcgtctgtaaaggcagattccgagagctagcatttagttgtgtccgcgtggccttggtccccatcaagtgcagtcgagacctccctggccaggcccgggggctcaggagcgctttatggcgagtgggacgcaaagattgcccacgccgcggcgcaagtagccgggtttccctccttggcaggcgtggtctcgggctgatggaggtgaacccagaactgtctcatccagaacatcgctcatgtcacgtgcgatgggagatctgtctgtgtcacacggttactgccaggagaatccgctag

SEQ ID NO: 14661 - DNA, 1761 bp, Artificial Sequence
  Description of Artificial Sequence: Synthetic coding sequence
atgggggtcaacgcagtgcactggttcaggaagggacttcgtcttcacgacaatcctgctctgaaggaatgtatccagggggctgacaccattcgatgtgtgtacatcctagatccttggtttgccggaagttcgaacgttgggattaatcggtggcgatttctgctgcagtgcctggaggacttggatgccaacctgagaaaactgaactcgcgtctttttgtgattcgaggtcagcctgcggatgtctttcccagactctttaaagaatggaatatcaccaagctgtccatcgaatacgatagtgaacctttcggtaaagagcgcgatgccgctataaagaaactggcaaccgaggccggcgtggaggtcatcgtccggatttctcacaccctctatgatctggacaagatcattgaactgaacggggggcagcccccgctgacatacaagagatttcagacactgatctcaaagatggagccgcttgagatcccagtggaaaccatcacatccgaggtcattgagaagtgtacaacacccctcagcgatgatcatgatgagaagtacggcgtgccctccctggaagagctcggcttcgacacagatgggttgagttccgccgtatggcctgggggagagaccgaggcccttacccgactggaaagacatctagagcgcaaagcctgggtcgctaacttcgaacgtcctaggatgaatgccaatagtctcctcgccagccctaccggactctccccatatctcagatttggttgcctttcttgcagactcttctacttcaagctgaccgatctttataagaaggtgaagaagaacagctctccaccattaagcttgtacgggcagctgctgtggagagagtttttctatactgcagctacaaataatcctcggtttgataagatggaaggaaacccaatctgtgttcaaatcccttgggacaaaaatcccgaagctttagcaaagtgggcagagggccggaccggatttccgtggatagacgcgattatgacccagctgcgccaggaaggatggatccaccatctggcgcggcatgctgtcgcctgtttcctaacaaggggcgatctttggatatcctgggaggaggggatgaaagtgttcgaggaacttctgctggatgccgactggtccattaacgccggaagctggatgtggttgtcttgttcctcgttcttccagcaatttttccattgctattgtccagttggatttggcaggcggaccgacccaaacggcgactatatacggaggtatcttccagtccttcgcggattccccgcaaagtacatatacgacccctggaacgctcctgagggaatccagaaggtagctaaatgtttgattggcgtcaattacccgaagccaatggtaaatcacgccgaagcatcacggctcaatatcgaacggatgaagcagatctatcagcagttgtcaagatacaggggattgggactgttggcatctgtaccctcaaacccaaatggtaatggtgggttcatgggatacagtgcggaaaatataccaggatgtagctccagcggatcttgctcccagggttccggaattctgcactacgctcatggcgatagtcagcagacccacctactaaagcagggccgaagttctatgggaaccggccttagtgggggaaagcgtcctagccaggaagaagatacccagtccattggacctaaagtacagagacaaagcacaaactag

SEQ ID NO: 14662 - DNA, 582 bp, Artificial Sequence
  Description of Artificial Sequence: Synthetic coding sequence
atgttggaggttggttgtggctgcctggtggttccatttttcaactttttccattgctactgtcctgtcggttttggaagaagaaccgaccctaacggggattatatcagaagatatctgcctgtcctgagaggctttcccgccaagtatatctacgacccttggaatgctcccgaggggatacagaaagttgctaagtgcttgattggggttaactacccgaaacccatggtgaatcacgctgaggcctcacgcctcaacattgaacgtatgaagcagatttaccagcaacttagtcggtataggggcttagggctgttggccagtgtgccatctaaccctaatggcaatggtggattcatggggtactctgcggaaaatatccccggctgctccagtagtggcagctgctctcagggctcaggaatactgcactatgcccacggcgattctcaacaaacgcacttgctgaaacaaggccggtcatctatgggcacaggtctaagtggcggaaaaaggccaagccaggaagaagatactcaatcaattggcccgaaagtacagagacagtctaccaattag

SEQ ID NO: 14663 - DNA, 1323 bp, Artificial Sequence
  Description of Artificial Sequence: Synthetic coding sequence
atgggatcaagccacctgctgaataagggactgccacttggggttcggccacccattatgaatggcccactgcatcccagaccactggtggcccttcttgacggaagagactgcactgtggagatgcccatactgaaggatgttgcaacggttgcattttgcgacgcacagtccactcaggagattcatgaaaaggtgctgaatgaagctgttggggctctcatgtaccatactatcacattgactcgggaggatctggagaaattcaaggccctgcgaattattgtgaggatcggctccggcttcgataatatcgacattaagtcagctggcgatctgggcattgccgtatgtaacgtaccagctgctagcgtggaggaaaccgctgattcaaccctctgccacatcctgaacctataccgacgggcaacctggctacaccaggcccttagggaaggaacacgcgtgcagtctgtggaacaaatccgagaggtggcctccggcgccgctaggatacgtggtgaaaccctcggcatcatcggcctgggacgtgtgggccaggctgtcgcgctcagggctaaggcgtttgggttcaacgttttattctacgatccttatctgagcgatggggtagagagggcactggggctgcagagggtttctacacttcaagatttgctcttccatagcgactgtgtaacacttcattgtgggcttaacgaacacaatcaccatttaatcaatgactttactgtcaagcaaatgagacagggggccttcttagttaacactgccaggggtggtctggtggatgaaaaggcactggcacaggcactcaaggagggccgaatccgtggtgccgctctggacgtccatgaatctgaacccttttccttttcacaaggtccactgaaagacgctcccaatctgatctgtacgccgcacgcggcatggtactccgagcaagccagcattgagatgcgggaggaggccgctcgagaaatcagacgcgccatcactgggaggattcctgactccttgaaaaactgcgtcaataaagaccaccttactgccgccactcattgggcttccatggatcccgcagtagtgcatccagagttaaatggcgctgcctacagataccctccaggggttgtgggagttgccccaactgggatccccgcggccgtggaggggattgtaccgtccgctatgtcactgagccacggattgccacccgtcgcacaccccccacacgcaccatctcctggtcagacggtgaaaccggaggctgatcgcgatcatgcttctgatcagttatag

SEQ ID NO: 14664 - DNA, 1290 bp, Artificial Sequence
  Description of Artificial Sequence: Synthetic coding sequence
atgtctggtgtgcgaccaccgatcatgaacgggcctcttcatccacgccctcttgtcgcactgttggacggaagggactgcaccgtagagatgcccatcctgaaggatgtggcgacggttgctttttgtgacgctcagtccactcaggagatccatgaaaaggtgctcaacgaggctgtgggggccctgatgtatcatactataaccctgacccgagaagatctcgagaaatttaaggctctccggataattgtgcggattgggtccggcttcgataacattgacatcaaaagcgccggagatctggggatcgccgtgtgcaacgtccccgctgccagcgtcgaggagactgctgattctactctttgccatatactgaacttatatcgtcgcgcaacatggcttcatcaggcattgagggaaggcacccgcgtgcagagcgtggagcagattagagaggtggcctctggcgctgcgaggatccgtggtgagacactggggatcatcggcctgggaagggtggggcaggctgtcgcgttaagagccaaggccttcgggtttaatgtgctgttctacgatccctacctatccgatggcgtggaacgcgccctcggtctccagagagtgagcactctgcaggatttacttttccacagtgactgcgtaacactgcactgcggcttgaatgaacacaatcaccatctcattaatgatttcactgtaaagcagatgcggcagggtgccttcctggttaatacagcccggggtgggctggtcgatgagaaagcactggcacaggcactcaaagagggaaggattcgaggagccgctcttgacgtccacgaatccgagccattctctttctcacaaggcccattaaaggacgcccccaatttgatttgcaccccgcacgctgcatggtacagtgagcaggccagtattgagatgcgcgaggaggctgctagggaaatacggcgggcgataaccggcagaattccggacagtttgaagaattgcgtgaataaggaccacctgactgcagccacacactgggcttctatggatccagccgtggtccaccctgagttgaacggtgccgcctaccggtatcctccgggcgtagtgggtgtggcacccaccgggatccccgccgcagtcgaagggatcgtcccttcggcaatgtctttgtctcatggtctccccccagtagcccaccctccacatgccccttcaccaggacagactgtgaaaccggaggcagacagggaccacgcgtcggaccagttgtag

SEQ ID NO: 14665 - DNA, 438 bp, Artificial Sequence
  Description of Artificial Sequence: Synthetic coding sequence
atgtcaggcgttcgccctcccattatgaatggacccctgcaccccagaccattggttgctctcctcgatggcagagactgtacagtcgagatgccaatcctcaaagacgtggcaacagtcgccttttgcgatgctcagagtacccaggaaatacatgagaaggtccttaacgaagctgttggcgccttgatgtaccacactatcaccctaacgcgagaggatctggaaaaattcaaggctcttaggatcattgtccggatcggcagcgggttcgataatattgacataaagtcggctggagatcttggtatcgccgtgtgtaatgtacccgcagcgtctgtcgaggagaccgcagacagcacactttgtcatatcctcaacctgtatcggcgcgctacatggttgcaccaggcccttcgggagggcactcgcgtttag

SEQ ID NO: 14666 - DNA, 516 bp, Artificial Sequence
  Description of Artificial Sequence: Synthetic coding sequence
atgtctggagtccggcctcctattatgaacggccctctgcaccctcggcccctggtcgcactgctagatggtcgcgattgtacagtggaaatgcctatcctgaaggatgtggccaccgtggccttctgtgatgctcagtctacccaggaaatccatgaaaaagtgctgaacgaggctgtgggagcactgatgtaccataccatcacgctcacccgtgaggacctggaaaagtttaaggcactaagaattattgtgcgtattggttccggttttgataacatcgatattaagagcgcaggggatctgggcattgcggtttgtaatgtccccgctgcatcagtcgaggagacggcggattcaaccctctgtcatattctgaatttgtaccgcagagcgacttggctccaccaggcgctccgagagggaactcgagttcagagtgttgaacagatccgcgaagtggcatcaggcgcggcacgtattaggggtgagacccttggcattatcgggctctag

SEQ ID NO: 14667 - DNA, 2958 bp, Artificial Sequence
  Description of Artificial Sequence: Synthetic coding sequence
atgccagttcccagtcggcatataaacattggccgctcgcagtcctgggacgccgccggatggtatgaggggccttgggagaacgctgaaagtctgcgtcccttgggtaggcgatcttcccttacatatggaacagcagaagggacttggtttgagccaaaccatcgcccgcaggatgctgccctgccggtagccgccgagccgtatctctaccgggaggcagtgtacaactccgtagccgctcgtaaaggctctacgcctgactttaccttctacgattcaagacaggcggtcatgtccggaaggtctcccctgttgcctcgcgagtattattcagatccttccggcgccgcaagggttcctaaggaacccccattgtatagagaccccggcgtttctagacccgtcccctcttacggtgtgcttggctcccgtacgtcttgggaccccatgcaaggtagatcccctgcattgcaggatgcaggccatctctatcgtgatccaggtggaaaaatgatcccacagggacggcaaacacagtcaagggccgcctctcccggtcgctatggtcgcgagcagcccgacacccggtatggcgccgaagtacctgcatatcctctatctcaggttttcagtgacatctcagaaagacccattgatccggccccagcacgccaggtagcccccacatgtctcgtggtggacccttcttctgccgcagctccggagggaagcacaggggtggctccgggggccctcaacaggggatacggtcctgctcgggaatcaatccctagcaagatggcctatgagacatatgaagctgatctgagtacattccagggcccaggaggaaaacgcacagtgctacctgaattcctggcttttctgcgtgctgaaggcctcgctgaggcaactctcggagccctgctccagcaaggctttgactctccggctgtactggccaccctggaggacgctgatatcaaaagcgtcgcccccaatttaggccaagctagagtactctccagactagccaattcttgcaggaccgagatgcaacttagaaggcaggatcggggaggtcctcttccacgggccaggtcatcatctttcagccacagaagcgaactgctgcatggcgatctcgcatctctaggtgccgccgcacccctgcagaccgcttcacctcgcgcaggcgaccctgctagacgcccaagcagtgctccttcccagcaccttctcgagaccgccgccacctacagcgctcctggcgtcggcacacacgccccacatttcccatccaactccggatatagttctcccacaccttgtgcattgaccgctcgcctttcccccacttacccgctccaggccggggtggccctaactaaccctggaccatccaatcccttgcacccaggccctaggactgcttatagcacagcctacaccgtgccgatggaactcctgaagcgcgaacggaacgtcgcagcatctccgcttccgtccccgcatggatcacctcaggttctgagaaaacccggggccccactggggccctccaccctgccccctgctagtcagtcactgcacacccctcatagtccatatcagaaagttgctaggagaaccggagctccaatcatcgtctctactatgctggcacccgagcctagcatacgaccccaaattatgaacggtcctctgcatcctaggcctctcgtggctttgcttgatggtcgcgactgtactgtcgagatgcccatactgaaagatctggcgacagtagccttctgtgacgctcagtctactcaggaaattcacgaaaaggtcttaaatgaagctgtgggcgcaatgatgtatcatacgatcacgcttacgagagaagatctggagaagtttaaagccctgagggtaatcgtgaggattgggtctggctacgacaacgtggacatcaaagcagctggagagttaggcattgcggtgtgtaacatcccctcggctgccgttgaggagacagccgatagcaccatttgtcatattttaaacctttaccgcaggaatacgtggctgtatcaggcactcagggaggggacacgggttcaatccgtcgagcagataagggaagtggcttctggagctgcaagaatacgaggagaaactctaggactcattggattcgggaggacaggacaggcggtggccgtgagagcgaaagctttcgggttctccgtgattttctacgacccatatctgcaggatggcatagagagaagcttgggcgtgcaacgcgtgtacactctgcaagacttgctctatcagtctgactgtgtgagtttgcattgcaatctaaacgaacacaaccatcatctgataaatgactttactattaagcagatgaggcaaggcgcatttctggtcaacgcagcacggggggggctggtggacgaaaaggctctagcccaggccctgaaggagggacggatcagaggagctgctttggacgtccacgagtctgaaccattctcctttgctcagggcccgctgaaagatgcacccaatttgatctgcactccacacaccgcttggtacagcgagcaggcctccctggaaatgcgtgaagctgctgctaccgagatacgtcgggcaatcactggacggattccagagtcgctccgaaattgtgtgaacaaggaattctttgtgacgagcgcaccctggtctgtaattgatcaacaagcaatccaccccgagttgaacggcgcgacctatagataccctcccggaattgtaggggtagcaccaggtggcctgccggcggccatggaaggcattatccctggcggaatccccgtcacacacaacttgccgacagttgcccacccctcccaggctccgtctccaaaccaaccaaccaagcacggcgacaatcgagagcaccctaacgaacagtag

SEQ ID NO: 14668 - DNA, 1338 bp, Artificial Sequence
  Description of Artificial Sequence: Synthetic coding sequence
atggccctcgtggacaaacacaaagtgaagaggcagagactggacagaatttgtgaaggcatccgcccacagattatgaacgggcctctgcatccacgcccgctggtcgccctgctggacggtagagattgtacagtagaaatgcccattctgaaagatctggcgacagttgccttttgcgacgctcagtctacccaggagattcatgaaaaagtgcttaacgaagctgtcggggcaatgatgtatcacacaatcaccctgaccagagaagacctggagaagttcaaagcactgcgggtaattgttagaattgggagcggttatgacaatgtggatatcaaagccgccggtgagctcgggatcgccgtgtgtaacataccctctgcggcagttgaggagactgccgatagtacaatttgtcacattctgaatctttaccggcgcaatacgtggctctaccaagcactcagggaaggcacgcgtgttcagtccgtagagcagatccgcgaggttgccagtggagcagcccgtatccgcggcgagactttagggctgataggctttgggcgcaccggccaagccgttgcagtgagggcaaaagcgttcggcttctctgttattttttatgacccgtacctccaagatggtatagaacgctccctgggcgtgcagagggtatatactctccaagatctgttgtatcaaagcgattgtgtgtcactgcactgcaatctcaatgaacacaaccatcatcttataaatgacttcactataaaacaaatgcgtcagggagctttccttgtgaacgccgcaagaggaggcctcgtggatgagaaagcactggcacaggctctgaaagaagggcggatcaggggtgccgcgttggacgttcacgaatctgagccatttagcttcgcacaaggcccacttaaggacgctcccaatttgatttgtacgccccacacagcctggtacagcgagcaggcttcactggaaatgagagaagctgccgcgaccgagatccggagagcaattaccggacgaataccagagagtctccggaactgtgttaacaaggaattttttgtcacctcagctccctggagcgtaatagaccagcaagccattcacccagagttaaatggtgcaacatatagatacccccccggaatagtaggcgtggctcccgggggtctccctgcagcaatggaaggcataattcccggtggtatccctgtcacccacaacctcccaacagtggcgcatccctcacaggcgcccagccccaaccagccgaccaagcacggtgacaatcgcgaacacccaaacgaacagtag

SEQ ID NO: 14669 - DNA, 1338 bp, Artificial Sequence
  Description of Artificial Sequence: Synthetic coding sequence
atggcgctggtggacaaacacaaagtgaaaagacaacgcctggataggatctgcgaagggatcaggcctcagatcatgaacgggcccctccacccacgccctctagtggctctgttggatgggcgtgattgtacagtggaaatgccaatcctcaaagacctcgccaccgtggccttttgtgacgctcagtccacacaggagatccatgaaaaagtgctcaacgaggccgtaggcgccatgatgtaccacaccattacgctgactcgggaggaccttgagaaatttaaggctctcagagtgatcgtgcgcataggaagtggatacgacaatgtagacatcaaagctgctggggagctggggatcgccgtgtgtaatattcccagcgccgcggtcgaagaaacagcagactctacaatctgccacatccttaacctctatcgtagaaacacttggctgtatcaggcactccgcgaagggacacgggtgcaatcagtagagcaaattcgagaggtggcaagtggtgcagccaggatcagaggtgaaactctgggcctgattggcttcgggcgcacaggccaagcagtggctgtcagggcgaaggcctttggcttttcagtgatcttttatgacccctacctccaggatggcatcgaaagaagcttgggtgtacagagagtgtataccctgcaggaccttctctatcagtctgactgtgtgagcctccactgcaacctgaatgagcataaccaccaccttattaatgactttactatcaaacagatgcgccagggtgccttcctggtgaacgccgcacgggggggcttggtggacgagaaggcacttgcacaggcactgaaagaaggccgcatccggggggcagccctggatgttcatgagtctgagcccttttccttcgcccagggccccctcaaagatgctcccaatctgatatgcactccccacactgcctggtattccgagcaggcatctctagagatgcgagaggcagccgccaccgaaatccggagagccatcacgggccggatcccggagtcccttcgtaactgcgtaaacaaggaattcttcgtgactagcgccccctggtctgtcatcgaccagcaggcaatccaccccgaactgaacggggcaacgtatcggtatccgcccggcatcgtgggcgttgccccaggcgggctgcccgctgccatggaggggattattccaggagggatccctgtcacccacaacctccctactgtcgcacatcctagtcaggccccttcaccaaatcaaccaacgaaacacggtgacaacagggagcatcctaacgagcaatag

SEQ ID NO: 14670 - DNA, 1338 bp, Artificial Sequence
  Description of Artificial Sequence: Synthetic coding sequence
atggcattggttgacaagcacaaggtgaagcgccagcggctggatcgcatttgtgaaggcattaggcctcagatcatgaacggacctctgcacccaaggcctttggtcgcacttttagatggaagggactgtaccgtggagatgcctatattgaaagatctggcaactgtggccttctgtgatgcccagagtactcaggagattcatgaaaaggtgctaaatgaggctgtaggggcaatgatgtatcacacaatcaccctgactagagaagacctggagaagttcaaggcactgcgggtgatcgtaagaataggatccggttacgataacgttgacattaaagcagcaggtgagctgggaattgctgtctgcaatatcccatcagccgccgtggaggagacagcagattcaacaatttgtcacattctcaacttgtacaggagaaacacttggctgtaccaggcactgcgcgaggggacacgggtgcaatctgttgagcagattagggaggtcgcttcaggtgccgcacgcattcgtggtgagacgctgggactgattggtttcggcaggaccgggcaggcggttgccgtgcgagctaaggccttcggatttagcgtcatcttctatgacccttacctgcaagacggtatagagcgttccctgggggtccagagagtgtataccctgcaagatcttctttatcagtccgattgcgtcagcctgcactgcaatcttaacgagcacaatcaccacctcataaatgatttcacgatcaagcaaatgaggcagggtgcttttctggtcaatgccgctaggggcggcctggtcgacgagaaagcactcgctcaagccctcaaagagggaaggattcgcggtgcagccttagatgtccacgagagcgagcccttctcattcgcacagggcccgctaaaagacgcacccaatttgatctgcactccccacactgcctggtactctgaacaagcctcactcgagatgcgagaggccgctgctactgagattagacgcgctatcaccggccgcataccggaaagtctgcgaaattgtgtgaataaagaattctttgtgacatctgctccctggagtgtcatcgatcagcaggccatccatcccgagttgaatggagctacatatcgctatcccccaggcatagtgggagtggctccagggggcctacctgctgccatggaggggattatccccggcggtatccctgtgacccacaatcttcccactgtagctcaccccagccaggccccttccccaaaccagcccacaaagcatggagataaccgcgagcatcccaatgaacagtag

SEQ ID NO: 14671 - DNA, 12 bp, Artificial Sequence
  Description of Artificial Sequence: Synthetic coding sequence
atggccctgtag

SEQ ID NO: 14672 - DNA, 1338 bp, Artificial Sequence
  Description of Artificial Sequence: Synthetic coding sequence
atggccttagtggacaagcacaaagttaaacgccagcggctggataggatctgtgaggggattagaccgcagatcatgaacggtccactccatccccgaccactggtagccctgcttgacggcagagattgtacggttgagatgcctatacttaaagacctggccaccgtggctttttgtgacgcccagtcaacccaggagattcacgagaaagtgttgaacgaagccgtcggcgctatgatgtatcatactataactctcacccgggaggacctggaaaagtttaaagcactgcgagtgatcgtgcgaatcggctcaggatacgataacgtggacatcaaagctgccggagagttgggcatcgcagtgtgtaatatcccgagcgccgcggttgaggagaccgcggactcgaccatatgtcacattctaaatctatacaggaggaacacttggctctaccaggcccttcgagaaggtacaagagtccagtctgttgagcagatcagagaggtggcgtcaggagcagcacggattaggggggaaaccctgggactgattggcttcggacgcaccggacaggcagtcgcagtgcgcgcaaaagcctttggcttttctgtgatcttttacgatccttacctgcaggatggcatcgaacggagcctcggggtacagagagtgtatacgctgcaggacctgctttaccagtccgactgcgtttcccttcattgcaatctgaacgagcacaaccatcatctcatcaacgattttacaataaagcaaatgagacagggcgccttcctcgttaacgctgcgagaggaggcctggtggatgagaaggccttggcccaagctctgaaagaaggaagaatccgtggcgcagccttggatgtgcacgagtccgagcctttcagttttgcccagggccccctcaaggatgcccctaatctgatatgcaccccccacacggcttggtattcggaacaggcttctttggagatgcgagaggccgcagcaaccgagatacgccgggctattacgggccgaatcccagagagcctgcgcaactgcgtgaataaggagttttttgtgacttctgctccttggtccgtcatcgatcagcaggcaatccatcctgaactcaacggggcgacctaccgttatcctcctggaatcgtgggcgtggcgcctggaggactccctgccgcgatggagggaattatccctgggggcattcctgttacccataatctgcccactgttgcgcacccgtctcaggctccctcaccaaatcagcccaccaagcacggcgataacagggagcaccccaatgaacagtag

SEQ ID NO: 14673 - DNA, 2331 bp, Artificial Sequence
  Description of Artificial Sequence: Synthetic coding sequence
atgtctagtactaggagccagaacccgcacgggctaaagcagatagggctggaccagatttgggacgatctccgggcgggtatccagcaggtttatacaaggcagtccatggcgaaaagccggtacatggaactgtacactcatgtctacaattattgcaccagtgtccatcagtccaaccaggctaggggtgcaggagtccctccctctaaatctaagaagggtcaaactcccggtggggcgcagtttgtcgggctggagctatacaagagacttaaggagttccttaaaaactatcttacaaatctgttaaaggatggagaagatctcatggacgagagcgtccttaagttctatacacagcagtgggaagattacagatttagctctaaggtactgaacggaatatgcgcatacctcaacagacactgggtgcggcgcgagtgcgacgagggaaggaaagggatctacgaaatctattctttagctctggttacctggagggattgtctttttcgccctctcaacaaacaggtgacaaatgccgtcctgaaactcattgagaaggagcgaaatggagaaaccattaacacccggcttatttcgggagtggtccagagctacgtggaattgggccttaacgaagatgatgcttttgcgaaagggcccaccctcacagtctacaaggagagttttgagagccaattcctcgccgatacggagcgcttttatacccgggagtccactgaattcttgcagcagaatccagtgaccgagtatatgaaaaaagctgaggctcggttgctggaggaacagcgccgggtgcaagtgtacctgcacgagtcaacccaggacgaactcgctagaaagtgcgaacaggtgctgatcgagaaacatcttgagatatttcataccgaatttcaaaacctactggacgcagacaagaatgaagacctgggtaggatgtataacctggtctctcgcatccaggacggacttggtgaactcaaaaaacttttggaaactcatatccacaatcagggacttgctgctatcgagaaatgcggcgaggcagcgctgaatgacccaaaaatgtacgtgcagaccgtgttagacgtccacaagaagtacaacgccctggttatgtctgcttttaacaacgatgcagggtttgtggctgctctggacaaagcttgtggccggtttatcaacaacaatgcggtcaccaagatggcccagtccagctctaaatcacctgaactcctggcgcgctactgtgattcccttctgaagaagagttctaaaaaccccgaagaggccgaactggaagataccctgaaccaggtcatggtcgtctttaagtacattgaggataaagatgtgtttcaaaaattttacgctaaaatgttggctaaaaggctagtacaccagaatagcgcatccgacgatgcagaagcaagcatgatctcgaaactgaagcaggcctgcgggttcgaatacacttcaaaactgcaaaggatgttccaggacattggcgtttctaaagatttgaatgagcagtttaagaaacatttgacaaactcggaaccgctggacctggatttttccattcaggtactgtctagcggctcttggccattccagcagtcctgtaccttcgcactgccttccgagttggagcgtagttatcagcggttcacagcattttatgcttccaggcacagtggtaggaaacttacctggctgtaccaacttagtaaaggcgagttagtgacaaattgtttcaagaatcgctatactttacaggcttctactttccaaatggctattctcttgcaatataatacagaggacgcttacactgtgcagcaactgacagactctactcagatcaaaatggatattctcgcacaggtactgcaaatcttgctgaagtccaagctgctggtactggaagacgaaaacgccaatgtggatgaagtcgagttgaagcctgatactctgatcaaactgtatctcggctacaagaataaaaagctgcgcgtgaatattaatgtgcctatgaaaactgagcagaaacaggagcaagagacaactcacaagaatattgaggaggacaggaagttactgattcaggcagcgatagttaggattatgaagatgcgaaaggtgcttaaacaccaacagctgctcggcgaagttctgacacaactgagctcacggttcaagcctcgggtcccagtgattaagaagtgtattgatatccttattgagaaggagtatctggagcgtgtggatggcgagaaagatacatactcgtatttggcgtag

SEQ ID NO: 14674 - DNA, 2331 bp, Artificial Sequence
  Description of Artificial Sequence: Synthetic coding sequence
atgtcaagcaccaggtctcaaaacccacacggcttaaagcaaatcggactggaccaaatttgggacgatttgcgagccggaattcagcaggtgtacaccaggcagtctatggccaagtctcggtacatggaactgtacacacatgtatataattattgcacctccgttcaccagagtaatcaggcccggggcgccggcgtccccccgagtaagagcaagaaggggcagactcctggaggggctcagtttgtgggtctggaattgtacaagcgcttgaaggagttcctcaaaaattacctaaccaatctgctgaaagacggggaggatctgatggatgagtcggtgcttaagttctacacgcagcagtgggaagattataggttctcttccaaggtattgaatgggatttgtgcctacctgaatcgccactgggtacgaagagagtgtgacgaaggccgtaagggcatttatgaaatctactccctggccttggtgacctggagagactgcctatttagacctctgaataaacaggttacgaacgccgtcctgaagttaatcgaaaaagagagaaatggcgagaccattaatactcgtctcattagtggagtggtgcaatcctatgttgaactgggtttgaacgaggacgacgcctttgctaaaggtcccacgctcacagtctataaggagagtttcgaaagccagttcctggccgacaccgagcggttttatacccgtgagagtaccgagttcctgcagcagaacccagtcacagagtatatgaagaaagctgaggccagactcctcgaggaacagcgcagagtgcaagtttaccttcacgagtccacccaggacgaactggctcgaaagtgcgagcaggtgctgatcgagaagcacttagaaatcttccacacagagtttcaaaacctcctggatgctgataagaacgaggacttggggcgtatgtacaatctggtatctcgaatccaagacggactgggggagctgaaaaagttgttagagacgcatatacacaaccagggacttgccgccattgaaaagtgcggagaggctgccctgaacgatcccaaaatgtatgtgcagacagtgctcgatgtacacaagaaatacaacgctctcgtgatgtcagcctttaacaatgatgctggctttgtggctgctctcgacaaggcctgcggccggttcattaacaacaatgcagttacaaaaatggctcagtcctccagcaagtcaccagagctgctagcacggtactgcgacagcctcctgaaaaaatcgtctaagaatcctgaggaggccgagttggaagacacgctgaatcaggtgatggtcgtcttcaaatacatcgaggataaagacgtgttccagaagttttacgcgaagatgttggcgaagagactggtgcaccagaacagcgccagcgacgacgccgaggcttccatgattagcaaactaaagcaagcttgcggattcgaatatacctcaaaattgcagcggatgttccaggatataggcgtatctaaggatctcaatgaacaatttaagaagcacctcactaatagtgaaccattagacttggactttagcatccaagtgttgtccagcggtagttggccgtttcagcagtcatgtaccttcgccctaccctccgagctcgagcgtagctatcagcgatttaccgcgttctacgcaagccggcatagcgggagaaaactcacatggctgtaccagcttagtaaaggcgaacttgtcacaaattgtttcaagaatcggtatacgttgcaggcttcgacattccagatggctatcttgctgcagtataatacagaagatgcatatactgtgcagcagttgacggatagcacccagataaaaatggatatactcgcccaggtgctgcagattctcctgaagagcaagctcctggtactggaggacgagaatgctaatgtggacgaagttgaactgaaaccagataccctaatcaaactttatcttggctataaaaataagaaacttcgcgtcaatataaacgtccccatgaaaacggagcagaaacaggagcaggagacaactcacaaaaatattgaggaagatcggaaactcctcatccaagccgctatcgtgagaatcatgaagatgcgcaaggtcctgaaacatcagcaactgctcggggaggtgttaacccaattaagctcccggtttaaacctcgggtcccagtgataaagaaatgtattgatattctcattgagaaggaatatctggagcgagtcgatggagagaaggacacctactcctaccttgcctag

SEQ ID NO: 14675 - DNA, 2112 bp, Artificial Sequence
  Description of Artificial Sequence: Synthetic coding sequence
atgtcgtccacccgttcacaaaatcctcacgggctgaagcagattggcttggaccagatctgggacgaccttcgcgccggtatccagcaagtctacacaagacaatctatggcaaaatccagatacatggagttgtacacacagcaatgggaggactatcgattctcctccaaggtactgaacggtatctgtgcctacctgaatagacactgggtgcgtagggagtgcgacgagggaagaaaaggtatttatgagatatatagcttagctctcgttacttggcgtgattgcctatttcgcccactcaataagcaggtcaccaatgccgtccttaaactgattgagaaagagcgaaacggggaaaccattaatacgcgactgatttcgggagtggtgcagagttatgtagaattaggactgaatgaagacgacgcctttgctaagggcccaaccctgaccgtgtacaaagagtcattcgagtctcagttcctggctgataccgaaaggttttatacacgcgaatccacggaattcctccagcagaaccctgttacagagtacatgaagaaagcagaggcccggctcctggaggaacaacgtcgggtgcaggtctatctgcatgagtccacgcaagacgaacttgccaggaagtgtgaacaggtactgatcgagaagcacctcgagatctttcacaccgagtttcagaatctactggacgctgataaaaacgaagacctggggcgtatgtacaacctagtgtcccgcatccaagacgggctgggtgagctgaaaaagttgctggagacacacatccataatcaggggctcgctgccatcgaaaagtgcggcgaggctgcactcaatgatccaaagatgtacgtgcagactgtgctggacgtgcacaaaaaatacaatgcactcgtaatgtccgcctttaacaatgacgccggattcgtggccgcactggacaaggcctgtggccggttcattaataacaatgctgtcacaaaaatggcccagtcctcctccaagtcccccgagctcttagctcggtactgcgattcgttattaaaaaagtcgtccaagaatcctgaagaagccgagctggaggataccttaaaccaggtgatggtagtatttaagtacatcgaggacaaagacgtgtttcagaagttctacgccaaaatgcttgcaaagcgtctggtgcatcaaaattcagcctcagacgacgctgaagcatccatgattagcaaattaaagcaggcatgtggcttcgagtatacctccaaacttcagcgcatgtttcaggatatcggagtgagtaaggaccttaatgaacaattcaagaaacatttaactaactctgagcccctggatctcgacttctccatccaggttttatcaagcggatcatggccgtttcaacaatcttgcacgttcgcactgccttccgagctggaacgatcctatcagcggtttaccgctttttatgcatcacgacactcaggtcgcaagctaacctggttgtaccagctgagtaagggcgaactggtgaccaactgctttaagaataggtacaccctccaggcctccacattccagatggccattttgctgcagtataataccgaagacgcttacacagttcaacagctcaccgacagcacccagattaagatggacatattggcacaggttctgcagattctgctgaagtcaaaactcctggtcctcgaggacgaaaatgctaatgtcgatgaagtggagttgaaaccggatacactgataaaactgtatttgggttacaagaacaaaaagctacgggtgaatatcaacgtgcctatgaagaccgaacagaaacaggagcaggagactacgcacaagaatatcgaggaggatcgcaagctgttgattcaggccgccatcgtgcgcattatgaaaatgcgaaaagtcctgaagcaccaacagttgttgggggaagtgctgacacagttgtcgtcaaggttcaagcccagagtccctgtcatcaagaagtgcatcgatatactcattgaaaaggagtatctggagagggttgacggggagaaggatacatactcatacttggcatag

SEQ ID NO: 14676 - DNA, 1824 bp, Artificial Sequence
  Description of Artificial Sequence: Synthetic coding sequence
atggagttgtacacccacgtgtataactactgcacttcagttcatcaatccaatcaagctagaggagcaggcgttcctccgagtaaaagtaagaagggccagacacccggcggcgcgcagttcgttggattagaactctataaaaggcttaaggaattcctgaaaaattacctgaccaatctgttaaaagacggggaggatcttatggacgaatccgtcctaaaattttacacgcagcagtgggaagattaccgattcagctctaaggttctgaatggtatttgtgcctacctaaatagacactgggttagaagggagtgcgatgaaggacgcaagggcatctacgagatttatagtttggctctcgtcacctggcgggattgcctctttaggccattgaataagcaggtcacaaacgcagtgctgaagctgattgagaaggaacgaaacggcgagaccatcaatacaaggttaatcagtggagtggtgcagagttatgtggagctgggactgaacgaggacgatgccttcgcaaaaggcccaacactgacggtatataaagaatctttcgaatcccaattcctggccgataccgagcggttctatacacgggagtccaccgaatttctccagcagaatcccgtcacagaatacatgaagaaagccgaggcacgactactggaggagcaaagaagagtccaggtctatctacacgagtccacacaggatgagctcgcccgaaaatgcgagcaggtgctgattgaaaagcacctggaaatctttcataccgaattccaaaacttgttggacgcagataagaacgaagatctgggacgcatgtacaatctggtttcccgcatccaagatgggctgggcgagcttaagaagttgttggagacacacattcacaatcagggcctcgccgctatcgaaaagtgcggggaggcagccctgaatgaccccaagatgtatgtgcagactgtactcgacgtgcataagaaatataacgcactcgtgatgtccgcctttaataacgatgccggattcgtggctgctttggacaaggcctgcgggcggtttatcaataataacgccgtaactaagatggcccaatcatcctctaagtcacctgaactgctggcccggtactgcgacagtttgctgaaaaaaagttccaaaaatccagaagaggccgaattggaggatactttgaaccaggtgatggtggtctttaagtacatcgaggacaaggacgtgttccaaaaattttacgccaaaatgctcgccaagcggctggtgcaccagaacagtgcgtcagatgacgcagaagcctcaatgatttccaaacttaagcaggcctgcggattcgagtatacttcaaagctccagaggatgttccaagatataggtgtttcaaaagacttgaacgagcagtttaagaaacatttaactaattccgaacccctagatctcgacttttcaattcaggtgctgtccagtgggagctggcctttccaacagtcctgcacgttcgcgctgccctcagagttagaaaggtcatatcagcgcttcacagcattttatgcatctcgacacagcggtagaaagctgacttggctctatcagctgtctaaaggggagttagtcaccaactgctttaagaaccggtacacactgcaggcatctacatttcaaatggccattctactccagtacaataccgaggatgcttatactgttcagcaactgacagactccacacagatcaagatggacattctagcccaagtgctacagattttgctgaagtccaaactactctag

SEQ ID NO: 14677 - DNA, 2121 bp, Artificial Sequence
  Description of Artificial Sequence: Synthetic coding sequence
atgagcctgaagccccgggtggtggatttcgacgagacttggaataagctgctcacaaccatcaaggcggtggttatgcttgaatatgtcgagagggccacctggaatgatcggttcagcgacatctacgccctgtgtgtggcatatccagaaccgttgggggaacggttgtatacagagactaagatctttttggagaatcacgtgagacatttgcacaaacgggtgctagagagtgaagaacaggttctggtgatgtaccacaggtactgggaggagtattctaagggggctgactatatggactgcctctacaggtacttgaacacacagtttataaagaaaaataaacttacagaggctgatctgcagtatggatacggtggcgttgatatgaacgagcctctgatggagatcggcgagctcgcacttgacatgtggcgcaaactgatggtagagcccctgcaggccattctcattcgtatgttgctgagagaaatcaagaatgatcgaggaggagaggatcccaatcaaaaagtcattcatggtgtgattaatagctttgtacatgtggagcagtacaagaagaaatttcccctgaaattttatcaagagatcttcgagtctcccttcctgaccgagacaggtgagtactacaaacaggaagctagcaacctcttgcaggagagtaattgttcccaatacatggaaaaggtgcttggaagactgaaagacgaagaaatccgatgtaggaagtacctgcatccgagtagctacactaaggttattcatgagtgtcagcaaaggatggttgccgaccatctccagtttctccacgcagaatgtcataatatcatccgccaggagaaaaagaacgatatggccaatatgtatgtactgctgcgagccgtctctaccgggctgccccatatgatccaggaactacagaaccatatccatgatgagggactaagggctacttccaatctcacccaagaaaacatgccaactctgttcgtggaatctgtgctggaggttcacggcaaatttgtacagttaataaatacagtgctgaacggagaccagcatttcatgagcgccctggataaggcattgacaagcgtggttaactatcgggagcccaagtctgtatgtaaggcgccagaactgttggcaaaatactgcgacaatttgctgaaaaaatccgctaagggcatgactgaaaatgaggtcgaagacagactgacttcattcataacggtctttaagtatatagacgataaggacgtctttcagaaattctacgcgcgtatgctcgcgaagcgattaattcacgggttaagcatgagcatggattccgaggaggccatgatcaataaacttaagcaggcttgcggttacgagtttacttcgaagttgcaccgcatgtacaccgatatgagcgtgtccgcagatcttaataataagttcaataattttatcaaaaaccaggatacagtgatcgatctcggcatcagcttccaaatctacgtgctccaggctggagcctggcccctcacccaggctccttcctccacctttgcaattcctcaggaattggagaagtccgtgcaaatgtttgaactgttctactcccagcacttcagtgggaggaaacttacatggcttcactacttatgtacaggcgaggtgaaaatgaactacctcggcaagccttatgtcgccatggtgacgacctatcagatggcggtcctgctagcatttaacaacagcgagaccgtgtcatataaggagctacaggactccacgcaaatgaatgaaaaagagctcaccaagaccatcaagtctctgctggacgttaagatgataaaccatgactctgaaaaggaggatatagacgccgagtccagcttctcactgaacatgaatttctccagcaagcgaacgaagttcaagatcaccacttctatgcagaaagacactccccaagtgattagtcagagtcgggcccggttcaaccctagcatcagcatgatcaaaaaatgcatcgaggtactcatcgacaaacaatatattgagcgcagccaagctagcgcggatgagtactcctatgtcgcgtag

SEQ ID NO: 14678 - DNA, 2121 bp, Artificial Sequence
  Description of Artificial Sequence: Synthetic coding sequence
atgtctctgaaacccagggtcgtcgattttgacgaaacatggaataagctgctgacaactatcaaggcggtggttatgctggagtacgtcgagagggcaacttggaacgacagattctccgacatctatgccctgtgcgtagcctatccagaacccttgggtgagaggctatataccgagactaaaatcttcctcgagaatcatgtcagacacctgcacaagcgcgtgttggagagcgaagagcaagtgttggtgatgtatcatagatattgggaggagtattccaagggcgccgactatatggactgcctgtacagatacttgaatactcagtttatcaagaaaaataaactgacagaagcagacctacagtacggatacgggggcgtggatatgaacgagccgctgatggagatcggagaactggccctggatatgtggcggaaactgatggtagaacctctgcaggcgattttgatacgtatgttgttacgcgagatcaagaacgatcggggtggtgaggatcccaatcagaaggtgatacacggggtcataaactctttcgtacacgtggagcagtacaaaaaaaagttccccctgaagttctatcaagaaattttcgagtcccctttcctgaccgaaacaggagaatattacaagcaggaagcttccaatctgttacaggagtctaattgttctcagtacatggaaaaggttttagggagactgaaagatgaagagattaggtgtaggaagtacctgcatccatcttcttacacaaaggtgatacatgaatgccaacagaggatggtggccgatcatctgcagtttttgcatgccgaatgtcacaatattatcaggcaggaaaagaaaaacgatatggccaatatgtacgtgctgctccgagcagtgtccacaggtctgccccacatgatacaggaactgcaaaatcacatccacgatgaaggcctgagagcgacgtccaaccttacacaggagaatatgcccacactgtttgtggagagcgtcctcgaagtgcacgggaaatttgtgcagctcattaataccgtgctgaatggggaccagcatttcatgtccgcattagataaagctttgacctccgttgtgaactatcgggagcctaagtctgtgtgtaaggcaccagagttactcgcaaagtattgcgataacctgttaaaaaagtctgctaagggtatgactgaaaatgaggtcgaagacaggcttacctctttcatcactgtattcaagtatatagatgataaggacgtgttccagaaattttatgccagaatgttggccaaacgtctcatccacggactcagcatgagtatggatagtgaagaagctatgatcaacaagctaaagcaggcctgcgggtatgagttcacgagcaagctgcacaggatgtacacggacatgagtgtcagtgctgacctgaacaataaatttaataattttattaaaaaccaggataccgtgattgacttaggaatttcctttcagatttatgtgctccaagccggggcgtggccacttacccaggcgcctagcagtactttcgcgattccccaagaacttgagaaaagtgtgcaaatgtttgaactgttctatagccagcacttcagtggccggaaacttacctggctgcactacctatgtaccggcgaggtaaagatgaattacctcggtaagccgtatgtggccatggtgactacataccagatggcagttctgctggcctttaacaactcggagacggtttcctacaaggaacttcaagactcaacacagatgaatgaaaaagaactgacaaaaaccatcaagtctcttctggatgttaaaatgatcaaccacgattcggagaaggaggacattgacgccgaatcatcattcagtctgaacatgaacttctcctctaaacgtacaaaatttaagatcaccacaagcatgcagaaggatacccctcaagtgatctcacaaagcagagcgaggttcaatccatcgatttcgatgatcaaaaagtgcattgaggtgctgatcgataaacaatacatcgagcgtagtcaggcctccgcagacgaatactcttatgtggcctag

SEQ ID NO: 14679 - DNA, 2238 bp, Artificial Sequence
  Description of Artificial Sequence: Synthetic coding sequence
atgagccttaaaccgcgggtggtcgatttcgatgaaacatggaataaactattaactactatcaaagccgttgtgatgctggagtatgtcgagcgggcgacatggaacgatcgcttttcagatatctatgccttgtgtgtagcctacccagaaccgttgggtgaacgcctgtatactgagactaagatattcctcgagaatcacgtgaggcatctgcacaagagagtcctggagagcgaagaacaggttctcgttatgtatcataggtattgggaggaatattctaagggcgcggactatatggattgtctttatcgctatctgaatactcaatttatcaaaaagaataaacttaccgaggccgacctccaatatgggtatggcggcgtggacatgaacgaaccattgatggagatcggagagctggccctggacatgtggcgaaagttgatggtggagcctctccaggccattctgatccggatgcttttgcgagagatcaagaatgatcgtggcggagaggatcccaatcagaaggtgatacatggggttattaattcgttcgtgcatgttgaacagtataaaaagaagtttccactgaaattctaccaagagatttttgaaagcccatttctgactgagaccggggaatattacaagcaagaagccagcaaccttctccaagaatctaattgcagtcagtacatggagaaggttctaggtcgcctcaaggacgaggagattaggtgtcgcaagtatctgcatccgtctagttacaccaaagttatccacgagtgccaacagcgaatggtggctgatcacctacagtttctgcacgcggagtgccacaacataatcaggcaggaaaagaagaacgatatggccaacatgtacgtccttctccgcgccgtatcaactggtctgccccatatgatccaagagctgcagaatcacatccatgacgaaggtctgcgtgcaacctcaaaccttacacaggaaaatatgccgactctcttcgtggagtccgtcctagaggtgcacggtaaattcgtacaactgattaatactgtcctgaacggtgatcaacatttcatgtccgcgcttgacaaagctctaacctcggtagtcaactatagagagccaaagtccgtttgcaaagctcccgagcttctcgcgaagtattgcgacaatttgttaaagaaatctgccaaggggatgacagaaaatgaagtggaggaccgcctgacctcattcattactgtctttaaatatatcgatgataaggacgttttccagaaattttatgcgagaatgttggcgaaacgactgattcatggcctcagcatgtcaatggacagtgaggaagctatgataaacaagctaaagcaagcgtgcggatacgagtttacaagtaagctgcaccgaatgtacactgacatgtctgtgtcggcagacctgaacaacaagttcaataatttcattaaaaatcaggacaccgtcatcgacttggggataagttttcagatctacgtgcttcaagcaggggcatggcccttgacacaagccccttctagcacatttgccattccacaggagctcgaaaagtcagtgcagatgttcgagctgttctacagccagcactttagcggtcgaaagcttacatggctccactacctgtgtactggagaggtcaaaatgaattatctgggcaaaccgtatgtggccatggtgaccacatatcaaatggccgtgttactggcatttaacaactcggaaactgtaagctataaggagttgcaggattctacacagatgaatgaaaaggagctcacgaagactatcaaaagcctgctagacgtgaagatgatcaaccacgattctgagaaggaggacattgacgccgagagctccttttcactgaatatgaacttttccagtaaacgtacaaaatttaagattacaacatccatgcagaaggacaccccgcaggagatggaacagacccggtctgccgtagatgaggatagaaagatgtacctccaggctgccatagttcgcattatgaaggctagaaaagtgctcaggcacaacgccctgattcaggaggtgatatcccagtctagagcaaggtttaacccctctatctcaatgatcaagaagtgcattgaagttctgatcgataagcagtatattgagagaagtcaggcaagcgctgacgagtactcctatgtcgcctag

SEQ ID NO: 14680 - DNA, 2238 bp, Artificial Sequence
  Description of Artificial Sequence: Synthetic coding sequence
atgagtctcaagccccgggttgtggacttcgacgaaacttggaacaaactgctaaccaccataaaggccgtggttatgctcgaatacgtggaacgggccacatggaacgaccgctttagtgacatctatgcactgtgcgtagcatatccagagccactgggcgagcggttgtacacagagacaaagattttcttggagaaccatgtgaggcatctgcataagagagtgctagaatcagaggaacaggtgctggtgatgtaccaccgatactgggaggaatacagcaagggagcagattacatggattgcttgtaccgttaccttaatactcagttcatcaaaaaaaataaattgaccgaggcggatctgcagtacggatatggcggagtcgatatgaatgagcctctgatggaaattggggaactggccttagatatgtggcgcaaactcatggtggagcctctgcaggccatcctcattcgtatgctgctgcgggagatcaaaaatgaccggggcggagaagatccgaaccaaaaggtgattcatggagtgatcaattcttttgttcacgtcgaacagtataaaaagaagtttccgctgaagttctatcaggagatttttgaatcccctttcctcacagagacaggcgagtactataaacaagaagcgtcaaacttgctacaggaatctaactgctcccagtacatggagaaggtgctgggccggctcaaggacgaggagattagatgccggaagtaccttcatccttcatcctatacgaaggttatccacgagtgccaacagaggatggtggccgatcacttgcagttcctgcatgcagaatgtcataacataattaggcaagagaagaagaatgatatggctaatatgtatgtcctcctgagggcagtgtccacaggcctgccgcatatgatacaggagctgcagaaccatatccatgacgagggcttgcgcgctacctctaacctgacacaggagaacatgcccaccctgtttgtggaatctgtcctggaggttcacggcaaattcgtgcagctgatcaacaccgtgttgaatggcgatcaacacttcatgtctgctctggataaagctctcacatctgtggtgaactatagagagcccaaatccgtgtgcaaggcaccggagctacttgccaaatattgtgacaacctcctgaaaaagtctgccaaagggatgaccgaaaatgaggtagaggatcgccttacatcctttatcaccgtgtttaaatacatcgatgacaaggatgttttccaaaaattctacgcccggatgctcgccaaaaggctgattcacggactctcgatgtccatggattcagaagaagccatgatcaacaaactgaagcaggcgtgtggctacgaatttacttccaagctacataggatgtatactgacatgtctgtgagcgccgacttgaataataaatttaacaatttcataaagaatcaggacactgtgattgacctgggaatcagctttcaaatctatgtattacaggctggggcgtggcctcttacccaggcgccttcctcaacatttgccataccccaggaacttgagaaaagcgtgcagatgttcgagctcttttactcccagcacttttccggcaggaaacttacatggttgcactacctctgcacaggcgaagtgaagatgaactatctcggcaagccatatgtggccatggtaaccacctaccagatggctgttttgcttgcctttaataactcagagacagtgtcatataaggagctgcaggacagtactcagatgaatgagaaggaactgaccaagactatcaagtccctgctggacgtgaaaatgatcaaccacgattcagagaaggaagacatagacgccgaatcctctttcagtctcaatatgaacttcagctctaaaagaactaaattcaaaatcacaacctccatgcaaaaagataccccacaggaaatggagcagacgcggtctgccgtcgatgaagacagaaagatgtacctgcaagcggcgatcgtgaggatcatgaaggctcgcaaagtgttgagacacaatgcgctgattcaggaggttatctcgcaaagtagagccagattcaatccatccatctccatgatcaaaaagtgtatcgaagttctgatagacaaacaatatatcgagcgctctcaagcatccgctgacgaatattcgtacgtggcctag

SEQ ID NO: 14681 - DNA, 2238 bp, Artificial Sequence
  Description of Artificial Sequence: Synthetic coding sequence
atgtccctgaaacctagagttgtcgatttcgatgagacatggaataagctgctgaccacgataaaagccgtagtgatgctggagtatgttgaacgcgctacatggaacgaccgtttcagcgacatttacgccctgtgtgtggcctatccggagcctcttggcgaaaggctgtataccgagactaaaatttttctcgagaatcacgtgagacatctgcataaaagggttttggagtcagaagagcaggtgctggtgatgtatcacagatactgggaggagtacagtaaaggggccgactatatggactgcctgtacagatacctgaacacccagttcatcaagaagaacaaactgaccgaagctgatctccagtacggatacggcggagtggacatgaacgaacctttaatggaaataggagagttggcactcgacatgtggagaaagctcatggtcgagcccctgcaggctatcttgatcaggatgctccttagggagatcaagaatgaccgagggggcgaagatcctaatcagaaggtgatccacggagtgattaatagttttgtgcacgtggaacagtacaagaaaaagtttcccctcaagttttaccaagagatcttcgagtctccgtttctgaccgagaccggggaatattacaaacaagaggctagcaatctcctgcaggagtcgaactgctcccagtacatggagaaagtcctcgggcgactgaaagatgaggagatcaggtgtaggaagtatctccatccctcgtcctataccaaggtgattcatgagtgtcagcaacgcatggtggcagaccacctgcagttcctgcacgctgagtgtcataacataattaggcaagaaaagaagaacgacatggccaacatgtacgtgctcctacgagcagtttcaacagggttacctcacatgatccaagagttgcagaaccatattcatgatgaggggttgcgggccacatcgaatctcacacaagagaacatgcctacactattcgtggaatcagtcctagaggtgcacgggaagtttgttcaactgatcaataccgtgctgaacggggaccagcattttatgtcagcgctggataaagcactcacctctgttgttaactatcgcgagcctaaaagtgtgtgcaaagcccccgagcttttagcaaagtactgcgacaacctcttaaagaagagcgcgaagggcatgaccgagaatgaggttgaagacagactgacctcttttatcactgtgttcaagtacatcgatgataaagacgtttttcaaaaattctacgcgaggatgcttgccaagagactcattcacggcctgtccatgagtatggatagtgaggaggcaatgattaataagctgaagcaagcctgcggctacgagtttacttccaagctgcatcgcatgtatacggacatgtccgtgtccgctgacctgaataacaagtttaataattttattaagaatcaggacacagtgattgatttgggtataagcttccagatttacgtcctgcaggcaggggcctggccactgacccaggcgccgagctctaccttcgccataccgcaagagctggagaaaagtgtccagatgtttgagctcttttattctcagcacttctctggtcgcaaattgacttggctccactacctgtgtaccggcgaggtgaaaatgaactacctcggcaaaccctacgtggctatggttacaacctatcagatggccgtgttgttggcattcaacaactcagaaaccgttagttacaaggaattgcaggacagcacccagatgaacgagaaagaactgaccaaaaccataaaatctttgctggacgttaagatgatcaatcatgactcagagaaggaggatatagatgccgaaagctcattctctctaaatatgaatttcagcagcaagagaactaagtttaaaatcactacctccatgcagaaggatacaccacaagagatggagcagacccggtctgcagtggatgaggaccggaagatgtatttgcaggctgccatcgtccgcattatgaaggccagaaaggtgctccggcacaacgcattgatccaagaagttataagccagagcagggccagattcaatccttcaatttccatgattaagaagtgcattgaggtcttaattgataagcagtatatcgagaggagccaggcttccgcagacgagtacagttacgtggcctag

SEQ ID NO: 14682 - DNA, 2067 bp, Artificial Sequence
  Description of Artificial Sequence: Synthetic coding sequence
atgctgtacgtctggccaatcctgaatccattggagaaggactttatccaaaagctgaggttcttctggaagattatgttcggcatctgcatccggtactgggaagaatactcaaaaggcgcagactatatggattgcttgtaccggtacctgaacacacagtttatcaaaaagaataaactcacagaggccgatcttcagtatggttatggaggagtcgatatgaacgagcctctgatggagatcggggagttggctctggacatgtggagaaagctgatggtggaacctctgcaagctattctaatcaggatgctactccgggaaatcaagaatgatagagggggtgaggaccctaaccagaaggtaatacatggcgtgatcaacagtttcgtccatgtggagcagtacaagaaaaagtttcctttaaagttctatcaagagattttcgagtccccattcctgaccgagaccggtgagtattataaacaggaggccagcaatctattgcaagaaagtaactgcagccagtatatggagaaggtgctgggtaggctcaaggatgaggagataaggtgccgcaagtacctgcaccccagctcatatacgaaagtcatccacgaatgtcagcagcgtatggtggccgatcatctgcaatttttacacgccgaatgtcataatattataaggcaagagaagaagaacgacatggccaacatgtatgttctgttgagagcggtgtctactgggttgcctcacatgatccaggagttgcagaaccatatccacgatgaggggctaagagccaccagtaatcttacccaggagaacatgccaacattgttcgtggagagcgtccttgaggtgcacgggaaatttgtgcagctcatcaataccgtcctcaacggcgaccagcattttatgtcagctctggataaggccctgacctctgtagtgaattatcgtgaaccaaagagtgtatgtaaggctcccgaattgctggcaaagtattgtgataacttactcaaaaagagtgccaagggcatgacagaaaatgaggtggaggatcgcctcacaagtttcattacagtatttaagtatatcgatgacaaggacgttttccaaaagttctacgcaagaatgctggccaaaaggctcatccacgggttatctatgtctatggattcagaggaagccatgatcaataaactaaagcaggcctgtggatatgaatttacatcgaaactccacagaatgtacacagatatgtcggtctccgccgacctgaacaataagttcaacaattttattaagaaccaggataccgtgattgacctcgggatctcatttcaaatatatgttctacaggccggagcatggccccttacacaggccccgtcctcgacatttgctattccgcaagaactggagaagagtgtgcaaatgtttgaactcttttatagtcagcactttagcggtcgaaaattgacctggttgcactatctgtgcactggcgaggttaaaatgaattacttaggtaagccctatgtagcaatggtgacaacctaccaaatggccgttctgctcgcattcaataacagcgaaaccgtttcttataaggaactgcaggattccacacagatgaacgaaaaggagctcaccaaaacaatcaagtctttactggacgtgaagatgattaatcatgattcagagaaggaggacatagatgccgagagctctttctccctaaacatgaactttagcagcaagcgcaccaaattcaaaattacgacaagtatgcagaaggatacacctcaggaaatggaacagacaagaagcgctgtcgacgaggacagaaaaatgtacctgcaagctgccatcgttcggattatgaaagcacgcaaggtcctaagacataacgccctgatccaggaagtgatatctcagagtcgggctcggttcaacccctcaatttcaatgatcaagaaatgtatcgaggtgctaattgataagcaatacattgaacgctcgcaggcttccgccgatgaatatagttacgttgcctag

SEQ ID NO: 14683 - DNA, 651 bp, Artificial Sequence
  Description of Artificial Sequence: Synthetic coding sequence
atgtcccttaaacctcgcgtcgtggattttgacgaaacatggaataaattgctgacaactatcaaggcggtggttatgctggaatacgtggagagagcaacttggaacgacaggttttccgacatctacgccctttgtgtggcttatccagaaccactcggagagaggctgtataccgaaactaaaatattcctggaaaaccatgtgcgccaccttcacaagcgggtcctggaaagtgaggaacaggtcttagtcatgtatcatcgatattgggaagaatattccaagggggcagattacatggattgtctctatagatacctgaatactcagtttattaaaaaaaacaaattaaccgaagctgaccttcagtatggatacgggggggtggacatgaacgagccccttatggagattggggagttggcccttgatatgtggaggaagctgatggtcgagcctctgcaggctattctcatccgcatgctgttacgcgaaattaagaatgatcgcggcggagaggacccaaaccagaaagtcattcacggggtgattaattcctttgtgcacgttgagcagtataagaagaaatttcccctgaaattttaccaagagattttcgaatcacccttcctgacagagacgggatag

SEQ ID NO: 14684 - DNA, 2295 bp, Artificial Sequence
  Description of Artificial Sequence: Synthetic coding sequence
atgtatcgggtcacatggtctacgttctggctgaggttccagcactacacctgtacaatgagcttaaagccaagggtggttgacttcgatgagacttggaacaaactgctcaccacaattaaagccgtggttatgctagaatacgtcgagcgtgccacctggaacgacaggttttcagacatttacgccctgtgcgttgcctacccagaacccctcggcgagcgactgtacaccgagaccaaaattttcctggagaatcatgtgagacacctacacaaacgagtgctggaaagtgaggaacaagtgcttgtgatgtatcatagatattgggaggaatatagcaagggggccgattatatggattgcctctaccgatacctcaacacccagttcattaaaaaaaataagcttactgaagccgatttgcaatacgggtatgggggtgtggatatgaatgagcccttgatggagattggcgagctcgcgttggacatgtggagaaaattgatggtggagcctctgcaggccatcctcattcgtatgttgctgagagaaatcaaaaatgatcgcggcggtgaggaccctaaccagaaagtgattcatggcgtgattaactcttttgtgcacgttgaacagtacaaaaagaagttccccctcaaattctaccaggagatctttgagagtcctttcctgacggaaacaggggagtattacaagcaagaggcttcgaacttacttcaggagtcaaattgtagccaatacatggagaaagtgttaggccggttaaaggatgaagagattagatgccggaagtacctgcacccttcatcctacaccaaggtgatccatgagtgtcagcagcgcatggtggctgatcatctgcaattcctgcacgctgaatgccacaacattattcgccaagaaaagaaaaatgatatggctaatatgtatgtcctcctacgcgccgtcagcacaggccttcctcacatgatacaggaattgcagaatcatatacatgacgaaggcctgagggccacttcaaaccttactcaggagaacatgcccactcttttcgttgagtcagtcttagaggtgcacggtaagtttgttcagctgatcaatactgttctcaatggggatcagcacttcatgtccgccctggataaagccctgacaagcgtcgtcaattaccgcgagccaaaatcagtgtgtaaggcacctgaactgctcgcaaaatattgtgacaacctgctgaagaagagtgcgaaaggtatgactgagaacgaggttgaggaccggttgacgtcttttattacagtgtttaaatacatcgacgataaggacgtgtttcagaagttctatgcccgtatgctggccaaacgtctcattcacggactgagcatgagcatggattcagaagaggcaatgattaataaactgaagcaggcgtgtggatacgagttcacatccaagcttcataggatgtatacagacatgagcgttagcgccgatctgaacaataagttcaacaattttataaagaaccaggacaccgtaatcgacctcggtatttcattccaaatctatgtcctgcaggcaggagcctggccactaacacaggcacctagcagcacttttgccattccacaagaactggagaagtccgtgcagatgttcgagctgttctacagtcagcacttcagcgggcggaagttaacttggcttcattatctgtgtaccggagaggttaagatgaactacctgggcaagccatacgtggcaatggtgaccacttaccagatggcagtgctgctggccttcaataacagtgagactgttagttacaaggaacttcaggattccacccagatgaacgaaaaagaattaacgaagaccattaagtctctgctggacgtcaagatgattaatcacgattccgagaaagaagacatcgacgcagaatcgagcttttcgttgaacatgaacttcagttccaagaggacgaaattcaaaattaccacctcaatgcagaaggacacgccacaggaaatggagcaaacgcgcagcgcagttgatgaagaccgtaagatgtatttgcaggctgccatcgtccggatcatgaaagcacgaaaggtgctgaggcacaacgcactgattcaggaggtcatttcccaatcacgggccagatttaacccatctatctctatgatcaagaaatgtatagaggtcttgatagacaaacagtatattgaaaggagccaggccagcgcagacgagtattcttacgttgcttag

SEQ ID NO: 14685 - DNA, 2307 bp, Artificial Sequence
  Description of Artificial Sequence: Synthetic coding sequence
atgtctaacctgtcaaagggcaccgggtctagaaaggacacaaaaatgcgcattcgtgcattcccgatgaccatggatgaaaaatacgtcaactccatctgggatttgctaaaaaatgccattcaggaaatccagcggaaaaacaactccggactgagcttcgaagagctttaccgtaacgcgtacacaatggtcctgcataaacacggagagaagctctatactggtctgagggaagtggtgaccgagcacctcatcaacaaagttcgggaagatgtactgaactctctgaacaataatttcctgcaaacgttgaaccaagcttggaatgaccaccagaccgcaatggtcatgattagggatatcctcatgtacatggatcgggtgtatgtgcaacagaacaacgtcgagaacgtgtacaatctgggcctcattatcttcagggatcaggtagtgagatacggctgcatccgagatcacctgagacagaccttgttagatatgattgctagggagcgtaaaggggaagtggtagaccgcggggcgatccgtaatgcctgtcagatgctaatgattctgggacttgagggccgatccgtctacgaagaggactttgaggccccctttctggagatgtcagcagaattttttcagatggaatctcagaagttcctcgctgaaaattccgcctccgtttatatcaagaaggtggaggcgcggatcaatgaggaaattgagcgagtcatgcactgcctggataaatcaacagaagaaccaattgtgaaagttgtcgagcgggagcttatcagtaagcatatgaaaacaatcgtcgagatggaaaactccggccttgtccatatgttaaagaacggcaaaaccgaggatcttggttgcatgtacaagctgttctctagggtgcccaacggccttaaaactatgtgcgagtgcatgtcgagttatcttcgagaacagggcaaggcccttgtcagtgaggagggcgagggcaagaatccagtggattatattcagggtcttttggatttgaaatctcgattcgatcgtttcctactcgagtcctttaacaacgatcggcttttcaaacagacaattgctggcgatttcgagtatttcctgaatctgaactcaagatctccagaatacctgtctttgtttatagacgacaaattgaaaaaaggtgtgaaaggactgacggagcaggaggtagagacaatccttgataaggccatggttctgttccgcttcatgcaggagaaagacgtgttcgaacgctactataaacagcacctggcaaggcggctgctgaccaacaagtcagtaagtgacgactcagagaaaaacatgatcagcaagctgaaaactgagtgtggttgtcagttcacttcgaagttagaagggatgttcagagatatgtctatcagcaatacaacaatggatgaattcagacagcatctgcaagccacaggggttagcttaggcggagtggacctcaccgtaagggttttgaccaccggctattggcctacgcaaagcgcgactcccaagtgcaacatacctcccgcacctagacacgctttcgaaatctttagaagattctatttagcaaaacattcgggccggcagctcactcttcagcatcacatgggatcagcagatttaaatgcaacattctatggccccgtcaaaaaggaggacggtagtgaagttggggtcggaggagcccaagtcacaggatccaacacacgtaaacacatactacaagtttctacattccagatgacaatactgatgctcttcaataaccgcgagaaatatacgttcgaagagatccagcaggagacagacattcctgagcgcgagttggtgcgggctctccaaagcctggcctgtggtaagcccacccagagagtgctaacaaaagaaccaaagtcaaaggaaatcgaaaacggacatatcttcacagtgaatgatcaatttacctctaaactgcatagggtgaagattcaaacagtggccgctaagcagggcgaaagcgatcccgagcggaaagagacaaggcagaaagttgatgacgataggaaacacgaaattgaggccgctatagtccgaataatgaaaagtcggaagaaaatgcagcacaatgtgctggttgcagaagttacccagcagttaaaagcccggttcttgccaagccccgtggtgattaagaagcgaatcgaggggcttatagaacgcgagtacttggcccgaactcctgaagatagaaaggtatatacatacgtagcttag

SEQ ID NO: 14686 - DNA, 2109 bp, Artificial Sequence
  Description of Artificial Sequence: Synthetic coding sequence
atgtcaaacctgtcaaaggggaccgggagccgcaaagatactaagatgcggataagggcgtttccagtccgagaggatgtactgaattcattgaataacaatttccttcaaacacttaaccaggcatggaacgaccatcaaactgcgatggtaatgattagagacattctgatgtacatggatcgtgtgtatgtccaacaaaacaacgtggaaaacgtttataacctcggacttatcatatttcgagaccaggtggttcggtatggctgtatacgtgaccatctccgacagactctcctggacatgattgctcgggagaggaagggagaggtggtggatcgcggcgcaattaggaatgcttgccaaatgttgatgatcctgggccttgagggtaggagcgtctacgaagaagacttcgaggctccatttctcgagatgtcagccgaattcttccagatggagagtcagaagtttcttgccgagaacagtgcttccgtgtacattaaaaaggtggaggctcggataaacgaggagattgagcgcgttatgcattgccttgataagtctactgaggaacccattgtgaaggtcgttgagcgagaactgatctctaaacacatgaagactatcgttgagatggaaaattccgggctggtgcacatgcttaagaatggcaagaccgaagatctcgggtgcatgtacaagctcttcagcagggtgcctaatggactaaagacaatgtgtgagtgcatgtcttcctacctgagagagcaggggaaggccctggtctccgaagagggtgaaggcaaaaatcctgtcgattacattcagggcctactcgatctaaagtcccggttcgaccgcttcttgttggagtctttcaacaatgacagactgtttaaacagaccatagctggggactttgagtacttccttaacctgaactcaagatctccagaatatctcagccttttcatagacgataagttgaagaaaggagtcaagggactgactgaacaagaagtcgaaacaattctggataaggccatggtgctctttagatttatgcaggagaaggacgtctttgaacgctattataaacaacaccttgctagaagactgttgaccaacaaatctgtcagtgatgacagtgaaaagaatatgattagtaagctgaaaacagagtgtgggtgtcagtttacttccaagctggaaggcatgtttcgggacatgagcataagtaatactaccatggatgaatttcggcagcatttgcaggccacaggcgtcagcttaggcggcgtcgatcttactgtgcgtgtgctgaccaccggatactggcctacacaatctgcaacccccaagtgcaatatccctcctgcaccgaggcatgccttcgagatctttagacgcttctatctagccaagcatagcggtaggcaactgactcttcagcatcatatgggttccgctgaccttaatgcaacattttatggaccagtgaaaaaagaggacggttcagaagtgggggtcgggggcgcacaggtgaccggcagcaacactcgaaaacacatcttgcaagtgtctactttccagatgaccattctgatgctcttcaataatcgggagaaatatacattcgaagagattcaacaggagaccgacattcctgagcgagagctggtgcgtgcccttcagtccctagcttgtggaaaacccactcagcgggttctgactaaggagcctaaaagcaaagaaattgaaaatgggcacatcttcactgtgaatgaccagtttacctctaagttgcacagggtaaaaatccagactgtggccgccaaacaaggcgaatccgacccagaacggaaggagaccagacagaaagtcgatgacgacagaaaacacgaaatagaggctgcaattgtgcgcatcatgaagagcagaaagaaaatgcaacacaatgtgttagtggcagaggtgacccagcagctgaaagctcggttcctcccaagcccagtggtgattaaaaaaagaatagaaggcctcatcgagagggagtacctggcacgaacgccggaggatcggaaggtgtatacatatgtcgcttag

SEQ ID NO: 14687 - DNA, 2235 bp, Artificial Sequence
  Description of Artificial Sequence: Synthetic coding sequence
atggacgaaaagtatgtgaactctatctgggatttattgaagaatgcgattcaagagattcaaagaaagaataacagcggcttgagcttcgaagaactgtatagaaatgcctacacgatggtcttgcacaagcatggggagaaactttatacgggcctgcgagaagttgtaaccgagcacctgatcaacaaggtgcgtgaggacgtcctcaattccctaaacaataactttctgcagacgctaaaccaggcatggaacgaccaccagacggccatggtcatgattcgcgacatcctcatgtacatggatcgcgtgtatgtacagcagaacaacgttgaaaatgtctataacctcggattgatcatcttccgggatcaggtcgtaagatacggctgtatcagggatcacctgcgccagactctgctggatatgattgcccgagagcgaaaaggggaggtagtggaccggggcgctatcagaaatgcatgtcagatgcttatgattctgggattggaaggtcgctccgtttatgaggaggactttgaggcccctttcctcgagatgtccgcggaattcttccagatggaatcccaaaaatttctggcagagaacagcgccagcgtgtatattaagaaagttgaggctcgcattaacgaagagatcgagcgggtgatgcattgcttagacaaaagcacagaggagccgatcgttaaagtcgtcgagcgcgaactcatctctaaacacatgaagacaattgtggaaatggaaaattccgggctggttcacatgcttaagaacggcaaaactgaggacctgggttgcatgtacaaattgttcagtcgagtcccaaacggtctcaagactatgtgcgagtgcatgtcaagttacctgcgagagcaggggaaggccctggtgtccgaggagggggagggcaagaatccagtggactatatccaggggctgcttgacctgaagtctcggtttgaccggtttctcttggagtcctttaacaacgataggttgttcaaacagacaatcgccggcgacttcgaatacttcctcaatctgaatagcaggtcacctgagtatcttagcctgtttatcgatgacaaactgaagaagggagtgaagggcctgacggagcaagaagtcgagacgattctcgacaaggctatggtgctgtttcggtttatgcaagaaaaggatgtattcgaacggtactataagcagcacctggcccgccgactgctgaccaataagtctgtctctgacgattccgagaagaatatgataagcaagctgaagacggagtgcggatgtcaatttacttctaagcttgagggtatgtttcgtgatatgtctatttctaacacaacaatggacgaattccggcagcatctgcaagccaccggcgtctccctcggcggggttgatctgaccgtcagggtgctcacaacaggctactggccaacacagagtgccacgccaaagtgcaacattcctcctgccccccgtcatgcttttgagatctttcggcggttctatttagccaaacattcaggacgccagcttacgctgcagcaccatatgggtagtgcggacctgaatgcaactttctatgggccagtaaaaaaagaagacggatcagaagtgggcgtcggtggtgcacaggtgaccggcagcaacaccagaaagcatatcctgcaagtgtcaacatttcaaatgacaattctgatgttatttaataacagagagaaatataccttcgaggagattcaacaggagaccgacattcctgaacgggaactcgtgagggctctacaatcactggcttgtggtaagccaactcaacgtgtcttgaccaaagaacctaaaagcaaggagatcgagaacggacatatctttactgttaatgatcagtttacctctaagctccatcgggtcaagattcaaactgtggcagcaaagcaaggggagagcgacccggagagaaaggaaactaggcagaaggttgatgacgatcgcaagcatgaaatagaagccgctatcgtacggattatgaaaagcaggaaaaagatgcaacataatgtgctggtggcggaagttacacagcagttaaaggcacgattcctgcccagtcccgtggtgattaagaagcgcatcgagggtttaatcgagcgggagtatctggcccgaacacccgaagatcgcaaggtgtacacttacgtggcctag

SEQ ID NO: 14688 - DNA, 2235 bp, Artificial Sequence
  Description of Artificial Sequence: Synthetic coding sequence
atggacgagaagtacgtcaactccatctgggatctgctgaagaacgctattcaggagattcagaggaaaaacaattccggcctgtcgttcgaggaactatacaggaatgcctacacgatggtcctgcacaagcacggggagaagctgtataccggcctcagagaagtagtgactgaacacctgatcaacaaggtgagagaggatgtgctaaattctcttaataataacttcctgcaaaccctgaatcaggcttggaacgaccatcagaccgctatggtgatgattcgagatatcctgatgtacatggatcgagtgtacgtgcagcagaataacgtggagaatgtgtacaaccttggactcataatttttagagaccaggtggtcaggtacggttgtattagggatcacctgaggcagaccctgcttgatatgatagcgagggagaggaagggggaagtcgtagacagaggagccatccggaacgcctgccagatgctgatgatcctgggattggaagggagatccgtgtacgaggaggacttcgaagcaccctttctggagatgtctgccgaattctttcaaatggagtctcagaagtttctcgccgagaattccgcaagcgtatatatcaaaaaggtggaagcccggatcaacgaggagatcgagagagtcatgcattgtctcgacaagtctacggaagaacctattgtgaaagtagtggaacgcgaattgatcagcaagcacatgaaaactattgtcgaaatggagaacagtggtctcgtgcacatgctgaaaaacgggaagactgaggacttgggctgtatgtataagcttttttctagagttccgaacggactgaagactatgtgcgagtgtatgtcaagttatttgcgggaacaaggaaaggccctagtatcggaggaaggtgagggcaaaaatcccgtggattatattcaaggcctcctcgaccttaagtccaggtttgaccgattccttctggaaagcttcaacaacgacagacttttcaaacaaacaatcgccggagactttgaatactttttgaacctgaattctagatcacccgagtatctcagcctgttcatcgatgacaaactgaagaagggtgtgaagggcctgacagaacaagaggttgagacaatcttagataaggctatggtcctatttcggtttatgcaggaaaaggatgtctttgaaaggtactacaagcagcatctcgcacggcggcttctcactaataaaagcgtttccgatgacagcgaaaagaacatgatttccaagcttaagactgagtgtgggtgccaattcacctctaagttggaggggatgttcagagacatgtccattagcaatacaacgatggacgaattccgccagcatctgcaggcaacaggtgtcagcctgggaggcgtcgacttgactgtccgcgtcctgaccacaggatattggccaacccagtccgcaacacccaaatgtaatattccccccgccccccggcatgcctttgagatcttcaggcgcttctacctggccaaacatagcggccgccagttgaccttgcagcaccatatgggatcagctgacttaaatgctaccttctatgggccagtgaagaaggaagacggaagcgaggtgggggtgggtggagcacaggtcaccgggagcaacacccgcaagcacatccttcaagtgagtaccttccagatgaccatcttaatgttgttcaataatcgagagaagtacacctttgaggagatccaacaggagaccgacatacctgagagagagctggtgcgcgctctgcagagcctggcctgtggcaagcccactcagcgcgtgctcaccaaggagccaaaatctaaggaaattgaaaatggccatatcttcaccgtgaatgaccaatttacatccaaattacacagagtcaaaattcaaacagtggcggcaaaacagggcgaatccgatcccgaaagaaaagagacgaggcagaaggtggacgatgaccgaaagcacgagatagaagcagcaatcgttcgcattatgaaaagtagaaaaaagatgcagcataacgtgttagtagccgaagttacccaacagttaaaagcccggttcctgccctccccagtggttatcaaaaagagaatagagggtctgatcgaacgggagtacctggctcggacgccggaggaccggaaagtctacacgtacgtcgcatag

SEQ ID NO: 14689 - DNA, 1398 bp, Artificial Sequence
  Description of Artificial Sequence: Synthetic coding sequence
atggaaaccggattccctgcgattatgtacccaggctcctttatagggggatggggtgaagaatacctcagttgggaaggccctggcctgccggattttgtgttccaacagcagcccgtggaaagcgaagcgatgcactgctccaatccgaaatccggcgtggtgctagccacagtggcacggggtcctgacgcgtgtcagattctgacaagggcccctcttggccaggatccacctcagagaactgtcctgggcttgctgactgctaacggtcaataccgtagaacatgcgggcagggaatcacacggattcgctgctatagtggtagcgaaaacgcattcccacccgcgggcaagaaagctttgccagattgcggagtccaggagccgccgaagcaggggtttgacatctacatggatgagctggagcagggtgatagggactcatgctctgtgagggagggcatggcctttgaggatgtgtatgaagtggacactggaacactgaagtccgatttgcactttctgctcgacttcaatacggtgtccccgatgctagttgactctagcctgctgagtcagtccgaagacataagcagccttggaacagacgtcataaacgttaccgagtatgctgaggagatctaccaatatctgagagaggccgagattcgacatagacctaaggcccactatatgaagaaacaacccgacattacagagggcatgaggaccatcctcgtcgattggctggtggaagtcggagaagaatataaactgagagctgaaaccctctatctggcagtgaacttcctggacaggttcctgtcatgtatgtctgttctgcgcgggaaactacagttggtcggaaccgccgcaatgctgctagcctcaaagtatgaggagatttacccccctgaagtggatgaattcgtttatataaccgatgacacatacactaagcgccagctgcttaaaatggaacacctgctcctgaaggtgcttgcctttgacctgactgtgcccaccaccaaccagttcctgctccagtaccttagaagacagggcgtgtgtgtgaggaccgagaacttggccaagtatgtcgccgaactttccctgctggaagctgatccctttctcaagtacctaccatctctgattgccgcagccgcgttttgtttggcaaactatacagtaaacaaacatttctggcctgaaacactggccgcattcaccggctacagcttgagtgaaattgtaccctgtcttagcgaattgcataaggcctatttagatattccccacagaccccaacaagctatccgagaaaagtacaaggcctcaaagtacctgtgtgtgtccctgatggagccgcccgcggtgttgctcctccagtag

SEQ ID NO: 14690 - DNA, 1395 bp, Artificial Sequence
  Description of Artificial Sequence: Synthetic coding sequence
atggaaactggctttcctgcgatcatgtatccgggctccttcattggggggtggggcgaggaatatctgtcctgggagggaccagggctgcccgatttcgtgttccaacagcccgtggagtccgaggccatgcattgctctaatcccaagtctggcgtcgtgcttgcaaccgtggcccgtggcccagacgcctgccagattctgactcgcgccccgctcggacaggaccctccccagcgcactgtgttgggactgttaacagcaaacggccaatatcgacggacatgtggacaaggcataacaaggatccgctgttactctgggtcagaaaacgccttccccccagctgggaaaaaggccctgcccgattgcggcgtccaggagcctcctaaacaaggcttcgatatctatatggacgagctggaacaaggagatcgggacagctgcagcgtcagggaaggcatggctttcgaggatgtttacgaggtggataccggcacgctgaaatcggacctgcactttctcctcgactttaacacagtgagccccatgcttgtggactcatccctgctttcgcagagcgaagacatttccagccttggaaccgacgttattaacgttactgagtacgcggaggaaatttatcaatacctcagagaagccgaaattagacaccgccccaaggcccattatatgaaaaagcaaccagacatcaccgaaggtatgcgaaccatactggtggattggttggtcgaggtaggggaagaatataagcttcgagccgaaactttatatctggctgtaaactttctagatagatttctgtcctgcatgtctgtcctgaggggcaaactacagctggttggaaccgccgcaatgctcctggccagcaagtatgaggaaatttaccctccggaggttgacgagtttgtgtacatcacggacgatacgtatacaaagagacaactgctgaagatggagcacctgcttctgaaggtcctggcgttcgacttgacggttccgacaacaaaccaattcctgttacagtatcttcgtcggcagggggtctgtgtacggacagaaaatctcgctaaatacgtagccgaattaagcctgctggaagctgacccctttctaaaatatctgccctccctgatcgctgcagcggcattttgtcttgccaattataccgtcaataaacatttctggccagagaccctggccgccttcactgggtactccctgagcgagatcgtgccttgtctaagtgaattacacaaggcatacctggacatccctcaccggccgcagcaggctatccgggaaaagtacaaggcgagcaagtacctatgtgtgtcccttatggagcctccagccgtgctcctgttacagtag

SEQ ID NO: 14691 - DNA, 1266 bp, Artificial Sequence
  Description of Artificial Sequence: Synthetic coding sequence
atgcattgttcaaatccaaaatctggggtggtccttgccaccgtggcccgaggcccagacgcctgccaaatcctcactcgggcaccgctcggccaggatccgccccaacgaaccgtgctaggtttgctgacggccaacggccagtaccggagaacatgcggacaaggtattactcgcatcaggtgctacagtggttcggaaaatgcatttccccccgcaggcaaaaaagctctacccgactgcggcgttcaggaacctccgaagcagggttttgacatctatatggatgagctcgagcagggagatcgcgattcttgctcagttcgggaaggtatggcattcgaagacgtttatgaagtggatacgggtacattgaagtcagaccttcacttcctgctcgactttaatactgtcagtcccatgctcgtggacagctctcttctgtcccagagcgaagacatttcctcccttgggacggatgtgattaatgtgacagaatatgctgaggaaatctatcagtacctgcgggaagctgagatcaggcataggccaaaggcccattacatgaaaaaacagcccgatattaccgaaggcatgcggaccatcttggtagactggttggttgaagtgggggaggagtacaagctccgtgccgagaccctttacctggccgttaacttcctggaccggtttctgagctgcatgagcgtgctgcgaggcaaactgcagctcgttgggaccgctgctatgcttctagcaagcaagtatgaagaaatttatccccccgaggtggatgagtttgtttatattactgatgatacctacacaaaaagacaattgctcaaaatggagcatctgctgctcaaagtcctagctttcgacctcaccgtgccgacgacgaatcaatttctgctgcagtacctcagaagacagggcgtgtgtgtccgcacggaaaacctcgctaagtacgttgctgaactgtcactgctcgaggccgatcctttcttaaaatacttgccatcactaattgcagccgctgctttttgccttgctaattacactgtgaacaaacatttttggccagagactctggctgcatttaccgggtacagtctcagtgaaatcgtaccttgtctgagtgagctgcataaggcctatctggacatacctcacaggcctcagcaggcgatcagagagaaatacaaggcaagtaaatatctgtgtgtttccctaatggaacctccggctgttctcctgctacaatag

SEQ ID NO: 14692 - DNA, 1266 bp, Artificial Sequence
  Description of Artificial Sequence: Synthetic coding sequence
atgcattgcagcaaccccaagtctggcgtggtgctcgccaccgtggctaggggcccagatgcatgccaaattcttacgagggccccactcgggcaagatccccctcagcgcaccgtgctcgggctcctgaccgccaatggccagtacaggaggacttgtggtcaaggtatcaccaggatacgctgctattctggatctgagaacgccttccctccggccggcaaaaaggctctccccgattgcggagtccaggagccacctaaacagggctttgacatatatatggacgagctggagcagggcgatagagactcctgcagtgtgagggagggcatggccttcgaggacgtgtacgaagtggatacaggtacccttaagtctgacttgcattttctgttggactttaataccgtgagtccaatgttagtcgactcttcactcctgagtcagagcgaggacatctcctccctgggaacagacgtgatcaacgtgactgaatacgccgaagagatttatcagtacttgagggaagcggaaattcggcaccggcctaaagcacattatatgaagaagcagcccgatattaccgaggggatgcgcacaattctggtggactggctcgtggaggttggcgaggagtacaaacttcgggcagagaccctatacctggcagtaaactttttggataggtttcttagctgtatgtccgtgcttagaggaaaactacaattggtcggcacagcagccatgctccttgcctctaagtatgaagagatctacccacccgaagtggatgaatttgtctatattacggacgatacctacaccaagcgccagctcttaaagatggaacatttacttctgaaagtcctcgcttttgatctcactgtcccaaccacaaatcaatttctgctgcagtatctgcggagacaaggagtctgcgtgagaactgaaaatttagctaagtacgtcgcagagcttagtctccttgaggcagacccatttctgaagtatctgccttcacttattgcagcggccgccttctgtctcgctaactacacggtcaataagcacttttggccagagactctcgccgcattcacgggatactccctgagcgagattgtgccatgcttaagcgaattgcataaggcataccttgacattcctcatcggcctcagcaggccatccgcgaaaaatataaagcgtctaaatacttgtgtgtctccctaatggaaccacccgccgttttgttgctccaatag

SEQ ID NO: 14693 - DNA, 1299 bp, Artificial Sequence
  Description of Artificial Sequence: Synthetic coding sequence
atgctcggtaattctgctcccggacctgcaacgcgggaggccgggtccgccctactggctctgcaacagacagcgttacaggaagatcaagagaacattaatccggaaaaagccgctcccgtgcaacagcctcgcacccgtgccgccctggctgtgctgaagagtggaaaccccagggggctggcccagcagcagcgtcccaaaacaagacgggtcgcccctctgaaagatctaccagtgaacgacgagcatgtcactgtgccgccctggaaagccaattccaagcagccggcatttacaattcatgtggacgaggccgagaaagaggctcagaagaaaccagccgagagccagaaaatcgagagagaggatgccctagccttcaattcggccatttctcttccgggaccccgcaagcccttagtgcctcttgactacccaatggatgggtcctttgagtcacctcatactatggacatgtcaatcattctcgaggacgagaaaccagtgagtgttaatgaggtccccgattaccatgaagacatccatacttaccttagagaaatggaagtgaaatgcaaaccaaaggtgggatatatgaagaagcaaccggatattactaactcaatgcgggcgattttagtggactggctggtagaggtaggagaggaatacaaactccaaaacgagaccttgcacctcgcggtaaactacatcgaccgcttcctgtcctccatgtcagtgctgagaggcaaactgcagctggtcggcactgcagccatgttgcttgccagtaaatttgaagaaatatacccacctgaggtggccgagtttgtgtacataacagatgatacgtatacaaagaagcaagtactcagaatggaacaccttgtcctaaaggttctgacatttgatctggccgcacccactgtcaaccagttcttgacacaatactttctgcaccagcagcctgccaactgtaaagtagaatccctcgctatgttcctaggggagctgagcctcattgatgccgacccttaccttaaatacctgcctagtgtcatagcaggcgcggcattccatctcgccctgtatactgtcaccggccaatcctggccagagtcgctgattagaaaaaccggttacactctggaatcgctcaagccctgtctgatggatctgcaccaaacctacttgaaagctcctcagcacgcacagcagagcatccgagagaaatacaagaattctaagtatcacggagtcagtctcctgaatcccccggaaacactcaatttatag

SEQ ID NO: 14694 - DNA, 1302 bp, Artificial Sequence
  Description of Artificial Sequence: Synthetic coding sequence
atggcattgagggtcactcgtaactccaagataaacgcagagaataaggctaagatcaatatggcaggcgccaagagagtccctactgcgcctgctgccaccagcaaacccggcttgcgccccagaacagctctgggcgatatcgggaataaggtcagcgagcaattgcaggccaaaatgccaatgaagaaggaggccaagcccagtgccaccggcaaagtaattgacaaaaaactgcccaagccgctcgagaaggtcccaatgttggtccccgttccagtgagtgagccagttcccgagcctgaacccgagcctgaacccgagcctgtcaaggaagaaaaactgtcccctgagccaattctggtagataccgcatctccatctccaatggagacctccggatgcgcgccagcagaggaggatctgtgccaggctttttctgacgttatcttagcagtgaacgacgttgacgccgaggacggcgccgaccccaacctgtgctctgaatacgttaaggatatctatgcatatctgcggcaactcgaggaggaacaggccgtgcggccaaaatatctgttaggtagagaagtaacaggcaatatgagagccattttgattgattggttggtgcaggtccaaatgaagtttaggctgttgcaagagaccatgtacatgacagtcagcatcatcgaccgatttatgcagaacaattgtgtgcccaaaaagatgttacagctcgtcggagttacagcgatgttcatcgctagcaagtatgaggaaatgtatccgcccgaaattggtgactttgcatttgtaacagacaacacttacacaaagcaccagatcagacagatggaaatgaagattctcagggccttaaatttcgggctggggaggccccttcctcttcatttcctgaggagggccagtaaaattggggaggtggatgtggagcaacacaccttagctaagtacttaatggagctgaccatgttagactatgacatggtgcacttccccccatcccagattgccgctggggcgttctgtttagccctgaaaatacttgataatggcgagtggactcccacattacagcattatctctcttacaccgaggaaagccttctacctgtgatgcagcacctggcaaagaacgtcgtgatggtgaatcagggactgactaagcatatgaccgttaagaacaagtatgccacgagtaaacatgccaagatatccacattaccacagcttaacagcgcgctggttcaagacctcgccaaggcggtggctaaagtttag

SEQ ID NO: 14695 - DNA, 1191 bp, Artificial Sequence
  Description of Artificial Sequence: Synthetic coding sequence
atggcactgcgcgtgactcgtaattccaagataaacgccgagaataaagccaagatcaacatggctggggcgaaacgagtcccaacggctccagcggctacatctaaacctgggctgcgcccccggactgctctaggcgacattggaaataaagtcagcgaacaacttcaagccaaaatgcctatgaagaaggaagccaagccctcagcaacgggaaaagtgatcgataagaagctgccgaaacccctggagaaggtccctatgttagtcccagtcccagtctccgaaccagtgccagaacctgagcctgaaccggagccggagcccgttaaagaggaaaaactctcaccggaacccattcttgtcgatacagccagcccatcaccaatggaaacctctggatgtgcgccagccgaggaagacctctgccaggcgttctctgacgtaatcctggccgtcaatgacgtcgatgctgaggacggcgccgaccccaacctgtgctccgagtacgtgaaggatatatatgcatacctccggcagttggaggaagagcaggctgtgcgcccaaaatatcttctggggagagaagtaaccggtaatatgagagccattttgatagactggttggtacaggttcaaatgaaattccgactgctgcaggagaccatgtatatgacggtctcaataattgacaggtttatgcagaacaactgtgtccctaaaaaaatgttgcagctcgtcggagtcacagcaatgttcattgccagtaaatacgaagagatgtatcctccagagatcggtgacttcgcctttgtcaccgataatacgtacactaaacatcagattaggcagatggagatgaagatccttcgggcgctgaattttggtcttggccgacctttgcccctacacttccttcgccgggcatcaaagattggagaggtggatgtcgagcagcacaccctcgctaaatatttaatggagttgacgatgcttgattatgatatggtgcatttccctccaagccagattgctgctggggccttctgtctggcgctgaagatacttgacaacggggagtggactgttaagaataagtacgcaactagcaaacatgccaaaatcagcaccctgcctcagctgaacagtgctctggtgcaggacctcgccaaagctgtggctaaggtctag

SEQ ID NO: 14696 - DNA, 1206 bp, Artificial Sequence
  Description of Artificial Sequence: Synthetic coding sequence
atggctctgcgggtgacgagaaattccaaaattaacgctgaaaataaggctaagattaacatggcaggagccaagcgagtgcctaccgctcccgccgcgacgagcaaacccgggctgcgcccacgaacagcactgggcgatattggaaacaaagttagcgagcagctgcaggccaagatgcccatgaagaaagaggcaaaaccatccgcaaccggcaaggtgatcgacaagaagctcccaaaacccttagagaaggtcccgatgctcgtgcccgtcccagtatcagaacccgtccctgagccggaaccagagcctgagcccgaacccgtgaaagaggagaaattgtccccagaacccatcctagtagacaccgcatccccgtccccgatggaaacttctgggtgcgcccccgccgaggaagacctgtgtcaggccttcagtgatgtgatcctcgctgtcaacgacgtcgatgctgaagacggcgctgatcccaacctgtgttccgaatatgtgaaggacatttatgcatacctgcgccagctggaggaggaacaggccgttcgccctaagtatcttttaggcagggaagtgaccggaaatatgcgggccatactgatcgattggttagttcaagtgcagatgaaattcagattactgcaggaaaccatgtatatgacagtgtccattatcgaccgattcatgcagaataattgcgtcccaaagaaaatgttacagctcgtcggtgtgacagccatgttcattgctagtaaatatgaagagatgtatccacccgaaatcggagactttgcttttgtaacagacaatacgtacacgaaacaccagatccggcagatggagatgaagattcttcgcgccctgaatttcggattgggccgccctctgcctttgcacttcctcaggcgggctagcaaaatcggtgaggtggatgtggaacagcatacactcgcaaaatacttaatggaacttaccatgctggattacgacatggtgcatttccccccgtctcagatcgccgcgggcgcattttgcctggccctgaagatcttggacaatggagagtggacacccacactgcagcactatctgtcctacactgaagagtcactattgcctgtgatgcagcatcttgccaagaatgtagtgatggtcaatcagggtctgaccaaacatatggtgtcacagtag

SEQ ID NO: 14697 - DNA, 1197 bp, Artificial Sequence
  Description of Artificial Sequence: Synthetic coding sequence
atggctctgctgagaaggccaacagtgtcatcagacctggagaatatcgatacgggagtcaactctaaggtgaaatctcatgtgaccattcgtaggactgtgctggaagaaataggaaaccgggtgacgactagagcagcacaggtcgccaagaaagcgcaaaacaccaaggttcccgttcagcctaccaaaaccacaaacgtcaacaagcaacttaagccgaccgcttctgtcaagcccgtacagatggagaagcttgcccccaaagggccttccccgaccccagaagatgtgtccatgaaggaggagaatctgtgccaagcgttttcggatgcgctgctgtgtaagattgaggacattgacaacgaggattgggagaatccccagctatgctccgactacgttaaagacatctaccagtatctgcgacagcttgaagtgttacagagtataaacccacactttttagatgggcgggacatcaatgggcgtatgcgggccattctggtggattggctagtccaggtccattctaaattccggttgcttcaggaaacactgtatatgtgcgttggtattatggaccgcttccttcaggtgcagccggtgtcccgcaagaagttacaattggtgggaattaccgccctcctccttgcaagcaaatacgaagagatgttttcccccaacatcgaggacttcgtctatatcacggataacgcctatacctctagccaaattagggaaatggaaacactcatcttgaaagaactgaagtttgagttaggccggcctttgccacttcattttttgcgtcgagcgagcaaggcaggcgaggttgacgttgagcagcacaccctggcaaagtatttaatggagctgacgttaattgattacgacatggttcattaccatccgtcaaaagtggccgcagctgcttcttgcttatcccagaaagtgttggggcaaggcaagtggaacttaaaacagcagtattacactggatacacagagaacgaagtcttggaggtaatgcaacacatggcgaagaatgttgtgaaggtgaacgagaacctgaccaagttcatcgccatcaagaacaagtatgctagtagtaagctgttgaagattagtatgataccacaattaaactcaaaggccgtgaaggaccttgcatcccccttgataggccgatcctag

SEQ ID NO: 14698 - DNA, 432 bp, Artificial Sequence
  Description of Artificial Sequence: Synthetic coding sequence
atggcaggcaatttttggcaatcctctcactacctccagtggattttggacaagcaagacctgctcaaagaacgacaaaaggacctgaaattcctttccgaggaagaatactggaagctgcaaatattctttaccaacgtcatacaggcgctgggcgagcacctcaagctgcggcagcaggtgattgcaaccgccacagtgtatttcaagagattttatgcacggtatagtctcaagtctatcgatccagtactaatggcccctacttgtgtttttctggcttctaaggtcgaagagttcggtgtggtttccaacaccaggttaatagctgctgccacatctgtctgcaagtgcaaaaaatacatctgcttcaaggacgtgattctcaaaaaggccccagagtacatcgatttctttttcttttccctatag

SEQ ID NO: 14699 - DNA, 852 bp, Artificial Sequence
  Description of Artificial Sequence: Synthetic coding sequence
atggcaggtaatttttggcagtcctcccattatcttcagtggatcctggataaacaggatttgctgaaagagaggcagaaggatctgaagttcttgagcgaggaggagtactggaagctccagatctttttcaccaatgtaatccaggcattgggcgagcatctgaagcttagacagcaggtcatcgcgacagccactgtgtactttaagaggttttacgcacggtactctttaaaaagtattgacccggtccttatggcgcccacgtgtgtgtttttggcaagcaaggtagaagaatttggagttgtatcaaacacaaggcttatcgcagccgcaacgtccgttcttaaaactcgcttcagttacgcttttcccaaggaatttccctacagaatgaatcacatcctggaatgtgaattttatctcttagagctgatggactgctgcttaattgtttaccacccctaccgacctctgctccagtacgtgcaggacatggggcaggaggacatgctccttcctctggcctggcgtatagtcaacgacacctaccggactgatttgtgccttctgtacccaccattcatgatcgccctggcttgtctccacgttgcttgtgtggtccaacaaaaagacgctagacagtggtttgcggagttatctgtggacatggaaaagatacttgagataataagagttatcctaaaactgtacgagcagtggaaaaacttcgacgagcgaaaagaaatggctacgatcctgtcgaagatgcccaagcccaagcccccgcctaactctgagggagagcagggccctaatggctcccagaattcttcctactcgcagtcttag

SEQ ID NO: 14700 - DNA, 597 bp, Artificial Sequence
  Description of Artificial Sequence: Synthetic coding sequence
atggcacccacatgtgtcttccttgctagcaaagtcgaagaatttggggtggtctcaaacacacgattgattgccgctgccacttctgttctgaaaactcgctttagctatgccttcccaaaagagtttccatacagaatgaaccacatcctggagtgtgaattctacttgcttgagctgatggattgctgcttgattgtgtatcacccatacaggccactacttcagtatgtccaggacatggggcaggaggacatgctcctgccactggcatggaggattgtcaacgacacctatcgcactgatctttgtcttctctaccccccttttatgatagctctcgcctgcctccacgtggcctgtgtggtacaacaaaaagacgcgcgtcagtggtttgcagaactttccgtcgacatggaaaagatcctagaaattatccgcgtgatcctgaagctttacgagcagtggaagaacttcgacgaacgcaaggagatggctaccatattaagcaagatgccgaaacctaagccccctcccaatagtgagggagaacaagggcccaacgggtctcagaactcatcttactcccagagctag

SEQ ID NO: 14701 - DNA, 597 bp, Artificial Sequence
  Description of Artificial Sequence: Synthetic coding sequence
atggcaccaacatgcgtatttctcgcctctaaggtggaagagttcggcgtagtgtctaatacccggttgatcgccgcagccaccagtgttctgaaaacaagattcagctatgccttcccgaaagagtttccctaccggatgaaccacattctggagtgtgaattctacttgttagagttgatggattgctgcctgatcgtataccatccatatcgtcctctgcttcaatacgtacaggacatggggcaggaagacatgcttctgcctctggcttggagaatcgtcaacgacacctacagaacagatttgtgcctcttatatcctcccttcatgattgcactcgcctgcctacatgtggcctgtgtggtgcagcagaaagacgcaagacagtggttcgcggagctaagtgtggacatggaaaagatactggagatcattagggtaatccttaaactgtatgagcagtggaaaaacttcgatgagaggaaagagatggccaccattctgtctaaaatgccaaaacccaagccccctcctaattcagagggtgagcagggccctaacggaagccagaattcttcctattcacaaagttag

SEQ ID NO: 14702 - DNA, 489 bp, Artificial Sequence
  Description of Artificial Sequence: Synthetic coding sequence
atggcccccacatgcgtgtttttggccagtaaggtggaggagtttggagtggtgtccaacacccgcttaatagccgccgcaacgtctgttctgaagacgaggtttagttacgcatttccgaaggaattcccctacaggatgaatcatatcctggaatgtgagttttatctgctggagctgatggattgttgcctgatcgtgtatcatccgtacagacccctcctccaatatgttcaggacatgggacaggaagacatgctcctgcccctcgcttggagaatcgtaaacgacacgtatagaaccgacctgtgcctactctaccccccattcatgattgcactcgcctgtctccacgtggcctgtgtagtgcagcagaaagatgcaagacaatggttcgctgagctctctgtggatatggagaagattctcgaaattataagagttattctaaagctctacgagcagtggaaaaattttgacgagcgctag

SEQ ID NO: 14703 - DNA, 2283 bp, Artificial Sequence
  Description of Artificial Sequence: Synthetic coding sequence
atgtctaccgtggaggaggattccgacaccgttactgtggagacagtgaattccgttaccttaacccaggataccgaaggaaatcttatcctccactgtccgcagaatgaagcagatgagatcgactcagaggatagcatcgaacctccccacaagcgtctctgcctctcatctgaggacgatcagagtattgacgactctaccccctgcatttcggtggtggcgttgccccttagcgagaacgatcagagcttcgaggttaccatgacagcgacaactgaagtggcggacgatgaagtaacggaggggactgtgacccagatccagatcttgcaaaacgaacaactggacgagataagtcccttgggcaatgaggaagtcagtgcggtaagccaggcctggttcaccacaaaggaagataaggatagtttgactaataaggggcataagtggaaacagggcatgtggtcgaaagaggagattgacattctgatgaataatatcgaaagatacctaaaagccaggggaattaaggacgctaccgagataatcttcgaaatgtctaaggacgagcggaaagatttctatcgaacaatcgcctggggcctgaacaggcctctgttcgctgtgtatcgccgcgtgctccgcatgtacgacgatcgaaatcacgtgggcaaatacacaccagaggagattgaaaaactgaaggagttacgtatcaaacacgggaatgactgggccaccataggagcagccctgggcaggagcgctagcagtgtgaaagacagatgtagacttatgaaagatacgtgtaatactgggaagtggacagaggaagaggaaaagaggctcgcagaggtggtgcacgagctgacatctactgaacctggagatatcgtcactcaaggggtgagttgggccgcagtggccgagcgggtgggtactagaagtgagaagcagtgtcgcagcaagtggcttaattatttgaactggaaacagagtggtgggacggaatggaccaaggaagatgagattaatcttatacttcggatcgctgagctcgatgtggctgatgaaaacgatatcaactgggatttactggccgaaggttggagttctgtgcggagccctcagtggttgagatcaaaatggtggaccattaagcgccagatcgcaaaccataaggatgtatccttcccagttctcattaaagggcttaagcagctgcatgagaaccaaaagaacaatccaactcttctggaaaataagtccggctcaggggttccgaactccaacactaactcgtcggttcagcacgtgcagatcagagtcgcccgactcgaagacaataccgccatatccagctctcctatggcggctctgcagattcctgtccagataactcacgtgagtagcgcagacagcccagctacggtggactccgagaccatcacactgaattcggggacactgcagacatttgaaatattacctagtttccaccttcagcctactgggacccctggaacttatctgctgcagacgagttcttctcaaggtctcccactgacgctgacggcatcccccactgtgacgcttacagctgcggctccagcatccccagaacagatcatagttcacgcccttagccctgaacaccttctgaacacgtctgacaacgtgactgttcaatgtcataccccaagggtgattattcagacagtggcaaccgaggacataacatcctctatctctcaggccgaattaaccgtcgatagcgacattcagtccagcgattttcccgagccacccgatgcactggaagcagacacatttcctgatgagattcaccaccccaaaatgacagtcgaaccaagcttcaacgacgcccatgtgagtaaattttctgaccagaacagcaccgagctgatgaacagtgtgatggtccgcaccgaggaggaaattagcgacacagacctgaagcaggaagagtctccgagcgacctcgcttccgcctatgtgacagagggtctggagagtcccacgatcgaggaacaggtggaccaaactattgacgatgagactattctcatcgttccctcacctcacggctttatacaggcatccgatgtgatcgacaccgagagcgtcctgcccctcactacccttacggaccccatcctgcaacaccaccaggaggagagcaacatcatcggaagttccctcggttcacctgtaagtgaggactctaaggatgtggaggacctggtgaactgccactag

SEQ ID NO: 14704 - DNA, 858 bp, Artificial Sequence
  Description of Artificial Sequence: Synthetic coding sequence
atgtccacggtggaagaagatagcgatactgttacagtcgaaactgttaacagtgtcaccctaacacaggatacagaaggtaacctaattcttcattgccctcaaaatgaagctgatgagatcgattccgaagattccatcgaacccccacacaagaggctgtgtctatctagtgaagatgatcaatcaattgacgatagtacaccttgcatcagtgtggtagccctcccactttctgaaaacgaccaatcattcgaggttaccatgactgccaccacggaggtggcagatgatgaagtgacagaaggtaccgtgacccaaatacagattcttcagaatgagcagctggacgagattagccccctgggtaacgaggaagtcagtgctgtgagtcaagcttggtttaccacgaaggaggataaggactctctgacaaacaagggccataaatggaagcaggggatgtggtctaaagaggaaatcgacatcctcatgaacaatatcgaacgatacctgaaggctcgcggtatcaaagacgctacagaaataatttttgagatgagcaaggatgaacgcaaagatttctatcggacaatagcctggggcctgaatagacctctgttcgcagtgtaccgacgcgtactgcgtatgtatgatgatcgcaatcacgtcggaaagtatacacccgaagagattgagaaactgaaagagaaaaaggccattgccgcttgtttctttttcacccatcggcagctgtggactccaaagaaaggccatacctttaagctgtggctttccaagtactgctgcccacagttgccaaatcaatccaacgggaagaaaaagaacgaagagtag

SEQ ID NO: 14705 - DNA, 2283 bp, Artificial Sequence
  Description of Artificial Sequence: Synthetic coding sequence
atgagcaccgtggaggaagattctgatacagtcaccgtagagacagtgaactctgtcactctcacacaggatacagagggtaatttaatcctgcactgccctcagaacgaggccgatgaaatcgattcggaggactctatagagccgcctcataaacgcctgtgcctcagttcggaggacgatcagtccattgacgatagcacaccttgtatcagcgtcgttgccctgccgctgtcggagaacgatcagtctttcgaggtgaccatgactgcaacaacagaggtcgcagatgacgaggttacagaagggacagtcactcaaattcaaattctccagaatgagcagctggacgagatctcccccctggggaatgaagaagtgagcgcagtatcacaggcttggttcacaactaaagaagataaggactcccttacgaacaaaggtcacaagtggaagcaggggatgtggtccaaagaagagatcgacatcctgatgaacaatatcgagaggtaccttaaggctcgagggatcaaggacgccactgagataatctttgaaatgtcaaaagacgagcgaaaagatttttataggacgatcgcatggggactgaacaggccactcttcgccgtctatcgccgagttttaaggatgtacgacgacaggaatcacgtcggcaaatacacacccgaggagatagagaaactgaaggaactgcgaattaagcacggcaatgattgggccaccatcggcgccgctttaggtaggtctgcttccagcgttaaagataggtgtagactcatgaaggacacctgcaatacgggaaagtggaccgaagaagaggagaagcgacttgctgaggttgtgcacgagcttactagtacggaacctggtgacattgtcacacagggagttagttgggccgctgtggcagagcgggtaggcacccgtagcgagaagcagtgtcggtcaaagtggctgaattacctgaactggaagcaatcgggcggtactgagtggaccaaggaagacgagatcaatttgatcctgcgcattgccgagctcgacgtggcagacgagaacgacattaactgggaccttctcgctgaaggatggagcagtgtccgtagtccccagtggcttagaagtaagtggtggactatcaaacgacagatcgctaatcacaaggacgtctcttttcccgtgctgattaaaggcctcaaacagctgcatgaaaaccagaagaacaacccaacactgctggagaacaagagcggaagcggcgtgcctaatagtaacaccaatagctcagtgcaacatgtgcaaatccgagtggctaggctagaggataacactgccatcagtagttcccctatggccgcccttcagatcccagtgcaaataactcacgtctcaagcgctgactcccctgctactgtcgactctgaaacgatcactttaaacagtgggacgctgcagaccttcgagatcctcccatcatttcatttgcaacctaccggtactcccgggacatacctgctgcagacttcctcgtcacagggcctcccccttacgctgaccgcatcccccaccgtgacgctgaccgcagccgccccggcaagccccgagcagatcatcgtgcatgcactgtcccctgaacatttactgaacacaagcgataacgttacagtgcagtgccacaccccaagggtcatcatccagacggtcgcgacggaagatataacctctagcattagtcaggccgagctgaccgtggattctgatatccaatctagcgattttcccgagccccccgatgccctagaagccgacacctttcccgatgaaatccaccatccaaagatgactgtggaacccagctttaacgatgctcatgtttcgaaatttagtgaccagaattccaccgagctcatgaattcggtaatggtacggaccgaagaggagattagcgacacagacctaaagcaggaggaatcaccatctgacctggcctctgcatacgtgactgagggcctcgaaagccccactatagaggagcaggtggaccagacaatcgacgacgaaacaattctcatcgtgccctccccacacggtttcattcaggcctcagatgttattgatacagaatcagtgctgcccctcaccactctgacagaccctattctccaacaccatcaggaggagtccaacatcatagggagctccctggggagccccgtatcggaggattctaaagatgtagaggatctggtgaactgccattag

SEQ ID NO: 14706 - DNA, 735 bp, Artificial Sequence
  Description of Artificial Sequence: Synthetic coding sequence
atgtccacggtggaagaagatagtgatactgtcacggtagaaaccgttaattcagtgactttgactcaggataccgagggcaatctcatccttcattgcccgcaaaatgtttctgaaaacgaccaatccttcgaagtcaccatgactgccacaacagaggtcgccgatgatgaagtcacggagggcacagtcacccagatccagattttgcagaacgaacagcttgacgagattagtcctctgggcaatgaggaagtgtcggcagtctcccaggcgtggttcactaccaaagaggacaaagacagtttaaccaataaagggcataagtggaagcaggggatgtggtcaaaagaggagatcgacattctgatgaacaacatcgagcgctacctcaaagccaggggaatcaaggatgccacagagatcatctttgagatgtcaaaggacgaacgcaaagatttttaccggaccattgcctggggactgaataggcccctgttcgcagtctacaggagagtactgaggatgtacgatgaccgcaatcatgttggaaagtatactccagaggaaatagaaaagttaaaggaaaagaaggctatcgcggcctgtttcttctttactcatagacagctgtggacgcctaaaaagggtcacacatttaagctgtggctgagcaagtattgttgtccccagctcccaaaccagagtaatggaaagaagaaaaacgaagagtag

SEQ ID NO: 14707 - DNA, 819 bp, Artificial Sequence
  Description of Artificial Sequence: Synthetic coding sequence
atgtcaaccgttgaggaggatagtgacacagtcaccgtagagacagtgaactccgtgacgctgactcaagatacagaggggaatctaatcttgcattgtccgcagaacgaggctgacgaaattgactccgaagactctattgaacccccacacaaaagattgtgtctatcctctgaggatgaccagagcatcgatgacagcactccgtgcatttccgtggtggctctgcccctgagtgaaaatgatcagtccttcgaggtgacaatgaccgcgaccacagaagtggccgacgatgaggtcacagagggtacagtgacgcagatacagatcctgcaaaacgagcagctggatgagatcagccccctgggaaacgaggaagtgtccgccgtgtcccaggcgtggttcacaacaaaagaggacaaggattccctcacaaacaagggtcataagtggaaacagggtatgtggagtaaagaagaaattgatatactcatgaacaacatcgagcgatatttaaaagcgagaggaataaaggacgccacagagataatcttcgagatgtcaaaagacgaaaggaaggatttctatcgcacaattgcttggggcttaaataggccactgttcgccgtatatcgtagagttttgcggatgtatgacgaccgcaaccacgtgggtaagtacactcctgaggagattgagaagctcaaagagcagctgtggacgcccaagaaaggccacacgtttaaactctggctgtccaagtattgttgtccccagctccctaatcaatctaatggcaaaaagaagaatgaagaatag

SEQ ID NO: 14708 - DNA, 2073 bp, Artificial Sequence
  Description of Artificial Sequence: Synthetic coding sequence
atgtcaacagtcgaggaagactccgacaccgtcaccgtggaaaccgtcaattctgtcaccctgactcaggatacagaaggtaacttgatcctgcattgtccccagaacgaggcagatgagatagattcggaagattcgatcgaacctcctcacaaaagactctgcctctcttctgaagacgaccagagtatcgatgatagtacgccttgcatttccgtagtcgctctccccctctccgaaaacgatcaatccttcgaagtgaccatgacagccacaaccgaggtcgccgacgatgaagtgaccgagggtaccgtgacacagatccaaatcctgcagaatgagcaactcgatgagattagccctctcgggaacgaagaggtttcagcagtgagccaggcttggttcactaccaaggaagataaggacagtctcactaataagggacataagtggaagcagggcatgtggtctaaggaagaaatagacatcctgatgaacaacatcgaacgatacctgaaagccagggggataaaagacgctacggagataattttcgagatgagtaaagacgagcggaaagatttttacagaacaattgcctgggggctcaaccgccctctgttcgccgtatatagaagagtcctgcggatgtatgatgacaggaaccacgtaggcaaatacaccccagaagagatcgaaaaacttaaggagctgcgaataaaacacggaaacgactgggctactataggggccgcgctaggaagatcggcatcctcagtgaaggacaggtgccggttaatgaaggatacatgtaatacaggaaagtggaccgaagaagaagagaagcgtctggcggaggtggttcacgagctgaccagcacggaacctggagatattgtgacacagggagtttcatgggctgccgttgcggagagagtcgggacaaggagcgaaaaacaatgccggagcaagtggttaaattatctgaattggaaacagtccggcggcaccgagtggacaaaggaggatgagataaatctcatactgcgtatcgcagaactggacgtggcagatgaaaacgacattaattgggacctattggccgaggggtggtcctcagtccggagcccccagtggctgcgctcaaaatggtggacgataaaaagacagatagccaatcacaaagatgtgagtttccctgcttcagccgatagtccagcgaccgtcgatagtgaaactattacactgaacagcggaacattgcagacattcgaaatccttccctcttttcacctgcagcccactggtacacctggcacctacctgcttcagacgtctagtagccagggcttgcccctgacgctaacagcctcccccacagtcactctgaccgccgcggctcctgcctcgcccgaacaaatcatagtgcatgctctgagtcctgaacacctattgaatacctctgacaacgttactgtccagtgccataccccaagggtgattatacagaccgtcgccacagaagatattactagcagcatatcacaggccgaactgactgtcgatagcgatatccagtcctccgacttcccagagccccctgacgccttggaagcagatacgttccccgacgagatccaccaccctaaaatgacggttgagcccagtttcaacgatgcccatgtctcgaaattcagtgaccagaattccacagagcttatgaattcagtgatggttcggacagaagaagagatatccgacaccgacttgaaacaggaggaaagtccaagtgacctggcttcagcctatgttacagaaggcctggaatcccccactatcgaggaacaagtagaccaaaccattgatgatgagactatactgatagtgccatccccacacggcttcattcaagcctcagatgtgatagacacggaaagcgttctgcctttgacgacattgactgaccctatcctccagcaccaccaggaagagtccaatatcatcggtagctcattgggtagtccagttagtgaggattcgaaggacgtcgaggacttggtgaactgtcattag

SEQ ID NO: 14709 - DNA, 1485 bp, Artificial Sequence
  Description of Artificial Sequence: Synthetic coding sequence
atgaaagacacatgtaataccggcaagtggacagaagaagaagaaaagcgattggcagaagtcgtgcacgagctcacatccactgagccaggcgatatcgtaacccagggagtctcttgggctgccgttgcagaacgagtgggcacacggagcgagaaacaatgtcggagcaagtggctcaactacctgaattggaagcagtcgggcggtactgagtggacaaaagaagacgagatcaacctgatcttgcggatcgcagaactcgacgtggccgatgagaatgacattaattgggaccttctggccgaagggtggtccagcgtaagatcgccacaatggttgcggtccaagtggtggacaatcaagaggcaaattgcaaatcacaaggatgtctcatttcctgtgcttatcaagggcttgaaacagcttcacgagaaccaaaaaaataatcccacccttcttgagaacaaatccggttccggcgttcccaatagtaacaccaattcttcagttcagcacgtgcaaattagagtcgccagactggaagataatacagccataagtagcagtcctatggcggctctacagatccctgttcaaatcactcacgtctctagtgctgactcgccagccacggtcgactctgagacaatcaccttaaacagcggcacactccagacctttgaaattttgccatcctttcatctgcagcctaccggcacaccgggcacttacctcctccagacctctagctcccagggcttaccgctaactctgacagctagcccaacagtcaccctgaccgctgctgcacctgccagcccagaacagattattgtacatgctctcagccctgaacacctgctcaacacctccgataacgtgaccgtgcagtgtcacacaccgcgggtgattatccaaacggtcgccacagaggatatcacttcaagtatcagtcaggccgagctgaccgtcgactcagatatccaatccagcgacttccccgagccacccgatgctcttgaggcagatacctttcctgacgagatccaccacccgaaaatgactgtggaacctagctttaacgacgctcacgtgagtaaattttcagatcagaacagcaccgagctcatgaatagcgtgatggttcgcacagaggaagaaatctcagataccgacttgaaacaggaagaatcgccctccgaccttgcaagtgcctatgttaccgaggggcttgagtcccccacaatcgaggagcaggtcgaccaaactattgatgatgagacgatcctgatcgtgccgtctccccacggcttcatccaagcttccgacgtcatcgacacagagtccgttttgcccctgaccacactaaccgatcctatccttcagcatcatcaagaagagagcaatataattgggagttcgcttgggtcccctgtgtccgaggatagcaaggatgtagaagatctcgtgaactgtcattag

SEQ ID NO: 14710 - DNA, 111 bp, Artificial Sequence
  Description of Artificial Sequence: Synthetic coding sequence
atgtcaacagttgaggaggacagcgacacggtgacagtggagaccgtaaacagtgtgactctgacccaggacactgagggcaacttaatactgcattgtcctcagaattag

SEQ ID NO: 14711 - DNA, 33 bp, Artificial Sequence
  Description of Artificial Sequence: Synthetic coding sequence
atgaccgccactacggaagtggccgatgactag

SEQ ID NO: 14712 - DNA, 111 bp, Artificial Sequence
  Description of Artificial Sequence: Synthetic coding sequence
atgtctaccgtggaagaggactctgacaccgtcaccgttgaaacagttaattctgtgacactgactcaggatacagaagggaacctcatactccattgtccccagaattag

SEQ ID NO: 14713 - DNA, 735 bp, Artificial Sequence
  Description of Artificial Sequence: Synthetic coding sequence
atgtctactgtggaggaggactcggataccgtgacagtcgaaaccgtaaactcagtcacactaacacaggacacggaagggaacctgattttgcattgcccacaaaatgtgtcggagaacgaccaaagcttcgaagtcaccatgaccgccacaacggaagtcgccgacgacgaggtgacagaagggactgtaacacagatccagattctgcagaatgagcagttagacgaaatatccccgctgggcaacgaggaggtgagcgccgtgagccaggcctggttcactacaaaggaggacaaagactcactaacaaataagggccacaagtggaagcagggtatgtggtcgaaagaggagattgatattttaatgaacaatattgagcggtatctgaaggccaggggcattaaagacgccacagaaatcattttcgagatgagtaaagatgaacggaaggatttttacaggacaattgcctggggacttaataggcctctgtttgcagtatacaggcgagtccttcggatgtatgatgaccgcaaccacgtaggtaagtacactcctgaagagatcgaaaagcttaaagaaaaaaaagcaatcgctgcctgctttttctttacccacagacagctatggactcctaagaagggccacacattcaagctgtggttatctaagtactgctgcccacaattgcctaaccaatctaacggtaaaaaaaaaaacgaggagtag

SEQ ID NO: 14714 - DNA, 582 bp, Artificial Sequence
  Description of Artificial Sequence: Synthetic coding sequence
atgagcactgttgaagaggattctgatacggtgaccgtcgagaccgtcaatagtgtaacactgactcaggacactgaaggaaacctgatcctccattgcccccagaacgaagccgatgagatcgattcagaggactcaatcgagcccccgcacaagagactctgtctgagcagcgaggacgaccagagcatcgacgacagcaccccttgcatttccgtggttgcactgcccctttcggaaaatgaccagtctttcgaggtgacgatgaccgcaacaacagaggtggccgacgacgaggtaaccgagggcactgttactcagatccagatcctccagaacgagcaattagacgagatcagtccgctaggcaatgaggaagtatcagccgtgtcacaggcttggtttactacgaaggaggataaggatagcttgacaaataaaggacacaaatggaagcagggaatgtggtccaaggaagagattgacattcttatgaacaacatcgagagataccttaaagccaggggaataaaagacgccaccgagatcatcttcgaaatgtccaaggacgaacgcaagtag

SEQ ID NO: 14715 - DNA, 84 bp, Artificial Sequence
  Description of Artificial Sequence: Synthetic coding sequence
atgtccacagtggaagaggatagcgatactgtgaccgttgaaaccgtgaacagtgtgactttgacccaagatactgaaggatag

SEQ ID NO: 14716 - DNA, 444 bp, Artificial Sequence
  Description of Artificial Sequence: Synthetic coding sequence
atgagcacggtagaggaggactccgacaccgtgacggtagagacagtgaactctgtgacgctaacccaggatacagaagggaatctgatacttcattgccctcagaacgaagctgacgaaatcgatagcgaggactctatcgagccccctcataaacggttgtgtctgagcagcgaagacgaccagtccattgatgacagcaccccatgcatcagcgtggttgcactgccactctctgaaaacgatcagtcattcgaggtgacgatgacagctacaactgaggttgcagatgacgaagtgacggagggaacagtcacacagattcaaatccttcagaatgaacaactggatgaaatctcccctctgggcaacgaagaagtgagtgctgtgagccaggcttggttcactactaaggaggataaggatagcctgacgaataagtag

SEQ ID NO: 14717 - DNA, 222 bp, Artificial Sequence
  Description of Artificial Sequence: Synthetic coding sequence
atgagcaccgtggaggaagattccgatacagtgacagtcgaaactgtgaattccgtcacgctcacgcaagacaccgaaggcaacttgattctgcattgccctcagaatgaggctgacgagattgactccgaagattctattgagcctccccacaagaggctttgcctgtcctccgaggacgatcagagcatcgatgactccaccccgtgtatttccgtctag

SEQ ID NO: 14718 - DNA, 2019 bp, Artificial Sequence
  Description of Artificial Sequence: Synthetic coding sequence
atgaccgcaacgacagaagtagccgatgatgaggtcacggagggaaccgtgacgcaaatccagattctccagaatgagcagctggacgagatctctcccctcggaaatgaggaggttagcgccgtcagccaggcctggtttaccacaaaggaagataaagatagtttgaccaataaaggtcataagtggaagcaggggatgtggagcaaagaggaaatcgacatcctcatgaataatattgagaggtacttaaaagcgcgcgggatcaaggatgccacggagattatttttgagatgtcaaaagacgaaagaaaggacttttacagaactatcgcttggggattaaatagacccctgtttgcagtgtatagaagagtcctaaggatgtacgatgataggaatcacgtaggaaagtacaccccagaggagattgaaaaactgaaagagctacgtatcaaacatggtaatgactgggcaacaattggcgccgctttgggaagatccgcctcttccgtcaaggacaggtgccgattgatgaaagacacctgcaatactggaaagtggaccgaagaagaagagaagcggctcgccgaggtggttcacgagctgacaagcaccgagccgggtgatattgttacacagggtgtctcctgggccgccgtggcggaacgcgttggcactcgcagtgaaaagcagtgccgtagcaagtggctgaactatctcaactggaaacagtctggcggcacagaatggacgaaggaagatgaaataaatttgattttaaggatcgccgaactcgacgtggccgatgaaaatgacatcaactgggaccttctagctgagggttggtcatcagtgcgttccccgcagtggctgcggagcaaatggtggactatcaagcgacagattgctaatcacaaggatgtgtcctttcctgttttaattaagggactgaaacagctccacgagaaccagaagaacaatcctacattgctcgaaaacaagtctgggtccggcgttcccaatagcaataccaattcttcggtgcagcatgtgcagattcgcgtggcacgattggaagataacactgctatttcctcctctcctatggcagctctgcagatccccgttcagattacgcacgtgtcttccgccgacagccccgccacagttgatagtgagacaatcactcttaactccggaactctgcaaacgtttgagatcctgccatcattccaccttcagcctactggcactcctggtacctacttactccagacgtcgtctagccaaggtctcccgctcaccctgactgcatcgccaacggtgacactaaccgccgcagcgccagcgtccccagaacagatcattgtccatgccctatctccggaacatctacttaatacctccgacaatgtgacagtacagtgccatacacctcgcgttattatacagactgttgccaccgaggatatcacgagctccattagccaagcagagctgacagttgactccgacatccaatccagcgactttccagagccgccagacgcgctagaagctgacactttccccgacgagattcaccatcccaagatgaccgtcgagccatcatttaacgatgcgcacgtgagcaaattctcagatcaaaactctactgagctaatgaattccgtgatggtacgcacggaagaagaaatatctgacacagatctcaagcaggaggaaagtccctcagatctggcgtccgcctatgtcactgagggcctggagtcacctacaattgaggagcaggtggaccagacgatcgatgacgagacgatactgattgtgcctagtcctcatggatttatccaggctagcgatgttattgatactgaaagcgtgctgccgctcactaccctgaccgatccgatcctgcagcaccaccaggaggagtctaacataatcgggagctccctgggctcgcctgtctcagaggattctaaggatgtcgaagatctggtgaactgtcattag

SEQ ID NO: 14719 - DNA, 291 bp, Artificial Sequence
  Description of Artificial Sequence: Synthetic coding sequence
atgtcgacagtcgaggaagactctgacactgtgaccgtcgagaccgtcaacagtgttacactcacccaggacaccgagggcaatctgatactacattgtcctcaaaacgaagccgatgagatcgattctgaggactcgatcgaacccccgcacaagcgcttgtgcctttctagtgaagacgaccagagcatcgacgattcaacaccttgcatttccgttgtggccttgcccctcagcgaaaacgaccagagcttcgaggtcactatgactgctaccactgaggtcgcctag

SEQ ID NO: 14720 - DNA, 171 bp, Artificial Sequence
  Description of Artificial Sequence: Synthetic coding sequence
atgtcaacagtcgaggaggatagtgataccgtcacagtcgaaaccgttaactcggtgaccttgactcaggatacggagggaaatcttatactgcactgtcctcagaatgaggctgacgaaatcgactcagaggacagtatcgaacctcctcacaagcggctctgcttatag

SEQ ID NO: 14721 - DNA, 858 bp, Artificial Sequence
  Description of Artificial Sequence: Synthetic coding sequence
atgtcaacagtggaggaggattctgataccgtgacagtcgagaccgtgaattctgtaactttgacacaggatactgaaggtaacctcatcctgcactgccctcagaacgaggctgacgagatcgattccgaagattcgatcgagcctccacataaacgcttgtgcctatcatcagaggacgaccagagcattgatgacagcacaccctgtatttccgtggttgctctgccactgtccgagaacgaccagagctttgaagtgacaatgaccgccactacagaagtcgccgatgatgaggttacggagggcacagtgacacagatccagatattgcagaatgagcaactggacgagattagtcccctgggaaatgaggaagtctctgccgtgtcacaggcctggtttacgacaaaggaggacaaagatagtctgaccaacaaagggcacaagtggaagcagggaatgtggagcaaggaagaaatcgatattttgatgaataatatcgaacggtacttaaaggctcgcggcatcaaggacgccacagaaatcatcttcgagatgtccaaagatgaacggaaagatttttatcgtacgatcgcctgggggctcaaccgtccgctctttgcagtatacaggcgcgtgctgcgaatgtacgatgaccggaaccacgtaggaaaatatactcctgaagaaatagagaagctaaaggagaaaaaagctattgcagcttgttttttcttcacacatcgacaactgtggaccccaaagaagggccacactttcaaactgtggctgtctaaatattgctgtcctcagctccccaaccagtctaacggcaaaaagaaaaatgaagaatag

SEQ ID NO: 14722 - DNA, 150 bp, Artificial Sequence
  Description of Artificial Sequence: Synthetic coding sequence
atgtctacagtcgaagaggactctgacaccgttaccgtggaaaccgtcaatagcgtcacccttacgcaagataccgaagggaacctgattctgcactgcccacagaatgaggcggacgaaattgacagcgaagactcaattgagccctag

SEQ ID NO: 14723 - DNA, 330 bp, Artificial Sequence
  Description of Artificial Sequence: Synthetic coding sequence
atgtctaccgttgaagaggacagcgacaccgtgactgtggagacggtgaatagcgtgacgttgacacaggatacagagggcaatctcattcttcactgccctcagaacgaagcagacgaaatcgactccgaagactcaatagaacctccccacaaacgactctgcctaagtagcgaagacgaccagagcattgatgacagcaccccatgtatcagcgtggttgcgctgccattaagcgagaatgaccaatccttcgaggtgacaatgacagctacaactgaggtcgccgacgacgaggtgaccgagggtacggtgactcaaattcagtag

SEQ ID NO: 14724 - DNA, 276 bp, Artificial Sequence
  Description of Artificial Sequence: Synthetic coding sequence
atgagcacagtcgaagaagactcggatactgtgacagtagagactgtcaatagcgtgactctgacccaggataccgaggggaatctcatcctgcactgccctcagaatgaggccgacgagatcgactcagaggattcaattgagcccccacataaacgactctgtctatcatcagaagatgaccagagcatcgacgattccacaccttgcattagcgtcgtcgccctgcccctgtccgaaaacgaccaatccttcgaagttaccatgacagcctag

SEQ ID NO: 14725 - DNA, 1647 bp, Artificial Sequence
  Description of Artificial Sequence: Synthetic coding sequence
atggcaacgggagcgaacgccaccccactcgattttccatccaaaaaaaggaagagaagcaggtggaatcaggacaccatggaacagaagactgttattcctgggatgcccacagtgattccgccaggattaacgcgcgagcaggagagagcatacattgtacaactgcagattgaagatctgacaaggaaactcagaactggagatctgggaatcccacccaatcccgaggatcggagcccctctcctgagcctatctacaattccgagggtaagaggcttaacacaagagagttcaggacacgcaagaagctggaggaagagcgccataatcttattactgagatggtggcactaaatccagattttaagcctcccgccgattataagccccctgcaacaagggtgagtgacaaagttatgatcccgcaggatgagtatcctgaaattaatttcgttggactcctgatcgggccaaggggtaatacgttaaaaaacattgaaaaagaatgcaacgccaagataatgatccggggtaaggggagcgttaaggaaggtaaggttggtagaaaagacggccagatgctgcccggcgaggatgagcccttacacgccttggtgactgctaatactatggagaacgtgaagaaggcggtggaacagatcagaaatatcttgaagcagggcatcgaaacacccgaagatcagaatgaccttcggaagatgcagcttagagagctcgctcgtctgaacgggactctgcgtgaggacgataacaggatccttcgcccctggcagagttctgagactaggagtattacaaacacaaccgtgtgcacgaaatgtggcggggccggacacattgccagcgactgcaaatttcagagacccggcgacccgcagagcgctcaggacaaagctaggatggacaaagagtatttgtcccttatggcagaactgggggaggccccagttcctgccagcgtcggctcaaccagtggcccagcgactaccccactggcaagtgcgccgcgtcccgcggctcccgcgaacaacccgccacctccctctctgatgtctaccacacaaagtagaccaccctggatgaacagtggaccatctgagagtcgtccctatcacggcatgcacggaggcgggccggggggacctggaggggggcctcactctttccctcaccccctgccatccttgacaggagggcatggtggccacccgatgcagcataatccaaacggtccaccaccgccatggatgcagccacctccaccaccaatgaatcagggcccacacccccccggtcatcatggtcctcccccaatggatcagtatctaggttcaaccccagtcggttccggcgtttacaggctgcatcagggcaagggaatgatgccacccccccctatgggtatgatgcccccaccacccccccccccaagcggccaaccccctcccccaccatctggaccgctaccaccttggcaacagcagcagcagcagcccccgccacccccgcccccttcgtcctccatggcctcctccacaccacttccttggcagcaaaggagcctacccgccgccgccatggctcgggctatgcgggtccgtacgttccgggctcattggtag

SEQ ID NO: 14726 - DNA, 486 bp, Artificial Sequence
  Description of Artificial Sequence: Synthetic coding sequence
atggaacaccagctgctgtgctgcgaagtcgagactattcgccgagcttatcccgacgctaatctgctgaacgatagggtgctgagggctatgctgaaagccgaagagacttgcgctcccagtgtgtcttactttaaatgtgtccagacattcgtggccctgtgtgccactgatgtgaagtttattagtaaccctcccagcatggtagccgcaggttccgtggttgccgcggtgcaaggcctgaacctgcgctcacccaataatttcctttcatactaccgcctgacccgatttctttctagggttattaaatgtgatcctgactgtctaagagcctgccaggagcagatcgaggcccttcttgaaagtagcctccggcaagcccagcagaatatggaccccaaggcagctgaagaagaggaggaagaagaagaggaagtcgacttggcctgcaccccaacggacgtccgggacgtcgacatttag

SEQ ID NO: 14727 - DNA, 870 bp, Artificial Sequence
  Description of Artificial Sequence: Synthetic coding sequence
atggaattactatgccacgaggtggaccccgtgagaagagccgtcagggataggaatctcctacgcgatgatcgggtgctgcagaacctgttaaccattgaggagaggtacttgccccagtgcagttacttcaagtgcgtacagaaggacattcagccatatatgcgacggatggtggcaacctggatgctcgaggtgtgtgaggagcagaaatgtgaagaggaggtgtttcctctcgccatgaattacctggaccgttttctggcaggtgtgcccaccccaaagtcccatctccagctgctaggcgctgtgtgtatgttcctggcctcaaaacttaaagagacaagccccttgaccgctgagaagctgtgtatctacaccgacaatagtatcaagccacaagagttattggagtgggagttagtggtgctgggcaaattaaagtggaatttagctgcagtgaccccacacgatttcatcgagcacattctcaggaagctcccccagcagagggaaaaattgtcattaattcggaaacatgcacagacttttatcgctctgtgcgccaccgactttaaatttgcaatgtatcccccctctatgatcgcaacagggtcagtgggcgctgcaatctgtgggctacagcaggatgaggaagtgtcctcactaacttgcgatgcactgaccgagctgctcgccaaaataactaatacagacgtggactgcttaaaggcatgccaggaacaaatagaggctgtgctgctgaacagtctgcaacagtacaggcaggatcaacgcgacgggtctaaaagcgaggatgagctggaccaggcttccacacccactgatgtgcgcgacatcgacctttag

SEQ ID NO: 14728 - DNA, 729 bp, Artificial Sequence
  Description of Artificial Sequence: Synthetic coding sequence
atgaagtccgccgggggcagcgggcgtagccttttaccttcgcccagggtttgtgaagaacagcgttgtgaagaggaggtctttcctcttgcaatgaattatctggacaggtatctgtcctgcgttccgaccaggaaagctcagctgcagctgcttggtgcagtttgcatgctgctagccagcaagctgagagaaaccaccccccttacgattgagaagctgtgtatctacacagaccacgcagtgtctcccaggcagctgcgcgactgggaagttctcgtgttgggaaaactgaaatgggacctcgcagccgtgatcgctcacgactttctggcatttatactgcacagactgagtcttccgcgggaccgccaagctctagtgaagaagcatgctcaaactttcctggcactgtgcgcaacagactacacattcgccatgtatccccctagcatgattgccaccggttccattggggccgccgttcaagggctgggcgcctgctctatgagtggtgacgagctgacggagctgctggccggcatcaccgggactgaggtggactgcctcagggcatgtcaggagcagatagaagcagctcttcgagagagccttcgcgaggcaagccagacatccagtagccccgcaccaaaggcaccgagaggctcctcgagtcagggaccttcccagacatctacacccactgacgtcactgcaatccacctatag

SEQ ID NO: 14729 - DNA, 636 bp, Artificial Sequence
  Description of Artificial Sequence: Synthetic coding sequence
atgaattatttggatcggtacctttcttgtgtgcctacacggaaggctcagctgcagctgttaggcgcggtgtgcatgctccttgcctcgaaactacgagaaaccaccccattgaccatagaaaagttgtgcatttacacggaccatgcagtcagtcccaggcaacttcgggactgggaggtgttagtacttggcaagctgaaatgggacctcgccgccgtaattgcgcatgacttcctggcgttcattctccaccggttatcactgccacgcgatcgtcaggccctggtcaagaaacatgcccagacctttttggcattgtgtgccaccgattacacttttgccatgtatcccccatcaatgatcgccacggggtccatcggcgccgctgttcagggattgggcgcctgttccatgagcggggatgaactcactgaactgctcgccggcatcactggaaccgaggttgactgcctccgcgcctgccaagaacagattgaggccgcactgagagagagccttcgagaggctagccaaacatccagttctcctgcaccaaaggctccccgcggaagcagtagtcagggtccttcacaaacctccacccccacagatgtgactgctattcacctctag

SEQ ID NO: 14730 - DNA, 879 bp, Artificial Sequence
  Description of Artificial Sequence: Synthetic coding sequence
atggagctgctttgttgtgaaggcacccggcacgccccccgggcggggcccgacccccgactgctgggcgaccagcgtgtgctgcaaagtctccttcgtttagaagagagatacgtccctcgggcctcatatttccagtgtgttcagagggagatcaagcctcatatgagaaaaatgctagcctactggatgcttgaggtctgtgaagagcagagatgcgaagaagaggtgttcccactagcgatgaattacctcgaccggtacttaagttgcgtccccactcgcaaggcccaacttcaattgctcggagccgtctgtatgttacttgcctcaaagctccgggaaaccaccccactcactatcgagaagctgtgtatatacacggatcacgcggtgtcaccccgccaactccgcgactgggaggtccttgtccttggcaagttaaaatgggatttagccgccgtgattgctcatgattttctggcgtttattctccatagactgtctttaccgagggataggcaggccttagtcaagaagcacgcccagacctttctagccttgtgcgcaactgattacacattcgcgatgtacccaccttccatgatcgcaaccggctctatcggggcagcagttcagggcttgggcgcctgtagtatgtctggagacgaactgacagagctgctagctggcattacgggaacagaagtggattgtctccgggcatgtcaggaacagatagaggcggccctccgcgaaagcctccgtgaggcatcacagactagttcaagcccagcccccaaggcccccagggggagctctagccaagggcccagtcagactagcactcctaccgacgttaccgctatccacctgtag

SEQ ID NO: 14731 - DNA, 663 bp, Artificial Sequence
  Description of Artificial Sequence: Synthetic coding sequence
atggaacttttgtgctgtgagggcactcggcacgccccccgcgccggacccgatccaagactccttggagaccagcgcgtgctgcaatccctgttgcgattagaagaacgttatgtcccccgggcctcttacttccagtgtgtacagagggagataaagccgcatatgaggaaaatgctggcctattggatgctggaagactgggaagtgctcgtgctgggcaagctcaagtgggacctggccgcggtcattgcacatgactttctggctttcattctgcatcgattgtcacttcccagagacagacaggccctcgtgaaaaaacacgcacaaacgttcttggcgctctgcgccaccgactatactttcgctatgtacccgccttctatgattgccacagggtccataggggccgcagttcaaggcctgggggcttgcagcatgtcaggcgacgaactgacagaactgctggctggaattactggtactgaagtcgactgtctgagggcttgtcaggaacagatagaggctgcactgcgggaaagtctccgggaggcctcccaaacatcgagctctccagcccccaaggcaccccgtgggagcagttctcagggtcccagccaaactagcacgcctaccgatgtgacggcaatccacttatag

SEQ ID NO: 14732 - DNA, 291 bp, Artificial Sequence
  Description of Artificial Sequence: Synthetic coding sequence
atgtacccgccttccatgattgccacaggctctataggcgcggccgtccagggactgggagcctgcagcatgagcggcgacgaattaactgaactgctcgctggcattacgggaactgaagtagactgtttacgtgcatgtcaggaacagattgaagccgcattgcgggaatccctcagagaggcaagtcagacgtcttcatcaccagcccctaaggcacctcgcggttcctctagtcagggaccatcacagacatccactccaaccgatgtcaccgctatccatctgtag

SEQ ID NO: 14733 - DNA, 132 bp, Artificial Sequence
  Description of Artificial Sequence: Synthetic coding sequence
atgaactacctggaccgttacctgtcgtgcgtgccaacaaggaaagcacagctgcagctgctcggtgcggtctgcatgttgctggctagcaaattacgcgagactactcccctgaccattgagaaactttag

SEQ ID NO: 14734 - DNA, 357 bp, Artificial Sequence
  Description of Artificial Sequence: Synthetic coding sequence
atgaattacctggataggtacctgagctgtgtacctaccaggaaggctcaactgcagcttctaggagccgtctgtatgctcctggcttcaaaattgagggaaacaacaccactgacgattgagaaactttgtatatacacagatcacgccgtgtcgccccggcagctgagggactgggaagtgctcgttctcggcaagctcaaatgggacttagccgcagtgatcgcccacgactttcttgctttcattctgcaccgcctcagcctcccccgcgatagacaagctcttgtgaaaaagcacgcccagacttttctggcactgtgtgcgacggattacacattcgccatgtatccgtag

SEQ ID NO: 14735 - DNA, 33 bp, Artificial Sequence
  Description of Artificial Sequence: Synthetic coding sequence
atgtaccctcccagtatgatcgctacaggatag

SEQ ID NO: 14736 - DNA, 636 bp, Artificial Sequence
  Description of Artificial Sequence: Synthetic coding sequence
atgaactacttagaccgatatctctcatgcgtacccactaggaaagcccagctacaactgctgggagccgtatgtatgcttcttgcctccaagctgcgggaaaccaccccacttaccatagaaaagctgtgcatctacaccgaccatgctgtgtctccgcgtcaacttagggattgggaagtgctcgtgcttggtaaattaaaatgggacctcgccgcggtgatcgcccatgattttctggctttcatactccaccggctgtcactcccaagggataggcaggcactggtgaagaagcatgcccagacatttttggccctgtgtgcaaccgattacacattcgcaatgtacccacctagcatgatagctactggatctatcggcgccgcggttcagggtctaggggcctgttctatgtctggcgacgaactgactgaacttctggctggcattacaggaaccgaggtcgactgcctccgggcgtgtcaagagcaaattgaagcagcacttcgagagtcccttcgcgaggccagccagacgtcttcctccccggcaccaaaggctcctagagggtctagcagtcaggggccctcacagacctctacccccaccgatgttaccgccattcacctgtag

SEQ ID NO: 14737 - DNA, 1233 bp, Artificial Sequence
  Description of Artificial Sequence: Synthetic coding sequence
atgccaagggaacggcgcgaaagagacgctaaggaacgagatactatgaaggaagatggaggtgccgagttctctgctaggtcacgcaaaaggaaagctaatgtgaccgtgttcctgcaggatccagatgaagagatggctaagattgatcggacagcccgcgaccagtgtgggagccagccttgggacaacaatgccgtctgtgctgacccttgctctcttatacccactccagacaaagaggacgatgaccgtgtgtaccccaactctacatgtaagccccggatcatcgcaccttcccgggggtccccgctgccagtcctgtcctgggcgaacagagaagaggtatggaaaatcatgttgaacaaggaaaaaacctacttacgtgatcaacacttcctggaacagcaccctttgctgcagcccaagatgagagccattctgctcgattggctgatggaagtgtgcgaagtgtacaaactgcatagggaaaccttctacttggctcaggatttttttgaccgctatatggcgacccaagagaacgtggtaaagaccctcctgcaactgatcgggattagcagcttgtttattgctgctaaacttgaagagatctatcctccgaaactacaccagttcgcctatgtgacggacggtgcctgctcaggcgatgaaattttgaccatggagcttatgattatgaaagccctgaaatggagactttcccccttaactatcgttagttggttgaacgtctacatgcaggtggcttatctcaatgacctacacgaagtcctgcttccacaatatcctcagcaaatctttatccagattgcggaactcctggatctgtgtgttctggacgtagactgtctcgagtttccctacggtatactggccgcctctgccctgtaccatttctcaagcagtgagcttatgcagaaggtgtccggttatcaatggtgtgacatcgaaaactgcgtgaaatggatggttccttttgccatggtgatccgcgaaacgggctccagcaagctgaaacattttaggggcgtggcagatgaggacgcgcacaacatccaaacccatcgggactcccttgacttgttggataaggctagagccaaaaaggccatgcttagtgaacagaaccgggctagtcctctgccctccggtctgcttacacccccacagagcggaaaaaagcaaagctcgggaccggaaatggcttag

SEQ ID NO: 14738 - DNA, 1104 bp, Artificial Sequence
  Description of Artificial Sequence: Synthetic coding sequence
atgcctcgcgagcgtagggaacgagacgccaaggaacgcgacactatgaaggaggacggaggagccgagttctctgcccggtccaggaagcggaaggccaatgttactgtgttcctccaagaccctgatgaagagatggcaaagatagacagaacagcgcgagaccagtgcggctctcaaccctgggacaataatgcagtgtgtgcagatccttgctcactgatacctacccctgacaaggaggatgatgaccgcgtttatccgaattctacatgcaagcctcgaatcattgcaccttcaaggggctctcctctgcctgtactgagctgggccaatagggaggaagtgtggaagatcatgctgaataaggaaaagacatacctccgggaccagcatttcctcgagcagcaccccctgttacagcccaagatgcgagctatcttactggattggttaatggaggtaagcctttccctcccagagatttaccccccgaaactccaccagttcgcctatgtgacagatggagcgtgtagtggcgatgagattttgaccatggaactaatgattatgaaggccctgaagtggcgtttgtccccgctgaccatcgtgagctggttaaatgtgtatatgcaggtggcctacctcaacgacctgcatgaggtgcttcttcctcagtacccacagcagatattcatacaaattgccgagctcctcgacttgtgcgtgttggatgttgattgtcttgagttcccatatggtatcctggctgcgagcgccctgtatcatttttctagtagtgagctgatgcaaaaagtttccggctatcagtggtgcgacatcgaaaactgtgtgaaatggatggtgccctttgccatggtgataagggagacaggatcttccaagttaaagcacttcaggggagttgccgatgaggatgctcacaacattcagactcaccgagactccctggacctactcgacaaagcacgggcaaagaaggcaatgctctcagagcaaaatcgcgcatcacccctgcctagcggcctgttaacgccgccccagtctggaaaaaagcaaagctccggccctgagatggcatag

SEQ ID NO: 14739 - DNA, 1188 bp, Artificial Sequence
  Description of Artificial Sequence: Synthetic coding sequence
atgaaggaagacggaggggccgaattttcagctcgaagcagaaaacggaaagctaacgtgacagtatttttgcaggaccctgacgaggagatggcaaaaattgaccggactgctcgggaccagtgtggatcccaaccctgggataataacgccgtgtgtgccgacccctgctcactaatcccaaccccagacaaggaagatgatgaccgggtatatccaaattccacctgtaaaccccgaataatcgcgccatcaagaggttcccctctgccagtgctgagttgggctaatcgagaggaggtttggaagattatgttaaataaagagaagacatacttgcgtgatcagcattttcttgagcagcaccccctgctgcagcctaagatgcgcgcaatactgctagattggcttatggaagtatgcgaggtgtacaagcttcacagagagactttctacttagcccaggacttttttgataggtacatggcgacccaggagaacgtggtgaaaactctcctccaactgatagggatctccagtcttttcattgctgctaagctcgaggagatttacccccctaaattgcatcaatttgcatacgtgaccgacggcgcctgctcaggggacgagatcctcactatggagcttatgattatgaaagcgttgaaatggaggctgtcccctctgaccatcgtgagctggttaaatgtttatatgcaagttgcgtatctgaacgatctgcacgaggttcttttgcctcaatacccgcagcaaatcttcattcagattgcggagctgctagacctgtgcgtgctggacgtcgattgtctggagttcccgtatggaatcttggctgcctcggccttgtaccactttagctcctctgaacttatgcagaaagtttcaggataccagtggtgtgacatcgagaattgcgtgaagtggatggtgccttttgccatggtaatcagggagaccggctcaagcaagctgaagcacttccgcggggtcgccgacgaggacgcgcataacatccaaactcatagagacagcctggatcttctcgataaagcccgtgcaaaaaaggccatgctgtccgagcaaaatagggcctctccgcttccctccggcctgttaacaccaccccaatcgggtaagaagcagtctagcggacccgagatggcatag

SEQ ID NO: 14740 - DNA, 2106 bp, Artificial Sequence
  Description of Artificial Sequence: Synthetic coding sequence
aggacctcctggccgtctgaactggccgcagaaaaaggcaacttcgaagctgccgttaagcttgggatcgcatatctgtacaacgaagggctctcggtgtccgacgaagcccgggccgaggtgaacggattgaaggcaagcagatttttctcgctggccgaacgactcaacgtgggggccgccccctttatctggctgtttatccgtcccccgtggagcgtgagcggatcctgttgcaaagccgtagtgcatgagtcgctgcgggccgaatgccagctacagagaacccacaaggcttccatcctccactgcctcggtagggttctctccttgttcgaggacgaggaaaaacagcaacaggcacacgatttattcgaagaggccgctcaccaggggtgtttgacttcgtcttacttgctttgggaatccgataggcggacggacgtgagcgaccccggaagatgcctgcacagtttccgcaagctgcgggactacgctgccaaagggtgctgggaggcccaactttcgttggcaaaagcctgcgccaacgccaatcagctgggcttggaagtgcgggccagctcagaaatcgtgtgccaactctttcaggcttcgcaggccgtgagcaagcagcaggtgtttagcgtgcagaaaggactgaacgacacaatgcgatatattttgatagattggctggtcgaagtggctaccatgaaggattttaccagcctgtgtttgcatctcaccgttgagtgcgtcgatcgctatctgaggcgtcgtctggtgccccgctaccgcctccagctccttggaatcgcctgtatggtaatctgtacacgttttatctctaaagagatcctgactatccgggaagctgtttggttaacggacaacacctataagtatgaggatttagtgcgcatgatgggagagatcgtgagcgccctggaaggcaaaatacgtgtaccaacagtggtggactataaagaggtactgctgactctcgtccctgtagaacttaggactcagcacctctgttcgttcctctgtgagttgtctttactccatactagcctatccgcgtatgctcccgcccgacttgctgccgccgccctgctgctcgcccgcctgactcacggacagacacagccttggaccactcaattgtgggacttgaccggcttctcctacgaggacctcattccgtgtgtgttgtcactgcacaagaagtgttttcatgacgacgctcctaaagattacagacaggtgagtctgaccgcagtgaaacaaaggtttgaggataagagatacggagaaatttctcaggaggaagttctgagctattcacagctttgcgcagctttgggcgttacgcaggactcacccgacccccctacctttttatctacgggggagatacatgcattcctgtcatccccctcagggaggcgaactaagcgcaaaagggagaattctctgcaggaagatcgggggtctttcgtgacaacacccactgctgagttatcttctcaggaggaaacactgctcggcagttttttagattggtccctcgactgttgctcaggatacgaaggagaccaggagtctgaaggcgagaaagaaggcgacgtcaccgccccatcgggcatcctcgacgtgacagtggtctacctgaatcctgaacaacactgttgtcaagagagctctgacgaagaggcctgccccgaggacaaggggccgcaggatccacaggcattggccttggatacgcaaattccagccacacccgggcccaagcccctggtgaggacctcaagggaacctggtaaggatgttacaaccagcggctatagttcagtgtctactgcatcaccgacttccagcgtggacggcggactcggcgctttgccacagcccacttcagttttatctttggactcagatagtcacactcagccttgtcatcaccaggcaagaaagtcatgcttacagtgtaggccaccatcgccaccggaatcttcagtgccccaacaacaggtaaaaagaataaacctctgcatccattctgaagaggaagatatgaacctggggcttgtgagactctag

SEQ ID NO: 14741 - DNA, 2361 bp, Artificial Sequence
  Description of Artificial Sequence: Synthetic coding sequence
atgggctccggtggggttgtgcactgccgctgcgcaaaatgcttttgctatccgacgaaaagacgcatccggcggcgcccacggaatttaactatcctgtcactccctgaggacgtgttattccatattctgaagtggctttccgtcgaggacatcctggcggtacgggcggtccactctcagctgaaagatctcgtagataatcatgcatccgtgtgggcctgcgcttcctttcaagagctgtggccatcgccaggaaacctcaagttgtttgagagggccgccgagaaaggcaattttgaagccgcggtaaaactggggatcgcctacctttacaacgaaggactatccgtaagcgacgaagctagggccgaggtgaatggcctcaaggcttcacgattttttagtctggctgagcgcctgaacgtgggggcagccccttttatctggctgtttattcggcctccctggagcgtatcaggatcctgctgcaaagccgtcgtgcatgaatccctgcgcgccgaatgtcagctgcagcgaacgcacaaggcttcaattttacattgcttgggacgggttttgagcttgttcgaggacgaggagaagcagcagcaggcacacgacctgtttgaggaggctgcccaccagggatgtctgaccagttcttatttgttgtgggaatctgacagacggacagatgtctctgaccccgggaggtgtctgcattcatttcggaagctcagagactacgctgctaagggttgctgggaggctcagctcagcctcgctaaagcctgcgccaacgccaaccagctcggtcttgaagtgcgagcctctagcgaaatcgtgtgtcagctttttcaagcctctcaggcggtgtcaaaacagcaggtgttttcagtgcagaaggggctcaacgacactatgagatacatactgattgactggctcgtcgaggtcgctactatgaaggattttactagtctttgtctgcacctgaccgtggaatgcgtggatcgctacctgagaagaaggctggttccccgctacagactgcagctgctgggcatcgcctgcatggtgatctgcacaagattcattagcaaggagatactgacaatcagggaagcagtgtggctcactgataatacatacaagtatgaagacctggtccggatgatgggcgaaatcgtctctgcactggaaggaaaaataagggttccgaccgtggtcgattacaaggaggttctcctgactctagttcctgttgagctgcgcacccagcatctttgctctttcctgtgcgagcttagcctgcttcacaccagcctcagtgcctatgcaccagcccgcctggccgccgcagctctgctcttagcgagactaacacacggccagacccagccatggacaactcagctttgggatctgacggggttcagctacgaagaccttattccatgcgttctgtccctgcacaagaagtgctttcacgacgatgcacccaaggactatagacaggtgtctctcactgccgtgaaacaacgctttgaagacaagaggtacggtgagatcagtcaggaggaggttctgagttattcgcagctgtgtgcagcactgggcgttacacaagactctcccgacccgccaaccttcctctctacaggggaaatccatgcattcttaagctcacccagcggcagaaggacgaaacgcaagcgggaaaattctctgcaggaggatagagggtccttcgtgacaactccaaccgccgagttgtctagccaggaggaaacccttttaggttcttttctcgactggtccctggattgctgcagtgggtacgagggggatcaggagtccgaaggcgagaaggagggcgatgtgaccgctccttctggaatcttagatgttaccgtggtttatctcaatccagaacaacattgttgtcaagaatcttctgacgaggaagcttgtcccgaagacaagggtccacaggatccccaggccctggccctagatacgcagatccccgccacgccaggcccgaaaccgctggtccgcacatcccgcgaaccgggtaaagacgtcacgacgtcaggatacagttcggtgtccaccgcaagtcccacttcctcagtggatggcggcttaggcgcactgcctcaacccactagcgtgctcagcctggactcagattcccacacccagccgtgtcaccaccaggctcggaagtcttgtctgcagtgtaggccacccagcccgcccgagtcaagtgtgccacagcagcaggtgaaacgaatcaacctttgtattcattccgaggaggaggacatgaacctcggcttagtgcgcctctag

SEQ ID NO: 14742 - DNA, 888 bp, Artificial Sequence
  Description of Artificial Sequence: Synthetic coding sequence
atgatcgaagtgctcacaaccactgactcacagaaactgctccatcaattgaatgccctgcttgagcaggagtctagatgccagccaaaggtttgtggcctccgccttattgagagcgcccacgataacggactccggatgactgctaggttgagagactttgaggtcaaagacctgttatcgcttacacaattcttcggctttgatactgagacattttccctggccgtgaatttgttagatcgcttcctgtcaaaaatgaaggtacagcctaaacatttaggctgtgtgggtctctcctgtttttacctcgctgttaaatcaatcgaagaggagcgcaacgttcctctggccactgaccttatccggattagtcagtacaggtttaccgtctccgacctcatgcgaatggaaaaaattgtgctggagaaggtgtgctggaaagtcaaagcaacaaccgcattccaattcctccagctctattactccttgctacaggagaacctgccgttggaaaggcggaattctataaattttgaaagactggaagctcagctgaaggcctgtcactgcaggattatcttctcgaaggcaaaaccttctgtgctggctttgtccattatcgcgctcgaaatccaggctcagaaatgcgtcgagctcaccgagggcattgagtgcctgcagaaacatagcaagatcaatgggcgggacctaactttctggcaggaactggttagcaagtgtctgacggaatactcgagcaacaagtgctccaaacccaatgttcagaagttaaagtggatcgtgtccggccggaccgctcgacaactgaagcactcttattatcggatcacgcatctgcccacaatcccggagatggtgccgtag

SEQ ID NO: 14743 - DNA, 888 bp, Artificial Sequence
  Description of Artificial Sequence: Synthetic coding sequence
atgatcgaagtactgaccacaacagactctcagaagctgctgcaccaactgaatgcacttctagagcaggagagccgttgtcagcccaaagtgtgtggcctacgactcattgaatctgcacacgataacggccttcggatgaccgcccgtctgcgggatttcgaggtgaaggatttactgtctctgactcagttctttggtttcgacactgagacctttagtttggcggttaatttgctggatagatttctgtctaaaatgaaagtgcagcccaaacacttaggatgcgtcgggctctcttgtttttatctcgcagtgaaatcaattgaggaggaaagaaacgtgccgctagcaacagacttgattaggatcagccagtatcggtttacagtgtccgacctaatgcggatggaaaagattgttctggagaaggtgtgttggaaggttaaggccacaacagcgtttcagtttctgcagctttactattcactactccaggaaaatctccctctggagagaagaaatagcatcaactttgagaggctagaagcccagctaaaagcgtgtcactgccggatcatattttcgaaggcaaagccaagcgtgttggcgctctccattatcgcattggagatacaagctcaaaaatgtgtcgaactgaccgaagggattgagtgcctgcaaaagcacagcaagataaacggcagagatctcaccttctggcaggagcttgtctcaaaatgcctgacagagtatagttccaataaatgttcaaaaccaaatgttcagaagctcaaatggatcgtgtctggtaggaccgcacgtcagctcaagcacagttattacaggatcacccatctacccacaattccagaaatggtcccctag

SEQ ID NO: 14744 - DNA, 411 bp, Artificial Sequence
  Description of Artificial Sequence: Synthetic coding sequence
atgatcgaggtcctgacaacgacagattcccagaagttgctgcatcaactgaatgcgctgctagaacaggaatctcgctgccagcccaaagtttgcggcctgcgcttgatcgagtcagcgcacgataatggcctgcgcatgactgccaggctccgggacttcgaagtcaaggacttactgtcactgacccagttctttgggttcgatacggagacattttccctcgctgtgaacctgttagacagatttttgagtaaaatgaaggtgcagccaaagcacttgggttgcgtcgggctgagctgtttctatcttgcagtgaagagtattgaggaggaacggaatgtaccgctggcaaccgacctgatcagaatcagccaatataggttcaccgtttctgacctgatgaggtag

SEQ ID NO: 14745 - DNA, 411 bp, Artificial Sequence
  Description of Artificial Sequence: Synthetic coding sequence
atgattgaggtcctgactaccactgattcccagaagctcctccatcaattgaacgctttattggaacaggaatctaggtgccagcctaaagtttgtgggctgcggctgattgaatccgcacacgacaatggacttagaatgacggctaggctgagagatttcgaggtaaaagacctgctgagcctcacccaattttttggtttcgacactgagacattctcactggcagtgaacctgctcgatcgattcttgtccaagatgaaggtgcagcccaaacatttgggctgtgtgggcctctcctgcttctatctagcagtgaagtccatcgaagaggagcggaacgtacctcttgctactgacctcattagaatctcccagtatcggtttaccgtctccgatttgatgcggtag

SEQ ID NO: 14746 - DNA, 504 bp, Artificial Sequence
  Description of Artificial Sequence: Synthetic coding sequence
atgtccgcgaaagatcttatgcgtatggagaagattgtcctagagaaagtttgttggaaggtcaaagccacaacggcattccagttcctgcagttgtactattctttgctgcaggaaaatctgccgctagagcgacggaacagcatcaatttcgagaggctcgaggctcagctcaaagcctgccactgtcggatcatcttctcgaaggcaaaaccgtcggttctagcgctgagtatcattgccctggaaatccaggcccagaagtgcgtagagcttactgagggcattgagtgtttgcagaaacacagcaaaatcaatggtcgagacctcacgttttggcaggagttagtgtctaagtgcctgactgaatacagctcaaacaagtgctctaagccaaacgtgcagaaattgaaatggatagtatcaggaaggacagcacgtcaattgaagcactcttactatagaataactcacctgcctactatccctgagatggtcccctag

SEQ ID NO: 14747 - DNA, 348 bp, Artificial Sequence
  Description of Artificial Sequence: Synthetic coding sequence
atgatcgaagtgttgaccacgaccgattcacagaagctgctccaccaactgaatgcgctgctggagcaggaatctcgctgtcagcccaaggtgtgtgggctgcgactgatcgagtcagcacatgataacggcttacggatgactgcgcggcttcgagatttcgaagtgaaggatctcctgtcactgacacagtttttcgggtttgataccgaaacattcagccttgccgtcaatctccttgatcgctttctgtccaagatgaaggtgcagcccaaacatttggggtgtgtgggcctgtcatgcttttatttagccgtcaagtccatagaagaagaacgcaacgtttag

SEQ ID NO: 14748 - DNA, 486 bp, Artificial Sequence
  Description of Artificial Sequence: Synthetic coding sequence
atgcggatggagaagatcgtgctggaaaaggtgtgttggaaagtgaaggcaaccacagcttttcagtttcttcagctctactattccctgctccaagagaatctgcctctggaacggcgaaattcaataaatttcgagcggctggaagcacaactgaaggcttgtcactgtagaatcatattcagtaaggctaaaccttccgtcctcgctctgtcgatcatcgcgctggagatacaggcccaaaaatgtgtcgagctgacagaagggattgagtgtcttcagaagcacagtaaaattaacgggcgcgatctcacattctggcaagagctggtgagcaagtgtttaacggagtacagcagcaataagtgcagcaagccaaacgtgcaaaaactgaagtggatagtctcaggcagaactgctcggcagcttaaacactcctattacaggataacccacctgccaaccattccagagatggtcccttag

SEQ ID NO: 14749 - DNA, 486 bp, Artificial Sequence
  Description of Artificial Sequence: Synthetic coding sequence
atgagaatggagaaaatagttcttgaaaaggtttgctggaaggtcaaagctactactgccttccagttccttcaactctattactcactgctccaggagaacctgcctcttgagcgaagaaacagcatcaacttcgagagattggaagcacaactgaaagcgtgtcactgtcggatcatttttagtaaagcaaaaccctccgtactggcactgtcaattatagctcttgaaatccaggcgcagaaatgtgtggaactgaccgaggggattgagtgtctgcagaaacactcgaagatcaacggaagagatttaaccttttggcaggaactggtgagcaagtgtctcacagagtattcctctaacaagtgctctaagcctaacgtccagaagctgaagtggatagtcagcgggaggaccgcacgccagctgaagcacagctattaccgcatcactcacttaccgaccatacctgagatggtgccgtag

SEQ ID NO: 14750 - DNA, 105 bp, Artificial Sequence
  Description of Artificial Sequence: Synthetic coding sequence
atgatcgaggtgctgaccaccacggacagtcaaaagctgctacaccagcttaacgcgttactggagcaggagtctcggtgccaacccaaacgccactttttgtag

SEQ ID NO: 14751 - DNA, 1035 bp, Artificial Sequence
  Description of Artificial Sequence: Synthetic coding sequence
atgaaggacttaggggccgagcatttggctgggcatgaaggagtccaactcttgggtctcctcaacgtctacctagagcaggaggagcgttttcagcctagggagaaggggcttagcctgatcgaagcaactcccgaaaacgacaacacactgtgtcctgggctgcgcaacgctaaagtcgaggatctacgttctttggctaacttcttcggcagctgcacagagacatttgtgctggccgtcaatattctcgacaggtttcttgccctgatgaaggtgaaaccaaagcacctcagttgtatcggcgtgtgttcattcctgctcgctgctcgcatagtcgaggaagactgcaatattccctccacacatgacgtcatccggatcagtcagtgcaaatgtaccgcatcagacatcaaaagaatggaaaagatcatatcagagaagcttcattacgaactcgaggctaccactgccttgaacttcctgcatctttaccataccatcatcctgtgccatacttctgagcggaaagagattttgtccctggacaagttagaagcccagcttaaggcgtgtaactgtaggcttatattttccaaggccaagccgtctgtcctcgccctgtgtctacttaatttggaagtggagaccctcaagtcagtggagctgctggagattctgcttttagtgaaaaaacattctaaaattaacgataccgaattcttctactggcgcgagttggtctctaaatgccttgcagagtattcgagtccggagtgctgcaagcccgatcttaaaaaactggtttggatcgttagccggcgcacagcacaaaatcttcataattcctactactctgtgcccgagctacccaccatccccgaaggcgggtgctttgacgagtccgagtcggaggactcttgcgaagatatgagctgtggagaagaatcactctccagcagcccaccctctgaccaggaatgtactttcttcttcaactttaaggtagcgcagaccctatgttttccttcatag

SEQ ID NO: 14752 - DNA, 1035 bp, Artificial Sequence
  Description of Artificial Sequence: Synthetic coding sequence
atgaaggacctcggagctgaacacctcgccggccatgaaggcgtgcagctcctgggcttgcttaacgtttatcttgaacaggaagagcgatttcagccccgagaaaaaggactgtccctgattgaagccactcctgagaatgataataccctatgcccgggactgaggaacgcgaaggtggaggatctgcgttcgctcgcgaacttctttgggagctgtacagagacttttgtgctggctgtgaacattctcgacaggtttttggcactgatgaaagtgaaaccaaagcacctcagttgcattggagtctgttccttcctcttggctgctcggattgtggaagaagactgtaatataccctctacgcatgacgtgatacgcatttcccagtgtaagtgcactgcctcggacatcaaacgcatggagaagattatcagcgaaaaacttcactacgagctcgaggctacaactgccctgaactttcttcacctttaccacacaattattttatgccacacctccgaacgtaaggagatcctgagcctagacaagctcgaagctcagctgaaagcctgtaactgcagactgatcttcagcaaagctaagccgtctgtcttggcactgtgcctcctgaatctcgaggtcgaaaccctgaaatccgtggagttgctggagattcttctcctcgttaaaaagcactctaaaattaatgatacagaattcttttactggcgcgagctggtttccaagtgcctggcagaatactcatcccccgagtgctgcaagccagatctgaagaagcttgtgtggattgtaagcaggaggactgcccaaaacctccacaatagttactattcggtccccgagctccccactatacccgagggtgggtgttttgacgaaagcgagagcagcgtggcccaggcaggcgtgcagtggcctgacctttcgtcttttcagcccccgccaacccggttcaaaaggttcagctgcctctccctgaggagcagctgggactatagctcttggacatag

SEQ ID NO: 14753 - DNA, 1035 bp, Artificial Sequence
  Description of Artificial Sequence: Synthetic coding sequence
atgaaggatctgggcgccgagcatctggccggacatgaaggcgtccagctgttgggtttactcaatgtttatcttgaacaggaagaaagattccagccacgggagaagggactctctttgattgaggcaacccccgagaacgacaacacattatgcccgggccttagaaatgccaaggttgaggatctgaggtcccttgccaactttttcggcagttgcactgagacattcgtcctggcagtgaatattctggatagattcctagccctcatgaaggtgaagccaaagcacctgagctgcattggtgtctgtagtttcctgcttgccgcacggattgttgaggaagattgtaatatccccagcacacacgacgtgatcaggatttcccagtgtaaatgcactgctagcgatatcaaaagaatggagaaaatcatctctgagaagctgcattacgagttggaagccacgactgccctcaatttcttacacttatatcatactatcatcctgtgccacacatcagagcgaaaagagatcctctctctggacaaactcgaagcgcagctgaaggcttgcaattgcaggctgatcttttccaaggctaaaccttcagtactggctctttgcctgctcaacctggaagttgaaaccctcaaatctgttgaactgctagagatccttttgctcgtgaagaaacatagcaaaatcaatgacaccgaattcttctattggagggaactggtctcaaaatgtctggctgaatacagtagcccagaatgttgcaagcctgaccttaaaaaactggtctggatcgtaagtaggaggaccgcccagaatctgcacaactcctactacagtgtgcctgaactgcccacgatccctgagggtggctgtttcgatgaatctgaatccgaggactcctgtgaggacatgagttgtggggaagagtccctatctagcagccccccttctgaccaggagtgtacattctttttcaactttaaggtggctcagaccctgtgcttcccatcatag

SEQ ID NO: 14754 - DNA, 1035 bp, Artificial Sequence
  Description of Artificial Sequence: Synthetic coding sequence
atgaaagacctcggcgccgagcacttggcaggacacgaaggggtgcagctgctgggactccttaacgtgtacctggagcaggaggagcggtttcaaccacgagaaaaggggctcagtctcatcgaagctacccccgaaaacgacaacacactttgccctgggcttcgtaacgccaaggtggaggacctgcgatcactcgctaatttcttcgggtcctgcacagaaaccttcgtgctcgccgtcaacatcctggataggtttctggccctaatgaaggtgaagcctaagcatctgtcgtgtattggagtttgtagcttcctcttggccgcaaggatcgtcgaggaagattgtaacattccgtctactcatgatgtgatccgtatatcacagtgtaaatgtactgcaagtgatatcaagcggatggaaaaaatcatttctgaaaagctgcactacgaacttgaagctacgaccgccctcaacttcctccacctttaccatacaatcattctgtgtcatacaagtgagagaaaagagatattgtcattagataagctagaagcacagctgaaagcttgtaactgccgcctcatctttagcaaagccaaaccttctgtgctcgccctgtgtctactgaacctggaagtggagaccttgaaaagtgtcgaactgcttgagatccttctgctggttaaaaaacactccaaaatcaatgacaccgagtttttctactggagagagttggtctccaagtgtctggcagagtatagctccccggagtgttgcaaacctgatttgaagaagctggtttggattgtgtcacggcgcactgcccaaaacttgcacaactcctattactcagtcccggagctccctaccatccccgaggggggctgctttgatgaaagcgagtcagaggacagctgcgaagacatgtcctgcggtgaggagtcactgtcatcctcacctccgtcagatcaggaatgcacgttctttttcaacttcaaggtggcccagaccctgtgtttcccatcttag

SEQ ID NO: 14755 - DNA, 483 bp, Artificial Sequence
  Description of Artificial Sequence: Synthetic coding sequence
atgaaggacctaggcgcagaacacctggccggacacgagggggttcaactgctggggctattgaacgtctatcttgaacaggaggaacgattccagccgcgagaaaaaggcctgtcgctaatcgaggccacacccgagaacgataacacactctgcccaggcttgaggaatgccaaggtcgaggacttgcgttctctcgccaatttcttcggttcctgtaccgaaaccttcgtattggccgtaaacatccttgacaggttcctagcactgatgaaggttaagcctaagcacctgtcgtgtataggggtctgctcgtttctgctggccgccaggattgtggaggaagattgtaacatccctagcacccacgacgtaattaggatatcccagtgcaagtgtacagcttcagatatcaagcgaatggagaaaatcatctcggagaagttgcattatgagcttgaagccactacagccttgaattag

SEQ ID NO: 14756 - DNA, 972 bp, Artificial Sequence
  Description of Artificial Sequence: Synthetic coding sequence
atgtaccataacagctctcaaaaaaggcattggacatttagctccgaagagcagttggcacgcctgagggctgatgccaaccggaaattcaggtgcaaggcagtggcgaacgggaaggttctgcctaacgatcctgtctttttagagcctcacgaggaaatgaccctctgcaaatactatgagaagcgtttactggaattttgttcagtcttcaaacccgcaatgcctcgttccgtggtgggtacagcctgcatgtacttcaagagattttacctgaacaactccgtgatggaatatcatccaagaatcattatgctgacctgcgcctttctggcatgcaaagtggatgagttcaacgtgtcctccccccaatttgtaggcaatctgcgagagagcccccttgggcaggaaaaagccctcgaacagatactcgaatacgaactgcttctcattcagcaactgaatttccatctaatcgtgcataatccttatcgccctttcgaggggttcctgattgacctgaagaccagataccccatactggagaatccggagattctgcggaaaactgctgacgattttttgaacagaatcgctctaaccgacgcatacttgctctatactccaagccaaatcgctctgacagcaattctgagcagtgcatcccgcgccgggataactatggaaagctacctgtctgaatcactcatgctcaaggaaaaccgaacctgcctgtcacaattactggatatcatgaaatctatgcggaaccttgttaaaaaatatgaaccaccgaggagtgaggaagtggcggtgctcaaacaaaaattagaaaggtgccactctgccgagctcgctctgaacgtcatcactaagaagaggaaaggatacgaagatgatgattacgtatcgaaaaagtcaaagcatgaggaggaagaatggacagacgacgatctggtggagtccctctag

SEQ ID NO: 14757 - DNA, 768 bp, Artificial Sequence
  Description of Artificial Sequence: Synthetic coding sequence
atgccaagatcagtcgtaggcacggcttgcatgtactttaagagattctatctaaataatagcgtcatggaataccaccctagaattattatgttgacctgtgctttcctggcttgcaaagtcgacgaattcaatgtgagttccccccaattcgtgggcaacctgagagagagcccactgggccaagagaaggctctggagcaaatcctcgagtacgagctgttgttgattcagcaactgaacttccacctcattgtgcacaatccctaccgcccattcgagggctttctcatcgacctcaagactcggtatcccatccttgaaaatccagagatcctacggaagactgcggacgattttctcaatcgcattgcactcacggatgcttatttactatacacaccatcacaaattgctctgacagccattctgtcttccgcttctagggcgggcataacgatggagtcatacttaagcgaaagccttatgctaaaagaaaatcgaacatgcctgtctcaactcttggatatcatgaaaagtatgaggaatttggtgaagaagtatgaacctccaagatctgaggaggttgccgttctgaagcaaaagctggagagatgtcactctgctgaactggccctcaacgtgatcacaaaaaaacgtaagggatatgaggatgatgattacgtcagtaaaaaatcaaagcacgaggaggtttgcttcactcctaaaatgaactcgaagctgtttttgctttatatccttgtttag

SEQ ID NO: 14758 - DNA, 750 bp, Artificial Sequence
  Description of Artificial Sequence: Synthetic coding sequence
atgcccaggtccgtggttggaacggcttgtatgtatttcaagcgcttttacttgaacaactctgtaatggagtatcatcccagaattattatgctgacctgtgcctttcttgcttgcaaagttgatgagttcaatgtatctagtccccagtttgtcggcaatctgcgggaatccccactggggcaggagaaggccctcgaacagatccttgagtatgagctcttgttgattcagcaactgaatttccacttaatcgtgcataatccttatcgccccttcgagggctttttaattgacctcaaaacccggtaccccatcctcgaaaaccccgaaatactccgcaaaacagcagatgacttcctgaaccggattgcattgacagatgcatacctcctgtacaccccgagccagatcgctcttacggccatcctgagctccgcatcccgtgcgggaatcaccatggaaagttatttgagtgagagcctgatgctcaaagaaaatcgtacttgtctgtctcagcttctcgatattatgaaatccatgcgcaatttagtcaaaaaatatgagcccccaagatcagaagaggtggctgttttgaaacagaagctggagcgttgccacagcgcagagttggccctcaacgtcattacaaagaagcggaaggggtatgaagatgatgattacgtgtctaagaagagtaagcacgaagaggaggaatggactgacgatgacctggtcgaatcactgtag

SEQ ID NO: 14759 - DNA, 1053 bp, Artificial Sequence
  Description of Artificial Sequence: Synthetic coding sequence
atggtgaccccatgtcccacatctccaagctcacccgccgcccgtgcgggccgccgagataacgaccaaaatttacgggctccagtgaaaaagtctcgccggccacggctgaggaggaagcagccgctgcacccattgaacccctgtccgctccccggcgactcaggcatttgcgatctgttcgagagtccttcgtccggctccgacggcgccgagagcccttcagccgccagagggggatctcctctccctggcccggcacagcctgtggctcagttggatctgcagacgtttagggactatgggcagtcctgttatgccttcagaaaggcccaggaaagccatttccatcctagagaggccttagcccgtcaacctcaagtcaccgctgagtcacgctgtaagctactgtcttggctgattcccgtgcatagacaatttggtcttagcttcgagtcgctgtgtctcactgtaaacacattggaccggtttctcacaacaacccccgtcgccgctgattgctttcagcttctcggagttacatctttattgattgcgtgcaaacaagtcgaagtacacccccctcgggtgaagcagctgctggcactttgctgcggcgcctttagtcgccaacaactgtgtaacctcgagtgcatcgtgttgcacaagctccatttcaccctgggtgcacccaccatatcgttcttcctcgagcactttactcatgctagagtggaagcaggccaagcagaagccagcgaggccttggaggcgcaggcactcgcacggggtgtcgccgagttaagtctggcagattatgctttcaccagctactccccatctctgttggccatctgctgtctggctctggcagatcgtatgttgcgggtctcaagacctgtggacttaagattgggtgatcatcctgaagcagcactggaggactgcatggggaagctacaactgcttgtagctattaatagcacaagcttgacccatatgttgccagtgcagatctgtgagaagtgctccctgcccccgtcgagtaagtag

SEQ ID NO: 14760 - DNA, 2181 bp, Artificial Sequence
  Description of Artificial Sequence: Synthetic coding sequence
atggaaggagagaggaagaataacaacaaacgctggtactttaccagggagcagctagagaactccccatcaagacggtttggggtggaccctgacaaagaactgtcttaccgacagcaggccgctaatctcctgcaagatatgggtcagaggttgaatgtatcgcaactgacaatcaataccgcaatcgtgtacatgcaccggttttacatgatccagtcttttacccagttcccgggaaattctgtagctcctgccgccttatttcttgccgccaaggttgaggagcaaccaaagaagctagagcacgtgatcaaagttgcccacacttgcctccaccctcaggaatccttaccggacactcggagtgaggcctatttgcagcaggtacaggatctcgtgattctcgagtctattattctgcagactcttggctttgagctgaccatcgatcacccacacacccatgtggtgaaatgtacacaacttgtccgagcaagcaaggaccttgctcagactagttatttcatggccaccaactcactgcatctgactactttttcactgcaatacacacctcctgtggttgcctgtgtatgcatacacctagcctgcaaatggtctaactgggaaattccagtgtccacagatggcaaacactggtgggagtatgttgacgccactgtgactttggagctcctggatgagctaacacacgagttcctgcagattctagaaaagacgccgaatcggctcaaacgaatctggaactggagagcatgcgaggccgctaaaaagactaaagccgatgatcggggaactgatgaaaagacaagcgagcagacgattctgaatatgatctcccagtcttcttccgacaccacgatcgccggcctgatgtcaatgtccacaagcactacgtccgcggtcccctctcttcctgtatcagaggagtcttcatccaatcttactagcgtagagatgctcccgggtaagagatggctctccagccagcccagcttcaaactggagcccacacagggacaccgcacctctgaaaatctcgccctgactggcgtggaccactcactgccacaagatggcagcaatgccttcatctcccagaaacagaactctaaaagcgtgccctctgccaaagtttccctaaaggagtacagagccaaacatgcagaggaattggctgcgcagaagcgacagctcgaaaacatggaagcgaatgttaaatcccagtacgcatacgctgcccagaacctcctctctcaccatgactctcactcaagtgtcatcctcaagatgccaattgaaggtagtgaaaaccctgaacgcccatttcttgaaaaggctgataaaaccgcactcaagatgagaatcccagtcgcgggtggagataaagcggcctcctccaagccagaggagattaagatgcgaatcaaggtgcacgcagcagccgacaaacacaatagtgttgaggacagtgtcacaaagagcagagaacacaaggagaagcataaaacccacccgtctaatcaccaccaccatcacaatcatcattctcacaagcacagtcactcccagttaccggttggaactggaaacaagcgtcctggcgaccccaagcattcaagtcagacttcaaacctggcccacaagacatacagcctcagtagttcgttcagctccagtagcagcactcggaagcgaggacccagcgaggagactggtggcgctgtgttcgatcaccctgctaagatagctaagagcacaaaatcatcttcactcaacttctcattcccatcactgcccacaatgggccagatgccgggccattcgtcagatacaagcggcctgtcctttagccagccaagttgtaagactcgggtcccccactcaaagctggacaaggggcctacaggcgcaaacggacataatacaacacagacaatcgattatcaggacacagttaatatgctgcattctttactgagtgctcagggcgtacagcccactcagcctactgccttcgagtttgtccgaccctactctgattacctgaatcccagaagtggcggcatcagctctcgcagcggaaacacggacaaaccacgacctccccctcttccttccgagcctccaccaccactgcctccgctgcccaaatag

SEQ ID NO: 14761 - DNA, 723 bp, Artificial Sequence
  Description of Artificial Sequence: Synthetic coding sequence
atggaggattacactaaaatcgagaaaatcggcgagggaacatacggagtggtgtataaaggccggcataaaacaaccgggcaggtcgtcgccatgaagaaaatccggctggagtccgaggaggaaggtgtgcctagcactgctatcagggagataagcctcctgaaggagctccggcatcccaatatcgtgtcactgcaagacgtgctcatgcaggattctcgcctctatctgatttttgagtttctctccatggatctgaaaaagtatcttgacagcatacccccaggccaatacatggatagctccctggtgaaagtggtgaccctttggtaccgctccccagaagtcctgctgggcagtgctagatacagcactcccgtggatatctggtccatcggcacaatcttcgcggagctcgccacgaagaaacccctgtttcatggcgactccgagattgaccagttatttaggatcttccgggcactgggcacccctaacaatgaagtgtggcctgaggtagagtccctgcaggattacaagaatacatttcccaaatggaagccaggttccttggcatcgcatgtgaagaacctggacgaaaacgggctcgatcttcttagtaaaatgcttatttacgatcccgcgaagaggatatctggtaagatggcccttaaccacccctactttaacgatctcgacaatcagatcaaaaagatgtag

SEQ ID NO: 14762 - DNA, 723 bp, Artificial Sequence
  Description of Artificial Sequence: Synthetic coding sequence
atggaagactacactaagattgagaagatcggagagggcacttacggcgtagtttataaagggagacataagacgaccggacaggtggtagcgatgaaaaaaattaggctggagtctgaggaggagggagttccttctactgctatacgggagatcagccttttaaaggagctgcgtcatcctaacatcgtgtctctgcaggacgtgctcatgcaggatagccgtctctacctaatctttgagtttctgtctatggatctgaagaaataccttgatagtatccctccaggccaatatatggattcatccctggtgaaggtggtgaccttgtggtaccgctccccggaggtgcttctgggtagtgccagatacagcactcctgtcgacatctggagtattggaacaatttttgccgagctcgccaccaagaagccactatttcatggggattccgagatagatcagctattccgtatatttcgggccctcggaactcctaacaacgaggtctggcccgaggtggaatcactgcaggactacaagaacacatttcccaagtggaaacctggcagtctggcatcacatgtgaagaacctggatgagaatggactggatcttctgagtaagatgctgatatatgatcctgctaaacgcatctccggaaagatggccctgaatcacccatattttaacgatctagataaccagatcaagaagatgtag

SEQ ID NO: 14763 - DNA, 894 bp, Artificial Sequence
  Description of Artificial Sequence: Synthetic coding sequence
atggaggattacacgaaaatagagaaaatcggggaggggacatatggagtggtgtacaagggcagacacaagaccaccgggcaggtagtcgccatgaagaagattagactcgagtctgaggaggaaggggtgccaagcactgccatcagggaaatctccctgctgaaggaattgcgccaccccaatatcgtcagcctacaggacgtgctcatgcaggactccagattgtacctgattttcgagtttttgagcatggaccttaaaaagtacttagatagcatccctccgggacagtacatggacagcagtttggtcaagagctatctctaccaaatcttgcagggcatcgttttttgccacagtcgtagggtcttacaccgggatctgaagccacagaatctcctgattgatgataagggcaccataaaattggccgatttcgggctagcgagagcgttcggaattcctatccgggtgtacacgcacgaggttgtgacgctgtggtacagatctcccgaagttctattggggtccgcacgttattcgacccccgtggatatctggtccattgggaccatcttcgccgaattagccaccaagaagcctcttttccatggagactccgaaatcgatcagttgttcagaattttcagagctctcggaacacctaataacgaggtttggcccgaggtggagagcttgcaagattacaaaaatacctttcctaaatggaaaccgggatccctggcaagccacgtgaaaaacctggacgagaacgggcttgacttgctgtcaaaaatgttgatctacgaccccgccaaaaggattagcggaaagatggcattaaatcatccttactttaatgatctggacaatcagatcaagaaaatgtag

SEQ ID NO: 14764 - DNA, 894 bp, Artificial Sequence
  Description of Artificial Sequence: Synthetic coding sequence
atggaagactacacaaagatcgagaagatcggggagggcacctacggtgtagtctacaagggtagacataaaacaactggtcaggttgtcgcaatgaagaagatccgtctggagagtgaggaagaaggtgtcccaagcacagcaatccgggagattagcctcctcaaagagctccgacacccaaacatagtttccttgcaggatgtacttatgcaggacagccggttatacctgattttcgagttcctgagtatggatctcaaaaagtaccttgactcaattccccccggacagtatatggactcgagcttagttaagtcctatctatatcagatcctgcagggaattgtgttttgccattcacggagggtcttgcaccgcgatcttaagccacagaatctgctcatcgacgataaggggactattaaactcgcagatttcggcctcgcccgcgcctttggcattcctatacgggtgtatacccatgaggccattaccctgtggtacagatcaccggaagtgctgttgggctctgctaggtactctactcctgtcgacatatggagcatcggaaccatttttgcagaacttgccaccaagaaacctctttttcatggcgattccgagattgaccaacttttcagaatctttagggcgctcgggacaccaaataatgaggtctggccagaagttgagtccctgcaggactataaaaatactttccctaagtggaaaccaggctctttggcctcacacgtaaagaatcttgacgagaatgggctcgacctgctgtctaaaatgctaatttatgacccggcaaaaagaatatctggcaaaatggccttgaaccatccctattttaacgacttggataatcaaatcaaaaagatgtag

SEQ ID NO: 14765 - DNA, 570 bp, Artificial Sequence
  Description of Artificial Sequence: Synthetic coding sequence
atggaggactacactaaaatcgagaagatcggtgagggcacttatggcgtagtgtataaggggcgacacaagactacaggccaggtggtggccatgaaaaaaatccgcttagagagcgaggaagagggcgtgccttcaactgccattcgcgaaatctcactgctcaaggaactgaggcaccctaatatcgtgagcctgcaggatgtactgatgcaggattcaagactgtaccttattttcgaattcctctccatggatcttaagaagtacctcgacagcatacctcctggccaatacatggatagctcactggttaagagctacctgtatcaaatcctccagggcattgtcttttgccattccagacgggttctgcaccgggacctgaagccccagaatttattaatcgatgataaggggaccatcaaattggccgacttcggcctggcccgcgctttcggaataccaatcagggtgtacactcacgaggcaataacattatggtataggagcccagaggtactcctcgggagtgcacggtacagcacacccgtcgatatctggagctag

SEQ ID NO: 14766 - DNA, 897 bp, Artificial Sequence
  Description of Artificial Sequence: Synthetic coding sequence
atggaaaactttcagaaggtggaaaagattggggaagggacctacggggtggtctataaagcccggaataaacttaccggagaggtcgtggcgctgaagaaaattcgcctggatactgaaaccgagggtgtgccaagtaccgccatcagagaaatttcccttctgaaggaactgaaccatcccaatatcgtgaaactcctggacgtcattcatactgagaataagctctacctggtgtttgagtttctgcatcaggacctcaagaagttcatggacgcttccgccctgaccggaatcccgctcccactcattaaaagctacctcttccagctgttacagggcctcgcattctgtcatagccatagggttttgcatagagatctgaagccacaaaatctcttgattaacactgagggagcaataaagctggctgactttggcctggccagggcatttggagtcccagtccggacgtacacacatgaggttgtgaccctttggtatagagccccagagatccttctgggttgtaaatactactcgacagcggtagatatctggtcattggggtgtatcttcgctgagatggtcactcgccgggccctttttccgggagattcagagattgaccaacttttcagaattttccggaccttagggacccccgacgaggtggtatggccaggcgtgacaagcatgccggactacaagccctccttcccaaagtgggcccgtcaggacttctcaaaagtcgtccctcctttggatgaggatggccgctccttgctgtcacagatgcttcactatgaccctaataagaggatttcagctaaagcggctctcgcccatccattcttccaggacgttactaagcctgtgcctcacctcaggctctag

SEQ ID NO: 14767 - DNA, 795 bp, Artificial Sequence
  Description of Artificial Sequence: Synthetic coding sequence
atggagaatttccagaaagtcgagaagatcggagaaggaacatatggggtggtatacaaagccagaaataagcttactggggaggtcgtggctctgaagaagatccgcctggacacggagaccgagggggtgccttccactgcaattcgggagatatctttgctaaaggagctgaaccatccaaatatcgtcaagctgctggacgtcatacatactgaaaataagctgtacctcgtctttgagttcctgcaccaggatctgaagaaattcatggacgccagtgctcttactggcattcctctgccactcattaagtcttatctcttccagttgctgcagggcctggccttttgtcacagtcacagagtgctgcatcgcgaccttaaaccccaaaacctgctgatcaatacagagggagctataaagcttgcggatttcggactggctcgggccttcggggtccccgtccgcacttatacacatgaagtgactcgcagggctctgtttccaggggattcggagattgaccagctgtttcgaatctttcgcacactagggacaccagacgaggtggtgtggccaggggtcacctcaatgccggattacaaaccctctttcccaaagtgggccaggcaggacttttcgaaggtggtacccccccttgacgaggacggtcggtccctcctgagccagatgctccattatgatcccaataagcgtatctctgctaaggcagccctggcccacccgttttttcaggacgtgactaaacccgtccctcaccttcgactctag

SEQ ID NO: 14768 - DNA, 348 bp, Artificial Sequence
  Description of Artificial Sequence: Synthetic coding sequence
atgtcttacaagcccaatctggcagctcacatgccagctgcggctctgaacgccgctggtagcgtacactccccaagtacatcgatggccactagttctcagtacaggcagctgctctcagattatggtccaccttccctagggtatactcagggaaccggaaactcacaggtgcctcagtcaaagtacgcggagctgctggccataatcgaagagctcggcaaagaaatccgaccaacgtacgcaggctccaaatcagctatggaaaggttgaagagaggcattatccatgcccgagggctcgtgcgagagtgtctagcagaaacggaaagaaacgcccgcagctag

SEQ ID NO: 14769 - DNA, 912 bp, Artificial Sequence
  Description of Artificial Sequence: Synthetic coding sequence
atggctaccagccggtacgaaccagtcgccgagataggtgtaggagcttacggaaccgtgtataaggccagggatcctcacagtggtcacttcgttgctctgaaatcagtgagggtaccaaacggcggcggaggaggagggggccttcccatcagcacagtaagggaggttgcactgctgaggagactcgaagcattcgagcaccccaatgtggtgcgacttatggatgtgtgcgcaacctccagaacggatagggaaatcaaagtcacactggtttttgagcacgtggaccaggatctcaggacatacttggataaagcccccccgcccgggctgcccgctgaaacaataaaagacttgatgcgacagttcttacgcggcctcgacttcttgcatgcaaactgcatagttcaccgcgatctgaagccggagaacattcttgtcacttccggcgggacagtaaaactggctgactttggtctcgcaagaatttactcctatcagatggcacttactccggtggtagttactctctggtatcgagcaccagaggtgttactgcagagcacatatgcaacaccagtggacatgtggagtgtgggatgtatttttgcggagatgtttcggcgtaagccactattctgcggcaatagtgaggctgaccagctgggcaaaatatttgatctaataggcttgcccccagaggatgactggcccagagacgtgagtctcccgagaggcgccttcccccccagaggaccccggccagttcagagcgtggtgcccgagatggaggaatcaggcgcacaactgctgctggagatgctcactttcaatcctcacaagcgaattagcgccttccgcgctctgcaacatagctatttgcacaaggacgagggtaaccctgaatag

SEQ ID NO: 14770 - DNA, 336 bp, Artificial Sequence
  Description of Artificial Sequence: Synthetic coding sequence
atggccaccagccggtatgaacctgttgcagagattggtgttggggcttacgggaccgtgtataaggctagagatccccatagcggtcacttcgtggccctgaaaagcgtgagggttccgaatggcggcggaggcggaggcggtttgcctattagcactgtgcgggaggttgcgctactgaggaggctcgaagcctttgagcaccccaacgtggtcaggctcatggacgtctgcgctacatctaggactgacagagaaattaaaaggtgcttcgtagaatccctgtccagcgtggaaaccctgaaaccgactagctgggccaagtctctgacatag

SEQ ID NO: 14771 - DNA, 552 bp, Artificial Sequence
  Description of Artificial Sequence: Synthetic coding sequence
atgagacaatttttacgcggcctggactttctccacgcaaactgcattgtccaccgagatcttaagcctgagaatatcctagttacttccggcggcaccgtgaagctggccgattttggacttgcaagaatctatagctaccagatggctctgacacctgtggtcgtcacattatggtacagagccccagaggtattattgcagagtacttacgctacaccagtggatatgtggtctgtgggttgtatattcgcggagatgttcaggaggaaacccttattttgcggtaacagcgaggccgaccagctgggcaagatcttcgatttgatcggattgccacccgaagatgattggcctcgcgatgtcagtctcccacgcggagcgttcccaccaaggggacctaggcccgtccagtccgtggtgccagagatggaagagtccggggcccagttattgctggaaatgctgactttcaacccacataagagaatttcagccttccgggccctccaacactcttatcttcataaagacgaggggaacccggagtag

SEQ ID NO: 14772 - DNA, 9 bp, Artificial Sequence
  Description of Artificial Sequence: Synthetic coding sequence
atggcttag

SEQ ID NO: 14773 - DNA, 612 bp, Artificial Sequence
  Description of Artificial Sequence: Synthetic coding sequence
atggccacctcgaggtatgagcccgtggccgagatcggtgtgggtgcatatgggactgtttacaaggcccgggatcctcactcagggcacttcgtcgcattaaagtcggtgcgggttccgaatggagggggcgggggcgggggcctccctataagcaccgtccgtgaagtcgctctgctccgcaggttggaggcatttgaacatcccaatgtcgtccgcctgatggatgtttgcgcgacaagtcgaaccgatcgggaaataaaagtcaccttggtgtttgagcatgttgaccaggatctcaggacctatctggataaagcccccccgccgggcctcccggccgaaactatcaaggacttaatgaggcaatttcttcgcggactcgacttcttacatgcgaattgcatagttcaccgagacttgaagccagagaacatcctggtgacttccggaggtactgtcaaactagctgattttggtctggcaagaatctattcgtaccagatggctctgacccctgtggtggtgaccctctggtatagggctccagaagtgttgttgcaatccacctatgcaacccctgtggacatgtggtccgtcggttgtatctag

SEQ ID NO: 14774 - DNA, 513 bp, Artificial Sequence
  Description of Artificial Sequence: Synthetic coding sequence
atggccactagtagatacgagcctgtcgcagaaataggagttggggcgtacgggacggtctacaaagctagagacccacactctggccacttcgttgctcttaaatccgtgcgcgtgcctaacggagggggcggtggtggagggctccctatttccaccgtcagagaagtggccctgctgaggcgccttgaggcattcgagcatccaaacgttgtccggctgatggatgtttgcgcaacatcacggaccgaccgggagataaaggtcaccctggtgtttgaacatgttgatcaggatctgcgcacttatttggacaaagccccccctcctgggttgcctgctgaaacaataaaagatctgatgcgccagtttctccggggcctggactttcttcacgctaactgcatagtacacagggacctgaagccagaaaatattctggtaacgtccgggggaacagtcaagcttgctgacttcggactggccaggatctattcttaccagatggcatag

SEQ ID NO: 14775 - DNA, 348 bp, Artificial Sequence
  Description of Artificial Sequence: Synthetic coding sequence
atggcaacaagccgctatgagcccgtcgccgagatcggagtcggcgcctacggcacggtctacaaggcccgggatccgcactctgggcattttgtggctctgaagagtgttcgggttccgaacggcggcggggggggaggaggcctgccaattagcaccgtgcgtgaggttgccttgcttcggcgtttagaagccttcgagcacccaaacgtagtgcggttaatggatgtctgcgccacaagcaggaccgatagagagatcaaagtaacattagtatttgaacatgttgaccaggatctccggacctaccttgataaagctcctccgcccggtctgccagccgagtag

SEQ ID NO: 14776 - DNA, 924 bp, Artificial Sequence
  Description of Artificial Sequence: Synthetic coding sequence
atgggaacagtcttgtctctgtcccccagttatagaaaggcaactcttttcgaagacggggcagccaccgttggccactacacagcagtgcagaactccaaaaatgccaaagataagaatctcaagagacattctattatctcggtgctgccttggaaaagaatcgtagctgtgagcgccaagaaaaaaaactcaaaaaaggtgcagcctaacagcagttatcagaacaatataacccatctgaacaacgaaaatctgaagaagtcccttagctgcgcgaatctgagcacctttgcacagcccccacccgcgcaaccccctgctcctcccgcctcccagctgtcaggcagccagacaggcgggagctcttccgtgaagaaggctcctcatccagccgtgacaagcgcgggaactccaaaaagggtaatcgtgcaggccagtacaagtgaactcctcagatgcttgggggagttcctttgcagacgctgttaccgcttaaaacacctgtcaccaaccgaccccgtcctttggctccgatccgtagaccgctcgctgttgctgcaaggctggcaggaccaaggatttatcactcctgccaatgtcgtgttcctctatatgttgtgccgcgacgtgattagtagcgaggtgggatctgaccatgaactacaggcggtacttcttacatgcctgtacctgtcctactcttatatggggaatgaaattagttaccctcttaagcctttcctcgtggagtcctgtaaagaagctttctgggaccgctgcctgagcgtgatcaatttaatgtcgtctaagatgctgcagatcaacgctgacccacattacttcactcaggtgttctcagaccttaaaaacgagtccgggcaggaggataagaagagacttctgcttgggctcgatcgctag

SEQ ID NO: 14777 - DNA, 981 bp, Artificial Sequence
  Description of Artificial Sequence: Synthetic coding sequence
atggaaaaagatggactgtgccgcgccgaccagcagtacgaatgcgtggccgagattggtgaaggcgcgtacgggaaggtgttcaaggccagagacctgaagaacgggggtcgctttgtcgctctgaaacgcgttcgggtccagaccggcgaagagggtatgcccctgtcgactattcgtgaagttgccgttctgagacatttggaaactttcgagcaccctaacgtggtgaggcttttcgatgtatgcacagtgtcccgcacagaccgcgagacaaagctgacccttgtgttcgaacatgtcgaccaggatctcaccacatatctggataaagtgcctgaacccggagtgccaacagagactatcaaggacatgatgttccagctgttaaggggactggatttcctgcatagccaccgcgtagttcatcgcgacctgaaaccccagaatatcttagtgacatcgtctgggcagatcaagctggccgactttggcctcgctcgaatctactcgtttcagatggcactgactagtgtcgttgttacgctgtggtatcgagcgcccgaggttctcctgcagtcctcctacgcaactcccgtagatttgtggtccgtgggatgtatctttgccgagatgtttcgcagaaagccactgttcagggggtctagtgacgtggaccagctgggcaagattttagatgtgattggactccctggcgaggaggactggcccagagacgttgcgttgcccagacaagcctttcatagcaagtctgcgcagccgatcgagaaattcgttactgacatagacgagctggggaaagacctcctgttgaagtgcctcacgttcaaccctgctaagcgaatctccgcctatagtgcattatcccacccctactttcaggacctggagaggtgcaaggaaaatctcgatagtcacttgcccccctctcaaaacacatccgagctcaatacagcgtag

SEQ ID NO: 14778 - DNA, 981 bp, Artificial Sequence
  Description of Artificial Sequence: Synthetic coding sequence
atggagaaagatgggctatgccgcgccgaccagcagtacgaatgtgtggctgaaatcggagaaggagcctacggaaaagtttttaaggccagagacctgaagaacgggggacgcttcgtcgcgctcaagagggtccgggtacagaccggcgaagaagggatgccactttctacaattagagaagttgccgttctgcggcatctcgaaacatttgagcaccccaatgttgtgcgactgttcgacgtctgtacagtttcgcggaccgacagagagacaaagcttacgctggtctttgaacacgtggaccaggacttgaccacctatctggacaaggtcccagaacccggagtgccaaccgaaaccatcaaggatatgatgtttcaattactcaggggcctcgacttcctgcacagccaccgggtcgtgcaccgagatctcaaaccacagaacatactagtcacttcctccggacagatcaagcttgctgatttcggtcttgcaagaatctactcatttcagatggctctgactagcgttgttgtaactttgtggtatagagccccggaggtgcttttgcagtccagttacgcgacaccagtggatctgtggtcagtcggttgtatttttgccgaaatgttcagaagaaagcctctgttccggggaagttccgatgtagaccaactgggaaaaattctggacgtgattggccttcctggtgaagaggactggccacgagacgtcgcactgcctaggcaggcatttcacagtaagagcgcccagcctattgagaaattcgttactgacattgatgaactggggaaagacctgttgcttaagtgcctgacatttaatccagccaaaagaatctctgcatactctgcactgagccatccatattttcaagatctggaaagatgtaaggaaaatttagatagccacctacctccctctcagaacacatctgagcttaatactgcctag

SEQ ID NO: 14779 - DNA, 1041 bp, Artificial Sequence
  Description of Artificial Sequence: Synthetic coding sequence
atggctctggacgttaagtccagagctaaacgttacgaaaagttggatttcctaggagagggccagttcgcaactgtgtataaggcaagggacaaaaatactaatcagatcgtcgctataaaaaagattaagctgggccacagatcagaggcaaaggacggtattaacagaactgctctaagggaaattaagctcttacaggagctttcccatccgaatatcattggcttactggacgcctttggacataagagtaacatttccctggtctttgactttatggagaccgatctcgaagtaatcattaaggataacagtcttgttctgacccccagccacatcaaagcgtacatgctgatgacactgcagggcttggaatatttacatcagcactggatcttgcacagggatctgaaacctaataacctattgctggatgagaacggagttctgaagttggctgactttggccttgccaagtctttcggatcgcccaacagagcctatacacaccaggtggttaccagatggtatcgggcacctgaattactattcggagccagaatgtacggggtgggcgtggacatgtgggccgtggggtgtatccttgcggaactgctgctccgggtaccctttcttcccggtgatagcgatttggaccagttgacgagaatcttcgaaaccttaggcaccccgaccgaagaacagtggcccgacatgtgttcactaccagactatgtaaccttcaagagtttccccgggatacctctccaccacattttctctgccgctggggatgatcttctcgatttgatccagggcctctttctatttaatccgtgcgccaggatcactgcaacacaagcactgaagatgaaatacttcagcaataggccagggcccacacccggatgccaattgccccgacctaattgtccagtggagacgctcaaagagcagtccaatccggccctggccattaaaagaaagagaactgaagccttggagcaaggggggttgcctaagaagttgatattctag

SEQ ID NO: 14780 - DNA, 1395 bp, Artificial Sequence
  Description of Artificial Sequence: Synthetic coding sequence
atggactacgatttcaaagtgaagctatctagcgagcgtgaaagagtggaagacctgttcgagtacgagggatgtaaggttggcagaggaacctacggtcacgtctataaagccaaaaggaaggacggcaaggatgacaaagattacgctctgaaacagattgaggggactggtatctcgatgtccgcttgtagggaaatcgctctcttgcgcgaacttaaacatccaaacgtgataagcctccagaaggtgtttttgagccacgccgaccgcaaagtgtggcttctgtttgactatgccgagcatgatttgtggcatattattaaattccatagggccagcaaggcaaataagaagcctgtacagctgcccaggggcatggttaaatcactcctctaccagattctggacgggatacactacctccatgccaattgggtcctacacagagacctaaaacccgctaacattttagttatgggagaaggacctgaaagaggccgggttaagattgccgacatgggcttcgcccgcctattcaattctcctctgaaaccattggccgacctggatccagttgtggtcactttttggtaccgggcacccgaactactgttgggggctagacactacaccaaggctatcgacatctgggctattggatgcatttttgcagaattacttacgtctgagcccatttttcattgtcggcaggaagacatcaaaacttccaacccttatcaccacgatcagttagaccgtatttttaatgttatgggcttcccagccgacaaggattgggaagatataaaaaaaatgcccgagcattccacccttatgaaggactttagacgcaatacctacacaaattgtagcctaatcaagtatatggagaagcataaggtgaagccagattctaaagctttccatctgcttcaaaagctgttaactatggatccaatcaagcgcattaccagcgagcaagcaatgcaagacccatatttccttgaggatccactccctacatctgatgtttttgcgggttgtcaaatcccttatccaaaacgtgaatttctgacggaagaggagccagacgataaaggcgataaaaaaaatcagcaacagcagcaaggaaacaatcatactaatggaacaggccatcccggaaaccaagatagctctcatacccagggccctcctctgaagaaagtgagggtggtgccaccgacaaccacttctggaggacttattatgacatcagattaccagaggtcaaaccctcatgctgcctacccaaacccaggaccctcaacctcccagccgcagtcaagcatgggctactcagcgacctcacagcagcccccgcagtacagtcatcaaacacaccgctactag

SEQ ID NO: 14781 - DNA, 495 bp, Artificial Sequence
  Description of Artificial Sequence: Synthetic coding sequence
atggactatgactttaaagtgaaactgagcagcgagagggagagggtggaggacctcttcgaatacgaaggctgcaaagtggggcgtgggacatacgggcacgtgtataaggccaagcgcaaggacggtaaggatgacaaagactatgccctgaagcagattgaaggcaccggaattagcatgagcgcatgcagggaaatcgcccttctcagagaactcaagcatcctaatgtgattagcctccagaaggtgttcctaagtcacgccgaccgcaaagtgtggcttttattcgactacgctgagcatgacctttggcacataataaagttccaccgcgcctcaaaggccaataaaaagccggtccagctcccaaggggaatggtaaagagcctgctgtatcaaatcctggacggtattcactacttgcatgctaattgggtgctgcatagagacttactgacttgggcgttgccggactacctcatccatctgtag

SEQ ID NO: 14782 - DNA, 1119 bp, Artificial Sequence
  Description of Artificial Sequence: Synthetic coding sequence
atggccaagcagtacgattcagtggaatgtcccttctgcgatgaagtgtctaaatacgagaaactggcaaagatcggacaggggacgtttggtgaagtcttcaaagcaagacacaggaaaaccgggcagaaagtggcccttaagaaggtcctgatggaaaacgaaaaggagggtttccccataacagctctgagggagattaagatactacagctcctgaagcatgagaacgttgtaaatctaattgaaatctgcagaacaaaggccagtccttacaatagatgtaagggctctatctatctggtcttcgatttctgcgaacatgacctggccggcctgcttagcaatgtcttagtgaaattcaccttgtcagagatcaaacgggtcatgcagatgcttctcaacgggctttattatattcaccgaaacaagattctacaccgggacatgaaagccgctaacgtgctgatcacccgcgatggtgtactcaaattggccgacttcggactagctagggcgttctctctcgctaaaaacagccagcccaaccgctacactaatcgagttgtgacattatggtaccgtccccctgaactccttctgggcgaacgagattatggcccccccattgatctgtggggcgccgggtgcatcatggccgagatgtggacaagaagccctatcatgcaaggaaatacggagcagcatcagctggctctgatctcacagctctgtggaagcataaccccagaggtgtggcctaatgtggacaattacgagctgtatgagaagttggaacttgtgaaaggtcagaaacgtaaagtgaaagaccgcttgaaagcctacgtgcgtgacccttacgcgctggatttgattgataagctgctggtgctggatccagcgcagcggatcgactcagacgatgcgttaaaccacgactttttctggagtgacccaatgccatcggacctcaagggcatgttgtcaacccaccttacttctatgtttgagtacctcgctccccctaggaggaaaggatctcagattactcaacagtccacaaatcagtctcgaaaccccgcaaccactaatcagaccgagtttgaaagggtattttag

SEQ ID NO: 14783 - DNA, 1470 bp, Artificial Sequence
  Description of Artificial Sequence: Synthetic coding sequence
atgcagagggacgcgccacccagagctcctgcacccgcgccacgccttccagcacctcctatcggtgccgcagcctcctcgggaggcggaggcggaggtggcagcggagggggcggaggaggggccagtgcagcaccggccccacctggactatccggcaccactagccctaggggacctggcggcgggaggagggccgaagaagccggttccgcacctcgtgggaggaagtggccctggcgtcgcaagtggcgtgggcgaggaggcgcttggagtgccgcagcggcgggaccaggcgccggagccgcagcggcggcgacaggaggcgggggcggcgccctggaagccgccatggccaagcagtacgatagcgtagagtgccccttctgtgatgaagtgagtaagtatgagaagttggccaaaattggccagggcactttcggagaggtgttcaaagcaagacaccggaagactggccaaaaggtcgccttaaagaaggtgctgatggaaaacgaaaaagaggggtttccaattactgctctcagagagatcaaaatcctgcaactgctgaagcacgagaatgtggtgaacttgattgaaatctgtcgcacaaaagcgtcaccttacaaccggtgtaaaggatccatttatctggtctttgacttctgcgaacatgatctggctgggctcctgagtaatgtcctcgttaaattcaccctgtccgagattaaaagagtgatgcaaatgcttcttaatggtctgtactacatccatcgcaacaagatcttgcaccgcgatatgaaagcagcgaatgtccttattaccagggacggagtactgaaattagctgattttggcctggctagggctttttccctcgctaagaattctcagccaaaccgatataccaaccgtgtggttaccctttggtatcggcccccagaattactgctgggtgagcgagattacgggccacccatagatctgtggggagccggatgcattatggcggaaatgtggacccgcagtcccattatgcaggggaacacagaacagcaccaactcgcattaatcagccagctgtgcgggagcataacacccgaggtctggcccaatgtggacaactacgagctgtacgagaaattggagctggtcaaagggcagaaaaggaaggtcaaagatagactcaaggcgtacgttagggacccttacgcactcgacctcatcgataagcttttggtgctcgacccagctcagaggattgattccgatgacgcgttgaaccatgactttttctggtcggaccctatgccaagcgatttgaagggaatgcttagtacgcaccttacctccatgtttgaatacctggcgcccccacggcgcaagggctcacagatcacacagcaatcgacaaaccagagtcgtaatccagccaccaccaaccaaactgaatttgaacgtgtcttctag

SEQ ID NO: 14784 - DNA, 585 bp, Artificial Sequence
  Description of Artificial Sequence: Synthetic coding sequence
atgcagcgggatgcacccccccgggctcctgcccctgcacccagactgcccgcgccccccatcggagccgcggccagtagcggtggggggggggggggcggctctggtggaggaggaggtggcgcctccgctgcacccgccccccctggcctttccggcaccacgagcccccgaggccctgggggaggcagaagagcagaggaagctggtagcgctccccggggccggaagtggccctggagacggaagtggcggggtcgcggcggggcatggtctgctgccgcggccgggcccggagccggtgccgccgcagcagctaccgggggcggtgggggcgccctcgaggctgccatggctaagcagtacgattcagtggaatgccctttttgcgacgaggtcagcaaatatgaaaagctcgctaagataggtcaaggtacattcggcgaagtgttcaaggcaaggcatcggaaaaccgggcaaaaagttgccctgaaaaaggtgctgatggagaatgagaaagaaggcttccctatcactgctttacgtgagattaaaattctgcagctcttgaagcacgagaactag

SEQ ID NO: 14785 - DNA, 495 bp, Artificial Sequence
  Description of Artificial Sequence: Synthetic coding sequence
atgtctgagcccgccggcgatgtccgtcagaatccatgcgggtctaaggcctgcagacgcctgtttggtcctgtggatagcgagcaactgtctcgcgattgtgacgctctgatggctggctgcattcaagaagcccgtgagagatggaattttgattttgtgaccgagacgccactggagggggactttgcatgggagcgtgtgcgcggtctcggcctgccaaagctctatctgcccacggggccccggcggggaagagacgaattggggggaggtcgacgaccaggaactagccccgccttactgcaggggaccgcagaggaggaccatgtggatctgtccctgagttgtaccctggtcccccgttctggggagcaagcggaggggtccccagggggccccggcgacagtcagggaagaaaacgaaggcagacatccatgactgatttctaccactctaagcgaaggctgatcttctctaaacggaaaccttag

SEQ ID NO: 14786 - DNA, 495 bp, Artificial Sequence
  Description of Artificial Sequence: Synthetic coding sequence
atgtccgaaccagctggagatgtccggcaaaacccgtgtggcagtaaagcttgtcggagactgtttgggcccgtggactccgagcagctgagcagagactgcgatgcattgatggctgggtgtatccaggaagcccgtgagcgctggaactttgatttcgtcactgaaacgcccctggagggcgacttcgcctgggaacgagtcagaggtttagggctgcctaagctgtatttgcctacgggaccaaggaggggtcgagacgagctgggggggggtagacgaccaggaacgagcccagcactattgcagggaacagccgaggaggatcacgtggatctgagcctgagttgcacccttgtacccagaagtggggaacaggcggagggctccccaggaggtcctggcgattctcaagggcgaaaacgaagacagacctccatgactgacttctatcattctaaacgacggctcatcttttccaagcgcaagccatag

SEQ ID NO: 14787 - DNA, 495 bp, Artificial Sequence
  Description of Artificial Sequence: Synthetic coding sequence
atgtcagaacctgcaggagacgtgcgccaaaacccatgcggtagcaaagcctgtcgtcgactgttcggacccgtggacagtgagcagctcagtagggactgtgacgcgctgatggcagggtgtatccaggaagctagagaacgttggaacttcgactttgtgacagaaactcctttggaaggcgactttgcctgggaaagagtgaggggtctgggcctccccaaactctacttaccgacaggtcctcggcggggtagagacgagcttgggggtggccgtcgacctggaacatctcccgccttattacagggcactgcagaggaggaccatgtggacctttccctgtcatgcactttggttccacggtctggtgaacaggccgagggctcgcccggcggccctggggattcccaggggcgaaaaagaagacagacttccatgactgatttttatcatagcaaaagacgcttgattttttctaagagaaagccctag

SEQ ID NO: 14788 - DNA, 597 bp, Artificial Sequence
  Description of Artificial Sequence: Synthetic coding sequence
atgtggggagtcttccggcgacagacaacacactccagcaatccgcccctgcccggccagcaatcttgctgtaatcaccgggatttcttctgttcaggggctatgagcgagccagccggcgacgttcgtcaaaatccatgtggaagtaaagcatgcaggagactgtttggacccgtggattcggagcagctgtccagggactgtgacgctttgatggcaggatgtatacaagaggctagagagcggtggaatttcgacttcgtgactgagacccccctggagggagactttgcctgggaacgcgtgcgcgggctgggtctgcctaaactgtatcttcctacaggcccccggcgtggacgagatgagttaggcggaggaagaaggccaggcactagtccagctctgcttcagggaacagcggaggaagatcatgtagacctttcactctcatgcactctcgtgcccagaagtggcgaacaggccgagggctcccccggaggccctggcgactcacaaggccggaaaagacgccagacctcaatgaccgatttctaccattctaagcgtagactcattttttccaaacgaaaaccttag

SEQ ID NO: 14789 - DNA, 363 bp, Artificial Sequence
  Description of Artificial Sequence: Synthetic coding sequence
atggacgatagcaaagtcgtaggcgggaaagtcaagaaacccggtaagcgcggtcggaaacctgcaaaaatagacctaaaagcgaaactggaacgcagccgccagagcgctcgcgaatgccgtgcgaggaagaaactccgttaccagtacctagaggagctggtctcttcgcgcgagcgagctatctgcgccctgcgagaagagctcgaaatgtacaagcaatggtgtatggcaatggaccagggcaaaatcccaagcgagatcaaggcattactgaccggggaggaacagaacaagtcccagcagaattcttctcggcacactaaggctggcaaaacagatgctaactccaatagctggtag

SEQ ID NO: 14790 - DNA, 444 bp, Artificial Sequence
  Description of Artificial Sequence: Synthetic coding sequence
atggaggaggccagtcaacggaaatggaactttgactttcagaaccataagcccctggaggggaaatatgagtggcaagaagtggagaaagggtccctgcccgagttttactaccgccccccccgtccccctaagggtgcatgcaaggtgcccgcccaagagagtcaggacgtgtcgggttctagacccgcagccccactgattggagccccagccaattcggaagatacccacctggttgatcccaagacagacccatccgacagccagacgggactcgcagaacagtgtgccggaattaggaagcgaccagctactgatgattcttcaacacagaacaaacgggcgaaccgtactgaagagaacgtgtctgacgggtcaccaaatgcgggctcagtcgagcagacacctaagaaacccggtctccgacgccgtcagacttag

SEQ ID NO: 14791 - DNA, 918 bp, Artificial Sequence
  Description of Artificial Sequence: Synthetic coding sequence
atggagcgcctggtcgcccgaggaacgttccccgtgctagtcaggacctcagcttgccgctccctgttcggaccggtggatcacgaggagctgtctagggaactgcaagcacgcctggccgaacttaacgccgaagatcagaatcgatgggactatgattttcaacaggacatgcctctgagagggcctggcagacttcagtggaccgaagtggatagcgacagcgtcccggctttctatagagagactgttcaagtgggtcggtgcagacttttacttgcaccgagacctgttgctgtcgccgttgcggtgagccctcctctagagcctgccgccgagagtctggacggcctggaagaagcaccggaacagttgccgtctgtccccgttcccgcccctgcatccacgccaccccccgttcccgtactggccccagccccagcccctgcacctgcaccagtcgcggcgcctgttgctgcccccgtagccgtcgcagtattagcccccgcgccagcgcctgctcctgcccctgcccccgctccagcgccagtggcagcaccagcaccggcccctgctcccgcacctgctccggcgcccgcccctgcccctgcacccgatgccgcaccccaggagagcgccgagcagggagccaatcaaggacagcggggacaagagccgcttgcagatcagttgcacagcggcattagcggtcggcccgccgcagggaccgcggcagctagcgcgaacggcgcagcgatcaaaaagctgtctgggccacttatttcagatttcttcgccaaaagaaaaaggagcgccccagagaagtcaagcggggacgtgccagccccatgcccttcacctagtgccgctcccggagtcggaagcgtcgaacagacacctcgcaaacggctgaggtag

SEQ ID NO: 14792 - DNA, 951 bp, Artificial Sequence
  Description of Artificial Sequence: Synthetic coding sequence
atgagtgacgcaagtctaagatccactagtacgatggagcgcttggtggcccggggcacctttcccgtgctggttagaacatctgcctgtcgaagtctgtttggccccgttgaccacgaagaactttcacgtgagctccaggcccgcctggccgagctgaacgcggaagatcaaaatagatgggattacgatttccagcaagacatgccgctgcgcggaccaggacgtctgcagtggaccgaagttgattccgattcagtgccggcattttacagagagacagtacaagtgggcaggtgtcgcctcctcctggccccacgacccgtggccgtcgcagttgccgtctcaccacccctggaaccagcggcggagagcttagacggattggaggaggcaccggaacaactgcctagtgtgccagtcccagcccctgcttcgacccctcctcccgtacctgttctcgccccagctcctgctcctgcccccgctcccgtcgccgctcccgtagcggctccagtggccgtcgcggtactggctccggcccccgccccggcaccggcgcctgcccccgcaccagcacctgttgctgcaccagctcccgccccggccccggcaccagcacccgcccctgcgcctgccccagcacccgacgccgctccacaggagtcggctgagcagggggccaatcaggggcaacgcggccaggagccccttgccgatcagctccattctggtatctctggaaggcccgctgcgggaactgcagccgccagcgcaaatggagcagccatcaagaagctgagtggaccacttatctcagacttctttgccaagcgaaagagatcggctccagaaaagtctagcggggacgttccggcgccatgtccctcaccatcagctgccccaggcgtgggatcggtggagcaaacccctcgaaaaagacttcgttag

SEQ ID NO: 14793 - DNA, 951 bp, Artificial Sequence
  Description of Artificial Sequence: Synthetic coding sequence
atgtccgatgcttctctgcgaagtactagcacaatggagagactagtcgctaggggtactttcccagtgctggtgcgcaccagcgcctgtagaagtctgttcggcccagtggaccacgaggagctgagccgcgagctgcaggctcgtctcgcggagctgaacgccgaggaccagaatcggtgggactacgattttcagcaagatatgccgttgcggggccccggacgacttcagtggaccgaagtggatagcgatagtgtgcctgccttctatcgggaaacagtgcaggtcggaagatgcagactactactcgccccccggcccgtggcagtcgccgtcgcagtgagccctcccttagaacccgccgctgagagtttggacggcctggaagaggctcctgagcagctccctagtgtgcccgttcctgcacctgcctccactcctcccccagtgcccgtcctggcacctgcacccgcaccagctcccgctccagtggctgctccagtggctgcccctgtggccgtggccgtgctggctccggcgcctgctccagccccagctccagcccctgcccctgctccagtggctgccccagcacccgctccagcacccgcccccgcacccgcacccgcacccgccccagcgcctgacgcagctccacaggagagcgctgaacagggcgccaaccaaggccagcggggacaggagcctctggcggatcagttacattctgggatcagtggccggccggcggccggcacggccgccgcctctgctaatggggcagcaattaaaaaactcagtggccccttaatatccgacttttttgccaagagaaagcgttcagcacccgaaaaaagttccggagatgtgcccgcgccatgtccaagccccagcgctgcgcctggcgtgggcagtgtcgagcagaccccccgcaagaggttgcggtag

SEQ ID NO: 14794 - DNA, 918 bp, Artificial Sequence
  Description of Artificial Sequence: Synthetic coding sequence
atggaacgcctcgtggccaggggaacttttcccgtcctcgtccggacgtccgcctgcagatcattatttggcccggtcgaccacgaagagctttctagggagcttcaggcaaggctggccgaactgaacgctgaagaccagaatcggtgggattatgatttccaacaggatatgcctttgcggggtcctgggaggctccaatggaccgaggtagattccgattccgtgccagcattttatagagaaacagtccaggtcggtcgatgccgactgctgctggcaccacgcccagtcgctgtggccgtggccgtgagccctccccttgaaccagctgctgaatcactggatgggctggaggaagctccagaacaactgcccagtgtgccggtccccgccccagccagtacaccacctcccgtgccagttctcgccccggctccagcccctgcccccgcgcccgtcgccgctcccgtggcagctcctgtggccgtcgccgtcctcgcacctgcacccgcaccggcacctgctcccgcacccgcccccgcccctgtagccgcacccgcaccagcacccgctccagcacctgcccctgcccccgctccagctccggcccctgacgctgctcctcaggagtccgccgaacaaggcgcgaaccaggggcagcgtggacaggagccactcgccgaccagttgcactccggaatctcggggagaccggcggctggtacagctgccgcaagtgccaacggggccgctattaagaagctgtctgggcctctcattagcgatttctttgctaagagaaaacgctcagccccggaaaaatcctcaggtgatgtgcccgcaccgtgccccagcccttccgcagctccgggagtcggctccgtggagcagaccccacggaagcgtttgcgttag

SEQ ID NO: 14795 - DNA, 504 bp, Artificial Sequence
  Description of Artificial Sequence: Synthetic coding sequence
atggaacccgctgcgggctcctctatggaacctagcgccgattggctggcaaccgctgcagcaagaggtagggtggaggaggtgagagcacttcttgaagccggtgccctgccaaatgcccccaattcttacggtcgccggcctatccaggtcatgatgatgggttctgctagggttgccgagttgttgcttctgcacggcgcggagcccaactgtgccgatccagccaccctgactcgtcccgtccacgatgcagctcgtgaaggcttcttggatactttggtcgttttgcatagggccggtgcccggctggacgtccgagacgcctggggccggctgcccgtggacctggctgaggagttgggacacagagacgtcgcccggtatctgagagctgctgctggtggcacccgaggcagtaatcacgctcgaatcgatgccgctgaaggcccctcggaaatgattggtaatcacctgtgggtctgtaggagcaggcatgcttag

SEQ ID NO: 14796 - DNA, 471 bp, Artificial Sequence
  Description of Artificial Sequence: Synthetic coding sequence
atggagcctgctgccggctcctcaatggagccaagtgcagactggctagccacagcggctgctaggggccgcgtagaggaggttagggctctgcttgaggcaggcgccctgcccaacgcacctaacagctatggccgccgcccaatccaggtgatgatgatgggtagcgctagagtggcagagcttctgctgcttcatggggccgagcccaattgtgccgaccccgctacactaacaagacctgtgcacgacgcggcccgggaaggctttctcgacacgttggtcgtgttgcaccgtgcaggggcaaggttggacgtgcgggacgcatggggcagacttccagtggaccttgccgaagagctgggtcatcgagatgtagcccgctacctccgggcagctgccggcggcaccagagggagcaatcatgcccgaatcgatgctgcagagggtccctcagacatcccagattag

SEQ ID NO: 14797 - DNA, 522 bp, Artificial Sequence
  Description of Artificial Sequence: Synthetic coding sequence
atgggcaggggacgctgtgtgggcccttccctgcagttgcgcggacaggagtggaggtgtagcccgttggttcctaaaggaggtgctgctgccgcagagttgggtcctggtggaggcgaaaatatggttaggcggttcctcgttaccctcagaatacgtagggcatgcggcccaccccgagtgcgggtcttcgtcgttcatatcccaaggctcacgggggaatgggctgcccctggagctcccgcagccgtcgcacttgtgctcatgctgctccgatcccaacgattgggtcagcagcctcttccccggcgacccgggcacgatgatggacagaggccatcagggggcgcagccgccgcaccaagacgaggcgcccagctgcgccggcctcggcactctcaccctacgcgcgcacgacggtgcccgggcggcctgcccggccacgcaggtggggctgcaccaggccggggggccgcaggcagggctcgatgcctgggcccaagcgcacgtggtcctggttag

SEQ ID NO: 14798 - DNA, 504 bp, Artificial Sequence
  Description of Artificial Sequence: Synthetic coding sequence
atggagccagccgcgggctccagtatggagccatctgccgattggctggccacagccgccgcacgtgggagggtcgaagaagtgcgagcactcctggaagcaggggcacttcctaacgcccccaatagttacggcaggcgccccattcaggttatgatgatgggatctgctagggttgccgagctccttctcctgcatggtgctgaacctaattgtgccgatccggctacactcacgcggcctgtccatgatgccgcccgagagggctttcttgacactttagtggtattacatagagccggcgctcgactggacgtgcgggatgcctgggggcggttgcccgtggacttagctgaagagttaggccatcgcgatgttgccaggtatctgcgtgcggctgcgggaggaactaggggctctaaccacgctagaatcgacgctgcggagggcccttccgaaatgattggcaaccatctgtgggtttgcagatctcgacacgcgtag

SEQ ID NO: 14799 - DNA, 399 bp, Artificial Sequence
  Description of Artificial Sequence: Synthetic coding sequence
atggtcaggcgctttctggttacacttcgcattcgtagagcttgtgggcccccaagggtgcgcgtgtttgtggtgcatatccctaggctaacaggagagtgggccgccccaggcgcccctgccgctgtagctcttgtactgatgctactgcggtctcagcggctggggcaacagccccttccgcgccgacccgggcacgacgatggccagcgcccctcaggtggggccgcagccgccccaaggagaggggcccaactgagaagaccacgccatagtcaccccaccagggccagacgatgccctggcggtctgcccggccacgctggcggcgctgcacccgggagaggggcagccggacgcgcccggtgcctgggcccgagtgcccggggcccaggctag

SEQ ID NO: 14800 - DNA, 417 bp, Artificial Sequence
  Description of Artificial Sequence: Synthetic coding sequence
atgcgtgaagagaataaggggatgccatccggcggcggctctgacgaagggctggcctctgccgctgcccgcggtctggtggaaaaggtgagacagttgcttgaagcgggggcagatccaaacggggtcaaccgttttggccgcagggccatccaagtcatgatgatggggagcgcaagggtagcggaactccttcttctccatggggcagaacctaactgcgccgacccggcgacactaaccaggcccgtccacgacgctgccagggaggggtttctggatactctggtcgtgctgcaccgtgctggcgcccggctggacgtgcgagatgcctggggccgcttacccgtggacttagccgaagagcgaggccaccgagatgtcgctggctacttgcgcacggcaactggtgactag

SEQ ID NO: 14801 - DNA, 237 bp, Artificial Sequence
  Description of Artificial Sequence: Synthetic coding sequence
atgcgcgaagaaaacaagggtatgccctctggagggggcagcgacgaggggctcgccagcgctgctgccagaggactggttgaaaaagttagacagctcctggaggcgggcgccgaccccaatggcgtgaatcggttcggcaggcgcgccatacaggtggctggcgcacccgggccacgacggcagggggcgagagaaagaggtgcccggcccagacggatcggggcaggcacctag

SEQ ID NO: 14802 - DNA, 237 bp, Artificial Sequence
  Description of Artificial Sequence: Synthetic coding sequence
atgcgcgaggagaacaaaggaatgcccagtgggggcggaagcgatgaggggctcgccagcgctgcagctagaggtttagtggagaaagtgaggcaattgctggaagctggagcagaccccaatggagttaaccgcttcggtcggagagccatccaggttgcaggggcccccggtcctagaagacaaggagccagagagaggggcgccagacctcgtaggatcggagccggaacctag

SEQ ID NO: 14803 - DNA, 507 bp, Artificial Sequence
  Description of Artificial Sequence: Synthetic coding sequence
atggccgagccttggggaaacgagctagcttcggcagctgcgcgcggggatttggagcagcttacttccttgttgcagaataacgtgaatgtgaatgctcagaatgggttcggtcgaactgctctgcaagtgatgaagctgggaaaccctgaaatcgctaggcggctcctcctgcgaggtgcaaacccggatcttaaagaccgaacgggcttcgcagtgatccacgacgccgcgcgagccggattcttggacacgttgcagaccctcctggaatttcaggctgacgtaaacatcgaagacaatgagggcaacctgccactgcacctggccgcaaaagaaggacacctgagagtggtcgagttcctggtgaagcatactgccagcaacgtggggcaccggaatcataaaggggataccgcatgcgatctggcccggttatatggcaggaatgaggtggtttctttaatgcaagcaaatggggccggaggagcaaccaacctgcagtag

SEQ ID NO: 14804 - DNA, 507 bp, Artificial Sequence
  Description of Artificial Sequence: Synthetic coding sequence
atggccgaaccatggggaaatgaactggctagcgccgccgcacgcggcgatctagaacagttaacctccctgctgcaaaacaatgtgaatgtcaatgcccagaacgggtttggacgaaccgccctgcaagtgatgaagctaggcaatccagagattgcccgtcggctcctgctgcgcggtgctaaccccgatttaaaggaccgtaccgggtttgctgtcattcatgacgcagccagggctggtttcttggatactctccagacactcctggaatttcaggccgatgtaaacatcgaagacaacgaaggcaatctgcctctacatctggccgccaaggagggacacttgagagtggtggagttcctggtgaagcataccgcatcaaacgtcggccacaggaatcataagggtgatacagcttgcgatctggctaggctgtacgggagaaatgaggtggtgtctcttatgcaagccaatggtgcagggggtgcaacgaacctgcagtag

SEQ ID NO: 14805 - DNA, 507 bp, Artificial Sequence
  Description of Artificial Sequence: Synthetic coding sequence
atggcagaaccttggggcaatgagctcgcctcagctgcagcacgcggtgaccttgagcaactgacatcccttctgcagaataacgtgaacgtaaatgcgcagaacggtttcggtcgcacagctctgcaggtcatgaagctcggaaatcccgagattgccagacgtctgctcttgcgtggagccaacccagatttgaaggaccggacagggtttgcagtgattcatgacgctgctcgtgccggcttccttgacactctccagactctgctcgagtttcaagctgatgtaaacatcgaagacaatgagggaaatctccccctgcatttggcagcgaaagaaggacacctgcgagtcgtggaatttcttgtgaagcacacagcctctaacgtcggacaccgcaaccacaaaggagataccgcctgtgacttagctaggctgtacggaaggaatgaggtagtcagcctaatgcaagcaaatggtgctggcggcgcaacaaatttacagtag

SEQ ID NO: 14806 - DNA, 501 bp, Artificial Sequence
  Description of Artificial Sequence: Synthetic coding sequence
atgctcctggaggaggtacgagccggggaccgtcttagcggggcggctgctaggggagatgtgcaagaggtacggcgccttctccacagagagctggtccaccccgatgctctgaaccgctttgggaaaaccgcattgcaagtcatgatgttcgggtctactgccattgcgctggaactgttgaaacagggggcatctcccaacgtgcaggatacatcgggtacgtctcccgtgcacgatgccgcccgcactgggttccttgacacgcttaaagtgcttgttgagcacggagcggatgtgaatgtgcccgacggcacaggtgctctcccaatacatctggccgtacaggagggacatacggccgtggtctcctttttggcggcagaatctgacttacaccgcagggacgcccgtggcttgacacccctggagttggccctgcaacgcggtgcacaggatctagtggatattttacaggggcacatggtggcccccctgtag

SEQ ID NO: 14807 - DNA, 501 bp, Artificial Sequence
  Description of Artificial Sequence: Synthetic coding sequence
atgttgcttgaggaggtacgggccggagaccgactatccggggccgccgcaagaggtgacgttcaggaagtccggcggttgcttcaccgagagctagttcacccagacgctctgaacaggtttggtaagaccgcactacaggttatgatgttcggatccactgcgatcgcgctcgaactgctgaaacagggggcatccccgaacgtacaagacacctcaggaacttcaccagttcatgacgccgctaggacgggcttcctcgatactcttaaagttttggtcgaacacggtgctgacgtcaatgtgccagatgggactggggccctgcccatacaccttgccgtgcaggaggggcacaccgctgtggttagttttctggctgcagagtccgaccttcaccggcgcgatgctcgggggctgacccccctggaattggccttgcaacggggggcccaggacctggtggacatcttacaggggcacatggtggccccactgtag

SEQ ID NO: 14808 - DNA, 639 bp, Artificial Sequence
  Description of Artificial Sequence: Synthetic coding sequence
atgaagcctccctcgagcattcagaccagcgaatttgattcctcagatgaagagcctatagaagatgagcaaacccctatccacatatcttggttatcattgagccgggtaaactgcagccagttcctcggactttgcgctctgccaggctgtaaattcaaggacgtgcgcagaaatgtccagaaggatactgaagagttgaagagttgcggaattcaggacattttcgtgttctgcacacgcggcgagcttagtaagtaccgtgtccctaatctactcgacttataccagcagtgtgggataataacgcaccatcatcctatagccgacggcggaacacccgacattgcttcttgctgcgagatcatggaggagcttacaacttgcctgaagaattacagaaagactctgatccactgctatggtgggctcggccggtcatgtctggtagccgcctgcctcctcctgtatctcagcgacactattagccccgaacaggccatcgatagcctgcgggatttgaggggcagtggtgcaatacagaccattaagcagtacaactatctgcacgaattcagagacaagttagccgctcatctgagcagtcgagattcgcagtctagatctgtgtctcgatag

SEQ ID NO: 14809 - DNA, 501 bp, Artificial Sequence
  Description of Artificial Sequence: Synthetic coding sequence
atgaacccctgctgcaaatttaaggacgtgcgcagaaacgtgcagaaggacactgaggagctgaagagctgtggcattcaggacatatttgtgttctgtacgaggggagagttgtcaaagtaccgcgtgccaaatcttctggacctttaccaacagtgtggcattataacacatcaccacccaatcgctgatggcggaacccccgacatcgcctcttgttgtgagataatggaggagctcaccacttgcctcaagaactatcgtaaaaccctgatacactgttatggaggccttgggaggtcttgtcttgtcgctgcgtgcttacttttgtacctctcagacacaatctctcccgagcaggcgatcgacagtctgcgtgatctgcgcggatcaggagctatacaaaccataaagcagtacaattatttgcatgaatttcgggataaactggctgcacatttgtcctcccgagactcccagtcccgttcagtttctcgatag

SEQ ID NO: 14810 - DNA, 210 bp, Artificial Sequence
  Description of Artificial Sequence: Synthetic coding sequence
atgaagcctccctcttccatacagacctcagaatttgactcaagtgatgaagaacctattgaggatgagcagacccctatacacattagttggctctccctcagccgggtcaattgtagccaattccttgggctgtgcgctttgcccggctgcaagtttaaagacgtgcggaggaatgttcagaaagagaagaagaagaagaagaaatag

SEQ ID NO: 14811 - DNA, 624 bp, Artificial Sequence
  Description of Artificial Sequence: Synthetic coding sequence
atgaagccaccatcttcgatccagacatccgagttcgattcgagcgacgaagagcctatcgaggatgagcaaactccgattcatatttcctggttgagtctctcacgagtcaactgcagtcagtttttaggactgtgtgccctccctgggtgcaaattcaaggacgttagacgcaacgttcagaaagacaccgaagagctgaagtcctgcggcattcaagacatcttcgtgttttgcacacgaggcgagctctccaaataccgggtgcccaatctcctggatttataccagcagtgcggaatcatcacgcaccaccatcctatcgccgacggggggaccccagatatcgcttcttgttgtgagatcatggaagagcttaccacatgtttgaaaaatcttttctgctacgggggccttggccggtcatgcctcgttgccgcatgcttgctgctctacctgagcgacacaatctctccagaacaggctattgattccttgagagatctccgggggtcgggagccattcaaaccatcaagcagtacaactatttgcatgaattcagagacaagctcgccgctcatctgtcttctcgggactcccaatctaggtccgtctcaagatag

SEQ ID NO: 14812 - DNA, 519 bp, Artificial Sequence
  Description of Artificial Sequence: Synthetic coding sequence
atgaagcccccatctagtattcagacaagctgcaagttcaaggacgttcggcggaacgtacaaaaggataccgaggagttgaagtcctgtggaatccaggacatctttgtgttctgtactcgaggcgagctgtctaaataccgggtcccgaacctgctggatctctaccagcagtgcggcataattactcaccaccatccaatagccgatggcggaaccccggacatcgccagctgctgcgaaattatggaggaactgaccacatgcctcaagaactacaggaagactcttattcactgttacgggggcctcggacggagctgcttggttgctgcatgtctgctgctatacttgtctgataccatcagtccagagcaagccatcgactctctgagagaccttaggggcagtggggccatccagaccataaagcagtacaactacctccacgagttcagggataaactagctgcccatctgtctagcagggatagccagtcgaggagtgtctctagatag

SEQ ID NO: 14813 - DNA, 2871 bp, Artificial Sequence
  Description of Artificial Sequence: Synthetic coding sequence
atgtcctctggcctttggagtcaggagaaggtcacctcgccctactgggaggaacgaattttctatctgcttctgcaggaatgctccgtcacagataagcagacacagaaacttctcaaggttccaaagggcagtatcggtcaatacattcaggaccgttccgtcgggcattctagaattccctcggcaaaaggtaagaagaatcagataggtctaaagattctggagcagccccatgcagtgctctttgtcgacgaaaaggacgtcgtggagataaacgagaaattcacggaactgcttctggctatcacaaattgtgaggaacggttctcccttttcaaaaatcgcaacaggctctctaagggtctccaaatagacgtcggctgtccagtcaaggttcagcttcgcagcggagaagaaaaatttcctggagtcgtgcggttccgcggtcccctgttggcagagaggaccgtgtccggaatcttttttggagtggagttgttggaggaggggagaggccagggatttaccgatggcgtttaccaggggaagcagctctttcagtgtgacgaggactgcggggtgttcgtcgcgctggataagctggagctcatcgaggatgatgacacagccctggagtccgactacgctggtccgggtgacaccatgcaggtggagttgcctccgctcgagatcaacagccgggtctcgctgaaggtgggagagacgatcgagagcggtaccgtcatcttttgcgacgttctccccggcaaggaaagtctggggtacttcgtcggggtggatatggacaatccgatcggcaactgggacggtcgctttgacggtgttcagctctgctcgtttgcctgcgttgaaagtactatcctgttgcacattaacgacattatccccgccctgtctgagtcggtgactcaggaacgccgcccgcctaaacttgcatttatgagccgaggggtaggcgataaaggatcaagctcacataataagccaaaggctaccggctctacaagtgaccccggtaacagaaatagatccgagttgttttacacacttaatgggtcctctgttgactctcaacctcaaagcaagtccaagaacacctggtacatagatgaggtcgccgaggatccggccaaaagcctcacagagatctccactgattttgataggtcctcgccccccttacagcccccgcctgtcaactcattgacaaccgagaataggtttcactctctcccattctcgctcactaaaatgcccaacacgaacggctccattggtcatagccccttgtcgttgtccgcccaatccgtcatggaggaattgaatacagcacctgtgcaggagagtccgccactggcaatgcccccaggcaacagtcacgggttagaagtgggctccctcgcagaggtcaaggagaacccaccattctacggggtgattagatggattgggcaaccacctggactcaacgaggttcttgctgggctggaactcgaggacgaatgcgctggatgcaccgatggcacattcaggggcacaaggtacttcacctgcgcccttaagaaggctttattcgtgaagctgaagagctgtaggccagatagcagattcgcctccctacaacccgtttccaaccagatagagaggtgcaatagtctagcatttggaggctatctgagtgaagtagtagaggagaatactcctcctaagatggaaaaggagggtttggagatcatgattggtaaaaaaaaaggcattcaaggccattacaactcttgctacctcgattccacgctgttctgcctcttcgctttctccagcgtgctggatacagtcctgctaaggccaaaggaaaagaacgacgtagaatattactcagaaacgcaggagcttcttagaaccgagattgtgaatcctcttcgcatttacggatacgtgtgtgcaaccaagattatgaagctgcgtaagatcttagagaaagtggaagcagccagcggctttaccagcgaagagaaggatcctgaagaattcctgaatatcctcttccaccacatcctgcgagtggagcctcttcttaaaataaggtctgctggtcagaaagtgcaggactgctacttttatcagatcttcatggaaaaaaacgagaaggtgggggtgccgacaatccaacagctgttggaatggagtttcatcaactccaatctgaaattcgctgaggcaccatcctgtctgattattcaaatgcctcgtttcggaaaggactttaaactgttcaaaaaaatcttcccctctttggaattgaatataaccgacctccttgaagacactccccgacaatgccgcatctgcggcgggctcgcaatgtacgagtgccgcgagtgttacgacgacccggatattagcgctggaaagattaaacagttttgcaagacctgtaacacccaggttcatttgcaccctaagaggcttaaccacaaatataaccccgtctcattacccaaggacctaccagattgggattggcggcacggctgcatcccatgtcagaacatggaactttttgcggttttatgcatcgagacatcccactatgtggcttttgtcaaatatggcaaggacgattcagcctggctctttttcgattctatggcagacagagacggaggtcagaatggctttaacataccacaagtgaccccttgtcctgaggtgggggaatacctcaaaatgagtctggaggatttacactccctggattccaggagaattcagggttgtgcacggcgactcttatgcgacgcctatatgtgtatgtatcagtcccctaccatgtctctgtacaaatag

SEQ ID NO: 14814 - DNA, 2862 bp, Artificial Sequence
  Description of Artificial Sequence: Synthetic coding sequence
atgtcaagtggtctttggagtcaggaaaaggtaacctctccgtactgggaagagaggatattctacctactgctgcaggagtgctccgtcacagataagcaaacacagaagttgttgaaagtccctaaggggtccatcgggcaatacatacaggacagatctgttggtcacagtagaatcccttctgccaaggggaaaaagaatcagattggactgaagatattggagcagcctcatgctgtgctttttgtcgacgagaaagacgtcgttgagattaatgagaaatttacggaactccttttggccatcaccaactgcgaagaaaggttctctctgttcaaaaatcgtaatagacttagcaaaggcctgcagatagacgtgggctgcccagtcaaagtgcagctccgctctggtgaagagaaattccctggcgtagtgagatttagagggccactgctcgctgagagaaccgtcagtggcattttcttcggagtggagctgctagaggaaggacgtggccaagggtttacggacggagtatatcaggggaaacaactttttcagtgtgacgaggattgcggtgttttcgtcgccctggataaactagaactgatcgaagatgacgatacagccttggagtcagactacgctgggcccggcgacactatgcaggtagagttgccaccactcgagatcaattctcgggttagcctgaaagtcggcgagaccattgaatccggaacggtcattttctgcgatgtcctgccaggtaaggagagtctggggtattttgttggggtcgacatggataaccctataggcaattgggatgggagattcgatggtgttcagctttgttcattcgcctgtgtggagagcaccatcttactgcatattaatgacatcatccctgaatcagtgacacaggagcgtaggcctcctaaactggcattcatgagccgaggtgtgggggataagggaagctcgtcccacaataaaccgaaggccactggctcaacctcggatccagggaatagaaataggagtgagctgttttatactcttaatggatcttccgtcgacagccaaccccagagtaagtccaaaaacacatggtacatcgatgaagtggcagaggaccccgcaaagtcactaacggagattagtaccgacttcgaccgctccagtcctccgctccagcctcctccggttaactctcttactacagagaaccgcttccactctcttccctttagtctgacaaaaatgcccaacaccaatggtagcatcggacatagcccactgtccctgtctgcacagagcgttatggaggaattaaatacggcacccgtccaggagagcccgccactcgccatgcctcctgggaattcccacggacttgaggtgggcagcttggccgaggtgaaggaaaatccacccttctacggggtaatacgctggatcggccagcctcccggcttgaatgaagtactcgccggattggagctggaagacgagtgcgctggatgcacggacggaacatttcggggaaccaggtattttacctgcgctctcaagaaagctttgtttgtgaaactgaagagttgtcgtcccgattcgcggttcgcttccctccagcccgtttcaaatcagattgaacggtgtaactctctggcattcggtggctacctcagtgaggtggtggaagagaacacaccgccaaaaatggagaaagaagggctggagattatgatcggcaaaaagaagggaattcagggacattacaattcttgctatctggattcaacactgttttgtttgttcgctttctctagcgtccttgatactgtactcctgcgccccaaagaaaaaaacgacgttgagtattacagtgaaacacaggaattgctcaggacagagatagtaaatccgctgaggatatacgggtacgtgtgtgcgaccaagatcatgaagctgcgtaaaatcctggagaaagtggaagctgcttccggtttcacctcagaggaaaaagatccagaagaattcctcaacatcctgttccaccatatcttacgggtggaacccctcttaaagatccgatccgctggtcagaaagttcaggattgttacttctaccagatcttcatggaaaaaaatgagaaggtcggggtacctacgatccaacagctccttgagtggagcttcataaatagtaatctgaagtttgcagaggcaccctcttgcctgatcattcaaatgccaagattcggtaaagacttcaagctgtttaagaaaatttttccaagcctggagctgaacatcacagacctgttggaggacaccccccggcagtgtcgcatttgcggcgggttagccatgtacgaatgtcgcgagtgttatgacgatccagacatcagcgccggcaaaatcaaacaattctgtaagacctgcaacacgcaggtccatctgcatccaaaacgactgaatcacaagtataacccggtgtcattgcccaaagatctgccggattgggactggaggcatggttgtatcccatgccagaatatggaactctttgctgtactgtgcatcgagacatctcattatgtcgcatttgttaaatacgggaaggatgattcggcgtggctgtttttcgatagcatggccgaccgcgacggtggccagaatggatttaacataccccaggtcactccgtgtcctgaggtgggagagtatctcaagatgtcactagaggacctccatagccttgacagcagaaggattcagggctgcgctcggcggctgctctgtgatgcttacatgtgcatgtaccagagcccaacaatgtcactttataagtag

SEQ ID NO: 14815 - DNA, 2862 bp, Artificial Sequence
  Description of Artificial Sequence: Synthetic coding sequence
atgtccagcgggctgtggagccaggaaaaagtgacaagcccctattgggaggaaaggatcttttacctgctgctacaggaatgttctgtaactgataaacagacacagaaattgttgaaagtgccaaaaggctccataggtcaatatattcaagacagaagcgtcggccactcccgaattccttctgccaaggggaaaaaaaatcagatcgggcttaaaatactcgagcagccacacgccgtgctattcgtagatgaaaaagatgtcgtggagataaacgagaagttcactgagcttctccttgctatcaccaactgtgaggaacggttctctttgtttaagaaccggaacagactcagcaagggcttgcagatcgatgtcggctgtcctgtgaaagtccagcttcggtcaggcgaagaaaagtttcccggagtagtaagatttcgaggtccactgttggccgagcgcactgtttccggaattttcttcggggtggagctcctggaagaagggaggggccagggtttcacggacggtgtatatcaggggaaacaactgttccagtgcgacgaagactgcggggtatttgtggccctggataagttggagcttatagaagatgatgacactgctctggagagtgactacgcaggaccgggagatacaatgcaggtggagttaccaccactcgagatcaacagcagggtttcactaaaagtcggggagacaatagaatcaggcaccgtgatcttttgtgacgtattacccggcaaagagagcctgggatattttgtgggggtggatatggacaaccccatcgggaactgggatggacgcttcgacggagtccaactgtgctcatttgcctgcgtggagtccactatacttctgcacattaacgatataattccagagagcgtgacacaagagagaaggcctccaaagttagccttcatgtcccgaggcgtgggagacaagggcagcagctcacacaacaagccaaaagctacggggagtacttcagaccctggcaatagaaaccgatcggaactattctatacgctgaatgggtcatccgtcgacagccaaccacaatcaaagtctaagaatacttggtacattgacgaggtcgcggaagaccccgccaagtccctcacagagatttccaccgactttgatcgaagctcacctcctcttcagcccccacccgtgaattccttgactactgaaaataggttccactccctgcccttctcactcaccaaaatgccgaacactaacgggtctattggacatagcccgctttctttgtcagcacaatctgtaatggaggagctgaacactgcgccagtgcaggaatctcccccattagccatgcccccaggcaattcgcacgggctggaggtaggaagcctagcagaggtgaaggaaaatccaccattctacggggttatcaggtggatcggccagccgcctggattgaatgaggtgctagctgggctcgaactcgaggacgaatgcgcaggctgtactgatggaacctttcggggcaccagatattttacttgcgcactgaaaaaggcactgttcgtcaaactaaagagctgccgccctgacagccggtttgcctccctgcaaccagtaagtaatcagattgagcggtgtaattcactcgcatttggcgggtacttgagcgaagtagttgaggagaatacacctcctaagatggagaaagagggcctggagatcatgatcggaaaaaagaagggtatccaggggcactacaattcatgttacctggacagcacactgttctgcttatttgcctttagctcagttctggacaccgtactcctgagaccaaaggagaagaacgacgtggagtactattccgagacccaggagctcctgcgtaccgaaattgtcaatcccctgagaatatacggctatgtctgcgcaaccaaaatcatgaagctgaggaaaattctggagaaggtggaggctgcttcggggttcacatcagaggaaaaggatcccgaggagtttctgaatatcctttttcaccacattctcagggttgaacctctcctgaagatccggtccgcaggccagaaggtgcaagactgttacttttatcagatctttatggagaagaatgaaaaggtgggcgtgccgacaatacagcaactgctggagtggtcattcattaatagcaatctgaaattcgccgaggccccctcttgcttgataattcaaatgcctcggtttggtaaagacttcaagctgttcaagaagatattcccctccctggagctgaacattactgacctcttggaagacaccccgagacagtgccggatttgcggcgggctggcaatgtacgagtgccgcgagtgttatgacgaccctgatatttccgccggaaagattaaacagttctgtaaaacctgtaatacacaggtgcatctgcacccaaagagactgaatcataaatataaccctgtttcgttgcccaaagatctgccagactgggactggaggcatggctgtattccctgccagaacatggaactcttcgcggtgttgtgcatcgagacctcccactacgtggcattcgtgaagtacggaaaagatgactcagcgtggctttttttcgacagtatggcggacagagacggtggccaaaatggattcaacatcccccaagttacaccttgccctgaggtcggggaatacctgaaaatgtcactggaggacctgcattctctggactccaggcgaatccagggatgtgcccgccggctcctgtgcgatgcctacatgtgcatgtatcagagccctacaatgagcctgtataaatag

SEQ ID NO: 14816 - DNA, 2871 bp, Artificial Sequence
  Description of Artificial Sequence: Synthetic coding sequence
atgagctcaggcctgtggtcccaggaaaaggtgacgagcccttactgggaggagagaattttctacctcctcttgcaggagtgctctgtaacggacaagcagacgcaaaaacttctgaaggtccctaagggcagcattggacagtacatccaagataggagtgtcgggcattctagaatcccttctgcgaaggggaaaaagaaccagatcggcctgaagatacttgagcagccacacgcagtcctcttcgtagatgaaaaagatgttgtcgagatcaacgagaaattcacggagttgctgctggccatcacaaactgcgaggagcggtttagccttttcaaaaaccgcaacaggctctctaaaggcctgcagatcgacgtgggatgccctgtcaaggttcaactacggtcgggcgaagagaagtttcccggggtagtgagattccggggcccgctcttggccgaacgaactgtttcaggtatttttttcggggtggaactgcttgaagaaggccgaggccaggggttcaccgatggagtctaccaaggtaagcagctgttccagtgcgatgaagactgtggggtgtttgtggcactggacaaactcgaactgattgaggacgatgacacagccctggaaagtgactacgccgggcccggggacaccatgcaggtcgagcttcctcccctcgagatcaatagtcgtgtgtcgttaaaggtcggtgaaacaatcgaatctgggacggtgattttttgtgatgtgctccctgggaaggaatcgttaggatatttcgtgggcgtggatatggacaatcctataggcaactgggacgggcggtttgacggggtgcagctctgttcatttgcatgcgtagaaagcaccattcttctgcatatcaacgacatcatacctgcagtctcagagagtgtgacacaagaacggcgaccccccaaactcgcctttatgtcccggggagtgggggacaaggggtcatcttcccataacaagcccaaggccacggggagcacaagcgacccaggcaaccgcaacagaagtgagttgttctatactttaaacgggtctagtgtggatagccagccccaatccaaatcaaaaaacacatggtatatcgatgaggtcgcagaagatcccgcgaagagcctgactgaaatttccactgactttgatcgaagcagtcctcctctgcagcccccccccgtgaactctttgacaacagagaatcgctttcattctctgcctttcagtctcacgaaaatgccgaacacaaacgggtcaatcggtcactcacctctatcattgtccgcgcaatcagtgatggaggaattgaatactgccccagttcaagaaagtccccccctcgctatgccccctggaaacagccacggtctggaagtgggctcactcgctgaggttaaagaaaaccctcctttttatggcgtgattaggtggatcgggcagccaccaggtctgaacgaggtattagcaggcctggagctcgaggacgagtgcgcgggctgtacagacggcaccttccgaggaacccgatactttacgtgcgcgctcaaaaaggccttatttgtgaaactgaagagttgtcgccctgacagccgcttcgcaagcctccagcccgttagcaaccagatagagaggtgcaactccctggcattcggaggatatctgtccgaggtggtagaagagaacacacctcccaaaatggaaaaggaagggctggagatcatgatcggcaaaaaaaagggcatccagggccactacaattcatgctacctggattcgaccctgttctgtctttttgccttttcatccgttctcgatactgtgttacttcgcccgaaagagaagaatgatgttgagtattacagtgagacccaggagctgctccgcacagagatagtaaacccgctccgcatttatgggtacgtgtgcgcaacaaagattatgaaacttaggaaaattcttgaaaaggtggaagccgcgtcagggttcacatcagaggagaaagaccccgaggagttcctaaatatcctctttcaccacattctacgtgtggaacctcttctgaaaattcgctccgccggccagaaggttcaggactgctacttttaccagatctttatggagaagaacgaaaaggtgggcgttccaacgatccagcagttgctcgaatggagctttattaatagcaatctcaagttcgcagaagccccaagttgccttatcatacagatgcccaggtttggaaaggatttcaagcttttcaagaaaatattcccttcacttgaactgaacatcaccgacttgctagaagacaccccaagacaatgccggatctgcggaggactggccatgtacgagtgccgggaatgctatgacgacccagacatttctgctgggaaaattaaacagttctgcaagacctgcaacactcaggtgcatttgcacccaaaacgcctaaatcataaatacaatcctgtgagtttgccgaaggatttacccgactgggactggcgtcacggttgtatcccctgccagaacatggagctgttcgcagtgctgtgcattgagacctcccactatgtggccttcgttaaatatgggaaagacgattcggcttggctcttctttgacagcatggctgatagggacgggggccagaacggattcaatatcccccaggtgacgccctgtcccgaggtgggggagtacctgaagatgtcgctagaagatctacacagcctcgactcccgccgcattcaaggttgtgcccgccggctcctctgcgatgcttatatgtgcatgtaccagagccccacaatgtccctctataaatag

SEQ ID NO: 14817 - DNA, 450 bp, Artificial Sequence
  Description of Artificial Sequence: Synthetic coding sequence
atggccaggtcaaatcttccactcgccctgggactggccttagtggcgttttgcttgcttgcgctgccaagagatgcccgggcacgcccccaagagaggatggtcggcgagctcagggacctgtcccctgatgacccacaggtgcaaaaggccgcacaggcagcagttgcaagctataatatgggaagtaactccatctattactttcgagatactcacataataaaagcccaatctcaactcgtcgccgggattaagtattttttgacaatggagatgggttcaaccgactgtcgtaaaactcgcgtgaccggtgatcacgtggacttgacaacatgccctctcgctgcaggggcacagcaggaaaagctgaggtgtgattttgaagtgctggtggtgccctggcaaaacagtagccagctgttgaagcataattgcgtgcagatgtag

SEQ ID NO: 14818 - DNA, 504 bp, Artificial Sequence
  Description of Artificial Sequence: Synthetic coding sequence
atgctgcccgagaaggctttacatggacacccccagctccctcgtaccgtccccaccagggcagcaatgagagcggccggaaccctgctggcattttgttgccttgtgctgtcgaccactggcgggcccagtccggacacttgttctcaggacctgaacagtcgagtgaagcccggatttcccaaaacgattaaaacaaatgatcccggtgtgctacaggccgctcgttactctgtcgagaaattcaataactgcactaacgatatgtttctattcaaggaaagccgcatcacccgggccctggtccagattgtgaagggcctgaagtatatgctggaggtggagatcggtcgtacaacatgcaaaaagaaccagcacctgcgcttggatgattgcgacttccagacgaaccacactctcaaacagactctctcctgctacagtgaagtgtgggtcgtcccctggctccaacacttcgaggtgcccgtgctccgctgtcactag

SEQ ID NO: 14819 - DNA, 438 bp, Artificial Sequence
  Description of Artificial Sequence: Synthetic coding sequence
atgcgggcagctggcacacttctggctttctgctgtttggttctatccacaaccggggggccctcaccggacacttgttctcaggacctgaattcaagggtgaagcctgggtttcctaaaacaataaagactaatgatccaggcgtattacaggctgcaagatacagcgtcgagaagtttaataactgcaccaacgacatgttcctgttcaaggagtctagaattacacgcgcgctcgtccagatagtgaagggcctcaaatacatgctcgaggtggagatcgggcggacgacttgtaagaaaaaccagcatttgcgcctggatgattgtgacttccagacaaatcatacactgaagcagactctctcctgctactctgaagtatgggtggtaccctggttacagcactttgaagtgcccgttcttcgctgtcattag

SEQ ID NO: 14820 - DNA, 453 bp, Artificial Sequence
  Description of Artificial Sequence: Synthetic coding sequence
atgctcggcgcggctctgcggcggtgcgctgttgcagcaactacaagggcagaccccaggggcctcctccacagcgccaggacacctgggcctgctgtcgccatacagtccgttcggtgctattcccacgggtcgcaggagacagacgaggagtttgatgctcggtgggtcacatatttcaataagcccgatatcgacgcctgggagttacgaaaaggaatcaacacgctggttacctatgacatggtccctgagcctaagataatcgatgcagctttgcgcgcatgccgcagactcaatgactttgccagcactgtgcgcattctagaggtagtgaaggacaaggctgggccacacaaggagatttacccatacgtaattcaggaactgcgccccacactgaacgagctgggaatctcaacaccagaggaactaggcctggacaaagtctag

SEQ ID NO: 14821 - DNA, 318 bp, Artificial Sequence
  Description of Artificial Sequence: Synthetic coding sequence
atgggcgacgtggagaagggtaagaagatttttattatgaaatgcagccaatgtcataccgtcgagaagggtggtaaacacaagaccggccccaacctccacgggctgtttggaagaaagactggtcaggcccctgggtactcctacactgccgccaataagaacaaggggataatctggggtgaagacacgctcatggagtacctcgagaatccaaaaaaatacatcccaggtacgaaaatgatattcgtcggtattaaaaagaaagaggaaagggcggacctgatcgcctatcttaagaaggccacaaatgagtag

SEQ ID NO: 14822 - DNA, 318 bp, Artificial Sequence
  Description of Artificial Sequence: Synthetic coding sequence
atgggcgatgtcgagaagggcaagaaaatctttattatgaaatgttcacagtgccataccgtcgaaaagggagggaaacacaagaccgggccgaatttacatggactgttcgggagaaaaaccgggcaagcacccggttactcttatactgctgctaacaagaacaagggtatcatatggggcgaagacaccctgatggagtaccttgaaaatcctaagaaatacattccgggtacaaaaatgatcttcgttgggatcaaaaagaaggaagagagggcggatctgatagcttacctgaagaaggctacgaatgagtag

SEQ ID NO: 14823 - DNA, 318 bp, Artificial Sequence
  Description of Artificial Sequence: Synthetic coding sequence
atgggagacgtggaaaaaggaaagaagatctttatcatgaaatgcagtcagtgtcacaccgtggagaaggggggcaaacacaagacaggccccaatcttcatgggcttttcggaaggaagaccggtcaggccccagggtactcttacactgccgccaacaaaaacaaggggatcatctggggcgaggatactctgatggagtacctagaaaaccccaagaagtatatccctggtacaaaaatgattttcgtggggatcaaaaagaaggaagaacgcgccgatctcatcgcatatcttaagaaagcaaccaacgagtag

SEQ ID NO: 14824 - DNA, 306 bp, Artificial Sequence
  Description of Artificial Sequence: Synthetic coding sequence
atgggagatgtggaaaagggcaaaaagatctttatcatgaagtgttctcagtgccacactgtcgaaaagggcggtaaacataagaccggccctaatttgcacggactgtttgggcgaaagactgggcaggcgcctggctatagctacactgccgcgaataagaacaaaggcattatatggggagaggacaccctgatggaataccttgagaatcctaaaaaatacatccctggcacaaaaatgatttttgtaggaataaaaaaaaaggaagaacgggccgatctgatcgcttatctgaaaaagtag

SEQ ID NO: 14825 - DNA, 1632 bp, Artificial Sequence
  Description of Artificial Sequence: Synthetic coding sequence
atgggaacgagcctgtcgccaaacgatccttggcccctgaaccccctctctatccagcagactactctgttacttctcctgtccgtgctggccaccgtacacgtggggcagcgactcctccggcagcgccgcaggcagctgagaagcgctcctcccgggcccttcgcctggccactaataggaaacgccgccgcagttggacaagcggctcacctttccttcgccaggctggctcgcaggtatggagatgtgtttcaaatcagattgggctcctgccccatagtggtgctcaacggggagcgggctattcaccaggctctcgtacaacagggaagtgccttcgccgatagacctgccttcgcatcgtttagggttgtttccgggggaaggtcaatggcctttggccactacagtgagcactggaaagttcagcgacgggcagcacattccatgatgcggaacttctttactcgacagcccaggtcacggcaggtgctggagggacacgtgttgagtgaggctcgggagttggtagctctcttggtccggggctcagcagacggggccttccttgacccgagacccctgacagtggtggccgtagcaaatgtaatgagtgccgtttgcttcggatgtcggtattcccatgatgaccccgagttccgtgagctgctttcccataacgaagaatttgggcgaacggtcggggctgggagcctggtcgacgtaatgccgtggcttcagtatttcccgaatcccgtgaggaccgtgttcagggaatttgaacagctgaataggaacttctccaactttatcctcgacaagttcttgagacattgtgagtcattgcgcccgggggccgcccctcgggacatgatggatgctttcattctgtccgctgagaaaaaagctgctggcgacagtcacggcggaggagcaagactggatcttgagaatgtgccggccacgatcaccgatattttcggggcgtcacaggacaccctttcaacagcacttcagtggcttctgctgctgttcaccaggtacccagatgtgcagaccagagttcaggccgaactcgaccaggtcgtcggccgggacaggcttccatgcatgggtgaccagcccaacctaccgtatgttttggctttcctctatgaagcaatgcgattctcttcttttgtgcctgttacaatccctcacgccacaactgcaaacacatcagtgctgggctaccacataccgaaggacaccgttgtgttcgttaatcagtggtccgtgaaccacgacccagtcaaatggccaaacccagaaaatttcgaccccgcccgattccttgacaaggacggcctgatcaacaaggacctgacttcaagggtgatgatttttagcgttggaaaaagaagatgcattggggaggaactgagcaagatgcagctcttcctttttataagtatcctggcgcatcagtgcgactttagggcaaatcccaacgaaccagcaaaaatgaacttttcttatggtcttacaatcaagcctaaatcatttaaggtcaatgtcactcttcgagagagtatggagctgcttgactctgctgtgcagaaccttcaggccaaagagacctgtcagtag

SEQ ID NO: 14826 - DNA, 1632 bp, Artificial Sequence
  Description of Artificial Sequence: Synthetic coding sequence
atggggacatctttgtcaccaaacgacccatggcccctgaaccctctttccatccagcaaactacattgctcctattgctgtccgtgcttgcgaccgtccatgtcggtcagcgcctccttcgtcagcggcgtcgtcagctcaggtctgccccaccaggtccattcgcctggccgctgattgggaatgccgcggctgtcggccaagccgcccacctgtcattcgcccgcctcgctcgtagatacggggacgtttttcaaatacggctcgggagctgccctatcgttgtcctgaatggagaacgcgctatccatcaagcgctagtgcaacaaggcagtgctttcgccgataggcccgccttcgcatcttttcgggtggtgtccggaggccggagtatggcgttcggacactattcggaacattggaaagtgcagaggagggccgcgcatagtatgatgagaaattttttcactcgacaaccaaggagtcgccaggtgctggagggccacgtgctctcagaggccagagagctggttgcccttcttgttaggggctcggccgacggggcattcctggaccccaggccattaaccgtggtagccgtggcaaatgtcatgagcgccgtctgctttggctgtcgatactcccatgacgatcctgagtttagggagttgctctcccacaacgaagagttcggccgaacggtgggcgcgggaagccttgtggatgtgatgccctggctacaatacttccctaaccccgtgagaacagtcttcagagagtttgaacagttaaatcgaaacttttctaattttatcctggataagttccttcgtcactgcgagtccctcagaccaggtgcggcccccagagacatgatggacgcattcatcctgtccgctgaaaaaaaagcagccggtgattcacacgggggtggagcacgccttgacttagagaacgttccagcgaccattactgacatcttcggcgcctctcaggataccctgagcacagctctacaatggctgcttctgctgttcaccagatacccggacgtccaaacccgtgtgcaggcagagttggatcaggtcgtcggccgggatcggttaccctgtatgggcgatcagccaaatctgccctacgttctagctttcctgtatgaagctatgaggttctcctcatttgtgcccgtgaccattcctcacgctaccacggccaatacaagtgttcttggttatcacattcctaaagacaccgtcgtgtttgtgaaccaatggagtgtcaatcatgatcccgtgaaatggcctaacccagagaattttgatcccgccaggttcctcgataaggacgggctgatcaacaaggacctgacttcccgcgtgatgatattctctgtggggaaacgaagatgcataggagaagagctttcaaaaatgcaactgttcctgttcatttctatcctcgcccatcagtgcgactttagggccaatccaaacgaacccgccaagatgaatttctcctacggcctgacgattaaaccaaagagcttcaaagtgaacgtaacgctacgagagtcaatggagttgctggattctgccgtgcagaatctgcaggctaaggaaacatgtcagtag

SEQ ID NO: 14827 - DNA, 3399 bp, Artificial Sequence
  Description of Artificial Sequence: Synthetic coding sequence
atggagcctgactctctgttagaccaggacgattcctatgagagcccacaggaacgtcccggcagtcgaagatccctccccggcagcctgagtgaaaaaagtccgagtatggagccaagcgccgccacacccttccgcgtcacaggcttcctctcacgtcggctgaaagggtcaatcaagcggaccaaaagccagcctaagttagatcggaaccactccttcaggcacattctgcccgggtttcggagtgctgctgcagcggcggcggataatgagcgctcccacttaatgccccgactcaaggagagcagaagtcacgagtccttactgtcgccatcctccgcggtggaggccttagatctgtctatggaggaagaagtggtgatcaaacccgttcacagttcaatcctgggccaagattactgctttgaggtcaccacttctagtggttcaaagtgttttagttgccggtcagcggcagaaagggataaatggatggaaaatcttagaagggccgtgcaccctaacaaggataatagcagaagggtggagcatatcctgaagctatgggtcatagaggcaaaagatctacctgcgaaaaaaaagtatctgtgtgaattgtgtctcgacgatgtcctgtacgcgaggactacaggcaaactgaaaacggacaacgttttctggggtgagcacttcgagtttcacaatctgccgcctctccggacggttaccgttcacctttatagagagactgacaagaaaaaaaaaaaggaacgaaactcgtatcttgggctcgtgagtctgccagccgccagtgtcgcaggacgtcagttcgtggagaagtggtacccggtagtaacaccaaaccctaaggggggtaagggacctggaccaatgatcaggattaaagcaagataccaaactatcaccatcctacccatggaaatgtacaaggagtttgcggaacatataaccaatcattacctggggctgtgtgctgcacttgaacccattctgtcggccaagacaaaagaggagatggcctctgcgttggttcacatcctccagtcaactggcaaagtaaaagatttcctcaccgatctcatgatgtccgaagtcgaccgatgcggagataatgagcacctgatcttccgggagaatactctggcaacgaaggccatcgaggaatatctgaagctggtgggacagaaatacttgcaggatgcgctgggggaatttatcaaggcactgtacgagtctgacgaaaactgcgaggtggatccttctaaatgctcggcagctgacctgcccgagcaccagggtaacctgaaaatgtgttgtgagcttgccttctgtaaaattattaacagttactgcgttttcccccgggaactgaaggaagtttttgcctcgtggagacaggagtgctctagccgcggcagaccagacatctccgaacggctgatctccgcttccttatttctgaggttcctgtgtccggcaatcatgtccccctctttgtttaacttgctacaggagtatcctgacgacagaacagccaggactttaaccttgatagcgaaggtaacacaaaatcttgctaactttgccaaattcggctccaaagaggagtacatgtctttcatgaatcagttcctcgagcacgagtggacaaacatgcaaagattcctgctcgaaatcagtaaccccgaaaccctgtcaaatacagcaggctttgagggctacatagacctgggcagggaattgtcctccctccattcccttctgtgggaagcagtttctcaactggaacaaagcatcgtgtctaagctcggcccacttccacggatcctgagggatgtacacaccgcgttgtctactcctggcagtggacaactcccaggaacgaatgacctagcaagcacgccagggtccggaagctccagcattagcgcaggcctgcagaagatggtaatcgagaacgatctgagtggattgatcgactttaccaggctcccatcaccaaccccagaaaacaaggatctgttctttgtcacccggtctagcggagtgcaaccctctcccgccagaagcagctcttactctgaagccaacgagcctgatctgcagatggctaacggcgggaagagcctgagcatggtcgacctccaagacgctcgtactctggatggagaggcaggcagtcctgctggcccggacgttttaccaacagatggtcaggccgctgcagcacagcttgtggccggatggccggcacgggctacacctgttaatctggctggcctagccaccgtgcgacgtgctgggcagacccctaccacaccaggcacttcagaaggagctccgggccggcctcagttactcgcccccctttcctttcagaacccagtataccagatggctgctgggcttccactctctcccagaggtctgggcgattccggtagtgaagggcactcttccctgtcatctcactcaaattcagaggagctggctgcagcagccaagctcggctctttctccaccgccgcagaggaactagcgagacgccccggagagctggcaaggaggcagatgtctctcacagaaaagggcggccagccgacagtgcctaggcaaaacagtgctggtccacagcgccggatcgaccagccacccccaccccctcctccccccccccctgcccctaggggcagaactccccctaaccttttgagtaccctgcagtatcctaggccatcatcagggacactcgcttccgcctcccccgactgggtcgggccatccacgagactgaggcagcagtcctcaagctcaaagggagatagccctgagctgaagcctagagctgtgcacaagcaggggccttcaccagtctctccaaacgccctggaccgcacagctgcctggctgctgacaatgaatgcccagcttctggaggacgagggcttgggacctgatcctccccaccgagaccgactgaggagtaaagatgaacttagccaggccgaaaaggacttggccgttttacaggacaagctgaggatctctactaagaaactggaagaatatgagaccctgttcaagtgccaggaggaaacgacacagaagctggtgctcgaataccaagctagacttgaggagggtgaggaaaggttgagacggcagcaggaggacaaagacatccagatgaaggggattattagcagactcatgtctgtagaagaggaactgaagaaagaccacgcagaaatgcaggccgctgttgatagtaaacaaaaaatcatcgacgcgcaagaaaagagaatagcttccctggatgctgcaaatgctcgcctgatgtccgctttgactcaactcaaggagtccatgcattag

SEQ ID NO: 14828 - DNA, 3198 bp, Artificial Sequence
  Description of Artificial Sequence: Synthetic coding sequence
atgccgagactgaaagaatcaagaagccacgagtcactcctgtcgcccagttccgctgtagaagccctcgacctgagcatggaagaagaggttgtcattaagccagtgcactccagcatcctgggacaggactactgctttgaggtgactacctcaagcggcagtaaatgcttctcttgcagaagcgcggcagagcgcgacaagtggatggaaaaccttcgaagagcggtacatccaaataaagacaactccaggcgcgtggaacacatcttgaagctgtgggttatcgaggcaaaggaccttccagcaaagaagaagtatctctgtgagctgtgccttgatgacgtgctgtacgcccggactaccggcaaactgaagacagacaatgtcttctggggcgagcacttcgaatttcacaacttaccaccccttcgaaccgtaacggtccacctataccgcgaaaccgacaaaaaaaaaaaaaaagaacgcaactcgtacttgggtctggtgtctctcccagccgcctcagtggcgggacgtcagttcgtggagaagtggtatcccgttgttacacctaaccctaaaggcggcaaagggcccggacctatgatcaggattaaggcccgctaccaaacgattaccatcctccccatggagatgtataaggagttcgcggaacacatcacaaatcattacttgggactctgtgccgcacttgagcccatactgagcgccaaaacgaaagaagagatggcctctgctctggttcacatccttcagtctacggggaaggtgaaggacttcttaaccgacctgatgatgagcgaagtggacagatgtggcgataacgaacacctgatatttagagagaacactctcgccaccaaggcaattgaagagtatttgaagttggtgggccaaaagtacttgcaagatgcgctgggcgagttcattaaagcgctttatgaatctgatgagaattgcgaagtggatcctagcaaatgcagtgccgccgacttgcctgaacaccaagggaatctcaagatgtgctgcgaattagccttctgcaagattataaattcgtactgcgtatttccacgcgaattaaaggaagtgtttgcatcgtggcggcaggaatgcagttctagaggcaggcctgacataagtgagagacttatcagcgcctccttgtttttaagattcttatgcccggccatcatgtctccttcactgtttaacctgcttcaggagtaccccgatgacagaaccgctaggaccctgacattgatcgctaaggtcacgcagaacctggcgaactttgccaagttcggctccaaggaggagtacatgtccttcatgaaccagttcctcgaacacgaatggaccaacatgcaaagattcctcctggaaatctccaacccagaaactctgtctaatactgcggggttcgaaggctatatcgatcttggtcgagaattgagcagcctgcatagcctgctgtgggaagcagtgtcccagctagaacagtccattgtgagcaaattaggccctctacctagaatactgagggacgtccataccgctctgagtaccccaggctctggacagctacctggcaccaacgacctggcatcaacaccagggtccggatcgtcaagcatctcagcgggactgcagaagatggtgattgaaaatgacctctccggcttgatcgactttacaagactgcctagtcctacccccgagaacaaagatttgttcttcgtcacccgcagctctggggtacagccttctccagcgaggtccagctcttattcagaagcaaatgaacctgatctccagatggcgaatggcggcaaatccctctccatggtggacctgcaagacgcccgaaccttggacggagaggcgggcagccctgcaggacctgacgtcctgcctacggatggtcaggccgctgccgcccagttggtcgccggctggcccgctcgggcgacccccgtcaatttggcagggcttgccaccgtgagaagggccgggcagacccccacaactcccggtaccagtgaaggcgctcctggccgtcctcagcttttggctccattaagttttcagaaccccgtataccaaatggccgccggattgccattgagccctcgggggctgggggacagtggctcggaaggccactccagcttgagttcccactcaaactcagaggaactggctgcggccgccaaactgggaagtttctctaccgccgctgaggagctggccaggcggcccggagagctggcgcggcgccagatgtcactgacagaaaagggtgggcagcctaccgtgccccgccaaaactctgcagggcctcagagaagaattgaccaaccacccccgcctcccccccccccacctcctgctccaagaggccgtactccccctaacctgctttccacccttcagtatcccaggcccagcagtggaactctcgcttcagcgtcaccggattgggtaggcccatccacaagattgaggcaacagtcaagtagtagcaagggggactcaccggagttgaagccgagggcagtccacaagcaggggcccagtcctgtctctccaaacgcactggatcgtaccgccgcgtggttgctgacgatgaatgcccagctccttgaagatgaaggcctggggcccgacccaccccacagggaccgactgcgatctaaggatgaactgtcacaggcagagaaagacctcgctgtgctacaggacaagctgagaatttccaccaagaaattggaggagtacgagactcttttcaagtgccaggaggaaaccacccagaagctggttttggagtaccaggcccggctggaggaaggagaagagagactaagaaggcagcaggaagataaagatatccaaatgaaaggtattatttctagattgatgtcagttgaagaggaactgaaaaaagaccatgccgaaatgcaagccgcggtggacagcaaacagaagataatcgacgctcaagagaagcgcatagctagtctggacgctgccaatgctcgactgatgagcgcccttacacagctgaaggaacggtacagtatgcaggcaagaaatgggatttctcctacgaatcctacgaaacttcagataaccgaaaatggcgaatttaggaactccagtaactgctag

SEQ ID NO: 14829 - DNA, 3210 bp, Artificial Sequence
  Description of Artificial Sequence: Synthetic coding sequence
agccagccaaagctggacagaaaccattcctttcgtcacatcttacctgggttccgcagcgccgccgcagccgccgctgataatgaacgcagccacctaatgcctaggctcaaggaatctagaagtcacgaatccttattaagcccctcctccgcagtcgaggccctggacctctctatggaggaagaggtcgtgataaagcctgtgcacagttccatccttggccaggattattgcttcgaggttacaacaagttctgggagtaaatgctttagctgtcgaagcgcagcagaacgtgacaaatggatggagaatctccgccgcgcagtgcatccaaacaaagacaattcgagaagggtcgagcatattctaaaattatgggtgatcgaggctaaagacctgcctgcgaaaaagaagtacctttgcgagctgtgcttggacgatgtgctgtatgccaggacgacagggaagctaaagaccgataacgtgttctggggggagcactttgagttccacaacttgccaccattgagaactgttacagtacacctgtatcgtgaaaccgacaagaaaaaaaagaaagagagaaattcttaccttggccttgtctccctgccagccgcctcggtagccggcagacagttcgtcgaaaagtggtacccagttgtgactccaaatcctaaaggaggtaaaggccctggccccatgatcaggatcaaggcgcgttaccagacaatcaccatccttcccatggaaatgtacaaagaattcgccgagcacattactaaccattacctgggattatgcgctgcactggaacccattttgtcggccaaaacaaaagaagagatggcgtccgcactggtgcatatcctccagtccaccggcaaagtcaaggatttcctgaccgatcttatgatgtctgaggtggatagatgcggcgacaacgagcatctgatttttcgcgagaataccttggccaccaaagcaatagaggagtatctgaaactggtgggtcagaagtacctccaggacgccctcggcgaattcattaaggcactgtatgagtccgatgagaactgcgaggttgacccatctaagtgttccgctgctgacctcccggaacaccagggcaatttgaaaatgtgctgtgaacttgcattctgcaagattatcaacagctattgcgtgttcccgcgcgagctcaaggaagtcttcgcttcctggcgccaagaatgctcctccagaggccgccccgacatcagcgagcgtttaatctctgcctcgctgtttctccggttcctctgtcccgcgataatgagcccatccctgtttaatcttttgcaagagtatccagatgatcggactgctcgcacacttaccctcatcgcgaaggttacccaaaacctcgccaacttcgcaaagtttggctccaaagaggaatacatgagctttatgaaccagttcctcgagcacgagtggactaacatgcaaaggttcctgctggaaataagcaatccagaaactctctccaacaccgcagggttcgagggatatatcgatctgggacgtgaactatctagcctacacagcctgctgtgggaagctgtctcacagctggagcagtccattgtgtctaaactgggcccgctaccacgtatattgcgtgatgtccatacggcgctgtccaccccaggtagcggccagttacctggcacaaacgacctggcttccactcccggcagtggctcgtctagtatctccgcagggctgcagaaaatggtgatagagaacgacctcagtggcctgatagatttcacgcgtctgccatcccctacccccgagaacaaggacctcttttttgttaccagatcatccggcgtacagccctcccccgccaggtcttcctcctattcagaggccaacgaaccagacttgcagatggccaacgggggaaaatccctgtctatggtggacctccaagatgccaggacactggacggcgaggcgggatcccccgcaggtccggatgtgctccctacggatggccaggccgctgccgctcagctggtggcgggctggcccgctcgcgcaactccggtgaatctggctgggctcgccacagtgcgaagggctgggcaaacgcctactacaccaggcacctcagagggagcaccagggcgccctcagctgctcgctcctctctcattccagaacccggtgtatcagatggccgccgggttgcccctctctcccagggggctgggcgattcaggttccgagggccattcctcattgtcatcccatagtaactcggaagagctggccgcagccgctaagctagggagtttcagtactgccgctgaggagctggccaggagacccggtgagctcgccagaagacagatgagtttgactgaaaagggtggccagcctaccgttccacgtcagaattccgcgggccctcagagacgcatagaccagcccccgccccctcccccccctcccccacccgctcctcgaggtcggacgccccctaacctgctttctaccctccagtatccccgtcctagtagtggcaccctcgcatcggcttcaccggactgggttgggcccagcaccaggctgaggcagcaatcatctagttcaaaaggcgacagcccagaattgaaaccgcgggccgttcacaaacagggccccagtcctgttagccccaacgctttggaccgcaccgccgcatggcttctgacgatgaatgctcagttgctcgaggatgaaggcctagggcccgatccacctcaccgcgacaggctacggtccaaggatgaactgtcccaggccgaaaaagacctggcagtgctgcaggataagctgaggattagcactaagaagctggaagagtacgagactctcttcaagtgtcaggaagagacaacgcagaagctagtcctggagtatcaggcgagactcgaggaaggggaggagagacttcgcagacaacaggaagacaaagatatccaaatgaaggggattatctcacgactcatgagcgtcgaggaggagctaaagaaggaccacgctgagatgcaggccgctgtcgactctaaacagaagattatcgacgcccaagagaaaaggatcgccagtctcgatgccgctaatgctcggcttatgtctgctcttacccaactcaaggagtctatgcactag

SEQ ID NO: 14830 - DNA, 876 bp, Artificial Sequence
  Description of Artificial Sequence: Synthetic coding sequence
atggagccagactctttacttgaccaggatgacagttatgagtccccccaggagcgaccggggagcaggcggtccctccccggatccctgtcagagaagagtccttcaatggaaccaagcgcagcaaccccctttcgggtgaccgggttcctgtctaggagactaaagggcagtatcaaaaggaccaaatcgcaaccgaaactggaccggaaccatagcttccgacatatcctccctggattcagatcagcagcagcagcggctgcagataatgagcgatctcatttgatgccacggctcaaagagtctcggtctcatgaatctcttttgtccccgtcatctgcagtggaggcactcgatctctccatggaagaggaggtcgtgattaagcccgtccacagctccatccttgggcaggattactgcttcgaggtgaccaccagctccggcagtaaatgcttctcgtgtcggtccgccgcagagcgtgataaatggatggaaaatctgagacgggcggtgcaccctaataaggacaacagtcgccgggtcgaacatattctcaagctttgggttatcgaggctaaggatctgcctgccaaaaagaagtacctctgtgagttgtgcctggacgatgtactctacgccagaaccacaggaaaactgaaaacggataacgtgttttggggagagcacttcgaatttcacaatctgccgcccctccgaactgtaaccgtgcacctctatagagagacagacaaaaaaaaaaaaaaagagcggaatagctacctcggtctcgtgtcacttccagctgcatcagtcgcaggcagacaattcgtcgagaagtggtatcccgtagtcacacccaaccctaagtag

SEQ ID NO: 14831 - DNA, 3570 bp, Artificial Sequence
  Description of Artificial Sequence: Synthetic coding sequence
atgtctgctggcggaagcgcgagaaaaagcacaggccggtccagttattattaccgcctgctgcgtagacctcgcctccagaggcaaaggtctcgttcccggtccagaacaaggcccgctagagagagccctcaggagcgacccggcagccgaagaagtttgcctggttctctgagtgaaaaatcaccatctatggaaccctccgcggccaccccttttcgcgtgactgggttcctttccagaaggctaaaaggaagcattaaaaggacaaagagtcaaccaaagctcgatcgcaatcattcgtttagacacattcttccaggatttaggtcagcagctgccgcggccgctgacaatgaacggagtcatctaatgccgagactcaaggagagtaggtcccacgaaagtctgttatccccttccagcgccgtagaggcgctggacttatcgatggaggaggaagtcgtgattaaacctgttcacagttccatactggggcaggattactgttttgaggtgaccactagttcaggatccaaatgcttttcatgtagatccgctgccgaacgcgataagtggatggagaacttacgacgcgcagtccacccgaataaggacaacagtcggcgggtagaacacatattaaagctctgggtgattgaggctaaggacctgcccgccaagaagaagtacctatgtgagctttgtctcgacgacgtgctgtacgcaaggaccacaggtaagctgaagacagacaatgtgttctggggggagcattttgagttccacaatctgccaccactgaggaccgtcactgtacacctgtaccgagaaacggacaagaagaaaaagaaggagcggaacagctaccttgggctggtctcccttcccgccgcatccgtggcaggtagacagtttgtggaaaaatggtacccggtggtcacccccaacccaaaaggggggaagggccctggccctatgatcagaattaaagcacggtaccagacaattacaatactccctatggaaatgtataaggaattcgcggaacatattactaaccattatctgggcctctgcgccgcgctcgaacccatactttccgcaaagactaaagaagagatggcctccgccttagttcacatcctgcagtcaaccggcaaggtcaaggatttcctgacagacctgatgatgagcgaagtagatcgctgcggtgataacgagcatctcatcttcagggaaaacactctggctaccaaagccattgaggagtacctcaaactcgtagggcaaaagtatctacaagacgcactgggagaattcataaaggccctttacgagagcgacgagaactgcgaagtggatcccagcaaatgcagtgcagcggatttgcctgagcaccagggaaatctcaagatgtgctgcgagctggctttttgcaagatcatcaatagttactgcgtattccctcgggaattaaaagaggtgttcgccagttggcggcaggaatgttctagccgcggaaggccagacatttccgaaaggctgatctcagcgtccctctttctgcggtttctgtgcccagccatcatgtctccctcgttgttcaatctgctgcaggaatatcccgacgacaggacagcgagaacgttaacactcatcgcgaaagttacacagaatctcgcaaactttgccaaatttggcagcaaggaagagtacatgtccttcatgaatcagtttctagaacacgagtggactaacatgcagcggttcctgctcgagattagcaatcctgagacactgtcaaatacagccggattcgaggggtacattgatttaggccgggaactgagtagcctacatagtctcctgtgggaagcagtgtcccaactggagcagtctattgtgtcaaagcttggacccctacccagaattctgcgagatgtacacacggcgctgagtacccccggatccggccagctgcctggtacgaatgacctcgccagtacccccggttccggctcatcctcaatatccgctggcttacagaagatggtgatagaaaacgacctatctggactcatcgattttaccaggctcccctcccccacacctgagaataaagatctgttcttcgtgactaggtcatctggcgtgcagccctccccagctcggtcttcttcttatagtgaagctaatgagcccgatctccagatggccaacggtggcaagagcctctccatggtggatcttcaggatgcccgcactttggatggcgaggccggcagtccagctggccctgacgttctgcctaccgacgggcaggcagcggcagcccagctggtggctggatggccagcccgagcaacaccagtaaatttggccgggctggctacagtgcggcgcgcgggccagacaccaaccaccccaggcacctctgagggagccccagggagaccgcagctactggcccccctgtcttttcaaaaccccgtttatcaaatggccgctggtctgccgctgagcccaaggggcttaggggactccggctcagaggggcactcgtctctgagtagtcactcaaacagcgaagagctggcggccgccgcaaagctgggcagcttcagtacagctgctgaggaactcgcccggaggcccggggagctggccagaagacagatgagcctgacggaaaagggtgggcagcctactgtaccccgccagaattctgctgggccccagaggcgaattgaccagccccctccgccacctccaccgcctcctccagcgccccgcggacgcaccccacccaacctgctgagcaccctgcaatatcctagaccttcttcggggacgctcgcgtcagcttctccggactgggtcggccccagtaccagactgcgtcaacagtcgagttcaagtaagggcgactcccccgagttgaagcctcgagctgtgcacaaacaggggcctagtcccgtgtccccaaatgcgcttgatagaacggccgcctggttgctcacgatgaatgcccagctactagaggacgagggactgggtcctgatccaccacaccgggacagattgagaagcaaggatgagctcagtcaggctgagaaagacctcgccgtgcttcaggacaagttgaggatatctactaagaaactggaggaatacgaaacattgtttaaatgtcaggaagagactactcagaaacttgtactggaatatcaagcgcggttggaggagggggaagaacggctgcggcgccagcaggaggacaaggatatccaaatgaagggcatcattagtcgtctaatgtcagtggaagaggagcttaagaaggaccacgccgagatgcaggctgccgtcgactcaaagcagaagatcatcgacgctcaggagaaacgcatcgcctccctcgatgcagccaacgcccggttgatgtccgctctgactcagttgaaagagcggtactccatgcaggccaggaatggcatctctccaacaaatcccactaagcttcaaattactgaaaatggagaattcaggaatagcagtaattgctag

SEQ ID NO: 14832 - DNA, 690 bp, Artificial Sequence
  Description of Artificial Sequence: Synthetic coding sequence
atgccaagacttaaggagtctcggtcacacgagagcctgctcagcccttcctcggctgtcgaggccctggatctttctatggaggaggaagtcgttattaaaccagtgcattctagcattctggggcaggactactgctttgaggtgactaccagctcagggtctaagtgtttctcatgtcgctccgccgccgagcgggataaatggatggaaaatttacggagggcagtgcaccccaacaaagacaatagccgccgagttgaacacatcctgaaactgtgggtgattgaggccaaggacctccctgctaaaaagaagtatctgtgtgaattgtgcctcgacgatgtcctctacgcccgcactacgggcaaactaaagacggataacgtgttctggggggagcattttgagttccacaacttgccccccctgcggaccgtgaccgtccatttgtatcgagagaccgacaagaagaagaaaaaggagcgcaattcctatctggggctcgtctcactaccagcggcctctgtcgcaggacgtcaattcgttgaaaaatggtacccagtcgtgacccccaaccctaagggaggcaagggcccaggcccgatgatcaggatcaaagctcgataccagacaatcactattctgcctatggagatgtacaaggagttcgcagaacacatcacttag

SEQ ID NO: 14833 - DNA, 3423 bp, Artificial Sequence
  Description of Artificial Sequence: Synthetic coding sequence
atgagttacaactatgtggtgaccgcccagaagcccacggcggtcaatggctgcgtcaccggtcatttcacaagtgctgaggacttaaacctcctgatcgccaagaatacacggctcgagatatacgtagtcactgcagaggggctgcgccccgtaaaagaagtcggaatgtacgggaaaatagcagttatggagctgttccggcccaagggagaatccaaagatctgctctttatactgacggccaagtataacgcctgcattctagagtataagcagtccggagagtccatagacattatcacccgagctcacggaaacgtgcaagacagaataggaaggcctagcgagaccggcattatcgggatcatcgacccagaatgtcgaatgattgggttacgcctgtacgatgggctgtttaaggtgattcctctggaccgggataacaaagagttaaaggcttttaatatacgacttgaggaactccacgttatagatgtcaagttcctatatggttgtcaggccccaacaatttgcttcgtgtaccaggacccccagggcaggcacgtgaaaacgtatgaggtgtctcttcgggaaaaggaatttaataaaggtccgtggaagcaagagaatgtggaggccgaagcgagtatggtgattgccgtgccagaaccttttggaggtgccatcattattggccaagagtctattacataccacaatggcgataaatatctggccattgcccccccgatcataaagcagtcaaccattgtttgccacaacagagtcgaccctaacggttcacggtacctgcttggagatatggagggtagattattcatgttgctgctcgagaaggaagagcagatggatggaacagtgaccttgaaagacctgcgcgtcgagcttctgggggaaaccagtatcgctgaatgtcttacctatctggataatggtgttgtgtttgtggggagccggctgggcgactctcagttagtgaagctgaacgtggacagtaacgaacagggctcttacgtggtggccatggagacctttactaatctgggtcccattgtggatatgtgcgtggtagacttggagagacagggtcagggccagttggtgacctgctctggcgcctttaaggaagggtcattgaggattatacgcaacggtatcggtatccacgaacatgcctcaatagacttgcccggcatcaaaggactatggcctttaagatcagatccgaatagagaaacagatgacaccttagtactatcattcgtgggtcagactcgtgttctcatgttgaatggcgaggaggtggaggaaactgaactaatgggcttcgtcgacgatcagcagacttttttctgtggaaatgtcgctcatcaacagttgatacagatcacctctgctagtgtgcgtcttgtcagccaggagccaaaggcgttagtcagtgaatggaaagaaccccaggccaagaacatttccgttgcaagttgtaactcgagccaagtggtagtggctgtgggcagagctctttactacctacagatccacccccaggaactgcgacagataagtcacacagaaatggagcacgaggttgcttgcctcgacatcactcccctcggggatagcaatgggctgtcacctttgtgcgctatcggcttatggactgacatctccgctaggatattaaagctcccctcctttgaactcctccataaagaaatgctcggaggcgagatcatcccccgctccattctcatgacgacgtttgagtcctcccattacctcctctgtgctctcggggacggagccttattctattttggccttaacattgaaactggtctcctgtccgacagaaagaaggtaacactcggaacgcagcccactgtgttgcgcactttccggtccttgagtactactaacgtctttgcatgttccgatcgtcccaccgtgatctacagctctaaccacaagctggtgttcagtaacgtgaatctgaaggaagtcaactacatgtgccccctgaactctgacggatatcccgacagtctagccctcgctaacaattctacactaactatcggaaccattgatgaaatccagaaactccacatacggaccgtgcctctgtacgagtcgccccgtaagatctgttaccaggaagtcagccaatgttttggagtattatcctcaaggatcgaagttcaggacacttccgggggcactaccgcactccgcccctcggccagcacacaggccctgtcctctagcgtgtctagtagcaaactgttttcatcaagcaccgccccacacgagacaagttttggtgaggaggtggaggtgcataatctattaattatcgatcagcacaccttcgaagtgctgcacgcccaccaattcctacagaacgagtacgccttgagcctcgtctcatgcaagctgggcaaagaccctaacacttatttcatcgtgggaacagcaatggtataccctgaggaggctgagcccaagcaaggccggatcgttgtcttccagtacagtgatggtaagctacagacagtagctgaaaaggaggtaaaaggggccgtatattccatggttgagttcaacgggaagttactcgcttctatcaatagcaccgtccgtctttatgagtggaccacagagaaggaacttaggaccgaatgcaaccattacaataatattatggccctctacctcaaaaccaagggggacttcattttagttggagatctcatgagaagcgtgcttttactcgcgtacaaaccaatggaaggcaacttcgaggagattgcgagagatttcaaccccaactggatgtccgctgtggagattctggatgacgacaattttcttggggccgaaaatgccttcaatctctttgtttgccaaaaagacagtgctgctacaacggatgaagaaagacagcacctgcaggaggtggggctgtttcatctcggtgagtttgtcaacgtattttgccacggatccctggttatgcagaatctgggggaaacgtctaccccgacacaggggtctgtgttgtttggaacagtcaatgggatgattggcctggttacgagcctctctgaaagctggtacaacctcctcctggacatgcaaaaccgcttgaataaggtaatcaagtcagtggggaagattgaacactctttctggagatctttccatacggaacgcaagaccgagccggcaactggatttatcgacggcgacctgattgaaagttttttggacatctcccgcccaaaaatgcaggaggtcgtggctaacctgcagtatgatgacgggagtgggatgaaacgggaggcaacagccgacgatctaattaaggttgtcgaagagttaacccggattcactag

SEQ ID NO: 14834 - DNA, 1356 bp, Artificial Sequence
  Description of Artificial Sequence: Synthetic coding sequence
atgagctacaattacgttgtgactgcacagaagcccaccgccgtgaatggttgcgtaacaggccattttacaagcgccgaggatctcaatctgctgatcgccaagaatactcgcctggagatctacgtggtgactgccgaggggctgcgtccggtaaaggaggtgggcatgtacgggaagattgcagtgatggagttgtttagacccaaagccctgagcagctcggtcagcagttccaagctgtttagcagctccaccgctccccacgagacttcctttggcgaggaagtagaggtccacaatctgcttatcatcgatcagcatacattcgaggttctgcacgcccaccagttcctccagaacgagtacgctctctccttggtatcctgcaagctcgggaaagatcccaacacatattttatagtgggtactgcaatggtgtaccctgaagaagctgagcccaaacaggggcggattgtggtcttccaatattccgacgggaaactgcagaccgttgcggagaaggaggttaaaggcgctgtgtactccatggtggaatttaatggtaagctgctggccagtattaattccaccgttcgtctgtatgagtggacgacagagaaggagcttcggactgagtgcaatcactacaacaatatcatggccctgtatctgaagacgaagggagactttatactggtcggtgacctgatgaggagcgtgctccttctcgcctacaagcctatggaggggaatttcgaggagatagctcgggattttaatcctaactggatgtctgcggtcgaaatcttggatgatgacaactttctgggcgcagaaaatgcatttaatctgttcgtctgccaaaaggactctgccgcgaccactgatgaagagaggcaacacttacaggaggtgggtctgtttcatttaggggagttcgtgaatgtgttctgtcatgggagcctggtgatgcagaacctgggagagacatccactcctacccagggctcggtgttgtttggcaccgtgaatgggatgatagggctcgtcaccagtctgtcagaaagttggtataacctgctgctggacatgcagaatcggctgaacaaagttataaaatcagtgggtaagattgagcatagtttctggcggagcttccacacggagcggaaaaccgagccggcgacaggatttattgacggagatctgatcgagtcctttctggatatcagtcgccccaagatgcaggaagtcgtggccaacctgcaatacgatgacggcagtgggatgaaacgagaggccaccgccgacgatctcatcaaggtggtagaggaactaacgcggattcactag

SEQ ID NO: 14835 - DNA, 441 bp, Artificial Sequence
  Description of Artificial Sequence: Synthetic coding sequence
atgtcctacaattacgtagtgacggcccagaagcccaccgcagtgaatggatgcgtgacgggccactttacaagcgctgaagatctgaatttgttaattgccaagaacacacggctagagatctacgtggttaccgccgaaggtctccgacccgtgaaagaagtgggtatgtacggaaagattgcagtaatggaattgttccgccctaagggagagtctaaagacttgttgtttatactaaccgctaaatacaacgcttgcatcctggaatataaacagtcaggagaaagtatagacatcatcaccagagcccacgggaacgtccaggaccgcattggtcgacccagcgaaacagggatcattgggattatagaccccgaatgtaggatgattggactgagactgtacgacggcctcttcaaagtgatcccactggactag

SEQ ID NO: 14836 - DNA, 330 bp, Artificial Sequence
  Description of Artificial Sequence: Synthetic coding sequence
atgtcctacaactacgtagtgaccgcacagaagcccactgctgttaatggatgcgtgaccggccactttacaagcgccgaagatctcaacctccttatagcgaaaaatactcgattagaaatatacgtggtgacggctgagggtttgcgccccgtcaaggaggtcgggatgtatggcaagattgccgtcatggagctgttcagaccgaagggagaatcaaaagacctgctgttcatccttaccgccaagtacaatgcttgcatcctggagtacaagcagtcaggtgaatctatcgacattataacccgagcgcacggaaacgtgcagtag

SEQ ID NO: 14837 - DNA, 1284 bp, Artificial Sequence
  Description of Artificial Sequence: Synthetic coding sequence
atggctcccaagaaacgacccgaaacacagaaaacatcggagatcgttctgaggccacggaacaaaaggagcaggtccccactggagttggaacccgaggctaagaagttgtgtgcgaaaggctctggcccctcacgacgctgcgatagtgactgtctgtgggtgggcctggcgggaccacagatcctgcccccatgcagaagtattgtacgtactctacatcagcacaaactcgggcgcgcctcctggccttctgtccaacagggtctccagcagagctttcttcatacactggattcgtataggattctccaaaaggctgcccctttcgaccgcagagcaacatcactcgcgtggcatccaacccacccctcaacggtggccgtgggtagtaagggtggcgacataatgttgtggaattttggcattaaggataagcctactttcatcaaaggtataggggctggcggcagtatcaccggcctcaagtttaacccactgaacactaatcagttttacgcttcaagcatggagggaactacacgcctgcaggatttcaaaggcaacatcctgcgagtgtttgccagctcagatacaatcaatatctggttctgctcactggacgttagcgcctcaagtagaatggtcgtcacaggggacaatgtggggaacgtcatcctgctgaatatggatggcaaggagctgtggaatctgaggatgcacaaaaagaaagttacacacgtcgccttgaacccttgttgtgattggtttctggccacagccagcgttgatcagaccgttaaaatctgggatctccgccaggttaggggaaaagcatcatttctgtattctctgccccaccgccaccctgtcaacgcagcatgtttctctcccgacggagcccgcctccttaccacagatcagaaatcagagatacgagtgtattccgcttctcagtgggactgcccccttgggctcattccacatcctcatagacactttcaacatcttacgcccatcaaggctgcgtggcacccgcgatataatctgatcgtagttggacgctacccagacccaaactttaaatcatgcacaccttacgagctgcgcaccattgatgtttttgacggcaacagtgggaagatgatgtgtcagttatacgatcccgagtcatccggcatttctagtctcaacgaatttaacccgatgggagacactctggcaagcgcaatggggtatcacatcctcatctggtctcaggaggaagcaaggactagaaaatag

SEQ ID NO: 14838 - DNA, 717 bp, Artificial Sequence
  Description of Artificial Sequence: Synthetic coding sequence
atggcccccaagaaaaggcccgagactcagaagacttctgagattgtgctgcgccctaggaataaacggtccaggagcccgctggagctcgagcccgaggccaagaagctgtgcgctaagggcagcggtccttcgagacgatgtgattctgactgtttgtgggtaggtctggccggacctcaaattctgcctccttgtcggagcatcgtgcgtaccctacaccagcataagctgggtagggctagctggccaagcgtgcagcaaggtctgcagcagagcttcttgcacacgctcgattcctatcgtattctgcagaaggccgctccattcgaccgtagagccaccagcctggcttggcaccccactcatcccagtactgtcgcagtcggaagcaaggggggcgatatcatgctgtggaacttcggaataaaggacaaacctacttttataaaaggtgccgcttggcacccaaggtacaatctaattgttgtgggtcggtaccctgatccaaactttaaatcctgtaccccatacgaactcagaaccatagacgtgttcgacggcaatagcggtaaaatgatgtgccaattatacgacccagagagttctgggatctcttctctcaacgaatttaaccctatgggcgatacgctcgcctccgccatgggttatcacattctcatttggagccaggaggaagcaaggactcgcaagtag

SEQ ID NO: 14839 - DNA, 735 bp, Artificial Sequence
  Description of Artificial Sequence: Synthetic coding sequence
atggctcctaaaaaacgccccgagacccaaaaaacatcagagatcgttctgcggccccgcaataagcggtcaaggagccccctggaactcgagcccgaagctaagaaattgtgtgcaaaggggtctgggccaagtcgtagatgcgattcagactgcctgtgggtcgggctggctggcccccaaatactgcctccgtgcaggagtattgtcagaactctccaccaacacaaacttggccgcgctagctggccatctgtacagcaaggcctccaacagtccttcttgcacactctggattcctatcgaattctgcagaaagccgctccatttgatagacgagctacaagtctggcttggcatcccacacacccctcaacagtggccgtgggctcaaaagggggtgatatcatgctgtggaattttggaatcaaagacaagcctacctttattaagggcatcggtgcgggaggatcgatcaccggactgaagttcaatccactgaacacaaaccaattttatgcctcttccatggaagggacgacaagactccaggatttcaagggcaatatccttcgggtcttcgcaagctcagacactattaacatctggttctgttctctggatgtgtcagcatccagcagaatggttgtgacgggggacaacgttgggaatgtgattctgctgaacatggacggtaaagagctggtctccgttcctatggaacccggatcctag

SEQ ID NO: 14840 - DNA, 1092 bp, Artificial Sequence
  Description of Artificial Sequence: Synthetic coding sequence
atggcgccaaagaagagacctgaaacccagaaaacatccgagatagtgctgcgcccgcgtaacaagcggtccagaagccccctggaactggaacctgaagccaaaaagttatgcgctaagggctccggcccatcgaggaggtgtgactctgactgcctgtgggtggggctggctggcccacaaattcttcctccttgccggtctatcgtccgcaccctgcaccaacataagctaggcagagcttcctggcccagcgtgcagcagatcggtgctggaggatctattacaggcctcaaattcaatccactcaatactaaccagttctatgcatcttccatggagggtactactagactgcaggatttcaaagggaatatcttaagggtgttcgcgagtagcgacaccatcaacatctggttttgtagcttggacgtgtctgccagttccagaatggttgttaccggagacaacgtcggcaatgtgattctcctgaacatggatggaaaagaactgtggaatctacgaatgcacaagaagaaggtgacacatgtagccctcaatccttgttgcgactggtttctcgctaccgcctcggtggatcagaccgtgaaaatctgggacctgaggcaggtgaggggcaaagcaagcttcttatactccctgcctcacagacaccctgtgaacgctgcctgcttctcaccggacggcgccagactgctgaccactgatcagaagagcgagattcgggtgtatagcgcctcccagtgggactgtccactcggactgattccacaccctcaccgtcacttccagcacttgaccccaattaaagccgcttggcatcctcggtacaatctgatcgtcgttggacgctacccggatcctaacttcaaaagctgcactccgtacgagctgcggactatagacgtgtttgacgggaacagcggcaaaatgatgtgccaactctacgatcctgagtcatcaggcatttcctccttgaacgagttcaaccctatgggcgacacactagcctcagccatgggttatcatattctgatctggtctcaggaggaggctcgcacccggaagtag

SEQ ID NO: 14841 - DNA, 1119 bp, Artificial Sequence
  Description of Artificial Sequence: Synthetic coding sequence
atgtccgaggccggtgaggctaccaccaccaccacgaccacactaccacaggcacccaccgaggccgcagccgcagctccacaagaccccgcccccaaaagtcccgtggggagtggcgcaccccaggctgctgcacccgctcctgcggctcacgttgcaggcaatccggggggcgacgccgcccccgcagccacagggaccgcagcagctgcttctctcgccaccgcggccggttcagaggacgcggaaaaaaaggtattagctaccaaagtgctgggcactgtgaaatggttcaatgtaaggaacggctacgggttcattaaccgtaatgacaccaaagaggacgtattcgttcaccagacagcaattaagaaaaacaacccgcgtaaatacctgcgaagcgttggagacggggaaaccgtggaattcgatgtggtggagggagagaaaggtgcagaggccgcaaacgtcacaggaccagatggggtgccagttgaggggagcaggtatgcagcagataggcgccgctataggaggggatattacggaaggcggcggggtccaccacgcaattacgccggcgaagaggaggaggaaggtagtggcagttccgagggctttgatcctcccgcaacggaccgccagtttagcggggcccgtaaccagctgagaaggcctcaatacagaccacagtaccgccagaggcgctttcccccgtaccacgtcggacagacattcgataggcgaagccgagttctgccacaccctaatcggatccaggctggcgagatcggggagatgaaagatggagttcctgagggagcccagttgcagggacctgtgcatcgtaatccaacttaccgtcctagatataggtccagaggccccccaagaccacgcccagcccccgccgtgggagaagctgaggacaaggaaaatcaacaagctacgagtgggcccaatcaaccatccgtccgtcgcggctatcggaggccttataattaccgacgcaggccgcgcccccctaatgcgccatcgcaagacggaaaggaggccaaagcaggcgaagcacctacagaaaatcccgctccaccaactcagcaatcctccgcagaatag

SEQ ID NO: 14842 - DNA, 867 bp, Artificial Sequence
  Description of Artificial Sequence: Synthetic coding sequence
atggcaaatgaaacgcagaaggtgggggctatccattttcctttccctttcacaccctactccatccaggaggacttcatggctgaactctatcgtgtcctcgaggctgggaaaattggcatcttcgaatcccccacaggcacaggcaaatcattgtctctcatctgcggagccttgagctggcttcgggatttcgagcagaaaaagcgtgaggaggaagctagactgctagagactggcactggccccctccacgatgagaaggacgagtccttgtgtctatctagcagttgcgaaggcgcagcagggacgccgagaccagcaggtgaacccgcttgggtcactcaatttgtgcagaagaaagaggaacgcgacctggtggacaggctgaaagcggagcaggccagacgaaaacagagggaagaacgcctccagcaactgcaacaccgcgtccagctgaaatacgctgccaagcgcctccgccaggaagaggaagagcgagaaaatttattgcgactcagccgtgaaatgctggagactggtccagaagcagagcgtttggaacagctggagtctggggaggaagaactcgtgttagctgagtatgaatcagatgaggagaagaaagtggcgtctagggccccctctgatgctactagctcccgccatccacccgacgcatcttttccggcagccctcaacttcctgcaacgcacacgcccctccagcgtgctgagtgaagatctcttaatgcaacgagccgtggccaagcaccccgccttgcttccctggcagatgtcatcttcccctctgcgaccgggctctgaatggatgcggatgcggatgacatggcgcaagaatacctag

SEQ ID NO: 14843 - DNA, 2571 bp, Artificial Sequence
  Description of Artificial Sequence: Synthetic coding sequence
atggctaatgaaacccaaaaggtgggcgcaatacacttccccttcccatttacaccgtattcgatccaggaggactttatggccgaactctacagagtgctggaggctgggaaaattggaatattcgaatcacccaccggcacagggaaatccttgtcgttgatctgcggcgcgttatcttggctgcgtgactttgaacaaaagaaacgcgaggaggaggcgcggctcctggagactggcacgggaccactgcacgatgagaaggatgagtcactctgcttatcttccagttgtgaaggtgcagccgggaccccccgcccagctggcgagccggcctgggtgactcagttcgtgcaaaaaaaggaagaacgggatcttgttgatagactgaaggctgagcaagctcggagaaagcaacgggaggaaaggctgcagcagctgcagcaccgcgtgcagctcaagtacgctgctaagcgtcttcgacaggaggaagaagaacgtgagaacctgctccggttgagtagagagatgctcgaaacggggcctgaggccgaacgactggaacagctcgagtcgggcgaagaagagctcgtgctggccgagtatgagtccgacgaggagaagaaagttgcaagtcgcgtcgatgaggatgaagatgacctggaagaggagcacattacaaaaatctactattgcagccgaacccactctcagcttgcccaatttgtgcatgaggtaaagaagtcaccgttcgggaaggacgtcagactcgtgtccctgggaagtcgacagaatctgtgcgtgaatgaggacgtaaagagtcttgggtcagtccagctgatcaatgatcgctgcgtggacatgcaacgcagtcggcacgaaaaaaagaaaggtgccgaggaagagaagccaaagcgcagaaggcaggaaaagcaggccgcctgtcctttctacaatcatgagcaaatgggattgctgcgcgatgaagccctggcagaggtgaaggacatggaacaactgctcgctctcgggaaggaggcgagagcgtgtccttattacgggtcccggctggctatcccagccgctcagctggtggtgctgccatatcagatgctcttgcacgctgcaactcgccaggccgcaggtatcaggctccaagaccaggtggtgataatagatgaagctcacaatctgattgatactataaccggcatgcattcagtcgaagtgtctggctcccagttgtgccaagcgcacagtcaactcctgcaatacgtcgaacggtatggcaagaggctcaaggcgaagaatcttatgtatctgaagcagatcctctacctcttggaaaagtttgtcgctgtacttggaggtaacatcaagcagaatcccaatacgcagtctctgagccagaccggaaccgaactgaagacaatcaatgactttctgttccagagtcaaattgataacatcaatctttttaaggtgcagaggtattgcgagaagtccatgatatctcgaaagctgtttggattcactgaaaggtacggagccgtgtttagttctcgcgaacagccgaaactcgccgggttccaacagttcctacagtcacttcagccaagaacaacagaagccctggcagcccccgcagacgagagtcaagcatcaaccttacgacctgcaagtcccctcatgcacatccagggtttccttgcagcccttaccaccgcaaaccaggatgggcgggtcatcctgtcaaggcaggggtcattatcccagagtacacttaagtttctcctccttaatcctgctgtccatttcgctcaagttgtgaaagagtgcagagctgtcgtgatagcaggaggtacaatgcagcccgtttctgactttagacagcaattgctggcatgcgccggggtggaagccgagcgcgtggtggagttctcctgcggacatgtcattccgccagacaatattttgccactcgtaatttgcagcggcatctccaatcagccactggagtttacatttcagaaaagagaattgcctcagatgatctttcaggaacccaagagcgcacaccaggtcgaacaggttttattggcttacagtcgctgcattcaagcgtgtggtcaggagagaggccaggtgacaggcgctctgttgttgtcagtggttgggggaaaaatgtctgaaggaattaatttcagcgataacttaggaaggtgtgtcgtgatggtcggaatgcccttcccaaacattaggtccgcagaactccaggagaagatggcgtacctggatcaaactcttccaagagctcccggccaggccccccctggaaaagctctggtggagaacctgtgtatgaaggctgtaaatcagagcatcggccgagcaatccgccatcagaaggatttcgcgtccgtggtcttactggaccaaagatacgcccgacccccagtcctagctaagctgccggcgtggatccgggccagggtagaggtgaaggccaccttcggacccgcaattgcggccgtgcagaagtttcatagggagaaatctgcctcctcctag

SEQ ID NO: 14844 - DNA, 1671 bp, Artificial Sequence
  Description of Artificial Sequence: Synthetic coding sequence
gaagaagagccgttatggcagggctgtagcgccggcctgccatggctgcccgctgaaaaaaaaaagggagccgaggaggaaaagccaaaaagacgacgtcaggaaaaacaggcagcatgcccattctataatcatgagcagatgggccttctacgcgatgaagcgctggcggaggtgaaggacatggagcagctcctggccttaggaaaggaagcacgagcatgcccatactacggctcccgcttagccattccggcagctcagttggtggtgttgccctaccaaatgctcctacacgctgctacgaggcaggctgcgggcatcagacttcaggatcaggtcgtcatcatcgacgaggctcacaacctgatagacacgatcactggcatgcactctgttgaagtaagtggctctcaactatgccaggctcattctcagttgctgcagtatgtggagagatacggaaagcgactgaaggcaaagaacctaatgtaccttaaacagattttatatcttctggaaaagttcgtcgcagtattgggaggcaacattaaacagaaccctaatactcaaagcttgtctcagaccgggacagaactgaaaaccataaatgactttctgttccaaagtcagattgataacataaacctctttaaagtgcagcgttactgtgagaagagcatgatcagcagaaagttgttcggctttacggaacgctatggtgcagttttctcctcgcgagagcagcctaagttggccggattccagcaattcttgcaaagcctgcagcccagaacaactgaagctctcgcagccccagcagatgagagccaggctagcacccttcgcccagcgtccccactgatgcacatacagggtttcttagccgcactgaccaccgccaaccaggacggcagggtaattctgagcaggcagggctctctgtcacaaagcaccctgaaattcctcctgctgaaccccgcagtgcatttcgcacaagttgtcaaagagtgcagggctgtagttatagcaggtggtactatgcagccagtgagcgacttccgccagcagctcctggcctgcgccggcgtcgaagccgagcgggtagtcgaatttagctgcggacacgtgatcccaccagacaacatacttcctcttgtgatctgttctggtatctctaatcagccattagaatttactttccagaagagagagcttccacagatgatggacgaggtagggaggatcttgtgcaacctgtgtggtgtggtgcctggtggagtagtatgtttttttcccagttatgaatacctcagacaggtgcatgcccactgggaaaaaggagggctgctcggtagactcgcagcccggaaaaagatctttcaggaacctaaatcggctcaccaggttgagcaggtgctgctggcatacagtaggtgtatacaggcatgcggtcaagagcgggggcaggtgacgggcgccctcttattgtcggtggtgggcgggaaaatgtcggaagggattaattttagtgataacctcggaagatgcgtcgtgatggttggaatgcccttcccaaacatacgatctgcagaactacaggaaaaaatggcctatctggaccagaccctggccgggcccagtgggacccgcaggatactacccgcatag

SEQ ID NO: 14845 - DNA, 2913 bp, Artificial Sequence
  Description of Artificial Sequence: Synthetic coding sequence
atggcgaacgagacccagaaagtgggcgcaattcattttccgtttcctttcaccccatactccatacaagaagattttatggccgagctctaccgagttctggaggccggcaagattggaatattcgagagccctaccggcaccggaaaatctctgagtttgatatgtggcgcactgtcgtggctgcgagattttgaacaaaagaaaagggaagaagaggccaggctccttgagactggtaccgggccactgcacgacgagaaggacgagtccctatgcctcagctcatcgtgcgagggtgcagctggcactcctaggcctgccggagagcctgcttgggtgacgcagtttgtacaaaagaaggaagagcgagacctcgtggaccggttaaaggccgagcaggccagacggaagcagagggaagagcgactacagcagctgcagcacagggtccagcttaagtacgccgctaaacgattgaggcaggaggaagaggagcgtgagaaccttctacgactttcgagggaaatgttggagaccggcccagaggccgagcgtctggaacagctagagtcgggcgaggaggagctggtcctggccgagtatgaatccgacgaggagaagaaggtggcaagccgagtcgacgaagatgaggacgatctggaggaagaacatatcactaaaatttactactgtagtagaacccactcccagcttgcccagttcgtgcacgaagtaaagaagtctccgttcggcaaggatgtgagactggtaagcctgggcagccggcagaacctctgcgtcaatgaggacgttaagtcactgggcagtgtccagctgataaatgataggtgtgttgacatgcagagatcaaggcatgaaaagaaaaaaggcgccgaggaggaaaaaccaaagaggcgtaggcaggaaaagcaggcggcctgtccattttataatcacgagcagatgggtttgctccgggacgaggccctcgcggaagtcaaggacatggaacagctgcttgcactcggtaaggaagcgcgagcatgcccttactacggcagccgccttgccatccccgctgcccaactcgtggtgcttccgtatcagatgctactgcatgccgcgacgagacaagcagccgggattcgacttcaggatcaggtggtcatcatagatgaggctcataacctgatagataccatcacaggtatgcactcagtcgaggtcagcgggtcccagctttgtcaggcccactcccagctccttcagtacgtggaacgctacggcaagcgcctgaaggcgaagaacctaatgtatctgaagcagattctctatctccttgagaagttcgtggccgtactgggtgggaatattaagcagaacccgaacacacagagcctcagccaaaccgggacggagttgaagaccatcaacgattttctcttccagagtcagatcgataatataaatcttttcaaggtgcaaaggtactgcgagaaatcgatgatttccagaaagctgtttggtttcacagaaaggtatggggcggtttttagctctcgtgagcagccaaagctggctggtttccagcagttcctccagagcctgcagccacgtactactgaagcgctcgcggctcctgccgatgaaagccaggcgagtacgctaagaccagcctccccactgatgcacatacaaggtttcctggccgcattgactaccgctaatcaggatggacgcgtcatcttaagtcgccagggctctttaagccagtcaacattgaagttcctcctgcttaatcctgctgtgcatttcgcccaggtggtcaaagagtgtcgagcagtggtaatcgccggaggcactatgcagcccgtgagtgacttcaggcaacagttgttagcgtgcgccggtgtcgaagctgaaagggtggtggagtttagttgcgggcatgtgatcccgcccgacaacatactgcctctggtgatctgttcaggcatttctaaccaaccactagaattcacgttccagaaacgggaattaccacagatgatggatgaagtgggcaggattctgtgcaacctatgcggggtcgtgccaggaggcgtggtttgcttctttccttcttacgagtacctgcgccaggttcacgctcattgggagaaggggggtcttttaggcaggctcgcagccaggaagaagatcttccaggagcccaagtctgctcatcaggtggaacaggttctcctggcttacagcagatgcatacaggcctgcgggcaggagagaggacaggtgaccggcgcgctactcctttccgtggtgggggggaaaatgtccgaaggaatcaattttagcgacaacttgggcagatgcgtggtaatggtcggaatgcccttccctaatatcaggagtgcagagcttcaggaaaaaatggcctatttagaccagactctgagtccaagacctggcacccctcgcgagggcagcgggggtgagcctgtccacgagggaagacagcctgtgcacaggcaagggcatcaggccccagagggattttgccagagaagcgcacccggtccggcgatctgcccggcgccatgcccggggcaggcagccggtttggaccctagcccgtgtggaggacagtcttatctgtggccacgccactgttgttgcgctgaagtgtcccccggagaggtgggcctgttcctaatgggcaaccacactactgcctggagacgagccctgccgttaagttgccctctggagactgtctttgtggtaggcgttgtctgcggagaccccgtgactaaagtcaaaccacgccgcagagtttggtctccagaatgttgccaggatcctggaactggagtgtcatcccggcggcgtaagtggggtaatccagaatag

SEQ ID NO: 14846 - DNA, 675 bp, Artificial Sequence
  Description of Artificial Sequence: Synthetic coding sequence
atggctgaactttacagggtgcttgaggctggaaagattggcatcttcgagagccctaccggcactgggaaatccctctcccttatctgtggggccctgagctggctgcgggattttgaacagaagaagcgagaagaagaggccagacttttagaaaccggcactggacctcttcatgatgagaaggacgagagtctgtgcctgtcatcttcctgtgaaggggccgctgggacccctagaccagctggcgaacctgcttgggttacccagtttgtgcagaaaaaagaagaaagggatctggtagatcgtctgaaggcggagcaggctcgtagaaaacaacgggaagagaggctccagcagctgcaacatcgcgtgcagcttaagtacgccgctaagcgccttcgacaggaggaggaggagagggaaaacctgctgagactctccagggagatgctggaaaccggaccggaggctgagcggctcgagcagctggagtccggtgaggaggaattggtgctagccgaatatgaatccgacgaggagaaaaaggttgcgagcagggtggacgaggatgaggacgatcttgaggaagagcatattaccaaaatttattactgcagcagaacccattcgcagctggctcagttcgttcacgaggttaaaaaaagcccctag

SEQ ID NO: 14847 - DNA, 2721 bp, Artificial Sequence
  Description of Artificial Sequence: Synthetic coding sequence
atggccaatgagacgcaaaaggttggagccatccactttcccttcccttttactccctattcaattcaggaggacttcatggctgagctgtaccgggtgttggaggcaggaaagatcggaatatttgagtctccaaccggcacagggaaatcgttgtcactgatatgcggcgctctcagttggctgcgtgactttgaacagaagaagcgtgaggaggaggctaggctgctggagacgggcactggccccttgcatgatgaaaaggatgagtctctctgcctgagcagctcttgcgaaggagcagccggtactccaaggcctgcaggtgagcctgcgtgggtgacccagttcgtgcagaaaaaggaggagcgtgatcttgtcgatagactgaaagcagaacaggcgagacgcaagcagagggaggagcgtctgcagcagcttcagcatcgggtccagctgaaatacgcagcaaagcggctgcgacaagaagaggaggagcgggaaaatttactgaggttgtcacgcgaaatgctggaaacgggtccggaggccgagcgattggagcaactggagtccggcgaggaagaattagtgctggccgagtacgagtccgacgaagagaagaaagtggcatctcgtgtcgacgaagatgaggacgacctcgaagaagagcatataactaaaatctactactgtagcaggacgcactcccagctcgcccagtttgtgcacgaggtcaagaaatcgccctttggaaaagacgttagactggtcagcctgggaagtcgccaaaatctgtgtgtaaatgaagatgttaagtccctcggatctgttcaattgataaacgataggtgcgttgacatgcagcggtcacggcatgagaagaaaaagggagccgaggaagaaaaacccaaacgccgaagacaagagaaacaggccgcgtgccccttctataatcatgagcagatgggtcttctgagggatgaggctttggcagaggtcaaagacatggagcagctgctagccctgggtaaggaggctcgggcatgcccctactacgggagtagattggctattcccgctgctcagctggtcgtgttaccctaccagatgctgctgcacgccgctaccaggcaggccgctggaattcgccttcaggatcaggtggtgattatagatgaggcccataatctgattgataccatcacggggatgcacagcgtggaagtgtctggaagtcagctgtgtcaggcccattcccagctgctgcagtacgtcgaacgctacgggaaacggttaaaagctaagaatctgatgtatttgaagcagatcctctacctcctggaaaagttcgtagccgttctgggaggcaatataaagcagaacccaaatacgcagtcactgagccaaaccggtaccgagctcaagacgattaatgatttcctgttccagagccaaattgacaacatcaacctctttaaagttcaacgctattgtgagaagagcatgatcagccgtaaactatttggtttcacagaaaggtacggggcagtcttttctagtcgagaacagccaaagcttgctggtttccagcaatttctccagagcttgcagccaagaaccacagaagccctggcggcccccgctgacgagagccaggcctctaccttacggccagcctctccgctgatgcacatccagggcttcttggccgccctcaccaccgccaaccaagatgggcgggtcattctgtcccgccaggggtctctgtcccagtcaacactcaaattcctgcttctaaatcctgctgtgcacttcgctcaggtcgttaaagagtgtcgggctgtcgtgattgcaggtggaactatgcaacccgtttccgactttcgccagcagctgctggcctgcgcaggcgtggaggctgagagggtggtcgagttttcatgcgggcatgtgattcctccggataatatccttcccctggtcatatgcagcggcatcagtaatcagcccctcgaatttactttccagaagagggagcttcctcaaatgatggatgaggtaggaaggatcctatgcaatctgtgtggggtggtgcccggtggagtggtttgttttttcccttcttacgaatacctgcggcaggtgcacgcccactgggagaagggcggcttactcgggagactcgctgccagaaagaaaattttccaagagcccaagtctgcccatcaggtagaacaggtcttactggcctacagtcggtgtattcaggcttgtgggcaggaaagagggcaagtaacaggtgccctcctcctcagcgtcgtggggggaaagatgtccgagggtatcaacttctccgataacctgggtcggtgcgtggtcatggtcggcatgcctttcccaaacattcgctccgcagagttgcaagagaagatggcttatctggaccagacacttcccagggctcctggtcaggctcccccaggcaaggcactcgtagaaaacctttgtatgaaagcggtcaatcagtcaatcgggagagccatccgtcaccagaaggattttgccagcgtagtactactcgaccagcgatacgcccggcccccggtgcttgccaagctccctgcgtggatccgtgccagagttgaggtcaaggccacattcggacctgccattgctgctgtgcaaaagtttcatcgggaaaaatccgcttccagctag

SEQ ID NO: 14848 - DNA, 2913 bp, Artificial Sequence
  Description of Artificial Sequence: Synthetic coding sequence
atggcgaacgaaactcagaaagtcggagccattcactttccttttccatttaccccctactctattcaggaggacttcatggcagagctgtaccgcgtgctagaagccggaaaaatcggaatcttcgagagccctaccggtactggaaagagcctgagcctaatatgtggcgctctgtcctggctcagggattttgaacagaaaaaaagagaggaagaagccaggctccttgagaccgggacaggtccgctgcatgacgaaaaggatgaatcactgtgcctctcatccagctgtgagggcgctgccggaacaccgaggccggctggggagccagcatgggttactcagtttgtgcagaagaaggaagaaagagatctggtggatcgcttgaaggccgagcaggcaagaagaaagcagagggaagagcggctgcagcaactgcagcatcgggttcagctgaagtatgcagccaagaggctgcgccaggaagaggaagaacgggagaacctgctgcgtctgtcacgtgagatgctagaaaccgggcccgaggcagaaaggctggagcagctggaaagcggcgaagaggaacttgtgttggcggagtacgaatccgacgaggagaagaaagtcgctagcagggtggacgaagacgaggatgatttagaagaggaacacatcacaaaaatctattactgctcaagaacccactcccagctggcccagttcgtccatgaggtcaagaagtcgcctttcgggaaggatgtgagattggtctcactgggtagcagacagaacttgtgcgtgaatgaagatgtgaagtctcttggaagcgtgcagctgattaatgacagatgtgtggacatgcagagatcaagacacgaaaaaaagaaaggggccgaagaggagaaacctaagcggagaagacaagagaaacaggctgcatgcccgttctacaatcacgaacagatggggctgctcagggatgaggcccttgccgaagttaaagacatggagcagctgctggcccttgggaaggaggctcgcgcgtgtccttattacgggtctagactggccattccagccgcgcaactggttgtgcttccctatcagatgctcctccacgccgccacgagacaggcggcgggcattcgcttacaggaccaggtggtgattatcgacgaagcacacaacctcatcgatactatcactgggatgcactcagttgaggtgtcaggaagccagctgtgccaagcccacagccagcttctgcagtacgtggagaggtacggtaagaggctcaaggccaagaatcttatgtacctgaagcagattctgtatttgctcgagaagttcgtggctgttctcggcggtaacatcaaacaaaatcctaacacacagagtctgagccagactgggacagaactgaagacaatcaacgacttcctcttccagtcccaaatcgacaatattaacctctttaaggttcagcggtattgcgagaaatcaatgatctcgaggaagctgtttgggttcacagaaaggtatggcgcagtgttctcaagcagggagcagcccaaactggctggattccagcagttcctccagtcgctgcagcctagaactaccgaagcattggctgcccccgctgacgaaagccaggctagcacactccggcccgcttctccattgatgcatatccaggggttcctagcagccctaacgacggcgaaccaggatggtcgagtcattttgtctagacaaggtagtctgtctcagtctacgctgaaatttctcctgctgaaccccgccgtgcattttgcccaggtcgtgaaagagtgtagagctgtagttatcgccggaggcactatgcagccagtgtctgactttcgccagcaactgttagcctgcgcaggcgtcgaagccgaacgggtggtggagttcagctgcggccatgtgatccctcccgataatatcctgccgctcgtcatctgcagtggcatttctaaccagcctttggaatttacattccagaaacgagagttaccccaaatgatggatgaagtcggcagaatactctgcaacctgtgcggtgtggtaccaggcggagtcgtctgcttcttccccagctacgaatacctacgccaggtgcacgcgcactgggagaagggaggcctgctagggagactggccgcccggaagaaaatatttcaggagcctaagtctgcgcaccaggtggagcaggtgcttctggcctattctcgctgcattcaggcctgcgggcaagagcgcggtcaagtcacaggcgccctcctcctgagtgtggtgggaggcaagatgagtgagggcataaattttagcgacaatctggggcggtgcgtggtcatggtgggaatgccatttcctaacatcaggagtgctgaattgcaagaaaaaatggcatacctggatcaaacattgagccctcgacctgggactccccgggaagggtccggaggggagcctgtccacgaaggacgccaacctgtacaccggcaaggccaccaggctcctgagggattttgccaaaggagcgcacctgggccagctatatgtccggccccatgccctgggcaggccgccgggctcgatcccagtccctgcggaggtcagtcatacctgtggccccgccattgctgctgcgcagaagtaagcccaggtgaggtagggctgttcctaatgggtaaccacactacagcgtggcgccgcgcactccccttaagctgtcccctggagacggtcttcgtggtcggagtagtctgcggcgatccagtcactaaagtgaaaccaagacgaagggtttggtcaccagagtgttgccaggatccaggcacgggagtgtccagccgacgacggaagtggggcaatccagagtag

SEQ ID NO: 14849 - DNA, 4293 bp, Artificial Sequence
  Description of Artificial Sequence: Synthetic coding sequence
atgacagtctttcgccaagagaacgtggacgattactatgacacaggggaagagctggggagcggccagttcgctgtagtgaagaagtgccgcgagaagagcaccggcttgcagtatgccgcgaagtttatcaagaagcgacgaaccaagtcctcccgtcgtggcgtctcaagggaagacattgaacgcgaagtcagcatcctcaaggaaatccagcaccccaacgtcattaccctccacgaagtgtacgagaacaagactgacgtgattctaattctggagctggtggctgggggggaactattcgacttcttggcggagaaggaaagtctaacagaggaagaggctactgagttcctcaaacagatattaaacggcgtctattacctgcactcattgcagattgctcactttgatttgaagccagagaacatcatgttgctggatagaaatgtgccaaaacctaggatcaagatcatcgactttggcctcgcgcacaaaatagacttcggaaacgagttcaagaacatttttggaactcctgagttcgtggcgcccgagatagtaaactacgagccactgggtctagaggctgacatgtggagtatcggagtgataacctacatactcctgtccggagcctcaccattccttggcgacacaaaacaggagacactagccaatgtaagtgccgtgaattacgaattcgaggatgagtactttagtaatactagcgcgctcgccaaagatttcatcagacggcttctggtcaaggaccccaagaaacgaatgaccatccaggattctctgcagcatccctggataaagcccaaggatacccagcaagcactgtctaggaaggcaagtgcggtgaacatggagaaatttaagaaatttgcagcacgcaaaaagtggaagcagagcgttcgtctgatctccctttgtcaaagactctccaggagctttctgagccgctcgaacatgtcagtggctcgcagtgatgataccctggatgaggaggattctttcgtcatgaaagccattatccacgctattaatgacgacaacgttcctggtcttcagcacctgcttggcagtctgtccaattacgatgtaaaccagccaaacaagcacgggactcctcccctgctcattgctgccggttgtggaaatatacaaattctccaactgttgattaaaagggggagtaggatcgacgttcaggataaaggtggcagcaacgcggtgtactgggcagccaggcatggacacgtggatactctcaagtttctgtccgaaaacaagtgccccctcgacgtcaaagacaaaagcggggaaatggccctgcacgtggctgcccgatatgggcacgctgacgttgctcagctgctgtgctcttttggttccaaccctaatattcaagacaaggaggaagagacgcctctgcactgtgccgcttggcacggctattacagtgtggccaaggccctgtgtgaggccggatgcaatgtcaatattaaaaatagagaaggtgaaacacccttactgacagcaagtgctcggggatatcatgacatcgtagaatgcctcgccgagcacggcgctgatctcaacgcctgcgacaaagacggtcatattgccttgcacctcgccgtccgtaggtgccagatggaagtgattaaaacactgctcagccaaggatgcttcgtagattaccaagaccgccacggaaatactccactccacgtggcttgcaaggacggcaacatgcctatcgtggtcgctctctgcgaggcaaattgtaaccttgatatatccaataaatatgggagaacacccctgcatctggctgcaaataatggcattcttgacgtagtgcgatacctgtgccttatgggcgcaagcgtggaggccctgaccaccgacggcaagacagcagaggatcttgcgcgctcagagcagcacgagcatgtggctggtcttcttgcgagattaagaaaggacactcacagaggactgttcatacagcagcttagacctacacagaacctccagcccagaattaagctcaagctgtttggtcactctgggtcaggcaaaacaacgttggtggaatcattgaaatgcggattgttaagatcattttttcgtcgtcgccggcccagactttctagcaccaattcttcaaggttcccaccatcccctctggcctccaagccgaccgtgtctgtgagtataaataacctctatcccggatgcgagaacgtttctgtgcgtagcagatccatgatgttcgagcccggcctgacaaagggaatgttggaggtgttcgtggctccaactcaccacccccactgctccgcagatgatcaatcaacaaaagcaatcgatatccagaacgcctacctcaatggcgttggcgattttagcgtttgggagttctcaggcaatccagtgtacttttgttgttacgactattttgccgcaaacgaccctactagtatccatgtggtggtcttctctctggaggagccctacgaaatccagctgaaccaagtcattttctggctgtccttcctgaagagtttggtacccgtggaagaacccatagccttcggtggaaagttgaaaaaccccctccaggtggtcctcgtggcgacccacgccgatataatgaatgtgcctaggcctgctggcggcgagtttggctacgataaggacacttccttgttaaaggaaatccggaacagatttgggaatgatctgcatatcagcaacaagctgtttgtgctcgatgccggcgcttcagggtctaaggacatgaaggtgctccgcaatcacctccaggagatcagatctcaaattgtgtcagtctgtccccctatgactcatctttgcgaaaagatcattagtactctgcccagctggcgtaaacttaatggtcctaaccagctgatgagtctgcagcagtttgtgtatgacgttcaggaccagttgaaccccctggcgtccgaagaggatttacgccggatagcccagcagctgcatagtacaggggagatcaacatcatgcagagtgagacggttcaggatgttttattactggatcccaggtggctgtgcaccaacgtcctgggcaaactgttatccgtggagaccccacgtgctctccaccactatcgggggcggtacacagtggaggacatccagcgactggtgccagacagcgacgttgaggaactcctgcaaatattggacgctatggatatatgcgccagggatttgtcttcaggcacaatggtagacgtacctgcactcataaagacagataacctgcaccgaagttgggccgatgaagaggatgaagtcatggtatacggtggagtgcgcatagtgccggttgaacatttgactccttttccctgtggcatcttccataaggtgcaggtgaatctgtgtcgctggatccaccagcaatctactgaaggggacgccgacattaggctgtgggtgaacgggtgcaagttagctaaccgaggagcggagctgctcgtccttctggtgaatcacggccagggcatcgaggtacaggtgcgcggattggaaaccgagaagattaagtgttgcctcctattggattctgtgtgcagcacaatagagaacgtgatggcaactaccctgccaggccttttgaccgtgaagcactatctgagccctcaacaacttagagagcatcacgagcccgtgatgatttaccagccacgcgatttttttcgggcacaaacgctgaaagagacaagcctcaccaacacaatgggcggttacaaagagtcgtttagcagcatcatgtgttttggttgtcatgacgtctactcccaagccagcctgggtatggatatccatgcatcggacctgaatcttctcacacgtcgcaaactgtcgcggctgctggaccctcctgaccccctgggtaaggattggtgtttgctcgccatgaacttgggcctgccagacctggtcgccaaatacaatacatctaacggtgctcctaaagacttcctgccatctcctctgcatgcccttctgagagaatggacaacataccccgagagcacggtgggcacgctaatgtcgaaactcagggagttaggccggcgcgacgccgccgatttcttgctgaaagcatcgtccgtctttaagatcaacctggatggaaacgggcaagaggcgtatgctagcagttgcaattcagggacctcctacaattccatcagcagtgtcgtatctaggtag

SEQ ID NO: 14850 - DNA, 4293 bp, Artificial Sequence
  Description of Artificial Sequence: Synthetic coding sequence
atgaccgtcttccgacaggagaatgtggacgattactacgacactggcgaagagcttggctcgggccaattcgctgtcgtaaagaaatgccgggaaaagagcaccgggctgcagtacgctgccaagttcattaagaagcgacggactaagagttcacgacggggagtgtcacgggaggatattgaacgggaagtgtctatcttaaaggagattcaacaccctaacgttataaccctccacgaggtctatgaaaacaagacagacgtgattctcattctggaactagtggcaggaggcgagttgtttgacttcttggccgagaaggaatctctcaccgaggaggaggccaccgagttcctcaagcagatcctcaacggtgtgtattatttgcacagcttgcagatcgcacactttgacctgaaacccgaaaacattatgttactggataggaatgtgcccaaacccagaatcaagattatcgatttcggcttagcccataaaattgactttggaaacgagtttaagaacatctttgggactcccgaattcgtcgctccagagatcgtaaattacgagccacttggtctggaggcagacatgtggtcaatcggggtgatcacctacatcctgctctcaggagcctccccttttctcggggatactaaacaggagacgctggctaatgtgagcgcggtcaactacgagttcgaagacgagtacttcagcaacacttccgctttggctaaggatttcatccgcaggttgctggtgaaggacccaaagaaacgcatgaccatccaggattcattacagcatccatggatcaaaccaaaagacactcagcaggccctgtcgagaaaagcctctgcagtgaacatggagaagtttaaaaagtttgctgctaggaagaagtggaaacaatccgtgaggctgatatccctctgccagagattgagtcgatcctttctttcgagatccaatatgagtgttgccagatccgatgacaccctggacgaggaggactcatttgtgatgaaggcgatcattcacgctataaatgacgacaacgtgcctgggctacagcacctcctggggtctctatctaattatgacgtgaaccagccgaacaaacatggaaccccccccctgcttatagccgcgggttgcgggaacattcagatcctccagctgcttattaaaaggggtagccgcattgacgtgcaggataagggtggcagcaacgcagtctattgggccgcaagacacgggcacgtagacaccttgaaatttctcagcgagaataaatgcccactagatgttaaggacaagtcaggagagatggctctgcatgtcgccgcccgatacgggcatgcggacgtggcgcagctcctttgtagcttcggctcgaaccccaatattcaagataaagaggaagaaacccctctgcattgtgccgcttggcatggctattattccgtcgcgaaagccttgtgtgaagccgggtgtaatgtcaacatcaagaacagggagggggagactcctctcctgaccgcctctgctcgcggctaccatgacatagtcgagtgtttggctgagcacggggccgacctgaatgcatgtgacaaggatggccacatcgcactgcatttagccgtgcgtaggtgtcagatggaagtgattaagactcttctcagccaaggatgcttcgtagactaccaggaccgacacggcaacaccccattgcatgttgcatgtaaggacggcaatatgcctatcgtcgttgctctatgtgaggccaattgcaacctggacatttcgaataaatacggtaggacacccctgcatctggccgcaaataatggcattttggacgtcgtacgctatctttgtctgatgggggcctctgtggaggctttaacaaccgatggaaaaaccgccgaggatctggctcggtccgagcagcatgagcatgtggctggactgctggccagactccgtaaggatacacaccggggcttgttcatccagcagttgcgccccacccagaacctgcagccaaggatcaagctcaagctgtttggccatagcggcagcgggaagactactctcgtggagagcctgaagtgtgggcttctacgaagtttctttagacgtcgtcgcccccgtctctcaagcaccaattccagcagatttccacctagtccgctggcatcaaaaccaaccgtgtcagtgtcaatcaataacctgtatccgggttgcgagaatgtatcagttcgaagccgatccatgatgttcgagcctggcctcacgaaggggatgctggaggtgtttgtagcgcctacacaccacccacactgctctgcagatgatcagtcaacaaaggccattgacatacagaatgcctatcttaacggcgtcggagacttttctgtgtgggaattctcggggaatcccgtgtacttctgctgctatgattattttgcagcaaacgatcctacctctattcacgtcgttgtcttctctttggaagagccctatgagatacagctcaaccaggtcattttctggctgtcattcttaaaatcccttgttcctgttgaagagcctatagcattcggtggcaaactgaagaatccactacaagtcgtactggtagctacacatgccgatattatgaacgtcccccggccggcaggaggggagtttggctacgataaggacaccagcttgctcaaagagattcgaaacaggttcggaaacgacttgcatatctccaataaactcttcgtgctcgacgccggagcctctggttccaaggatatgaaggtacttcgaaaccacctacaggaaatccgcagtcagatcgtgagcgtgtgtccccctatgacacatctgtgtgaaaaaataatttctacattgcctagctggcgcaaactgaatggaccaaatcagctgatgtcactccagcagtttgtgtatgatgtgcaagaccagctcaaccctctggcgtccgaggaggaccttcggcggattgctcagcaacttcacagcactggcgaaattaacatcatgcagagcgaaactgtgcaggacgtgctgcttctagatccacggtggctttgtaccaacgtgctgggcaaattgttgagcgtagaaactccgcgggccctgcatcactacagggggcgctacaccgtagaggacatccaaaggctggtccctgactctgacgtggaggaactgctccagatcttagatgccatggacatctgcgctcgcgatctgagcagtggcaccatggtagatgtacccgccctgatcaagaccgataacctccaccggagctgggccgacgaggaggatgaggttatggtctatggaggtgtcagaattgttccagtagaacatctcacacccttcccctgcgggatttttcataaggttcaggttaatctgtgtcgatggatccatcaacagtccaccgaaggtgacgctgacatcaggctgtgggtaaatgggtgcaaactggccaacagaggagctgagctgttggtgttactggtgaatcatggtcagggcatcgaggtgcaggtccggggcttagagacagagaaaatcaaatgctgcctgctccttgattccgtgtgttcaacaatagaaaatgtcatggctacaacattgcccggacttctaaccgtgaaacattacctgtccccccaacagctccgcgaacaccatgagcctgtgatgatctaccagcctagggattttttccgggcacagacattgaaagagacgagtctgacgaataccatgggcggatataaggaaagcttcagttccatcatgtgttttggttgccacgatgtgtactcacaagcttctctgggcatggatatccatgccagtgacctcaacttgctgacaaggcgaaaactgagtcggcttttggatccccccgaccctctggggaaagactggtgccttttggctatgaacttaggactcccggacctcgttgccaaatataatacctccaacggggcaccaaaagactttctcccaagccctttacacgccctgcttcgtgaatggaccacttatcctgagtccaccgtcggtaccctgatgtcaaagctacgtgaattgggacgtcgcgacgctgcggactttttgttaaaggcatcatccgtttttaagataaacctggacggcaatggacaggaggcatatgctagctcatgcaattctggcacaagctacaactcaatctcttccgtggtcagccggtag

SEQ ID NO: 14851 - DNA, 4368 bp, Artificial Sequence
  Description of Artificial Sequence: Synthetic coding sequence
atgacggtgttccgccaggagaacgtcgatgactactacgatacaggagaggagctggggagtggtcaatttgccgtggttaagaagtgcagggaaaagagcaccgggttgcagtatgccgcaaagttcattaaaaaacggaggaccaaaagcagcagacggggcgtgtcacgcgaggacatcgaaagggaggtctcaattctgaaggaaatacagcatcctaacgtgatcacgctgcatgaagtctacgagaataagacagatgtgattctaattctcgagctggttgccgggggagagctcttcgacttcctcgcagagaaggagtccctgaccgaggaggaagcaacagagtttttaaagcagattctcaatggcgtctattatctacatagcctccaaattgcccacttcgatcttaaaccagagaatatcatgctcctagatcggaacgtgccgaaaccaagaatcaaaatcatcgactttgggctcgctcacaagatagacttcggaaatgaattcaagaacattttcggaactcctgagtttgtggcgcccgaaattgttaactatgaaccattggggctcgaagctgacatgtggagtatcggagtgattacatatatcctgctctcaggcgccagcccgttcctcggtgacactaaacaggaaacgctggcgaacgtgtcagctgtaaactatgaatttgaagacgagtatttcagcaatacctcagccttggctaaagacttcatccgcaggttgctggtgaaggatccaaagaaacggatgacaattcaggatagcctgcagcatccatggatcaaacctaaggacacacaacaggccctcagtagaaaggcaagtgcagtcaatatggagaagttcaaaaagttcgcagctaggaagaagtggaagcagtcggtccgcctaatctccctttgccagcggctgtctagatccttcctcagtcggtccaacatgtcagtggcgaggtccgatgatactttagatgaagaagactcttttgtgatgaaagccataatccatgccataaatgatgacaacgtgccaggtctccagcatctgcttggatcactgagtaattatgacgtgaatcagccaaataagcacggaactccccccctgctcattgcagctggatgcggcaatatccagatactccagctcctcatcaaacgaggcagtcgcatcgacgtgcaggacaagggcggctccaacgccgtctactgggcagccagacatggccacgttgacactctgaaattcttatccgagaacaagtgtccattagatgtgaaagataagtccggcgagatggccctgcacgtcgctgcacggtacggtcacgcagacgttgctcagttgttgtgttcatttggatccaatcctaatatccaggataaggaggaggagaccccgctgcattgcgccgcatggcacggctattacagtgtcgccaaagctctttgtgaagcggggtgcaacgtcaatataaagaatcgcgagggagagaccccccttctgacggcctctgctaggggttaccatgacatcgtggagtgtctcgctgagcatggtgctgacctcaacgcctgtgacaaagacggccatattgctttgcaccttgccgtccgccggtgtcaaatggaggtcattaagaccctcttaagccagggctgctttgtggactatcaggacaggcacggaaatactccactccatgtggcttgcaaggatggtaatatgcccatcgttgtggcactttgtgaagccaattgcaacctggacatctctaataaatacggcagaacccctctgcacctggcagccaacaacgggatccttgatgtcgtacggtacctctgtttgatgggagcaagtgtggaggccctaactaccgacggaaaaaccgccgaagacctggcccgaagcgagcagcatgagcacgtggccggcttgctggcccggctgcggaaagatactcaccgtgggttgttcattcagcagctgcgaccaacacagaacctccaaccccgtattaaactgaagctctttggtcatagcggcagtggtaagactacattagttgaatcgttaaagtgcggattactgaggtcttttttccgcagacggagacccagattgtcatccaccaactccagccgatttccaccatctcctctggcttctaagcctaccgtcagtgtcagtatcaataacttgtacccagggtgtgaaaatgtgtctgtgcgctctcgctccatgatgtttgagccaggactcacaaagggcatgcttgaggtctttgtcgctccgactcaccacccgcactgctctgctgacgatcagtcaacaaaagctatagatatccagaacgcatatttaaacggggtgggcgatttctctgtgtgggagttttctggcaaccctgtctatttttgttgttatgattattttgccgcgaatgatccgacatctatccacgtagttgtcttttccttagaagagccttacgaaatccagcttaatcaggtaattttttggctctcctttctgaagtcactggtgccggtggaagaacctatcgccttcggaggcaagttgaagaatcccctgcaggtggtgctcgtggccacccatgccgacataatgaacgtccctcggcccgcgggtggcgagttcggctacgataaagataccagcttgcttaaggagatcagaaacaggttcggcaatgacctccatatttctaacaaactcttcgtgcttgacgctggagcctccgggtccaaggatatgaaagtcttaaggaaccatctgcaggagattcgaagccagatagtcagtaaaacgttaccattcactcccgatatactggtaggagttcctttatggcatcatcagaaaattgggggatccccagtgtgccctcctatgactcacctgtgcgaaaaaataatctcaaccttgcccagctggcgaaaattgaacggacctaaccagcttatgtcactgcaacaattcgtgtacgacgtacaggaccagctgaatcctctggccagcgaggaagacctgagaaggatcgcccagcagttgcactccaccggagagattaacataatgcagagcgaaaccgtgcaagacgttctcctgctagacccaagatggttgtgtaccaatgttctgggcaagttattgtccgtggagactccacgtgctttgcaccactacagggggagatataccgtcgaagacattcagagacttgtcccagatagcgatgtcgaagagttattacagatcctggatgcgatggatatttgtgcccgggacttgtcctcgggcaccatggtcgatgttccggcactgatcaaaaccgacaatctgcaccgctcatgggctgacgaggaagacgaggttatggtgtacgggggcgtacgcattgttccagttgagcaccttactccatttccctgtggcattttccacaaggtgcaggttaacctttgccgatggatacatcagcagtcaaccgagggcgacgccgacattagactttgggtcaacggctgcaagctggctaacaggggcgcagagttactggtgcttctggtgaaccatggccagggtatcgaagttcaggtacgggggctcgaaaccgagaaaatcaaatgctgcttgcttctcgacagcgtctgctcaacgatcgagaacgtaatggctaccactctgccaggcctcctgactgttaaacactatctgtctccacagcaactgagagaacaccatgagccagtcatgatctaccaaccaagagacttcttcagagctcaaacccttaaagagacctctcttaccaacacgatgggtggctataaggagtccttttccagcattatgtgcttcggatgtcatgatgtgtatagccaggcttcccttggtatggatatacatgccagtgacctcaacctgcttacacgcaggaagctttcaaggttgctagatcctccagacccactcggaaaagattggtgcctgctggcgatgaatttagggctcccggatcttgtcgcaaagtacaacacctcaaatggagctcccaaggactttctgccttcacctttacacgcactactgcgggaatggaccacctatccagagtctactgtgggcacacttatgagcaagttacgggagttaggtaggagagatgctgccgacttcctgcttaaggcatcgagtgtatttaagatcaacctggatggcaatgggcaggaggcttatgcttcatcctgtaattcaggaacttcctacaattccataagctcagtcgtgtctagatag

SEQ ID NO: 14852 - DNA, 4293 bp, Artificial Sequence
  Description of Artificial Sequence: Synthetic coding sequence
atgaccgtgttcagacaggaaaacgtggacgattattatgacactggcgaggaacttgggtccggacagtttgctgttgtgaaaaagtgtcgggaaaaatcgactgggctccagtacgcagcaaagtttataaaaaaaagacgtaccaaatcaagcaggcggggcgtgagtcgggaggatatcgagagggaagtaagtattctgaaggaaattcagcacccaaacgtcatcacattgcacgaggtttatgagaataagaccgatgtgatactgattctcgaactggtggccggaggtgaactgtttgatttcctcgccgagaaagagagcctaaccgaagaggaagctacggagttcttgaaacagattctgaacggtgtttattacctccactccctgcagattgcccatttcgatctgaaacctgagaacatcatgctgctggatcgaaatgtcccaaagcctagaatcaagataattgacttcgggctggctcacaagatcgatttcggcaatgagtttaaaaatattttcggcacccccgaattcgtggctcctgaaatcgttaattacgaaccattaggcctagaagcagatatgtggtcgattggagtaatcacgtacatccttctgagcggggcctccccattcctcggcgacacgaaacaagagaccctggcaaatgtatcagcagttaactacgagtttgaggatgaatacttctcaaatactagcgcccttgctaaggactttatacgaaggctgctggtgaaagatccaaaaaagcgaatgactattcaggactctctgcagcatccctggataaaaccgaaggacacccagcaggctttgtccaggaaggccagcgccgtcaatatggagaagtttaagaagtttgccgcccgtaaaaagtggaagcaatccgtccgcctgatttctctatgtcagcggctttcccgcagcttcctcagcagaagcaatatgagtgttgctagaagcgatgacactcttgacgaagaggattccttcgtcatgaaggctatcatccatgctatcaatgatgataatgtacccggacttcagcacctgcttgggagtctctctaattatgacgtgaatcaaccaaataaacacggcactccacctcttctgattgctgcgggatgcggcaacattcagatcctccaactgctgattaagagggggagccgcatcgacgttcaggacaaagggggaagcaacgccgtatattgggccgctcggcacggacacgtggacactcttaaatttttgtccgagaacaaatgccccctggacgttaaagacaagtccggagaaatggctctacacgtagccgcacgctacgggcatgcagacgttgctcaattgctctgcagtttcggatccaacccaaatattcaagataaagaggaagaaacgcccttacactgtgccgcctggcatggatattattccgtagcaaaggccctttgcgaggccggctgcaatgtcaatatcaaaaatcgtgaaggtgagacacctcttctgactgccagtgcccgtggatatcatgatatcgtcgagtgcttagccgagcacggtgcagatctgaacgcatgcgataaggatggccacattgccctccaccttgctgtacgtagatgtcagatggaggtgatcaaaaccctgttaagccagggctgcttcgttgattatcaagatcgccacggcaatacacctttacacgtggcttgtaaggacggtaacatgcccatcgtcgtagcgctctgtgaggccaattgcaacctcgatatctctaacaaatacggaagaacccccctacacctggctgcgaataacgggatactggacgtcgtccgctatctgtgtttaatgggggcatccgtggaagctttgaccaccgacggtaagacagccgaggaccttgcccgcagcgagcagcatgaacatgttgccggtttgctggcaagactgaggaaagacacacacagaggcctcttcatccaacagctcagaccaacacagaacttgcagccgcgtatcaaactcaagctcttcggacattccggtagtggcaagactacgttggttgagagcctgaaatgtggactgctgagatccttctttcgcaggaggaggccccgtcttagctctaccaattcttctagatttcctccatcgcctctagcatcaaagcccactgtgtctgtctccataaataacctgtacccgggctgcgagaacgtctcagtgaggtctaggagtatgatgtttgaaccaggactcaccaagggcatgcttgaagtgttcgtggcacccacccaccatccacactgtagcgccgatgatcagtccacaaaagctattgacatccaaaatgcatatttgaatggggtaggggatttctcagtgtgggagttcagcggtaaccctgtatacttctgttgttatgactactttgctgccaacgacccaacttctatccacgtagtcgtttttagtttggaggagccatatgagatccaactcaaccaggtgatcttctggctgtctttcctcaaatctctcgtgcccgtagaagagcctatcgccttcggcggcaaactgaagaatccgctgcaggtggtacttgtcgcgactcacgccgacatcatgaacgtgccacgacccgcgggaggcgaattcggttatgacaaagatacaagtttattgaaggaaattcgaaaccggttcggcaacgatttacacatctctaacaagctgtttgtgctggatgccggtgcctctggctcaaaggacatgaaagtcctgagaaatcacctgcaggagataagaagccagattgtgtctgtgtgcccacccatgacacacttatgcgaaaagatcattagtactctcccctcatggcgtaagctgaatgggccaaaccagttaatgtccctgcagcagttcgtttatgacgtgcaggatcagctgaacccactggcttctgaggaagacctaagacgaatcgcacaacagctgcactctaccggagaaataaacattatgcaaagtgagaccgtccaggacgtactgctcctagatcctagatggctgtgcaccaatgtcctgggcaaactgttgtcagtggaaaccccacgcgccctccaccactatcgtggccgctatacagtggaggacatccagagattagtgcccgacagcgacgtagaggaactgctccagatcttggacgctatggatatttgtgcacgggaccttagctccggtaccatggtggacgtgcctgcactgatcaaaaccgacaatctgcatcggagctgggcagacgaggaagatgaagtgatggtgtatggtggcgtccgtatcgtgccagtagaacatctgacgccttttccttgcggaattttccataaagtgcaagtcaatctctgccggtggattcaccagcaaagtaccgaaggagacgccgacatccggctgtgggttaatggatgtaagttggcaaaccggggagcagagctgcttgtgctcctcgtgaaccacggccagggcattgaagtacaagtgagagggcttgagactgaaaagattaagtgctgcctccttttggattccgtgtgtagcacaatcgagaatgtgatggctacgactctccccgggctgctgactgtgaaacattatctctcaccgcagcaactgagggagcatcatgaaccagtgatgatctatcagcccagagatttctttagagcacagactctgaaagaaacgagtctcaccaacacaatgggaggatataaagaatcgttctcttccattatgtgcttcggctgccacgacgtgtattcccaggcatcactgggtatggacattcatgctagtgatttgaatctcctgacaaggcgcaagctgtctaggctcttggatccacctgatcccctgggcaaagattggtgtttgctggcgatgaaccttgggctccccgaccttgtggcaaaatataacacctccaacggggctcccaaggattttctgccgagccctttgcacgctctgctacgggagtggaccacctatccggagagtacagtgggcacactgatgtctaagctccgcgagctgggccgcagggacgctgccgacttcttgctgaaggcttcgagcgttttcaagattaacctcgatggaaacgggcaggaggcatacgcaagtagttgtaactccggcacctcttataacagcatctcttcagtcgtgagccgctag

SEQ ID NO: 14853 - DNA, 4095 bp, Artificial Sequence
  Description of Artificial Sequence: Synthetic coding sequence
atgactgtgtttcggcaggagaatgtagacgattactatgataccggagaagagctgggatccggacagtttgccgtggtgaagaaatgccgggagaagtccactggactgcagtacgctgctaagtttattaagaaaagaaggaccaagagctctcggaggggcgtttcaagagaagatattgagcgcgaagtgtccattctgaaagaaatacagcatcccaatgtgatcactttgcacgaggtgtatgaaaacaaaaccgatgtcatcctgatacttgaactggtggccggcggagagctgtttgacttccttgctgagaaggagtcactgacagaagaggaggcaacggagttcctgaagcagatcctgaatggcgtatactacttacacagtctgcagatcgcccacttcgacctcaaacctgagaacatcatgctgctggaccgcaatgtgcccaaaccccggattaagataattgactttggcctcgcacacaagatagactttgggaacgagttcaagaacattttcgggacgccagagttcgtcgcaccagaaatcgtgaattacgaacccctgggactggaagctgacatgtggtccattggcgtgattacctacatacttctgtctggagccagcccctttctaggcgacacaaagcaggagaccctggccaatgtctccgctgtaaattacgagtttgaggatgaatatttcagtaatacctcggcactggccaaagatttcattcgccgccttcttgttaaggaccccaagaaacggatgacgatccaggactccctacaacatccatggatcaagcctaaagatacacaacaagctctgtcaaggaaagcaagcgctgtgaatatggaaaaattcaagaagtttgcggcccgtaagaagtggaagcaaagcgtgaggctgatctctctttgccagcgactgtctcgctcttttctgtcgcggtctaacatgtctgttgcgagaagcgatgacaccttagatgaggaagattcatttgtgatgaaagccataatccacgctataaacgacgataacgtgcctggacttcagcatttgttaggcagtttatccaattacgacgtgaaccagccaaataaacatggcacacctccactgctcatcgccgccggatgcggaaatattcagattctacagctattaattaaacgaggatctcggattgacgtgcaggacaaaggaggtagcaatgccgtctactgggcggcccgacacgggcacgttgacacacttaagttcctttcagaaaataaatgtcctttagatgttaaggacaagtcgggcgaaatggctctgcacgtggccgccaggtatggccatgcggacgttgcacagctgttgtgcagcttcggctctaatccgaacatccaggataaggaggaggaaactcctctgcactgtgcagcatggcatggctactacagcgtcgccaaagccctgtgtgaggccgggtgtaacgtcaacataaagaacagagagggagagacccctctccttaccgccagcgccagaggctaccatgatatcgtggaatgtctcgcagaacatggcgcggatctgaacgcttgcgacaaggatggtcacatcgccctgcacttagctgtcaggcgctgccagatggaagtaataaaaactctgctgtcccaggggtgtttcgtcgactaccaagatcgccatgggaatacacccctgcacgtggcatgtaaggatgggaacatgcctatcgtggtggccttatgtgaagcaaattgcaatctggatatttccaacaagtatggtcgtacaccattacatctggctgctaacaacggcattttagatgtcgtaaggtatttgtgtttgatgggtgcttctgttgaggcactgaccacagacggcaagactgcagaggatttggctaggtccgagcagcacgagcacgtggcaggcctgcttgccagactgcggaaggatacacatagggggctttttatccagcaattacggcctacccaaaacttgcagccccgtatcaagctgaagttgtttgggcattcagggtctggcaagactaccctcgtggagtcactgaagtgtgggctgctccggtctttctttaggcggaggagaccccgtttgtcctccacaaactctagtagatttccacccagcccactcgccagcaagccaacagtatctgtctcgatcaacaacctctaccctggctgcgaaaatgtgtcggtgcgaagtagaagcatgatgttcgaacctggtctgacgaagggaatgctcgaggtgttcgtcgcccctacccaccacccccactgttctgctgacgaccagtcaaccaaagcgatagatatccagaatgcctacctgaacgctttcggaggcaaactcaagaacccactccaggtcgtcctagtggcaacacatgcagacattatgaatgtaccgaggccggcgggtggtgagttcggttacgacaaggacacgtctttgctgaaggagattcgtaataggtttggtaacgatctgcatatatccaataaactgttcgtcttggacgccggtgccagcgggtcaaaggatatgaaggttctgaggaaccacctgcaagaaattcggtctcaaatcgtctcggtctgccctccgatgacccacttatgcgaaaagattatttcaaccctcccaagctggaggaaactgaacggacctaaccaactgatgtcactgcaacagtttgtctacgatgtgcaagatcagctcaacccgctcgcgagcgaggaagacctgcgacgcattgctcagcaactgcactcaactggcgaaatcaatatcatgcagagcgagacagtccaagacgttctgctgctagacccccggtggctctgtactaatgtgcttgggaaactgctgtccgttgagacacctcgggctttgcaccactataggggccgatatacagttgaggacatccagcggctcgtgccagattccgatgttgaggagctgttgcagatcctggatgctatggacatctgtgctcgggacctgagctcaggaaccatggtggatgtgcccgccttaatcaaaaccgacaatttgcatagaagctgggctgacgaggaagatgaggtcatggtatatggaggcgtgcggatcgtgccagtcgagcacctgacccctttcccctgtgggatttttcacaaagtgcaggtgaatctgtgtaggtggattcatcaacaatccacagagggcgacgccgatatcaggctttgggtgaacggatgcaagctcgcgaaccggggcgctgaactactcgtactgctggtgaatcacgggcaaggtatagaagtccaggtgagggggttagagacagagaagataaaatgctgtctcctcctcgactccgtatgtagcacaattgagaatgtcatggctaccaccctccctggcttgctgacggtgaaacactacctctccccacaacagctacgcgaacaccacgagcctgtgatgatttaccagcctagagacttctttagggctcagacattgaaagaaacatcacttactaacaccatgggaggctataaggaaagcttcagctctatcatgtgcttcggctgccacgacgtgtattcccaggcctccttgggcatggacattcatgcctctgacctgaacctgctgacaaggcgcaaattgtccaggctgctagacccacccgaccccctcggaaaggattggtgcctactagccatgaacttgggcctgcccgacctggtggctaagtataatacaagtaatggagcacctaaggatttccttcctagtccactccacgcactgctgcgtgagtggactacctacccggaaagcacagtcggaactcttatgagcaaactgcgcgagctcggacgaagggatgcggccgattttctgcttaaagccagctctgtctttaaaattaatctggatgggaacggccaagaggcctatgcctcttcatgcaattctggcacatcatacaattccatcagctcggttgtcagcagatag

SEQ ID NO: 14854 - DNA, 2223 bp, Artificial Sequence
  Description of Artificial Sequence: Synthetic coding sequence
atggcaacggcaaactccatcattgttcttgacgacgacgatgaggatgaagccgctgcccaacctggtccttcccaccctctcccaaacgctgcatcccctggcgctgaagctccaagttccagcgagcctcatggagcccggggaagcagcagttccgggggaaagaagtgctacaaactggaaaacgagaagctcttcgaggagttccttgaactttgtaagatgcagacagccgatcacccagaggttgtgccatttctatacaacaggcagcaaagagcacactccttatttttggcctccgcagagttttgtaacatcctttctagggtgctaagtcgggcaagaagcagaccagccaaattgtatgtgtacattaatgagctttgcacggtgctcaaggctcactccgccaagaagaagctgaatttagctcccgcggccacaacctctaacgaaccatcaggaaataaccccccaacccacttgtcactggatcccaccaacgcggagaataccgcaagccagtctccccgcaccaggggctcccgccgccagatacagagactggagcagctgctagcactttacgtggctgagatcaggagactccaagagaaagagctggacctctcagagctggacgacccagacagcgcctacctgcaggaagcccgtttgaaacgcaaactcatccgcttattcgggaggctctgcgaactaaaggattgctcatccctcaccggccgcgtgattgaacaaagaataccttaccgcggcacccgatacccggaagtgaacaggcgcatcgagaggctgatcaacaagccaggtcccgatacatttcccgattacggggatgtgttgcgtgctgtggagaaggcggcggcacgccacagcctcggattgcccaggcagcagttgcaactcatggcccaggatgcttttcgagacgtaggaataagattgcaggagaggcgacatctggatctgatctataacttcggatgccatcttaccgacgattatcgccccggcgtggatccagctctgtcggatcctgtgctggctagacgtttgagagagaaccgcagcttagccatgtctcgcctcgacgaggtcatttctaaatacgccatgctccaggacaagtcagaggagggagagagaaagaaaaggcgagctagactgcaggggacatccagccacagcgctgatacccctgaggcctcactggacagcggtgagggtccatccggcatggcctcacagggctgcccatcagcctcacgcgctgaaacagatgacgaagatgatgaggagagtgacgaggaagaggaagaagaggaagaagaagaagaggaagaagcaactgattctgaagaagaggaggacctggagcaaatgcaggagggccaggaggacgacgaagaagaagatgaggaggaggaggccgccgccgggaaggacggggacaaaagtcctatgtcatctctgcagatctctaacgagaaaaacctggagccagggaagcagataagccgctctagtggagaacagcagaataagggacgtattgtttcacctagccttctatcggaggaaccccttgccccatcctccatcgacgccgagagtaacggcgagcagcctgaggagctgacactggaggaggaaagtccagtctcccagctgttcgagctagagatcgaggccctgccgctcgacacgccttcatcggtggagacagatattagttcttcccgaaagcaaagcgaagaacccttcacgaccgtgctggagaatggcgctgggatggtgtcttcaacatccttcaatggcggagtctctccacataattggggggactctggacccccttgtaagaagtcaagaaaggagaagaaacaaactggctccggcccactcgggaactcctacgtggagcgtcagcgtagtgttcacgagaagaacggaaaaaaaatctgtaccttgcccagtcctccaagtccactggcctcgctcgcccctgtggctgacagctctactcgggtcgatagcccgtcgcatgggcttgtcacctcaagcctgtgcataccgtcgcctgcacgcctgtcacaaactccgcacagtcagccacctcggcccggtacatgcaaaaccagcgtcgctacccagtgcgacccagaagaaattatcgtactctctgactccgactag

SEQ ID NO: 14855 - DNA, 2223 bp, Artificial Sequence
  Description of Artificial Sequence: Synthetic coding sequence
atggcaactgcaaattccatcatcgtattggacgacgatgatgaagatgaggccgctgctcagccagggccttcacaccccctccccaacgctgcgtcccctggcgcagaggccccctcatcctccgagcctcatggcgcaaggggctcctcgagttctggtggaaagaaatgctacaaacttgagaacgagaagcttttcgaagagttcttagaactgtgcaaaatgcagacagctgaccacccggaggttgtgcccttcttgtacaatcggcagcaacgggcccactctctgttcctggcgtcagccgagttctgtaatatcctgtccagggtactgtctcgggctaggtcaaggcctgccaagctatacgtgtacatcaatgaactttgtactgtcctcaaagcccacagcgcgaagaagaaactgaacctggccccagcagcaacaaccagcaacgagccatccggtaataaccctccaacccacctgagcttagatcctacaaatgccgaaaacaccgcctcacagtcaccccggacccgcggctcccggagacagatccagcgtctggagcaactgctggcactttacgtcgctgaaatcaggcggctgcaggagaaagaactcgatctctctgagctggatgaccccgacagcgcatatctgcaagaggctaggctcaaaagaaagctcatacggctcttcggcaggctctgtgaattgaaggattgtagtagcctgactggaagagttatcgaacagcgcattccataccggggtacaagatatccggaggttaataggaggatcgagcgcttgattaacaaaccagggccagacacttttccagactacggtgatgtactgcgagcagtggaaaaggctgctgctaggcactccctgggattaccacggcagcagctgcagctgatggcacaagatgcttttagggatgtgggcatcaggttacaggagagaaggcaccttgatctaatttataactttggttgtcatctgacagacgactatcgcccaggagtggatcccgcactcagtgacccagtgctcgccagacggctgcgggagaataggtctctcgccatgagcagactggacgaagttatcagtaagtatgccatgttgcaggacaaatcggaggagggagagcggaaaaagagacgggcccgcctacagggcaccagctctcatagtgcagacactccagaggctagtctggatagcggagagggtccctctgggatggcctcccaagggtgtcccagcgccagcagggccgagacagacgatgaggacgacgaggaatcggatgaggaagaagaggaggaagaggaggaggaagaagaggaggccacagactcagaggaggaggaggacctggagcagatgcaagagggtcaagaagacgacgaagaggaggacgaagaggaagaggctgcagcgggtaaagatggggataagtctcccatgagcagtctgcagatctccaatgaaaagaacctggagcctggcaagcagatctcccggtcaagtggggagcagcagaacaagggtcgaatagtctctccatctcttctgagcgaagaacctctggccccgtcttcaatcgatgccgaaagcaacggagaacagcccgaggaactgaccctcgaagaagaatcacccgtgagccaactgttcgaactagagatcgaggccctgcccttagataccccgtcgagcgtggaaacagacattagctcgtctcgaaaacagagcgaggaaccattcaccaccgtactggagaatggagctgggatggtcagttccacgtcttttaacgggggcgtatcacctcacaactggggggacagcggtccgccgtgtaagaaatcacgaaaagagaagaaacagaccggctccggtccactgggaaatagctacgttgaacgccagagatctgtccatgagaaaaacggaaaaaaaatatgcacactcccatcgcctccatccccacttgccagtctggccccggtggcagatagctcaaccagggtggactcaccaagccacggcctcgtcacctctagtctatgcatccccagccctgctcggctatcccaaacaccacactcccaaccaccacgccccggaacttgcaaaacatccgttgcaacacagtgcgacccagaggagatcatagtcctgtctgactctgattag

SEQ ID NO: 14856 - DNA, 1998 bp, Artificial Sequence
  Description of Artificial Sequence: Synthetic coding sequence
atgcagaccgctgaccaccctgaagtggttcctttcctttacaatagacagcagcgcgctcattcactgttcctggctagcgcagaattttgtaatatactctctcgcgtgttatcacgtgctagatccagacctgcgaagttgtatgtgtacattaacgagctgtgtaccgtgttaaaggctcattccgctaagaagaaactgaatctcgcacccgcagccaccacttccaacgagccttcaggcaataatcccccgacacacctgtcgcttgatccaaccaacgccgagaatacagcctcgcagtcgcctagaactagaggctctcgcagacagatccagagactggaacagctgctggccctgtatgttgccgagataaggcgcttacaggaaaaggagcttgatctcagcgagcttgacgacccagatagtgcttatctgcaggaggcacggctgaagaggaaactgattcgactatttggaagactctgcgagctgaaagattgttcctcccttacagggcgagttatagaacagaggattccctaccggggaacccgatatcccgaagtcaaccgcaggattgaaaggcttataaacaagccggggccggacactttccccgattacggcgacgtgctgcgcgctgtggagaaggcggctgctagacacagcttgggcctccctcgacaacagctgcagttgatggcccaggatgcattcagggatgtgggaatcaggctgcaagaacgtcgccacctggatttgatatataacttcgggtgccatctgaccgatgattaccgaccgggagtggaccccgccctatcggaccccgtgctagcacgaagacttagagagaaccgctcccttgcaatgtcacgcctcgacgaggtgatctctaagtacgcaatgcttcaggacaagtctgaagaaggtgaacgtaagaaaagacgagccagattacaggggacctcatctcacagcgccgacacacccgaggcctctctggacagcggtgagggcccctccggcatggccagccaggggtgccccagcgcttcgcgggctgaaactgacgacgaggatgacgaggagtccgacgaggaagaagaggaagaagaggaagaagaagaagaggaggccacggactcagaagaggaggaggacttggaacaaatgcaggagggacaggaggatgacgaggaagaggatgaagaagaggaggccgctgctggtaaggacggagataagagccctatgtcatcactacagatctctaatgagaaaaacttggagcccgggaagcagatttcaaggagcagcggcgaacagcagaacaaaggtcgaatagtttcaccttcactcttatccgaggaacctctcgcaccttccagcatcgatgccgaatcaaatggcgaacagccggaagaactcacccttgaagaggaaagtcctgtctcccagctgttcgaactcgaaatcgaggcacttcctctcgatactccttcttccgtggaaacggacatcagttcatctcggaagcagtctgaggagccattcacaaccgtgttggagaacggagcagggatggtctcatcaactagtttcaatggtggcgtaagcccccataattggggagacagcggcccaccttgcaagaagagtcgtaaagagaagaagcagacagggtctggcccactcgggaacagctacgttgagaggcagcgctccgtgcatgaaaaaaacggcaagaaaatctgcacactgccctcccctccaagcccactcgcctccctggcccctgtggctgattcctcaacacgggtggactcccccagccatgggctagtcacatcatctctgtgcatccccagtcccgcacgcctaagtcagacacctcatagtcagcctccaagacctggtacctgtaagacttctgtggcaacacagtgcgaccccgaggaaattatcgtactgtcagactctgactag

SEQ ID NO: 14857 - DNA, 537 bp, Artificial Sequence
  Description of Artificial Sequence: Synthetic coding sequence
atggcgaccgcgaactctatcatcgtgctagacgatgatgatgaggatgaggccgcggcgcagccgggaccatctcatccactgcccaatgctgcgagcccaggtgctgaggccccaagctcatctgaaccccacggagcaagagggagcagtagctcaggaggcaagaaatgctacaagctagaaaatgaaaaactcttcgaagagttcctggaactgtgcaaaatgcagactgccgaccacccagaggtggtaccattcttgtacaatcgccagcagcgcgcacattccctgtttttggcgtccgcagaattctgcaatatcctttctagagtgctttcccgcgcccggagccgccctgcgaaactgtacgtctacattaatgagctctgcaccgtcctgaaagcacattccgcgaaaaagaaactgaatctggcgccagccgctacaaccagcaatgaaccctctggaaataatccacctactcacctgagcctggatcctactaatgccgaaaacaccgcctctcagtcgtag

SEQ ID NO: 14858 - DNA, 147 bp, Artificial Sequence
  Description of Artificial Sequence: Synthetic coding sequence
atggctaccgctaattctatcatcgtgctggatgacgacgatgaggacgaagcagcagcccagccgggcccaagccaccccctgcctaacgctgcctcacccggtgcagaagccccttcaagctctgagccgcatggcgcacgttag

SEQ ID NO: 14859 - DNA, 393 bp, Artificial Sequence
  Description of Artificial Sequence: Synthetic coding sequence
atggcgacagctaactcaattattgtcctcgacgacgatgatgaggacgaggccgcagcccaacctggcccctctcatcccctgcctaacgccgcatcacccggggccgaggcgccctctagctccgagccgcatggggctagaggcagcagtagtagcggggggaagaagtgttataagctggagaacgaaaagctctttgaggaatttctagaactttgcaagatgcagactgctgaccacccagaggtggtgccattcctgtacaataggcagcaacgtgcccacagtctctttttggcatccgcagagttctgtaatattctctcacgcgttctcagtcgcgcccggtcacgaccagccaagctgtatgtgtacatcaacgagctgtag

SEQ ID NO: 14860 - DNA, 2316 bp, Artificial Sequence
  Description of Artificial Sequence: Synthetic coding sequence
ggtgtgcccgtgatcaaatggaagaaagacggcattcatctcgcactgggtatggacgaacgcaaacagcagctcagcaacggctcactgcttattcaaaatatcctgcactccaggcaccataagcctgatgagggtctgtaccagtgtgaggcgtcactgggtgattcagggtctattatctcgaggacagcgaaggttgccgtggcaggaccgctgcgtttcctgtcgcagaccgagtccgtgaccgcattcatgggtgatactgtgctgctgaaatgcgaagtgatcggggaacccatgcctacaatacattggcagaagaaccagcaggatctgaccccaatcccaggcgactcgagagtcgttgtgctgccaagcggcgcactgcaaatatcacggctgcaacccggagatattggtatttaccggtgcagcgcaagaaacccagcatcctcaagaaccggcaacgaggccgaagttcggatcttgagcgaccctggacttcaccgccagctgtattttctccagcggccctcgaacgtggtggccattgagggaaaagacgccgtacttgaatgctgcgtctcagggtaccccccacctagctttacgtggctccggggagaggaggtaattcagctaaggagcaagaaatattcgctgttggggggcagcaaccttctcatcagcaatgtaacggacgacgatagcgggatgtacacatgcgtcgtcacatacaagaatgagaatatttccgcgtcagccgagcttactgtcctggtgccaccttggttcctcaaccacccgtccaacttgtacgcttacgagagtatggacatagaatttgagtgcactgtgagcggaaagcctgtgcctaccgtaaactggatgaagaatggggacgttgttatcccctcggactacttccagatcgtcggagggtctaacttaaggatattaggtgtggtaaaatccgacgagggcttctaccagtgtgtggccgagaatgaggctgggaacgcccagacgtcagcccagctcatcgtgcctaagcctgcgattccctcctctagcgtgctgccgagcgccccaagagacgtcgtgcctgtcctggttagctcacgttttgtgagactgtcctggagaccacctgccgaggccaaggggaacatccagaccttcacagttttctttagcagggagggcgataatcgcgagagggcgctcaacacaacccagcccggatcgttgcagttaacagtggggaatctaaagcctgaagcaatgtatacgtttcgagtggttgcctacaacgagtggggacccggagagtctagtcagccaatcaaagtggctacccagcccgaactgcaggtaccagggccagtcgagaatttacaggctgtaagcacatctccgacttcgattctcattacctgggagccacctgcctatgctaacggccccgtacagggttataggttgttttgcacggaagtgtctactggaaaggaacaaaatattgaagtggatggtctcagttacaaattggaagggctgaaaaagttcacagaatactctctgaggttcctggcttacaacagatacgggccaggagtgtcaaccgacgacatcactgtcgttactttgagcgacgtgccatcggcgcctcctcagaatgtttctctcgaagtggtcaattctaggtccattaaagtgtcatggctccctccacccagtggaactcagaacggtttcatcaccggctacaagatccgacacaggaagacaacaaggcggggggagatggagaccttagagccaaataatctgtggtacttgtttaccggtctggagaaaggatctcagtacagttttcaggtttccgctatgacggtgaatggtacagggccgcccagcaactggtatacagcggaaacccccgaaaatgacctggatgaatcccaggtgcctgaccagccctcgtccctacatgtgcgcccacagacaaattgtatcattatgagttggactcctccactgaaccccaatatcgttgtccgggggtatataatcggctatggagtgggcagtccttacgcggagacagtacgggtggactcaaagcagcggtactattctatcgaaagactcgagtccagctcccactacgtgatcagcctaaaggcctttaataacgctggagagggagtccccctgtacgagagcgctacaacccgctctatcacagtccggcgtcacaatatcagcaaactgcattctaacaggccccagacgaagcataacgtttag

SEQ ID NO: 14861 - DNA, 2694 bp, Artificial Sequence
  Description of Artificial Sequence: Synthetic coding sequence
atgggcgataccgtactgctgaaatgtgaagttatcggcgagccaatgcctaccatccactggcagaagaaccagcaggacctcacgcccattccgggcgattcgcgggtcgtggtgcttcccagtggcgcactgcagatatcaaggctccagcccggcgatatcggaatctaccggtgctcagccaggaaccctgctagctctcgcacaggcaatgaagcggaagtgaggattttgtcggaccccggtctgcacagacagctgtacttcctacagaggccatcaaatgtcgtggccatcgagggcaaagatgccgtattggagtgttgtgtatcaggctatcctcccccatcttttacttggttgcgaggagaggaagtcattcagttgcgcagcaagaaatacagtctgttgggtggaagcaatttacttatttccaacgtgaccgacgacgattccgggatgtatacctgtgttgtcacttacaagaacgaaaatatctctgcaagtgccgagctaaccgtgctggtgcctccatggtttttgaatcacccatcaaatctctacgcatacgagtcaatggacattgagttcgagtgcacagtgagcggtaagcctgtacccacggtgaattggatgaagaacggcgatgtggtaatcccttctgactactttcagatagtaggcggctccaacctccgaatacttggcgtggtgaagtccgatgagggcttctatcagtgtgttgctgagaacgaggcgggaaatgctcagaccagcgcacagctcatcgttcctaaacctgcaatcccctcctcctcagttctgccttctgcccctcgggacgtcgtaccagttttagtcagctcgcgatttgtgcggctgtcttggagaccaccggcggaggctaagggcaatatacagacgtttaccgtgttcttttcccgggagggggataatcgagagagagcactcaacactacccaaccagggtcactgcagctcactgtgggcaatctgaaacctgaggcaatgtatactttccgggttgtggcttataacgagtgggggcccggagaaagtagtcagccgataaaggttgcaacacaacccgagcttcaagtgccaggtcctgtggagaatctgcaggcggtgagtacttctcctaccagcatcttaatcacctgggaaccacccgcatatgccaatgggccagtccaggggtacagactcttctgtaccgaagtatcaactggaaaggaacaaaatatcgaagtggacggactgagctataagctggaagggctaaagaagttcaccgagtattctcttagattcctcgcatacaacagatatgggcccggggttagtacagacgatatcactgtcgtgacattgagtgacgtgccatctgcccccccacaaaacgtctcattggaggtcgtgaactccaggtccatcaaagtgtcatggcttccccccccgtctgggacccagaacgggtttataaccggatacaaaattcgccaccgaaagacaacacgtcggggcgagatggagacacttgaacccaacaatctgtggtacctgttcactggacttgagaaaggtagtcagtactcatttcaggtctcagcgatgactgttaacggcaccgggccaccctctaattggtacacagctgagacgccagagaatgatctggacgaatcccaggtaccagatcaaccgtcttcactgcatgtgagaccacagacaaattgcattatcatgtcgtggacaccacccctcaatccaaatatagtagttcgtggctatatcattggatacggggtgggatctccttatgccgagacagtgcgggttgactctaagcagcgatactactcaattgaaaggctcgaaagttcttctcattacgtgatctcgctgaaggcgttcaataacgcaggggaaggagtgcccctgtatgagtccgcgaccacacggagcatcacggacctctcaaccccaatgcttccccctgtgggggtgcaggctgtagccctgacccatgacgcggttcgggtgtcatgggctgataacagtgtgcccaaaaaccagaagacaagtgaagtgagattgtatactgtgaggtggagaacatcgttctctgcaagcgccaagtataaaagcgaagacacgacttctctttcttatacagcaaccggcctcaagcctaataccatgtacgaattttccgtcatggtaacaaagaaccgccgctccagcacctggtcaatgaccgctcacgccacgacctacgaggccgctcctacatctgcccctaaggatctgactgtgatcactcgggaaggaaagcccagagccgtgattgtgtcttggcagccacccctggaggccaacggaaagattaccgcctatatcctgttctacactctggacaaaaacatcccgattgacgactggattatggagaccatttctggagaccggctgacacatcagattatggatctgaatcttgatacgatgtactactttcgcattcaggctcgaaattccaagggggtcggtcccctcagtgaccccatcctttttcggacactgaaagtggaacatcctgataagatggctaacgatcaagatactggtgttaccatcaacctcgtgaacgaagtgttgctggggtag

SEQ ID NO: 14862 - DNA, 4344 bp, Artificial Sequence
  Description of Artificial Sequence: Synthetic coding sequence
atggaaaactcgttgcggtgcgtttgggtgccaaaactggcatttgtgctgtttggcgcctctttgttttcagcgcatctccaggtgacaggcttccagatcaaagcgttcaccgcgttgcgattcctctctgaaccttcggatgcagttaccatgagaggcggtaacgtgctgctagattgcagtgccgagtcagacagaggagtgccagtcatcaagtggaagaaagacgggattcacctcgctctgggaatggatgagcggaagcagcaactgtcaaatggcagtctactcattcagaacattctgcactcccggcatcataagcccgacgaggggctctaccagtgtgaggcctctctgggggatagtggctccatcatttcccggacagcgaaagtggccgtggctggccctctgcgatttcttagtcaaaccgaatccgttacagcttttatgggcgatacagttctgttgaagtgtgaagtaatcggggagcccatgcctacaatccactggcagaagaatcagcaggatctgacgccaattccaggggacagccgagttgttgtcctgccctccggagccctgcagatcagcaggctccagccaggagatatcggcatttaccgttgttcagcccggaacccagcctcctctcggacggggaatgaagctgaagtgcgcatcctctcagaccctggactgcaccggcaactatactttttacagagaccaagcaacgttgtcgcgatcgaaggaaaagatgctgttttggaatgttgcgtttctggctatcccccaccatctttcacttggctgcggggggaagaggtaatccaactgcggtctaaaaagtatagcctgctgggtgggagcaatctgctgatctccaacgtgacagacgatgattcaggtatgtacacgtgcgtcgtcacttataaaaatgaaaacatcagcgcctccgctgagttgaccgtacttgtccccccttggttcctgaatcacccatccaacctctatgcctatgagagtatggatattgagtttgaatgtacggtatccggcaagccagtgcctacagtgaactggatgaaaaacggagatgttgtcatccctagcgattactttcaaatcgttggcggcagcaatttgaggattctgggtgtggtgaagtcagatgagggattctaccagtgcgtggccgaaaacgaggcaggcaatgctcaaacaagcgcccagcttattgtgcctaagcctgctattccctccagctcagtgttgccaagtgctcccagagacgtggtgcccgtgctcgttagtagtagatttgtcaggttgtcatggagaccacccgccgaggcaaagggtaatattcagaccttcaccgtcttcttttcaagagagggagataatcgcgagagggcactaaatactacacaaccaggctctttacaactaacggttggaaaccttaagccagaggctatgtatacttttcgcgtggtcgcttacaacgaatggggacccggtgaatcctctcagcccatcaaagtagctacccagcctgagttacaggttcctgggccggtcgaaaatctgcaagcagtatccacaagcccaacaagtatcctgattacctgggaaccacccgcatacgctaatggtcccgtccaggggtatcgactgttctgcaccgaagtgtcaaccggaaaggaacagaatatcgaagtggacggactgagttacaagctggagggtctgaaaaagttcaccgagtattcactccgcttcctggcctacaatagatatgggccaggtgttagcaccgacgatatcacagtagttaccctgagtgacgttccatccgcccctccacaaaatgtgtctctggaggttgtgaacagtaggtccattaaggtgtcctggttgcccccaccctccggtacacaaaacggattcattaccggctataaaatacggcaccgtaagaccacccggaggggagaaatggaaaccctggaaccaaacaacttgtggtatcttttcactgggcttgaaaaaggatcccaatactcctttcaggtgagtgccatgactgtgaatggcacaggacccccctcgaactggtacactgcagagacccccgaaaacgacttagatgagtcccaggtgccagaccagccctcaagtctgcatgttagacctcaaaccaactgcataatcatgagctggacacctccgcttaatcctaacattgtggtacgagggtatataatcggatatggggtaggatccccttatgccgagacggtcagagtggattctaaacagcggtactacagtattgaaaggcttgaaagttcaagtcattacgtgatcagtctgaaggctttcaataatgccggggaaggggtcccactttacgagtccgctactactaggtccattacggatcccaccgatcccgtggattattatcccctgctggacgactttccaacgtctgtccctgaccttagcacacccatgttgcccccagtgggagtgcaggcagtggctctgacgcacgacgccgtcagggtgtcttgggcagacaactccgtgccgaaaaaccagaaaacttccgaagtacgtctctataccgttaggtggaggacctctttttcggccagcgcgaaatacaagtctgaagatacgaccagcctaagttatactgccaccggcctcaagcccaataccatgtatgagttttcagttatggtgaccaagaataggcgatcaagcacatggtctatgacagcccatgctacaacatatgaggcagcccctactagcgccccaaaggacctcaccgttatcactcgggagggcaaacctcgtgccgtaatcgttagttggcagccacctctcgaagcaaacgggaagatcacagcttacatcctcttttataccctcgataagaacatccccatcgatgactggattatggagacaatttccggagacagactgacgcaccagattatggacctcaacctggacactatgtactattttcgcatccaagcccgcaacagcaagggcgtcggccccttaagcgaccctatactgtttcgtacgctgaaagtcgagcaccctgacaagatggccaacgatcaggggcgacatggagacggcggatattggccagtggataccaacctgattgatagatccactcttaatgagcctcctattggccaaatgcacccgccacatgggtcagtgacccctcagaagaatagcaatctgctggtcattatcgtggtgacggttggcgtcataaccgtgctggtagtggtaatcgtggcggtgatctgcacgagaaggtccagtgcgcagcagcgtaaaaagcgggctacgcattcggctggcaagcggaagggctcccagaaagatctgcgccctccggacctgtggatacaccatgaagagatggaaatgaaaaatattgagaaacccagtggaactgatcctgcaggaagagatagccctatacagtcctgtcaggatctgactccagtgtcacacagtcagagcgagactcagctgggtagcaaatctaccagtcactccggccaggatactgaagaggctgggtcttccatgtccacactggagcgctcactggccgctcgtcgggcacctcgggccaagctaatgatccctatggacgcccagagcaataatcctgcagttgtttcagccatccctgtccctaccctcgaatctgcccaataccctggaatcttgccaagcccgacttgcggataccctcatccgcagtttacgctccggccggtgcccttccccactctatctgtggatcgaggatttggcgccggacgtagtcagagtgttagcgaaggcccgaccacccaacagcctcccatgctcccaccatctcagccagaacactcgtcttccgaggaggcgccaagccggaccatacctacggcatgtgttcggcctacccaccccttgcgttcttttgctaatcctcttctccctccgcctatgagcgctatcgaacccaaagtgccctacacacccctgctttcccagccaggaccgacgctccccaaaactcacgtcaagacagccagcctcggcctggccggcaaagctaggagcccattgcttcccgtttccgtccccacagctcctgaagtttcagaggagagccacaaaccaaccgaggactcagccaacgtgtatgaacaggatgatctgagtgagcaaatggcttctctggagggcctaatgaagcagttaaatgccatcacaggctcagccttttag

SEQ ID NO: 14863 - DNA, 213 bp, Artificial Sequence
  Description of Artificial Sequence: Synthetic coding sequence
atgaccatgaatgtgttggaggccggcaaatggaagagtatcgtgccagcacctggcgagggcttgttagctgtacttcacatgatggtgttcactgacgcattacacagggagcggtccgtaaaatggcaagcaggggtgtgctataatggaggaaaagacttcgccgtttccctcgcccgcccaaaggctgcagagggaatagctgattag

SEQ ID NO: 14864 - DNA, 1392 bp, Artificial Sequence
  Description of Artificial Sequence: Synthetic coding sequence
atgtcggtggccatcaggaaaaggagctgggaagaacatgttacccactggatgggtcagccatttaactccgacgaccggaataccgcctgtcatcacggccttgtggctgacagcctgcaggcatctatggaaaaagacgctactctcaacgttgacaggaaggagaaatgcgtgtcccttcccgactgttgccacggaagtgaacttcgcgattttcctggtaggcccatgggacacctatccaaggatgtggatgagaatgactctcatgaaggggaagaccagttcctgtcattagaggcatccacggaaacactggtccatgttagcgacgaggataacaatgcggacctctgcttgaccgacgacaaacaggtcctgaatacacaaggccagaagacttccggacaacatatgatacagggcgccggatctctggagaaagcgctcccgatcattcaatctaatcaggtctcttccaatagctggggcattgcaggagagacagagttggcccttgtgaaggagagtggagaacgaaaagtcactgattccatctctaaaagcctcgagctttgcaatgagatcagcttgtctgagatcaaagacgccccaaaagttaatgccgtagacaccctgaatgtgaaagatatcgctcctgaaaagcagctactcaacagcgccgtaatagctcagcaaaggaggaaacccgatccaccgaaagacgaaaacgaacggtctacatgcaatgtcgtgcagaatgaatttctggacacaccctgcacaaatcgtggtctcccactgctgaaaacagacttcggaagttgcctgctccagccaccctcctgtcctaatgggatgtcagccgaaaatgggctggagaagtccggattcagccagcaccagaataagtcaccccccaaagtgaaggccgaggacggtatgcaatgcttacaacttaaagagacgctggccacccaagagccaacggacaatcaggtacggctgagaaaacgaaaagagatccgggaagacagggaccgcgccaggttggattcaatggtgcttctgatcatgaaacttgaccagctggatcaagacatagaaaatgcactgagtactagctcttctcctagtggcaccccgacaaacctccggcgacatgtgccagacctggagtctggttcggagtccggcgctgacactattagcgtgaatcagacccgcgtgaatctttcatctgacacagaatcaacggatttgccctcctctacccctgtcgctaacagcggaacaaaaccaaaaacaacagccattcagggcattagcgagaaggagaaggctggcaagttaaccttctggttttgctttttagcaaatttgttctag

SEQ ID NO: 14865 - DNA, 5268 bp, Artificial Sequence
  Description of Artificial Sequence: Synthetic coding sequence
atggaaactcgcagtagtaaaacaaggcgctccctggcttcaagaaccaatgagtgccaaggcactatgtgggccccgacttctcctccggctggctcctctagcccaagtcaacctacatggaagtcttctctgtactcgagcttagcttattcggaggccttccattattctttcgcggcccggcccagaaggctgacccaactggcgttggcacaacggcccgaacctcaactcttacggctgaggcctagctcgctgcgaacacaggatatatctcacctgctgactggggtctttagaaatctgtattctgccgaagtgatcggggacgaggtgtctgctagtttgattaaagctaggggcagcgaaaacgagaggcacgaggagtttgtagatcagctgcagcaaataagagagctgtacaaacaacgcctggatgagttcgagatgctggaacggcacatcacccaggcccaggcccgtgctatcgcagagaacgagcgggtcatgtcccaggctggtgtgcaggatctcgagtctctggtgcggctgcccccagtgaagtcagtttctagatggtgtatcgattcagagctgcttagaaaacatcacctgatatctcctgaggattattacaccgacacggtacctttccattcagctcccaagggaattagcctccctgggtgtagcaagctcacgttctcctgcgagaagaggtcagtacaaaagaaggagcttaacaaaaagcttgaggattcctgtaggaaaaagctagctgagtttgaggatgagctcgatcatacagtggattccttgacctggaaccttactccaaaagcaaaggaacgcactcgggaacctctgaaaaaggctagccagccaaggaataagaactggatgaaccatttgagagtaccacagcgcgaactggaccgactactgctcgcccgcatggagtcacgcaaccactttctgaagaacccacgcttttttccaccaaacacccgatatggaggcaaatcacttgtcttcccgccaaagaagccagcacccatcggagagttccagtcaactgagcccgagcagtcgtgtgccgatactccagtctttttggccaagccaccgattggtttctttactgactacgaaatcggcccggtgtacgaaatggtgattgctctacaaaacaccactacaacatctaggtacctgcgggtgctgccaccatcgaccccctatttcgccctgggtttaggaatgttccccggaaaaggtggtatggtggccccgggaatgacatgccaatatatcgttcaattttttccagattgcctgggcgattttgacgactttatactggttgaaacgcagtctgcccacacactcctgatacctctgcaggccagaaggcctccgccagtcctgactctatcacccgttttggattgcgggtactgccttattggcggggtcaagatgactcgcttcatctgtaaaaatgtcgggttttcagtgggaagattctgcataatgcccaagacttcctggcctccactgtcattcaaggcgattgctactgttggatttgtagagcagcccccatttggcatcttgccgtctgtgtttgaactcgctcccgggcacgctattctggtagaggtgcttttttcacctaaaagcttgggaaaggctgagcagacttttattatcatgtgcgacaattgccagattaaagaactcgtcacaattggcatcgggcagctgattgctttggacctcatctacatttcaggagaaaaatcccaacctgacccaggcgaactgacagatctgaccgcccagcatttcatccgcttcgagcctgagaacttacgcagtacagcacgcaaacagctgataattaggaacgccacacacgtagaactcgctttttactggcagattatgaaaccaaacttacaacctttgatgccaggagaaacatttagtatggactctataaagtgctaccccgacaaagagacagcctttagcataatgccccggaagggcgtcctgagccctcacaccgaccatgagttcatcctgagcttttctcctcacgagctgagagattttcacagcgtcctccagatggtactggaggaagttcccgagccagtgagttccgaggccgagtctttgggacacagcagctatagcgtcgacgacgttatcgtgctcgagatagaggtgaaggggtccgtagagcctttccaggtcctgttggagccgtacgctctgatcatccccggcgaaaactatatcggcatcaatgtgaagaaggcctttaaaatgtggaacaacagcaaatcccccatccgttatttatggggcaaaatctccgactgccacattatagaggtagagcccggaacaggtgtgattgaaccttcagaggtcggtgacttcgaacttaacttcacgggcggggtaccaggcccaacctctcaggatttactctgcgagattgaggattcgccatcccccgtcgtgctccatattgaagccgtcttcaagggacccgccttaataattaacgtgtctgccttgcagtttggattactccgcctgggccaaaaagcaacgaactccatccagattaggaacgtatctcagttacctgctacgtggcggatgaaagaaagcccagtgtctctgcaggaaagaccagaagacgtcagccccttcgatattgaaccgagctctggccagttacactctcttggagaatgtcgggtggatatcacacttgaagccctacactgtcagcacctcgaaactgtcctggagctggaagtggagaacggggcttggtcctacctccccgtatacgcagaagtacagaagccccacgtttatctccagtcaagccaggttgaggtacggaatctttatctgggagtgcccacaaaaaccactatcacgctgattaatggcacattattgcctacccagtttcattgggggaaactcctggggcaccaggccgagttttgcatggtcaccgtgtctccaaagcacggactcctaggaccatcagaggaatgtcagctgaaactggagttgaccgctcatactcaggaggaattgactcatttggctctgccctgccatgtttccggcatgaagaagcccttggtgcttggtatcagtgggaaaccccaaggattacaggtggcaatcacaatctccaaagagtcctcagactgttcaaccgaacaatggcccgggcatccaaaggagctgaggctagattttggctctgctgttcctctgaggactcgcgttactcgtcagttgattctcaccaataggtctcccatcaggacaaggttctccctgaaatttgaatattttggtagtcctcagaattctctctctaaaaaaacttccctgcccaatatgcctcccgcactgcttaaaaccgtgcggatgcaggagcatttagcgaaacgcgaacagctagacttcatggaaagcatgctttcgcacggcaagggggcggccttttttcctcacttctcccaaggcatgttaggaccttatcaacagttgtgtattgatattaccgggtgcgcgaatatgtggggagaatattgggacaaccttatatgcaccgtaggcgatctgctcccggaagtcatccctgttcatatggccgcagttggatgcccaatttcctctctgcgaaccactagctatactatcgatcaggcccagaaggagccggcaatgcggttcggtacacaggtgtccgggggagacactgtgactagaacgttacggctgaacaacagttcaccttgcgatatcaggctggattgggaaacctacgtccctgaagacaaggaagacagactggtcgaacttctggtgttttatggccccccatttcccctacgggaccaggctggtaacgagctggtttgccccgacacacctgagggagggtgcctgctttggtctcctgggcctagtagtagttccgaattcagtcatgagacggattcctcggtggagggctcaagctccgcctcgaatcgggtggcgcagaagttaatctccgttattctgcaggctcatgagggagttccatccggccacctctactgtatttctccaaagcaggtagtggttccagctggtggaagttcaacaatctacataagctttaccccaatggtgttgtctccggagattcttcataaagtggagtgtaccgggtacgcactcggctttatgagcctggacagcaaggttgagagggagatccccggcaaacggcacaggctgcaggatttcgcagttggcccactgaagctggacctccacagctatgttcggcccgctcagctgtctgtcgagctggactatggcggctccatggaatttcaatgtcaagcctcagatttaattccagagcagccctgctctggcgtgctcagtgagctcgtgactactcaccacctcaagttaacgaatactactgagataccccactactttcggctgatggtcagtcgccctttctcggtcagccaggacggagctagccaggaccacagagcccccggaccagggcagaaacaagaatgtgaagaggaaactgcctcagccgataagcagctagtgctgcaggcccaggaaaacatgctcgttaacgtgagcttctcactcagtctcgagctgttaagctatcagaaactgcccgcagaccagacactccctggagtggacattcagcagtcagcctctggagaacgggagatggtttttactcagaacttgcttctagagtatactaatcagacgactcaggtggtgccccttcgggcggtagtcgcagtccccgagctgcagttgagcacctcgtgggtcgattttggaacatgtttcgtgtcacagcagagggtacgagaggtgtacctgatgaatctgtccggttgccgttcctactggacgatgctcatggggcagcaggagcctgctaaagctgccgtggccttccgcgttagtccaaattccggcttgctggaagcacgctccgcaaatgccccaccgacgtctatcgcattgcaggtttttttcactgcccgcagtagtgaattgtacgagtctactatggtagtagagggcgttctgggggaaaaatcctgtacactaaggctaaggggccagggttcatatgatgagaggtacatgctgcctcaccagccctag

SEQ ID NO: 14866 - DNA, 5337 bp, Artificial Sequence
  Description of Artificial Sequence: Synthetic coding sequence
atggagacccggtcctccaagacccggcgctcgctggcctctaggacaaacgaatgtcagggaacaatgtgggcgcctacctcaccacctgctggctccagtagcccctctcagcccacatggaagagttctctgtactcctctctagcttattccgaagcctttcactactcttttgctgctagacctcggcgcctaactcagctcgctctcgcgcagagacccgagccccaactgttgcgccttagaccaagttctctacggacacaagatatttcccacctgctgacaggagtgtttagaaacttgtacagtgccgaggtgattggtgacgaagtcagcgcctctctgataaaagccaggggcagcgagaacgagcgtcacgaggagtttgtagaccagctgcagcagattagagagctgtacaaacaaaggctagatgagttcgagatgcttgaacgccatatcacccaggcacaggcacgggccatcgcagagaacgagagagttatgagccaggctggggtgcaggatctggagtccctggtgcgcctgccaccagtgaagtctgtatcacggtggtgtattgattccgagctgttgcggaagcatcacctgataagccctgaagattattacaccgataccgtgccgttccattcagctccaaaaggcatctccctgcctggatgctccaaactcacattcagctgtgagaaaaggtccgtgcagaagaaagagctgaacaaaaagctagaagattcttgtaggaagaagctcgccgagtttgaagatgaactagatcacaccgtcgatagcctgacatggaacctcacaccaaaagctaaggaaaggacccgcgagccccttaagaaagcctcccagccacggaacaaaaactggatgaaccatctcagggtacctcaacgtgaactggatcgcctgctcttggcccgaatggagagtagaaaccacttcttgaaaaacccacggtttttcccccctaatacccgctatgggggtaaaagcctagtttttcccccgaagaaacccgcacctatcggcgagttccagtctacagaacctgagcagagctgtgccgatacaccagtttttctcgcaaaacccccgatcgggttttttaccgattatgagatagggcccgtgtacgagatggtcatcgctcttcagaatactacgacaacctccagatacctgcgggtgcttcctccttctaccccttatttcgcgttaggattaggtatgttcccaggaaaaggtggaatggtggccccgggcatgacctgtcaatatattgtacagttttttcccgattgtctgggcgacttcgacgactttattctggtagagactcagtcggctcacacactcctcataccgctgcaggctagaagaccgccaccagtacttactttgtcacctgtactcgattgcggctactgccttattggaggcgttaagatgacaagattcatttgcaagaatgtgggtttcagcgttggccgattctgcatcatgcccaaaacttcatggccgccactatccttcaaagccatcgcaactgtcggcttcgttgagcagccaccctttggcatccttcccagcgtcttcgaacttgcgcccgggcatgcaatcctcgtggaagtattgttcagcccaaagtctttaggtaaggccgagcagacgttcataataatgtgtgataattgtcagatcaaggagcttgttacgatcggcatcgggcagctgatcgccctcgatcttatttacattagtggggaaaaatcacagcccgaccctggagagctgaccgacctcactgctcaacatttcatccgcttcgaacctgaaaaccttaggtcaacggctcgaaaacaattgatcattcgcaatgctacacatgtggagctcgccttttactggcagatcatgaagccaaacttacaaccactgatgccaggagagactttctcaatggacagtataaagtgctatccagacaaagaaaccgcctttagtatcatgccacgcaagggagtgctgagtccccatactgatcacgaattcattctcagctttagcccccatgaactgagagacttccattcagtccttcagatggtgctggaagaagtgcccgagcccgtctcttctgaggcagaatccctcgggcacagttcgtacagcgtagacgatgtaattgtgctggaaatcgaagtcaaaggttcagtcgaaccattccaggtgttattagagccgtacgctctcattattcctggcgagaattatatcggaattaacgtgaagaaagcctttaagatgtggaataatagtaagtcacctatccgatacctgtgggggaaaatcagtgactgccacatcatagaggtggagcccgggacaggtgtgatagaaccttcggaggtgggtgattttgaactgaactttacgggcggtgtgccaggacctacctctcaagatctgctttgcgagattgaggatagcccgtcacccgtggtcctgcacatcgaagccgtgttcaaaggtcctgcccttatcatcaatgtctcagccctgcagtttggtcttttgcgcctgggccaaaaagcaacaaacagtatacagattaggaacgttagtcagcttcctgccacctggcgcatgaaagagtctccggtgtccctgcaggagcgacctgaggatgttagtcccttcgatatcgaaccctctagcggccaactccactccttgggggaatgccgcgtggatataacgctggaagcccttcactgtcaacacctggagacagttttggaactggaggttgaaaatggggcttggtcttatctacctgtctatgccgaagttcaaaagccacacgtgtaccttcaaagttctcaagttgaggtgaggaatctgtacttgggcgtgcctactaagaccacaatcaccctgattaatggcactttgctccctacccagttccactggggaaagctgctgggacatcaggcagaattctgtatggtgactgtgtctccgaaacacggactactcgggcccagtgaagagtgccagctgaagctcgagttgactgcccacactcaggaagagcttacccacctggcattaccctgtcatgtgtcaggcatgaagaaaccactcgtattgggaatcagcggaaaacctcagggccttcaggtggcaataacgataagtaaagagtcatccgattgcagcacagagcaatggccagggcatcccaaggagctgcggcttgacttcgggagcgcagtgcctctgaggacgcgagtgactagacagctgattctgacaaataggagtcctattcggaccaggtttagtctaaagttcgagtattttgggagtccacaaaattccctcagtaaaaagacctcactgccaaatatgcctcctgcgctgctcaagacagtgcgcatgcaagaacacctggcgaaacgagagcaactcgattttatggagtctatgctgtcacacgggaaaggcgctgccttcttcccccacttctcccagggcatgctcgggccgtaccagcagctctgcatcgacatcaccgggtgcgcgaacatgtggggtgagtactgggataatctgatctgtacagttggcgacctgctgcctgaagtcatccccgtacacatggccgccgtaggctgtcccatcagctccctgcgaacaaccagctacaccatcgatcaggcccagaaagaaccagctatgagattcggaacccaggtcagcggcggtgataccgtcaccagaaccctccgactgaacaacagttcaccttgcgacattcgcctggattgggagacatacgtaccagaggacaaggaagataggctggtggagttactggtgttctatggccccccttttcccctgcgggaccaagccgggaatgagctggtttgcccagacacgcctgagggcgggtgtctgctgtggtcaccagggcccagctcttcaagcgagttctctcatgagaccgatagctcagtcgagggctcaagcagcgcgtcaaatcgcgtggcccagaaattaatcagcgttattctgcaagctcacgaaggcgtaccttccgggcatctgtactgtatttcccccaagcaggtggtagtgccagcaggaggtagcagtactatctacatcagcttcacacctatggtgctgtccccagagatcctgcacaaggtggagtgcaccggctatgccctcggatttatgtctctcgattcaaaggtggaaagagaaatccccggcaagcgccacagactgcaggactttgccgtcgggcccctcaagcttgatcttcacagctacgtgcgcccagcccagctcagtgtagagctggactatggtggaagcatggagttccagtgccaagccagtgatctgataccggagcagccatgttcaggcgtgttaagcgagcttgtcactacgcaccatctcaagctaaccaatacaactgagattcctcactatttcaggctgatggtgtcccggccattcagtgtgtctcaggacggggctagccaggaccacagggcaccaggacccggacagaagcaggagtgcgaagaagagaccgcctccgctgataagcagttggtacttcaggcgcaagagaatatgctcgttaatgtgtccttttcactttcactggagttactcagttatcagaagcttccagccgatcaaacactgcctggcgtagatattcagcagtcggcttccggcgaacgggagatggtcttcacgcaaaaccttttgttagaatatacgaatcagaccacgcaggttgtgccattgcgagccgttgtcgccgtccccgaactgcagctgtccacatcctgggtggacttcggcacgtgctttgtgtctcagcagagagtgagagaagtctacctgatgaacctgagcggatgtaggtcatattggaccatgctcatgggggtcgtgagctgtacaagcccaagatggtggtggaaagtgtgttccgtccgtagcccggcaccctgtggcagtggcgcgaaggcccccatgatgagagacacctgctgtctgacaagtccagaggccccccctcagcctagtgcgcctgggccctcttggcggaaaaacatagcccagggcctcggcgccgccctgcagcacaaggataccgacttggggacttggggcccactggggtcatcctggaatggaagaacccccttccataacggtctgtctctgggccctcacgacatgtctagtgagctgacttag

SEQ ID NO: 14867 - DNA, 5277 bp, Artificial Sequence
  Description of Artificial Sequence: Synthetic coding sequence
atggagacacggtctagcaaaacccggagaagtctggcctccagaaccaacgagtgccagggtacaatgtgggcgccaacttcccccccagcaggttcatcctcccccagccaacctacttggaaaagttctctctacagcagtcttgcttactcagaggcttttcattatagtttcgccgcaagacctcgccggttaacccaattagccctggcacagcggcccgaaccacagcttctccggttgcggccctcatccctgagaacacaggacatttcccatctgctcacgggcgtgttcaggaacctgtacagcgcagaggttattggtgatgaagtgagtgcgtctctcattaaggccagggggagcgaaaacgagcgccacgaggaatttgtggaccagttgcagcagatacgcgagctttataaacagaggctggatgaatttgagatgctcgaaagacacattacccaggcacaggctagggccatcgctgagaacgagagggttatgtcacaggccggagtccaggatctggagtccttggtgcggctcccccctgtcaagtcagtgagtaggtggtgtatcgatagcgaacttctgaggaaacaccaccttatttcaccagaggactattatactgacacagttcctttccactctgcgccaaagggcatcagcctgcccggctgttcaaaattgacctttagttgcgaaaagagatctgtgcagaaaaaggagcttaataagaaattagaagatagttgccgcaagaagctggccgaattcgaagacgaactggaccataccgtggactccctgacctggaatcttaccccgaaagctaaagagcgcacacgagagccactcaagaaggcatcgcagccccgaaataagaactggatgaaccacttacgggtcccgcagcgcgagcttgacaggctgttgcttgcgcgcatggagagcaggaaccattttctcaagaatcccaggttctttcctccaaatacaagatatggagggaaatcactcgtgttccctcctaagaagccagcccctattggggagttccagtcaacggaacccgaacagtcttgcgctgatacacccgtcttccttgcaaaaccacctatcggctttttcaccgattatgagattggccccgtatacgagatggtaattgctttgcagaacacaactaccacctcacgctatttgagagtactcccaccaagtacgccctacttcgctctcgggttaggtatgtttccagggaagggagggatggtggctcctggcatgacttgtcagtatattgtccaattctttcctgactgccttggagattttgatgacttcatcctggtcgagactcagtctgctcataccttactgatccctctccaggcccggagaccgccaccagttttgaccttgagtccagtgctcgattgtggctactgtctcatcggtggcgtcaagatgacgcggttcatatgtaagaacgtgggattcagtgtcgggcgattttgcataatgcccaagacctcatggccacccctgagcttcaaagctatcgcaacggtgggatttgtcgagcagccgccctttggaatcctaccctccgtgttcgagttagcccctggacatgctatcctggtggaggtccttttttccccaaaatcactggggaaagcggagcagacattcataataatgtgcgataattgccagataaaagagctagtcacaattggcatcggtcagctcattgcgctcgacctgatttatatcagcggagaaaagtcccagccggacccaggtgagcttacagatctgaccgcccagcatttcatccggttcgagcctgagaacctgagatcaacagcccggaagcagctaatcattagaaatgctacccacgtggagctagccttttactggcagatcatgaagcccaatcttcagcctctaatgcctggcgagactttttcaatggattccataaagtgttatcccgataaggagacagcttttagtatcatgcctcggaaaggcgttctgtctccccatacagatcatgaatttattctgtctttcagcccccatgaactgcgcgatttccacagtgttttgcaaatggttctggaggaagttcccgagccggtcagttcggaggcagaatcgcttggtcactcatcgtactctgtggatgatgtcatcgtgctcgaaattgaagtgaagggaagtgtggagccattccaagtcctgttagaaccatacgcactgatcataccaggcgaaaattatattggcatcaatgtgaaaaaggcctttaagatgtggaacaactccaagagccccattaggtacttgtggggcaaaatttccgactgccacatcatcgaggtggagccgggtacaggcgtgatagagccctccgaggtgggagatttcgagctgaactttaccggtggagtgcctggtcctacaagccaagatctgttatgcgaaatagaggatagcccatcaccagtggtactgcatatcgaagccgtttttaagggccctgctttgatcataaatgtaagtgccctgcaattcgggctccttcgcctgggacaaaaggccactaactctatccagatccgcaatgtttctcaacttcccgccacttggaggatgaaggagtctccagtgtccctgcaggaacggcctgaggacgtgagtccatttgatatcgaacccagctctggacagctgcactcgctcggggaatgtagagtggacatcaccctggaggcactgcactgtcaacatctggaaaccgtccttgaactggaggttgagaacggtgcgtggtcatatctgcctgtgtacgccgaagtgcagaagccacatgtctatttgcagtcctcacaggtcgaagtgcgaaacctctacctcggggtccctacgaagaccaccataactctcatcaatggaaccttgctccctacgcagtttcattggggaaagctgctggggcaccaggctgagttctgtatggtgaccgtgagccccaaacacgggctccttggcccctcagaggagtgccagctgaaactcgaactcactgcgcatacgcaggaagagctgacacacttggccctcccttgtcatgtgtcaggcatgaaaaaacctctcgtgcttggcatcagcggcaaaccgcaggggttgcaggttgctataacaattagcaaggaatcaagcgattgctcagtgttctcaactgaacagtggcccgggcatccaaaggagttgcgactggacttcgggagcgctgtgcctctcagaacaagggtcacccgccagctcatactcactaatagatcccctatccgaacaagattctcactgaagtttgaatattttggctcaccgcagaatagcctatcaaagaagacctcattgcccaacatgcctcccgccctactaaagaccgttcggatgcaggagcatctggccaagagggagcagctcgattttatggaatcaatgttatcccacggcaaaggagctgcatttttcccacatttctctcagggcatgctcgggccataccagcagctatgtatcgatattaccggatgtgccaatatgtggggtgagtattgggataacctgatttgtactgtgggcgatttgttacctgaagtgatccctgtgcacatggcggccgtaggttgtcctatatctagcctgcgcacgacctcttataccatcgatcaggcgcagaaagaaccagcaatgcgttttggcacccaggtctcaggcggcgatacagttactaggacacttagactgaataacagttctccctgtgacattagactagattgggagacatatgtgccggaggacaaggaggaccgcctggtggaactcttagtgttttatggacccccttttcccctcagggaccaagctggtaatgagctggtgtgtcctgacactcctgaaggcggctgcctgttgtggagtccaggcccatcttcctcaagcgaatttagccatgagacagatagctctgtggagggctctagttccgcatctaatagagtagctcagaaacttattagcgttatcctgcaagcacacgagggcgtgccgtccgggcacctgtactgtatttcacccaaacaagtcgtggtgcctgccggcggatcatctactatttatatttccttcacaccgatggttctgagcccggaaattctacacaaagtcgagtgcacaggctatgccctagggtttatgagtctggattccaaggtcgaacgcgagattcccggaaaacgtcacaggctgcaggactttgcagtggggcccctgaaattagacttgcattcttacgtgagaccagcacagttgtcggtggaattagactatgggggatctatggagttccagtgtcaggcttctgatttgatcccggagcagccatgctctggcgtgctctctgagctggtgacaacccaccacctgaagcttacaaacactacagagatcccacactactttagactgatggttagcaggccctttagtgtatctcaggatggcgcttctcaggaccatagggcccctgggcctgggcagaaacaggaatgcgaggaggaaacagcatccgccgataagcagctggttttgcaagctcaggagaatatgcttgtgaatgtaagcttttctttgtcccttgagctcctgtcatatcagaagctgcctgctgatcagacgctgcctggcgtagacatacagcaaagtgcatctggagaaagggagatggtgttcacccagaatctcctcctcgagtacaccaaccagacaactcaggtggtgcctctgcgggcagtggttgctgtgcccgaactgcaattaagcaccagctgggtcgacttcggaacgtgcttcgtgtcgcagcagagagtgagagaagtatatctcatgaacctgagtggctgcaggagttactggactatgctgatgggtcagcaagagcccgctaaagctgctgtagcgtttcgggtgtcaccaaactccggactgcttgaagctcgcagcgccaacgccccccccaccagcattgcccttcaagtgttttttaccgcaagaagttcagagctctatgagtccacgatggtggtggagggagtgctcggtgaaaagtcttgtacgcttcgcttaagaggccagggcagttatgacgaaaggtacatgctgcctcaccagccttag

SEQ ID NO: 14868 - DNA, 237 bp, Artificial Sequence
  Description of Artificial Sequence: Synthetic coding sequence
atgaggccttgcatttggatccatgtgcacctgaagcctccttgtcgcctcgtcgagttgctgcccttctcttccgccctgcagggcctttcgcaccttagccttggcaccactttgcctgtaatcttaccggagaggaacgaggaacaaaacttacaggagctgtctcataacgccgacaagtaccagatgggggattgctgtaaggaggagatagacgactccattttttactag

SEQ ID NO: 14869 - DNA, 2940 bp, Artificial Sequence
  Description of Artificial Sequence: Synthetic coding sequence
atgcgcgggtatcatggggataggggctctcacccccgccctgcccggttcgctgaccagcagcacatggacgtaggccctgccgctcgagccccgtacttgctcggctctcgcgaggccttctctactgagcccagattctgcgcacctagagcaggactgggccacatcagcccagaaggaccattgagtctcagcgaaggaccatctgtgggacccgagggcggaccggctggcgctggggtgggcggtggcagttccacttttccacgcatgtacccaggacagggccctttcgatacctgtgaggattgcgtgggacatcctcagggaaaaggtgctccgcgtctgcctcccacattgctggaccagtttgagaagcagcttcctgtgcagcaggacggcttccacacgctcccctatcagcgggggcctgctggcgccggcccagggcccgcccctggaacaggaacggcccccgaaccgcgtagcgagagcccatctcgtatcagacatcttgtacactcggttcagaagctcttcgccaaaagccactcactggaggccccaggcaagagagactacaatgggcctaaagccgaggggcgaggcggttcgggcggcgattcctatcctggccctgggtctggagggcctcacacctcccaccatcaccatcatcaccaccaccaccatcaccatcagtctcgacacgggaagaggagtaagtccaaggaccgaaaaggcgatggcaggcatcaagccaagtccaccgggtggtggagtagcgacgacaatttggattctgactcggggttcctcgctgggggcaggccccccggcgagcccggcggtcccttttgcttagaggggcccgacggatcctacagagatctgtccttcaagggtaggtccggcgggtctgaaggacggtgcctcgcttgcaccggcatgagcatgtctctagatgggcagtctgtgaagaggtccgcctggcacactatgatggtttcccagggtcgcgatggttaccccggcgccgggccagggaaaggcctgctggggcccgagactaaagcgaaagcccgaacataccattatctccaggttccccaggacgattgggggggctaccccaccggcgggaaggatggcgaaatcccctgcaggcgcatgcggtcagggtcgtatattaaggctatgggagacgaagagagtggagacagcgacggatctccaaagacttccccaaaagcagtggccagaagatttacaacacgacggtccagtagtgtcgaccaggccaggatcaattgttgcgtaccccctagaattcacccccgcagctccattccaggctattcacggagcctgacaacaggccagcttagcgatgaattaaatcagcagctagaagccgtgtgtggaagcgtctttggcgaattggaaagccaggccgtggatgctttggacttacccgggtgcttccgaatgaggtctcatagttacctgcgcgcaatacaggccgggtgttcccaggacgatgattgcctgcctctcctcgcaacccccgcagccgtgagcgggcgcccagggagctctttcaatttcagaaaggcgccaccacctatacctccaggcagccaggcgcccccccgcatctcaattacagctcagtccagcacagacagcgcccatgaatcgtttaccgcggcggagggacccgccagacgctgttcgtcagcagacggccttgatggaccggccatgggggcccgcacgctcgagttggcaccggtccccccaagggcatctccaaaaccccccacccttatcattaaaaccataccgggccgcgaggagcttcggagcctggcaaggcagcgcaagtggagaccgagtattggcgtacaagttgagacaatttccgatagcgacaccgagaataggtcccgccgcgaatttcatagcatcggtgtccaggtagaagaggataagcgtagggcccgctttaagcgctccaactccgttacggctggggtacaagccgacttagaattagagggattagcagggctggcaaccgtcgctacagaggacaaggcccttcagtttgggcggtctttccagaggcatgccagcgagcctcagccaggcccgcgagctccaacttacagtgtgttccggacggtgcacacgcaaggccaatgggcgtacagagagggctaccccctcccttatgaacccccagccacggacggatcaccaggacccgcccctgcgcccacgcctgggccaggcgctggacgccgagattcttggatcgagcgcgggtctcgcagcctgccggattccgggcgcgctagcccatgtccaagggatggagaatggtttataaaaatgctccgcgcggaggtggagaagctggagcattggtgtcagcagatggaaagagaggccgaggactatgaactccccgaggagatcctggagaaaattcggtcggccgttggtagcacacagctgctcctcagtcagaaggtacagcagttcttccgcttgtgccaacagtctatggacccgactgcatttcccgtaccaactttccaggatctagctggtttctgggacctgctccaattatctatcgaagatgtcacactcaagtttctggagttacagcagttgaaggccaactcatggaaactgctggaaccaaaggaagagaaaaaagttccaccaccaatacctaaaaaaccactgcgaggccgcggcgtgccagtaaaagagcgcagccttgactcagtggaccgccaacggcaggaggcacgcaagcggcttctggctgctaaaagagccgcttcatttcggcactcttccgctacagaatccgctgacagcatcgagatctacatccccgaagcccagacacgactgtag

SEQ ID NO: 14870 - DNA, 5358 bp, Artificial Sequence
  Description of Artificial Sequence: Synthetic coding sequence
atgggcatctctacggtcatccttgagatgtgtcttctttggggacaggtactaagtacaggcggctggattccccgaacaaccgactacgcctcactgattccaagcgaagtacctcttgatcctactgttgccgagggatcccccttccctagtgagtccaccttagaatccaccgttgccgaggggtcccctatctcacttgagtctaccctagaaagcaccgtggccgaaggatccctaataccaagtgagagtactttggaatccacagtggccgaaggatccgactctggactcgctctccgcctggtcaatggagacgggcggtgccagggcagagtggaaatactgtaccggggatcctggggcactgtctgtgacgatagctgggacaccaacgacgccaatgtggtgtgcaggcagcttggttgcggttgggcaatgagcgcacccggaaacgcctggttcgggcaggggagtggtcctattgctctggatgatgtgcgatgttcaggacatgaatcttacctgtggtcgtgcccacacaatggttggctctcccataattgcgggcacggagaagatgccggcgtgatttgcagcgcagctcagccacagtctaccctgcgcccagagagctggcctgtgcggatctctccccctgtgcccactgaagggagcgaatcgtcactggctctcaggctggtaaacgggggggacaggtgcagagggcgcgtcgaagtcttgtacaggggctcttggggtaccgtttgcgacgattattgggacaccaacgacgcaaacgtcgtttgccgacaacttggctgcggctgggctatgagtgcccccgggaacgcacagtttgggcagggaagcgggcctattgtcctggacgatgtcagatgtagtggacacgagtcctacctatggagttgcccgcataacggatggctgacccacaattgtggacactccgaagacgctggtgtcatttgctcagccccccaaagcagaccaacaccatcacctgacacttggcccactagccatgctagtaccgccggccccgaatcgtcactcgccctccgtctggtaaacggaggggacagatgtcaggggcgcgtagaagtcctgtatagaggaagttgggggaccgtatgcgacgactcatgggacacaagtgatgccaacgtggtatgccgccagctggggtgtggttgggcaacatccgctcctggaaacgcaagatttgggcaaggctcaggaccaatcgtactggacgatgtgaggtgttccggctatgagtcctacctgtggtcgtgcccccataacggttggctatcccacaactgccagcacagtgaagacgccggggtgatttgtagtgctgctcactcatggtccacaccgtcccctgacaccctgcccaccatcacacttcccgcatctaccgtcggcagtgagagtagcctagctttacggctcgttaacggcggagacaggtgtcagggacgcgtcgaggtactgtaccagggttcctgggggactgtttgtgacgattcctgggacactaatgacgcgaatgtcgtatgtcggcagctgggatgtggctgggccatgtccgctcccggcaatgcacgcttcggccagggctcgggtcccattgttctggacgatgtgcgatgtagtggccatgagagctacctttggagttgtccacacaacggctggttgagtcacaattgcggacactccgaggatgcaggagttatttgttctgcaagccagtcacgccctacccccagtccagatacttggcctaccagtcacgcttcaacagcgggttccgaatcgagtctggctctgagactggtgaacggcggggacaggtgccagggcagagtcgaggtgctgtaccggggatcttgggggaccgtgtgtgatgattactgggatactaatgatgctaatgtggtttgcagacagctgggatgtggctgggctatgtccgcacccggaaatgctcgtttcgggcagggctccggccctattgtcctcgacgacgtccggtgctcaggtcatgagtcttatctgtggtcctgtccacataatgggtggctctcgcataactgtggtcatcacgaagatgccggtgttatctgttctgccagccagtcccagcccacgccgagtcctgacacatggccaactagtcatgcgtctacagctggctcggagtcatctctggctctgcgtctcgtgaatggaggagacagatgtcaggggagagtagaagtactctacaggggcagctgggggacagtatgcgatgactattgggatacgaacgatgcgaacgtcgtttgcaggcagctcggctgtggttgggctacttccgccccgggaaacgcacggttcgggcagggctcaggacccatcgtcctagacgacgtcaggtgtagcggtcacgaatcctatctttggagctgtccgcataatggttggttgtcgcacaattgcgggcatcatgaagacgctggtgtgatttgttctgcttcacagagccagccgacaccaagccccgacacatggcccacttcacgggcctctaccgccgggtcagaatccactctggctctcaggttagtgaatggcggcgacaggtgtcgagggcgggttgaggtgctctaccaagggtcctggggaacagtttgtgatgactactgggatacaaacgatgccaatgtcgtgtgtcggcagctgggctgtggatgggccatgtccgcaccgggtaacgcccagttcgggcagggttctggtccgattgtcttagacgacgttcgttgcagcggccacgaaagttatttgtggtcctgcccacacaacggttggttatctcacaattgcggacaccacgaggatgctggggtgatttgcagtgctgctcaatcccagagcactccaagacccgacacttggctgacaacaaaccttcctgcactgaccgtcggctccgagtcgagtctggccttgcgccttgtgaatgggggagaccgctgccggggccgggtagaagttctgtaccgaggatcgtggggcacagtgtgtgacgattcgtgggacacgaacgacgcaaacgtggtgtgccgtcagctgggatgtggatgggctatgagcgcccccggaaatgctagattcggacagggttctgggccgattgtgcttgatgatgttagatgcagtggaaacgagagctatctctggtcttgtcctcataaaggctggcttacacacaattgcggccatcacgaggatgctggcgtgatttgcagcgctacccagataaattctaccaccactgattggtggcacccgactaccaccactaccgcccgccctagttccaactgcgggggtttcctgttctatgcctccggtactttctcttcgcctagctacccagcatactatcctaataatgccaaatgcgtgtgggagattgaggtgaattcaggatataggatcaatttaggttttagtaacctgaaattggaagctcaccacaattgtagcttcgactacgtggagatcttcgacggctctctgaattctagccttctgctcgggaagatttgtaatgacacgcgtcagatattcaccagtagttacaatagaatgacaatccacttcagatctgacatctctttccagaataccggatttctcgcttggtataactctttccccagtgatgccaccctacgactagtgaacttaaacagcagctatgggctgtgcgccggtcgcgtcgagatctatcacggaggcacatggggcactgtatgcgacgactcctggactattcaagaagccgaggtggtttgcagacagttgggctgcggaagggcagtctccgctttgggtaacgcttacttcggatctggaagtggacccattaccttggatgatgtggagtgtagcggaacagaaagcacgctgtggcagtgccggaatagaggttggttcagccacaattgtaaccacagggaggacgcaggcgtaatctgctcaggcaaccatctctctacaccagcccctttcctcaacatcactcggcctaatacagattactcctgcggtgggttcctgtcccagccgagcggcgacttctcttcgccattttaccccggaaactatcccaataatgcaaagtgcgtttgggatattgaggttcagaacaattatcgcgtcaccgttatcttccgggacgtgcagctggagggtgggtgcaactatgactacatcgaagtgttcgatggtccttaccggtcaagtcctctaatagcccgggtgtgtgacggggcgaggggatcttttacttctagttccaatttcatgtctattaggttcattagcgatcacagtattaccagaagaggattcagggcagaatactattcgagccctagtaacgattccactaacttgctctgcttacccaatcacatgcaggccagcgtatcacggtcctatctgcagagcctcgggttctccgcctctgacctggtgatatctacttggaacggctactacgaatgtaggcctcagattactcccaatctagtaattttcacaattccctatagtggctgtgggacattcaagcaggctgacaatgataccatcgattactcaaacttcttgaccgcagcggtatcaggggggataatcaagagaaggactgaccttaggattcatgtctcctgcagaatgctacaaaacacttgggtcgataccatgtatatcgctaacgataccattcacgtggcaaataacaccatacaggtagaggaggtccagtacggaaatttcgatgtgaacatcagcttctacaccagctccagctttctgtaccccgtgacatccaggccctactacgtggatcttaaccaggacctgtacgtgcaagctgaaatacttcattccgacgcagttcttacgctcttcgtcgatacatgcgttgcttctccctactctaatgatttcacaagcctcacctacgatttgatccgttccgggtgcgtcagagatgacacctacggaccatatagttccccttcactcagaatagcccggttccgttttcgtgctttccattttctcaacaggtttccgtccgtctaccttagatgcaaaatggtggtctgtcgtgcatatgatcccagctccagatgttacagggggtgcgtgctgcgcagtaagcgggacgtgggcagttatcaggagaaagtggacgttgtgctggggccaatccagctacagacccctccccgacgagaggaggagccacgctag

SEQ ID NO: 14871 - DNA, 5358 bp, Artificial Sequence
  Description of Artificial Sequence: Synthetic coding sequence
atgggcatatctacagttatcttagagatgtgtctgttgtgggggcaggttctgagtaccggagggtggatcccgcggacgaccgactatgccagcctcatcccatccgaagtacctctggatcccaccgtggcagaaggaagtccttttccgtctgaatccactcttgagagcaccgtggccgagggaagccccatctcccttgagagcacacttgagagcactgtggcggagggtagccttattccaagtgagagcaccttggagtcaacggttgccgaaggctccgacagcggattggccctaagactggtcaacggagatggtcgctgtcaggggagagtggaaatactataccgggggtcctggggtaccgtatgcgatgattcttgggacactaatgacgccaacgtggtttgcaggcagctgggctgtggttgggcaatgagcgctcccggcaacgcttggttcggacagggtagtgggcctatcgctctggacgatgtgcgctgttcaggccatgaatcatatctctggtcttgtccccacaatggttggctctctcacaactgtggacacggagaggacgccggggtgatttgtagcgcagcccaaccccaaagtactcttcggcccgagtcctggcccgtgaggatctctcctccagttccgactgagggaagcgagagcagcctggccctgaggttggtgaacgggggagatcgatgtcgcggtcgtgtggaagtcctataccgtggaagttggggaaccgtgtgcgacgactattgggacacaaatgatgcgaatgtcgtttgcaggcagctcgggtgtggatgggccatgagcgcgcccggaaacgctcagtttggacaggggagtggtcctatcgtgttagacgatgtaagatgcagcgggcacgagtcctatctgtggtcatgccctcataatggatggctgacccacaattgcggccacagcgaggatgcgggggtaatctgttccgccccccagtcaaggcccacaccttcgcctgacacatggccgactagccacgcgtcaaccgcaggacctgagtccagcctggcattaagattggtaaatgggggagatagatgccaggggcgagtcgaagtgctgtaccgtgggtcttggggaaccgtatgcgatgatagctgggatacaagcgatgccaacgtcgtgtgtagacagttaggctgcggatgggccacttctgcccccggaaatgcaaggtttgggcagggtagcgggccaatcgtgttggatgatgtaagatgttcaggttacgaaagctatctttggtcttgcccacacaatggctggttgtctcataattgccaacacagtgaagatgcaggagtgatttgttccgcagcacatagttggagcactcccagccctgataccctgccaactataacactccccgctagcacagtcggttctgaatcatcgttagctctgagacttgtcaacggaggcgatcgctgccaggggagggtagaggttttgtatcaggggagttgggggactgtttgcgacgattcttgggacacgaacgacgcgaatgttgtgtgccgccagctgggatgcgggtgggccatgtcagcccccggcaatgccagattcggccaaggttcagggcctatagtgcttgatgatgtcagatgttctggacatgaatcttacctgtggtcgtgcccacacaacgggtggctttcacacaactgcggccattccgaggatgcgggtgtgatttgcagcgcttcccaatcccggcccaccccgagtccagacacatggcctaccagtcacgccagtactgccgggagcgaatccagcctcgcgttgagacttgtgaacggtggcgatcggtgccagggccgcgtggaggtactgtaccgagggagctgggggacggtttgcgatgactattgggataccaatgacgccaatgtggtgtgccggcaactggggtgcggatgggccatgagcgccccaggaaatgctcggttcggccagggctcaggaccaattgtgcttgatgacgttaggtgttcggggcacgagagctatctttggagttgtccacataatggctggttaagtcacaactgcgggcatcacgaggatgcaggtgtaatctgctcggcatcacagtcccagccaacccctagcccagatacctggcccacctcccacgcttcaacagcagggtccgaatcaagtttggcgctgcgcttggtgaacggcggcgatagatgccagggtcgagttgaagtgctttaccggggatcctgggggacagtctgtgatgattattgggacaccaacgacgctaatgtagtgtgtcggcagctggggtgcggttgggctacctcagctcctggcaatgctcggtttggacagggctcaggcccaatcgtgctggatgacgtgcggtgctctggccacgaaagttacctgtggtcttgtccccacaacggatggctatcacataactgcgggcaccatgaggatgcaggggtcatctgttcagcttctcagtctcagccgactccgagccccgacacttggcctaccagtcgtgcgtctactgccgggagtgaatccacccttgcactgcgcctcgtaaacggcggagatagatgccgcgggagggtggaagtgctgtatcagggtagttggggcaccgtgtgcgatgattactgggacaccaacgacgccaacgtcgtttgccgacagttgggctgcgggtgggcgatgtccgccccagggaatgcccagttcggccaaggtagcggcccaattgtcctggatgacgttcgctgttccgggcatgaatcttacctctggtcctgcccccacaacggctggttatcccacaattgcgggcaccatgaggacgctggcgtgatctgtagcgctgcccagtcacagtctaccccaagaccagatacatggctcactaccaacctgcctgcccttaccgtggggtccgagtccagcctggccttgcgcctggtcaacggcggcgacaggtgcaggggtcgcgttgaggtcttgtacagaggctcctggggtactgtgtgtgacgacagttgggatacaaacgacgcgaacgtagtttgcagacaattgggctgtgggtgggccatgtcagcacccgggaacgccaggttcgggcagggctctgggcccattgtactggacgatgtgcgatgttcgggcaatgagtcttatttgtggagttgccctcataagggctggctcacacacaactgtggacatcacgaagacgccggcgtaatctgctcagccactcagatcaattccacgactaccgattggtggcatcctacaactaccacaacggctcgaccctctagtaattgcggtggctttctgttctatgcatcaggaaccttctctagtcccagttaccctgcctactacccgaacaacgctaaatgcgtgtgggaaatagaagtcaatagcgggtaccgcatcaatttaggattcagcaatctcaaactggaagctcaccataactgctcctttgattacgtggaaatctttgatggatcactgaactcttcactactgctgggcaagatttgcaatgacacccggcaaatcttcaccagtagttacaacaggatgaccattcactttcgcagtgatatttcatttcagaacaccgggttcttagcgtggtataatagcttccccagtgacgctacccttcggcttgtgaacctcaatagtagctatggactctgtgccggccgtgtggaaatctatcacgggggtacttggggcactgtgtgcgacgatagttggaccatacaagaagctgaagtggtgtgtagacagctgggctgcgggcgggcggtatctgccctcgggaacgcttacttcggctccggaagtggcccaattacactggatgatgttgagtgtagtgggaccgaatccacactgtggcagtgccgtaaccggggatggttctcccacaactgtaaccatagagaagatgccggggtgatctgttccggtaaccatttatccacaccagcccccttcctaaatataaccaggcccaatacagactactcttgtggaggatttctgtcccaaccatccggcgatttctcttcccctttttaccctgggaactatcctaataacgcaaaatgcgtttgggatatcgaggtacagaataattatagggtcacggtcatatttcgagacgtgcaactggaaggcgggtgtaactacgactacattgaagtattcgacggtccttacagatcctcaccactgattgccagggtctgtgatggggctaggggaagcttcacttcaagctcgaactttatgtccattagattcataagtgaccatagtattactcgtaggggctttcgtgctgagtattattcctcaccatccaacgactctacaaacttgctatgtctgcctaaccacatgcaggcctccgtgagccgatcttacctccaatctctgggcttctccgccagtgatttagtcatatccacatggaatggatactacgagtgtcgcccccagataacccctaacttggtgatttttactatcccttactccggttgcggtactttcaaacaagctgacaatgataccattgattacagcaacttcctgactgccgccgtcagcggtggaatcattaaaaggcgtaccgacctgcggattcatgtgtcttgcaggatgctccagaacacgtgggttgacaccatgtatatcgcaaatgacactatacacgtagccaacaatactatacaagtggaagaggtccagtatggcaatttcgatgtcaatatttccttctacacatcgtctagtttcctgtatccagttacctcacgaccatactatgtcgacttgaatcaagatctgtatgtccaggcagagattttacactcggacgccgtgttgacactctttgtggatacatgtgtggcctctccttacagtaatgacttcacctcactgacctatgacctgatcagatccggatgtgtcagagatgacacatatggcccttactcttctccaagcctgcgcattgctagatttaggtttagagcatttcactttctgaaccgattcccgtcggtttacttgcggtgcaagatggtggtatgtcgtgcttacgaccccagcagcagatgctaccgaggctgtgtcctgcggtcaaagagagatgtcggatcctaccaggagaaagtggatgttgttctgggacctatccagcttcagaccccacccagaagagaagaagagccaagatag

SEQ ID NO: 14872 - DNA, 7242 bp, Artificial Sequence
  Description of Artificial Sequence: Synthetic coding sequence
atgggcatttccacagtgatcctggaaatgtgcctgttgtggggccaggtcctgtctactggcggatggattccaaggactactgactacgcaagcctgatcccgtccgaagttcctcttgaccccaccgttgccgaaggcagcccattcccttccgaatccactctggagtccacagtggccgaggggagccccatctcgctcgagtccactcttgaaagtactgtggcggaggggtctctgattccaagcgagagcactctcgagtctaccgtcgcagagggctctgacagtggtttagcactccggttagtgaacggcgacggcaggtgtcagggacgagtcgaaattctgtatcgcggaagttggggcacggtatgcgatgactcctgggatacaaatgacgcgaatgtcgtgtgcagacagctcggctgcgggtgggctatgagtgctcctggtaatgcctggtttggacagggatctgggcccatcgccctggacgatgtgcgttgttccggccacgagagttacctatggagctgcccgcacaacgggtggttgtctcacaattgcggtcacggggaagacgcgggcgtcatctgttccgccgcacaaccacagtccacccttagaccagagtcgtggccagtgcggattagcccacccgtgcccacagagggcagtgagagctctctggccctccgcctcgttaatggcggggataggtgtcgcggtcgagtggaggtactgtatagagggtcctgggggacggtctgtgatgattactgggatacgaacgatgcaaacgtggtgtgccggcagctggggtgcggttgggcgatgtcagctcctgggaatgcgcagttcggacaggggagtggtccaatcgttttagatgatgtacgctgtagtggccacgaaagttatctgtggagctgcccacataacggctggctgacacacaattgtggccacagcgaagatgccggcgtgatctgtagtgccccgcaaagtagacccactccttctcccgatacctggcctacgagccacgccagcactgcaggccctgaatcaagtttagccctgaggctcgtgaacgggggagaccggtgccaagggcgcgtggaagtactttatcgcgggtcctggggcactgtgtgtgatgattcctgggacacgagtgacgcgaacgtggtgtgtaggcagctgggatgtgggtgggccacgagcgcccccggaaatgctcgtttcggacagggctctggtcccattgttttagacgacgtgaggtgttcagggtacgaatcctacctttggagctgtccacacaacggctggctgtcccacaactgccagcactccgaggatgccggagtcatctgtagtgccgcacactcatggtcgactccatcacccgatactctccccacgatcactctccccgccagcaccgtgggcagcgagtctagccttgcactgcggctcgtcaatggtggcgacagatgccagggcagggtcgaagtactttacagagggtcatggggcacggtctgcgacgatagctgggatacaaatgatgccaacgtggtttgtaggcagctcggatgcggatgggccatgttagcacccggtaacgctcgcttcggacagggctcagggcccatagtactggatgacgtgcgatgctccggcaatgagtcctacttatggtcctgcccccacaatggctggctctcgcacaactgcgggcattccgaggatgcgggtgtgatttgttcgggccccgagtcctctttggcgttgagactggtcaatgggggggataggtgccagggcagggtggaggtgctttaccgcggttcgtggggaaccgtctgtgatgatagttgggacaccaatgacgccaatgtggtgtgcaggcagttagggtgcgggtgggctacaagcgcacccgggaatgcacgctttggccagggcagtgggcccatcgtgctggacgacgtcagatgtagcggccacgagtcatacttgtggtcctgcccaaataatgggtggttgtcacataattgcggacatcacgaagacgctggagtgatttgttcagccgcgcagtctaggagtactcctcgacctgatactctgagcaccattaccctccctcccagtactgttggatcagaatcatccctgacactgagactcgtgaatggatcagatagatgccagggccgagtggaagttctttacagagggtcgtggggcacagtctgtgacgattcttgggacactaacgatgcaaatgtggtgtgtcgacagctggggtgtgggtgggcaactagcgccccaggaaacgcccggttcggccagggttccgggcccatcgtgctggatgacgttaggtgcagcggccacgagtcatacctatggtcctgtccgcacaatgggtggcttagccataactgcggccatcatgaggacgccggtgtgatatgttcggtgtctcagtctcgaccaaccccatctcctgatacctggccaacaagccatgccagtaccgcaggtcccgaatcatccttggccctgcgattagtgaacggaggagatagatgtcaggggcgggtagaggtattgtatagaggtagttggggcaccgtctgcgatgacagctgggacactagcgacgccaacgtcgtgtgtcgacaactcggatgtggctgggctacttccgcgcccggcaacgcacggtttgggcagggctctggaccaatcgtgcttgacgatgtgcggtgctcgggctacgagtcctatctgtggagttgcccccataacggatggctttcccataactgtcagcatagcgaagatgctggagtgatctgttctgcagcacactcttggtcgactcctagccccgacacacttcctacaatcacactccctgcttcaaccgttggctctgagtcatcattggcactgaggctggtgaatgggggcgatcggtgccagggtcgagtggaagtactttatcaagggagttgggggacggtgtgtgacgatagctgggacactaacgatgcaaatgtggtttgtcggcagctcgggtgcggttgggcaatgtccgcccctggcaatgctagattcggtcagggctctggtcctattgttctggacgacgttcggtgttccggccatgagagctacctgtggagctgcccacacaacggatggctgagccataactgtggccacagcgaagatgcaggagtaatctgctcagcatcgcagtctagacccacaccatcgcccgacacttggccgacaagccatgctagtactgctggatctgagtccagcctggccttgaggttggtaaatggcggggaccggtgccaaggacgggtagaagtcctttatcggggcagttggggtacagtctgcgacgactattgggacaccaatgatgccaacgtggtctgtcgccaactggggtgtggatgggcgatgtcggctcctggcaacgctagattcgggcagggctcagggcccatcgtccttgatgatgttagatgttccggccacgagtcctatctgtggtcttgcccacataatgggtggttgagccacaactgcggccaccacgaagacgctggcgtaatctgctcggcctcacagtctcaaccgaccccctctccagacacttggccaacaagccacgcttcaactgccggatcagagtcaagcctcgctctccgcttagtaaacggaggcgatagatgccaggggcgggtagaggtcctctacagaggttcttgggggacagtgtgtgacgattattgggacaccaatgacgccaatgtggtgtgccggcaattaggttgtggatgggcaacgtccgcccccggcaacgctcgcttcggacagggatcaggacccatcgtgttggatgatgtccggtgcagcgggcatgaatcctacctgtggtcttgcccccacaacggatggttatctcataactgcggccatcacgaggacgccggtgtgatctgttctgcgagccagtcacagccaacaccctcacccgacacttggcctacttcacatgcctctacagccgggtccgaaagcagtctggcactgcgcctggtcaacgggggagatcgatgccagggaagagtggaggtgctatacaggggctcgtggggaacagtgtgtgacgattattgggacactaacgatgctaacgtcgtgtgccgacagctgggatgtggctgggcaacctctgcacccggaaatgctaggttcggacaggggtctggaccgatcgtgctggatgacgtccgctgctcaggccacgaaagctatctgtggtcgtgtccacataacggctggttgtcgcacaactgcgggcatcatgaggacgctggcgtgatctgctccgcatctcagagtcaacccacccccagccctgatacttggcctacttccagagcctctacagcgggtagcgagtccacgctcgctttgaggctcgtcaacggcggagatcgttgccgcggcagagtggaggtgctatatcagggaagttggggcactgtatgtgacgattattgggacaccaatgatgccaacgtggtgtgccgtcagctgggatgtggctgggcaatgtccgccccgggaaatgcccaattcggacaggggtccggacctattgttctggacgacgtgcgttgcagtgggcacgaatcttatttatggtcttgtccacataacggatggctctctcacaattgcggccaccacgaagatgctggggtcatctgctcggctgcccaaagtcagagcaccccgcggcccgacacctggctgacaactaatttgcctgccttgactgtcgggtctgaatccagtctggctctgcgcctggtgaatggcggtgacagatgtagagggcgggtcgaagtgctataccgcgggtcttgggggacagtgtgcgacgacagttgggacactaatgatgcaaacgttgtgtgtcggcagctgggatgcgggtgggccatgtccgcccctggtaacgctcggttcggccagggatccgggcctattgtccttgatgatgttaggtgtagcgggaacgaatcttacctgtggagttgccctcacaaggggtggctcacacataattgtggccaccatgaggatgctggagtgatctgttcagcaactcagatcaatagtaccacaacagattggtggcatcccacaactaccacaacagcccggccgtcgagtaattgtgggggattccttttttatgcatctgggacattcagcagcccttcctaccctgcatattaccccaataacgctaaatgtgtgtgggagattgaggttaatagcggctatcgcatcaacctgggatttagcaacttaaaacttgaggctcaccataattgcagctttgactacgtagagatttttgatggtagtcttaactccagtctgctgctcgggaagatctgcaatgatacccggcagatctttacttcttcttataacaggatgacgatacattttagaagtgacataagtttccagaatacaggtttcctggcctggtacaatagtttcccttcagatgccaccctccgcctagtgaacctgaactcctcctatgggctttgcgcgggtcgtgtggaaatctatcacgggggaacatgggggactgtatgcgatgattcttggacaattcaggaggcagaggtcgtgtgcagacagctgggatgcgggagggccgtgtctgcacttggtaatgcgtactttgggtcgggctcagggccaattaccctggacgatgtggagtgctccggcaccgaaagcacattatggcagtgtaggaaccggggttggttctcacataactgtaatcatcgagaggacgctggtgtgatttgtagcggaaaccacctgtctacacccgcaccatttctaaacatcaccaggccgaatactgattacagttgcggtggctttctctctcagcccagcggggacttctccagtccgttttaccctggcaactacccgaacaatgcgaaatgcgtgtgggatattgaggttcagaataattatcgggtcaccgtgatctttcgtgatgtacagctggaaggggggtgtaactatgattacattgaggtttttgacgggccatacaggagcagtcctctaatcgctagagtttgtgatggagcgcgggggtctttcacgagtagcagcaactttatgtctattcggttcatcagcgatcattctatcaccaggcgaggcttccgggccgagtactactcctcaccctccaatgactccaccaatctcctgtgcctccccaaccatatgcaggccagtgtgtctcgaagctacctgcagagtcttggctttagcgcatctgatctagtgatttctacttggaatggctactacgaatgcagaccacagattacacctaatctggtcatcttcactatcccttacagcggctgtggaaccttcaagcaagccgacaacgacactatcgactatagcaactttttgaccgcggccgtgagtggcggcattataaagaggcggaccgacctgcggatacatgttagttgtaggatgctgcagaacacctgggtcgatacaatgtatattgcgaacgatacaattcacgtcgctaacaatactatccaggtcgaggaggtgcagtatgggaactttgacgtgaatatctctttttacacctctagtagcttcctgtaccccgtgacttctcgtccttactacgtggatctgaatcaggacctgtacgtccaggctgagatcctccatagcgacgctgttctgactctgttcgtcgacacatgtgtggctagcccctatagcaacgatttcacctcccttacatatgaccttatccggtctgggtgtgtgagggatgacacatatggcccctattcatctccatctctcaggatcgctagattccgctttagagcttttcactttctgaacaggtttccttctgtctacctgaggtgtaagatggttgtctgtcgcgcctacgacccttctagtagatgctaccgtggctgcgtgctgcgctccaagagggatgttggcagctaccaagagaaggtggacgtcgtcctgggaccaatacagctccaaaccccaccccggagagaagaggaacctcggtag

SEQ ID NO: 14873 - DNA, 5358 bp, Artificial Sequence
  Description of Artificial Sequence: Synthetic coding sequence
atgggaatatcaaccgtgatattagagatgtgcttattgtgggggcaggtgctgtccactggcggctggatcccccggacgacggattatgcatctctcattcccagtgaagtcccccttgatcccacagtggccgagggatcacccttcccttcagaaagcacccttgagtcaactgtggccgagggctccccgatctctctggaatccactctcgaaagcactgttgccgaaggtagtctcatcccctctgagtctactctggagagtaccgtagccgaggggagtgactccggcctggcactcagactggtgaacggtgacggaagatgccagggcagggtggaaatattataccgcggcagctggggaacagtttgcgatgatagttgggacaccaatgatgcgaatgtggtgtgtagacagctggggtgtgggtgggccatgtcagcccctgggaatgcttggtttggacagggcagcggccctatcgccctggatgacgtgcgatgctcaggacacgaatcttatctctggagctgcccacacaatggctggttgtcccataattgcggacatggcgaagacgccggcgtgatttgttccgccgctcaacctcagagtactttaaggccggagtcttggcccgtccgaatcagccccccggtacccactgagggcagcgagtcatcactcgcccttcgactagtcaatggcggcgatcggtgtcgtgggcgtgtggaggtgctgtaccgagggagctggggaactgtctgtgatgattactgggatacaaacgacgccaacgttgtgtgtcgacagttagggtgcgggtgggccatgtccgctccaggaaatgcgcagtttggtcagggcagcggcccgatcgtgctggacgacgttcgatgtagcggccacgaatcttacttgtggagctgtccgcacaatggatggctgactcacaactgtggccatagcgaggacgccggggtcatttgtagcgccccacagtcccgcccaacaccttctcccgacacttggcctacttcacatgcttcaactgcgggaccagaatctagtcttgcactccggttggtcaatgggggcgataggtgtcagggacgggtggaggtgttatatcgcgggtcatgggggactgtttgtgatgactcttgggatacaagtgatgccaatgtggtttgccgacagttaggatgtggctgggccacttcggcccctggcaacgcaagattcggtcaaggctctggccccatagtgctggatgacgtgagatgttcgggctacgaaagctacttatggtcatgtccccacaatggatggctgtctcacaactgtcaacatagtgaggatgccggcgtaatctgcagcgccgcgcacagctggtctactccttcccctgacacactcccgacaattaccctgccggccagcaccgttggatctgagagctccctggcactaaggctggtcaacggcggcgatagatgtcaaggacgagtagaagtactctaccagggtagttggggaactgtgtgcgatgacagctgggacactaacgacgcaaacgtggtgtgccggcagctgggatgcggttgggcgatgtctgcacccggcaatgcgcgcttcggccaaggaagcggccctatagttctggacgacgtccgctgcagtgggcacgagtcttacttgtggtcttgtcctcataatgggtggttgtcgcataattgtgggcactccgaagacgctggcgtcatatgttcagctagtcagagcaggcccaccccttctcctgatacttggcctacttctcacgcaagcacagccggtagcgaatctagtctggccctcagactggttaacgggggtgatcggtgccagggtagggttgaggtgctatacagaggctcttggggcactgtgtgcgatgactactgggacactaatgacgccaatgtagtctgtcgacagctgggctgcggctgggccatgtcagcaccaggcaacgctagatttggtcagggctccggtcccatcgtactggacgacgttcggtgttctggacacgagtcttacctctggtcctgtccacacaacggatggctgtcccataactgcgggcatcacgaagatgctggggtgatctgctccgcctcgcagtcccaacctaccccttccccagacacttggcccacctctcatgcttccaccgcggggtctgagtcctctctggcattgagactcgtcaatggcggagacagatgccagggtagggtggaggtgctatatagggggagttgggggaccgtatgtgacgactattgggatactaatgatgccaatgtagtgtgccgccaactggggtgcggatgggctacatctgctcctggtaatgcacgatttggacagggctctggacccatcgtcctggatgatgtaaggtgttctggacacgagagctacttatggagttgtccacacaacggttggctgagtcacaactgcgggcatcacgaagatgctggtgtgatttgttccgcctcccagtcacagccaaccccctctcctgatacttggcctacttcacgtgcaagcaccgctggaagtgaaagtaccttagccctcagactggtgaatggaggggacaggtgccgagggcgggttgaagtgctataccaaggctcctggggaactgtgtgtgacgactattgggataccaatgacgcaaatgtagtttgtcgccagttgggctgtggctgggctatgagtgcgcctggtaacgctcagtttggacagggcagcggacccattgtgttggacgatgtcaggtgttctgggcacgaaagctatctgtggtcctgcccacacaacggttggctgagtcacaattgtgggcaccacgaggatgccggagttatttgtagcgcagcacaatctcagagcaccccaaggccagatacctggctgacaaccaatttgcccgccctgaccgtgggtagcgaaagtagcctggctttacgcttggttaacggcggcgataggtgtcgcggacgcgtagaggttctgtatcgcggcagttggggaacggtttgcgacgatagctgggacactaacgacgccaatgttgtctgtagacagctcggttgtggatgggctatgtctgcccctggtaatgccagattcgggcaaggcagtgggccaatcgtactggatgacgttaggtgctcagggaatgaaagctatttatggtcctgtccacacaaagggtggctgactcacaattgtgggcatcacgaggatgcgggagtgatttgcagcgctacacaaatcaacagcacaaccaccgactggtggcaccctactacaacaaccacagcgcggccatctagcaattgtggcgggttcctattctacgcttccggtacatttagcagcccatcataccccgcctactatccaaataacgcaaaatgtgtctgggagatcgaagttaatagcggataccgtatcaatctggggttctcgaacctgaagctggaggcgcatcataattgttctttcgattacgtcgaaatatttgatggtagtctgaatagtagcttacttctggggaaaatatgtaacgatacccgtcagatctttacctccagttataatcgtatgacaatccactttcgatcagacatctcattccagaataccggcttcctagcttggtataacagcttcccgagtgacgcaactctcagattagtgaatctgaattcctcctatggattgtgcgccggccgggttgagatataccacggtggcacctggggtacagtgtgcgacgattcctggacaatccaggaggcggaagtggtctgtaggcagctcggctgcggccgggccgtttccgctcttggtaatgcatattttggctctgggtccggtcccatcaccctggacgatgtggagtgtagtggaacagaatctaccttgtggcagtgcagaaatagagggtggttcagccataactgcaatcatcgcgaggacgcaggagtgatttgttccgggaatcatctctcgacccccgccccctttctcaacataacccgtcctaacacagattattcttgtggcggattcttgagtcagccaagcggcgatttcagcagcccattttatccaggcaattacccaaataacgccaagtgtgtgtgggatattgaggtgcagaacaattaccgggtgaccgtgatcttccgcgacgtccagttagagggcggatgtaattacgattatatcgaggtattcgatggaccttatcggtcttccccactaatagccagagtatgcgacggagcaagaggatccttcactagttcgtcaaacttcatgagtattaggttcatcagcgatcatagtataacgcgtagaggatttagagccgaatattatagtagtccaagtaacgattccacaaacctgctgtgcctccctaatcacatgcaggctagtgtgagtagaagttacctgcaaagcttagggttcagcgcaagcgacctagtgatcagcacttggaatggctattacgagtgtaggccacagataacccctaacctggtgatctttaccatcccctactccggctgcggaaccttcaagcaagccgacaatgatactatagactactcgaattttctcaccgctgccgtcagcggcgggattattaaaaggagaactgacctcagaattcatgtctcttgtcggatgctccagaatacctgggtggataccatgtatatagccaacgatacaatacatgtggcaaacaataccatccaagtggaggaggtgcagtatggtaattttgatgtgaatatctcattttacacaagttcaagcttcttgtacccagtaacttcaaggccatactacgtcgacctgaatcaagacttgtatgttcaggcagagattctccattccgacgccgtgcttactcttttcgtggacacgtgtgtagccagtccttactctaacgatttcacttctcttacttatgacttgattagatcaggttgcgtgagagacgatacttacggcccatactctagccctagcctgagaattgcacgtttccgcttcagagcctttcacttcctgaaccgcttcccgagcgtgtacctacgctgtaagatggtcgtctgcagagcctacgatccctcttcaagatgctatcggggttgtgtcctgagaagcaaaagggacgtggggtcttaccaagaaaaagtggacgtagttctgggcccaatccagctgcagacacccccccgtagagaggaggagccacgctag

SEQ ID NO: 14874 - DNA, 7242 bp, Artificial Sequence
  Description of Artificial Sequence: Synthetic coding sequence
atgggcatctcgacagtaatcctggagatgtgcctgctttggggacaggtcttgagtaccggaggatggatcccacggactaccgattatgcgtccctgatcccaagtgaggtgccactggatcccacagtcgctgagggctctccctttccttccgagtctactctcgaatccacagtcgcggaaggcagtccaatttccttagagagtacactggagtcaactgtggccgagggctcacttataccttcagagtcgaccctggaatcgacagtggccgaggggtctgacagtggattagcattgcgattagtcaatggcgacgggcgctgtcaagggagagtcgagatcctgtatcgtggatcgtggggaaccgtctgcgatgacagctgggacacaaatgatgcgaacgtagtgtgccggcaactcggatgtgggtgggctatgagcgcccctggcaatgcatggttcggtcagggttctgggcccattgcattggatgatgtgagatgttctggacacgaaagctatttgtggtcatgtccccacaacgggtggctgagccataactgtgggcatggtgaagatgccggcgtgatttgctcagcagcccaaccacagagtacgctacggccagagagctggcccgtgcgaatcagtccaccagttcctacagaagggtctgagtcaagtctcgccttgcggctggtgaatggtggcgaccggtgtcggggacgggttgaggtcttataccggggttcctgggggactgtctgtgacgactactgggataccaatgacgcaaatgtcgtctgccggcagctaggttgcggctgggccatgtcggctcccggcaatgcccaattcggccagggctctggtcccatcgtgctcgacgatgtgcgctgcagtggtcacgaatcgtacctgtggtcctgcccccacaacggctggctgacacacaattgtggtcactctgaagacgccggggtcatttgctcggctccacagtcaaggcccaccccttccccggatacatggcccacctctcatgctagcacagctggacctgaatcaagccttgcgcttcgtctggttaatggcggtgaccgatgccagggccgggtggaagttctttaccgcggatcatggggcacggtttgtgatgactcatgggacaccagcgacgccaacgtagtatgtcggcagctaggttgtggctgggcgaccagcgccccggggaatgccagatttgggcagggttccggcccaattgtgctggacgacgtcagatgctcagggtatgaatcttacctctggagctgtccacacaacgggtggctttcccacaactgccagcattcagaagacgctggtgttatatgcagcgcagcccattcgtggtcaaccccaagccccgacacactgccaactataaccctgccggcttcaacggtgggcagcgagtcaagtctcgccttgcggctcgtaaacggcggtgaccggtgtcaggggcgggtagaagtgctgtacagggggagctgggggacagtgtgtgatgacagttgggacacaaatgacgccaacgtcgtctgtagacagctcggatgcggatgggccatgctggctccagggaacgcccgcttcggccaaggttccggacctatcgttctggatgatgtgagatgcagcggaaacgaatcttacttatggtcatgcccccacaatggttggctatcccacaactgtgggcattctgaggatgcgggagtgatatgtagcggacccgaatcctccttagcactccgactggttaacggtggggaccgctgccaaggcagagtggaagtgctgtatcgaggctcttggggtaccgtctgcgatgatagctgggatacaaatgacgccaacgtcgtgtgtcgacaactgggctgcggctgggccacatcagcccccgggaacgcccgattcggccaggggagtggaccgatcgtcttagacgacgtaagatgtagtggacatgagagctacctgtggtcatgtcccaataatggctggttatctcacaattgtggccaccacgaagacgccggcgtgatttgttccgctgcccagtccagatcaactccccgaccagacaccttgagtactataactcttccaccatcaaccgttggctccgagagcagcttaacgctccggctcgtcaacggctctgacaggtgccaagggcgcgttgaagtactataccgtggcagttggggcacggtatgcgacgattcttgggacactaacgacgcaaacgtcgtttgtagacagttaggatgcggctgggccacatccgcgcctgggaacgctcgcttcggccaaggtagtgggcctatcgttttggacgatgttcgctgttccggccacgagtcatacctttggtcttgcccacacaatggttggctgagccacaattgcggccaccatgaggacgccggcgtgatctgtagtgtgtcccagtctagaccgacaccgagcccggatacctggccaacatcccatgccagtacggctggacctgaatctagtctggcgctccggcttgtgaacgggggagaccgctgccagggacgcgttgaggtgttataccggggttcttggggcactgtgtgtgatgatagttgggacacttcagatgcgaacgtggtttgtcggcaattgggatgcgggtgggctaccagtgcccccggcaacgcgaggttcggccaagggagcggtcctattgtgctggacgacgttagatgtagtggatacgagtcctatttatggtcttgccctcacaacggctggctctcacacaattgtcaacatagcgaggacgcgggtgttatctgtagcgcagcacacagctggtccactccttctcccgacactcttcccaccataacactaccagcctctaccgtgggatccgaatcatccctggctctgcggctggttaatggcggagatcgatgccaaggcagggtagaagtgttatatcaggggtcgtgggggaccgtgtgcgacgactcctgggatacaaatgacgccaacgtcgtctgccggcaattgggatgcggatgggctatgtctgctccaggaaatgctcgctttggtcaaggttctggaccgatcgtattagacgatgtgcgctgctcaggacatgagtcttacctgtggagctgcccacacaacggttggctgtcacacaattgcgggcactccgaggatgccggagtaatctgcagcgcctcccagtctcgtcctaccccaagtcctgacacatggcccacctcacatgcctcgactgccgggagcgagagctctctggccctgaggttagtgaatggaggagacaggtgccaaggacgtgtcgaagtgttgtatcgcggaagttggggcactgtctgtgacgattactgggacacaaatgatgcaaacgtggtctgtcggcagctaggctgtggctgggcaatgagcgcccccgggaacgctaggtttggccagggatcggggcctatagtgttggacgatgtacgctgttccgggcacgaatcatacctgtggtcttgcccgcataacgggtggctgtctcacaactgcggccaccacgaagacgctggcgtgatctgttccgcatctcagtcccagcccactccttcccctgatacatggcccacgtcccacgctagcaccgctggctctgaatcatccctggccctgagactggtcaatgggggggatcgctgccagggacgtgtggaggtgctctaccgtggatcttggggcaccgtttgtgatgactactgggatacaaatgatgctaacgtcgtgtgccgccaattgggctgcggctgggccaccagtgctccagggaacgccagatttggccagggcagtggtcctatcgttttggacgatgtgagatgttccggacacgagtcttacctgtggagctgtccccacaacggctggctgagccataactgtggccaccatgaggatgcaggtgtgatctgcagcgctagccaatctcagcctacaccaagccctgatacctggcctacaagccacgcctctactgcaggttccgaatcaagccttgcgctccggctggttaatggcggtgaccgatgccagggtcgggtcgaagtattataccgcgggagctggggtacagtttgcgacgattattgggacaccaatgacgccaatgttgtttgccggcagttggggtgcggttgggccacgagtgcacccggcaatgctagatttggccagggcagcgggcccattgtgttggacgacgtgcgatgttctggccacgagagctacctctggtcatgcccgcacaacggctggctgagccataactgcggtcaccatgaggacgcaggcgtgatctgttcagcttctcaaagccagccaactccttcccccgatacttggcctacctcccgggcttccacagccggttcagagtccacactggccctgcggctggtgaatgggggcgatcgatgtcgcggacgggtggaagttctctaccagggcagttggggcactgtgtgtgacgattattgggatacaaatgacgccaatgtcgtctgcaggcaactcgggtgcggatgggccatgtcagcccctggtaacgcacaatttgggcaaggcagcggacctatagttctggatgacgttcggtgttcggggcacgagagctacctgtggtcttgtccacacaacggatggctgtcacataactgcggacaccatgaagacgccggcgtgatttgttctgctgcgcagagccaatcgacaccacgtccagatacttggctgacgaccaatctcccggccctgacggtgggatcagagagtagtctggctctgcgtcttgtcaatggcggtgacagatgtaggggccgtgtggaagtgctttaccggggctcatggggcaccgtgtgcgacgactcgtgggataccaacgatgccaacgtcgtctgccgccaactgggctgtggttgggccatgtcggcacctggcaacgcacgcttcgggcagggaagtggtcccattgtgctggatgatgtgaggtgtagcggaaacgagagctacctgtggtcttgcccacacaaaggatggctaacacacaactgtggtcaccatgaagacgctggggtcatctgttccgccactcaaattaattctaccactacagattggtggcatcctaccacaacgactactgctagaccttcctcaaactgcggaggatttctgttctacgccagtggcactttctctagtccctcctaccccgcgtattaccctaataacgcaaagtgcgtgtgggagatagaggtgaactcagggtatcgcataaacttgggcttcagtaacctgaaactggaagcccaccataattgcagctttgattatgtagaaatttttgacggttctttaaacagcagcctcctcctgggcaaaatctgtaacgatactagacagattttcacttcttcctataaccgcatgactatacattttcgtagcgatatatcttttcagaataccggcttcctggcttggtataacagctttccctcagacgctacactccggctagtcaacctgaactccagttacggtctgtgtgcggggagagtggaaatttatcatggcgggacttggggcaccgtgtgtgacgactcatggactatccaggaggccgaggttgtatgtcgccaactgggatgcggccgtgccgtcagtgcccttggcaatgcgtatttcggctcaggctcggggcctattactctagatgatgtcgagtgttctgggactgaatcgacactgtggcagtgccgcaatcgagggtggttttcccacaactgcaatcatagggaagacgcaggggtgatttgtagcggcaaccatcttagcactccagctcccttcttgaatatcacccgcccgaacaccgattatagctgtggcggcttcctgtcacagccaagcggtgattttagctctccattctatcccggaaactatcccaacaatgcaaagtgcgtctgggatatcgaagtgcaaaacaactatcgcgtgaccgtcatatttagggacgttcagctggaaggagggtgcaactacgattatatagaggtatttgatggtccttaccgatcttccccactgattgcccgcgtctgtgacggcgcgaggggatcattcacctcatcctccaatttcatgtcaattaggttcatctcagaccacagtatcacgcggcggggcttcagagccgaatattactcaagtccaagcaacgatagcacaaacctactttgcttacctaaccacatgcaggcatctgtttctagatcatacttgcagtctctgggattctcagcctctgacctggtcatcagtacatggaatggctattatgaatgcagacctcagatcacgcctaacctggtgatcttcaccattccctattccggctgcggcactttcaagcaggccgacaacgacacaatcgactactccaattttcttaccgctgccgtgagtggtggcattattaaacgcagaacagatttacggatccatgtcagctgtcggatgctgcagaatacttgggtggatacaatgtatatcgccaacgacacaatccacgtggctaacaatactatccaggtggaagaggttcaatatggcaatttcgacgtcaatatttccttttacactagcagctcattcctgtatcctgtcacgtcccggccatattacgtggatctcaaccaagatctgtacgtgcaggccgagatccttcatagcgacgccgtgcttacactgttcgtggatacctgtgtagcgtcaccatacagcaacgacttcaccagccttacatatgatttgattcgttctggttgcgtgagggatgatacatacggcccttattcttccccaagcctgcgaatagctcggttccgcttcagagcattccatttcctaaaccggttcccatccgtgtacctgaggtgcaaaatggttgtgtgtcgagcttacgatccgagctcgagatgttataggggatgtgtgctgcgctccaagagagatgtgggcagctaccaagaaaaagttgatgtggtgctgggacctattcagctgcagactcctcctagaagagaagaggagccacggtag

SEQ ID NO: 14875 - DNA, 7242 bp, Artificial Sequence
  Description of Artificial Sequence: Synthetic coding sequence
atgggcattagtaccgtgattttagaaatgtgccttctttggggtcaggtgttatcaactggcggttggataccaaggactaccgactacgcctcactcattccatccgaagtgccattggacccaacagtggctgaaggatccccctttccatcagagtcaacccttgaaagcaccgtcgcagaaggctccccgatcagccttgagagcacgctagaatcaaccgtcgccgaaggtagcctgatcccgtccgagtctacgctagagagcaccgtggccgagggctctgacagcgggctcgctttaagactggtgaacggcgacgggaggtgccagggtagggtagagattctgtatagagggtcatggggtactgtctgcgatgattcgtgggacacaaatgatgcgaatgtggtgtgccgacaactgggctgtggctgggccatgagtgctccaggtaacgcctggttcgggcaaggatcagggccaatcgccttagacgatgtgaggtgttccgggcacgaatcctatctctggagttgtccccataatggctggctttcacataattgtggccatggagaggacgcaggcgttatctgttccgccgcccagccacagagcacattgcggcctgagtcatggcccgtccggatttcacctccagtgcccactgaaggtagtgagagcagtctagcgctgagactcgtcaatggcggcgacaggtgcagaggaagagttgaggtcttatacaggggcagctgggggactgtgtgtgacgactattgggacacaaatgatgctaacgtggtttgtaggcaactcggttgcggatgggctatgtccgcccccggcaacgctcagtttgggcagggctcgggaccaatcgtcttagacgacgtccggtgcagcgggcacgagtcctacctgtggtcctgccctcacaacggatggttgactcataactgtgggcatagcgaggacgcgggggtcatttgcagtgccccccagagtaggccaacgccgtccccagacacatggccgacatctcacgcatccactgccggtccagagtcctctttggctctacgcctggtgaacggaggggacaggtgtcagggacgagtagaagtgttgtacaggggctcttgggggactgtgtgtgatgatagttgggacacgagcgacgctaatgtggtatgccgccagctgggttgcgggtgggccacctcagcccccgggaatgcgaggtttgggcaagggtcaggtcccatcgtcctggatgatgtccgctgtagtgggtatgagagctatttgtggtcatgccctcataatgggtggctctctcacaattgccaacactctgaagatgccggggtcatttgtagtgcagctcactcatggagcacaccaagtcctgatacccttcccaccatcaccttgccggcgagcacagttggctccgagagttccctggcacttcgactggtgaatggtggcgatcgctgccagggaagagttgaggttttatatcgggggtcctggggcaccgtgtgcgatgatagctgggacactaacgatgccaacgtcgtatgtagacagctgggctgtggttgggctatgctggccccgggaaatgcccgcttcggtcagggatctggcccgatcgtgctcgatgacgtgcgctgcagcggcaacgaatcctatctttggagctgtccccataacggctggctgagtcataattgcggccattctgaagacgcgggggtgatatgttctgggcccgaaagctctctggcattgagactggtgaacggcggggatcgctgtcagggccgtgtcgaagtcttatatagggggtcatggggcacagtttgcgacgacagctgggatacgaacgacgcaaatgtggtgtgccggcagcttggctgtgggtgggcgacctccgcgcctggaaacgctcgcttcggtcagggctcagggccaatagtgctcgatgatgtcagatgttcgggtcacgagtcttatctgtggtcctgtcccaataacggctggttgagccacaactgcggtcatcatgaggacgctggggtgatctgttccgcagctcagagccgttcaacgccaagacctgacacgctgagtacgattacactgcccccttccacagtgggctccgagagctccctgacactgcgcctggtaaacgggagcgacaggtgccaagggagagtcgaagtgctgtacaggggaagctggggaaccgtctgcgacgactcttgggatacaaatgacgccaatgttgtttgccgccagctcgggtgcggatgggcaacttcagcccccggaaatgccaggtttgggcagggcagtggacccattgttttagatgacgtgcggtgctcagggcacgaaagttacctgtggtcttgtccacacaatggttggctctcacataactgtggccaccacgaagacgccggcgtgatctgctctgtgagccagagccggccaaccccgagcccagacacttggcctacttcacacgcctcgactgcgggccccgaatcatccctggctctcaggctggtgaatggcggcgacaggtgtcagggcagggtggaggtgctgtaccgaggttcgtggggaacagtgtgcgatgacagctgggacaccagcgacgcgaatgtcgtttgccgacaattaggttgcggttgggctacgagcgctccagggaatgctcgcttcgggcagggctccggaccaatagtgctggacgacgtgagatgtagcggttacgagtcctatctttggtcttgtcctcacaacggctggttgagccataattgtcagcactccgaggatgctggcgtgatttgttctgcagctcattcatggtccacgccatctcctgacacactgccaaccatcactttacccgccagcactgtcggcagcgaatcctcactggcccttaggctggttaacgggggggacagatgccagggccgcgtcgaggtcttataccagggatcttggggcacggtctgtgacgacagctgggatacaaatgacgccaatgtggtgtgtaggcagctgggctgtggttgggcaatgagcgcacccggaaacgcgaggtttgggcaaggatccggtccgatcgtgctggacgacgttaggtgctccgggcatgagagttatttgtggtcttgtccgcataatggttggctgtcccacaactgcggccactcggaggacgctggagtcatctgcagcgcctctcagtcacggcccaccccttctccagatacatggccgacttcgcatgcctcaaccgccggcagcgagagctcactggccctgcgcctcgtgaatgggggagaccgctgtcaaggccgtgtcgaagttttatacagggggtcctggggaacggtctgtgatgactactgggataccaacgacgctaacgtcgtgtgcaggcagctggggtgcgggtgggctatgtccgctcctggcaacgctcgattcggccagggcagcggacctattgtgttagatgatgtcagatgttccggccacgagagctacctctggtcatgtccacacaacggttggctgagtcataactgcggtcatcacgaggacgcaggtgtaatctgcagcgcttcccaaagccagcccacacccagcccagacacttggcctacctcgcatgcctccactgctgggagcgaatcttccctcgccctacgactggtcaacgggggcgataggtgtcagggccgcgttgaagtactgtataggggttcgtggggtaccgtgtgtgacgactactgggacactaacgatgccaacgttgtatgccggcagctgggatgcggttgggcaacgtctgcccccggcaacgccaggtttggtcagggttcgggccctattgtattggacgatgtgcggtgcagcgggcacgaaagctatctgtggtcttgtccacataacgggtggctttcccacaattgtggacatcacgaggatgcaggggtcatctgctcggcttcacaatctcagccaacacccagccctgatacatggcccactagtcatgcaagcaccgcaggatctgagagctcacttgcgctgagacttgtcaatggcggtgatcgctgccaaggaagggtggaagtgctctaccgtgggtcctgggggactgtgtgcgacgattattgggatacaaacgacgccaatgtggtgtgccggcagctgggttgcggatgggcaaccagcgccccagggaacgcccggtttggtcaggggtcaggacccatcgtactggacgatgtaaggtgttccggccatgaatcctatctatggtcctgcccccataacgggtggctcagccacaattgcggccatcacgaagacgcaggtgtgatttgttctgcctcccagtcacagcccacgccatccccagatacctggcccactagtagggcttctacagcaggcagcgaatctactctggcattacggctggtgaacggcggcgatcgttgtaggggccgagtcgaagtcctgtaccaagggtcatgggggaccgtatgcgatgattattgggacactaatgacgcaaacgtcgtgtgccgacagctgggatgcggatgggccatgtctgccccgggtaacgctcagttcgggcagggttccggacccatcgtattagatgacgtgagatgcagtggtcacgaatcgtacctttggagctgtccccacaacgggtggctgtcgcataactgtgggcaccatgaagacgcaggagttatctgctcagccgctcagtctcagtccacgcctcgacccgacacttggttgaccacaaatctgcccgcactgaccgtcggcagcgagtcctccctggccctgaggctggtgaacggaggcgatagatgtagagggcgtgtcgaggttttatacagaggcagttggggaaccgtctgcgatgactcatgggacacgaacgatgcaaatgtcgtatgcagacagctcggatgtgggtgggcaatgagcgccccaggaaacgcacggtttggacagggctcaggtccaatagtgctagatgatgtcaggtgcagtggcaacgagtcatatctgtggagctgcccacataaggggtggctcacccataattgcggccaccacgaagacgcgggggtcatttgcagtgccacacaaattaattcgactacgaccgactggtggcatccaacaaccactaccacggctcggccctcatctaattgcggggggtttttgttttatgccagcggcactttttccagtccaagctatcccgcctattacccaaacaacgcaaagtgcgtgtgggaaatcgaggtgaattcaggatacagaattaacctgggcttctccaacctgaaactggaggcccaccataattgctcctttgactacgtggagatctttgacggctccctgaactcatctctgctactcggcaagatctgtaatgacactagacagatcttcacctcctcctataaccggatgacaattcacttcaggtcagacattagtttccaaaacaccggctttttggcatggtacaattccttcccaagcgatgccacactgcgtctcgtcaatctgaattcctcctatggactgtgcgccggacgagtcgagatctaccacgggggaacctggggaacagtttgcgatgattcttggacgatacaggaggcggaggtcgtgtgccggcagctgggttgtggaagggcagtgtccgctcttggcaatgcttatttcggatcaggcagtggaccaatcactctggacgatgtcgagtgttctggaaccgagtctactctgtggcagtgccgtaacagaggctggtttagccataattgcaaccaccgtgaagatgctggcgtaatctgtagtgggaaccacttatctaccccagcgcctttcttgaacatcactcggccaaacactgactattcctgtggcgggttcctctctcagcctagcggggatttcagtagcccgttctaccctggcaattacccaaacaatgccaagtgcgtctgggacatcgaggtgcagaataattatcgagttaccgtcatctttagggacgtacagctggagggtgggtgtaactatgattatatcgaggtgtttgacgggccttatcggtccagtccacttatagctagagtatgcgacggggcgcggggaagtttcacctcgagcagcaatttcatgagtattcggtttatctcagaccactccatcacccgcaggggcttccgcgcagaatactactccagcccaagtaatgattctactaatttactgtgtctgcccaaccacatgcaggcgagcgtttccagatcctatctgcagtcccttggcttttccgcctctgacctggttatctctacctggaatggatattatgagtgccggccacagataactcctaacctggtcatctttaccattccttattcggggtgcggcaccttcaagcaagcggataacgacacaatcgactattctaacttcctaacggccgccgtatcgggaggtataatcaaacgccgaaccgacctgagaatccacgtttcatgccgcatgttgcagaacacgtgggtggacacgatgtatatcgcaaacgatactattcacgtggcaaataacaccatccaggtggaagaagtgcagtacggcaactttgatgttaacatttccttttatacatctagctcattcctttatccggtcaccagccggccttattacgtagatcttaatcaggacctgtacgttcaagctgagatcctacattcagacgccgtgttaaccttgttcgtggacacctgtgttgcttctccttactccaacgacttcacatctctaacctatgacttgatccgctctggttgcgttagggacgacacatacgggccttattctagccctagccttagaatcgcacgtttcaggtttcgtgctttccacttcctgaatcggtttccaagcgtttacctgcggtgtaagatggtggtgtgtcgcgcgtatgacccaagctcacgatgttaccggggatgcgtgctgcggagcaagcgcgatgttggcagctaccaggagaaagtggacgttgtactgggccctatccagttgcaaacaccccctcgcagggaagaggagcctcggtag

SEQ ID NO: 14876 - DNA, 7212 bp, Artificial Sequence
  Description of Artificial Sequence: Synthetic coding sequence
atgggaatttccactgtgattctggaaatgtgcctcctttggggacaagtcctgtccaccggtggttggatccctcgcacgactgattatgcttcgctaatcccctctgaggtgccgctggatcccacggtagcagaaggctctccctttccctcggaaagcacactggaatcaactgtggccgaaggaagccccatcagcctcgagtccaccctggagtctacggtcgctgaaggatccttaatcccctcagagtccacgctcgaatccaccgtggccgaagggagtgattcagggctggcactccgactggtcaacggagacgggcgttgtcaagggcgcgtggagatcctgtataggggatcttggggcactgtctgcgatgactcatgggacacaaacgacgccaatgtcgtctgtcggcagctgggctgtggctgggcaatgtctgcacccggaaacgcctggttcggacagggatctggccctatcgctctggacgacgtcaggtgttctggccacgaaagctatctatggagctgccctcataacgggtggctgtctcataactgtgggcacggggaggacgccggcgtaatctgcagcgcggctcaaccccagtcaacccttagacccgaatcctggcccgttcgcataagcccgcccgtgcctactgagggaagcgaaagctcactggccctgcggctggttaatgggggggaccgttgcagaggcagggtggaagttctctataggggctcttggggcaccgtgtgcgatgactactgggataccaacgatgctaatgtggtctgtcggcaactcggatgtggatgggctatgagtgcaccagggaatgcccagttcggccaggggagcggcccaattgtgttggacgatgtcaggtgttcaggacacgagtcatatctgtggagctgcccgcataatggctggcttactcacaattgtgggcactccgaggatgcaggggtgatttgtagcgcacctcagagtcggcccactccaagccccgacacctggcccacctctcacgcctccacagccggccctgagtcctccctcgccctgagattggtgaatggaggcgacagatgtcagggaagagtggaagtgctctaccgcgggtcctggggaaccgtgtgcgacgattcttgggacacctcagacgctaacgtggtgtgtagacagctgggctgtggctgggctacatccgctccaggaaatgctcggttcgggcagggtagtggtcctattgtcctagacgatgtgcgatgcagtgggtacgagtcttacctgtggtcatgcccacacaatggatggttaagtcacaattgtcagcatagcgaagatgccggcgtgatttgttccgacaccctgccaaccatcacgttaccagccagtaccgtgggttcggaatctagtctcgcacttcgattagttaacggtggcgacaggtgtcagggtagagtagaagtactctaccgcggatcctggggcacggtctgtgatgactcctgggacacgaatgatgccaacgtggtgtgcaggcagctgggctgtggatgggcaatgctggcccccggcaatgctcggttcggtcagggaagtggacccatcgtgctggacgacgtgaggtgttcaggtaacgaaagctacttatggagctgccctcataacggatggctgagtcataactgtggtcattctgaggacgctggggttatttgttctggacccgaaagctccttagcactcagattggtgaatgggggagacagatgccaaggaagggtcgaagtgctgtatcgaggttcttgggggaccgtgtgtgacgatagctgggacactaatgatgctaacgtggtgtgcagacagttggggtgtggctgggccactagtgcgcccggcaacgcacgctttggccaaggctccgggccaatcgttttggatgatgtacggtgcagtgggcacgaaagctatttatggagctgtcccaataacggctggctcagtcacaattgcggccaccatgaggacgcaggcgtcatctgctccgcagcacagagtcggagcaccccacgtccagacaccctctcaaccatcacactgcccccaagcacagtcggctcagagagcagtctaacactgcggctagtgaacggatccgataggtgccagggtagggtagaggtgctgtatcggggtagctggggcaccgtgtgcgatgattcttgggatactaatgacgctaatgtggtgtgtagacagttgggctgtggctgggcgacatccgccccaggaaacgcacgctttggccagggcagcggcccgattgtgttggatgacgtacggtgctctgggcatgaatcttatctgtggagctgcccccataacggctggctgtcacacaattgtggacaccatgaggatgcgggggtgatttgctccgtgtcgcagagcaggccgacccccagtcctgatacctggcctacttctcacgcaagcactgccggtccagaaagctcactggcgttgaggttggtcaatggaggcgatcgctgtcaggggagagtcgaagtgctctatagagggtcatggggtacggtctgcgacgattcctgggatacctctgacgctaatgtggtctgtcggcagctgggatgcggttgggccacttcagcaccggggaatgctaggttcggacagggaagcggtcctatcgtgctagacgatgttagatgttccggatacgaatcctatctatggagttgtccacacaacggttggctgagtcacaattgtcaacacagcgaggatgcaggtgtaatttgctctgcagcccattcttggtccactccatctcctgacacgctccctaccattactctccccgcctccacagtggggtccgaatcctcactcgccctccggctggtcaacggaggtgatcgatgccagggcagggtggaggtgctctaccagggatcttgggggactgtgtgcgacgatagctgggatacaaatgatgcaaacgtggtgtgcagacaactcggttgcgggtgggctatgagtgctccggggaacgcaagatttggtcagggttcaggacccattgtgctggacgacgtccgctgcagcgggcacgagagctacctttggtcgtgtccccacaacggttggttgagccataattgcggccattcggaggacgcaggagtcatctgcagcgcaagtcagtcccgcccgactcctagtcctgacacctggcctaccagccacgcctccactgctggttcagaaagtagcctggccctgaggctcgtcaatggcggagatagatgccaaggacgagtggaggttctttaccgggggagttggggcactgtctgcgatgattattgggacacgaatgatgcaaacgtggtgtgtcgccagctgggatgtggctgggccatgagtgctccaggtaacgctcgcttcgggcagggctcagggcccattgtgcttgacgacgtgcggtgcagcgggcacgagtcttatctctggtcatgccctcacaacggatggttaagccataattgtggacatcacgaagacgcaggcgttatctgttctgcaagccagagtcaaccgacaccgagccctgacacttggccaaccagccacgccagcacagctggaagtgagagttcgctggccctcaggcttgtgaacggcggcgatcggtgccagggtcgagtggaagtgttgtataggggttcttggggaacagtctgtgatgattattgggacaccaatgacgccaatgtagtctgccgtcagttaggctgcggctgggctaccagcgcaccgggaaatgcccggtttggacagggaagcggaccaattgtgttggacgatgtgcgttgctccgggcacgaatcttacctttggtcgtgtccccacaatgggtggcttagccacaattgtgggcatcatgaagatgccggggtcatctgttcggccagtcagagccagccgaccccctcccctgatacctggccgacatcccatgcctccacagccggaagcgagtccagtttagctctgcggctggtgaatggtggcgaccggtgtcaagggcgtgtggaagttttgtaccgggggtcatggggcaccgtgtgtgacgactactgggatactaatgacgctaacgtcgtgtgcaggcaactggggtgcggctgggccacatctgcaccaggtaacgcccggtttggtcaagggagcggccccatcgtcctcgatgacgtgagatgcagcggacacgaatcatacctgtggtcctgcccgcataacggctggctttctcataattgtggacatcacgaggacgcaggagtgatctgcagcgcctcccaatcacagcctaccccatcaccagacacgtggccaacatcccgcgcctccactgctgggagtgaatccaccctggcacttcgccttgtgaatgggggtgatagatgtagggggcgggtggaggtgctgtaccaaggcagttggggtactgtttgtgatgattattgggataccaacgatgccaatgtggtctgtcgtcagctgggatgcgggtgggccatgtccgccccagggaacgctcagttcggtcagggttccgggccaatcgtccttgatgatgtccgttgctcaggacacgagagttacctgtggagctgcccccacaacggatggctttcacacaactgtggacaccacgaggacgccggtgtgatttgctccgccgcccaaagccaatctactccgcggccggacacatggctgactacgaatctccctgcgctgaccgtgggttctgaatcttccctggcattaagactggtcaacgggggcgacaggtgtagaggccgcgtggaggtgctttaccgcggaagctggggcaccgtttgcgacgactcatgggacactaacgatgcgaacgtcgtctgtcggcagctcggctgtggttgggctatgtcagcccccggcaatgccaggttcggccagggtagcggccccatcgttttggatgatgttaggtgctcgggcaacgaaagctacctatggagttgccctcataagggatggctaactcacaactgtggccatcacgaggatgctggcgttatctgctccgcaacacaaattaattctacaacaacggactggtggcatcctaccaccaccactacagcccgtccttcatccaactgcggggggtttcttttttatgccagtgggacatttagttctccatcttatcccgcttattaccctaataacgcaaagtgcgtgtgggaaatagaagtcaacagcgggtacagaatcaacctggggttctccaacttgaagctggaagctcatcacaactgctcgtttgattacgtcgaaatcttcgacggcagtctgaacagctctctactgttaggcaaaatctgtaacgacacccgccagatattcacctcatcatataaccggatgacaattcactttagatccgatatttctttccagaacacagggtttcttgcttggtacaactcctttccttctgacgctactctgcgtttggtgaacctgaattcgagctatggcctttgcgccggcagagtcgaaatctatcatggcggcacttggggcaccgtttgcgatgacagctggaccatccaggaagccgaggtagtctgtcggcagcttggctgcggaagggctgtaagcgccctcgggaacgcttactttgggtcgggttcaggtccgataactttagacgacgtggagtgtagtggcaccgaaagcactctgtggcagtgccggaatcggggctggtttagccacaattgtaaccaccgggaggatgcgggtgtgatctgctcaggaaatcacttgtctacaccagcgccctttttgaacattactagaccaaacactgactattcctgtggggggttcctcagccaacctagcggtgacttctcctccccattctatccgggaaactatcctaataacgctaagtgcgtgtgggacatcgaagtgcagaataactatcgggtgaccgtcatctttagagatgttcagctggaaggtggatgtaactacgactatattgaggtgtttgatggtccctataggtcctctccgcttatagcccgggtgtgtgacggcgcccgcggttcattcacgagctcctccaactttatgtcaattcgcttcatttctgatcacagtattacgaggagaggattcagggccgagtactattctagtcccagcaacgactctactaaccttctctgcctgcctaaccacatgcaagctagcgtgtcaaggtcatatctgcagagcctaggattttctgcaagtgatctcgtgatctcgacctggaacggttattacgagtgtcgccctcagataaccccaaacctcgtgatatttacaataccgtacagcggatgtgggacattcaagcaagcggataacgacacaatagattactctaatttcctgaccgccgcggtcagcggcggcataatcaagcgccgcactgatttaaggatccacgttagctgtcgcatgctccagaatacctgggtagacactatgtacatagcaaacgacacaatccatgtggctaacaacacaatacaagtcgaagaggttcagtatggcaattttgacgtgaacatttcattctacacctcttcatcatttctttacccagtaacatctaggccctattacgtggatctgaatcaggacctttacgtgcaggctgagatccttcatagcgacgcagtgttgacactgttcgttgatacatgcgtggcttctccgtacagcaatgacttcacctccctgacttatgatctgatccgatccggatgtgtgcgagatgatacctacgggccctattcttctccatctctccgaattgccaggtttcggttcagggctttccatttcttgaacaggtttccctctgtctatttgagatgtaagatggtggtctgccgcgcgtatgacccaagttctcggtgttaccggggctgcgtattgaggtccaagagggacgtcgggtcctaccaggaaaaagtagacgtcgtcctcggccccattcagctccaaactccaccccgccgggaggaggagccgaggtag

SEQ ID NO: 14877 - DNA, 1680 bp, Artificial Sequence
  Description of Artificial Sequence: Synthetic coding sequence
atgaccattcatttcaggagcgacattagctttcaaaacacgggtttccttgcttggtacaactcattcccctccgatgcgacactgcgcctggtgaaccttaactcttcctacggactgtgtgctggccgagtggaaatttaccacggagggacttggggaaccgtatgcgacgattcatggacaatccaggaagctgaggtagtttgccggcaattaggctgtggtcgggccgtgagtgccttgggcaatgcctactttggcagtgggagcggaccaattaccttggatgacgttgaatgttcgggcaccgaaagtacgctgtggcaatgccgcaaccgaggttggtttagtcataactgtaaccaccgggaggatgccggcgtgatttgctccggcaaccacctcagtacgccggcaccgttcctcaacattacccgcccaaatactgactacagctgcggcgggttccttagtcagccctcaggagacttcagctctccattctaccctgggaactaccctaacaatgctaagtgtgtttgggacatcgaggtgcagaataactacagggtgacagtcatatttcgagacgtccagctggaagggggctgtaattatgactacatcgaagtgtttgacggaccataccgttcatccccactgattgctcgagtgtgcgacggtgctcgcgggagtttcacttctagtagcaacttcatgtctattaggttcatatccgatcattccatcacaaggaggggcttccgggcagaatactattcatctccatccaacgattctaccaacctgctgtgtctgcccaatcatatgcaggcctcggtgtctcggagctacttacaaagtctcggcttcagcgcgagcgatcttgtaattagcacctggaatggttactatgagtgtcgcccgcagataactccgaatctggtcatattcacaattccgtacagtggatgtggtaccttcaagcaggcagataacgacacaattgactacagcaatttcctgacagcggccgtgagcggtgggattatcaaacggcgcaccgacctgcgaatccatgtttcatgtcgcatgttacagaatacctgggtggacacgatgtacatcgccaacgatactatccatgttgctaataacacaatccaggtggaggaagtccaatatgggaacttcgatgtgaacatatccttctatactagtagttcttttctgtacccagtgaccagcagaccctattacgtggacttaaatcaggatttatacgttcaggcagaaattctgcatagcgacgccgtcctcaccttatttgtggatacctgcgtcgcttctccatactcaaatgatttcacaagcctgacctacgacctcatcaggtccgggtgcgtgagggatgatacctacggcccatactcaagtccctctctgaggatcgcaaggtttcgttttcgcgccttccatttcttaaaccgctttccctccgtgtaccttcggtgcaaaatggtcgtctgtcgggcctatgaccccagttctaggtgctacagaggatgtgtgctccggtccaaacgagatgtcggatcttatcaggaaaaggtggatgttgtcctcggacctatacagctgcaaactcctcctaggagggaggaggagccgagatag

SEQ ID NO: 14878 - DNA, 3402 bp, Artificial Sequence
  Description of Artificial Sequence: Synthetic coding sequence
atggggataagcactgtgattctggagatgtgcctcctttgggggcaggttctgtcaaccggcggatggataccccggactacggactatgcctcgctgatcccaagcgaagtcccccttgaccccacggtagccgaaggatccccatttcctagcgaaagtacccttgaatctaccgtggccgagggtagcccaatatcattagaatccacactggaatcgaccgttgccgaggggtctcttattcccagcgaaagtacgttagagagtactgtggccgagggctctgatagcggtctggcactcagattagttaacggagacggccgttgccagggcagggttgaaattctttacaggggctcctggggtacagtgtgtgatgatagttgggacactaacgatgcgaacgttgtctgtcgtcagctgggctgtggctgggctatgtcagcacctggaaatgcttggttcgggcaggggagtggtcctatcgccctggacgatgtgcgctgtagtgggcacgaatcctacttatggtcctgcccccacaacgggtggctgagtcacaattgcggccacggggaggatgcgggcgtgatatgctcagcaccgcagagtcggcctacacccagtcccgacacgtggcctactagccacgccagcacggcaggaagcgaatcatctctcgcgctccgcttggtgaacggtggtgacaggtgccaggggcgtgttgaggttctctaccgcgggtcctggggcaccgtctgtgatgactattgggataccaatgacgccaatgtggtgtgccgacaactgggctgcgggtgggccacctcggctcctggcaacgcaaggttcggacaggggtctggtcctatcgtcctggatgacgtgcgctgcagcggtcatgaaagctatctttggtcttgcccacacaacggctggctgtctcacaactgtggacatcacgaggatgccggtgtcatttgctcagcatcccagtcccagcctacaccatccccagacacgtggccaacttctcgcgcatccaccgccggctcggagtccacattagcccttcgcttggtgaatggcggagaccgctgccgaggacgggtggaggtgctgtaccaggggagttggggaacagtatgtgatgactactgggacacgaacgacgcaaacgtcgtgtgccggcagctggggtgcggttgggcgatgtccgctcctgggaacgcccagttcggtcagggtagcggacctattgtgctggacgatgtgaggtgctcggggcatgaaagctatctgtggtcctgcccacataacggttggctttcccacaactgcgggcatcatgaagacgctggtgtgatctgtagcgcaactcagatcaacagcacaactacagattggtggcaccctacgaccaccactacagcacgccctagttctaactgcgggggctttctgttctacgctagcggcaccttctcctctccctcgtatcccgcctactaccccaataatgccaagtgcgtgtgggagatcgaggtgaactccggctataggatcaacctgggatttagcaacctaaagctggaggcacaccacaattgttctttcgactacgtggaaatatttgacggatcgctcaactcgtccctgttattaggtaagatctgcaacgacacaaggcagatttttacatccagctacaataggatgaccattcactttcgttctgacatctcatttcagaatacgggattcctggcatggtataactcctttccaagcgacgccacattgcggctggtcaacttgaattctagctatggtctctgtgctggccgcgtcgagatataccacgggggaacatggggcaccgtatgcgacgatagttggacgatccaggaagccgaggtggtctgccgccagttagggtgtggaagagctgtgtccgcattggggaacgcatactttggctccggtagtggacccataaccctcgacgacgtggaatgtagtggaacagagtctactctgtggcaatgtcgcaacagaggctggtttagtcataactgcaaccaccgcgaggatgccggagtgatttgtagcggtaatcatctgtcgactcccgcccctttcctcaacattacacgacccaacacagattactcttgcgggggctttctgagccaaccctccggcgattttagctcccctttttaccctggaaactaccccaataacgctaagtgtgtgtgggacattgaggttcagaataattatcgtgtgactgtgattttcagagatgtacagctagaagggggctgtaactacgactacatcgaagtgttcgacggcccttatagatcaagcccacttattgcgcgggtatgcgatggcgcacggggatcctttacaagcagctctaatttcatgagtatacgctttatctctgatcatagcattacgcgccgtgggttcagggctgagtattattcttctccatccaatgactctaccaatctattgtgcctgccaaaccatatgcaggccagtgtctcaagaagctatttgcagagcctgggctttagcgcctctgatctcgttataagcacctggaatgggtactatgaatgtcgcccacaaattaccccaaacctagttatcttcaccatcccctatagcggatgcggtacctttaaacaggctgacaacgatacaatcgattactccaacttcctaaccgccgcagtgtcagggggaattattaagcgcaggaccgacctgagaatccatgtcagctgtaggatgttacaaaacacatgggttgatacaatgtacattgctaatgacaccattcacgtggcaaataatacaattcaagtggaggaggtgcaatatggcaattttgatgtgaatatcagtttttatacatcatccagcttcctctaccccgtgactagcaggccctactatgtggaccttaaccaagatttatatgtgcaggctgagatcctgcatagcgacgccgtactaacgctgtttgtcgacacatgtgtggccagtccctatagtaacgatttcacttcattgacttacgatttaatcaggtcaggatgtgttcgcgatgacacctacggcccttattccagcccttcacttcgtatagctcgcttcagattcagagcctttcacttcctcaaccggtttccatccgtgtatctgagatgcaaaatggtcgtgtgcagagcctatgacccttcctcccgctgttaccggggctgtgtactacgcagtaaacgagatgtaggatcctatcaggagaaggtcgacgtggtgctgggccctatccagcttcagactccaccaagacgcgaggaagaacccaggtag

SEQ ID NO: 14879 - DNA, 7242 bp, Artificial Sequence
  Description of Artificial Sequence: Synthetic coding sequence
atggggataagcactgttattctggagatgtgtcttctctggggccaggtgctgtccaccggaggctggatacctcgtacaaccgactacgccagtctaatcccctccgaagtacccctggacccaaccgtagctgagggatcaccattcccatctgaaagcacactggagagcacagtggctgaaggctcacctattagcttagaaagtacccttgaaagtactgtggctgagggctccttaatcccatccgaatcaacactggagtctaccgttgcagagggctctgacagtggtctcgcacttcgactagtgaacggtgacggacggtgtcagggcagggtggaaattctttaccggggctcatggggaacagtctgcgacgacagctgggataccaatgacgccaatgtagtgtgtcgtcagttaggatgcggatgggccatgtccgcccccggcaacgcgtggttcgggcagggctctggtccgatcgcgctagacgatgtgagatgctccggccacgaaagctacctgtggtcatgccctcacaacggctggttgtcccacaattgcggccatggggaggacgccggggtgatttgctctgctgcccagccgcagtcaacgttgcggcctgaaagttggccagttagaatctccccccccgtgccaacagagggctccgagtctagcttggcgctcaggctggtgaacgggggagatagatgtaggggccgcgtagaggtattgtaccggggcagctggggaactgtgtgtgatgattattgggatacgaacgacgccaatgtggtttgcagacagctggggtgtggatgggcaatgtcggcccctggtaacgctcagtttggtcagggcagcgggccgatcgtgctggatgatgtgcgttgttccgggcacgaatcgtatctgtggtcttgtcctcacaatggttggctgactcacaactgtgggcatagtgaggatgccggtgtcatctgttcagccccccagtcgcggccaaccccctctccggacacttggccaacatcacacgcgtcgaccgccggacccgaatcaagcctcgccctcaggctggttaacggcggtgaccggtgccagggccgggtcgaagttttgtacaggggaagctggggcacagtttgtgatgatagttgggatactagtgacgcaaatgtggtgtgtcgtcagctcggctgtgggtgggccacctctgcaccggggaacgcccgctttggccaaggatccggccccatcgtcctcgatgatgtaagatgcagtggctatgaatcctacctgtggagctgtcctcacaacgggtggctgtcccataattgccagcactccgaggatgcaggagtgatctgtagtgcggcccacagttggagcactccaagccctgataccttgccgactatcacactgcccgcctccactgttgggtccgaatcatctctggccctgagactggtaaatggcggtgatagatgtcaggggagagttgaagtcctatatcgaggcagctggggtaccgtatgtgatgacagctgggataccaacgatgctaatgtggtctgcagacagctggggtgcgggtgggcgatgctcgcgcctggaaacgcgagatttgggcagggtagcggtccaatcgtgttggatgacgttcgatgttcaggaaacgaatcgtatctgtggtcttgtccgcacaacgggtggctttcacacaattgtggtcatagtgaagatgctggcgtgatatgctctggccccgagagctcactggctttaaggctggtcaacggtggtgaccggtgtcagggtcgagtagaagtcctttatagggggtcttggggcacagtatgcgatgattcttgggacacgaatgacgccaacgtggtttgccggcagctgggatgcgggtgggccacatcagcgcctggcaacgcacgatttggccagggatctggcccgatagtattggacgatgtgcgatgtagcggccacgagagctatctgtggagttgtccgaataacggatggctctctcacaattgcggacaccacgaggatgccggggtcatctgcagcgccgctcagtctagatcaactcctaggcccgataccctgtccactatcactctacccccctcaaccgtgggatcagagtcgagcctgaccttgcgcttagttaacggctccgatcggtgtcaaggtagggtggaggtgctctatagaggcagctgggggacggtctgtgacgactcgtgggacaccaatgacgctaacgtggtttgtagacagttgggctgcgggtgggcaacaagtgcccccggaaacgcgcgattcggacagggcagtggacccattgtcctggacgacgtcagatgctcaggccatgaatcatatctgtggtcatgccctcacaatggctggctgtctcataattgcgggcaccatgaagatgccggtgtgatctgcagtgtaagccagtcccgcccaaccccatcacccgacacctggccgacatcacacgctagtacagccggccccgaatccagcctcgctcttcgactggtgaatgggggcgatcgttgtcagggccgtgtggaggtcctgtatcgcggcagttggggcacagtgtgcgacgactcatgggacacgtccgacgccaatgtggtgtgccgccagcttgggtgtggatgggctacatctgctccggggaacgctcggtttgggcagggctctggacccattgttctggacgatgtgaggtgttcaggttatgagtcctacctgtggtcctgcccccataatggatggctatcacataactgtcaacattccgaggacgctggggtaatctgttccgcagcccatagttggagcacacccagtccagataccctgcccaccatcacacttcccgcatccacagttggcagcgaatccagcctcgcactgcgacttgtcaatggcggagatcggtgccagggccgcgtcgaggtcttgtaccaaggaagctggggaaccgtgtgcgatgactcctgggacaccaacgacgcaaacgttgtgtgccggcagctgggatgtggctgggctatgagtgccccgggcaatgcgaggtttggacaaggaagcgggccgatagtgctggacgatgtacggtgtagtggccatgagagttacctgtggagctgcccccacaatggatggctgtcccataactgcggccacagcgaggatgcgggggtcatttgctctgcctctcagtctaggcctacaccgtcccccgacacctggcccaccagccatgcctccacggcaggctcagagtcctcattagccttgagactggttaacggcggggaccgatgccaaggtcgcgtggaagttttatatcggggttcatggggcacagtgtgtgatgactattgggacacaaacgatgccaacgtggtgtgccgccagctgggatgtggatgggcaatgtcggcaccgggcaacgctaggtttgggcaagggtcaggccctatcgtcctcgatgacgttagatgcagcggccacgagtcctacctctggagctgcccgcataacggttggcttagccacaattgcggtcaccatgaagacgccggcgtgatctgcagcgcctctcagagtcagcctactcctagcccagacacctggcccactagtcacgcctctaccgcaggctctgagtcctctctggccttgagactggtcaacggtggcgatagatgtcaggggcgggtggaagtgctgtaccgcggctcttggggaacggtgtgtgacgattactgggataccaatgacgctaacgtagtctgtaggcagctgggttgcgggtgggcaacctctgcacctgggaatgctcgcttcggccaggggtccggcccaattgttcttgacgatgtccgctgtagcggccatgagtcctacctgtggtcctgcccccacaacggctggctgagtcataactgcggtcatcacgaggacgccggggttatttgcagcgcctcccagtctcagcctacaccatctcccgatacatggccaacatcacacgcatcaaccgcgggaagtgagtcctctcttgccctgagactcgtgaacgggggtgataggtgtcaggggcgggtagaggtgctgtacagagggagctgggggacggtgtgcgatgactactgggacactaacgacgctaatgttgtgtgtaggcagctgggatgtggatgggcaacatccgctccagggaacgcccgttttggccagggttccgggccaatcgtgctagatgatgtccggtgctcaggccatgaatcatatctatggtcttgcccccacaacggttggttatctcataattgcgggcaccatgaggatgccggcgtcatttgtagtgcttcgcaatcccagcccacgccttcacctgatacctggccgacctcacgcgccagcacagccggctcagagagtacccttgcactgaggctcgtgaacggcggagatcgctgccgcggacgagttgaggtcctttaccagggtagctggggcactgtatgcgatgactattgggatacaaatgatgcgaatgttgtttgtcggcagctcggttgcggatgggcaatgagcgctcctggcaacgcccagttcggacaagggtccggtcccatcgtcctcgacgatgtgcggtgctctgggcatgagtcatatttatggtcatgcccacataatggctggctgagtcacaactgtgggcaccatgaggatgctggcgtgatttgttccgccgctcaaagtcagtcaacaccacggcccgacacatggctgacaaccaacctccctgccctcaccgtcgggtcagaatcttcacttgccctcaggctggtgaacggaggagataggtgtcgaggacgtgttgaggtcctgtacaggggctcctggggcactgtttgcgatgacagctgggatactaacgacgccaatgtggtgtgcaggcaattaggatgcgggtgggcgatgtctgcgcctggtaacgcacggttcggccaaggctccggacctatcgtgttggacgatgtgcggtgcagtggcaacgagtcatacctctggtcatgcccacacaaggggtggctgacacataactgcgggcaccatgaggatgcaggagtcatatgctccgcaacgcaaattaatagcacaacgacagattggtggcatcccacaaccacgacaacggctcgacctagcagtaactgtggagggttcttattctatgcaagtggaaccttttcctctcccagttatcctgcctactatcccaataacgccaagtgtgtctgggagatcgaagtcaacagcgggtaccgcatcaacctggggttcagcaatctgaaactggaggcacaccacaactgtagtttcgattacgtcgagatcttcgacgggagtctaaattccagtttgctgctgggcaaaatctgcaacgacacccgtcagatttttacatccagctataataggatgaccatacacttcagatctgacataagctttcagaacacaggcttcctcgcctggtacaactccttccccagcgacgcaactctcagactggtgaatttaaactcatcttacggactttgtgcgggtcgcgtggagatatatcacggggggacatggggcaccgtatgcgacgactcctggacaattcaagaggccgaggttgtatgtcgtcagttggggtgcgggcgggccgtgtccgctcttggcaacgcctattttggcagcggctctgggccaattaccctggatgacgtagagtgttcagggacggagagtactctatggcagtgccgaaatagaggctggttctcccataattgcaaccacagggaggacgcgggagtcatttgctccggaaatcatttatctacccctgcacccttcctgaacattacacgccccaacaccgattacagctgtgggggatttttgagtcagccatcgggcgatttttcgtctccattttaccccggcaactaccccaataatgctaagtgtgtttgggatattgaggtgcaaaataactaccgagtgaccgtcatctttcgggatgtccagcttgaggggggttgcaactacgattacattgaagtcttcgatggcccctatcggtctagcccgctgatcgcgcgggtgtgtgatggtgctagaggatcttttacgagtagctcaaactttatgagcatcaggttcatctcagatcattccatcacccggaggggattccgggcagagtattactccagtccatcaaacgatagcaccaacttactgtgcttgcctaaccatatgcaggcctctgtgtccagaagttaccttcagagcttgggcttttcagcctccgacctggtaattagtacctggaacgggtactacgagtgccggccgcaaattacgcccaacctagttatcttcaccatcccctatagcgggtgcgggacattcaagcaagcagacaacgatactatagattatagtaacttcctcacagccgctgtgagtggcggaattattaagaggcggactgatttgcgtattcatgtgtcatgcaggatgttgcagaacacgtgggtggacacaatgtatatcgccaacgatacaatccacgtggctaacaacaccatacaggtggaagaagtgcagtacggcaatttcgatgtgaacatttctttctatacatcatcttctttcctgtaccccgttaccagtaggccctactatgtggacctgaatcaagatctttacgtccaggccgagatcttacactccgacgctgttttaaccctttttgtcgatacctgcgtggcttctccctattccaacgacttcactagcttaacctatgacctgatcagatcagggtgcgtgcgggacgacacatacggaccctatagctccccatcgttacggatcgctcgttttaggtttcgcgccttccatttcctaaatcggtttccatctgtgtatctaaggtgcaagatggttgtctgccgtgcatacgacccctcatctaggtgctacaggggatgcgtgcttaggtctaagagagacgtagggagttaccaagagaaggtagatgtcgtgctcggtcctatccagctccagaccccaccccgtcgagaggaagaacccagatag

SEQ ID NO: 14880 - DNA, 7629 bp, Artificial Sequence
  Description of Artificial Sequence: Synthetic coding sequence
atggggattagtaccgttatcctggagatgtgtttgctttggggacaagtgctctccaccgggggttggatcccaagaacaaccgattacgcaagtcttattccctccgaagtccctctggacccaaccgtggctgaggggtcgcccttcccctccgagagcacattggagagcacggtggcggaaggatctcctatatctctggagtcaactctggagtcaactgttgcagagggtagcctcatcccgagtgagtctaccctggaatccaccgtagcagagggctccgactcgggtctggccctgcgccttgtgaatggcgacggccggtgtcaggggcgggtggaaatcctctatagaggctcttggggtactgtctgtgacgattcttgggacactaacgatgcaaacgtggtttgcagacaactgggttgtggatgggccatgagcgcacccggcaacgcgtggtttggccaggggtccggtcccatcgccctggatgatgttcggtgcagcggtcacgaatcttacctgtggtcctgtccgcataacggctggctgtcccataattgtgggcacggcgaggatgccggggttatctgcagcgctgctcagcctcagagcacactgcggccggagtcatggcccgtgcgcatctccccaccagtgcccacagaaggtagtgagagcagcttggccctaaggttggtgaacggaggggataggtgtcgcgggagggtcgaagtgctgtaccgcggcagctggggaaccgtgtgcgacgactattgggacactaatgacgcaaacgtcgtgtgccggcagctaggctgtggttgggctatgtccgctcccgggaacgcacagttcggacagggaagcgggccaattgtgctcgacgatgtgagatgctcaggccacgagtcgtacctatggtcttgtccccacaatggttggctgactcataattgcggtcactcagaagacgccggggtgatctgctccgcaccacaatcaagaccaacgccttcaccggatacgtggccaacttctcatgcttctacggccggtccggagagttcactggccctgcgattagtgaatgggggggaccgatgccagggacgtgttgaagtgctctaccgtgggtcctgggggacggtctgcgacgactcatgggacactagcgatgcgaacgtggtttgccggcagctgggctgtggctgggccacatccgcacccggaaacgctcgctttggccaaggctccgggccgatcgtgcttgacgatgtcaggtgtagcggttatgagagttacttgtggagttgcccgcacaatgggtggcttagtcataattgccagcactcagaggacgccggggtgatatgctccgccgcacattcctggagcactccatctcctgacactctccccaccattacactccctgcctcaaccgttgggagcgaatctagtttggccctacggctggtgaatggcggagaccgttgccagggtcgcgttgaggtgctatatagagggtcatggggcacggtgtgcgatgacagttgggacacgaacgatgccaacgtggtgtgcaggcagctcggatgtggctgggctatgcttgccccaggcaatgcgaggtttggacaaggaagtggaccaatcgtgcttgacgatgtcagatgctcgggaaatgagtcttatctgtggtcttgtccccacaatgggtggttatcgcacaactgcggacatagcgaagacgccggggttatttgcagtgggccagagtcatctctggcccttcggctcgtcaatggcggcgataggtgccagggaagagtggaagttttgtatcgcggctcctggggcacagtctgtgacgactcttgggacaccaacgacgccaatgttgtgtgccgacagctgggctgtgggtgggcaacttccgcaccaggcaacgccaggtttgggcaaggaagtgggcccatcgtcttggacgacgtccgttgttcaggtcatgagtcttatctctggtcatgtcccaacaatgggtggctctcccacaactgcgggcaccacgaggacgccggagtcatttgttccgccgctcagtctagaagtacgcccagacctgatacactctccaccattaccttgccgccgagcaccgtggggagtgaatctagcctgacattaagattggtcaacgggtctgatcgatgccaggggcgcgttgaagtgctgtatcgcgggtcttggggcaccgtgtgtgacgatagttgggataccaatgacgcgaatgtggtttgtcgtcagctcggttgtggctgggccacttcagcgccaggcaatgctcggttcggccagggctccggaccgattgtcctggacgacgttcgttgctcaggacatgaatcttatctgtggagttgcccccacaacggctggctatcacataactgtggtcatcacgaggacgcaggtgtgatatgtagtgtctctcagtctaggcctaccccgagccccgacacttggccaacctcacacgcaagcactgcaggccctgaatcgagcctcgccttgcgactcgttaacggaggcgaccgctgtcagggacgcgtagaagtattatatcgtggcagctgggggacagtctgcgatgatagctgggatacatctgacgccaatgtagtgtgcagacaactggggtgtggctgggccacgtctgcaccaggcaacgctcgcttcggccagggctccggacccatcgtgctcgatgacgttcgctgtagcgggtacgagtcttacctttggagctgcccccataatgggtggctgagtcacaattgccagcattcggaagatgctggggtaatctgtagcgcggcacactcctggtccaccccgtccccagacaccctgccgacaatcactctgccagccagcaccgtgggctcagaaagctccttagctctgcgacttgtgaatggcggggatcgctgccagggccgcgtggaagtgctatatcaggggagttggggcacagtgtgtgacgattcgtgggatacgaatgatgctaatgttgtgtgccgtcaactgggatgcggctgggctatgagcgcacctgggaacgcccgatttggacagggttctggtcccattgttctggatgacgtcagatgctccggccatgaatcctacctgtggtcttgcccacacaacggctggctgtcgcacaattgcggacactcggaagacgcaggcgtaatctgtagcgcttctcagtcccggcctacaccaagtccagatacatggcccacctcacacgcgtcgactgcaggaagtgagtcttcgctggccctacgcctcgtgaacggaggagaccgttgccagggccgcgtggaagtcttgtataggggttcctggggaaccgtttgtgacgactattgggacaccaatgatgcgaatgtagtctgtcggcagttgggatgtggctgggccatgagcgctcctgggaacgcgagattcggccaagggtctggacctatcgtattggacgatgttcggtgttctgggcacgagtcttatctgtggagctgtccccataatggctggctgtcacacaactgcgggcaccacgaggacgccggggttatctgttctgcgtcgcagagccagccaacaccatcccccgacacgtggcctacctctcatgcatctacagctggctctgaatcttctttagctctcaggctcgtgaacggtggggaccgctgtcagggacgagtcgaggtcctctacagaggtagctggggcaccgtgtgtgacgattactgggatacgaacgatgcaaatgtggtgtgcaggcaactgggctgtggatgggctacctcagctccagggaacgcccgtttcggccaaggatccgggcctatagttctggacgatgtcaggtgcagcggacatgaatcatatctctggtcatgcccccacaatggttggctgtcccacaactgtgggcaccatgaggacgcaggcgtcatctgctctgctagtcaaagccaaccgacaccaagcccagacacctggcccacgagccatgcttccacagccggcagtgagagctccctcgcgctgcgcctggttaatggaggagatcgctgccagggccgggtggaagtcttgtacagaggctcttggggcaccgtgtgtgatgattactgggacaccaacgacgcaaacgttgtctgcaggcagttagggtgtggatgggcaacctccgcaccgggaaacgcgagattcggtcagggaagcggaccaatcgttctcgacgacgtgcgttgctccggtcatgagtcatatctatggtcatgtccccataacggttggctcagccacaactgcggccaccacgaagacgccggggttatctgttcagcaagccaaagccagcctactccgagcccagacacatggcctactagtcatgccagcacagcaggaagtgagagttcccttgcactcaggctggtaaatggcggcgataggtgtcagggccgggtcgaagtgctctaccgcgggtcctggggcacagtctgcgacgattactgggacactaacgacgcaaatgttgtatgcagacaactcggctgcgggtgggccacatcagctcctggcaatgcacgttttggccaaggctctgggcctatcgtgttagatgatgtgcgctgctccggtcacgaatcttacttatggtcttgcccccacaacggatggctttcccataattgtggccaccacgaggatgccggtgttatttgttcggcaagccagagccagccaacaccctcccccgatacctggccgacttccagagcctccacagccggttcagaaagcacattggcactgcgccttgtcaacggcggggaccggtgcaggggcagagtagaggttctctaccaggggagctggggcacggtatgcgatgactactgggatactaacgatgctaacgtggtgtgccgccagcttgggtgcggatgggctatgtctgcccctgggaacgctcagttcggacaggggtccggccccatcgtgttagatgacgtgaggtgttcaggtcacgagtcatatttatggagttgcccgcacaatggctggctgtcacataattgtggtcaccacgaagacgctggggttatctgtagcgcagcccagtctcagagcacaccacggcccgatacctggctgacaacgaatttgccggcactcacagtaggcagcgagtccagtctggcacttaggcttgtgaacgggggcgatcggtgtagaggcagagtagaggtactgtatcgggggagctggggcaccgtgtgcgatgactcctgggacacaaacgacgccaatgtggtgtgccgacagttggggtgcggttgggctatgagcgccccaggaaatgcacgttttgggcaaggcagcggaccaatcgtgctcgacgatgtgcgatgcagtgggaacgagtcatacctctggtcttgtccccataaagggtggctgactcataattgtggccaccacgaagatgctggcgttatctgctctgctacgcagatcaattctactaccactgactggtggcaccctactaccaccacaaccgcaagacccagctcaaactgcggtggatttttgttctacgctagcggcacattttccagcccatcttatcccgcctactatcctaacaacgccaaatgcgtgtgggaaatagaggtgaattcgggctacaggattaacctggggttcagtaaccttaagctggaagcccatcataattgcagcttcgactacgttgagatcttcgacggcagcctaaattcctccctactcctaggaaagatatgcaatgatacgcggcagattttcacttcaagctacaaccggatgaccatccactttaggagcgatattagttttcagaatactgggttcctggcctggtacaactcatttccatctgacgctactctgaggcttgtaaacttaaattcaagctacggcctttgcgccggtcgcgtggagatataccacggcggtacctggggtaccgtctgcgatgattcttggaccattcaagaagcagaagtcgtttgccgtcagcttgggtgcggaagagcagtgtcagccctaggtaacgcttactttgggagcggaagcggacccattacactggatgatgtagagtgcagtggaactgaatccacactatggcagtgtcgaaaccgcggctggttctcgcataactgcaaccatcgggaggacgctggcgtcatttgctcgggaaatcacttatctacccccgcaccattccttaacatcaccaggcctaacactgattactcatgtggcggtttcctgtcacagccaagcggagacttttcgagccccttttaccccgggaactacccgaacaacgctaaatgtgtttgggacatcgaggtccaaaacaattatagagtgacagtgatcttcagagatgttcagctcgaaggcgggtgcaactatgactatattgaggtgttcgatggcccgtatcggtcttcgcctctgattgcccgcgtctgcgacggagctaggggatcatttacctcatcaagtaattttatgtcaattcgcttcatatccgatcattctataacgaggaggggcttccgagccgagtactacagctctcctagtaatgatagcactaacctgctgtgcctgcccaatcacatgcaggctagtgtgtctcggagctacttgcagtcactgggcttctctgcctctgacctagtcatctctacgtggaatgggtactatgagtgcaggcctcaaattaccccaaacctcgtcatttttacaatcccttactctgggtgtggcacatttaagcaggccgacaatgataccattgattatagcaactttctgaccgccgccgtaagtggcggcataatcaaacggagaaccgacctgcggattcacgttagctgtcggatgctgcagaatacttgggtggacaccatgtacattgccaacgacaccattcatgttgcgaataacaccatacaggtggaggaggtccagtatggcaattttgacgttaatatctcgttctatacctctagcagctttttatatcctgttacgtcccggccatactacgtcgacctgaatcaagatttgtatgtgcaggctgaaatcctgcacagcgatgccgtgctcaccttatttgtagacacctgcgtggcttctccttacagtaacgacttcacctcgctgacctacgaccttattcgcagtggctgtgtcagggacgacacatatggcccatactctagcccatctctccgtatcgctcgttttcggtttagggcatttcactttctgaataggtttccctctgtctatctgaggtgtaagatggtggtgtgccgcgcatacgatcccagctctaggtgctatcggggctgtgtgcttcggagcaagagagatgttgggagttatcaggaaaaggtggacgtagtgttagggcctatccagctgcagactccccctaggagggaggaggagccccgatag

SEQ ID NO: 14881 - DNA, 7239 bp, Artificial Sequence
  Description of Artificial Sequence: Synthetic coding sequence
atgggaatcagtacagtcatcctcgaaatgtgtctgctgtggggtcaggtcctgtccacaggtggctggataccacgcactactgactatgcatccctgataccatcagaagttcccttagatccaacggttgccgagggctcacctttcccatccgaatcaacacttgagagcacagttgccgaaggctcacccatctcactggagagtactctcgagtccacagttgcagagggcagtctgatacctagtgaatcgacactggaaagcaccgtggccgagggctctgacagtgggttggccctgagactggtcaacggagacggacggtgtcagggcagggttgaaatcctgtataggggaagttgggggacggtgtgtgacgacagctgggatacaaatgatgccaatgtggtatgtagacagctgggctgcgggtgggcgatgtctgcccccggcaacgcctggtttggccagggcagcggcccaattgctttggacgatgtgcgctgtagcgggcacgagagctacctgtggtcatgcccacataatgggtggctatcccataactgtggccatggagaagacgcaggagttatttgctctgcagcccagccgcagagcacactgcggccggaatcatggccagtgcggatcagtccacctgtgcccacggaaggaagcgagtctagtttggctctgagactggtgaacggtggtgacagatgccgggggagggtagaagtcttgtatagaggctcatgggggactgtctgtgacgactattgggatacaaatgacgcgaatgtcgtgtgccgacagctcgggtgtggttgggctatgtccgctcccggcaacgcccagtttggccagggatctggcccaatcgtgctggacgatgtccggtgtagcggacacgaatcctacttgtggtcatgtcctcacaatgggtggcttacccataattgtgggcactctgaagacgccggagttatctgctctgccccccagagccgccccactccatcacctgacacttggccaaccagccatgcgagtaccgccggccccgagtcttctttggcgctgcggctggtgaacggcggagataggtgccagggacgcgtggaagttctctacaggggcagctgggggaccgtttgtgacgatagctgggatacatccgacgctaatgtggtgtgccggcaactcggatgcggatgggctacctcggcacctggaaacgccaggtttggacaagggtcggggccaatagtactggacgatgtgagatgctccgggtatgaaagctacctttggagctgcccacataacggatggctgtcgcacaactgccagcacagtgaagacgctggtgtcatctgttccgctgcacactcttggtctaccccctcaccagataccctgccaactattaccttacccgcgtccacggtcggcagcgaaagcagtctcgctctgcgtcttgtcaacgggggcgaccggtgtcagggtagagtagaggtcctatatcggggttcttggggcacggtgtgcgatgatagctgggatacgaatgatgctaatgtggtatgtcgacagctgggctgcggttgggccatgctcgcaccagggaatgctaggttcggacagggttctggtcctatcgtcctggatgatgtgcgctgcagtggtaacgagagctacctgtggtcctgccctcataacggctggttaagtcataattgtggccatagtgaagatgctggtgtgatttgctccggtccagagtcttctctggccctgaggctcgttaatgggggtgacagatgtcaggggagagtagaagtgctttatcgcggaagttggggaacagtttgtgacgactcttgggacaccaacgacgcaaacgtggtatgtcggcagcttggctgcggatgggctaccagcgctccaggaaacgccagattcggacaaggatcaggtccaattgtcctggatgatgtcagatgcagcggacacgagtcctacctctggtcgtgccccaataatgggtggctgagtcacaattgcgggcatcacgaggatgcaggagtgatatgctccgcagctcagagtcgctctactcctagacccgacactctgagcactatcacactgccgccgtcaaccgtgggctccgaatcatcgcttactctccgtctggtgaacggcagcgatagatgccaaggaagagtggaagtcttatatcgagggagctggggaactgtttgcgacgacagctgggacactaacgatgctaacgtagtatgtaggcaactgggatgtggatgggctactagcgcaccaggcaacgctaggtttgggcagggctctgggccaatagtgctggacgatgttcgttgcagcggccatgagagctacctgtggtcttgcccccacaacgggtggctttcccataattgcggacatcatgaagatgccggcgtcatttgttcagtctcccagagccggccaactccaagcccggacacatggccaacttcacacgccagcaccgctggacctgagtcctcactggcacttcggttggtgaatggaggcgatcggtgtcagggccgagtggaggtgctgtacagggggagctggggaacagtctgcgacgactcttgggatacctcagacgccaacgtagtctgtcggcagcttggttgcggctgggctacgtcggctccagggaatgcccggttcggccagggcagtggtcctattgttcttgacgacgtgagatgctctgggtatgagtcatacctgtggtcctgtccccacaatggatggctttcacataactgccagcacagcgaagacgccggggtgatctgcagtgcagctcattcttggtccacccccagtccagataccctgcccaccattacattgcctgccagcaccgtcggctctgaaagtagcttggcattgcggcttgtgaacggcggggaccgatgtcaggggcgggtcgaggtgctataccagggttcctggggcacagtgtgtgacgactcctgggacactaatgacgccaacgttgtgtgtagacaactgggatgcgggtgggcaatgtctgcccctgggaacgcaaggtttgggcaaggcagtgggcctattgtcctcgacgatgtcaggtgctccggccacgagagctatctatggagctgtcctcataacggctggctatcacataattgtggccactccgaggatgccggagtcatctgttcggcttcccagtcgcggcccacaccatctcccgacacttggcccaccagccacgcctctactgccggctctgaatcctcacttgcattacgcctggtgaacggtggtgaccgatgtcagggacgagtcgaagtgctgtatcgaggatcatggggcactgtttgtgacgattattgggacaccaacgacgcgaacgttgtctgtagacagctcggctgtggttgggccatgtcagcccccggcaacgccagattcggtcagggaagtggaccaattgtgttagacgatgtgcgctgctcgggtcacgaatcctacctgtggtcctgtcctcataatggttggctgagtcataactgcggacatcatgaagatgctggagttatctgctctgcatcccagagtcaacccactccatctcccgatacatggccgacgtcgcatgcgagtactgctggaagcgaaagctcgcttgccctgaggctcgttaacggcggtgatcgctgtcagggtcgggtagaagtcctttacagggggagctgggggacagtatgcgacgattattgggacacaaacgacgctaatgtggtatgccgacagctggggtgtggctgggccaccagcgccccaggaaacgcacgttttggccaggggagtggccctatcgtcttggatgacgtaaggtgtagcggccacgaatcctacctttggtcttgtccgcacaacggctggctctcacataactgcgggcaccatgaagatgctggggttatctgctccgcctctcaaagccagccaactccctctccagatacatggcctacctcccacgcatctactgccggaagtgaatcttccctggccctgcgcttagtgaatggcggcgatagatgtcagggcagagtagaggtgctttaccgagggtcttggggaacagtgtgcgacgattactgggacaccaacgatgctaacgtggtatgtagacagctgggctgcggatgggccacaagcgctccaggaaatgcccgtttcggtcaaggaagcggacctatcgtgcttgatgatgtgcgatgttctggccacgagagctacctgtggtcttgtccccataacggttggcttagtcacaactgtggccatcatgaagacgccggggtaatttgcagcgcctcacagtcgcaaccaacaccgagtccagacacgtggccaacgagcagagccagcactgccgggagcgaatccacacttgcgcttcgcctggtgaatggtggcgacagatgcaggggccgggtcgaagtgttgtaccagggcagttggggcaccgtgtgtgatgactactgggatactaacgacgcaaacgtggtgtgccgacagctgggatgcggatgggctatgtccgcgcccggtaacgcccagtttggacaaggctccggacccatcgtcctcgacgacgtgagatgtagtgggcatgaatcctacctgtggtcgtgcccacacaatggatggttgagccataactgtggccatcacgaagacgcaggagttatctgttccgcagcccagagtcaatccactcctagaccagatacgtggttgactacgaacctgcctgccctgaccgttggcagtgagtctagtctagcactgcggctcgtcaacggcggcgacagatgtaggggtcgggtcgaagtgctgtaccgtggctcttggggcaccgtttgtgatgatagttgggacactaacgatgccaacgtggtatgccgccaacttggttgcgggtgggccatgagtgcacctggaaatgccagattcgggcaaggcagcggccctattgttctggatgatgtaagatgctcaggcaacgagagctacttatggtcatgccctcacaaaggatggctgacacacaattgcggtcatcacgaagacgctggcgtgatatgcagtgccacccagatcaatagcactaccaccgattggtggcatcctaccaccaccacaacagccaggccgtcctctaattgcggggggttcttattctacgcgagtggcaccttctcgagtccttcctatccggcctactatcctaacaacgccaaatgtgtgtgggagattgaagtgaattccggttaccggattaatctggggtttagcaacctcaaactggaggcgcatcacaattgttccttcgattacgtggaaatcttcgacggctccctaaattcttcactgcttctgggcaagatctgtaatgacacaaggcagatcttcacctcatcgtacaaccggatgaccatccactttagatcagatatctctttccagaacacagggttcctggcttggtacaatagtttcccctccgacgccaccctgcgactggtcaatctaaactcatcctatgggctgtgtgccggccgggtggagatttatcacgggggcacctggggcactgtctgcgacgatagctggacaatacaggaagccgaggtggtgtgtcgccagctggggtgtgggcgggcagtgagcgcgctaggaaatgcatacttcggaagcggatccggcccaattacactggatgacgtcgaatgttcaggaactgagtcaacattatggcagtgtagaaacagggggtggttttcccataattgtaatcacagagaggatgctggagtgatatgcagcggaaatcacctctccacacctgccccttttttaaacattacaaggcccaacaattacagttgcgggggttttctgagtcagccttccggcgacttctctagccccttctaccctgggaactacccaaataacgcaaagtgtgtatgggatattgaagtacagaacaattaccgtgtcacagtgatatttagggacgtccagcttgaaggggggtgcaattatgactatatcgaagttttcgacggaccataccggagctccccactaatcgcacgggtctgtgatggggcacggggctcctttactagtagttccaactttatgagcattaggttcatttccgaccacagcatcactcgtcggggctttagggcagaatactatagtagcccttccaatgacagtactaacctgctgtgtctacctaaccatatgcaggcatctgtgtctaggagctacctgcagagcctcggtttctcggcttcagatctggtgattagtacctggaacggctactatgaatgcaggcctcagattacccctaacctggtgatctttacaattccctactctggttgtggcacttttaaacaggccgacaatgatactatcgactactctaacttcctcaccgccgctgtgagtggaggaatcatcaaacgccggaccgaccttaggatccatgtcagctgtagaatgttgcaaaacacctgggtggataccatgtatattgccaacgacacgatccatgtggcaaacaatacgattcaggtggaagaagtgcagtacggtaattttgatgtcaatatctccttctatacatccagctcattcttgtaccctgttacctctagaccctactacgtggatctcaatcaggacctctacgtacaagccgagatcctgcactcagatgccgtccttaccctcttcgtcgacacgtgcgtggcaagtccctatagcaacgactttacctcacttacgtatgacctgatccgaagtggctgcgtgcgcgacgacacatacgggccctactcttcaccgtcattaaggatagcacgcttccggttccgggccttccactttctcaacagatttccgtctgtttaccttagatgcaaaatggtggtgtgtcgggcctacgatccatccagccgttgctatcgaggctgtgtcctcagaagcaagagggacgtgggcagctatcaggagaaggtagacgtggttctggggcctatccagctccagacgccccccagacgtgaggaggagccccgctag

SEQ ID NO: 14882 - DNA, 7242 bp, Artificial Sequence
  Description of Artificial Sequence: Synthetic coding sequence
atgggtattagtactgtaattcttgaaatgtgtctgctttgggggcaagttctgtcgacaggggggtggatcccccggaccacagactatgcttccctaattccttctgaggtgcccctcgaccccacagtggctgaaggaagccccttcccgagcgagtcaaccttagagtctacagtcgcagaaggctcccccatatcacttgagagcacgctggagagcacagtggctgagggcagcctcataccttctgagtcaacactcgagagtaccgttgctgagggctctgattcgggattggccctacgtctcgtaaatggggacggccgttgccagggcagagtggaaattctctaccgaggatcctgggggaccgtatgtgacgactcatgggatacaaatgatgcaaatgttgtgtgtcgacagctagggtgtggttgggcgatgtctgcccccggcaatgcctggtttggtcagggctcaggacctatcgcgctcgatgatgtgagatgtagtggacacgagtcatatctgtggagctgtccccacaatggttggttatcacataattgtggacacggcgaagatgcaggagtgatctgttccgccgctcagccacagtcaactttgcgcccagaatcctggccagtgcgaatcagtccaccagtgccaacggaaggatccgagtcatcgttggcccttaggttagttaatgggggtgaccgctgtagaggcagggtcgaggtgttgtatcgcggatcatggggaactgtctgtgatgattactgggacaccaacgacgctaatgttgtttgtcgtcagcttggctgcgggtgggccatgagtgctccgggaaatgcccagttcggacaaggaagcggacctattgtgctcgatgatgtgagatgtagtggccatgaaagctatctttggtcatgtccgcacaacggttggctgacacacaactgtggacattctgaggacgccggagtaatttgctccgcccctcaatcccgccctaccccctctcccgatacctggcccacctcccatgcgtcaacggcaggccccgagtcttctttggccctccgcctggtcaacggaggggacagatgtcagggacgggtagaggttctgtaccgtgggtcatggggaaccgtctgcgacgatagttgggacaccagcgacgcaaacgtggtatgccggcagttaggctgcgggtgggcgactagtgctcccggtaatgctaggttcggccaggggagcgggcccattgtccttgacgatgtccgctgcagcggctatgagtcatacctttggtcttgtccgcataacggctggttatcacacaactgccagcacagtgaagacgcaggcgtcatatgctccgctgcccacagttggtccacaccaagccccgatacgctaccaactattacactacctgcatctaccgtcggaagcgagtcaagcctggccctgcgactcgtaaacggcggcgacaggtgccagggccgtgtggaagtgctgtaccgaggttcgtggggaactgtctgtgatgactcctgggatacaaacgacgccaatgtagtctgccggcaactgggctgcggctgggctatgctggccccaggcaacgccagattcgggcagggttctgggccaattgtcctggatgatgtcaggtgctcaggtaacgagagttatctgtggagctgcccccataatggatggctgtcacacaactgcggtcactcagaggatgctggagtcatttgttccggacccgaaagctcgctcgccttgcggctggtaaatggcggcgaccgatgccaaggcagagttgaggtgctatacagaggctcttggggaactgtgtgtgacgactcttgggacaccaacgatgcgaatgtggtgtgtcgccagctgggttgcggttgggctacaagcgctcctggcaatgcacggtttggccaggggtcaggacctatagttctggatgatgttaggtgttccggacatgagtcgtacttgtggtcgtgccccaataacggctggctcagccataactgcggccaccacgaagatgccggtgtgatatgctcggcagcccagtctagatctactccacgcccagacactctctctactattactctgcctccgagcactgtgggtagcgaatccagcctgactctgaggcttgtgaatggctctgacaggtgccagggtagagtcgaggtgctgtaccgtggctcatggggaactgtttgtgatgattcctgggatacaaatgacgccaacgtcgtgtgcagacaactaggttgcggttgggcgacgtcagcgcctggcaatgcacgcttcgggcagggcagcgggcccatcgttttggacgatgtccgttgtagtgggcacgagagttacctgtggagctgcccgcacaatggctggctaagccataattgcggccatcatgaggacgccggagttatatgttcagtgtctcagagccgtcctacaccatcccctgacacctggcctaccagccatgccagcacggctgggcccgaatcctctctagcactgagactggtcaacggcggtgaccggtgccagggaagagttgaagtcctctacagggggagttgggggactgtctgtgatgattcctgggatacatcagacgctaatgtggtctgcagacaactcggctgtggctgggcaacctccgcccctggcaacgccaggtttggccagggaagcggaccaatcgtgctggacgacgtgagatgttctggatacgaaagctatctctggtcatgtccccataacggatggctttctcacaactgccaacacagtgaagatgcaggcgtcatctgttccgccgctcacagttggtcaacaccatccccagacacacttcctaccataacccttcccgctagcacagtggggagtgaatctagtttagctctaagactcgtaaacggtggagatcggtgccaggggcgtgtggaagtgctgtatcagggttcctggggtaccgtttgtgacgatagctgggatacaaatgacgccaacgtcgtgtgcagacaactggggtgcgggtgggccatgagtgcccctgggaatgcgcgctttggtcagggttcagggcccattgtgctggacgacgtgcgctgttcagggcacgaatcctacctgtggtcgtgtccacataacggctggctgagtcataactgtggccatagcgaagatgccggcgtaatttgctcggcttctcaatcaaggcctacaccaagccccgacacttggcccacctcacatgcgtccaccgccggaagtgagagcagcctggccctgcgcctagttaacgggggggaccgatgccagggaagagtcgaggtcttgtaccgtggtagttggggcactgtgtgcgacgattactgggataccaacgacgccaacgtcgtgtgtagacaactggggtgtgggtgggcaatgtctgccccgggaaacgccagatttggacagggttctggccctatagtcctagacgatgtgcggtgttcaggacacgaaagctatctctggtcttgtcctcacaacggctggttgagccacaattgtggtcatcacgaggacgccggcgtgatctgcagcgccagtcaaagccagcccaccccctcccctgacacctggcctacgtcacatgctagcactgcggggtcagagagcagcctcgcgctgcgacttgttaacggcggcgaccggtgccaaggtcgcgtggaggttctgtaccggggtagttggggcactgtgtgtgatgactactgggacactaatgacgccaacgtggtgtgccgacagctgggttgcggctgggccacctcagccccaggaaatgcgaggtttgggcagggatcagggccaatagtgctcgatgatgtgagatgtagcgggcacgaaagttacctgtggtcttgcccacacaatggttggctgagccataactgtgggcatcatgaggatgccggtgttatctgtagtgcgagccaaagtcaaccaactccctcgcccgatacatggccaacctcccatgctagcaccgcaggttccgaatcaagcctggcactgcgtttggtgaacgggggcgatcgctgccagggccgcgttgaagtactctataggggttcttggggaaccgtgtgtgatgactattgggacactaatgatgctaacgtggtgtgtaggcagctcgggtgtggttgggctaccagtgccccgggcaacgctcgatttggacagggttctggccccatcgttctggacgacgttagatgctccggccacgagagctacctttggtcctgtcctcataacggttggctgtcgcacaattgcggacatcatgaagacgccggcgtgatatgctccgcctcgcagagccagcctactccaagcccagacacgtggcccacctctagggcctccaccgccggaagcgaaagtactctggccctgcgtctggtgaacggtggagataggtgcaggggtcgcgttgaagtcctctatcaaggatcgtggggcacagtgtgcgacgactattgggacacaaacgacgcaaacgtggtgtgcaggcaacttggatgcggctgggctatgagtgctcccgggaatgctcagttcggacaggggagcggacccatcgtcctagatgatgtgagatgctctgggcacgagtcgtacctttggtcctgtccacacaatggttggttaagccacaattgtggccatcacgaagacgcaggagtcatctgttctgccgctcagtctcagtcaacccccagaccagatacgtggctgactaccaacttgccagccctcacagtcggcagtgagtcatcccttgcccttaggcttgtgaacggaggcgaccgatgcagaggacgagtggaggtcctgtatcgcggaagctggggcaccgtgtgtgacgatagctgggacacgaatgatgccaatgtcgtgtgtcgccaattaggttgcgggtgggccatgtccgcacctggaaacgccaggtttggtcagggctccgggcccatcgtgctcgatgatgtgcgttgtagcggaaatgaaagctatctctggagctgcccgcacaaaggctggcttactcataattgcggtcatcatgaggatgctggggtgatttgtagcgcgacccagataaattctacgacaacagattggtggcatccgaccactactacaacagctcggccaagctcaaactgtggtggattcttattttatgcttcgggcactttttcgtcacctagctatcctgcctattacccaaacaacgccaaatgcgtctgggagatcgaggtgaactccggctatcgaataaacctaggattttccaatctcaagctcgaggctcaccacaactgctcgttcgattacgtcgagatttttgatggatctctcaacagttcgcttctccttggaaagatctgtaatgacacgagacagatctttacatcttcctacaaccggatgaccatccacttccgatcagacatctctttccagaacacggggttcctcgcatggtacaactccttcccttccgatgccaccctccgccttgtcaacctaaactcatcttacggcctgtgtgccggccgggtagagatctaccatgggggaacctggggaactgtgtgcgacgacagttggaccattcaggaagccgaagtagtgtgtcggcagctcggctgtggacgtgccgtgtccgctctggggaatgcctacttcgggagcgggtctggacccataacactggacgacgttgagtgctccggaacagagagtacactgtggcaatgcagaaatcgcggttggttttcccataactgtaaccatagggaggacgctggcgtgatctgctccggcaatcacttatcaacaccggcgccattcctgaatatcacaagaccaaatactgattacagttgcggaggcttcctgtcacaacctagtggggacttttcctccccgttttacccgggcaactatccaaataacgccaaatgcgtctgggatatagaggtgcaaaacaactatagggtgaccgtaatttttagagacgtacagctggaggggggctgtaattatgactacatcgaagtcttcgatggaccttatagatcatcaccactgatcgcccgggtatgcgatggtgctcggggctcctttacaagctcatccaacttcatgagtatacgattcatctcagatcattccataaccaggcgcgggtttcgtgcagaatattactcaagccctagtaacgactcgactaacctgttatgtctgcctaaccatatgcaggccagcgtcagccgctcttatcttcaaagtctcggctttagcgcatccgacctggtcatatccacatggaacgggtactatgaatgccgcccccagatcacgcctaaccttgtgatatttaccattccctattctggatgcggtacgtttaagcaagctgacaacgacaccattgattatagtaattttctgaccgcagctgtgagtggcggcatcatcaagcggcgcactgatctccgaatccacgttagctgccgaatgttgcagaacacatgggtggacacaatgtatatagccaatgacacgatccatgtggcaaataatacaatacaggtggaagaggtccagtacggaaacttcgacgttaacatctccttttacacctcctcttcatttctgtacccggtgacctccagaccttactatgtggacctgaatcaggacctctacgtccaagctgaaattcttcactcagacgctgtccttaccttgttcgtggacacatgtgtggccagcccctactccaacgactttacatcactaacctatgatctgataaggtcgggatgtgtgcgggatgacacctatgggccatatagcagcccatccttacgcatcgctcgttttagatttagagcttttcacttcttgaacaggtttccaagtgtgtacttgcgctgcaaaatggtggtgtgcagggcctacgaccctagctcccgctgctatcgcggatgcgtcctacggtccaagagggatgtcggctcctatcaagaaaaggtagatgtggtgcttggacccatccagctgcaaactccaccccgaagggaggaagagccaaggtag

SEQ ID NO: 14883 - DNA, 7212 bp, Artificial Sequence
  Description of Artificial Sequence: Synthetic coding sequence
atggggatctcaactgttatcctggagatgtgcctgctatggggccaggtgctgtcaactggaggatggatcccccggaccacagactacgcttccttgatcccctccgaggtccccctggatcccaccgtcgctgaaggatctccattcccctcagagagtacacttgaaagcacagtcgcagagggctctccaatctctttggaatccacactcgagagtacggttgccgaaggcagcctgatacctagcgagtccaccctggaaagtaccgttgcggaggggtccgactccggcctcgcactcaggctggtgaacggagatggccgctgccagggtagagtggagattctttatcgcgggtcatggggaactgtatgtgatgattcatgggatactaacgacgcgaacgttgtctgtagacaacttgggtgtgggtgggccatgtccgctcccgggaacgcctggtttggtcaggggagcggacctattgcccttgatgatgtgcggtgttccggccacgagagttacctgtggagctgccctcataacggatggctgtcccataactgcgggcatggtgaagacgccggggtcatttgcagcgccgctcaaccacagtcgactctgcgccccgagagctggccggtgagaatctcaccgcctgtcccaaccgagggatcggagagttccctcgcccttcgcctcgtgaacggtggggatcgttgtagagggcgtgtcgaggttctgtataggggcagttggggcactgtgtgtgatgactattgggatactaatgacgccaatgttgtatgtaggcagcttgggtgtggatgggccatgtcagcgccaggtaatgctcagttcggacagggtagcggccctatcgtgctcgatgatgtgaggtgttctggacacgagagttacctctggtcctgtccccacaatggatggttgacccataactgtgggcacagtgaggacgcgggagttatttgttccgcacctcagtcacggcccaccccgtcccccgatacttggccaacctcacacgcctctaccgcaggaccagaaagctctctggctctgaggctggtaaatggcggagaccggtgccaggggcgggtcgaagtcctttatagagggtcttggggaactgtgtgcgatgactcctgggacaccagcgatgccaacgtagtatgtcgacagttgggatgtggttgggctacctccgctccagggaatgctaggtttggacagggttcaggccctatcgtgctggatgatgtgcgctgctcaggttatgagtcatatctgtggagttgtcctcacaatggatggctaagccataactgccagcactcggaggacgctggagtcatatgctcagataccctgcccactattacactcccagcatccactgtgggctcggagtcctcccttgccctgaggctagtgaacggaggggatagatgtcaaggacgcgtggaagtcttatatcgcggaagctgggggacagtgtgtgacgactcatgggatactaacgacgccaacgtcgtttgccgccaactgggctgtggctgggccatgctggcccctgggaatgcccggttcggacagggctctgggcctatcgttctagacgacgtccggtgttctggaaacgaatcctacctttggtcttgtccgcacaacgggtggctcagccacaactgtgggcactcggaggacgcaggcgttatttgttcgggacccgagtcctctctcgcacttcgcttagtgaacggtggtgaccgttgccagggacgcgttgaggtactttaccggggaagctggggaactgtctgtgacgattcctgggacaccaatgacgcaaacgtcgtttgccgacagctggggtgtgggtgggccacaagtgcaccaggcaatgctcggttcggccagggtagtggacctattgttcttgacgatgtacggtgttcaggccacgagagctatctctggtcttgtcccaacaatgggtggctctcccacaactgtggtcatcacgaagacgctggcgtgatatgtagcgctgcccagagcagatcaacccccaggcctgacactctttctaccatcacattgccaccgtccacagttgggtcagagagtagccttacccttagactggtcaatggatccgacagatgtcagggaagggtcgaagttctttatcgagggagctgggggactgtctgtgacgactcatgggatactaacgatgcaaatgtggtgtgccggcagctgggatgtggttgggctacctctgctccaggcaatgcgaggtttggccagggtagcggtccaatcgttctcgacgacgtaagatgcagcggtcacgagagctacctgtggagctgtccacacaacggttggttgtcccacaactgcggccatcacgaagatgcaggcgttatatgctctgtcagccagagccgcccgacaccttccccagatacatggcccacgtctcacgctagcacagccggaccagagagctctctcgccctgagactggtcaacgggggagaccggtgccaaggacgggttgaagtgctgtatcgtggatcttggggtactgtatgtgatgattcatgggataccagcgatgcgaacgtggtgtgcaggcagctgggttgtggatgggccacctcggcaccaggcaacgcacgcttcggccagggctctggtccaatcgttttagacgacgtgcgctgctcgggttacgagagctacctctggtcgtgcccgcataatgggtggctgtcacacaattgccagcactcggaggacgcaggagtgatatgcagtgcagcacattcttggtctaccccttctcccgacacattgcctacaatcacattaccggcttcaactgtggggtcggagtccagcttagcccttaggctagtgaatggtggtgaccgctgccaaggccgggtcgaggtgctctatcagggtagctggggcactgtgtgcgacgattcctgggacacaaacgacgctaatgtcgtgtgccgccagctcggctgcggttgggctatgtcagctcccggaaacgcccgctttggccaggggtccggccctatcgttctggatgatgtgaggtgtagtggccacgagagttatctctggtcctgcccccacaatggatggctgtcccacaactgtgggcacagcgaagacgcgggcgtaatctgcagcgcttcacaatctcgccccacgccatcccctgatacctggcccaccagtcatgccagcactgctggatcggaatcttccctggcactccgcttggtgaatggaggagaccgatgccagggccgggtcgaagttttgtatagagggagctggggtaccgtgtgtgatgactactgggacacaaatgacgcaaatgttgtttgcagacagctcggatgtggctgggctatgtctgcccctggcaacgcccggtttggtcagggctcgggaccaattgtactggacgacgtgcggtgttctgggcatgaatcatacctctggtcatgtccccataatggctggctgtcacataactgtggacaccacgaggacgccggagtcatctgttctgcatctcagtcacagcctacacctagtccggacacttggccaacatcacacgccagtacagcgggttctgagagctctctggccctgcggttagttaacggtggcgacaggtgccagggaagggttgaagtgctatacaggggtagctggggtacagtgtgtgatgactattgggatactaacgatgcaaatgtcgtgtgtaggcagctggggtgtggatgggcaacaagtgccccgggaaatgccagatttggtcagggctctggtcccatcgtcttggatgatgtgcgttgttctggccatgaatcctacctgtggtcttgtcctcacaacggctggctttcccacaactgcgggcatcacgaagacgctggtgtcatttgttctgcttctcagtcgcagccaaccccaagtccggacacttggcctacttctcacgccagtaccgccggctccgagtcaagtctcgcactccgcctggtgaacggaggagatcgatgtcaaggcagggtagaggtgctgtatcgtggcagttggggaaccgtttgtgacgattactgggacaccaacgatgcgaacgtagtctgtcggcagttgggctgcggctgggcaacaagtgccccaggtaatgcccgcttcggccagggaagcggtccaatcgtgcttgacgacgtgcgctgtagcgggcatgaatcatatttatggtcatgcccccataacgggtggctctcacataactgcggccaccatgaagacgctggggtcatctgttcagcatctcagtcccagcccacgccttcacccgacacctggccaaccagtcgtgcttcgactgcaggctctgagagtacactcgcattgaggctggtaaatggcggcgatcgctgtaggggacgggttgaggtcctctatcagggaagctgggggacagtctgtgatgattattgggacactaatgatgccaatgtggtctgccgccagttaggttgcggctgggccatgagtgctcccggtaatgcacagttcgggcagggcagcgggcccatcgtgctcgatgatgtccgatgttctggccatgagtcatatttatggtcctgccctcacaacggctggctgagccataattgtggacaccacgaagatgcaggtgtcatctgttcggccgctcaaagccagtccacccccaggcccgacacctggctgactaccaacctgcccgccctcactgttggttcagagtctagcttggccctccggctggtgaacgggggggaccggtgccgtggccgggttgaggtcctgtatagaggaagttgggggacggtttgtgacgactcctgggataccaacgatgcaaatgtggtgtgccgccagctcgggtgtggatgggcgatgagcgctccaggaaacgctaggttcggacagggcagcggtccgatcgttcttgatgatgttaggtgcagtggcaacgaaagctatttatggtcttgtccccataaggggtggctgacacataattgcggacaccacgaggacgcaggtgtgatttgttccgcaacgcaaattaactccactactacggattggtggcatccgacaactaccacgaccgctcgcccttcctccaattgcggagggttcctgttctacgcgtctggcactttttcttccccctcctatcccgcctactaccccaacaatgccaagtgtgtgtgggagatcgaggtgaattcagggtatcggattaatctgggattttcgaatctgaaattagaggcccaccataactgcagctttgactacgtggagattttcgacggaagcctcaattcgtccctccttcttggaaagatttgtaatgatacaaggcagatctttacctcctcatataaccggatgaccatacattttcggagtgacatatcctttcaaaacactggatttcttgcatggtataatagttttccatctgacgcaacattacgtcttgttaatctgaactcgagctacggcttgtgcgccggacgagtggagatataccatggggggacctggggcacagtctgtgacgactcatggacaatccaggaggcggaggtggtttgcagacagctcggatgcggtagggcagtgagtgccctgggcaatgcgtattttggaagcggcagcggcccaataactctggacgacgtagaatgcagcggcaccgagagcactctctggcagtgtaggaacaggggctggttcagccacaattgcaatcatcgggaagacgctggcgttatttgctccggcaatcatctgagcacccccgcccccttcctcaacatcacgaggcccaataccgattactcttgtggaggattcctgtcccaaccttcaggggatttctctagtcccttctatcccggaaactatccaaataatgccaagtgtgtttgggacatcgaagtgcagaacaattacagagtcacagtgattttccgcgacgtccagctggaaggcggctgcaactacgattacatcgaggtattcgacggcccctataggtcttcacctctgatcgctcgggtctgcgatggggcccggggaagcttcacgtcctcttccaactttatgagcatccgtttcatatcagatcattcaatcacccggagaggcttcagagctgagtactattcttcaccatcaaacgattctacaaatctgctttgcttgccaaatcacatgcaggcaagcgtatcacgtagctacctccagagccttggcttctctgcttctgatttagtgatcagcacctggaatggttactacgaatgtcggccccagattacacctaatttagtgatttttactattccatattctgggtgtggcaccttcaaacaggcagataatgacaccattgactacagcaatttcctcaccgccgcagtgagtggaggaattatcaaaaggcgcaccgacctgcgaattcacgtgtcctgtaggatgctgcaaaatacatgggttgacaccatgtatatcgccaatgatacaatccatgtcgccaacaatacgatccaggtggaggaagtgcagtacggcaactttgacgttaacatcagcttttatacctcttctagcttcttgtacccagtgactagccgtccgtactacgtggacttgaatcaggatctgtatgtgcaggcagagatcctccacagcgatgcggtccttactctcttcgtggatacatgtgtggctagcccttatagcaatgactttacctcactcacctatgatctcattcgttcaggatgtgttcgggacgacacgtatggcccctactcatccccttctctgcgaatcgcacgctttagattccgcgcctttcacttcttaaatagattcccgtcggtgtacttgcgctgtaaaatggtcgtgtgcagagcctacgacccctcctcacgctgttacaggggttgcgtgttgcgcagtaaaagagatgttgggagttaccaagagaaggtcgacgtcgtcctgggccccatccagctgcagacgccacctcgccgggaagaagagcctaggtag

SEQ ID NO: 14884 - DNA, 5358 bp, Artificial Sequence
  Description of Artificial Sequence: Synthetic coding sequence
atgggaatctctactgttatcctcgagatgtgtttactgtggggccaggtgttgagtactggcggatggataccacggaccactgattatgctagcctgattcccagcgaggtgccattggatcctaccgtagctgaaggtagtccctttccttcagaaagtactctggaatccacggtggccgagggcagccccatcagtcttgaatctactctggagtcaaccgtggccgaaggtagcctcatcccaagtgagagtacactcgaaagcacggtggctgaggggtcggacagtggactcgccctccggcttgtcaacggcgacggccgatgtcagggtagggttgagatcctgtacagaggctcatggggcactgtgtgcgatgacagctgggatacaaatgatgcgaatgtggtttgccggcagctgggttgtggatgggccatgagtgctccaggtaatgcctggttcggacagggctccggccccattgctctggatgacgtgaggtgctcaggccatgagtcctacttatggagctgcccccataacgggtggctcagccataattgcggccatggcgaggatgctggcgtgatttgctcagccgcccaacctcagagcaccctccgccccgagagctggcccgtgcggatctctcctcccgtacccactgaggggagcgagtcgtcattggcgctgaggctggtcaacggcggggacaggtgcagaggtcgagtagaggtgctgtatcgaggaagctggggtacggtatgcgatgattattgggatacaaacgacgcaaatgtagtctgccgccagctcggatgtggctgggcgatgagcgcgccaggtaatgcccagtttggccaggggtcgggtccaattgtcctagatgacgtccgctgctccggacacgagagctatctgtggtcatgcccgcataatggatggctcacccataactgcggacactcagaggacgctggagtgatatgttcggcacctcagtcccggccaaccccctccccagatacctggcccacatctcatgcatccacggccggtcccgaatcatcgcttgccctgcgtctcgtcaatgggggggaccggtgccagggccgcgtcgaggtgttgtataggggctcttgggggaccgtctgcgatgactcttgggatacatcagacgccaatgtggtatgtaggcaattaggttgtggctgggccacatccgcccctggaaatgcccggttcgggcaggggagtggccccatcgtattggacgacgtgagatgctctggctatgaaagttatctttggtcctgccctcataatggctggctgtcccacaattgtcaacactctgaggatgccggtgtcatctgctccgccgcccactcctggtctacaccatctccggacactctccccaccattaccctgcctgctagcaccgtgggatccgagtcctccctggccctgaggttggtaaacggcggcgatcgatgtcaggggagagtcgaagtgctttatcaaggtagttggggaacggtgtgcgacgacagctgggacacaaacgatgcaaacgtagtatgccggcagctcggctgtgggtgggccatgtcggcccccgggaatgctcgatttggccaggggtcggggcctattgtcttagatgacgtacgttgcagcgggcatgaaagttatctgtggagttgcccacataacggttggctgagccataactgtggccactcagaagacgcgggggtgatatgtagcgcgagtcagtctagacccacaccttcaccagacacctggcccacatcacatgctagtactgctgggtctgaatcatcactggctctacgtctcgtcaacggtggagatcggtgtcaaggcagggtggaggtgctataccggggcagctggggaactgtatgtgacgactattgggacactaatgatgctaacgtggtgtgtagacagcttgggtgtggttgggctatgtccgcccctggaaacgccagatttgggcagggctccggccccatcgtgcttgatgacgtccgatgcagcggtcatgaaagctacctctggtcctgccctcataacgggtggctgtcacacaactgtgggcaccacgaggatgccggcgtaatctgctccgcctcacagagccagcccaccccgtcaccggatacctggccaacttcccatgccagtactgccggctccgaaagctctctggccctgcggctggtaaatggaggcgatcgttgtcaaggccgcgtagaggtcctgtacagaggaagctggggcactgtctgcgacgattactgggataccaacgatgctaacgtagtatgccggcaactggggtgtggatgggctacctcagcccctgggaatgcaaggttcgggcagggtagcggacctattgtgctggatgacgttagatgttccggacacgagtcctacctgtggtcctgcccccataacggatggctgagccataattgcggccaccatgaagacgctggtgttatctgctccgcctctcagagtcagccaaccccatcccccgacacttggccaacctctagagcttccacagccggatccgagtccaccctcgcgttgcgtctagtcaatggcggggaccgctgtaggggtcgcgtggaggttctttaccaggggagctggggcacagtctgcgacgattattgggacaccaatgatgccaacgttgtatgcaggcagcttggatgtggttgggccatgtccgcccctggaaacgcgcagttcggccaggggtctggcccaatcgtcctggacgatgtgcgatgtagtgggcacgagagctacctgtggtcatgcccccacaacggatggttgagccacaattgtggacatcacgaggatgccggtgtaatttgtagcgctgcacaaagccagtctacaccacgtccggacacatggctgaccacaaacttgccagccctcactgtcggcagcgaatccagcctggctctgaggctcgtcaatggaggagaccgctgccgcggtagggtcgaagtgctgtaccgaggtagctgggggaccgtatgcgatgattcttgggacacaaatgacgcaaatgtcgtgtgcaggcagcttggctgcgggtgggccatgagcgcccctgggaacgcccggttcggccaaggcagcggaccaatagtgttagatgatgtgcgttgcagcggtaacgaatcatacctctggagttgtccccacaaaggttggctaactcacaactgcggtcaccacgaggatgccggagttatctgttccgccacgcaaattaactccactacaaccgattggtggcacccgacaaccaccactactgcccgcccatcgagtaactgcgggggcttccttttttatgcctccgggacgttctcatcacccagctaccccgcatactaccctaataatgcgaagtgtgtttgggagatcgaggtgaattctggctatagaataaatctggggttctcgaacctgaaactggaggcccatcataattgttcctttgactatgtggagatctttgacggttccttaaacagctcgttgctgctcggaaagatatgcaacgatacgagacaaatttttactagttcttataaccgaatgactattcacttcaggtcggacatttctttccagaatacagggttccttgcttggtataatagtttcccaagcgacgcgacccttcggcttgtgaatctaaattcatcttatgggctctgcgcaggcagagtagaaatatatcacggcggaacctggggcaccgtatgcgatgactcttggacaattcaagaagccgaggtcgtatgccggcaactcggctgcggcagagctgtgtcagcccttggcaatgcctactttggctccgggagtggcccaataaccctggatgacgtagagtgttccggcacagaaagcactctttggcaatgccggaacaggggatggttttcgcacaactgcaaccaccgcgaggacgccggtgtcatttgtagcggaaaccatctgagcacacccgcaccattcctgaatatcacaaggccaaataccgattattcctgtggcgggttcctttcccagcctagcggcgacttctcaagtccgttctatcccggcaactatccgaataatgctaaatgcgtatgggacatcgaggtgcaaaacaattaccgcgtcacggtgattttccgagacgtccagctagaagggggctgcaattatgattacatcgaggttttcgacggtccatatcgaagctcgcctctgattgccagagtttgcgacggagcccgaggctccttcacctctagctctaactttatgtcaatccggttcatttctgatcacagcattacaaggcgaggattcagggcagagtactattcctcaccctccaatgattcaacaaacctgctgtgcttgcctaatcacatgcaggctagcgtgtcacgctcctacctgcagtctttgggattctcagccagtgacctcgttatctctacgtggaatgggtactatgagtgtcgcccccagatcactccgaacctcgtgatttttaccatcccctactcgggttgcggcacgtttaagcaggcagacaatgatacaattgactactcaaactttcttacagcagccgtctccggcggaatcatcaaaaggcgaacagacctgcggattcacgtgagttgtagaatgctccaaaacacgtgggtggataccatgtacattgcgaacgataccatccacgtcgcaaacaacacgatccaggtggaagaggttcaatacgggaacttcgacgtgaacatcagtttctatacctctagctccttcctgtatcctgtgacttctcgcccctactacgtggacttgaaccaggacctgtatgtgcaggctgaaattctgcatagtgacgcggtacttaccctctttgtagacacgtgcgtggccagtccatacagtaatgacttcacaagtctaacgtatgacttaatacgcagcgggtgtgtcagagacgacacttatgggccctatagctcgccctctctgaggatagctagatttaggtttagagcattccacttcctcaatagatttcccagcgtctacttacgctgcaaaatggttgtgtgtcgtgcctacgaccctagcagccgatgctaccggggctgcgtcctaaggtctaaaagggatgtgggctcctaccaggagaaagtcgacgtggtattgggaccaattcagctgcaaacgcctccccggagggaggaggagccccgctag

SEQ ID NO: 14885 - DNA, 597 bp, Artificial Sequence
  Description of Artificial Sequence: Synthetic coding sequence
atggctgcggacatatcagaatcttctggggctgactgtaagggcgaccccagaaattctgctaagctcgacgcagattatccccttcgcgtcctgtattgcggcgtgtgttcattaccaactgagtattgtgagtatatgcccgatgtcgctaagtgccggcagtggcttgagaaaaattttcccaatgagtttgccaagctcacggtggagaattccccgaagcaggaggctgggatttctgaggggcaggggactgctggagaggaagaggagaagaagaagcagaaacgcgggggccggggtcaaatcaaacagaagaagaaaactgtgccccagaaagtcacaattgctaagattccccgcgcaaaaaagaagtatgttactagagtctgcggacttgctacattcgaaatcgatctgaaggaggcccagcggttcttcgcccagaagttctcctgcggggctagtgtgacaggggaagacgagataataatccagggcgacttcaccgacgatatcattgacgtgattcaggagaagtggcctgaggtggacgacgattccatcgaggacctcggcgaagtcaaaaagtag

SEQ ID NO: 14886 - DNA, 1530 bp, Artificial Sequence
  Description of Artificial Sequence: Synthetic coding sequence
atggaccctccacgcgcctcccacctgtctccacgaaaaaaacgccctagacagaccggcgcccttatggccagcagccctcaggatatcaaattccaggatctggtagtgttcattttggagaaaaagatgggcaccacacgacgagccttcctgatggagctggccaggcggaaggggttcagggtggagaatgagctctctgattcagtgacccatatcgtcgctgagaacaactccgggtccgatgtcttggagtggctccaggcacaaaaagtacaggtgtcatcacagcctgagctgttggatgtcagctggttgatcgagtgtattcgagcaggaaagcccgttgaaatgaccggcaaacaccagctcgtggtcaggcgggactacagtgattctaccaatcccggcccgcctaagacaccccctatcgctgttcagaagatttcacagtatgcttgccagcgccgcacaaccctcaataactgtaaccagatctttaccgacgccttcgatatcctggccgagaattgtgaatttagggagaatgaggacagctgtgtgacgttcatgcgcgcagctagcgtacttaaaagtctgccattcactatcatctccatgaaagacacagagggaattccatgtttgggatccaaagttaaagggatcatagaggagatcattgaggacggtgagagcagcgaggtcaaggccgtcttaaatgacgagaggtaccagtccttcaaactgtttactagcgtgttcggcgtcgggttaaagactagcgaaaagtggtttcggatggggttccggacactgtcgaaagtcaggtctgacaagagtctcaagttcacccggatgcagaaggccggcttcctgtattacgaggacttagtctcctgtgtgacacgggccgaggccgaagctgtgtcagttctggtgaaagaagcggtttgggcgttcttgccagacgcattcgtgaccatgacggggggctttagaaggggcaaaaagatggggcatgatgtggactttttgattacctcccccggctctaccgaagacgaggaacaactgcttcagaaagttatgaacctatgggaaaagaaagggctgctcttgtactacgatttagtcgagtcaacctttgagaaacttaggctgccatcacgcaaggtagatgctctagatcactttcagaaatgtttcttgatcttcaagctcccccgccagagggtggacagtgaccagtcatcttggcaggaaggtaagacgtggaaggcgattagagtcgacctcgttctctgtccttacgagcgcagagccttcgctctcctgggctggacaggatcccggcagtttgagcgtgatttgcgtcgatatgccacacatgagaggaagatgatcctggataaccatgccctgtacgataaaacaaaaaggatattcttaaaggctgaaagcgaagaggagatatttgcccatctcggcttggactacatagaaccttgggaaagaaacgcgtag

SEQ ID NO: 14887 - DNA, 1527 bp, Artificial Sequence
  Description of Artificial Sequence: Synthetic coding sequence
atggatccccccagagcctcccatctctctccccgaaagaagcgcccacggcagacaggggcgctcatggcaagctctcctcaggatatcaaattccaggacctcgtggtgtttatcctagagaaaaagatgggcacaacccgccgcgcattccttatggagctcgctcgcagaaaaggcttccgggtcgagaacgagctttctgactccgtgacccatatagtggcagagaataattccggcagtgacgtcttggagtggctccaggctcagaaggtgcaagttagctcacagccagagctgcttgatgtgagttggctgatcgaatgtatccgcgcagggaagcccgtggaaatgaccgggaaacaccaacttgtggttcgccgcgactattctgactccaccaaccccgggcctcccaagacaccaccaatagctgtacaaaaaatttcccagtatgcctgccaaaggagaaccactttgaacaactgcaatcaaattttcacagatgccttcgacatcctcgctgagaactgcgagttccgggagaacgaggatagctgcgtcacttttatgagagccgcctctgtattgaagagcctacccttcacaatcatttccatgaaagacacggaaggaatcccatgcctgggttccaaagtaaaggggataattgaagagatcattgaagatggagagtccagcgaggtcaaggctgtgttgaatgatgaaagatatcaatcatttaaattgtttacttctgtgttcggcgtgggcctcaaaacgagcgagaagtggttcaggatgggctttaggactctgtccaaggtgaggtcagacaagtccctgaagtttacacggatgcagaaagcaggctttttgtattacgaggacttggtgtcatgtgtgacccgcgcagaagccgaggctgtgagtgtgttggtcaaagaggctgtctgggcctttctgcctgacgctttcgtaactatgacagggggatttagacgcggaaaaaaaatgggacacgatgtcgatttcctgataactagcccagggtccaccgaagacgaggaacagcttctccaaaaagtcatgaacctctgggaaaaaaaagggctcctgttatattatgacctggttgagagcaccttcgagaaactaaggctcccctctcggaaagtggatgcattagatcatttccagaagtgttttttgatattcaaacttccaaggcagcgcgtggactctgatcagagctcatggcaggaggggaagacctggaaggctataagggttgaccttgtgctctgtccgtatgagcgacgagccttcgcactcctgggctggacaggcagtcggtttgagcgcgatctcagaaggtatgccacacacgaacgcaaaatgatcctggacaatcacgcactgtacgacaagacaaaacgcattttcctaaaagccgagagcgaagaagagatcttcgcccacttgggtcttgattacatcgagccatgggaaagaaatgcttag

SEQ ID NO: 14888 - DNA, 2544 bp, Artificial Sequence
  Description of Artificial Sequence: Synthetic coding sequence
atggaagccgccaggccttccgggtcgtggaacggcgcgttgtgccgattgctcctgctgaccctcgcgattctaattttcgctagcgatgcttgcaaaaacgtgaccctgcacgtgcccagcaaattggatgcggagaagctcgtgggccgggtcaacttaaaggagtgctttactgcagctaatctaatccatagttcagaccccgactttcaaattctggaggatggtagtgtctatactactaacactattctgctgtccagtgagaaaaggtcgttcacaatactgctctctaacaccgagaatcaagaaaagaagaagatctttgtgttcttggagcatcagacgaaagtcctgaagaagaggcatacaaaagagaaggtcctgcgcagggctaagagacgctgggcccccatcccctgttctatgttggagaatagtctgggtcctttcccgctgttcctgcaacaagtgcagtctgacacagcccagaactatactatttactattccatccgcggcccaggggtagaccaagagcctcgcaacttgttttacgttgagcgggacaccggtaacctgtattgtacgagacctgttgaccgcgagcagtatgagagttttgagatcatcgcctttgctaccactcctgatggatatacacccgaactgccgctgcctttgataatcaagattgaagacgaaaacgataattatccaatattcaccgaggagacgtacacctttactatctttgaaaattgtcgcgtggggacaactgttggccaggtctgtgccaccgataaggatgaacccgacaccatgcacactagattgaagtacagcattattgggcaggtgcctccgagtccgacacttttcagcatgcacccaactaccggtgtcatcactactacttcatcacaattagacagggaactcattgataaataccagttgaaaatcaaggtccaagacatggatgggcagtatttcgggctccagaccacgagcacatgcatcatcaatatcgacgacgttaacgatcatctccccactttcaccaggacatcctacgtgaccagcgtcgaggagaacacagtagacgtagagattttacgagttacagtagaggacaaggacctggtgaacaccgcaaattggagggcaaactataccatccttaaaggcaatgagaacggcaacttcaagatcgtcaccgatgccaagactaatgaaggcgtgctctgtgtggtgaaacccttgaactacgaagagaagcagcaaatgatactgcagatcggggttgtgaacgaagccccattttcaagagaggcctctccccgctctgctatgagcactgcgaccgtcacagtaaatgtagaggaccaggacgaggggcccgagtgcaatccgcctatccagacagtgcggatgaaagaaaacgccgaagtgggaacgaccagcaatgggtacaaggcctatgaccctgaaacccgttcctcttctgggatccgatataagaaactgacagaccctacgggatgggtgacaattgatgagaacaccggaagcatcaaagtattccgttctctggaccgcgaagccgagacgatcaagaacggtatttacaatataactgtgctggcttccgatcagggaggacgcacctgtacagggacactgggcatcatcctgcaggatgtcaacgacaactctcctttcattcccaagaagacggtgatcatttgcaagccaactatgtctagtgctgagattgtcgctgttgacccagatgagccaattcatggaccacccttcgatttttccttagaatcttccacatcagaagtacagaggatgtggagactcaaagccatcaacgatactgcggcccgcttatcataccagaacgatcctccctttggcagttacgtggtccctataacagtgcgggatcgtttaggaatgtcctcagtgaccagcctcgacgttaccctgtgcgattgcatcactgaaaacgactgcactcacagagttgacccccggatcggaggaggaggcgtgcaactgggcaagtgggccatcctagctatcctgcttggtatcgccctccttttctgtatactcttcaccttggtgtgcggagccagtggtacatccaaacagcccaaagtgataccagacgacctggcccaacagaacttgatcgtgtcaaacacagaggcgcccggagacgataaggtctatagtgcaaatgggtttaccacacagacggtgggcgcgagcgcacagggcgtctgtgggaccgtcggcagtggcattaagaatggggggcaggagaccattgaaatggtgaaaggtggtcatcaaacatccgagtcatgcaggggcgccggccaccaccacacattggattcctgtcgtggcgggcacaccgaggtagataattgtaggtacacatacagcgagtggcactcctttacacaacctcggctgggcgaggagtccatacgcggtcacacgcttatcaaaaactag

SEQ ID NO: 14889 - DNA, 2706 bp, Artificial Sequence
  Description of Artificial Sequence: Synthetic coding sequence
atggaagctgctcggcctagcggtagctggaacggagcgttgtgcaggctccttctactgaccctggccattctaatttttgcgtctgacgcatgcaagaatgtgactctgcatgttccctccaaactggatgctgaaaagctcgtcggcagagtgaatctgaaggaatgtttcaccgcggcgaaccttattcactcgtctgacccagattttcagattcttgaagacggaagtgtgtacacgaccaataccatcctgctaagctctgagaagcggtcctttaccatcttgctatccaacacagaaaaccaggagaaaaaaaagatttttgtctttttggagcaccagaccaaggtcctgaaaaaaaggcacaccaaagagaaggtcctaaggcgcgcaaagaggcgttgggctcctattccctgctctatgctggaaaactccctggggccgttcccactcttcctgcagcaagttcaaagcgatactgctcagaattataccatatattatagcattcgtggccccggagtggatcaggaacccaggaatctgttttacgtggagcgcgacactggaaacctgtactgcaccagacccgtcgatcgcgagcaatacgaaagctttgaaatcatcgcgtttgccaccacacctgatggctacacgcctgaactcccactgccgcttatcattaaaattgaagatgagaacgacaactatcctatctttactgaagaaacttataccttcacaatatttgaaaactgccgagtgggcaccacagtgggccaagtctgcgctactgataaggatgagcccgacaccatgcatacccgccttaaatactctattattggacaggtaccaccttcacctacattgttcagcatgcatccaacaaccggagtaataaccacaacttcttctcagctcgaccgcgagctcattgataaatatcagctgaaaatcaaggtccaggatatggatggacagtacttcgggttacaaactacctcaacctgcattatcaacatagacgatgtcaacgaccacttacctacattcaccagaacctcatacgtaacctctgttgaggagaatactgtcgacgtggaaatactccgggtgacagtagaagataaagatctggtaaatactgccaattggcgcgctaattacacaatccttaaggggaatgaaaatggaaatttcaagatcgtgacagatgctaagactaatgaaggagtgttatgcgtcgtgaaacctctgaattatgaagagaagcagcagatgatcctccaaatcggtgtggtgaacgaggcaccattctctcgcgaggcaagccctcgcagtgctatgtctactgcaacagtcacagtgaacgtagaggatcaagatgaagggcccgagtgtaacccaccaatccaaacagttaggatgaaagaaaacgctgaggttggcacaacttctaacggctacaaggcgtatgaccccgaaacaagaagcagtagtggtattcgttataaaaagctgacggatccaaccgggtgggtcaccattgacgaaaacaccggatcaattaaagtattccgcagtctcgatagagaagctgaaactattaagaatggcatttataatataactgtgctggcatcagaccagggcgggcggacatgcactggtaccctgggaattattctgcaggacgtcaacgataactctccattcattccaaaaaagaccgtgattatatgtaagcctaccatgtccagtgctgaaattgttgcagtggatcccgacgaacccatacatggcccccctttcgacttcagcctggaaagcagcacctctgaggtccagaggatgtggagactgaaagcaataaacgacaccgcggccaggctaagctaccagaatgatcctccatttggcagttacgtcgtccccatcacggtgcgggatagactgggaatgagcagcgtcactagccttgacgtgacactgtgcgactgtatcactgaaaatgattgtacccatcgggtcgatccgcggattggggggggcggtgtgcagctaggcaagtgggcaatattggcaatattgctcggcatcgcactgctcttttgcatactctttactttggtttgcggcgcttcagggacgtccaaacagcccaaagtgattcctgacgatctcgcccagcagaacctaatcgtgagtaacactgaggccccgggtgacgacaaagtctacagcgcaaacggcttcactacccagactgtcggggcatccgctcagggcgtgtgcggaacagtgggcagcgggattaaaaacggcggacaagagacaattgagatggttaaggggggtcatcagacatccgagtcgtgtagaggagcaggacaccaccacactttagactcatgccgtgggggccacacagaggtggacaactgccggtacacctattcagagtggcactccttcacccagccgagattgggtgaaaaggtgtacctgtgcaatcaagatgagaatcataaacatgcccaggactacgtgctgacctataactacgaaggcagaggctccgtggcagggagcgttggctgttgctctgagcgccaggaggaggatggcctggagttcctggacaatcttgagcccaagtttcgcacgctggccgaggcctgcatgaagcggtag

SEQ ID NO: 14890 - DNA, 2745 bp, Artificial Sequence
  Description of Artificial Sequence: Synthetic coding sequence
atggaagcagctcgtccatccggtagttggaacggcgccctctgtcggctactcctgctgacactggcaattctgattttcgcatcagacgcgtgcaagaacgtcaccctgcatgtgcccagcaaactggatgctgaaaagctcgtcggcagggtgaacctcaaggagtgtttcaccgcagctaatctgattcatagtagtgatcctgacttccagatcctagaggacggctcagtatacaccacgaatacaatactgctttcttcagaaaaacggtctttcaccattctgctttccaatacagaaaatcaagagaagaaaaaaattttcgtctttcttgagcaccaaacaaaaattagtctgctggtgccctggctgtgccttgtagccgaggttctgaagaagcgccataccaaggagaaggtgctgcgtcgggctaagcgcagatgggctcctatcccctgttccatgttagaaaatagccttggcccctttcctctgtttctgcaacaggtacagagtgacacagcgcagaattacactatttattatagcatccggggccccggcgtagatcaagaaccaaggaatctgttctacgtcgaaagagacaccggtaacttatattgcacccggccggtggacagggaacagtatgaatctttcgagattatcgctttcgcaactacacccgatggatacaccccagagctacctctgccactcataatcaagatagaggacgagaatgacaactatccaatctttaccgaggaaacatatacattcactattttcgaaaactgcagagttggtaccacggtgggccaggtgtgtgccaccgataaagacgagccagatacaatgcacaccaggctgaagtacagcattatcggccaggtcccgccatctcctacgcttttcagcatgcacccaacgaccggcgtgataactacaacctcctctcagttggatagagaactgatcgataagtaccaattaaaaatcaaggttcaggatatggacggacagtatttcgggctgcagacaacatctacatgcatcattaacattgacgacgtgaacgaccatctgcctacctttacccgaacttcttatgtgacgtcagtggaggaaaatacagtggatgttgaaatactcagagtcacggtggaggacaaggatctggtgaacaccgctaactggcgggctaattataccattctaaaaggaaatgaaaatggaaatttcaaaatcgttactgacgcaaagactaacgaaggagtcctgtgtgtggtgaaaccgcttaattacgaggagaagcaacagatgatcttacaaatcggcgttgtgaatgaggcacctttctctcgagaggctagcccaaggtccgctatgagcacagctacagtaactgtgaatgtggaggatcaggatgaagggccggagtgcaacccgcccattcagacagttcgcatgaaggaaaacgccgaggtcggcactacatccaacggctataaagcttacgaccccgaaacacggagcagctccgggattagatacaaaaagctgaccgatccaaccggctgggtgacaattgatgaaaatacaggatcaatcaaagtatttcgctcactggacagggaagcagagaccattaaaaacggaatttacaatattactgtccttgcatctgatcagggaggaagaacctgtacaggcaccctgggaattatcctgcaagatgtcaatgataactcaccctttattcccaaaaaaacagtgatcatttgtaagcccacgatgtcctccgccgagattgtagctgtagacccagatgagccaatccacggtccacctttcgacttcagccttgagagttccacctctgaagttcagcgtatgtggaggctcaaagccatcaatgacacagccgcacgcttgtcatatcaaaacgatccccccttcggctcgtatgttgtgccaataactgttagagatagactgggaatgtcgagcgtcacttcattagacgttacactgtgcgactgcatcactgaaaatgactgcacacatcgtgtggacccgcgcattggcggcggcggggtgcaattgggaaaatgggctatcctggccatactgctggggatcgccttactgttttgcatcctctttactctcgtttgcggagcttcgggcacctccaaacagcctaaagtcattcctgatgacctggcacagcaaaatttgatcgtgagcaataccgaagcacccggggacgataaagtgtactcagcaaacggattcaccacccagaccgtcggcgcaagtgctcagggtgtttgcgggacagtggggtcaggcattaaaaatgggggccaggagaccattgagatggtaaaaggcggccaccagacttcagagtcatgcagaggcgccgggcaccatcacaccctcgatagctgccgaggcggccacactgaggttgacaattgcaggtacacctacagtgagtggcactcatttactcaacccaggctaggggaaaaagtctatctatgtaatcaagatgagaatcacaagcatgctcaggattatgtactgacctacaattatgagggacggggaagcgtggcaggcagcgttggatgctgcagcgaacgccaggaggaagatggactcgagtttctggataacctcgagccgaagtttcgtacactagccgaagcgtgtatgaagcggtag

SEQ ID NO: 14891 - DNA, 2004 bp, Artificial Sequence
  Description of Artificial Sequence: Synthetic coding sequence
atgaagatgatcacaacccagttcctgcagaaaaaactaatattgctccagttcctgaagatcgccgagtggggcaccacagtcggacaggtgtgcgccaccgacaaggatgagcccgatactatgcacacaaggctaaaatacagcattattggacaagttcctccgtcccctaccttatttagtatgcatccgactactggtgtcatcactactacttcttcacagctcgacagagagcttatcgataaataccagctaaagataaaagtccaggatatggacggacagtactttgggctgcagacaacaagcacttgcatcatcaacattgacgacgtgaacgatcatttgcctactttcacaagaacaagctacgtgacatccgtggaggagaatacagtggacgtagaaatattacgagtgactgttgaagataaggatcttgtgaatactgctaattggcgggccaattatacgatccttaagggcaatgagaacggaaattttaaaatagtaaccgatgcgaaaaccaacgagggcgtcctttgcgtggtcaaacccctcaattatgaggagaagcagcagatgatactccagataggtgtggtgaacgaggctccctttagccgggaggcttcgccgcggagtgccatgagtactgccaccgtcacagtgaatgtcgaggaccaggacgagggcccagagtgcaaccctcctattcagaccgttcggatgaaggaaaacgcagaagttggcacaaccagtaacgggtataaggcctacgatcccgagacacgtagttcgagcgggattagatataaaaagctgaccgaccccaccggatgggtaacaatagacgaaaacaccggatccatcaaagtttttcgctccttagacagagaggcagaaactattaagaatggtatctacaacataaccgtgctggcatccgatcagggagggaggacctgtacaggcacacttggcataattctgcaggacgttaatgacaacagtccatttatccccaagaagactgtaatcatctgcaagcccacaatgagcagcgccgaaatcgtggctgtcgaccccgacgaacccatccacgggcccccttttgatttttcactcgagtcttccacaagtgaggtccagaggatgtggcgactgaaagctattaacgacaccgctgctcgcctctcctaccagaacgaccccccctttgggtcatatgtcgttcctataactgtgagggatagattgggcatgtctagtgtgacttcactggatgtcaccctttgcgactgcattactgagaacgattgcacccacagggtcgacccccggatcgggggtggaggagtgcagctagggaagtgggccattctggccatcctgctgggaatcgcgctgttattttgtatccttttcacactggtttgtggcgcctcaggcaccagcaagcagcccaaggtaatacctgacgacctggctcagcaaaacctcatagtttccaatacagaggcaccaggagacgataaggtctattcggccaatgggttcacgacccagaccgtcggcgcctccgcccagggggtatgtggaactgtaggaagtggtattaagaatggtgggcaagagaccatcgaaatggtcaaagggggccaccagaccagtgagtcttgtcgaggcgcggggcaccatcacacactagattcatgtaggggtgggcacacagaggtggataactgccggtacacttatagtgaatggcatagcttcactcagccccgactcggagaaaaagtctatctgtgtaaccaagacgaaaaccacaagcacgcccaggactacgtgctgacctacaattatgaggggcggggctcagtcgcaggatctgttggatgctgttcagaacgccaagaggaggatgggctcgagtttttagataatctggaaccaaaatttaggacattggccgaggcttgtatgaagcggtag

SEQ ID NO: 14892 - DNA, 3000 bp, Artificial Sequence
  Description of Artificial Sequence: Synthetic coding sequence
atgatgggcctgttcccaaggacgacaggagctttggccatttttgtggttgtgattcttgtacatggcgagctgagaatagagaccaagggacagtacgatgaggaagagatgaccatgcaacaggctaagcgtagacagaaacgggagtgggtgaagttcgccaagccttgtcgggagggagaagacaacagcaaaagaaatcccatagctaaaatcacctccgactatcaggccacacagaaaatcacataccgaatttcaggggtgggaatcgatcagcccccttttggcatctttgtagtagacaagaatactggcgatatcaatataaccgcaatcgtggacagagaagagaccccttccttcttaatcacctgtcgggccttgaatgcacaaggtctggatgtcgagaaacccctgatcctaacagttaagatactggatataaacgacaacccgcctgttttctctcagcagatatttatgggggaaattgaggagaactcagcaagtaattctctggtaatgattctgaacgccacagacgcagatgagcccaaccacctgaattcgaaaatcgcctttaagatcgtgagccaagagcctgctgggactcccatgttccttctgagcagaaacacgggcgaagtgaggactttaactaattcactggatcgcgaacaggcttccagttaccggcttgtcgtgtcgggggcagataaggacggcgagggacttagcactcagtgtgaatgtaacataaaagtgaaggatgtcaatgataactttcctatgttccgcgatagccagtattcagcccggatagaagaaaacatcttgtcctcggagctgctcaggttccaggtgactgatcttgatgaagaatacactgataattggctagccgtctacttctttacatccggaaacgagggaaactggttcgaaattcaaacggaccctaggacgaacgaaggcatattaaaagttgttaaggctctcgactacgagcagctgcaaagcgttaaactatcaatcgcagtcaagaataaagcggaattccaccagtccgttatctcaaggtatcgggtccaatctacgcctgtgactatacaggtcatcaatgtccgtgagggaattgcgttcaggccagcaagcaagaccttcaccgttcagaaggggattagcagcaaaaaactggtcgattacattctggggacttatcaggcaatcgatgaagatactaataaggccgcttccaacgtgaagtatgttatggggcgcaacgacggaggctaccttatgattgattcgaagacggccgaaatcaaatttgtgaagaacatgaatcgagactctacgtttattgtcaataagaccattactgccgaggtgctcgcaatcgatgagtataccggcaaaactagtacaggcacagtgtacgtgcgagtcccagatttcaacgataactgccctactgctgttctcgagaaagatgccgtttgctcttccagtccgagcgtggtcgtttccgccagaacactgaacaatcgatatactggcccttatactttcgctctggaagaccagcccgtgaagctccctgccgtgtggtcgataacgactctgaacgccacctctgcactgttacgagcacaggagcaaattcctcccggagtttatcacatcagtttggtgttgacagacagccagaataatagatgcgagatgcctcggtcattaacgctggaggtgtgtcagtgtgacaaccgtgggatttgcggcacctcctatcccaccacatctccaggcaccaggtacggcaggccccactctggtcgattgggccccgcagcaattggcttgctgcttctggggctccttttgcttcttctggcgccattactgctgctgacatgcgattgtggagccggctccactggaggagtgaccggagggttcataccagtgccagacggctcggagggaaccatccaccaatggggtatagaaggcgcgcatcctgaagacaaagaaattactaatatatgtgtgccaccggtcacagcaaatggtgcagatttcatggagagtagcgaagtgtgcacgaatacctacgccaggggaaccgcggtggaaggaacatctgggatggaaatgacgactaaactgggggcggcaacagagagtggcggggctgccggatttgcgaccggcactgtttccggagcggccagcggctttggcgcagctaccggcgtgggaatctgttcttctggccagagtggcactatgcggacgcgccacagcactggggggacgaataaggactacgccgacggggctatttccatgaacttcctcgatagctacttttcccagaaggcttttgcatgcgcggaggaagatgatgggcaagaggcgaatgattgcttactcatatatgacaatgagggcgccgacgcaacaggatctcccgtcggcagcgtggggtgttgtagctttatcgccgacgacctggacgactctttcttggactcccttggacccaaattcaaaaaattggctgaaatatctctgggagtcgacggggagggtaaggaagtccagcctccctccaaagactctggatacggcatagaatcttgcgggcacccaatcgaagttcagcagacaggattcgttaaatgccagacgctcagcggctcacagggggcaagtgctttgagcacctccgggtccgtgcagcctgctgtatccatacccgaccctttgcagcacggtaattatttggtgaccgagacatatagcgccagtggttccttagtgcaaccctcaaccgcaggcttcgaccctctattaacccagaacgttattgtcactgagcgggtgatctgccccatctcaagtgtcccggggaatctggctggcccgacccagttgagaggatcacataccatgttgtgtaccgaggacccttgcagccgactgatatag

SEQ ID NO: 14893 - DNA, 8616 bp, Artificial Sequence
  Description of Artificial Sequence: Synthetic coding sequence
atgagttgtaatggcggctcacacccccgcataaacacattaggacgtatgatcagggccgagtccgggcctgacctgaggtacgaagtgacgtccggcggaggggggacctcccgcatgtactattcccgcagaggcgtcatcacagatcagaatagtgacggatactgccagacaggaaccatgagccgccaccagaatcagaacactattcaggagctactgcagaattgctcggattgcctgatgcgggccgaactgatcgtgcaaccagagctcaagtacggtgacggcatacaattaacacgatcacgggagctggatgagtgctttgcccaggccaacgatcagatggagatcctggacagtttgattcgggaaatgcgccagatgggccagccctgtgacgcgtaccagaagcgtctgttgcagctgcaagagcaaatgagagccctgtataaggctatctccgttccaagagtccggcgggcctcaagcaagggaggcggcgggtatacctgtcagtctggttccggatgggacgagtttacaaaacatgttacaagcgagtgtctgggctggatgcggcaacagcgcgccgagatggacatggtcgcttggggcgtggacttggcctccgtggagcaacacatcaactcccatcgaggcattcacaactccattggcgactacaggtggcagcttgacaaaatcaaggccgacctgcgcgaaaagtccgcgatctaccaactggaagaggagtatgagaacctgttgaaagccagctttgagcgaatggaccacttaaggcagttgcagaatatcatacaggccacttctagggagataatgtggattaatgattgtgaggaggaagagctcctgtacgattggagcgataagaacactaacatcgctcagaaacaagaggccttcagcatcaggatgtcacagctcgaagttaaggaaaaggagttgaataagctgaaacaagaaagtgaccaactggtgttgaatcagcaccccgcctcagacaagatcgaggcctatatggatacccttcaaacccagtggagttggatcttacagattaccaaatgcattgacgtccatctcaaggagaatgccgcttatttccagtttttcgaggaggcccagtctacagaggcatacctgaaaggactccaggacagtattcgtaaaaagtacccctgcgacaagaatatgccccttcagcatttgctggagcagatcaaggagctagagaaagaaagggaaaagattttagaatacaaaaggcaggtgcagaaccttgtcaacaagagcaaaaagatcgtacagctcaagccacgaaatcctgactatcggtccaataaacctattatacttagggctttatgcgactataaacaggatcagaagatcgtgcacaagggggatgagtgtatcttgaaagacaataacgagcgcagcaaatggtacgtcaccggtcccggaggagtagacatgctggtgcctagtgttggtctcattattcctccccccaatcccttggctgttgatttatcatgcaagattgaacagtattatgaggccatcctggcactgtggaatcagttgtatattaatatgaaatctttggtttcttggcactactgtatgatcgacatcgagaaaatccgcgccatgactatcgccaagctaaagactatgagacaggaggactatatgaaaacgattgctgacttggaactacactaccaggagttcatacgtaactctcagggctctgagatgtttggggacgatgataaacggaagatccagagccaattcactgatgcccaaaagcactatcagacactggtgatacaattgccaggctatcctcagcatcaaacggtgactaccacagagattactcaccatggaacatgccaagacgtgaaccataacaaagtgatcgagactaatagagagaacgataaacaggaaacctggatgctcatggagttgcagaaaataaggcgacagattgagcattgcgaaggacggatgaccctgaagaatctgccactggctgaccagggtagttcccaccatattactgtcaaaattaatgaattgaagtcagtccaaaacgattcccaggctatagccgaggtgctcaatcagttgaaagacatgttagcaaacttccgaggatccgagaaatactgttatctgcagaatgaggtttttggactgttccaaaagctggaaaacattaacggtgtaacagatggatacctcaattctctgtgcacggtaagggcactccttcaggcgatcctgcaaaccgaagatatgttgaaggtctatgaggctaggctgaccgaagaagaaacagtctgtttggatctcgataaagtggaagcctatcgctgtggcctgaagaaaataaagaatgatttaaacctgaaaaaatcactgctggccactatgaagaccgagctacaaaaggcccagcagatccatagccagacgtcccagcagtatccactatacgatctggatctgggaaagttcggagaaaaggttacccagctgactgaccggtggcaacggattgataagcagatcgacttccgactctgggacctggagaaacaaatcaagcagttgcgaaattaccgagacaattaccaggccttctgtaagtggctgtatgatgctaaaagaagacaggatagtctcgagtcaatgaaattcggggactctaatactgtgatgagatttctgaatgaacagaaaaaccttcactctgaaatctccggaaaacgcgataagtcagaggaggtccaaaagatagcagagctgtgcgcgaatagtataaaggattatgaattacagctggcatcgtacacatcgggtttggagacccttctgaatatcccgatcaagaggaccatgattcagagtccaagtggagtgatccttcaagaagctgccgatgttcatgctaggtacattgaattgcttacccggagtggtgactattatagatttttgtctgagatgttgaaatctctggaagacctcaaactgaaaaacaccaagattgaggtgctcgaagaggaactacgccttgcacgagatgcgaattccgagaattgcaataagaacaagtttctcgaccagaatttgcaaaaatatcaggcggaatgctcccaattcaaagccaaactcgcttcactggaggagcttaagaggcaggccgagctggacggaaaaagcgctaagcagaacctggacaaatgctatggccagatcaaggaactaaatgaaaaaatcactcgcttgacgtatgagatagaggacgagaaaaggcggcgcaaatccgtggaggatagatttgatcagcagaagaatgattacgatcaattgcagaaagcgcgtcagtgtgagaaagagaacttggggtggcaaaaacttgagtccgaaaaagccatcaaggaaaaggaatacgaaatcgagaggctgcgggtgttgctgcaggaagaggggacccggaagcgagagtatgaaaacgaactcgcgaaggtgagaaatcactataatgaggaaatgtctaacttgcgcaacaagtatgagacagaaattaatataaccaaaacaacaattaaggaaatcagtatgcaaaaggaagacgatagtaaaaacttgaggaatcaactagatcgcctatctcgagagaatcgggatctaaaagacgagattgtacggctgaatgattctattctgcaagcgactgaacaaagacggagagccgaggagaacgctctgcaacagaaagcgtgcggcagcgagatcatgcagaaaaagcagcacctggagattgagttgaaacaggtgatgcaacagcggagtgaggataacgctaggcataagcaaagtttggaagaggccgcaaagacaatccaggacaaaaataaagagatcgagcggttgaaagccgaattccaggaagaggctaaacgacggtgggagtacgaaaatgagctctcaaaggttcgcaataactacgacgaggaaataattagtctcaagaatcagttcgaaaccgaaattaatatcacaaagactacaatccaccagctgactatgcaaaaggaagaggatacctccggttatcgtgctcagatagataatctgaccagggagaatcggtcgttatccgaggagattaaacggcttaaaaatacactgactcagacgacggaaaatctgcggcgtgtcgaagaggacattcagcagcagaaggctactggaagtgaggtgtcccaacgaaaacaacagctcgaggtggaactgagacaggtgacacagatgcgcactgaagaatctgtcaggtataagcagtcacttgatgatgccgccaaaaccatccaggacaaaaataaggagattgagaggctgaagcaactgatagacaaggagaccaacgacagaaagtgcctggaagacgagaatgcaaggctccagcgcgtgcagtacgatcttcaaaaagctaactcctccgccacagagaccatcaataagctgaaggtccaggaacaggaactgacacgactcaggattgactacgaacgagtgtcccaagaaagaacggtgaaggatcaggacatcacacggtttcagaactcactgaaagagctccagctgcagaagcagaaagtggaggaggagttgaaccgcctcaagagaaccgcctccgaggactcttgcaaaagaaagaaattagaggaagaattggagggcatgcggaggtccctcaaggagcaggccattaagataaccaatctgacccaacaattagaacaggcatcaattgtcaaaaagagatcagaagacgacctccgccagcagcgggacgttctggatggacacctgcgggagaagcagcggacccaggaggaacttagacgcctgagcagcgaggtggaggccctccggaggcagcttctccaggaacaggaatcagttaagcaggctcatcttcgcaatgagcacttccaaaaagctattgaggacaaaagcagaagcttgaacgaatctaaaattgagatcgagaggttgcagtctcttaccgagaacctgaccaaagaacatctgatgctcgaagaggaactgcgaaaccttcgacttgagtatgatgatctccgacggggtagatctgaggccgacagcgataaaaatgctacgattttggagcttaggagtcaactacaaatcagcaacaatcgcactctggagctccagggcctgattaacgacctccagcgggagagagaaaacctgcgtcaagaaatcgaaaagtttcaaaaacaggcgctcgaggccagtaaccggatccaggagtctaagaaccagtgcacgcaggtcgtgcaggagcgggaatctttattggttaagatcaaagtcctggagcaggataaagcccggctgcaaaggctggaagacgagctgaacagagcaaagagtacgcttgaagcagaaacgagagtcaagcaaaggctggagtgcgagaaacagcagatccagaatgatctgaatcaatggaaaacccaatattccaggaaggaggaggctataaggaagattgagagtgaacgagaaaaatcagagcgggagaagaatagcctgcggagcgagatagagaggctgcaagccgaaataaaacgcatcgaggagcgatgtcgacgcaagctggaagactccactagagagactcaatcgcagttagaaactgaacgctcccggtatcagcgtgaaattgataaattgcgccagcgcccctatggatcccaccgtgagacgcaaacggaatgtgagtggacagtggacacaagtaaattggtctttgatggactgagaaaaaaagtaactgccatgcagctctacgaatgtcaattaatagacaaaaccacactggataagctcttgaaaggaaaaaagtctgtggaggaggtagcaagcgagatccaaccctttctgaggggtgccggctccattgccggcgcatcggcgagtccaaaggagaaatacagcctcgttgaagccaaacgcaaaaagctgataagcccagagagcaccgtcatgctgctagaggctcaagccgcaacgggcgggatcatagatccgcaccgcaacgagaagttaactgtagacagtgccattgcccgggatctgatcgacttcgacgacagacagcagatatatgcagccgagaaagccatcacaggttttgacgaccccttttcaggaaagacagttagcgtgagtgaggcgattaagaaaaacctcatagatcgggagactgggatgcgactccttgaagcccaaatcgcctcaggcggggtagttgacccagttaattcagtctttttacctaaggacgtcgccttggctagaggactgatcgatagagacctgtatcgaagcctgaacgacccccgggatagccaaaagaatttcgtggaccccgtgacaaaaaaaaaagtttcatacgtacagctgaaagaacgctgccgtatcgaaccccacacagggctgctcctgttgtcagtgcagaaaaggagcatgagcttccaaggcattcgacagccggtgactgtgactgaactggtggatagcggaatacttcggccaagcactgtaaatgaactcgagtctggccagattagctacgacgaagttggcgagcggattaaggactttcttcaaggaagctcgtgtatcgcggggatttacaacgagacaaccaagcaaaagctggggatatacgaggccatgaaaatcggactggtccgtcccggtacggccctggaactcctggaagcacaggccgccacaggctttattgtcgatcctgtctccaacttgaggcttccggtggaagaggcatacaaacgaggtctggttggcattgagtttaaggaaaagcttctcagtgctgagcgggcagtgacgggatataacgacccggagacgggcaatatcatcagcttgttccaggcaatgaataaagagttaatcgaaaagggacacgggatccgactgctggaagcccagattgcaactggcggcatcatcgacccaaaagaaagccatcggctccctgtcgacatcgcttataaaagaggctacttcaacgaggagctctcagaaatcttgtccgacccatctgacgacacgaagggcttcttcgacccaaatacagaggaaaatcttacttacctgcaacttaaggagagatgcatcaaagatgaagagaccggactgtgcctgcttcctctgaaagaaaaaaagaagcaggtgcagacctcccagaaaaatacactacgaaagcgccgagtggtgatcgtagacccagagacaaataaggagatgtctgtccaggaagcgtacaagaagggacttatcgattacgagaccttcaaagagctctgcgagcaggagtgtgagtgggaggaaataaccatcactgggtccgacggcagcactcgagttgtgctggtggaccgcaaaaccgggtcacagtatgacatccaggatgcgatagacaaaggactggtcgatcgaaagtttttcgaccagtataggtccgggagcctgagcctgacacagtttgccgacatgatatccttgaagaatggggttgggacttctagctctatgggtagcggcgtcagcgatgatgttttctcatcctcgcggcacgagagcgtgagtaagatctccactattagctcagtgagaaacctgacaatccgctcttcgtcttttagtgacactctcgaagagtcttcccccatagcagccattttcgacactgaaaacctcgagaagatatctattacggagggaattgaacgcggcattgtggactcaatcaccggtcagcggcttttggaggcacaggcctgcaccggtggcatcattcatcccaccaccggccaaaagctgtccctgcaggatgccgtgtctcagggtgtaatcgaccaagacatggcaacaagactgaagcccgctcagaaggcattcattggattcgagggcgtcaaaggtaagaagaaaatgtctgcagccgaagcagttaaggaaaagtggctcccttatgaggctggccaacggttcttggagttccagtacttaacaggtggactggtggacccagaagtgcatggtagaatctctaccgaagaagccatccgtaagggattcattgacggacgagcagcccagcgcttacaggacacaagtagttatgccaaaatcctgacatgcccaaagacaaagctcaagattagctacaaggatgccatcaacaggagcatggtggaggatattacggggctgagactgctggaggcagctagcgtctcaagcaaaggcctgcctagcccatacaatatgtcttcagctcctggtagtagaagtggatcacggtccggtagccgctctggttcacgctccgggagcaggagcggctcccgacggggtagctttgatgcaaccggcaactcttcttatagctacagctatagtttttcctcctcttctattggccactag

SEQ ID NO: 14894 - DNA, 2862 bp, Artificial Sequence
  Description of Artificial Sequence: Synthetic coding sequence
caacaacagcgcgccgagatggatatggtagcgtggggcgtcgatctagcatccgttgagcagcacatcaacagtcaccgaggcatccataactccatcggtgattacagatggcaactggataaaataaaggcagatcttagagagaagtcagccatctatcaactcgaggaggagtatgagaacctgctcaaggctagctttgagcgcatggatcatcttcgacagctccaaaatatcattcaggcaacgtcaagagagatcatgtggataaatgattgtgaggaagaggaactcctgtacgactggagcgataaaaacacaaatatcgctcaaaagcaggaggcgttttctatccgtatgtcacaactggaagtaaaggagaaggagctgaacaaacttaaacaggaatccgaccagcttgtgctcaatcagcaccctgctagtgataaaattgaggcctacatggatacactgcagacccaatggtcctggatcctgcaaataactaagtgtatcgacgttcatttaaaagagaatgccgcgtattttcagtttttcgaagaagcccagtcaaccgaggcctaccttaagggactgcaagatagcattcgtaaaaaatatccttgcgataaaaacatgcccctccagcacctgcttgaacagataaaggaattagagaaggaacgggaaaagattctggaatacaagcgccaagtgcagaatcttgttaataaatcaaaaaagatcgtccagttaaagccccggaacccagattatagatccaataagcctatcatcctgagggccctgtgtgactacaaacaggatcagaagattgtgcacaagggagatgaatgtatcctgaaggataacaatgaaagatcaaaatggtacgtaacaggcccaggaggggtcgacatgctggtcccgtccgtgggcctgatcatacctcctcctaacccactggctgtcgacctgtcatgcaagatcgagcagtactatgaggccattctcgctttatggaaccagctgtacatcaatatgaaaagtctggtgagttggcactattgcatgattgatattgagaaaattcgagctatgacaatagctaagctgaagaccatgcgacaagaggattacatgaagaccattgccgatttagaactgcactatcaggagttcatcaggaacagccagggaagcgaaatgttcggcgatgacgacaagcgaaagatacagagtcaatttaccgatgcccaaaagcactaccaaacactcgtcattcaactgcccggttacccacagcaccagaccgttactacaaccgaaattacccatcacggcacctgccaggacgttaaccataacaaggtgattgaaaccaatagagaaaatgacaagcaggagacatggatgctcatggaactgcagaagattcgaaggcagatagagcactgtgaggggcgaatgaccctgaaaaatctccccctggcagatcagggctcctcccatcacattactgttaagatcaatgaactgaaatctgtccagaacgattcacaggctattgccgaggtgcttaaccagctgaaagacatgctggccaacttcagaggttccgaaaagtactgttacctccaaaacgaggtcttcgggctctttcagaagctcgaaaacatcaacggggtcacagacggctacctgaactctctttgcacagttcgtgccctgttacaggcgatcctccaaaccgaagatatgttgaaagtgtatgaagccagactcacagaagaggagaccgtctgtctcgatttagacaaagttgaggcttaccgttgcggactgaagaaaattaaaaatgatttgaatcttaaaaagagcttgctggctacaatgaaaactgaattacagaaggcgcagcagatccacagtcagacgagccaacagtacccattgtacgacctggatctggggaaattcggagagaaagttacccagctcacggatagatggcaacgaattgacaagcaaatagacttccggctatgggatctcgaaaaacagataaagcagttgaggaactatagagacaactatcaggcattctgcaaatggctgtatgatgcaaaacgtaggcaagatagcctggagagcatgaaattcggcgattcaaataccgtgatgcgattcttgaacgagcagaagaacctccacagtgagatctctggtaaaagagacaagtccgaggaagtgcagaagatcgccgagctgtgtgcgaactcaattaaagactatgaactgcagcttgcttcctatacctcaggactggagaccttgcttaatataccaatcaaacggactatgattcagtccccatctggggtgatattacaggaagctgcagatgtacacgctaggtatattgagttactgacacggagcggggattactaccggtttttgtctgagatgttgaagtccctggaagatctgaagcttaaaaataccaaaatcgaagtgctcgaggaagaacttcggctggcacgcgatgcgaatagcgagaactgtaacaaaaacaagtttctggaccaaaacctccaaaagtaccaagccgagtgttcccagttcaaagctaagctcgcttccctggaagagctgaaaagacaggcagagctggatggcaagtccgcaaaacagaatctggataagtgctacgggcagatcaaggagcttaatgaaaagattacccggctgacatatgagatcgaggacgaaaagcgaaggaggaagtcagtggaagatcgttttgaccagcaaaagaatgactatgatcagcttcagaaggcccggcagtgttag

SEQ ID NO: 14895 - DNA, 6819 bp, Artificial Sequence
  Description of Artificial Sequence: Synthetic coding sequence
atgtcgtgcaatggaggatcgcaccctagaattaatacacttggaagaatgattagagctgagtctgggccagacctgcggtacgaggtgacatctggcgggggcggaacgtcaaggatgtactacagccggcggggggtgattaccgatcagaactcagatggttactgtcagacgggtacaatgagtcgtcaccagaatcagaacacaatccaggagctcctccagaattgttcagactgcctgatgagagcggagctaattgttcagcctgagctgaagtacggggacggtatccagctaactcggtcccgagaattagatgaatgctttgcacaggctaacgatcagatggagatcctcgatagcttgataagggagatgaggcaaatgggccagccatgtgatgcttatcagaagagactattacaactgcaggagcagatgagagctctctataaggccatttctgtgcctcgcgtgaggcgtgcctcatcaaaagggggtgggggctacacatgtcagtcaggatcaggatgggacgaatttacaaagcacgtcacttcggagtgcctcggttggatgagacagcagagggctgagatggacatggttgcttggggtgtggacttagcttcagtggaacagcatatcaatagccacagaggtatccacaatagtatcggagactaccgatggcagctcgataagatcaaggctgatctcagggagaagtccgccatataccagttagaagaggaatatgaaaacttgctcaaggcttctttcgaacgaatggatcatttgcggcagctgcagaatattatccaagccactagcagagagataatgtggattaacgactgtgaagaggaggaactcctctatgactggtcagacaaaaataccaatatcgcccagaaacaggaggcctttagtataagaatgtcccagttggaggtaaaggaaaaagaactgaataagctgaagcaggaaagtgatcagcttgtccttaatcagcaccccgccagtgataagatcgaggcctatatggacacgctgcagacccagtggtcctggatactccagataaccaagtgtattgacgttcacttgaaagaaaacgctgcgtactttcagttcttcgaggaggcccaaagcacggaggcctaccttaagggtctgcaagattccattcgcaagaagtacccctgtgacaagaacatgcccctacagcacctcctagagcaaataaaagaactggagaaagagcgcgagaagatcctggaatataagcgacaggtgcagaacttagtaaataagagcaaaaagatagttcagctgaagcctcggaaccccgactacagatccaataaacccatcattttaagagcactgtgcgactataagcaagatcagaaaatcgtccacaaaggtgacgaatgcattctcaaagataacaatgagcgatctaagtggtacgttacaggtccgggcggggtggacatgttggtgccatctgtcgggctaataatacccccgcccaatcccctcgctgtggatctgtcctgcaaaatagagcagtattatgaagcgatcctcgccctatggaaccagttgtatatcaacatgaaaagtctggtttcctggcattactgcatgattgatatcgaaaagattagggctatgaccatcgcaaagctaaagactatgcgccaggaggactacatgaagacaatcgctgatctggagctgcactaccaggagtttatccggaactcacagggatctgagatgtttggcgatgatgataagcggaagattcagtcccagttcacagacgctcagaagcactaccagacgctggtcattcagctgcccggatatccccaacaccaaacggtcaccacaacagagataacgcatcatgggacttgccaggacgtcaatcacaacaaggtgatagaaaccaatcgcgaaaatgacaagcaagaaacctggatgctcatggaactccagaagatacggcggcagatcgaacactgtgaggggcggatgacactcaagaatttgcccctggccgatcaagggtcttcccatcacattaccgtgaaaattaacgaacttaagagcgtgcagaatgacagccaagcaatcgccgaggtgttaaaccaactgaaagatatgctggccaatttcaggggctccgaaaaatactgctacctccagaacgaagtgtttgggttgttccagaagctcgagaacattaatggcgtcactgacggatacttgaattcattgtgtaccgtgagggcgctgctgcaggccatactgcagaccgaagacatgctgaaggtttacgaagcgaggttaaccgaagaagagactgtgtgcctagacctggataaagttgaagcttatcgctgcgggttgaaaaagattaaaaacgacctgaacctcaagaagtcattactggcgactatgaaaaccgaactgcagaaggcccagcaaatacactcacaaacaagccagcagtatcctctgtacgatttagatttagggaagtttggggagaaggttacacagctaacggatagatggcagcggatagacaagcagattgactttagactatgggaccttgaaaagcagattaagcaattgcggaactacagggacaactaccaggctttttgcaaatggctctatgatgctaagcgtaggcaggacagcctcgaatccatgaagtttggcgacagtaacactgtaatgcgctttctcaacgaacagaaaaaccttcactctgagatctccgggaagcgggacaagagcgaagaagtgcagaaaatcgccgagttgtgtgctaactccatcaaagactatgaactgcagcttgcctcttacacatccgggctggagacactcctcaatattcccattaaacgcactatgattcagtctccatctggcgttatcctgcaggaagcagccgacgtccacgcgaggtatattgagctgctgaccaggtctggagattactaccgctttctgtccgagatgctgaaaagtctggaggacctcaagctcaagaacacaaagattgaggttttagaggaggaactccggttggctagggatgccaattcagagaattgtaataagaacaagtttctcgaccagaacctgcagaaatatcaagctgagtgttctcagtttaaggctaagctcgcaagtttggaagagctgaagcgccaggcggagttagacggcaaaagcgccaagcaaaatctggataagtgctacggtcagatcaaagagctgaacgagaaaattacaagacttacatacgaaattgaggacgagaaaaggcgtaggaaatctgtggaggaccgcttcgaccaacagaagaacgactacgaccagctgcagaaagcccgccagtgtgaaaaagagaatctcggatggcagaagctagaatccgaaaaagccataaaagagaaggagtacgaaattgaacgccttagagtgctgctccaggaagaggggacgagaaagagggaatacgagaatgagctggcaaaagcctctaaccggattcaggaatccaaaaaccagtgtacccaggtggtgcaagaaagagaatcactgctcgtgaaaattaaggtgctagagcaagataaggcacgtcttcagcgcctcgaggatgagctgaatcgagcgaagtcgacgctcgaggctgaaacccgagtaaaacagcgacttgagtgcgagaagcagcaaatccaaaacgatctcaaccagtggaaaacccagtacagccgcaaggaagaagccattcgcaagatcgaaagcgaacgcgaaaagtccgaaagggaaaaaaattcccttcgtagcgaaatcgagcgcctacaggccgaaattaaaagaattgaagaaagatgccgcagaaaattggaggattccacccgcgaaacgcagtctcagttagagactgaacgaagcaggtaccagagggaaattgataaattacgccaacgcccatacgggagtcaccgggagacacagaccgagtgtgaatggacggtcgatacgtccaagctagtgtttgacgggttacggaagaaagtgactgcaatgcagctgtatgaatgtcagctgatcgacaagacaactctggacaagctcctcaaaggaaaaaagagcgtggaagaggtagcatcagagatccaaccattccttcggggagccggcagtattgccggggccagcgcgagtcccaaggagaagtatagtttggtggaggccaagcggaagaaactgatcagccctgaaagcaccgtgatgctcctcgaagcccaggccgccactggcgggatcatagacccacatcggaatgaaaaactaactgtggattctgcaatagcaagagacctgattgatttcgatgaccgtcagcagatatatgccgccgaaaaggccattactgggtttgacgatccatttagcgggaagacagtctctgtgtcggaagcaatcaaaaaaaatctcatcgaccgggagacaggaatgcggttgcttgaagcgcagatagcttcaggaggagtagtcgacccagtgaattccgtattcttgcctaaggacgtagctcttgctagaggtttaattgatcgggacttgtaccggtccttgaatgacccgagagactcccagaaaaactttgtcgacccggtgactaaaaagaaagtgtcttatgtacagctgaaggagagatgccgaatcgagccacatacgggattgctgctcttaagtgtgcagaagcggagtatgtcgttccagggaattcgccagcccgtgacagtgactgagttagtcgacagcggtattctgaggccatctacagttaatgagctggaatcaggtcagatttcatatgatgaagtgggggagaggatcaaagattttttgcaggggagctcctgcatagccggcatctataacgaaacaactaaacagaagctggggatatacgaggcaatgaaaatcggcctggttcgacctggcacagccctggaactcctcgaggcgcaagctgcaacaggctttatcgttgacccagtgtctaatcttcgtctcccagtcgaagaggcttacaagaggggtcttgttggcatcgaattcaaggaaaagctccttagcgccgaaagagccgtgaccggatacaatgaccccgagacgggcaacatcatctctctgttccaagctatgaacaaggagttaattgagaaaggtcatggcattcgattattggaggcacaaattgctacggggggcattatcgatcctaaagagtcacataggctcccagtggacatcgcctacaagaggggctatttcaatgaagagctgagtgagatcttgtctgatccatcagatgacacaaaaggtttcttcgacccgaacactgaagaaaacctgacttatcttcaactgaaagaacgctgtataaaggacgaggaaacaggtctatgcttgctgcccttgaaggagaagaagaaacaagtccagacatctcagaagaatacattacgcaagaggagagtggttattgtcgatccagagacaaacaaagaaatgtcagttcaggaggcctacaaaaagggcttaatcgactatgaaaccttcaaagagctgtgtgagcaggaatgcgagtgggaggaaatcactatcactggtagcgatggatctactcgggtcgtgctggtagaccgcaagacaggaagtcagtatgacatacaagatgcgatcgataagggcctggtggacaggaagttcttcgatcagtatcggtcaggctcattgtcactgactcaatttgccgatatgatctcccttaaaaatggggtcggcacgtcctcctctatgggctcaggcgtatcagacgatgtgtttagctcgtcgaggcacgagtccgtctctaaaattagcaccattagctccgtccgcaatctcactatcagaagctcttcgtttagtgacaccttagaggagagctcacccatcgctgcgatatttgacacagagaatctggaaaaaattagtattaccgagggtatcgagcgcggcatagttgattccatcaccggccaaagactactggaagctcaggcctgcacaggcggcatcatccatcccacgacgggccagaagctgagcctccaagatgctgtgagtcagggggtaattgaccaggacatggccactcggctgaaacccgcccagaaagcattcattggcttcgagggcgtgaagggaaaaaagaaaatgagcgccgcagaggccgtgaaagaaaagtggcttccttacgaggccggccagcggttcctcgagttccagtacctgaccggcggcctcgtcgatcccgaagtgcacggacggatctctacagaggaagctatcagaaagggatttattgacgggagagctgcacagaggctacaggacacgtcctcctacgccaaaatcttgacatgccccaaaaccaagctgaagatatcgtacaaggacgcgatcaacagaagcatggttgaggacattactggcttgagattactggaagccgcctccgtatcctccaagggtttgccaagcccatacaatatgagctcagcccctgggagccgatccgggtctcgcagtggctcacgaagtggctctaggtccggcagccgatcaggcagcaggagagggagtttcgacgccactggaaactcctcatattcctattcatactccttttccagctcaagcatcggacactag

SEQ ID NO: 14896 - DNA, 507 bp, Artificial Sequence
  Description of Artificial Sequence: Synthetic coding sequence
atggaaccacctaacctgtacccggtcaaactgtacgtttacgatctctccaagggattagcccgacggctgagtccaatcatgttgggaaaacaactggaaggcatctggcatactagcattgttgtccacaaggacgagtttttttttgggtctggggggatctccagttgccctccaggggggaccctcctcggaccccccgacagtgttgttgatgtcggttctaccgaagttaccgaggaaattttccttgagtacctgtcctcactcggagagtcgctgtttcgtggagaggcctataatctgttcgaacataactgcaacactttctccaatgaggtggcgcagttcctaactggcagaaagataccaagctacattacagacctgccgtcagaggttctgtcaacacctttcgggcaggccctgagaccactgctagattctattcaaatacagccacccggcggaagtagtgtaggtaggcccaacggacagtcttag

SEQ ID NO: 14897 - DNA, 561 bp, Artificial Sequence
  Description of Artificial Sequence: Synthetic coding sequence
atgaagtccgacttttacttccaaaaatccgaacctcatagcctatctagcgaagctctaatgcgccgtgctgtgagcctcgtaactgactctacctctacctttctatcacagaccacatatgcactgatcgaagccatcacagagtacaccaaagctgtttatactctgacaagcttgtacaggcagtacacatctctgctcgggaagatgaatagcgaggaggaagacgaagtctggcaggttatcattggggcaagagctgagatgactagtaaacaccaagaatatctgaagttggagaccacatggatgacggctgtcggtttatccgaaatggctgctgaggccgcctaccagactggcgctgatcaggccagtattacagctaggaatcacatacagctggtgaaattgcaggtggaggaagtgcaccaactgtctaggaaagcagagactaaacttgcagaggcccagatagaagaactgcgccagaagacccaggaggaaggagaggagcgcgctgaaagcgaacaggaggcctacctgcgcgaggattag

SEQ ID NO: 14898 - DNA, 588 bp, Artificial Sequence
  Description of Artificial Sequence: Synthetic coding sequence
atggcagctctaaagagttggttgtccaggtctgtcacttccttcttcaggtaccgacagtgcctttgtgtccctgtagttgcaaatttcaaaaagcgttgcttttctgagctgattagaccatggcacaaaacagtaacaattggattcggcgtcacgctctgcgcggtccccatcgcacaggccgtttatactctgacttctttgtatcgccaatacacgtctcttctcggcaaaatgaactctgaggaggaggacgaagtctggcaggtgatcatcggtgcacgcgccgagatgacatccaagcatcaggagtatctcaagctcgagaccacttggatgaccgctgtgggattatcagaaatggccgccgaggcggcataccagacaggggccgatcaggccagcatcactgctcgaaaccacatccagctggtaaagcttcaggtcgaggaagtccatcagttgtctcgcaaggccgaaacaaaacttgctgaggctcaaatcgaggaactccgtcagaaaacccaggaagagggcgaagagagagctgaaagtgaacaggaagcctaccttagggaggactag

SEQ ID NO: 14899 - DNA, 588 bp, Artificial Sequence
  Description of Artificial Sequence: Synthetic coding sequence
atggccgccttaaagagttggttgtccaggtctgtgaccagtttctttcggtatcgccagtgcctttgcgttcccgttgtggccaattttaaaaaaaggtgtttcagtgaattgatacgcccctggcacaagacggttacgatcggatttggcgtgacgctgtgcgctgtgccgatcgcccaggcagtgtacaccctcacatcgctgtaccggcagtatacttcattattaggcaaaatgaattctgaggaagaagacgaggtctggcaagtcatcattggcgccagagcagagatgaccagcaagcaccaggaatatctaaaattagagaccacttggatgacagcggtaggtttatcagaaatggcagccgaagccgcataccagactggtgccgatcaggcctccattaccgcccggaaccacatacagcttgtgaagcttcaagtcgaggaagtgcaccagctcagcaggaaagctgaaaccaagttagcagaagcccagatcgaagagttacgccagaagacacaggaagagggcgaagaaagagcggaatctgagcaagaagcctacctcagggaggattag

SEQ ID NO: 14900 - DNA, 720 bp, Artificial Sequence
  Description of Artificial Sequence: Synthetic coding sequence
atggctgcactgaaaagctggctgagtcgaagtgtgacctccttctttcgctataggcagtgcctatgcgtgcctgtggtcgcaaattttaaaaaacgctgcttcagcgagctcataagaccatggcataagaccgtcaccattggtttcggggtcactctttgtgccgtgcctatcgcccagaagtccgagcctcactctctaagcagcgaagccctgatgcgcagggctgtatccttggtgaccgactccacctcaactttcctgtcacaaacaacttatgcactgatagaagcaatcactgaatataccaaagccgtgtacacactgacgtccttataccgtcagtacacttccctcttgggcaagatgaatagcgaggaagaggatgaagtctggcaggtgattattggcgccagggccgagatgacgagcaagcaccaagagtacctcaagctggaaaccacatggatgaccgctgtgggactgtctgagatggcagccgaagctgcctaccaaaccggcgccgatcaggcctctatcacagcgaggaatcatatacaactggtcaagctgcaggttgaggaagtgcaccagctcagccgaaaagccgagactaaactggccgaggcacagatcgaggagctgcgccaaaagacccaggaggaaggcgaagagcgggcagagtcggagcaagaggcatacctgcgtgaagattag

SEQ ID NO: 14901 - DNA, 561 bp, Artificial Sequence
  Description of Artificial Sequence: Synthetic coding sequence
atgaagagtgatttctatttccagaagagtgagccccactctttgtccagcgaagccctaatgagaagagccgtgagtctggtgactgatagcaccagcacattcctcagtcaaacaacttatgcactgattgaggcgattacggagtatacaaaagcagtgtatactctgactagtttatatcgccagtatacttctttgctggggaaaatgaattccgaggaggaggacgaagtgtggcaggtgataatcggcgcacgcgctgagatgactagtaagcatcaggagtatctgaagctggaaactacttggatgactgccgtaggactctctgaaatggcggccgaggccgcctaccagaccggcgccgatcaggcttctattaccgcaaggaaccacattcagctggtgaagctgcaggtagaggaggttcaccagctttcgagaaaggccgagaccaagctggctgaggcacagatcgaggagcttaggcagaagacccaggaagagggcgaggaacgggccgagagtgagcaggaggcctatctgagggaggattag

SEQ ID NO: 14902 - DNA, 3822 bp, Artificial Sequence
  Description of Artificial Sequence: Synthetic coding sequence
atggagcccccagggggatccctcggacctggacggggtactcgcgacaaaaaaaagggccggtctccggacgaactgccttccgctggcggagacggcgggaaatctaagaaattcacactgaaacggctgatggccgacgaattagagagattcacgtctatgaggatcaaaaaggaaaaagaaaaacccaactcagctcacaggaatagctccgcctcttatggcgatgacccaactgcacagtctttgcaagatgtctccgacgaacaagttctagtcctctttgaacagatgctgctggacatgaacttgaatgaagaaaagcaacaaccactgcgagaaaaggatatcataattaagcgagaaatggttagtcagtatctgtatacctccaaagcaggaatgagccaaaaagaatcctcaaaaagcgccatgatgtatattcaggagttacggtcaggcttacgggatatgcccctcctgagttgccttgagagcctgcgagtgtcacttaataacaatccggtctcgtgggtacagacattcggagccgaaggacttgctagcctccttgacatcttaaagagactgcacgacgaaaaggaggaaaccgcaggatcatatgactcccgcaacaagcacgagataatccgatgcctgaaggcgtttatgaataataaatttggaataaagacaatgctggagacagaagaaggcattctcctcctggtccgtgctatggatcctgccgtgcccaacatgatgattgacgctgcaaagctgctgtcagccttgtgcattctcccacaaccagaagatatgaacgaacgcgttcttgaggccatgacagaacgggctgagatggatgaggtggagcggttccagcctctgttggacgggctgaagtcgggcaccactatcgcccttaaagtcgggtgtttgcagctgattaatgccttgataacacccgctgaggagctcgatttccgcgtccacatcagatccgagctgatgagactgggactccatcaggtcctccaggacctgcgagagatcgagaacgaggacatgagggtccagctgaacgttttcgatgaacagggggaagaggactcttacgatctgaagggccggctagacgacattcgcatggagatggacgacttcaatgaggtctttcaaatcctgctgaacactgtgaaagattcgaaggccgagccacattttctttctattttacaacacctgctgttagtgcgaaatgactacgaagctaggccacagtactacaaactgattgaggagtgtatatctcagatagttctgcataagaatggtgcagatcccgactttaaatgccgtcatctccagatcgaaattgagggccttatagatcagatgattgacaagacaaaggtcgagaagagcgaggcgaaagcagccgagctcgaaaaaaaactcgattctgaactgactgccaggcacgagctgcaggttgagatgaagaagatggaatctgactttgaacagaaactgcaggacttgcagggggagaaggatgcacttcactccgagaagcagcaaatcgccaccgaaaagcaggacctcgaggctgaggtgtcacagctgactggcgaggtcgctaagctgactaaggaactggaagacgccaaaaaggagatggcatccttatcagccgctgccatcaccgtgcctcctagcgttccatccagggcacctgtccctccagccccccctttgcccggcgattccggaaccataatacctccaccccccgcaccaggagattcgactacacctccccctccaccccctccacctcctcccccccctcctttgcccgggggtgtgtgcatcagctctcctccgagcctgcccggaggaaccgcaatttctccccccccacccttgagcggggacgccacgattcctcccccgccccccttgccagagggtgtgggcatacccagtcctagttcactgccaggaggaaccgctatccccccacctccccccctgcccggatctgccagaatccctccacccccacccccgttaccgggcagtgcggggattccccctccacctcctccactccccggcgaagctggtatgccgcccccccctccccctctgccaggcggaccagggataccccccccacctccattccctggcgggcccgggattccaccaccaccgcctggcatgggaatgcctcctccacctcccttcggattcggtgtcccagcagcccccgtactgcctttcggcctgacgccaaagaagctatacaagccagaggtgcagctcagacgtcctaactggtctaagctagtcgctgaggacctttcacaagactgtttttggaccaaggtcaaagaagatcgtttcgaaaacaacgagctgttcgcgaaactcactctgaccttcagtgcacagacaaagagaacaaaaaaagcaaagaaggatcaggaaggtggagaggagaaaaaatcagtgcaaaaaaagaaggtgaaagaacttaaggtcctggactccaagacagctcaaaacctgtccatctttttggggtcattcaggatgccgtaccaggaaataaaaaatgtgattcttgaagtaaatgaggcggtgcttacagaaagtatgatccaaaatctgataaagcagatgcctgaacctgaacagctaaagatgctgtccgagttgaaagatgagtatgacgacttggccgagtccgaacaattcggcgtcgtgatgggcaccgtcccccgcttgagaccaaggttgaacgctatattattcaaactgcagtttagtgaacaggtggagaacattaaacccgagatcgtgagcgttactgcagcatgcgaagagctgaggaagagcgaatccttcagtaacttgttggagataaccctgcttgtcggcaattacatgaacgctggatcccgcaatgctggagcttttgggtttaacattagctttctgtgcaagttacgcgataccaagagcaccgatcagaagatgacgttgctgcatttcctcgctgaactgtgtgagaacgactatcccgacgttctgaaattccccgatgagttggcgcacgtggaaaaggcttcccgggtgagtgctgaaaatttgcagaagaatctggaccagatgaaaaaacagatcagtgacgtagagcgggacgtgcagaacttccccgccgcgactgacgagaaagataaattcgtggagaaaatgactatatttgtgaaggacgcccaggagcaatacaataaactaagaatgatgcactctaacatggaaacactgtacaaggaactcggtgagtacttccttttcgatcctaaaaagttatctgtggaagagtttttcatggacctgcataattttcgaaatatgttcctacaggctgtcaaagagaatcagaagcgccgtgaaactgaagagaagatgagaagagctaagttagcgaaagagaaggccgaaaaggaacgtctcgagaagcagcagaagagggagcagctcatagacatgaacgctgaaggggatgaaacaggcgtgatggactcccttcttgaagctctgcagtcaggcgccgcctttcgccgtaagagaggaccaaggcaggctaacagaaaggcaggatgcgctgtgaccagcctcctggctagtgagctgaccaaggacgacgctatggcggcagtacccgccaaggtgagcaagaactccgagaccttccctactatcctcgaagaagcgaaggagctcgtcggaagggcctcctag

SEQ ID NO: 14903 - DNA, 3810 bp, Artificial Sequence
  Description of Artificial Sequence: Synthetic coding sequence
atggagccccctgggggtagcctcgggccaggcaggggaactagagacaagaaaaagggccgcagcccagacgaactgccaagtgcaggaggcgatggaggcaagagtaagaagttcactcttaaaagactaatggctgacgaactcgagcgattcaccagtatgcgaattaagaaggagaaggaaaaacctaatagcgcacaccggaactcttctgcttcttacggagatgacccgacggctcagtcactgcaggatgtgtccgacgagcaggttctggttctattcgaacaaatgctgcttgacatgaacttaaatgaggaaaagcagcaaccactgcgggaaaaggacatcattattaagagagaaatggtgtcccagtatctctatacttccaaggcagggatgagtcagaaagaatcttctaaatcggctatgatgtatattcaggagctacgatcaggactgcgcgatatgccgcttctgtcatgcttggaaagcctgcgcgttagcttgaacaacaacccagtgtcctgggttcagaccttcggcgccgaaggattggccagcctgctggatatcctcaagcggcttcacgacgagaaggaggagaccgctgggtcatatgatagccgcaacaagcacgagatcatccgctgtctcaaggcattcatgaataataaatttgggatcaaaacaatgctggagaccgaagaaggaatactactcctcgtgcgagctatggatccagctgtgccgaatatgatgattgatgctgccaagttgctgtctgccctatgtatcctaccccagcccgaagacatgaatgaacgggtattggaggccatgacggagcgggccgagatggatgaagtcgagaggtttcaaccactgcttgacggactcaagtcaggtaccaccatcgccctgaaggtaggatgcctgcagttgataaatgctctaataactccagccgaggaactggactttcgggttcatataagatccgaattgatgcggctcggcctccatcaggtgcttcaggacctgagagaaatcgagaatgaagatatgcgcgtacagctcaacgtcttcgatgagcaaggggaggaggactcctacgacttaaaagggaggctggatgacatcagaatggaaatggatgatttcaatgaggtcttccagatacttctgaataccgtcaaagattcaaaagctgagcctcactttctcagtattttgcagcacttattgttagtccggaacgattacgaagctcggccccagtactacaaactgatcgaagaatgcatttcccagattgtgctgcataagaatggggctgatccagacttcaaatgccggcaccttcaaatcgagattgagggcttaatagaccagatgattgacaagactaaagtcgaaaaaagcgaggcaaaagcggcagagctggagaagaaattggacagcgaactcacggcccggcatgagctgcaggtagagatgaaaaaaatggaaagtgacttcgagcagaagctgcaggatcttcaaggagaaaaagacgcgctccattccgagaagcagcaaatagcaaccgagaagcaggacctggaagcagaggtgtctcagcttaccggagaggtggctaaactgacaaaggaactggaagatgccaagaaagagatggcaagtctgtctgccgccgccattacggtgccaccgagtgtgccatctcgagcccccgtgcctcccgctccaccacttccaggagattccggaacaataatcccaccaccaccagctccaggtgattccacgacacctccccctccacctccaccaccccctccacccccaccattacctggcggagtctgcatcagttctcccccttctctacctggcgggaccgccatctcacctcctccacccctgtctggggacgctaccatcccccccccccccccgttgcccgagggagtcggcatccccagcccttcgagcctgcctgggggcaccgccattcctcccccccctccactccctggctccgctagaatccctcctccaccgccccctttaccagggagcgctgggatccccccaccaccacctccactgcccggggaagcgggcatgcccccgcctcccccccctctgccaggggggcccggaatccctcccccaccccccttccctgggggacccggcattccccccccacctcccggtatgggtatgccacctccccccccgttcggttttggcgtgcccgccgcgccggttctcccattcggactcacaccaaaaaaactctacaagcccgaagtgcagctgaggagaccgaattggagcaaactggtggccgaggacctcagtcaggattgcttttggacaaaggtgaaagaagataggtttgagaacaatgaattattcgccaaacttacactgacctttagcgcgcaaactaaaaccaagaaggaccaggaggggggggaggagaaaaagagcgtacagaaaaaaaaggtgaaagagctgaaggtgctggacagcaaaaccgcccagaacctgtccatcttcttgggctcatttcgcatgccataccaagagataaagaatgtgatccttgaggtcaacgaagcagtgctgaccgaatcaatgatccaaaatctgatcaaacaaatgcctgaacccgaacagcttaagatgctcagtgagctgaaagatgaatatgacgacctggctgaaagcgaacagttcggggtggtgatggggaccgtacctcgactcagacctaggttgaatgctatcttgttcaaactgcagttcagtgaacaagtcgagaatattaaaccagagatcgtttcggttacggcagcatgcgaagagcttcgaaaaagcgaatctttctcaaatctcctggagatcacactgctggtcggaaactatatgaacgcgggcagtagaaatgccggcgcttttggattcaacataagcttcctttgtaaacttcgggacacaaaaagcacagatcagaagatgacactgttgcacttcctggccgaattgtgcgaaaacgattaccctgacgtgctcaaatttcccgacgagttggcgcatgtggagaaagcaagccgagtttctgccgaaaatctgcagaagaacctagatcagatgaagaagcagatttcagatgtggagcgggacgtacagaacttccctgctgctacggacgagaaagataagttcgtagagaagatgacatcgttcgtgaaagacgcacaggagcagtataataagctgaggatgatgcactctaatatggagacactctataaagagctgggggagtacttcctttttgaccctaaaaagttgagtgtagaggagttttttatggatttacataacttccgcaatatgttcctgcaggccgtcaaggaaaaccaaaagcgtcgcgaaacagaagaaaagatgcgccgcgccaagctggcgaaagaaaaggccgaaaaagaaagattggagaaacagcagaagagagaacagctgatcgacatgaacgcagaaggtgacgagactggggtgatggattccctgcttgaagctctgcagagcggcgccgcatttcgacggaagagaggtcctcgccaggctaacagaaaagcgggctgtgcggtgacttctctgctggcctcagagctgaccaaggatgacgcaatggctgctgtgcctgccaaggtctctaaaaactccgaaacattccccacaatcctcgaggaggccaaagagctggtggggagagcttcctag

SEQ ID NO: 14904 - DNA, 3792 bp, Artificial Sequence
  Description of Artificial Sequence: Synthetic coding sequence
atggagcccccaggaggcagcctagggcccggtaggggcactcgggataagaagaaagggcgctcccccgacgagctgccttctgcagggggtgacggcggcaaatctaagaaatttctggaacgttttacctctatgcgcattaagaaggagaaagaaaagccaaactccgcgcacaggaacagctctgcttcttacggagatgaccccactgcgcagagcttgcaagatgtgtctgatgagcaggttctcgtcctcttcgagcaaatgcttctagacatgaacttaaacgaggaaaagcaacagcccctgagagagaaggatataataattaaaagagaaatggtttcacagtatctgtacacaagtaaagctggaatgagccagaaggaatcttccaaaagcgcgatgatgtatatccaggagctccgatcaggccttcgagacatgcctctgttgagctgccttgaatcgcttagagtgagcctcaacaataatccagtaagctgggtgcagacattcggcgccgaggggctagccagcttgctggacatactgaaacggctccatgatgaaaaggaggagaccgccgggagttacgactctagaaataagcatgagatcattagatgcctgaaagcattcatgaacaacaaatttgggattaaaactatgctcgaaactgaggaaggaatcctgctcctagttagagctatggacccagcagtgcctaacatgatgatagatgccgccaaacttctttccgcactgtgtattctgcctcaacctgaggatatgaacgaaagggtgctggaggctatgaccgagagggccgagatggacgaggtggaacgttttcagccacttctcgacggccttaaatccggaacaactatcgccctcaaggtaggatgtctgcagcttatcaatgccctcatcacacccgctgaggagctcgacttcagagttcatatccgtagcgagctgatgaggctaggactccaccaggtgttgcaagatctccgcgagattgaaaacgaggacatgcgggttcagttgaacgtgttcgatgaacaaggcgaggaggactcttatgatttaaagggaaggctggacgatatccggatggaaatggatgattttaatgaagtatttcagatcctattaaataccgttaaagatagcaaagccgagccacactttctttcaattctgcaacatctgctgctggtacggaacgattacgaagcccgcccgcagtactacaaacttatcgaggagtgcatcagtcagatcgtgctgcataagaacggagctgatccggacttcaagtgtcgacacctgcagatcgagattgaggggctgattgaccagatgattgataaaacaaaggtggagaagagtgaggcaaaggccgcggagctggaaaaaaagctggactccgaattgactgcccgccacgagttgcaggtggaaatgaagaagatggagtccgactttgagcagaaacttcaggacctgcaaggcgagaaggatgcactgcacagtgaaaaacagcaaattgccaccgaaaaacaggacctggaagccgaagtgtcccaactcaccggtgaggttgcaaagctgaccaaagagttagaagatgcaaagaaagaaatggcttccctgagcgcagctgcgatcacggtgccaccctccgtgccatcccgggcccctgtgccgccggctcctccactccccggagattcagggacaatcatcccccccccaccagcccctggcgactcaaccacgcccccaccacctccaccccccccgccaccacctcctccactcccaggcggagtctgtatcagctcgcctccttcccttcctggtggaaccgccataagtcctccacctccactgagcggtgacgccaccattcccccccctccccctcttcctgagggggtgggcataccatcaccatcgtctcttccgggaggcacagcaatacctccgccacccccccttcctggtagcgctcggatccctccccctcctcctccactgcccgggagcgccgggatcccacctcccccaccccccttgcccggggaggccggcatgccgccccctcccccgcccctacccggagggcccggcattcccccgccaccgcctttccccggcggccccgggatcccgccaccaccacccggcatgggaatgcctcccccacctcccttcggtttcggtgtgcctgcagctccagtgctcccctttggacttacccctaagaaactgtacaagccagaagttcagcttagacggccaaactggtccaagctggtggccgaggatctgtcacaggactgcttttggacaaaggtcaaagaggacagattcgagaataacgagctgttcgcgaagctgaccctgaccttttcggcgcagaccaagacaagtaaggctaagaaggatcaggaaggaggagaggagaagaaatccgttcagaaaaagaaagtgaaggagctgaaggtactggattctaagactgcccagaacctgtctatcttcctggggagttttagaatgccgtaccaagagataaagaatgtgatactcgaggtgaacgaagccgtgctaactgagtccatgatccagaacctcattaagcaaatgccagagcccgagcagcttaaaatgctgtcagaactcaaggatgaatatgatgacctggccgaatccgaacaattcggcgtagtcatggggactgttcctaggctgaggcccaggcttaacgctattctgtttaagttgcagttttcagagcaggtcgagaacatcaagcctgagatcgtttcagtaactgcagcctgcgaagagctgaggaagagtgaatcgttcagcaacctgctcgagataacattacttgtgggcaactatatgaacgctgggtctcgcaatgctggagcatttggatttaatattagttttttgtgcaagcttcgggacacaaaatctacagatcagaaaatgacattgttgcattttctggctgagctgtgtgaaaacgactatcctgacgtccttaaattccccgacgaattagcccatgtcgagaaggccagtcgggtttccgcagaaaacttacagaaaaacttggatcagatgaagaaacagatcagcgacgttgagcgcgatgtgcagaatttccctgctgcaacggatgagaaggacaaatttgtcgagaaaatgacctccttcgtgaaggatgcacaagagcaatacaataaacttcggatgatgcactctaatatggaaacgctctacaaagagctcggcgagtatttcctgttcgacccaaaaaagctgtcagtggaagagttctttatggacctgcataacttccgtaatatgttcctgcaggccgtgaaggagaatcaaaaaagaagggaaactgaagaaaagatgagaagagccaagctggctaaagaaaaagcagagaaagaacggttagaaaaacagcagaagcgggagcagctgatcgacatgaatgctgagggagacgagacaggtgtgatggacagccttctcgaggcactccagtcaggcgcagccttccgccgcaagaggggccctaggcaggccaatagaaaagctgggtgtgccgtcaccagcctattggcaagtgaactcactaaggacgatgccatggcagccgtgcccgctaaggtatcaaagaatagtgagaccttccctacaattctcgaggaggctaaagagctggtggggagggcctcttag

SEQ ID NO: 14905 - DNA, 3819 bp, Artificial Sequence
  Description of Artificial Sequence: Synthetic coding sequence
atggaaccgcccggtggaagtctgggaccaggccgagggacccgggataagaaaaaagggcgctcccctgacgagttgccaagcgctgggggggatggaggcaaatctaagaagttcactctgaaacgtctcatggccgacgaactagagcggtttacttccatgcggataaagaaggagaaggaaaagccaaactccgcccaccgtaactcctccgcctcttatggtgacgaccctactgcacagagcctccaggacgtctctgatgagcaagtcctggtcctcttcgagcagatgctgctcgatatgaacctgaacgaggaaaaacagcaacctctgcgagagaaggatatcataattaagagggaaatggtttcacagtatctgtacacatccaaggccggaatgtctcagaaggaatcttccaaatcggccatgatgtatatccaggaactaaggtcaggtttgagggatatgccattgcttagctgtctggaatccctccgggtgagtctcaacaataatccagtctcatgggttcaaaccttcggggccgagggcctggcctcacttctcgatatactgaagcgcctgcacgatgagaaagaggagacagccggcagctacgactcacgaaacaagcatgagatcatcaggtgcctaaaggcctttatgaacaacaaatttggtatcaaaacaatgctggaaaccgaggaaggtatcttgctgttagtgcgggcaatggatcccgccgttcccaacatgatgattgacgcagcaaagctcctgtccgctctgtgcatactgccccagccagaggatatgaacgaaagagtccttgaggccatgacagagcgggctgaaatggacgaggtagaaagattccagcccttgctcgacggcttgaaatccggcacaactatagctcttaaggtcggttgcctccagctgataaacgctctcataacccctgccgaggagctggactttagagtccacattcgctccgagctgatgcggctaggacttcaccaggtgctccaggatctccgggaaattgaaaatgaggatatgcgagtccagctaaatgtctttgatgagcagggcgaagaagacagctatgacctgaaaggaaggcttgacgacatccggatggaaatggatgacttcaacgaagttttccagatactgctgaatactgtgaaggattccaaggccgagccccattttctcagcatcttgcagcacctgctgctcgtgaggaatgactatgaagcacggcctcaatattacaaactgatcgaagaatgtatttcccagattgtgctccacaagaacggcgcagatccagatttcaaatgtcgacatctgcagatcgagatagaagggctgatcgatcagatgattgacaagactaaagtcgaaaaaagcgaagctaaagccgcggaactggagaaaaaactcgacagcgagctgaccgccagacatgagctacaagtagaaatgaagaaaatggagagcgacttcgagcagaaactgcaggatttacagggcgagaaggatgctctacacagcgagaagcaacaaattgctaccgagaagcaggacttggaggccgaagtgtcccagctaacaggggaggtagctaagttgaccaaggagctggaagacgctaagaaggagatggcctccctgtctgccgcagccattactgttcccccatccgtgccttcccgggctccagtgccacctgcacctccacttcctggagacagcggaacaatcatcccacctccccccgcgccaggtgacagtaccactccgccaccccccccccctcctccccccccacctccacccttgccaggtggtgtttgcataagtagtcctccaagcctgcctggcggtacagcgatcagccctccccccccactgtctggtgacgctacgatccctcccccaccccctttgcctgaaggggtcggaatcccctctcccagttcactccccgggggaacggcaatcccccctcctcccccccttccgggcagtgccagaatcccgccccctccaccacccctgcccggatctgctggaatccctcctcccccacctccgctgccaggggaagcaggcatgcctcccccacccccgcccctgcccggcggcccaggcataccccctccccctcccttccccggaggccccggtatacctccgcctcctccggggatgggcatgccacctccgcctccttttggcttcggagttccagcagctccagtgttaccttttggcctgacgcctaagaagttgtataaaccagaggttcagctgaggagaccaaattggtctaaactggtggcagaagacctctctcaggattgtttctggacaaaggtcaaggaagatcgattcgaaaataatgaactgtttgcgaaactcactctgaccttttctgcccagactaagacctccaaagcaaaaaaggatcaagaaggtggcgaggaaaaaaaatctgttcagaagaagaaggtcaaggagttaaaagtgctagacagtaagactgctcagaatcttagtattttcctgggcagcttcaggatgccttaccaggaaatcaagaacgtgatcttagaagtgaatgaggccgtgctgactgagagtatgattcagaacctcattaagcaaatgcccgaacctgagcaattgaagatgctgtccgagcttaaagatgaatacgatgatctggcagaatccgagcagtttggggtggtgatggggacagtcccaagacttcgccctcgattgaatgcgatcctgttcaagctgcagttcagcgagcaggtggagaatattaagccagaaattgtgagcgttactgccgcgtgcgaggaactccgtaagagtgagagcttctcaaacctgctcgagattaccctgctggtgggaaattatatgaacgctggctcccgaaacgcaggcgcttttggctttaatatctcctttctctgtaagctgcgggacactaagtccacagatcagaaaatgacacttctgcactttctcgctgaactgtgcgaaaacgattaccccgacgtgctgaagttccctgatgagctggctcatgtcgagaaagcatcacgggtgtcagcagagaatctgcaaaaaaacctggaccagatgaagaagcagatttccgacgtcgaaagagacgtccaaaactttccggctgctacggacgagaaggataagttcgtcgaaaagatgacgagctttgtgaaggatgcccaggaacagtacaataagctcagaatgatgcattccaacatggagaccctgtataaggaactgggagagtactttctgttcgatcctaagaaactgtctgtggaggagttcttcatggatctgcacaatttcagaaacatgttcctgcaagctgttaaggagaaccagaagcgaagagagactgaggaaaagatgaggcgcgcaaaactggccaaagaaaaagccgagaaagagcggctggagaagcaacaaaaaagagagcagttaattgatatgaatgctgagggagatgagaccggggttatggacagcctgctggaggccctccagtccggggctgctttccgtagaaagcgcgggccccggcaggcaaaccgtaaggccggatgtgcagtcacaagcctgctggcaagcgaactgaccaaggatgacgccatggctgccgtgccagcaaaggtctctaagaattccgagactttcccgaccattcttgaggaggcaaaagagctagtcggccgcgcatcctag

SEQ ID NO: 14906 - DNA, 3747 bp, Artificial Sequence
  Description of Artificial Sequence: Synthetic coding sequence
atggagcctcctgggggctcccttggaccagggcgcgggacacgcgataaaaagaaggggaggagtccagacgaactccccagcgccggcggcgatgggggaaagtccaaaaagtttctggagaggttcacttccatgcggataaagaaagagaaggagaaacccaattccgcacaccgcaatagctcagcaagctatggtgacgatcccacagcgcagagcctgcaggatgtgagtgatgagcaagtgttggtgctgttcgaacaaatgttgttggacatgaatctgaacgaagagaagcagcagcctctcagagagaaggacatcattataaaacgtgagatggtctcacagtatttatatacttcaaaggcgggtatgtcccagaaggaatcatccaaaagcgctatgatgtacattcaggagctgcgttccggcttgcgcgacatgcccttactctcctgcctggagagcctccgggtcagtctgaataataacccggtaagttgggtgcagacatttggagcagagggattggcatcgctgctcgacattttgaaaagactgcatgacgaaaaagaagagactgctggaagctacgacagcagaaacaagcatgaaattattagatgcctcaaggcattcatgaacaataagtttggtatcaagaccatgctggagacagaagaagggattctgctattggtgagggctatggaccccgctgttcctaacatgatgattgacgccgcaaagctcctgagtgctctatgcatactcccacagcccgaggacatgaacgagagggttctggaggcaatgacagaacgggcagaaatggacgaagtggagcggtttcagccactgctggacggcctgaaatctggcaccacgattgctttaaaggtgggatgtcttcagctaatcaatgccttaataactccggctgaagaactggactttagggtgcacattcgctcagagcttatgcgactcggcctacatcaggtactgcaggacctgagggaaatcgaaaacgaggacatgcgggtccagttgaacgtgtttgatgagcaaggagaagaggacagttacgacctgaaggggcggctggacgacatccggatggaaatggatgacttcaacgaggtgttccagatcctgttgaatacagtgaaagactccaaagccgagccacactttcttagcattttgcaacatctgctgctcgtgagaaacgactacgaggcccgaccacagtattataaactgatcgaggagtgcatttctcagatcgtgttgcataagaacggagctgatcccgattttaagtgccgccatctgcaaatcgaaatcgaggggcttatagatcagatgattgacaaaacaaaagtcgaaaagtccgaagctaaagctgcagagctcgagaagaagctggacagtgagcttacagcacgacacgagcttcaggtcgagatgaagaaaatggaaagcgattttgaacaaaagctgcaggatctgcaaggagagaaggatgctctccactccgaaaaacagcagatcgctactgaaaaacaggatcttgaggccgaggtgtcccagctgaccggggaggtggcaaagctcacaaaggagctagaggatgccaagaaggagatggcctctttgtccgcggcggccatcaccgtcccaccttctgtaccttcccgggcccccgtgccacctgccccgcccctccccggtgacagtggaaccattatcccgcccccaccggcccccggagactctactacacctccaccccctcccccccctccaccccccccaccaccccttcccggaggaaccgctatttctcccccacccccactgtctggagacgcgaccatccccccaccccctccgcttcctgagggagtcggaatcccatctccatcgtctcttcctggcggcacagcaatccctccccctccacccctgcccggctcggctcggatccccccaccacccccccctctgccagggagcgcgggtatccctccaccccccccccccttacctggcgaggccggaatgccaccacctccacccccattaccgggagggcccggtatcccacccccccctcctttcccgggcggcccgggaattcccccaccacctccaggcatgggcatgcctccgcctccaccctttggatttggtgtccctgctgcacccgtgcttccattcggactgacccctaagaaactctacaagcccgaggtgcagctgcggcgacccaattggagcaaactggtagctgaagacctcagtcaggattgcttctggaccaaagttaaagaggatcgctttgagaacaacgaacttttcgctaagctcactttaacgttcagtgcgcagacaaagactaagaaggatcaagaaggaggcgaggagaaaaagtcagtccaaaaaaagaaagtaaaagagcttaaggtgctagacagcaagacagcccaaaatttgtcaatctttcttggcagtttccgtatgccctatcaggaaataaaaaacgtcatcctcgaagtcaacgaggccgtcctgactgaatcaatgatccagaacctgatcaaacagatgccagaacccgaacagctgaagatgctgagcgagctgaaggatgaatatgatgacctggcggaaagcgagcagttcggggtcgtaatgggaactgttccccgcctgcgcccacggttgaacgcaattttattcaagctccagttttccgaacaggtggagaacattaaacccgagatcgtctcggtaacggctgcctgcgaggagctgagaaaatctgagtcattctccaaccttctcgagatcaccttgctagttggcaactacatgaatgccggtagtcgtaacgccggcgcttttggcttcaacatatccttcctgtgtaagctgagagacacaaaatcaactgaccagaagatgacactcctccactttctggcagaactgtgtgagaacgactaccctgacgtgctcaagttccctgacgaactcgcgcacgtcgagaaggctagtagagtgtctgctgagaacctccagaagaatcttgatcaaatgaagaaacagattagcgacgtcgagcgggatgtgcagaactttccggctgccacagatgaaaaagataaattcgtcgagaagatgacaatcttcgtgaaggatgctcaggagcaatataataaactgagaatgatgcactccaatatggaaaccttgtacaaagaattgggcgagtatttcctctttgatcccaaaaaactttccgtggaggagttcttcatggacctgcataactttaggaacatgttcttacaagcagttaaagagaatcagaaacgtcgcgagactgaagaaaagatgagaagggccaaactcgcaaaagaaaaagccgaaaaagagaggctggaaaagcaacagaaaagagaacagctaatcgacatgaacgctgaaggggacgagaccggagtgatggacagcctccttgaggcactccagtctggggctgccttcagacggaaacgggggccgaggcaggcaaataggaaagctggctgcgctgtaacaagcttgctggcgtccgaactcactaaggatgatgccatggcagcggttccggcgaaggttagtaagaacagtgagacctttcccaccatattggaggaagccaaagaactggtgggtcgtgcgtcctag

SEQ ID NO: 14907 - DNA, 3795 bp, Artificial Sequence
  Description of Artificial Sequence: Synthetic coding sequence
atggaaccacccggcgggagcctaggccccggccgtggcacaagggataagaaaaagggtcggagtccagacgagctcccgagcgccggtggcgacgggggcaagagcaaaaagttcctcgagcggttcacctctatgcgcattaagaaagaaaaagagaagccaaattcagcgcatagaaattcctccgcaagctacggtgatgatcctacggcccagagtctgcaagacgtgtcggacgagcaagtccttgtcttgttcgaacagatgttactggacatgaaccttaatgaagagaagcagcagccactgagagagaaggatataataatcaagcgggaaatggtgagccagtatttgtacacctccaaggccggaatgtctcagaaagaatctagtaaaagtgctatgatgtacattcaggagctcagaagtggcctgagagatatgccactactgtcttgtctcgagtccctccgcgtctctctgaataataaccccgtaagctgggtgcagacctttggtgccgaagggctggcgagcctgctcgatatactgaaaagactgcatgatgagaaggaggaaaccgctggctcctacgattcccgaaataagcacgagattataagatgtctgaaggcattcatgaataacaaattcgggatcaaaactatgcttgagaccgaagagggaatcctgctgttggtgcgggccatggatcctgccgtccccaatatgatgatcgatgctgcaaaactgctcagcgctctatgtatactgccccagcccgaagacatgaatgagcgggtgctagaggccatgacggaaagggcggaaatggacgaggtggagagattccagcctctgctcgacgggttgaagagcggtaccaccatagccctgaaagtgggatgcttgcagctgattaatgccctgataacccccgctgaggaactggattttagagtccatataagatccgaactgatgcgcctcggactacatcaggtgcttcaagacctgagagagatcgaaaacgaggatatgagagttcagcttaacgtcttcgatgaacagggcgaggaggactcatacgacctaaagggccgcctggacgacataagaatggagatggatgatttcaatgaggtgtttcagatcttactgaatactgtgaaagactccaaagctgagccccacttcttgtcgatcctgcagcacctacttctggtccggaacgattacgaggcaaggcctcagtactacaagcttattgaggagtgcatatcacaaattgtactgcataaaaatggtgccgaccccgactttaagtgtcgccatttgcaaatcgagatcgagggtttgatagatcagatgattgacaaaaccaaagttgagaaatctgaggctaaggctgccgaattggagaagaagctggatagcgaactcactgcaagacacgagctgcaggtcgagatgaaaaaaatggagagcgatttcgagcagaagctccaggatttgcagggagagaaggatgcactgcactctgaaaaacagcagattgctactgagaagcaagacctggaggccgaagttagccagcttaccggggaagtcgccaagctgaccaaggaactggaagatgcaaaaaaagaaatggcttccctttcagccgccgccattactgtccctccctcagtgccctcacgggcccctgtgccaccggctccgcccctgccgggtgactctggtactattatccctccgccgccagctcccggggatagcacaacccctcctccccctcctcccccacccccaccacccccgccacttcccgggggagtgtgcatttcctcacctcctagcctgccagggggcacagctattagccctcctccacctttaagtggggatgctactattccgccccccccccccttgccagagggcgtaggtattccttccccaagctctctgcccggcggcaccgcaattcctccccccccacctctgcccgggtctgccaggataccacccccgcccccccctctaccgggaagcgcgggaattccacctccacctccacccctcccgggcgaggcggggatgcccccaccacctccgcccctcccgggtgggccaggaatcccccctcccccacctttccctgggggccctggcatccctcctcctcctcccgggatggggatgcctccccctcccccgttcggcttcggggtgcccgctgcccccgtgctcccctttgggctgacccccaagaaactttataaaccggaggtccagctccgccgccctaactggagtaaattagtggccgaggacctgagtcaggactgcttctggactaaagtgaaagaggatcgtttcgagaataacgaactgttcgccaagctgaccttgactttctcagcccagacaaagagaaccaagaaggctaagaaggaccaggagggaggagaggagaagaaatcagtccaaaaaaaaaaggttaaggaactgaaggttttggatagtaaaaccgctcagaatttatcaattttcctcggtagttttcggatgccctatcaggagataaagaatgtcatactcgaagttaacgaggccgtgctgaccgaatccatgatccagaatcttatcaagcaaatgcccgagcccgaacaacttaagatgctcagtgagttgaaagacgaatacgatgacctcgctgaaagtgagcagttcggcgtggtgatgggcactgtaccaaggttgagaccaaggctgaacgcgattttgttcaaactgcaattttcagagcaggtcgaaaacattaagccagaaattgttagcgttacagcagcctgtgaagagctcagaaagagcgagtcgttctccaacctgttggaaattaccctactagtaggaaattacatgaatgctggctccaggaacgccggtgccttcggttttaacattagctttctctgcaaacttagggataccaagtctaccgatcagaaaatgaccctgctgcacttcctcgctgaactatgtgagaatgattatccagatgtgctgaagttccctgatgagttggctcatgtcgaaaaagcatccagagtgagtgcagaaaacctccagaagaatctggatcaaatgaagaagcaaatcagtgacgtggaacgcgacgtccaaaattttcccgcagccaccgacgaaaaagataagttcgtcgaaaaaatgaccattttcgtcaaggacgcgcaagaacaatataacaagctgagaatgatgcattcaaatatggaaaccctctataaagagcttggcgagtacttcttattcgatccaaaaaagcttagcgttgaggagttcttcatggatctgcacaactttcggaacatgttcctgcaggccgtgaaggagaaccaaaaacgaagggagaccgaagaaaagatgagacgggccaaattagcaaaggagaaggccgagaaggaacggctggaaaagcagcagaagagggagcagttaattgacatgaatgctgaaggcgacgaaaccggtgtgatggacagcctgctggaagcccttcaatcaggagcggcatttcgtaggaagaggggccccaggcaggccaacagaaaggctggctgtgctgttacgagtctcctggccagcgaactcaccaaggacgacgcaatggccgccgtgccagccaaagttagcaagaactccgagacctttcccaccatcttagaggaggccaaggagctggtaggccgcgcatcctag

SEQ ID NO: 14908 - DNA, 855 bp, Artificial Sequence
  Description of Artificial Sequence: Synthetic coding sequence
atggccagcttgtccgcagcagcaatcacagtcccccctagcgtcccctcccgggctccagtgcctcccgctccaccactgcctggcgacagcggaacaatcatacctccgccacctgctccgggagattccacaacccccccacccccccctccaccaccgccacccccaccccccctgccggggggcgtctgtatttcgtcccccccttcgctccccgggggaacagctattagccctccaccgccactttcaggcgacgccaccattcctcctcccccccccctgcccgagggagtcgggattccatctccatcctccctgccaggcggtactgccattcctcctcctcctccgttgcctggtagcgccaggatcccacctcctccaccccctctcccagggtccgctggtatccctccacctcccccaccactgcccggagaggccggaatgccacctccccctccccccctccccggaggaccggggattcccccaccaccgcccttccccggaggtccaggtataccaccccctcctcccggcatggggatgcccccgccgcctccttttggattcggagtgccagcagcccccgttcttccatttggtctgacaccaaagaagctgtacaagcccgaagtccaactgcgaaggcctaactggtctaaactagtggccgaggatctgtcacaagactgtttctggacaaaagtgaaggaagatcgttttgaaaacaatgagttatttgcgaaactcacacttacattttctgcgcagactaaatctgaaaaggccaagaaagaccaagaggggggcgaggagaagaagtctgtgcagaagaagaagtag

SEQ ID NO: 14909 - DNA, 513 bp, Artificial Sequence
  Description of Artificial Sequence: Synthetic coding sequence
atgtactgccagttcgccagttttcagtacacatgccagccatgccgggggcagcgaatgttgtgcacccgggattcggagtgctgtggcgatcaactgtgcgtctggggacactgcaccaagatggctacaagaggctccaacggcaccatctgcgataatcagcgagactgccagccaggcctgtgctgtgcttttcagcgaggcctgctttttccagtctgtacccccctgccagtagaaggcgagctgtgccatgaccccgcctcgcgtctcctggatctgattacttgggaactggaaccggacggagcactcgaccgctgcccttgtgcatccggtcttctgtgtcaaccgcatagtcactccctcgtgtacgtatgtaaacccaccttcgtggggagcagggaccaggatggggaaatactgttgcccagggaggtgcctgatgaatacctggccgctagttggagacgctgtgcaagatcttggaggacttggcgcggcgcctag

SEQ ID NO: 14910 - DNA, 1053 bp, Artificial Sequence
  Description of Artificial Sequence: Synthetic coding sequence
atgcaacggctcggggcaactctgctatgcctgctccttgcagccgcggttcccacagccccggctcctgctccgaccgccacttctgccccagttaagcccggccctgccctctcatatccccaagaagaggccactcttaatgagatgttccgggaggtcgaggagttgatggaagatacacaacacaagctaaggagtgcagtcgaagaaatggaagccgaggaagcggccgcgaaagcatcttcggaagtgaacctcgctaacctgcctccttcttaccataacgagacaaacactgacaccaaggtcggcaataatacgatccatgttcaccgagaaatccataagattaccaacaatcagaccggccagatggtgttttcagagacagtgattactagtgtgggagatgaagaggggcggcgctctcatgagtgcataatagacgaggactgcggaccgagcatgtactgccagtttgcatccttccagtacacttgccaaccgtgcagaggccagcgaatgttgtgcacacgagacagcgaatgttgcggggatcagctgtgcgtctgggggcactgtaccaagatggccacccgtgggagcaacggaactatctgcgacaatcagcgggattgccagcccggcctgtgctgtgccttccagagagggctgttgtttcccgtgtgcactcccctgcctgtggagggagaactttgtcatgatcctgcgtcccgactgttggacttaattacttgggaactggagcctgacggcgctcttgataggtgtccgtgcgcaagcggcctcctctgtcagcctcacagtcacagcttagtgtacgtgtgtaagcctaccttcgtcggttcacgggaccaggacggtgagattctgcttccgagagaagttcccgatgagtacgaggtggggtcttttatggaagaagtgcgtcaagaattagaagacctcgaacgctcattaaccgaggagatggcattaagggagcctgccgccgccgcagcggccctgttggggggcgaagagatttag

SEQ ID NO: 14911 - DNA, 882 bp, Artificial Sequence
  Description of Artificial Sequence: Synthetic coding sequence
atggaagatactcagcacaagctgagatctgcagtggaagaaatggaagccgaggaggccgccgccaaggcaagttccgaggtgaacttggctaatctcccgccgagctaccataacgaaactaacactgatactaaggttggaaataataccatacacgtacaccgggaaattcacaagattacaaataaccagaccggccaaatggtgttttccgaaactgtgattacttcagtgggggacgaagagggtcgcagaagccacgagtgtatcatcgatgaggattgcggcccctccatgtactgtcagtttgcctcctttcaatatacatgccaaccatgccgaggccagcggatgctgtgtactcgagatagcgaatgttgcggcgaccaactatgcgtgtgggggcactgcactaaaatggccactaggggatccaacgggacgatctgtgacaaccaaagagattgccagcctggcctatgttgtgccttccaacggggcttgctgttccccgtgtgtactccattgcccgtggaaggtgaattgtgtcacgaccctgcatctcgtctcttagatttaatcacatgggagctggaacccgatggagccctggatagatgcccgtgtgcctccgggctgctatgtcagcctcactcgcacagtttagtgtacgtctgtaagccaacctttgtcggaagtagagaccaggatggcgagattcttttgccaagggaggttcccgatgagtacgaagtgggatcattcatggaggaagtgagacaagaactagaagatctggagcgtagtctgactgaggagatggccttgagggagcccgcggccgccgccgcggctctactgggaggggaagagatttag

SEQ ID NO: 14912 - DNA, 1053 bp, Artificial Sequence
  Description of Artificial Sequence: Synthetic coding sequence
atgcaacgtttaggcgctaccctcctgtgtctcctactggctgccgcagtgcccactgcaccagcacccgcacccaccgcaacgtcggcgcccgtgaagccgggacctgcactatcttacccccaggaggaagccactctcaacgaaatgttcagagaggttgaggaactgatggaagatacgcaacataaactgcgaagcgccgtagaggaaatggaggcagaggaggccgctgcaaaagctagctcagaggtgaatctcgcgaacctgcccccttcatatcataatgagacaaataccgataccaaggtgggaaacaacaccatccatgtacacagggaaatccacaagattacgaataaccaaactggccaaatggtgtttagtgagaccgtgatcacctccgtgggtgatgaggagggaaggagatcccatgaatgcatcatcgacgaagactgcggcccatcaatgtactgtcagttcgcgagtttccaatacacctgccagccctgccgcggacagagaatgttatgcacccgggacagtgaatgttgcggagaccagttgtgcgtatggggccactgcacaaagatggcaacacggggctccaacggaaccatttgtgacaaccagagggattgccagccaggcctgtgctgcgcctttcagcgcggcttgctcttccccgtgtgtacccccctgcccgtggagggtgaattatgccacgacccagcttcgaggctgttagacctcataacatgggagcttgaacctgacggggcactagatcgttgtccatgcgcttccggactgctttgccagccccattctcattctcttgtatatgtttgcaagcccactttcgttggaagccgcgatcaggatggcgaaatccttctgcccagggaagtgcccgatgagtacgaggttgggagtttcatggaagaggtccgtcaagagctagaggacttggagcgaagtctcactgaagaaatggcactgcgcgaacctgccgcagctgctgcagctctgctagggggcgaagaaatctag

SEQ ID NO: 14913 - DNA, 969 bp, Artificial Sequence
  Description of Artificial Sequence: Synthetic coding sequence
atgcagcgcctgggggccacccttctatgtctcctgctcgctgcagctgtgcccacggcccccgccccagctcccaccgctacttcagcccctgtgaagcccggcccagccctgagctatcctcaagaagaagctaccctgaacgagatgttcagagaggtggaggaactcatggaggatactcagcacaagttgcgcagcgccgtggaggagatggaggccgaggaggcagcagcaaaagcctcttcagaggtgaacctggctaacctccctccgtcctatcacaacgagaccaacacagatacaaaggttgggaacaataccatccacgtccaccgagaaattcacaaggagtgcattatcgacgaagactgcggtccaagcatgtattgtcagttcgccagctttcagtacacctgtcagccgtgtagggggcagaggatgctgtgtacacgcgatagcgagtgctgtggtgaccagctatgcgtgtgggggcattgcaccaaaatggctacacgcggttctaatggaacaatctgcgacaatcagagagactgccaaccaggactctgttgtgctttccagcgaggacttctatttccagtgtgtactccgctgcccgtagagggcgaactgtgtcatgacccggctagccggctgttggacctgattacttgggagctcgaacccgatggtgctctggatcgatgtccatgcgccagtggactactatgccagcctcactcccacagccttgtttatgtctgtaagccgacttttgtggggtccagagaccaggatggcgagatcctacttccacgcgaggtccctgacgagtatgaagtgggctccttcatggaggaggtcaggcaggagctggaagatctcgaaagatccctgaccgaggagatggccctcagagagcccgccgctgccgcagcggctctcttaggcggcgaagaaatctag

SEQ ID NO: 14914 - DNA, 708 bp, Artificial Sequence
  Description of Artificial Sequence: Synthetic coding sequence
atgcagagattgggtgcgactctgctatgtcttttgcttgccgcagctgtgccaaccgctccagcccccgcaccaacagccacgagcgcgcctgtgaagcctggccccgcactgtcctatccgcaggaagaagccacattaaacgaaatgttccgagaagtggaagagctgatggaagatacgcagcacaaactgcggtccgcagtggaggaaatggaagctgaggaggccgccgcaaaggccagttctgaagtcaacttggccaacttgcctccaagctaccacaacgagactaacacagatacaaaagttggcaataacaccattcacgtccaccgagaaatccataagatcactaacaaccagacgggacagatggttttctcagagaccgttatcacctctgtgggcgatgaagaaggaagaagatcgcacgagtgcatcattgatgaggactgcggccctagtatgtactgccagtttgctagtttccagtatacctgtcaaccctgtcggggccaaaggatgctgtgcacacgtgactccgagtgttgcggagatcaactttgcgtctggggccattgcaccaagatggccaccaggggctccaacggcaccatttgtgacaatcagcgagactgccagcccggcctgtgctgtgcgtttcaaagggggctgctgtttcccgtttgtacaccactcccctag

SEQ ID NO: 14915 - DNA, 2301 bp, Artificial Sequence
  Description of Artificial Sequence: Synthetic coding sequence
atgaaaaccccttggaaggttcttctcgggctactcggtgcagccgccttggtgacaatcatcaccgtgcctgtggttctgctgaataaaggtaccgatgacgccacagcagacagcaggaaaacatacacactgacagattatctcaagaatacctacaggctgaaactgtattctcttcgttggatatccgaccatgagtatctttataaacaagaaaacaacatcctggtattcaatgccgaatatgggaattcatccgtctttttggaaaactcaactttcgatgaattcggacattctatcaacgactactccatttctccggatggccagttcattctgctggaatataattatgtcaaacagtggagacacagctacaccgctagctatgatatctacgatctgaacaagcggcagttgataaccgaggagagaatcccaaataatacgcaatgggtgacatggtcccctgtaggacacaagttggcctatgtgtggaataatgacatctatgttaaaatcgaacctaacctgccaagttacaggatcacttggacaggaaaggaggacatcatctataatggaataactgactgggtctacgaagaagaagtgtttagtgcttattccgccctttggtggtcaccaaatgggacatttcttgcctacgctcagttcaatgacacagaggtgcctctgatagagtacagcttctactctgacgaatcacttcagtatcctaagaccgtgcgcgttccatatccaaaagcgggagcagttaatccaaccgtgaagtttttcgtcgtcaacaccgatagtctgagttcggtcacaaacgccactagcatacagatcactgctcctgcttccatgcttattggcgatcactatctgtgtgacgtaacttgggcaacgcaggagcggatcagccttcagtggttgagacgtattcagaattactcagtcatggacatttgtgactacgatgagtctagcggaagatggaactgtctagtggcacggcagcacattgagatgagtactacaggctgggtcggcaggtttcgcccgagcgagcctcacttcaccctggacgggaactctttttacaagataatctctaacgaggagggatatcgtcacatctgttatttccagatcgacaagaaagattgcacatttattacgaagggaacttgggaggtcatcggtatcgaggctctgactagcgattatctctattatatatctaacgaatataagggcatgccgggaggtcgaaatctgtacaaaatccagctgagcgactatactaaagtcacttgtttatcttgcgagctcaatccagaacgatgtcagtactatagcgtgtcctttagtaaggaggcgaaatattaccagttgcgctgctccgggccaggcctccccttatacacactgcacagcagcgtgaatgacaaaggactgcgcgttctcgaagacaattctgctctggacaaaatgttgcagaacgtgcagatgccatcaaaaaaactggacttcatcattctcaatgaaactaagttttggtatcagatgatactccccccccattttgacaagagtaaaaaatacccactcttgctggacgtttacgctgggccctgttcccagaaggccgacacagtgtttcggctcaattgggcaacgtaccttgcctctactgagaatatcatcgtcgcatcctttgacgggcgcggatccggatatcagggagacaagattatgcacgccatcaatcgtaggctcggcactttcgaggtcgaagatcagattgaggcagccagacagttcagtaagatgggattcgtggacaataaacgcatagcaatatggggttggagttatggcggctacgtgacttccatggtcctggggtctggaagcggcgtctttaaatgcggcattgctgtggcacctgtctcccgatgggagtattatgactcagtgtacaccgagcgatacatgggcctgccaacgccagaagacaatttggaccactaccgcaacagcacagtcatgtctagggccgagaattttaaacaggtggagtatctccttatacacggtaccgcggatgacaacgttcacttccaacagtcagcgcagatttccaaggcccttgtggacgtcggcgtggatttccaagcaatgtggtacacagatgaggaccatggtatcgcctcatcaaccgcgcaccagcatatatacacccacatgtctcatttcatcaagcagtgtttcagtttgccgtag

SEQ ID NO: 14916 - DNA, 645 bp, Artificial Sequence
  Description of Artificial Sequence: Synthetic coding sequence
atgaacgtctttcgtattctcggagatttatcccacctactggctatgattctcttactgggtaagatctggcgctccaaatgttgcaaagggatatccggcaagtcacagattcttttcgcgctcgtgtttacaacgcgatacctggatctgtttactaacttcataagtatatataatacagtgatgaaggttgtgtttttgttgtgtgcatacgttacggtctacatgatttacggaaaattcagaaagacctttgattccgagaacgataccttcaggttggagtttctgctggttccagtgatcgggctctcgttcctggagaactacagcttcaccctgttagaaatcttatggacattctccatatatttggagtcagtcgcaatacttcctcaactatttatgatctccaagactggggaggcggaaacgatcacaacccactatttgttcttcctgggactttatagagctttgtacctggccaattggatacggaggtaccagacggagaacttctatgatcaaatagctgtcgtgagcggagtggtccagaccatcttctactgtgactttttctatctctacgttacaaaggtcctgaaaggcaaaaaactgtccctacccatgcccatttag

SEQ ID NO: 14917 - DNA, 498 bp, Artificial Sequence
  Description of Artificial Sequence: Synthetic coding sequence
atgaaagaggaccaggtggtcgcagaggagcctggttttcaggatgaagaagagagccttttccaggacatagatctcctccagaagcatggcatcaacgtagctgacatcaagaagctgaagagcgtggggatctgtacaatcaaaggcattcagatgacaacacgtcgcgccctgtgcaacgtgaaggggttaagtgaggcgaaggtggacaagattaaggaggccgccaacaagctaatcgagcccgggttccttacggccttcgagtacagcgaaaagcggaaaatggtatttcatatcactacgggatcccaagaattcgacaagttgttaggaggagggatcgaatcaatggcgatcaccgaagcgtttggtgagttccggacagggaagacacagctgtctcacactctatgcgtcacggctcaattgccaggcgcgggagggtaccccggcggaaagatcatctttatcgacactgagaacaccctgtag

SEQ ID NO: 14918 - DNA, 420 bp, Artificial Sequence
  Description of Artificial Sequence: Synthetic coding sequence
atgaaagaagatcaggttgttgctgaggagcccggcttccaggacgaggaggaatccttgttccaggatatcgatctgctccagaaacatggaataaatgtggctgatattaagaaattgaagagcgtgggaatctgcaccatcaagggcatccagatgacaactcgacgcgccctatgcaacgtgaaaggcctgtctgaagcgaaagttgacaaaatcaaggaggctgctaacaaactaattgagcctggcttcctaactgcttttgagtacagtgagaagcgaaagatggtgttccatatcaccactggcagccaggagttcgataaactcctgggcggtggtatcgaaagcatggccataacggaagcctttggcgaatttcggaccggaaaaactcagctctcgcacacactgtag

SEQ ID NO: 14919 - DNA, 858 bp, Artificial Sequence
  Description of Artificial Sequence: Synthetic coding sequence
atgaaggaagaccaggttgtcgccgaggagcctggctttcaggatgaagaggaatctcttttccaggatatcgatctcctccagaaacatggtatcaatgtggctgatatcaagaagctgaagtcagtcggtatctgtacgattaagggaatacaaatgaccactcgccgcgccctctgcaacgtcaagggtctgagtgaagcaaaagtcgacaaaattaaggaggccgccaacaagctgatagagccaggattcctgactgcgtttgaatattcagagaagcggaaaatggtcttccacattaccacaggtagccaggagttcgacaaactgcttggggggggcatcgagagtatggctatcaccgaagctttcggcgaattccggacgggaaagactcagctgtcccacacattgtgtggagagcatcagatggaactgctagattacgtcgcggcgaaatttcacgaagaagccggaattttcaagctcctaatcatcgacagtatcatggccctttttagggtggatttctcaggacgcggggagctggccgagaggcaacaaaagctcgcccaaatgctttccagactgcagaagatcagtgaggagtacaacgtggccgtctttgtgactaatcagatgactgccgaccccggcgctacaatgacattccaggccgatcccaaaaaaccaatcggaggacacatactcgctcacgctagtacaactcgcatatccctgcgcaaagggaggggcgagctccgaattgccaagatatacgactctcctgagatgcctgagaacgaggccaccttcgctatcactgccgggggcatcggggacgcaaaagagtag

SEQ ID NO: 14920 - DNA, 612 bp, Artificial Sequence
  Description of Artificial Sequence: Synthetic coding sequence
atgaaggaagaccaggtggttgccgaagaacctgggttccaagacgaagaggaaagcctctttcaggatatcgacctgttacaaaaacatggtattaacgtcgcagacatcaaaaaactgaagtctgtgggtatttgtaccattaaagggatacaaatgaccactcgtcgtgccttgtgcaacgtgaaaggactgtcagaggccaaggtcgataaaattaaggaagcggctaataagcttatagaacctggctttctaaccgctttcgagtattctgagaagaggaaaatggtgtttcacatcaccactggctctcaagagtttgataaactgcttgggggcgggatcgaaagtatggctataaccgaggcctttggcgaattcaggacgggcaagacacagctgtcccacacactgtgcggtgagcaccagatggaactgctggattatgtcgccgctaagtttcacgaggaggctggaatttttaaactactaatcatcgactctatcatggcccttttccgcgtagatttttccgggcgcggggaactcgcagaacgccaacagaagctcgcccaaatgttgtcccgcctccagaaaatctccgagtag

SEQ ID NO: 14921 - DNA, 1599 bp, Artificial Sequence
  Description of Artificial Sequence: Synthetic coding sequence
atgaacggagttctgatacctcacacccccatagctgtcgatttctggagtctcaggcgggcagggactgcgagactctttttcctttcccatatgcactctgaccacaccgtgggtttgtcctctacgtgggctagacccctgtattgcagccccattacggctcatcttctgcatcggcatcttcaagtgagtaaacaatggatccaggcattggaggttggtgaaagtcacgttcttccgctggacgaaattggccaggagacgatgaccgtcactctcctggacgccaaccattgtccaggcagtgtaatgtttctgttcgaaggttacttcggaactatcctgtacaccggcgattttcgctacacccctagcatgctgaaggaaccggctctgacccttggaaagcagattcataccctctatctagataacaccaactgcaatcctgcactcgtcttgccgtcaaggcaggaggcggcacatcagattgtgcagttgatccgtaagcacccgcaacacaacatcaaaattggactttactccctaggcaaagaaagccttctggaacagctggcactagaatttcagacctgggtggtgctctctccgagacggctggaacttgtgcagcttttaggactcgcagacgtcttcacagtcgaggaaaaagcgggaagaattcacgcagtcgatcacatggagatctgccacagcaatatgttacggtggaatcagacccatcccacgattgccatactgcctacatccaggaagatccattccagccacccagatattcatgttattccatatagtgaccactcctcatacagcgaactgagagcctttgtcgctgccctaaagccctgccaggtggttcccatcgtgtccagacgtccgtgtggtggctttcaagattctctgtcccctcgcatctctgtgcctctcatcccagactctgttcaacagtacatgtcaagctcatctcgcaagcctagtttgctttggcttctggaaaggcgattaaaacgtccacggactcagggtgtggtcttcgagtctcccgaggagagcgcagaccagtctcaagctgatagagactccaagaaagctaagaaagagaagctgtctccatggccagctgatctcgagaaacagccttcccatcaccccttacggattaaaaagcagctttttccagatctgtactcaaaggagtggaataaagccgtgcccttttgtgagtcacagaaacgggtgaccatgctcacagctcccctgggcttctcagtgcatctgcggtccaccgatgaagaattcatctcacaaaagacgcgcgaggagataggcctgggttcacccttggtcccgatgggcgacgatgatggggggcccgaggccacgggcaaccagagtgcatggatggggcatgggagccctctgtctcattcctcaaaaggcacaccattactagccaccgagttccgaggccttgcgctgaagtacctgttgacacctgtgaacttttttcaagcaggctattcctctcgccgcttcgaccagcaggtagaaaagtaccataaaccctgctag

SEQ ID NO: 14922 - DNA, 1734 bp, Artificial Sequence
  Description of Artificial Sequence: Synthetic coding sequence
atgaaacaccaggagagattcctcttccagggcaataatggcactgttctgtacacgggcgactttagattggctcaaggagaggctgcacggatggaactgttacactcaggcgggcgggtaaaggatatccagtcagtgtacctcgacacaactttttgcgatcctcgcttttaccagatcccaagccgagaggaatgtctgagtggggtgctggagcttgtccgatcctggatcactagatcgccttatcacgttgtgtggctgaactgtaaggcggcatacggctatgaatatctgtttaccaacctgagcgaggaactcggagtgcaagtgcatgtcaataagctggacatgtttcgtaacatgcccgaaatcctccaccatttgaccacggacagaaatactcagattcacgcatgcagacaccctaaagcggaggaatacttccagtggtccaaactgccttgcggcattacatcccgaaaccggatacccctccatatcatctctatcaagccttccacaatgtggttcggagagcgctcaaggaagaccaacgttatcgtgcgcaccggtgagtcctcttaccgcgcttgctttagcttccacagtagttatagcgagataaaggactttctgtcctatctctgtcctgtaaacgcttatcccaatgtaattcccgtcggtacaactatggataaagtagttgaaatcttgaaacccttatgtcggtcctcccagtccacggaacccaagtataagcccttagggaaacttaaacgagcacgcaccgtgcaccgggattccgaagaggaggacgattatttatttgatgatccactgccaatcccgctacgccacaaggtcccctatccagaaacctttcacccagaggtattctccatgacagctgtgtctgagaagcagccagagaagctgcgccagacccccgggtgttgtcgcgcagagtgcatgcagtcttccaggttcacaaattttgtggattgcgaggagtcaaactcagagtctgaagaggaagtcgggataccagcctcactgcagggcgacctagggtccgtgctgcacctccaaaaggcagacggtgatgtgccacaatgggaagtatttttcaagcgtaatgacgaaatcacagacgagagcctggagaactttccttctagcacggtggcaggagggtcacagagtcctaagctattctcagattctgatggggaaagcacccatattagctctcagaacagctcacagtccacccacatcaccgaacaagggtcccagggctgggatagccagagtgacactgtgctcctcagttcccaggaaaggaattctggcgatatcacctccctggataaggcagactatagaccaaccatcaaggagaacatccccgcatccctgatggagcaaaatgtcatctgtcctaaggatacttattctgacttaaaaagtagggacaaggacgtgacaatcgtgccgtctacaggcgaaccaaccacccttagtagtgagacgcatatcccagaagaaaagtcactgctgaatttgagcaccaatgccgatagccagagttcctctgattttgaagtacccagcaccccagaggcagaactccccaagagagaacatctccagtacctctacgagaagttggccacaggcgaaagcatagctgtcaagaagagaaagtgttcactgcttgacacttag

SEQ ID NO: 14923 - DNA, 255 bp, Artificial Sequence
  Description of Artificial Sequence: Synthetic coding sequence
atgttcttattccagggtaataacgggaccgtgctgtatacaggtgatttccgcttagcccagggggaggcagccaggatggagctgttgcattcaggcggtagggtgaaagatattcagtctgtttatcttgatacaacgttctgtgatccaaggttctatcagatccctagccgcgaggagtgtctgtctggcgtgctggagctagtgcggagctggataactaggtccccataccacgtggtgtggttatag

SEQ ID NO: 14924 - DNA, 1038 bp, Artificial Sequence
  Description of Artificial Sequence: Synthetic coding sequence
atggacaaagtggtcgagatactgaagccgctgtgcagatcctcacaatccactgagccgaaatataagcccctcggcaaacttaagcgagcgaggacagttcatcgggactcagaggaggaagacgactatctttttgacgaccccctaccgattcccctaagacacaaggtgccataccccgagacgttccacccagaggtgttctctatgacagccgtgagtgaaaaacaacctgagaaactccggcagaccccggggtgttgtcgcgcagaatgcatgcagtcaagtcgctttacaaattttgtggactgtgaggagtccaattctgaatcagaagaggaggtggggattcctgcaagcctgcaaggtgatctcggatccgttctccacctgcaaaaagccgacggtgatgttccccagtgggaagttttctttaagcggaatgacgagatcaccgacgagtctctggaaaatttcccttcctccacagtggcaggaggcagtcagagtccaaaactcttctccgattcagacggggagtctacccatataagctctcagaactcgtcacagtctacacacataaccgaacaaggaagccagggctgggacagccagtctgatacagtgctcctttctagtcaggagcggaattcaggagacatcacttccttagacaaagctgactaccgccctactataaaagagaatatccccgcatcgctcatggaacagaatgtcatctgccccaaggatacttactcagatctcaaaagcagagataaagacgtcactattgttccatcgactggcgaacctaccacactgagtagcgagacccacattcctgaagagaaaagcctcctcaacctgtctacgaacgccgatagccagagcagtagcgattttgaggttcccagtactccagaagccgagctacctaagagggaacatctgcagtatctctatgagaagctggcaacaggggagtcgattgcagtaaagaaacgaaagtgctctctgctcgatacatag

SEQ ID NO: 14925 - DNA, 1734 bp, Artificial Sequence
  Description of Artificial Sequence: Synthetic coding sequence
atgaagcatcaggaacggtttctgtttcagggcaataatggtactgtgttgtacacaggagactttcgacttgctcaaggagaggctgccaggatggagctgttgcactcaggcggtcgggtaaaggacattcagagcgtgtatttggacaccaccttctgtgacccccggttttatcagattccatcaagagaggaatgcctgtccggcgtgctggaacttgtgcggtcttggattacacgctctccctaccatgtagtgtggctcaactgtaaggccgcgtacggctacgaatacctgttcaccaacttgagcgaagagttaggcgtccaagtccatgtcaacaaactggacatgtttcgtaacatgccagagatcttgcaccatctcacaacggataggaacacccagattcatgcttgtcgccaccctaaggccgaggagtactttcagtggtcgaaacttccatgtgggatcacatcaaggaaccggatccctctgcatatcatatctataaaaccatctaccatgtggtttggggagcgcagccggaagacaaatgtcatagttcgaacaggtgagtcttcgtatagggcctgctttagttttcattcatcatattcggagatcaaagacttccttagctacctgtgtcccgtgaacgcttatcccaatgtgatccctgtcgggacaaccatggataaggtcgttgagattctcaagcctctgtgtcgcagctctcagtctactgaaccaaagtataaaccattaggtaagcttaaaagggcccggactgttcaccgggattctgaggaagaagacgattatctgttcgacgatcctcttcccataccattgcggcacaaggtcccttaccccgaaactttccaccccgaggtgttcagcatgaccgccgtcagcgagaaacagcctgagaaactccggcagaccccgggatgctgccgggctgagtgcatgcagtcaagcaggttcactaacttcgtggattgcgaggaatcaaactcggagagtgaggaggaggtgggaattccagcttcgttgcagggcgacctgggtagcgtgctccatctgcaaaaggccgatggggacgtgccacaatgggaagtgttcttcaaacggaacgatgagatcactgatgaaagtctagagaacttcccctcaagcactgtagcaggcggctcccagtcgcctaaattattctcggacagtgatggggaatccacgcatatatccagccagaatagctcccaatcaacccacatcactgagcagggcagccaggggtgggactcacagtctgacactgtgttgctgtcttcccaggaacggaattctggtgacatcacaagtttggataaggcagactatcgccctacaatcaaggagaacattcctgcgagcctgatggagcaaaacgtgatttgccctaaggatacctattctgatttaaaaagccgggacaaggatgtgacaattgtgccgtcgactggtgagcctactacactgtcctccgagacccatatcccggaggagaagtctctcctaaatttgagtactaatgccgactcacaatcaagctccgatttcgaggtcccctccacccccgaggccgaactgcccaaaagggaacacctgcagtatctgtatgaaaagctggcaaccggggaatccatcgccgtcaaaaaacggaaatgctctttgttggatacctag

SEQ ID NO: 14926 - DNA, 1734 bp, Artificial Sequence
  Description of Artificial Sequence: Synthetic coding sequence
atgaaacaccaggaacgctttctcttccaagggaataacggaactgtgctgtataccggggactttaggctcgcccagggggaggccgctcgaatggaattgttacacagcggaggccgagtaaaggacattcaaagcgtgtacctggacacaacgttctgtgaccctaggttttatcagatcccatctcgggaagaatgtcttagcggtgtgctagaacttgttcggtcctggataacccgctctccatatcacgtggtctggctaaattgcaaagctgcgtatggttacgagtacttgtttactaacctgtcagaagaactcggagtgcaggtgcatgttaacaagctcgacatgttccggaatatgccagagattctgcaccacctaaccactgacaggaatacacagatccacgcttgcaggcatcccaaggcagaagagtactttcagtggtcaaagctcccgtgcggaatcaccagtcgtaacaggatacccctgcacatcatcagtattaagccctccaccatgtggtttggagaaagatctcgcaaaactaacgtgatcgtgaggacgggcgagagcagttacagggcctgcttctcctttcattccagttattcagaaatcaaggatttcttaagctatctgtgccccgtgaacgcctatcctaacgtgatccccgttgggacgaccatggacaaggtcgtggaaattctaaaacccctatgccgctcatcacagtcaactgagcctaagtataaaccactgggcaagctgaaacgggctcgtacagtgcaccgggactcggaagaagaggatgactatctctttgatgaccccctgcccatccctctccgccacaaggtcccatatcccgaaactttccaccccgaggtcttttccatgactgcagtgtccgagaagcaacccgagaaactgcggcaaactcccggatgctgccgtgcggagtgtatgcagtcctcaagattcacaaattttgtcgattgcgaagaatcaaactccgaatccgaagaggaggtgggcatacccgccagcctgcagggcgatttgggttcagtgctgcacctccagaaggctgatggggacgttccccagtgggaggtattctttaagcgcaacgacgagattactgatgaaagtctggaaaatttcccaagctcgaccgtcgctggtggttcgcaatcccccaagctatttagcgacagcgacggcgagtctacccacataagcagccagaactccagtcaatccactcacattacagaacaagggtcacagggctgggactctcaaagcgacaccgtgttgctgtccagccaagagcgcaattccggggacatcacttcccttgacaaggcagattatcgccccactataaaagagaacatccccgcatctttaatggagcagaatgtgatttgccccaaagatacatattccgacctcaagtcccgtgacaaggacgtgacaattgtgccttctaccggagagcctacaaccttaagttctgagacccacattcctgaagagaaaagtttgctgaatctgtcaaccaatgctgatagccagtctagttcagatttcgaggtaccctcaactccagaggccgagttgcctaaacgcgaacacctgcagtacctttacgagaaactggctactggggaaagcatcgccgtgaaaaagaggaaatgtagtctcttggacacttag

SEQ ID NO: 14927 - DNA, 1719 bp, Artificial Sequence
  Description of Artificial Sequence: Synthetic coding sequence
atgtttctcttccagggaaataatggaaccgtgttgtatacaggagactttcgcctggcccagggcgaggctgccaggatggaattactgcattctgggggccgcgttaaggatatccaaagtgtctatttggacaccaccttctgcgacccacgcttctaccagatcccaagcagagaagagtgtctgtccggggtgctagagctggtgcgctcatggatcacaaggtcaccttaccacgtggtttggcttaactgtaaggccgcctatggatacgaatatctgttcacgaatctgtcagaagagctgggggtgcaggtccacgtcaataaactggacatgttcagaaacatgcctgagatccttcaccaccttaccacagaccgaaatactcagattcatgcctgccggcaccccaaggccgaggagtattttcaatggtctaagctgccctgtggcatcacatccaggaatcggatcccattgcatattatttctatcaagccctctaccatgtggtttggagaacgctcaagaaagaccaatgtgatcgtaagaacaggcgagagttcctaccgtgcatgcttttctttccattctagttatagtgaaattaaggacttcctgagctatctctgtcctgtgaatgcatacccaaatgtgatcccagtgggaaccacaatggataaagtggtcgaaatcctgaaacctctgtgtcgatcctctcagagcaccgaaccaaagtataagcccctggggaagttaaaaagggccaggacggtccacagggattctgaggaggaggacgattacctctttgatgaccccttgccgattcctctacggcacaaggtaccttatcccgagaccttccatccagaagttttttccatgacagcagtgtccgagaagcagccggaaaaattgcgtcaaaccccaggatgttgtcgagccgaatgtatgcagtccagtagattcactaatttcgtcgactgcgaggaatccaattcagaatccgaggaagaggtaggcatcccagcttccctacagggggacttaggctccgtgttgcatttacaaaaagcagacggcgacgttccgcaatgggaagtattcttcaaacgcaatgatgaaatcaccgacgaaagtctagagaatttccctagctcaaccgtagcagggggttctcagtcgcccaagctgttctctgacagcgatggcgagagtacacatattagctcccaaaattcaagccagagtacccatatcacagagcaaggttctcagggctgggatagccagagcgatactgtgttacttagttcacaggagcggaatagtggggacatcaccagtctggataaggccgattatagacccactatcaaggagaacatccccgctagtttgatggaacaaaatgttatctgcccaaaggatacatatagtgatctcaagagccgggacaaggatgttacgatcgtgccgtccacaggtgaacctacaaccctgtctagcgaaacacacatcccagaggagaagagtctgctcaacctgtccactaatgcagactcgcaatcctcctctgacttcgaggttcccagcacacctgaggccgaactgcctaaacgcgagcacctgcagtatctgtatgaaaaacttgccaccggtgaaagtatagccgtcaagaaaaggaagtgcagcctgctggatacctag

SEQ ID NO: 14928 - DNA, 1719 bp, Artificial Sequence
  Description of Artificial Sequence: Synthetic coding sequence
atgttcctgtttcaaggtaataatggcactgttttgtacaccggagattttaggctggcgcagggtgaggccgcccggatggagctgttgcatagcggagggcgtgtgaaggacatccagagtgtttacctggatacaaccttttgtgatccaaggttttaccagatcccttcaagggaagagtgtctgtcaggggtcctggagcttgtgcggtcatggatcacaaggtccccataccatgtggtgtggctgaactgtaaggccgcatacgggtatgaatatttgtttactaatctctccgaggagctgggtgtgcaggtgcatgttaacaagcttgacatgttcaggaacatgcccgagatcctgcaccacctcacaaccgaccggaacacacagatacacgcctgcagacacccaaaggccgaagagtactttcagtggagtaagctgccatgtggcatcactagtcgaaaccgaattcctctccacatcatcagtataaaacctagtacaatgtggttcggcgagcggtccagaaaaacgaatgtgatagttagaacaggggagtcctcctacagagcctgtttctccttccattcctcctactctgagatcaaagattttttgtcatacctttgcccagtgaatgcctacccaaacgtgattcctgtgggcacaacgatggacaaggtggtggaaattcttaaaccactatgccgttcctctcagtctaccgaacccaagtacaagcccttgggcaagctcaaaagggctagaactgtccatagagactctgaggaagaggatgactacctgttcgatgacccccttcccatccccttacggcataaggtcccctacccggagacttttcaccctgaggttttttcaatgacagcagtcagcgagaagcaacccgagaagcttcgacagacacccgggtgctgtagggccgagtgcatgcaaagcagcaggtttaccaacttcgtggactgtgaagagagcaattcagaatctgaagaggaggtagggataccagcatctctgcaaggagacctgggtagcgtgcttcatttgcaaaaggccgatggtgatgtaccacagtgggaagtattcttcaagcggaacgacgaaattacggatgaaagtttggaaaattttcccagcagtacagtggcgggcgggagtcagagtcccaagcttttttctgatagtgatggagaatccacacacatttccagtcagaacagctctcagtcaacccatataacagagcagggtagccagggctgggattctcagagtgataccgttctcctaagttctcaagaacggaacagcggggatatcacatccctcgacaaggccgactatagacccactattaaagagaatattcctgctagcctgatggagcagaatgtgatctgccccaaggacacttacagtgatctgaagtccagggacaaggatgtgactattgtccctagcactggcgagccaaccacactcagctcagagacacacattccagaggaaaagagcctgctgaacttgtccacaaacgccgacagccagtccagctccgacttcgaagttcctagtacgcccgaagccgaacttccaaaacgcgaacacttgcaatatttgtatgaaaaattagccaccggagaaagcatcgctgtgaaaaagcgcaagtgctcccttctggatacatag

SEQ ID NO: 14929 - DNA, 1719 bp, Artificial Sequence
  Description of Artificial Sequence: Synthetic coding sequence
atgtttctttttcaaggaaacaatggaactgtactatacaccggcgatttcagattggctcaaggcgaggcggcccgcatggaactgctgcattccggcggtcgtgtaaaagatattcagtctgtctatctggacacaaccttctgcgatccacgcttttatcagatccctagcagggaggagtgtctttccggggtgcttgagctggttcgcagctggatcacgcggtcaccatatcacgtggtctggctgaattgtaaggccgcgtatggatatgagtacctttttaccaacctgagcgaggaactgggcgtgcaggttcatgttaacaaactggatatgtttaggaacatgcccgagatcctgcaccacctcaccacagaccgcaacacccagattcacgcttgcaggcaccccaaagcggaggagtattttcagtggtccaagctgccttgcggcattacatccagaaaccgaattccgctccatatcatctctatcaaaccatcgacaatgtggtttggagagcggagtagaaaaactaacgtaattgtacgaacgggggaatcaagttaccgagcatgtttttcatttcatagctcatacagcgagatcaaggattttctgtcttatctgtgccccgtaaatgcctaccctaatgttattcctgttggcacaacaatggacaaagtggttgagatcttgaaaccactctgtcggagtagtcaatcaacagagcctaagtacaagccactgggaaaattaaagcgagcacgtaccgtgcacagggactctgaagaagaggatgattatctttttgacgatcccctgcctatcccactccggcacaaagtgccctacccagaaacgtttcacccggaagtgttcagtatgaccgcggtaagtgaaaagcaaccggagaagctccggcagacccctgggtgctgcagggcggagtgcatgcagtctagtcgctttacaaattttgtcgattgcgaggagagtaattcggaaagcgaagaggaagttggaattccagcctctcttcagggagatcttggatccgtgctccacctccagaaagcagatggcgatgttccccagtgggaagtgttttttaagcggaacgacgaaataaccgatgaatctctggaaaatttccccagcagcacagtcgccggtgggagtcagagtcctaagctgtttagcgacagcgacggcgagtccactcacattagcagtcaaaatagcagccagtccactcacattacagagcaggggtctcagggctgggattcgcagagtgatactgtgttgctgtcatcacaggaacggaattccggggacattacctctctggacaaggctgactaccgtccaacgataaaggagaacatacccgcaagcttaatggaacaaaacgttatctgccctaaagatacctattcagacttaaagagccgcgacaaggatgtgacaatagtaccctcaacaggtgagcctaccacgctctcctcagagacccatattcccgaggaaaagagcctgttaaacctcagtaccaatgccgattcgcagtctagctctgacttcgaagtgccctcaacccctgaggcagaactgcccaagagggagcatctgcaatatctctatgaaaaactggctactggcgaaagtatcgccgtgaaaaaacggaagtgcagccttctggacacgtag

SEQ ID NO: 14930 - DNA, 2079 bp, Artificial Sequence
  Description of Artificial Sequence: Synthetic coding sequence
atgtccagcttcgagggtcagatggccgagtatcctaccatctcaattgacaggttcgatagagaaaatttgcgggctagagcctacttcctcagccattgtcataaggaccatatgaagggactgcgggctccaaccttgaaacgccgcttggaatgcagcctgaaagtctacttatattgcagccccgtcacgaaggaactccttctcacatctccgaagtacaggttctggaaaaaacgaatcatctccatagaaatagaaaccccaacgcagatcagcctggtcgacgaagcatctggggaaaaggaagagattgtggtcacactattacccgcaggacactgtcctgggtcggtgatgttcctgtttcagggaaacaacgggaccgtcctgtacacaggtgacttccggcttgcccagggcgaagccgctagaatggagttgctgcattccgggggtcgcgtcaaggatattcagtctgtgtacctggacactaccttctgcgatccacgtttctatcaaatcccttctcgagaagagtgcttaagtggcgtgctggagttggtgcggtcatggatcacgaggagtccataccatgtggtctggctaaactgcaaggctgcctatgggtacgagtatctgtttaccaacctgagtgaggaactcggtgtccaggtgcatgtgaacaagctcgacatgttccgaaatatgcccgagatcctgcatcatcttaccacagatagaaatacgcaaatccacgcctgtaggcaccccaaggcggaagagtatttccaatggtccaaactgccctgcggcatcacttctcgaaaccggattccgttgcacatcatctctattaagccttccacaatgtggttcggcgagagatccaggaagacaaatgtcatcgtgcggactggtgaatcatcatatcgagcatgtttcagctttcattccagttacagtgaaatcaaggatttcctctcctatctgtgtccggtgaatgcctacccaaacgtgattcctgtgggaaccacaatggacaaagttgtggagatcttgaaacccctctgtaggagctctcagagcacagagcctaaatacaagcctcttgggaaactaaaacgcgcacgaactgtacacagggactcggaggaagaagatgattatctgttcgatgatccactgcccatccccttgcggcataaggtcccttatcccgagacctttcatccagaagtcttttcaatgacggccgtgagtgagaagcaacctgagaagctcagacagactccaggctgctgtcgggctgagtgcatgcagagcagccggttcactaattttgtggattgcgaggagtccaatagcgagagtgaggaggaagtggggatcccggcatccctgcagggcgatctgggcagcgtgctgcatctgcaaaaagccgacggcgacgtacctcaatgggaagtatttttcaagcgaaatgatgagattaccgacgagtctctggagaattttccttcttccacggtggcgggcggttcacagtctcctaaattattttctgactccgatggggagagcactcacatttctagtcagaactcctctcagtcgacacacatcactgagcaggggtctcaggggtgggattctcaatccgatacagtccttctctcttcgcaagaacggaattccggcgacattacctcgctggacaaggccgactatcgtccaaccatcaaggagaatatcccggcctcccttatggagcaaaatgttatttgcccaaaagatacctattctgacctaaaaagtagggacaaggatgtgaccattgttccctctaccggggagccaacaaccctgagctccgagacacacattccagaagagaaatctttgttgaacctgtcaactaatgcagactcccagagctcatccgacttcgaggtgcccagtaccccagaggccgagctgccgaagagagagcatcttcagtacctgtatgagaagctcgcaactggggaatcgattgctgtgaagaaaagaaaatgttctctgctcgacacctag

SEQ ID NO: 14931 - DNA, 1305 bp, Artificial Sequence
  Description of Artificial Sequence: Synthetic coding sequence
atgagttcctttgaaggccaaatggccgagtacccaacaattagcatcgacaggtttgaccgagagaaccttcgcgctagggcctattttctgagccactgtcacaaagaccatatgaaaggcctgcgcgcaccaactctgaaacggcgccttgaatgctccctgaaggtgtacttatactgcagccccgtcacgaaagagctgctcttgacatctcccaagtaccggttctggaaaaagaggattatcagtatcgagatcgaaaccccgacacagatctccctggtggatgaggccagcggggagaaggaggaaatagtggtgacactgctcccagccggccactgtcctggaagtgtaatgtttcttttccaagggaataacggcactgtcctctatacgggagacttcagacttgcgcaaggcgaagcagcaaggatggaactgttgcattctggaggtagagtcaaggacatccaaagtgtgtaccttgatactacattctgtgacccaaggttctatcaaatccccagtcgcgaggagtgtctctccggcgtcctcgaactggtacgatcttggattactcgttcaccctaccatgtcgtgtggctgaactgcaaggctgcttatggctacgagtatctgtttaccaacttgagtgaggagctgggggttcaggtgcacgtcaataaactcgatatgtttcggaatatgccagaaattctgcaccatttaacaactgacaggaacacacagatccatgcctgtagacatccaaaggctgaagaatatttccagtggagtaagctgccctgtggcatcacttctcgcaacaggatacccctacacatcatctccataaagccgagtaccatgtggttcggggaacgctccagaaaaaccaacgtgattgtgaggaccggcgagtcttcgtaccgggcctgtttctcattccattcatcatatagcgaaattaaagatttcctgagctacctctgtccagtgaatgcctatccaaatgtgatcccagtgggcactacgatggacaaggttgtggaaatcctgaagccactgtgccgctccagccagagtacagaaccaaaatataagccgctgggcaagttaaagcgcgcgcgaactgtacatagggactccggtagccattccgtaacccaggccaggatgagatggtgccaccatgactccctctacccccttacccctggcatcaaaagatcatcctgcttgtcactgctcacgagctggatcacaggtgcctaccggcacgcccagctcatgatctag

SEQ ID NO: 14932 - DNA, 1719 bp, Artificial Sequence
  Description of Artificial Sequence: Synthetic coding sequence
atgttcctgttccagggtaacaatggcaccgttctctacaccggggatttcagactcgcgcagggcgaggccgcaaggatggaattgctgcacagcggaggccgcgtgaaagacattcagtcagtttatctggacactaccttctgtgacccccgattttaccagatccctagccgtgaagaatgtctgtcaggcgtgctggagctggtgcgttcttggataacacgaagtccctaccatgtggtctggctgaactgcaaggctgcctacgggtacgaatacctgttcaccaatctgtcagaagagctcggagtacaggttcatgttaataaactagacatgttccgcaacatgcctgaaattttacatcacttaacaactgacagaaacacacaaatccacgcgtgtagacatcccaaagccgaagaatatttccagtggtccaagctcccctgcggtatcacatctaggaaccgtattcctctccacattatcagcatcaaaccctctacaatgtggttcggggagcgatcccggaagaccaacgtgatcgtgaggactggtgagtctagttatagggcttgtttctcctttcactcgagctattctgagatcaaggatttcctctcatatctttgtcctgtaaacgcatatccaaacgtgattccagttggtactaccatggataaggtggtggagatcctgaaacccctttgtcgatcaagtcagtctacagaaccaaagtataaacctctcggaaagctgaaacgcgcccgaactgtgcatagagattccgaggaggaagacgattacttgttcgacgatccacttcccatccctttgcggcacaaagtcccctatcccgagacctttcatcctgaagtattctctatgactgcagttagcgaaaaacaacccgaaaagctacggcagacaccaggatgctgcagggccgagtgcatgcagagctcccgctttaccaacttcgtagactgtgaagaaagcaatagtgagagcgaagaagaagtaggaatccccgcaagcctgcagggggacttgggatctgttctgcatctgcagaaagctgatggggatgtgcctcagtgggaagtttttttcaaacgaaacgacgagattacagatgaaagtctagagaacttcccatcaagtacagtggccggcgggagtcagtcccctaagttgttttccgatagtgatggagagtctacacacatatcaagtcagaacagcagccagagtacacatattaccgagcagggatctcagggatgggactcccagagcgacacggtgctactgtcttctcaggagaggaactctggcgatataacctccctggataaggccgattacaggcctacgataaaagagaatatccctgcttcactgatggagcagaacgttatttgtcccaaagatacttactcagacctaaaatcgagagataaagacgttaccatcgtacctagcactggggaaccgaccacgttgtcatccgagacacacatccctgaggagaagagcctgctgaacctttccactaacgcagactcccagagctcatcagacttcgaagtgccttcgacccccgaggcagagctgcctaagagagaacatctccaatatctttacgagaagctggcaacaggagaatctatagcggtgaagaagcggaagtgtagcttacttgacacctag

SEQ ID NO: 14933 - DNA, 354 bp, Artificial Sequence
  Description of Artificial Sequence: Synthetic coding sequence
atggagctactgcattctggggggcgcgtcaaggacatccaatctgtttatttagacactacgttctgtgacccgcgattttatcagatccccagcagagaggaatgcctttccggggtactcgagctggtccggtcttggatcacccgttctccctaccatgtggtttggttaaactgtaaggccgcctatgggtatgaatacttgttcaccaatctgagcgaggagctgggggttcaggttcacgtgaataagctggacatgttcaggaacatgccagagatcctgcaccatctcacaactgatcgtaatactcagatccatgcctgtcgccatccaaaagctgaggagtag

SEQ ID NO: 14934 - DNA, 1719 bp, Artificial Sequence
  Description of Artificial Sequence: Synthetic coding sequence
atgttcctgtttcagggtaataacggcaccgtgctgtatactggagatttccggctagcccaaggggaagccgctagaatggaactactgcactcaggagggagggtgaaggacattcagtcagtgtacctggacaccaccttttgtgatcctcgattttaccaaatcccgtcccgggaagagtgcctgtcaggggtgctagaactagttaggtcatggatcacccgctctccgtaccatgttgtgtggttaaactgcaaagccgcatatgggtacgagtacctgttcacgaacttaagcgaagaactgggagtgcaggtccacgtgaataagcttgatatgtttcgtaatatgccagagatcttacaccaccttacgacagataggaacacacagatccatgcatgccgccaccctaaggcagaagagtatttccaatggagtaagctgccgtgtggcatcacatcccggaacaggattcctctccacattatcagtataaaaccctcaactatgtggtttggcgagagaagccggaaaaccaatgtcattgtgcgaactggcgagtcaagctaccgggcctgtttcagctttcacagcagctatagcgagattaaagatttcctttcctacttgtgtccagtgaatgcttaccctaacgtcattccagtcggcaccactatggacaaagtggtagaaatcctcaagcccttatgccgcagttcgcagagcactgagccgaagtacaagcccctcggaaaactgaagcgcgcccggacggtccatcgggactccgaggaggaggatgattatctgtttgacgaccctctgccgattcctctcagacacaaggttccataccccgagaccttccacccagaagtgttttccatgacagctgtttcggaaaaacagcctgaaaagcttcgacagacacccgggtgttgcagagcagaatgcatgcagagtagccgtttcaccaatttcgtagattgtgaggagagcaacagcgaaagcgaggaagaagtaggaattcccgcgtctctccagggcgacctgggatcagtccttcacctccagaaagctgatggagatgttccacagtgggaggtgttcttcaagaggaatgacgaaatcacagacgagtccctcgaaaattttccatcctctacagtggccggcggatcgcaaagccctaagctattcagtgattctgatggtgagtcaacacacatctcctctcaaaactcatctcagagcacacacatcacggagcaggggagccaaggatgggactcacaatcagataccgtgctcttaagttctcaagagcggaactctggtgatatcacgtccttggacaaagcagattatagacccacgatcaaagaaaatattccagcatctttaatggaacagaacgtgatctgtccaaaggatacatattctgacctcaagtccagggacaaggatgtaaccatcgtgcccagcactggcgagcccaccaccctgagttctgagacacacataccggaggagaagtcccttctgaatctttcgacgaacgctgactcccagtcctccagtgattttgaggttccctccaccccagaggcagaactgcccaaacgtgaacacctgcagtacttgtacgagaaactggctactggggaaagcatcgcagtcaaaaaacggaaatgttccctgctcgatacatag

SEQ ID NO: 14935 - DNA, 174 bp, Artificial Sequence
  Description of Artificial Sequence: Synthetic coding sequence
atgaagcaccaagaacgcttcctgttccagggcaacaacggtacagtcctttatactggggacttcagactagcgcagggggaagctgctaggatggagctgctgcatagtgggggccgggtgaaagatatccaatctgtttatcttgacacgactttttgtgaccccaggtag

SEQ ID NO: 14936 - DNA, 807 bp, Artificial Sequence
  Description of Artificial Sequence: Synthetic coding sequence
atggaggtcacaggggacgctggggtgcctgagtctggagagatccgcacgctgaaaccttgcctcctaagacggaattactcacgggaacagcatggggtggccgcctcatgcctggaagatcttaggtccaaggcttgtgacattcttgccattgataaatcgctgacccctgttaccctggtgctcgcagaagatggcactatagtggacgatgacgattactttctctgcctgccgtctaatactaagttcgtggcactcgcaagcaatgaaaaatgggcatacaataactccgatggcgggacggcgtggatcagccaagaatccttcgatgtggatgaaacagattctggagctggtctgaaatggaagaatgttgcgcgccagctcaaggaagacctgagttctatcatattgctgtcagaggaagatctgcagatgcttgtggacgcaccttgcagcgatcttgctcaagagttgcgacagtcctgcgcgacagtgcagcggctgcagcacactcttcaacaagtacttgatcagcgggaggaggtccgacagagtaagcaattgctgcaactctacttgcaggcactcgaaaaggaggggtctctcctcagcaagcaggaagagtctaaagctgccttcggggaggaggttgatgctgtcgacacgggaatttcacgggaaactagcagtgacgtggccctggccagccacattctgacagcgctgagggagaagcaagcccctgagttgagcctcagcagccaggacctcgaagttggcggaaaccaaggtcactag

SEQ ID NO: 14937 - DNA, 996 bp, Artificial Sequence
  Description of Artificial Sequence: Synthetic coding sequence
atggaagttaccggtgatgcaggcgtgcctgagtctggcgaaattagaacccttaagccctgccttcttcggcggaattattccagggaacagcacggcgtcgccgcatcctgtctagaggacctccgttcgaaagcttgcgacatcctggctatcgacaagagccttaccccggtgactttagtgctggctgaagacggtacgattgttgatgacgatgattacttcctgtgcctgccctctaacactaagttcgtagcgcttgcctctaatgaaaagtgggcgtacaataactctgacggtggaacggcgtggatttctcaggagtcttttgatgtggatgagaccgatagcggagcgggactcaaatggaaaaatgttgcacggcaacttaaggaggacctgagttctataattctcctatccgaggaagatctgcagatgctcgtcgacgcgccttgtagcgatctcgcccaggagctgcgccagagctgtgcaaccgtgcaacgcttacaacatacactccagcaggttttggaccaaagggaagaggttagacaaagtaaacagctgctgcagctgtatctacaagccctcgagaaagaaggaagcctcctttcaaagcaggaagaatccaaagctgcttttggggaagaagtggatgccgtggatactggcatttctagggagacatcaagcgacgtggcacttgcaagtcatatcctcactgccctgcgggagaagcaggctcctgaactctcgctgtccagtcaggacctcgagctcgtgacaaaggaagaccccaaggctcttgcggtcgcacttaattgggacatcaaaaagactgaaacggtgcaagaagcatgtgaaagagagctggccttacgtctgcagcaaacacagagtctccactctctgcgcagtatcagcgccagtaaggcctctccgccaggagaccttcaaaaccccaagcgggcgaggcaagatccgacatag

SEQ ID NO: 14938 - DNA, 510 bp, Artificial Sequence
  Description of Artificial Sequence: Synthetic coding sequence
atggccgctgagagtctaccattcagttttggtaccctttctagttgggagctggaggcctggtacgaggacctgcaggaggttttgtccagtgatgagaacggtgggacctatgttagccctcccggtaatgaggaagaagagagcaagatcttcaccaccctcgatcctgctagcctggcttggttaactgaggaagagcccgagcccgcggaggtcacatccacgtcacagagccctcactctccagatagtagccagtcttcccttgcccaggaagaggaggaggaggaccaaggtagaaccagaaaacgcaaacaatcaggtcactctcctgcccgcgctggcaagcaacgcatgaaggagaaggagcaagagaacgaacgcaaggttgcccaacttgccgaagagaacgaacgcttgaagcaggagattgaacgactcactcgagaggttgaggccacccggcgcgcccttatcgacaggatggttaatctgcaccaagcttag

SEQ ID NO: 14939 - DNA, 510 bp, Artificial Sequence
  Description of Artificial Sequence: Synthetic coding sequence
atggcagccgagagcctgccatttagtttcgggaccctgagtagctgggagctcgaggcctggtacgaggacctccaagaggtccttagctccgacgagaacggtggtacgtacgtaagcccccctggaaatgaggaggaagaatccaagattttcacaacactcgacccagcttcgcttgcttggcttacggaggaggagccagaaccagccgaggtgacttcaacttcccagagcccgcactcacccgatagcagccagtcttctctagcacaggaagaagaggaggaagatcaggggagaacgcgcaagcgcaaacagtcgggccattcccccgccagagcgggaaaacagcggatgaaggaaaaagagcaagaaaatgagcgtaaagtggcccagttggccgaagagaacgagcgattaaagcaggaaatcgagagactcacccgcgaggtcgaagctaccagacgggctctgatcgatcgcatggtgaacttacaccaggcctag

SEQ ID NO: 14940 - DNA, 438 bp, Artificial Sequence
  Description of Artificial Sequence: Synthetic coding sequence
atggaacttgtgcctgcgaccccccattatcccgccgatgtcctttttcagaccgatcccacggctgagatggctgctgaatcactccccttttcatttggcacactgtcctcctgggaactggaggcatggtacgaagaccttcaagaggtcctgagtagcgacgagaacggaggaacgtacgtgagcccccctgggaatgaggaggaggaaagtaaaattttcactactcttgacccagcatctctggcttggctgacagaggaggaacccgaaccagccgaggtgacgagcacaagtcaatcgccacacagcccagattcctctcagtcttcattagcgcaagaagaggaggaagaagaccagggccgaacccggaagaggaagcagtccgggcattcgcccgctcgtgctggtaagcaacgcatgaaagaatag

SEQ ID NO: 14941 - DNA, 579 bp, Artificial Sequence
  Description of Artificial Sequence: Synthetic coding sequence
atggagttggtgcccgcaactcctcattatcccgcagatgtgctgttccaaaccgaccccacagccgaaatggcagctgagagcctgccatttagcttcggaaccctgtcgagctgggagctcgaggcctggtatgaggacctgcaggaagtgctgagttctgacgaaaacgggggaacctatgtgtcaccaccagggaatgaggaagaagaatctaaaattttcaccactctggatcccgcttctctcgcatggttaacagaagaggagcccgagcctgctgaggtgactagcacctcacagtcaccacacagccctgatagcagccaatcgagtctcgctcaggaggaggaagaagaggaccaagggcggaccagaaagaggaaacagtccgggcattcccctgccagagctgggaagcagaggatgaaagagaaggaacaggagaatgaaaggaaagtagcacaattggctgaagagaatgaacggcttaagcaggaaatcgaaagactcacgcgcgaagtggaagccacccggcgggctctcatcgatcgcatggtgaacctccaccaggcatag

SEQ ID NO: 14942 - DNA, 579 bp, Artificial Sequence
  Description of Artificial Sequence: Synthetic coding sequence
atggagttagtgcctgctacaccacattaccctgccgatgtcctgttccaaactgatccaacagccgagatggcggcagagtccctcccattctctttcgggactctgtcgtcgtgggagttagaggcctggtatgaggatctccaagaggttttaagctcagacgaaaatgggggtacttacgtgtctccccctggaaacgaggaagaagaaagcaagatcttcacgacgctggacccagcaagtctggcctggctgacagaggaagaacctgaacctgcagaggttacaagtacctcgcagagccctcatagcccggattcgtctcagtcgagcctggcgcaggaagaggaggaagaggaccagggacgaactcggaagcgcaaacaaagtggccattcgcctgcgcgtgccggcaaacaacggatgaaggagaaggagcaagagaacgagcgcaaagtggcacagctggccgaagagaatgagaggctgaagcaagaaattgagcgcttaacaagggaggttgaggctacaaggagggcactgattgacaggatggtgaatttgcatcaggcctag

SEQ ID NO: 14943 - DNA, 864 bp, Artificial Sequence
  Description of Artificial Sequence: Synthetic coding sequence
atggcctccctggaggtctccagaagccccagaaggtcacgccgcgagctcgaagttcgctcaccacgacagaataagtactccgtccttctgcccacatacaacgagagagaaaatctgcctctgattgtatggctgctagtcaagtcattctctgagagtgggatcaactatgaaatcatcattattgatgatggaagtccagatggaacccgagacgtagccgagcagcttgaaaagatttacggctccgatcggattctcttgaggccgcgggaaaaaaagctcgggttgggcactgcgtatatccatggtatgaaacatgcgactggtaattatatcattattatggacgccgatctgtcccaccacccaaaatttattccagagttcattaggaagcaaaaggaggggaattttgacattgtgagcgggacccggtacaaagggaatgggggtgtgtacgggtgggaccttaaacgaaagattatctctgatggcgtgctgccttgttgccccggctggagtttattgggatcatctgaccccgccattctcgctagctgggactattcccgtggcgcaaattttctgacacagattttgctgcggcctggagcttcagacctcaccggttccttccgcctgtacagaaaggaggtactggaaaaattgatcgagaaatgcgtgtccaaaggatatgtcttccagatggagatgatcgttcgggcacgtcagctgaattatactattggcgaagtgcctatttcatttgtcgatagagtgtatggtgagtcaaaacttggaggcaacgagatcgtatccttcctgaaaggcttgcttacattgtttgcaaccacctag

SEQ ID NO: 14944 - DNA, 768 bp, Artificial Sequence
  Description of Artificial Sequence: Synthetic coding sequence
atggcatcactcgaggttagccgaagccctcgtcgttctagaagagaactggaagtacgctctcctagacaaaacaaatattctgtcttgctgcccacgtataatgagagagaaaatttacccctaatcgtgtggctgctggttaagagtttctcagaaagcggaatcaattatgaaataattatcattgacgacggcagccctgatggaacccgagacgtggctgagcagcttgaaaaaatctacggctcagataggatcttacttcgacctcgcgaaaagaagcttggcctggggacggcttacattcacggcatgaaacacgctacaggaaattatattattatcatggacgccgatctctctcaccacccaaaattcattccagagtttatctccgatggagtgctcccctgctgccctggctggtcactactgggtagctctgacccagccattctagcctcatgggattactcccggggagcaaatttcctcacacagattttactgaggcctggcgcgtcagatttaacgggctcttttaggctgtatcggaaagaagtacttgaaaagcttattgaaaagtgcgtgtcaaaggggtacgtgttccagatggagatgatcgtgcgggctaggcaactgaattacaccatcggcgaggtgccaatctcatttgtggatcgggtgtacggtgagagtaaattggggggaaacgagatcgtcagcttcctgaaaggccttctgacgctgttcgctaccacatag

SEQ ID NO: 14945 - DNA, 888 bp, Artificial Sequence
  Description of Artificial Sequence: Synthetic coding sequence
tgagcaagcctggaagtcagtcgttccccacgaagatcgcgaagggaattagaagtccggtctcctcggcagaataaatactccgtcctgctgccaacttacaatgaaagagagaatcttcctcttatagtgtggttacttgtgaaatcattcagcgagtccggcatcaactacgagataatcatcatcgatgacggcagtccagacggaacacgtgacgttgccgagcagctggagaaaatctatggttccgatcgcatactgctccggccacgagagaagaagctgggcttagggaccgcatatattcacggaatgaagcatgcaactggcaactatattattatcatggacgccgatcttagccatcaccctaaattcattccggagtttattcgcaagcagaaggaggggaacttcgatatcgtaagtggtactaggtacaagggcaatgggggtgtctacggttgggacctgaaaagaaagattatctccgacggggtgctcccatgctgccctggctggagcctcctggggtcatctgacccggctattctggctagctgggactatcggtgcgagccccctagactggcttctaggggagcgaattttctgactcagattctgctcaggcctggcgcttccgacctcacgggttcatttcgtctgtatcgtaaggaggtgctggagaagttaatagaaaaatgcgtgagtaaaggctacgtgtttcaaatggagatgatagtacgcgccaggcagctgaattataccattggagaggtcccaatctcatttgtggacagggtgtacggcgagtctaagcttggtggtaacgagattgtgagtttccttaaaggcctgcttaccctgttcgccacaacttag

SEQ ID NO: 14946 - DNA, 783 bp, Artificial Sequence
  Description of Artificial Sequence: Synthetic coding sequence
atggctagcttggaagttagccgcagccctaggcgcagcagacgcgaactggaggtaagatcaccacggcagaataagtattccgttttactcccgacttataacgaacgcgaaaatttaccgttgatagtgtggcttcttgtgaaaagcttcagtgagagtggcattaattacgaaattatcatcatcgatgacggctctcccgatggaactcgggacgtagcagaacagttggaaaaaatttatgggtctgatcgtatcctgctgcggcctcgggaaaagaaactcgggttgggtaccgcctacatccacggcatgaagcacgctactggtaactatatcattatcatggatgcggacctctcacaccacccaaagtttatccctgaatttattagaaaacagaaggaaggcaactttgatattgtctctgggactaggtataagggcaatggaggagtctacgggtgggaccttaagcgaaagattattagtcggggtgctaatttcctgacacagatcctgctccggcccggtgccagtgacttaaccggctcatttcgcctgtacagaaaggaagtgctggagaagttgattgaaaaatgtgtgtccaaaggatacgtatttcaaatggagatgatcgtaagagcaagacagctgaattacacaataggggaagtaccaatatcattcgtcgatagagtgtacggggagagtaaactcggtggcaacgagattgtgtcctttcttaagggactgcttacgctattcgccaccacttag

SEQ ID NO: 14947 - DNA, 666 bp, Artificial Sequence
  Description of Artificial Sequence: Synthetic coding sequence
atggccagtctggaagtttctagatcccctcgcagatcccgacgagaacttgaagtgcgatccccccgccaaaacaaatacagcgtacttctaccgacttataatgagagggaaaacttacctctcattgtgtggctgctagtcaagtccttttctgagtcaggcatcaactacgagataatcattatcgatgacggcagtcctgatggtacccgtgacgtggccgaacaactcgaaaaaatctacggttccgacaggattttgcttagacctagagagaaaaaactggggctcggcacagcgtacatccatggaatgaagcatgctacaggaaactatatcattataatggatgcagatctgtcccaccacccaaagttcatccccgaatttatctccgatggggtgctcccctgctgtccaggatggagcttactaggcagctctgatcccgccatactggcatcctgggactactcaagaggtgcgaactttctaacccagatccttttacgtccaggtgctagcgatttgacgggttccttccgtctgtatagaaaagaagtcctggagaagttgattgagaagtgtgttagcaaaggttatgtgtttcagatggagatgatagtgcgagccaggcagctcaactacacaattggagagtag

SEQ ID NO: 14948 - DNA, 888 bp, Artificial Sequence
  Description of Artificial Sequence: Synthetic coding sequence
atggcgagccttgaagtgtcaagatccccccggcggtcacgacgggagttggaggtccgatcgcctagacagaacaagtattccgtcctgcttccaacctataatgagagggaaaacctacccttgatcgtttggttgctggtcaaaagttttagcgaaagtggaatcaactacgaaattatcatcattgatgatgggtctcccgacggaactagggatgtggccgagcagctggagaagatctatggctcggataggattcttctccgccccagagaaaagaagctgggcctaggcaccgcttacattcacggtatgaagcacgctaccggaaactacattattataatggacgccgatctgtcccatcatccaaagttcattcccgagtttatacggaagcagaaggagggtaactttgatattgtttctggcacacgctacaagggaaacggcggggtgtatgggtgggatctgaaacggaagatcatttctgatggggtccttccatgctgtcctggatggtctttgctcggttccagcgatcctgcaatattagccagctgggactatcgctgcgagcccccaagactcgcatcacgaggagccaattttctgactcagattctcctaagaccaggggcctccgatttgacaggctcttttagactgtacagaaaagaggtgttggagaagctcattgaaaaatgcgtgtccaaaggctacgtgttccagatggaaatgattgtgcgggcgaggcagcttaactacacaattggggaggtacctatctcatttgtggaccgcgtctatggcgagagcaaattgggcgggaatgagatcgtttcttttctgaaggggttattaacccttttcgcaaccacatag

SEQ ID NO: 14949 - DNA, 1332 bp, Artificial Sequence
  Description of Artificial Sequence: Synthetic coding sequence
atgcggcgccaggttatggctgccctggttgtttctggtgccgccgagcagggcggccgcgatggcccaggccggggacgggcgccccgggggcgggtggcgaaccagatccctcctgaaatactcaagaacccccaactgcaagctgccatcagagttttgccaagcaattataatttcgaaattccaaagaccatttggcgcattcagcaggcccaggcaaagaaggtagcactgcaaatgcctgagggtttgctgctttttgcctgcacgatagtcgacattctggaacgtttcactgaggctgaggtgatggttatgggggatgtgacctacggtgcctgttgcgtggacgactttactgcccgtgcccttggcgccgatttcctggtccactacgggcatagctgtcttattccaatggacaccagcgcccaggatttccgggtcttatatgtgttcgttgatatccgcattgacactactcacctattggattcccttagattgacttttccacccgccaccgcccttgcactggtgtccactattcagtttgtatccactctccaggccgccgcccaggagctaaaggcagagtaccgtgtcagcgtcccccaatgtaaacccctatctccgggcgagattttgggctgtacaagccctaggctgtccaaagaggtggaggcagttgtctacctgggcgacggtcgcttccatctggagtctgtgatgatcgccaaccccaacgttcccgcataccggtatgacccttactcaaaggtcctatcaagagaacactacgatcatcagagaatgcaagctgcccgccaggaggcaatcgccaccgctcgcagcgctaaaagctgggggctgatccttggtacattgggcaggcagggtagccccaaaatcctggaacatctggaatcacgactgagagccctcgggctcagttttgtcaggctgcttctgagcgagatcttcccttcaaaactttccctgcttcctgaagtcgacgtttgggtccaagtggcttgcccccgtctgtcaatagactggggtaccgcttttcccaagcctctcttaaccccttacgaggccgctgtggccctccgggacatctcctggcagcaaccctacccaatggacttttatgcgggctcgagcttaggtccttggactgtcaatcacggccaggatagaaggcctcacgccccgggccggcctgccaggggcaaagtacaggagggatccgcccggcctccgtctgcagtggcgtgtgaggattgttcatgcagggatgagaaagttgctcctctagctccttag

SEQ ID NO: 14950 - DNA, 1146 bp, Artificial Sequence
  Description of Artificial Sequence: Synthetic coding sequence
atgattgatactcttaggccggtcccgtttgcatcagaaatggcaatctcgaagaccgttgcgtggcttaacgagcaacttgaattgggaaacgagagacttctgctgatggactgtagaccacaggaattgtatgaaagttcccacatagaaagcgccatcaacgtggccatcccaggcattatgctgcgcaggttacagaaaggtaacctcccagtcagagcactattcaccagaggagaagatagggacaggtttacacgccgatgtggtacagatacagttgttttatatgatgagtctagctccgattggaacgagaacaccggcggggagtctgttctgggcctgttgcttaaaaaactcaaggatgagggttgtagagcattctatcttgagggcggctttagcaaatttcaggccgagttttctttgcattgtgagacgaacctagacggctcgtgcagcagcagcagtccccccctgccagtcctcggtctgggcgggttacggatcagctccgattcatccagtgacatcgaatcagacctcgaccgagatccgaattctgcaacggattccgacggatcccccctgtccaactcgcagccgagcttccctgtggaaattctgccatttctgtaccttggctgtgccaaagatagcacaaacttagacgtactggaagagttcggtatcaaatatatcctgaatgtcacccccaacttaccaaacctgtttgagaatgctggggaattcaaatataaacagattcccatctctgatcactggtcccagaacttgagtcagttttttccagaggccatatcctttattgatgaggccaggggcaagaactgcggcgtgttggtgcactgtctggcaggcatttccaggagtgtgactgttaccgtggcatacctcatgcagaagttaaacctctcgatgaacgacgcctatgatattgtgaagatgaagaaatctaatattagccctaacttcaattttatgggccaattattagatttcgagcgaacgttggggctgagctcgccatgtgacaatcgcgtccccgctcagcagctgtactttacgacaccctccaaccagaatgtttatcaagttgattcgcttcagagcacctag

SEQ ID NO: 14951 - DNA, 708 bp, Artificial Sequence
  Description of Artificial Sequence: Synthetic coding sequence
atgattgatactctacgtcctgtgcctttcgctagcgaaatggcaatttcgaagacggtggcctggctgaatgagcagctcgaactcgggaacgagcgcctgctgttgatggactgtcgacctcaggagctctatgaaagttctcacatagagtctgcaattaatgtagctatccccggtattatgctccgccgtctccagaagggcaacttaccagtgcgggcactgtttacccgaggagaggacagagatcgcttcaccaggcggtgtggaactgatactgtggtcctgtatgacgagtctagctctgattggaacgaaaacactggcggcgaatctgtgctaggcctcctgctgaaaaaacttaaggacgaaggatgcagagccttttaccttgaggacgaagctcgggggaaaaactgcggtgtgctcgtccactgccttgctggaatttctaggagcgtcacagtcacagtcgcatatctgatgcaaaaattgaacttaagcatgaacgatgcttacgatattgtgaagatgaagaaaagtaacatctctcctaattttaacttcatgggacaactgctcgacttcgagaggacactgggcctctcatctccatgcgataatagggttcctgcccaacagctatacttcacaacgccatccaatcagaatgtgtaccaggttgattccttgcagtctacctag

SEQ ID NO: 14952 - DNA, 354 bp, Artificial Sequence
  Description of Artificial Sequence: Synthetic coding sequence
atgatcgatacgttacgaccggtcccctttgcctcagagatggccatttctaagacagtggcatggctgaatgagcaactggaactcgggaacgaaaggttgctactgatggattgtcggccgcaggaactttatgagagtagccatattgaatctgcaatcaatgttgccattccgggtatcatgttacgtcgtctgcaaaagggtaatcttcctgtgcgcgcactgttcacccgaggcgaagaccgcgatcgtttcacacgaagatgcggcactgacacggttgtgctttatgatgagagctcatccgactggaacgaaaacactggcggggagagcgtactggggctgtag

SEQ ID NO: 14953 - DNA, 1545 bp, Artificial Sequence
  Description of Artificial Sequence: Synthetic coding sequence
atggccgacgccgaggtaatcatccttccgaaaaagcacaaaaagaaaaaggagcgcaaatccctgcccgaagaggacgtggccgaaatccagcatgccgaggagtttttgatcaagccggaatccaaagtggctaagctggatacgagccaatggcccctgctcctgaagaattttgataaactgaatgtcaggacgacccactatacaccactcgcctgcggcagcaatcctctgaagcgtgagatcggcgattatattagaacaggcttcattaacctcgataagccttcaaatccatctagtcacgaggtcgtggcctggataaggcgtatattgagggttgaaaaaacaggccattccggtactctcgaccccaaagttacgggatgcctaattgtgtgtatcgagcgggccacacgacttgttaagtctcagcaaagtgccgggaaggaatatgtggggatcgtgaggctccacaatgcgatcgagggggggactcagttgtcacgcgcccttgaaacactgaccggagctttatttcaacggcctccactcatagccgctgtcaagcgacagctgcgcgttcggaccatctacgagtccaagatgatcgagtacgacccagagcgtagactaggcattttttgggtttcttgcgaggccggcacgtacatccgaaccctttgcgttcacctgggcttactgctgggcgttgggggccaaatgcaggaactgagaagggtgcgctccggagtcatgtccgaaaaggatcacatggtcacaatgcacgacgtgttggacgcccaatggctgtatgacaaccataaggacgagtcttatctcaggcgcgttgtctaccccctcgagaaactgttgacatcacataagcggcttgttatgaaggatagtgcagtcaatgccatttgctatggtgccaagataatgcttcccggggtgctgcgttatgaggatgggatcgaagtgaatcaagagattgtggtcattaccaccaagggggaggcaatctgtatggccatcgccctgatgacaacagctgtgatatctacctgcgaccacggaatagtggccaaaattaaacgagtaatcatggaaagggacacatatcccaggaagtgggggctgggcccaaaggcaagtcaaaaaaagctcatgattaagcaggggctgctcgataagcatggcaaacccacagatagcacccctgccacctggaagcaggaatacgtggattactcagaaagcgccaagaaggaagtggtcgcggaggtcgtgaaagctccgcaggtggtggccgaggccgctaagactgctaagcggaagcgggagtctgaaagcgagagcgatgagacaccacccgcagctccccagcttatcaagaaggagaagaagaaatccaaaaaggacaaaaaggccaaggctgggctggagagcggcgcggagcccggggacggggatagtgataccaccaagaaaaaaaagaagaaaaaaaaggctaaagaagtggagctggtttcagagtag

SEQ ID NO: 14954 - DNA, 7245 bp, Artificial Sequence
  Description of Artificial Sequence: Synthetic coding sequence
atggctgaaaacgtggtagaaccgggtccgccatctgccaagcgtccaaaactatcttccccagccctctccgccagtgcttccgacggcaccgatttcggctccctatttgacctggagcacgaccttcccgatgagctgattaattccacggagttggggctgaccaatggaggtgacattaatcagctccagacgtccctcgggatggtgcaggatgcggcatccaagcacaaacagctgagtgagcttctgcgctccgggagctcacctaacctgaatatgggggtgggaggccccggccaggttatggccagccaggcccagcagtcctcccctggcctcggcttgattaatagcatggtaaaatcccccatgacccaggccgggcttactagtccaaatatgggaatgggaacctccggccctaatcagggccctactcaatcgacaggaatgatgaatagccccgtaaaccagcccgccatgggtatgaacaccgggatgaatgcaggtatgaatcctggaatgctggcagctggcaacggccagggtattatgcctaatcaggtgatgaatggatccatcggcgcagggaggggaagacaaaacatgcagtatcctaaccccggaatggggtccgcaggcaacctgctcacggaacctttgcaacaggggagcccacaaatgggcggccagacaggcctcagagggccacagccactgaaaatgggtatgatgaacaaccccaacccttatggctccccatatactcagaaccccgggcagcagataggagcctcaggcctgggtttacaaatacaaactaagactgtgctctccaacaacctttctcctttcgcaatggacaaaaaggcagtacctggcggaggaatgcccaacatgggccagcagcccgcccctcaggtacagcagcccggcctggtgactcctgtggcgcagggcatgggatcgggagcgcacaccgcggatcctgagaaaagaaaactcattcagcaacagttagtcctgttgttgcatgctcataagtgccagcggcgtgaacaggccaatggtgaggttagacagtgtaacctgccacattgcaggacgatgaagaacgtcctgaaccacatgactcactgtcaatccgggaaaagctgccaagtggctcactgtgcaagcagccgccagatcatctcacattggaaaaattgcacacgccacgattgtccagtttgcctgcccttgaaaaacgccggggacaaaagaaaccagcagccaatcctgaccggtgctcccgtgggattaggaaatccctctagtttgggagtgggacagcagagtgcacccaacctgtcgacagtttcccagatagaccccagcagcatagagcgcgcctatgccgccttaggcctcccatatcaggtcaatcaaatgccaactcagccccaggtccaggccaaaaatcagcagaaccagcaacccggtcagtcaccccaggggatgcggcccatgagtaacatgtcagcaagtcctatgggcgtgaatggcggtgtaggtgtgcaaacgccctcactcttgtctgacagtatgctacattccgcaataaacagtcagaatcccatgatgagtgagaacgcaagtgtaccaagcttgggcccaatgccaaccgccgcccagcccagcaccactggcatccgcaagcaatggcacgaagatatcacacaggatttgagaaatcatctggtccacaaactggtgcaagcaatttttcctacgccagatccggccgcccttaaggacagacgaatggagaatttggtggcatacgcaaggaaggtggagggcgacatgtatgagagcgcaaacaatcgagccgaatactaccacctgctggcggaaaaaatttataaaatacaaaaggaactcgaggaaaagcgccgcactagattacagaaacagaatatgctgcctaacgctgccggtatggtgccggtatctatgaacccagggccaaacatggggcagcctcagccagggatgaccagcaacggcccccttcctgacccctcgatgatcagaggcagcgttcccaaccagatgatgccccgcatcactccccagtcgggccttaaccagtttggacagatgtcaatggctcagcctcccatcgttccaagacagacccctcctctgcaacaccatggacagctggcacagcccggtgctctgaatcctccaatgggatatgggcctaggatgcagcagccatcaaatcagggacagttccttcctcagacccaattcccatcgcaggggatgaacgtcaccaacatcccgctcgcaccctcaagtgggcaggctccagtatcacaggcgcaaatgtcctcctctagttgccccgtgaactcccctattatgcctccaggaagccaggggtctcacattcactgtccacagcttccccagccagcattgcaccaaaattctccgagtccagtgccttcacgcacccctacccctcaccatacccctccctccatcggtgcccaacagcctcctgcaacaaccatcccggcgcctgtgcccaccccgcctgcaatgccacctggcccacagtcccaggccttacatccacccccgcggcaaactcctacccctccaacaacccaacttccccagcaggttcagccctccctgccagcagcacccagcgccgaccagccccagcaacaaccaaggtcacaacagtccactgctgcttctgtgcctactcctaccgcaccgcttttgccaccccagccagctaccccactctcccagccagctgtctccatagagggacaggtatctaatcccccaagcacatcttccacggaagttaactcacaggcaattgccgagaagcagccaagtcaagaggtcaagatggaagccaaaatggaggtcgaccaaccggagcccgccgatactcaacctgaggacatttcggaatccaaggttgaggactgtaaaatggagagcactgaaaccgaagaacggagtacagagcttaaaacggaaattaaggaagaggaagatcagcccagcacctcagccacccagtcatcccctgccccgggtcaaagcaaaaagaaaattttcaaacccgaggagttaagacaggctcttatgcccaccctggaggcactgtacagacaggaccccgagtccctgccattccgacaacccgtcgatccccaattgttgggcatacctgactacttcgatatagtaaagagtccgatggacctctcaaccatcaagcgaaagcttgacaccgggcagtaccaggaaccatggcagtatgtggatgacatctggcttatgttcaataatgcatggctgtacaacaggaagaccagcagagtgtataagtactgttcaaaactgagtgaggtttttgagcaggagatcgatcctgtgatgcaaagtttggggtactgttgtggacgcaaattagagttcagtcctcaaactttgtgttgttacggcaagcagttgtgcacgatccctcgggacgcgacctattacagctatcagaatagatatcacttctgcgagaaatgcttcaatgagatacagggagaatccgtgagccttggagacgacccaagccagcctcaaactaccattaataaagaacagttcagcaagcgcaaaaatgacactctggacccagaattattcgtggagtgtacagagtgtggcaggaagatgcaccagatctgtgttctgcatcacgagatcatttggcctgccggattcgtgtgcgacggatgtctcaagaaatctgctcggacacgtaaagaaaacaagttttcagcaaaacgactcccatcaacccgtttaggaacttttttggagaacagagtcaatgacttcctccgccgccagaaccatcccgaaagcggggaagtcaccgttagggtggtccatgcttcggacaagaccgtcgaggtcaagccaggcatgaaagctagattcgtggactcaggtgaaatggcggagtcatttccatataggaccaaggcgctgttcgctttcgaagaaatcgatggagttgacctgtgcttctttggcatgcacgtccaggaatatggttccgactgccccccaccgaaccagcgaagagtctatatttcctacttggacagcgtccattttttccgccccaagtgtctgaggaccgctgtgtatcacgagatcctaattggatatctggagtatgtcaagaaattgggctacacaacaggtcatatatgggcttgtcccccctccgagggtgatgactacatcttccactgccatcccccagaccagaagattcctaaacctaaacggctgcaggagtggtacaaaaagatgcttgacaaggcggtgtccgagcgcattgtgcacgattacaaagatatctttaagcaggcaacggaggaccgactgacgagcgctaaagaacttccctattttgaaggagacttttggccaaatgtcctggaggaatccattaaagagctggagcaggaggaagaggagaggaagagggaggagaatacgtccaatgaaagcactgacgtgaccaaaggggatagtaagaatgccaaaaagaaaaacaacaaaaaaacttcgaaaaacaaatcatcactgtcaaggggcaataagaagaaacccggcatgccgaatgtatctaacgacctgagtcagaaactctatgctacaatggaaaaacacaaggaggtattctttgtgatacggctgatagctggacccgcagcaaacagcttgccacccattgtggacccagaccccttgatcccctgcgatctgatggatggccgcgatgccttcctgacacttgccagggacaaacatctagaattctctagcctgaggcgggcacagtggtctacgatgtgtatgctagtggagcttcacactcaatcccaggacaggtttgtttacacatgtaacgaatgtaaacaccatgtggagacacggtggcattgcactgtgtgtgaggattatgatttgtgtattacgtgttataacacaaagaatcacgaccataagatggaaaaattgggcctgggccttgatgatgaatctaataaccaacaggctgccgcaactcagagcccaggagacagcaggaggttgagtatacagaggtgtattcagagcttagtccacgcatgccaatgccgaaatgccaattgcagtctgccctcctgccagaagatgaaacgagttgtgcagcacacgaaggggtgtaaaaggaaaaccaacggaggatgtcccatctgcaaacagttgatagctctctgctgctatcatgcaaagcattgtcaggagaataaatgccccgttcctttctgtctgaatataaaacagaaactcaggcagcagcagttgcagcacaggctgcagcaagctcagatgctgaggcgtcgcatggcatcaatgcagcgaactggcgtcgttggtcaacagcaagggttgccatcccccaccccagcaacgccgactacacccactgggcagcaacctacgactcctcaaacgccccagcctacttcccagccccagcccaccccacctaatagtatgcctccatacctcccgagaacacaggcagccggtcctgtgtcacaagggaaggccgccggccaggttacaccacccacgcctccacaaacggcgcaaccccctctgcctgggcccccacccgccgctgtggagatggccatgcagattcagcgcgccgcagaaacccagagacagatggctcacgtgcaaatttttcaacgcccgatccagcatcagatgcccccaatgacccctatggcacccatgggcatgaatcctccccctatgacaagagggccaagcggacacctggaacccggtatgggaccaaccggtatgcagcagcagcccccatggtctcagggagggctgccccagccccagcagttgcaatccgggatgcccaggccagcgatgatgagtgtggcacagcacggacagccactcaatatggctccacagcctggcctcggccaggtgggcatcagtcccctaaagcccggcacagtctcacagcaggcgctgcaaaatctgttacgtacattaagatcccctagttcacccctgcagcagcagcaagtcctgtcaatcttgcatgcaaacccgcaactcctcgctgcatttatcaaacaaagagcagccaagtacgcaaactcaaatcctcagccaatcccagggcaaccaggaatgccgcagggccagccgggcttacaaccccccacaatgccggggcagcagggagtacatagcaacccagcaatgcaaaacatgaacccgatgcaagccggggtgcagagagctggcctaccgcagcagcagccccagcagcagttgcagccgcccatgggaggaatgtccccccaagcgcaacagatgaatatgaatcataacaccatgccatcccagtttcgggatattcttagaaggcagcagatgatgcaacagcagcagcagcagggggccggacccgggatagggcctggtatggctaaccataaccaatttcagcaaccacagggggtgggctatccaccccagcaacaacagagaatgcagcatcatatgcagcaaatgcagcaggggaacatgggccagatcggccagcttccacaagccctgggcgccgaggcaggtgcaagcctgcaggcatatcagcagaggttgctgcagcaacagatgggatctccagtacagcccaaccctatgtcacctcagcagcacatgctgccaaatcaagcacaaagcccccacctgcaggggcagcagatccccaatagcctcagcaatcaggtgcgcagccctcagcctgtccccagtccgcggccccagtcccagccaccccactccagtccaagcccccggatgcagcctcagcctagcccccaccatgtgtcgccgcagacgtccagcccacacccaggcctcgtggccgctcaggccaaccctatggaacagggacattttgcctcaccagatcagaatagtatgctttcccagctggcctcaaatcctggaatggcgaacctccacggcgcaagcgccactgatctcggcctttcaactgataattctgacctaaacagtaatctgtcacagtctacactcgacatccattag

SEQ ID NO: 14955 - DNA, 1314 bp, Artificial Sequence
  Description of Artificial Sequence: Synthetic coding sequence
atggcactggccggggcaccagccggcgggccctgcgccccagccttagaagctctgctcggcgctggagctctaaggctcctggattctagccaaatcgtgattatttcagccgcccaagacgcttccgcccctcctgccccgacaggtccggcagcaccagctgccgggccatgcgatcccgacttgctactgttcgctacacctcaggccccccgccccaccccaagcgcccctagaccagctctcggcaggccccctgtaaagaggaggctagacctcgaaacagaccaccagtacctggctgagtcgtcaggaccggcgagagggcggggccgacaccccggtaagggagtcaagtcgcccggcgagaagtctagatacgagacctccttgaacctgacgaccaaacgattcctcgaattactgtcacatagcgcggacggagtcgttgacctcaactgggctgctgaggtgctgaaggtgcagaaacggcgcatttatgacattactaatgtcctggaaggaattcagttgattgccaagaagtcgaagaatcatattcagtggctggggtctcacaccacagtgggggttggtggtcgcctggagggactgacacaagatctgagacagctgcaggagtctgaacagcagcttgaccacctgatgaacatctgtacaactcagctcaggctgctcagcgaggacacagattcacagaggctggcctacgttacgtgccaggatctgcgctctatcgccgatcccgcagagcaaatggttatggtcattaaggcaccgcctgagacacagttacaggccgtcgatagttccgagaactttcagataagcctcaaaagcaaacagggtcccatcgatgtgtttctctgtccagaagagacggtcggaggcatttcccccggcaagaccccatcccaggaggtgacttctgaagaggaaaatcgggctactgattccgctacaatcgtgtctccgccccctagctcccctccatcttcccttacaaccgacccttcccaatccctgctttccttggaacaagaaccactgctgagcagaatgggctccctcagagccccggtagacgaggatcgattgtccccccttgtggccgcagactccctgctggaacacgtcagagaggatttttccgggctcctgccagaagagttcatatccctttctcccccacacgaggctcttgactaccacttcggcctagaggagggggagggaatcagagatctgttcgattgtgatttcggggacttgaccccgctcgacttctag

SEQ ID NO: 14956 - DNA, 1242 bp, Artificial Sequence
  Description of Artificial Sequence: Synthetic coding sequence
atggcagaggcaggccctcaggcccctccacctccaggtaccccctctcggcatgaaaagtccctcggactgctgactacgaagtttgtatccttacttcaggaggccaaagacggagttttggacctgaagttagctgcagatactctcgctgtccggcaaaagaggcgcatttacgacataacaaatgtgctagaggggataggtttgatcgaaaaaaagtcaaagaactctatccagtggaagggtgtcggcccggggtgcaacactcgagagatagccgataagctgatcgaactgaaagctgagatcgaagagctgcagcagagggagcaggaacttgaccaacataaagtatgggtccagcagtctatccggaacgtgacggaggacgtgcagaacagctgtctcgcatacgttacacacgaggatatctgccggtgctttgctggggatacattactcgcaatacgcgctccgtcaggaacgtcacttgaggtccccatccccgaggggctgaatggacagaagaagtaccagattcacctcaaatcagtctctgggccgattgaggtactccttgtcaataaggaggcttggagcagtccgccagtagccgttcctgtaccaccacccgaggatctcttacagagtccgtcagccgtgtccacccccccccccctccccaagccggccctggcacagagtcaggaagcctcacgccccaattctcctcagttaacccccacggccgtcccgggctccgcagaagtgcagggcatggcgggaccggcagctgagattacggtgagcggcgggcccgggacagactccaaggactccggcgagctgtcgagtctgccactggggcctaccacactcgacacacgacccctgcagtccagcgcactgctggactcctcctccagctcatcctcttcgtcctcatcctctagcaactcgaattcgtcctccagcagcggccccaacccaagtacaagcttcgagcctatcaaggctgaccctactggggtgctggaactacccaaagaattgagcgaaatcttcgacccgactagagagtgcatgagtagtgaactgctcgaggaactgatgtcttccgaggtatttgcaccattgttgcgtctttcccccccaccgggggaccatgactacatctacaatctcgatgaaagcgagggggtgtgtgatcttttcgatgtcccggtcttaaatctgtag

SEQ ID NO: 14957 - DNA, 1164 bp, Artificial Sequence
  Description of Artificial Sequence: Synthetic coding sequence
atgacagggaaactggcagagaagttgcctgtgacgatgtcctccctgttgaaccagctcccggacaatctctatcctgaagaaattccatctgccctgaatttgttcagtggcagctccgatagcgttgtgcattataatcagatggccacggaaaatgtgatggatatcgggttgacgaacgaaaaacccaaccccgagctgtcatattctgggagcttccaacccgcgccaggcaacaagaccgtcacttatcttggaaagttcgccttcgatagcccttctaactggtgtcaagacaatattatatcactgatgtcggcggggatactaggagtgcctcccgcctccggagccctcagcacccagacatcaaccgcgtcgatggtgcagcctccccagggcgatgtagaggcgatgtaccctgctctgcccccttatagtaactgcggcgatttgtactcggagcccgtgagcttccacgatccgcagggaaatcctgggcttgcatatagtccacaggactaccagtcggccaagccagcactcgacagtaacctgttccccatgattcctgactacaatctgtaccatcatcctaacgatatggggtccatccccgaacacaaaccttttcagggcatggatcccatccgggtgaatccacctcctataacccctttggaaacaatcaaggccttcaaggacaagcagatccatccagggttcggaagcctgccccagccccctctcacactgaagcccatccgtccgcggaaatatccaaatcggccatccaaaactccattacatgagcgaccccacgcttgtccggcagaggggtgcgatcgtcggttttcgcgcagcgatgagcttacaaggcatctccgtattcatactggacataagcccttccagtgtcggatttgtatgcgatccttctcccggagtgaccatctgacaacacatattcgcacccatactggcgagaaacctttcgcttgcgagttttgtgggcgcaaattcgctagaagcgatgagcggaaaaggcatgcaaaaatccacctgaagcagaaggaaaaaaaggctgagaagggcggcgccccctctgcttcctctgcaccacccgtgtccctggcaccggtagtgacaacatgcgcgtag

SEQ ID NO: 14958 - DNA, 687 bp, Artificial Sequence
  Description of Artificial Sequence: Synthetic coding sequence
atggacattggtcttactaacgaaaagcctaatccggaactttcttacagtggatcctttcagcccgctccgggcaacaagaccgttacaatgatcccagattataatttgtaccatcaccctaacgatatgggatcaatccccgagcacaaaccgtttcagggcatggatcccattcgggttaaccccccaccaataactccccttgagaccatcaaagcttttaaggacaagcagatacaccctggtttcggaagccttcctcagccaccactgacacttaaacccattcgtcctagaaaataccctaatcggccctcgaaaacccctctgcatgaacgaccccatgcttgccccgccgaagggtgcgacaggcgattcagccgcagtgacgaactcaccaggcacctacgcatccacaccggacacaagccctttcagtgtagaatttgtatgcggtcattctcccgctccgaccacctgaccactcatatccgcactcataccggtgaaaagccgtttgcctgtgagttttgtgggcggaaattcgctagaagcgacgagcgcaagcgtcacgcaaaaatccatctgaaacagaaagaaaaaaaggctgagaaagggggggcaccttccgcctcttctgccccaccggtgagcctggctcccgtggtcacaacctgcgcatag

SEQ ID NO: 14959 - DNA, 1050 bp, Artificial Sequence
  Description of Artificial Sequence: Synthetic coding sequence
atggaaccttgcgccgcctggtcaccccgcggcgggagggaaaatgtgatggatatcggcctcacgaatgagaagccaaatccagaactctcctattccggatcatttcagccagccccaggaaataagactgtgacctacttggggaaatttgccttcgacagcccgtcgaattggtgtcaggataatatcattagcctgatgtcagcagggattctgggggtgccccctgcttctggggcacttagcacccaaactagtaccgcgagtatggttcagcctcctcagggagacgttgaggctatgtaccctgccctccccccctacagcaactgcggggatttatactctgaaccggtcagcttccacgacccacaaggcaaccccggccttgcctacagtccacaggactaccagtccgctaagcccgccctcgatagcaatcttttcccaatgattcccgattacaatttatatcatcatccaaacgatatgggaagcatccccgaacataaacctttccagggtatggacccaatacgggttaatcctccccctatcacgcctcttgagaccataaaggctttcaaagataagcagatccaccccggatttgggtcattgcctcaaccgccactaactttgaaacccatcaggccaaggaagtatcctaaccggccttccaaaactcctctgcatgagaggcctcatgcatgcccggctgagggatgcgaccggcgctttagtaggtcagatgaacttactcggcatctgaggattcatacaggccataagccctttcagtgtcgaatatgcatgcgctcctttagtagaagtgaccatctgactacacacatcaggacacataccggtgagaaaccttttgcctgtgaattctgtggtcgaaagtttgctcgttccgacgagcgaaagcgccacgctaaaatccacctcaagcagaaagaaaagaaggctgagaagggtggggccccctctgccagcagcgcgccccctgttagtctagctcctgtggtcacaacatgcgcctag

SEQ ID NO: 14960 - DNA, 3696 bp, Artificial Sequence
  Description of Artificial Sequence: Synthetic coding sequence
atggctagcgtgtggaagagacttcagcgtgtcgggaaacacgctagtaagttccagtttgtagcttcataccaggagctgatggtggagtgcaccaagaagtggcagcccgacaaattggtggtggtctggacgcggcggtctcggcgcaagtcctctaaggcccactcctggcagcccgggatcaagaatccatatcggggcgtcgtggtttggccggtgcctgagaacatcgagatcacagtgacactgtttaaggatcctcacgcggaggaatttgaagacaaggagtggacgtttgttattgaaaatgagtcaccttccgggagaagaaaagccctggccaccagcagcatcaatatgaaacaatacgcatccccaatgccaacacaaaccgacgtgaagctgaagtttaaacccttatctaagaaggtggtgtccgcggcacttcagttctccctgtcctgtattttcttgagggaggggaaggctacagacgaagatatgcagagtctggcgtctctgatgagcatgaagcaggcggatatcggtaacctggatgactttgaggaagacaatgaggacgatgacgaaaaccgcgtgaaccaggaggaaaaggccgccaagataacagaaatcgtgaatcagctcaatgcgctcagtagcctggacgaggaccaggatgactgcataaagcaggccaacatgcggagcgcaaagtctgcttcctcatcggaggaattgattaacaagcttaatttcttggatgaggctgagaaggatctggcaactgttaacagcaatcctttcgatgacccagacgccgctgagctgaatcccttcggtgaccctgatagtgaagaacccatcaccgaaactgccagcccgcgcaagactgaagattctttttacaacaattcatataacccattcaaggaggttcagactccccaatacttgaacccattcgacgagcccgaggcctttgttaccatcaaggactccccaccgcagtcaacaaagaggaaaaatattagaccagtggatatgtcgaaatacctgtacgctgactcctcgaagacggaggaagaggaacttgatgaaagtaaccccttttatgaacctaagtcgaccccgcctcctaacaacttagttaacccagtgcaggaactggagactgaaagacgcgttaagagaaaagcccccgcaccgccagtcctgtctcccaagacaggagtcctcaacgaaaatacggtgtctgctggtaaggatctgagcacctcaccgaaaccatcacctataccaagccctgtgctgggcagaaagcctaacgcgagccagtcattgctcgtgtggtgtaaggaagtgaccaagaattacaggggcgtgaagattacgaacttcacaacaagttggcgcaacggtttatcgttctgcgctatactgcatcatttcaggccagatctcattgattacaagtctctaaacccccaggacatcaaggagaataacaagaaagcttacgacgggtttgcctcaattggcattagtagattgctggagccatctgacatggtccttttagcaatccccgacaaactgactgtcatgacatatctttatcagattcgtgcacatttctccggacaggagttaaacgtggttcaaatagaggagaactccagcaagagcacatacaaggtgggcaactacgagacagacaccaactccagcgtggaccaggaaaagttctacgccgagctctcggacttaaagcgagaacctgaacttcagcagcctatcagcggcgccgtcgacttcctgagtcaggacgattccgtgtttgtgaatgactccggagtcggagaaagcgagagtgagcaccaaaccccggatgatcacttgagcccgagcacagcaagcccctactgtcgccggacgaaaagtgacaccgaaccccagaaatcccaacaaagctcaggccggaccagtgggagcgacgatccggggatttgctcgaacacagacagcacccaggcccaagttctgttgggtaagaaacgattgctgaaagccgaaacactggaactcagcgatctctatgtttccgacaaaaagaaggacatgtcaccgcctttcatttgtgaagaaaccgatgagcagaagcttcagactctcgacatcggatctaacctggaaaaagaaaagctggaaaactcacggtccctcgaatgccgctctgacccagagtccccaatcaagaaaacttcgctgtctccaacttctaagcttggttactcatattcccgcgatctggacctggcaaagaagaagcacgcgagtttgcggcagaccgaatctgaccccgatgcagatcggactacactgaaccacgctgatcactcgtccaagatagttcaacaccggcttttgtcccgacaggaagagcttaaagaacgggcaagagtgctcttggaacaggcacggagagatgctgccctcaaggcaggcaacaaacataatactaacaccgccacacccttctgcaataggcagctgtcagatcagcaagatgaagagcgaagacgccaactaagagagagagctcgccagctgatcgcagaggcgaggagcggggtgaaaatgtccgagctgccttcgtatggcgaaatggccgccgagaagctgaaagagaggtctaaggccagcggagatgagaacgacaacatcgagatagacaccaacgaggagatccctgagggctttgtggtgggaggaggggacgagctgactaaccttgagaacgacttggacacccccgaacagaactcaaagctggtagacctgaagctaaagaagctgttggaggtccagccacaggtggcgaactccccatcatccgctgctcagaaggccgtcaccgagtcaagtgaacaggatatgaaaagtgggacagaagacctgaggaccgagagactgcagaaaacaactgagaggttccgcaaccctgtcgtgttctctaaagacagcacggtccggaagacccagctgcaatctttctctcagtacatcgaaaaccggcccgagatgaaaaggcaaaggagcatacaggaagataccaagaagggaaatgaggaaaaagcagccattacggaaacacaaaggaaaccttcagaggacgaagtgttaaataaaggattcaaggatacttcccagtacgtggtcggagagttagcagcactggaaaacgagcaaaagcagatcgatacacgcgctgccctagtggagaaacggttacgctaccttatggatactggaaggaatactgaggaggaggaagccatgatgcaggagtggtttatgcttgttaataaaaaaaacgcacttatcaggcgaatgaatcagctctctctcttagagaaggaacacgatctggagagacgatacgaattactcaacagagagctccgtgctatgctcgccatagaggattggcaaaaaaccgaggcgcagaaacgccgggaacagctgctactcgacgagcttgtggccctagtgaataagcgggatgcgctggtgcgggatctagacgcacaagagaaacaggccgaagaggaagacgaacacttggagcgcactctcgaacagaataaaggcaaaatggctaaaaaagaagaaaaatgtgtactgcagtag

SEQ ID NO: 14961 - DNA, 3591 bp, Artificial Sequence
  Description of Artificial Sequence: Synthetic coding sequence
atggcgtccgtctggaaacgcctccaaagagtaggcaagcacgcctcgaaattccaattcgtggcatcatatcaggagctcatggtggagtgtaccaaaaaatggcagccggacaaactggtggtcgtatggacccggaggtcacgaaggaaaagcagtaaagcccactcatggcagccaggcattaaaaatccatacagaggggtggtggtttggcccgtccccgagaacatcgagatcacagtgacgctgtttaaagacccccacgccgaagagtttgaggacaaagaatggaccttcgtcatcgaaaatgagtctccctcaggacgcaggaaagcgctggcgacgtcttccataaacatgaagcaatacgcaagccccatgcctactcagacagatgtcaaactcaaattcaaacccctttcaaagaaagttgttagtgctgcgctgcagtttagcctcagctgcatattcctccgcgaaggcaaagcaacagacgaggacatgcaatccctggcgagcctcatgtcaatgaaacaggcggatatagggaatctcgacgattttgaggaagacaatgaagatgacgacgagaatcgagtcaatcaggaagaaaaagccgccaagattaccgaactcataaataagttaaactttttggatgaggcagaaaaggacctcgccaccgttaactctaacccatttgacgaccctgacgctgccgagctcaacccctttggcgatcccgatagtgaggagccaataacagaaacggcttctccccggaaaacagaagactctttctacaacaactcctataaccctttcaaggaagtgcagacaccccagtacctcaatcctttcgacgaacccgaggctttcgtcaccataaaagactcacccccccagtctacgaagcgaaagaatatccggcctgtggatatgtcgaagtatctgtatgcagactcctccaagactgaggaggaggagttggatgaaagcaaccctttctacgagccaaaatccacccctccacccaataaccttgtcaatccggtacaggagctcgagaccgagcgacgtgtgaagaggaaggctcccgccccaccagtactcagtcctaaaacgggcgtgctgaatgaaaacacagtctcggcagggaaagatctctcaacctcccccaaaccttcacccattcccagcccagtgcttggacgcaagcccaacgcctctcagtccttactcgtgtggtgtaaagaggtcacaaagaattatcggggggtgaagataaccaatttcactacttcctggcgcaacgggttgagcttttgcgcaattttacatcacttcaggccagatctgattgattataagtccttgaatccccaagatatcaaagagaataataagaaggcctatgacggctttgccagcataggaatctccaggcttttggaacccagcgacatggttctgcttgcaatccctgacaagcttaccgtcatgacttatctgtatcagattcgagctcatttctctggtcaggaactcaatgttgtgcaaatcgaagaaaacagctctaagtctacctataaggtgggcaattacgaaaccgacaccaatagctcagtcgaccaggagaaattctacgccgaattgtcagatctaaaacgtgagccggagcttcaacaacctatcagcggagccgtcgattttctctcgcaggacgattctgttttcgtaaatgattcaggggtgggagaatcggaaagcgaacatcaaaccccagatgatcatctctctcccagcactgccagcccctattgtagacggaccaagtctgatactgaaccccagaagtctcagcaaagtagcgggagaacgtctgggtctgatgatcctggaatttgttctaacacagattcaactcaggcccaggtcttgttgggcaagaaacgtctactcaaagccgagaccttggagctgtccgacctttatgtatctgacaaaaaaaaagacatgagcccaccctttatttgcgaagagaccgatgaacaaaagctgcagaccctggatatcgggtcaaacttagaaaaagagaagctggaaaacagcaggtcattggaatgccggagcgatcccgagtcccctatcaaaaagacatcactctcccccacctctaagctgggatactcatacagcagggacctggacttagcgaagaaaaaacatgcgagtctgcgccaaaccgagagtgatcccgacgcagataggacaacattgaaccacgccgaccatagctcgaagattgtgcagcaccgtctactgagccggcaggaggagctgaaagaacgtgccagagttctacttgagcaagcacggcgcgacgcggccctgaaggccggtaataaacacaatactaacacagccacacctttctgcaataggcaactgagcgatcaacaggacgaagaacgccgccgccagctcagggagcgggccagacagctgattgctgaagcacgttcaggcgtgaaaatgtctgagctgcccagctacggagaaatggccgcagaaaagctgaaggaaaggagtaaagccagcggcgacgaaaatgacaatatagagattgacacaaatgaggagatcccggaagggttcgtcgtaggaggtggggatgaattgacaaacctagaaaatgatctggatacaccagaacagaatagtaagctggtggacctcaaactcaagaagctgctcgaagtgcaaccacaagtggccaactcaccaagctccgctgcccaaaaggcagttactgaatcaagtgagcaggatatgaaaagtgggaccgaagacctccgtactgaacggctgcagaaaaccactgaaaggtttagaaaccctgtcgtgtttagcaaagatagcactgtccgtaagacacagttacagagtttctctcaatatatagaaaacaggcctgaaatgaagaggcaaagatccatccaggaggacaccaagaaggggaatgaggaaaaagcagccatcacagagactcagagaaagccatccgaagacgaggtgctgaataaaggctttaaagatactagccagtacgtggtgggggagctggccgccctagaaaacgagcagaagcagattgatacccgtgcagcactcgtcgaaaaacgcctgcggtacctgatggataccggacgcaatacggaagaggaagaagccatgatgcaggagtggttcatgctcgtgaataagaagaacgcactcatccgccgtatgaaccagctatcactgctggagaaggaacacgatttggaacgccgctacgagctgctaaacagggaactccgagcaatgctcgcaatagaagattggcagaaaacagaagcccagaagcggcgagaacaattgctcctggatgaactcgtagcactcgttaataagcgcgatgcgttggtgagagatctggatgctcaggaaaagcaggcagaggaagaggatgaacatcttgagaggactctcgagcagaacaagggaaaaatggccaaaaaagaggaaaagtgcgtattacagtag

SEQ ID NO: 14962 - DNA, 3483 bp, Artificial Sequence
  Description of Artificial Sequence: Synthetic coding sequence
atggcgagcgtgtggaaaaggctgcagagagtggggaaacatgccagcaaattccagttcgttgcctcgtaccaagaactgatggtggaatgcactaagaaatggcagccagacaagcttgtagtggtgtggactcgcaggagcagacggaagtcgtcaaaggctcattcttggcagcccggcatcaaaaatccgtatcgaggcgtcgttgtgtggccagttccagagaatatcgaaattacagtaactctgttcaaggatccccacgctgaagaatttgaggacaaggaatggaccttcgtcattgagaatgagtcgccatcgggcaggaggaaggcactcgccacgagctccattaacatgaaacaatatgcctcaccaatgccgacccagaccgacgtgaagctcaagttcaaaccgctgagcaagaaagtcgtgtccgcggcactccagttctctctctcatgcatcttcttgcgggagggtaaagccacagacgaggacatgcagtccctggcaagcctgatgagtatgaaacaggccgatatcggtaatctagatgattttgaggaagataatgaggatgatgatgagaacagagtgaatcaggaggagaaggccgctaaaatcaccgaattaataaacaaactcaatttcctagatgaggcggaaaaagatctggcaactgttaattcgaaccctttcgatgatcctgacgcagcagaactcaacccctttggcgaccctgactccgaggaaccgatcactgagaccgcgtcccccagaaaaacagaagatagcttctataataactcctataacccatttaaagaagtacaaacgcctcagtatcttaacccttttgatgagcccgaggcctttgtgaccattaaagacagtcccccacaaagtaccaagaggaaaaacattaggcctgtcgacatgagcaagtatctgtatgcagacagctccaagacggaggaggaggaactggatgaatccaatcccttctatgagcctaagtccacccccccccctaataatctggtcaaccctgtccaagagctggagaccgaacggagagtgaagcgaaaagcccccgcacccccggttctgagtcccaagacgggcgtcctcaatgaaaacactgtaagcgccggaaaggatctgtcgacaagtccgaagcccagtcccattccatctccggtcctggggcgtaagcccaacgctagccaatccctgttggtgtggtgtaaagaagttacgaaaaactacagaggagtaaaaattaccaatttcacaacctcatggagaaacggcttgtctttctgtgcgattctgcatcattttagaccagatctcatcgattataaatctcttaatccacaggacatcaaggaaaacaacaagaaagcctacgacgggttcgcgtctataggcataagtcgactgctggagccctccgacatggtacttctggccattcctgacaagttgacagtaatgacatacctgtaccagatccgggcccacttctccggccaggaattgaacgttgtgcagattgaggagaatagctccaaatcaacctataaggtagggaattatgagacagataccaacagctccgttgatcaggagaaattttacgctgagctcagcgacctcaagagggaaccagagctgcagcagccaattagtggggccgtcgattttctctctcaggacgactcagtgttcgtcaatgatagtggggtcggtgaaagcgagtcggaacaccagacccctgacgaccacctgagcccatcaacagcctctccatattgccgacgcactaaatctgacacagaaccgcaaaaatcgcaacagtcaagtgggcgcactagcggctcagatgatcctggtatctgttccaatacagactcaacgcaggctcaggtcctgctgggaaaaaagaggttgcttaaagcagagacgttagagctgagcgacctgtacgtatccgataagaaaaaagatatgtcccctccttttatatgtgaggaaactgatgaacaaaaattgcagacattggacatcggctctaacctcgagaaagaaaaactcgagaactctcggtccttggaatgccgctccgacccggagtcacctatcaagaagacatctctttcccctaccagcaaattggggtactcatactcaagggatctggatctggcaaaaaagaaacatgcttccctacggcagactgaaagcgatccggatgccgaccgtactaccctaaaccacgcggatcattcctcaaagatcgttcagcaccggctcctaagtaggcaggaagagctgaaggagcgggctcgcgtgttactggaacaagcccggcgggacgctgcccttaaagcaggcaataaacataacacaaacacagcaacacccttctgtaatcggcaactgagcgatcagcaagatgaggagaggagacggcagctgcgagagagggctagacagctcatcgcagaggcgcgctctggcgtgaagatgagtgaactgcctagctatggggaaatggccgccgaaaagcttaaggagagatctaaagcatctggcgagcaaaacagcaagctcgtggatctcaaactcaagaaattgttagaggtccagccccaagttgctaacagtcctagcagcgccgcccagaaggccgtcaccgaatctagcgagcaggatatgaagagtggcaccgaggatttgaggacagaacgcttgcaaaaaacaacagaaagatttcgaaatcccgtggtgttctcaaaggactctaccgttcgaaagacccagctgcaaagtttcagtcagtacattgaaaatagacccgaaatgaagcgtcagcggtctatccaggaggatacgaagaagggaaacgaggaaaaagccgctattacagaaacacagcgcaagcccagtgaagacgaagtcctcaataaaggattcaaggacacgagtcagtacgtggtcggagaactcgccgcactggaaaacgaacagaagcaaattgacaccagagccgcccttgtggagaaaaggcttaggtatcttatggacaccggaagaaacactgaagaggaggaggccatgatgcaggaatggtttatgctcgtgaacaagaagaacgcgctcataaggcggatgaaccagctcagcttactggagaaagagcacgacctcgaacgccgatatgagctcctgaatcgcgaactcagagcgatgctggcgattgaagattggcaaaagaccgaggcgcaaaaacggcgagagcagctattactagatgaattggtcgctctggtgaataaacgggatgctctggtgcgggatctggacgcccaggagaaacaggctgaggaggaggatgaacatctcgagcggaccctggagcagaataaaggtaagatggccaagaaggaagagaaatgtgttctacagtag

SEQ ID NO: 14963 - DNA, 3591 bp, Artificial Sequence
  Description of Artificial Sequence: Synthetic coding sequence
atggcatccgtgtggaagcgcctgcagagggtgggtaagcacgcatctaaattccagtttgtcgccagctaccaggaattaatggtggagtgtaccaaaaaatggcagccggacaagctggttgtagtatggaccaggcgaagccggcggaagagcagcaaagcgcacagctggcagcccggcatcaagaacccttacaggggcgtcgtggtctggccagttcccgagaatatcgagattaccgtcacactatttaaggatccgcacgctgaagagttcgaggataaagaatggacattcgtgattgaaaacgaaagtccatccggtcgcagaaaagctctggctacttcaagcatcaatatgaaacagtacgcgagcccaatgccaacccagactgacgtgaaattgaaattcaagccgttgtccaaaaaagtggtatccgctgcactccagttctcactgtcttgcatttttctgagagaggggaaggcaaccgatgaagatatgcagtccctagcaagcttgatgtccatgaaacaggctgacattgggaatcttgatgacttcgaagaggataatgaagacgatgacgagaaccgggtaaaccaggaggagaaggccgccaagatcaccgagctcatcaacaagttgaattttctggatgaagcagaaaaggacctggccaccgtcaactccaacccgtttgacgaccctgacgccgcggaattaaacccttttggggatccagactccgaagagcctatcacggagacggcgagccctcggaaaactgaggacagcttttacaataactcatacaatcccttcaaagaggtacaaacgccgcaatacctgaatccgttcgatgaacccgaagccttcgttactatcaaggactcccccccccagagcaccaagaggaagaatatccgcccagtggatatgtcaaagtacctatacgccgactccagcaaaactgaggaggaggaactggatgagagcaatcctttctatgagcctaaatctactccaccaccgaacaatttagtgaatcccgtgcaggaactcgaaaccgaacgcagagtgaagcgcaaagcacccgccccacctgttctgtcaccaaagacgggcgtactgaacgaaaatacggtgtcagctggtaaagacctgagcacctcaccgaagccaagccctatcccaagcccagtgctggggcgaaagccgaacgccagccagagcctgctcgtgtggtgcaaagaggtgactaaaaactaccgcggcgtcaaaattactaactttactacttcttggaggaatggcctgtctttttgcgcaattctgcatcacttccgccctgatttgattgattacaaatccctgaaccctcaggacattaaggagaataacaagaaggcctacgacgggttcgcttcaatcggcatcagcaggttgcttgaaccctctgacatggtgctccttgcaatccctgataagctgaccgtgatgacttacctgtaccaaattagagcccatttcagtggtcaggagctgaatgtggtacagatcgaagaaaattccagcaagtccacctacaaggtgggaaattacgaaactgacaccaattcctccgtcgatcaagaaaaattttacgctgaactgtccgatcttaagagggagcctgaacttcagcagccgatctcaggcgctgttgatttcctgagccaggatgattcggtgttcgttaacgattcaggtgtgggggaaagtgaatccgaacatcagactccagatgaccacctgtctccatccactgcctccccatactgccgccgcacgaaatccgacactgagcctcagaagtcccagcaatcgtccggtagaacatctggatccgacgacccagggatctgtagtaataccgactctacacaggctcaggtgttgctcgggaaaaagagactcctgaaggctgagaccctagaattaagcgatctctacgtgtcggataagaaaaaagacatgtctcccccatttatctgcgaggaaactgacgagcagaaactgcaaaccctagacattgggagcaacctggagaaagagaaactggagaacagtcgcagtttggaatgccgttcagacccagagagcccgattaagaagacaagcctctctcccacaagcaaattgggctactcatacagccgagatctcgacctggcaaagaaaaaacacgccagtctgcgtcaaacggaaagcgatccagacgccgacagaaccactttaaaccacgcagatcactcctctaagatcgtgcagcaccggctgcttagccgccaggaagaattgaaggagcgggctcgcgtgctcctagagcaggcaagaagggatgctgccttaaaagctggcaataaacataatacaaacaccgcgacacccttctgcaatcggcagctctctgatcaacaggatgaggagagacgtcggcagttgagagaaagggcacggcagctcatcgcagaagccagaagcggcgtgaaaatgtcagagttgccctcatatggcgaaatggccgctgagaagcttaaggaacgatcgaaggcatccggcgatgaaaatgataacattgaaattgacacgaacgaggagattccagaggggtttgtcgtcggaggtggggatgagcttactaacttggagaacgacttggatacccctgagcagaactccaaacttgtagacctcaagctgaagaagctccttgaggtacaacctcaggtggctaatagccccagtagtgccgcacagaaggcagttacggagagttccgagcaggacatgaagagtgggacagaggatttacgcactgagaggctgcaaaagaccaccgaacgcttccgcaacccagtggtctttagtaaggatagcaccgtgagaaagactcagttacaatcattctcccaatacatcgagaataggccagagatgaaaagacaacggtctatccaagaggacactaagaaggggaacgaggaaaaagctgccattacagagacgcagagaaaaccttcagaggatgaggtgctgaataaaggctttaaggatacctcccagtacgttgtaggagagcttgccgcactggaaaatgaacagaaacagatcgatacaagggcagctctggtcgagaagcgcctgcgatacctgatggacacggggagaaataccgaagaggaggaagcaatgatgcaggagtggttcatgctggtgaacaagaagaacgccctgatacgcagaatgaatcagttgagtctattagagaaggaacatgacctcgaacgcagatacgaattgctgaacagagaactgagagctatgctagctatagaggactggcagaagactgaggcccagaaacggcgtgagcagctcctgttggatgagctcgtggccctagtgaacaagagagacgcattagtaagagatctcgacgctcaggaaaagcaggccgaagaagaagatgaacatctagagcggaccttggaacagaataagggcaaaatggccaagaaggaggagaaatgcgttctgcagtag

SEQ ID NO: 14964 - DNA, 933 bp, Artificial Sequence
  Description of Artificial Sequence: Synthetic coding sequence
atggctagtgtctggaagaggttgcagcgagttggcaaacatgcctctaagtttcagtttgtcgcctcttaccaggagctcatggtggaatgcacaaaaaagtggcagcccgataaactggtggttgtctggacacgcaggagcagacggaagtcatcaaaggcgcacagttggcaaccgggtataaagaacccttacagaggagttgtagtgtggcctgtgccagaaaatattgagattactgtgaccttatttaaagacccccatgctgaagaattcgaagacaaggaatggacatttgtgatcgagaacgagtccccttccgggaggcgcaaagccctcgcgacctcctctatcaacatgaagcagtatgcatctcccatgcctacacaaactgacgttaaattgaaattcaaaccattgtccaagaaggtagttagtgcagctctgcagttttctctgagttgtatcttcctccgcgagggaaaggccacagacgaagacatgcagagtctagcatcactgatgagcatgaaacaggccgacatcggcaacctggatgacttcgaagaggacaacgaggacgatgacgagaaccgggttaaccaggaggaaaaggcagccaaaattaccgagctgattaataaactcaactttctggatgaagccgaaaaggatttggccacggtgaattcgaacccctttgacgaccccgacgctgcagaactgaacccattcggggaccctgattctgaggaaccaattacagagacagcaagcccacgcaaaacagaagactccttctacaacaatagctacaacccatttaaagaagtgcagaccccacagtacctaaaccctttcgacgagcccgaggccttcgtcactattaaggattcccccccgcagagcacaaagcggaagaacatttag

SEQ ID NO: 14965 - DNA, 234 bp, Artificial Sequence
  Description of Artificial Sequence: Synthetic coding sequence
atggcctcggtgtggaagcgtctgcaaagagtgggaaaacacgccagtaagtttcaattcgtagccagctaccaagaactgatggtggaatgtaccaagaagtggcagccagacaaattagtggtcgtatggactagaagaagccgcaggaaaagtagcaaagctcacagctggcagccaggcatcaaaaacccctatcggggagtggtcgtctggccagtgcccgagaattag

SEQ ID NO: 14966 - DNA, 3483 bp, Artificial Sequence
  Description of Artificial Sequence: Synthetic coding sequence
atggcatccgtttggaaacgactccaaagagttggaaagcacgcctcaaagttccaatttgtagcgtcgtatcaagagctgatggtggagtgcactaaaaagtggcagccggacaaactggtggttgtctggactcgccgttcccgtcggaaatcatcaaaggcgcacagttggcagcctggaatcaagaatccttaccgaggggtggttgtgtggcctgttccagaaaatattgagatcacagttacactctttaaggacccccatgctgaagaatttgaggataaagaatggacgttcgtaatcgaaaatgagtccccgagcggcaggagaaaggcactggcgacttcatcaatcaacatgaagcaatatgcctcgcccatgccgacccagacagatgtgaaattgaagttcaaacctctgagcaagaaggtcgtaagtgctgccttacagttctccttgtcgtgtatttttctgcgggagggtaaggcaactgatgaagacatgcagtctcttgcatcactgatgagcatgaaacaggcggacatcggaaatctggacgacttcgaggaggataacgaagacgacgacgaaaaccgcgtcaaccaagaagaaaaggctgctaaaatcaccgaacttattaacaagcttaattttctagatgaggctgagaaggacctggccacagtgaacagcaatccatttgacgaccccgatgcagccgagttgaaccccttcggagaccctgacagcgaagaaccgatcacagaaaccgcgtccccaagaaaaacagaggacagcttttacaataatagctataatcccttcaaggaggtccagaccccccagtatctcaatccattcgacgagcccgaagctttcgttactatcaaagactcccccccacagtctactaagcgcaagaacattagacctgttgacatgagtaagtacctgtatgccgattcctctaaaactgaagaagaggagttagacgaatctaatcctttttacgagccgaaatcgaccccacctccaaacaatctcgttaatcctgtgcaggaactggaaaccgaacgacgggtaaagcgtaaggcaccagcaccacccgtactctcgccaaagacaggggtgctcaacgaaaacaccgtctcagctggaaaagatctgagtacctcaccaaagccttcacccattcccagtccggttctgggtagaaagccaaacgcatcacaatctctgctagtgtggtgtaaggaagttacaaaaaactatcgcggagtcaagataacaaatttcactacgagctggcgcaatggcctttctttttgtgctattttgcatcactttaggcctgatttgattgattacaaaagtctgaatccccaggacatcaaagagaacaataagaaggcctacgatggattcgcatctatcggaatctctcggctgctagagccgtctgacatggtgctgttggcgatccctgataaacttaccgttatgacctatttgtaccagatcagggcacattttagtggccaggaacttaacgttgttcagatcgaggagaatagctcaaagtccacctataaagtgggcaactatgaaacagatacaaactcaagcgtagaccaggagaaattttacgcagaactgtccgaccttaagcgcgaacctgagctgcaacagcctatcagcggggcagtggactttctgtctcaagatgactctgtgtttgtaaacgattccggcgtcggcgaaagcgagtcagagcatcagacgcccgacgaccacctgtccccaagtaccgcgtctccttactgccgtagaacaaagagcgacaccgagcctcagaaatctcaacaaagttccggcagaacatctggctccgatgaccccggaatttgctctaataccgactcaactcaagcacaagttttgctgggcaaaaagagactgctgaaggccgagaccctggaactgtcagacctgtacgtgagcgataaaaagaaagatatgtctccccccttcatctgcgaagagacggacgagcaaaaactccagaccctggacatcggctctaatctcgagaaggagaagctggagaactcaaggagcctggagtgccgttcagaccctgagtccccgataaagaagactagcctttcgccaacttccaagctggggtatagctacagccgcgatctggatcttgcaaaaaagaagcacgccagtctgcgccagaccgagtctgatcccgatgccgacaggacgactctcaaccacgccgaccatagtagcaagattgtccaacaccggttgctgagccgccaagaagagctcaaagagcgcgcacgcgtgctgctggagcaggcccgcagagacgccgctttgaaagccggaaataaacataatacgaacacagccactccattctgcaaccgccaactttccgaccaacaggatgaggagcgaagacggcaactgagagagagagcacgccagctcattgccgaggccagatcaggggtgaaaatgtcggagttacctagctatggcgagatggctgccgaaaagctgaaagagcggtctaaggcttcaggagaacagaattccaagcttgttgacctgaagctcaaaaaactcctcgaggtccagccccaggtagcaaattccccatcctctgcagcccagaaggcggtaacagagagctccgagcaagacatgaagagcggtacggaggacttacggacggagaggctgcagaagacaaccgaaaggtttagaaaccccgtggttttctctaaagatagcaccgttaggaaaacccaattacagagcttctcccagtatattgaaaacagaccagaaatgaagcgccaaagaagcatacaagaggacactaaaaaggggaatgaggaaaaagccgcaattaccgaaacccagcgaaaaccttcagaggacgaggtcctgaacaaagggttcaaggacacctcccagtacgtggtcggcgagctggctgccctagagaatgagcagaagcagatagatacacgtgctgccctggttgaaaaacggttgcggtacctcatggacactggaagaaacacagaggaggaggaagcgatgatgcaggaatggttcatgttggtgaataagaaaaacgccttgatcagaaggatgaaccagctcagtcttctggagaaggaacatgaccttgaacggaggtacgagctgctcaatcgggaactgagagctatgctggccattgaagattggcagaagacagaagcacagaagaggagggagcaactcctgctcgacgagctcgtggctctcgtgaacaagcgggacgcacttgtgcgggacctcgacgcccaggagaaacaagctgaagaagaagacgagcatcttgagcggacactcgagcagaataaaggaaaaatggctaaaaaggaagagaaatgcgttctacagtag

SEQ ID NO: 14967 - DNA, 609 bp, Artificial Sequence
  Description of Artificial Sequence: Synthetic coding sequence
atgaagcgccagagaagtattcaggaggatacgaaaaaaggtaacgaggagaaggcggcaatcaccgaaacacagcgtaagccctctgaagacgaggtcctgaacaagggcttcaaggacacatcacagtacgtagttggcgagctcgctgcccttgaaaacgaacagaagcagatagatacccgagctgcactcgtggagaaacgccttcggtacttgatggacaccgggagaaatacagaggaggaggaggcaatgatgcaggaatggttcatgctcgtcaacaagaaaaatgcactgatacggcgcatgaatcagctatccttacttgagaaggagcatgacctcgagaggcggtacgagctcctgaatagagaactaagggccatgttagcaatcgaagattggcaaaaaacagaggcccaaaagcggcgggaacagctattgcttgacgagctcgtcgccctcgtgaataaacgcgatgcactggtccgtgatctggacgctcaagaaaaacaggctgaagaagaagacgagcatcttgaacggactcttgaacagaataaggggaaaatggcaaaaaaggaggagaagtgcgtactgcaatag

SEQ ID NO: 14968 - DNA, 1287 bp, Artificial Sequence
  Description of Artificial Sequence: Synthetic coding sequence
atggatcctagtgtgaccctgtggcagttcctgttgcagctactccgcgaacaggggaacggccacatcatctcgtggacctccagggacggtggcgaatttaaacttgtcgatgctgaggaggtggcaagattgtgggggttgcggaagaacaagaccaacatgaattacgacaagctgagcagagctctgaggtattattatgataagaacattataagaaaggtgagcggccagaaattcgtgtataagttcgtttcctaccctgaggtagctggctgcagcactgaagattgccctccacagcctgaggtgagtgtaacttctaccatgcccaacgtcgctccagccgccatacacgcggcaccaggggataccgtttctggtaagcctggaactcccaagggggctggcatggccggtccgggtggcctagctcggtcttcaagaaacgagtacatgcggtccggtctctatagcacatttacaatacagtcccttcaacctcaacccccaccgcacccccgacctgcggtggtgctcccttctgctgccccggccggggccgccgcaccaccttctgggtctagaagtactagtccctccccactcgaggcctgtctggaggcggaggaagccgggcttcccctgcaggttatcctgactcccccagaggcaccaaacctcaagtctgaagagttgaacgtggagcctgggctgggcagagccttgcccccagaggtgaaagtcgaaggccccaaggaggaactcgaggtagccggagagcgtggtttcgtgcccgaaacgacgaaggcagagccagaggtgcccccacaagagggggtgccagcccgtctgcctgcggtcgtcatggacactgcaggccaggccggcggccacgcggcaagctctccagagatctctcagccccagaagggcagaaagccgcgcgacctcgaactccccctcagtccaagccttctaggaggccccggtccagaacgcacacccggaagcggatccgggtctggactgcaagcgcccggaccggctctcacgccatcattgcttccaacgcacaccctgacacccgtgttactgactccttcttcactccctcccagcattcacttctggtccactctgtcaccaatcgcccctaggagccccgcaaaactgagtttccagttcccttctagcggttctgcccaggttcacatcccctccatctcagtagacgggcttagcacaccagtcgtgctcagccctggaccacagaagccttag

SEQ ID NO: 14969 - DNA, 288 bp, Artificial Sequence
  Description of Artificial Sequence: Synthetic coding sequence
atggacccatcggttacgctgtggcaatttctcctccagctgctgagagaacagggcaacgggcatatcatctcctggaccagtcgagacgggggcgaattcaagctagtagatgcagaggaggtggctaggctctgggggctgaggaagaacaagaccaacatgaattacgataaactctccagagcacttagatactactatgacaaaaatatcattcgcaaagtgagtgggcagaagttcgtctataagttcgtctcttatccagaatcccactgcgctccatag

SEQ ID NO: 14970 - DNA, 1287 bp, Artificial Sequence
  Description of Artificial Sequence: Synthetic coding sequence
atggatcccagtgtgaccctgtggcaattcctgctgcagctactccgggagcagggcaacgggcacatcatctcgtggacttcccgggacggtggcgaattcaaactggtggacgcggaggaagtagctcgtttgtggggacttaggaagaacaagactaacatgaattacgataaactgtctagagcactgagatattactatgataaaaacataatccggaaagtttcgggccagaaatttgtgtacaagtttgtcagttatcctgaggtagcaggttgtagcaccgaagattgcccacctcagcctgaagtttccgtcacctctactatgcccaatgtggctcctgccgcaattcacgccgcccctggagatacagtgtccggcaagccaggcacccctaagggagccggaatggccggacccggcggccttgcaaggtccagccgtaacgagtatatgaggtccggactttacagtacattcacaattcagagtctccaacctcagccgccaccacatccccgcccggccgttgttttgccttcagccgctccggccggtgcagcagctccaccttctggctcaagaagcacaagcccatcccctcttgaggcatgtttagaggccgaggaggcaggcctgccactgcaggttatcctcacccctcctgaagcgccaaacttaaaatctgaggagctcaacgttgagcctggcctgggtcgcgcgttgccacccgaagttaaggttgaaggaccaaaagaagagctggaggtcgctggggagcggggctttgtgcccgagaccacaaaggcagaaccagaggtgccccctcaggagggggtacccgctcgcctccctgccgtggtgatggacactgcgggacaggccggtggacatgctgcatcttccccagagatctctcaaccacaaaaagggcggaagccgagggatttggaattacccctgtctccctccctgctgggtgggcccggtccagaaagaacccctggatccggatctggctcagggttacaggccccgggcccggctcttacgcctagcctattgcccacccacaccctgaccccagtgctcctcacaccctcaagcctgcctccttccatccacttctggtcaactttatctccaatagctcctagatctccagctaaacttagcttccagtttccctcaagtggaagcgctcaagtgcatattcccagcatctctgtggacggattgagcactcccgtagtactgtctccaggcccacagaaaccttag

SEQ ID NO: 14971 - DNA, 366 bp, Artificial Sequence
  Description of Artificial Sequence: Synthetic coding sequence
atggatacggccggccaggcaggaggccatgccgcctcctcaccagagatcagtcaaccccagaaaggccgcaaacccagggatcttgaactccccctgagtcctagtctgcttggagggcctggtccagagcggacccccgccctccttcctacacacactttgactcccgtactgctcacaccttcatccctcccaccttctatacatttctggtcaaccctgagtccaattgctccgcggagtcctgcaaagctgagcttccagttcccctcctctggctcggcacaggtccacattccctcaatctcagttgacggcctctccaccccagtggtgctgagcccaggccctcagaaaccctag

SEQ ID NO: 14972 - DNA, 1713 bp, Artificial Sequence
  Description of Artificial Sequence: Synthetic coding sequence
atgagtgagcagagtatctgtcaggcacgagcagcggttatggtgtacgacgacgccaataagaaatgggtgcccgcgggtgggagtactgggttttctcgcgtgcacatctaccaccacacgggaaataatacattcagggtggtcggaagaaaaattcaggatcatcaggtagtgatcaattgcgccatcccaaaagggctaaagtataatcaggcaactcagaccttccatcagtggagggatgcgcgtcaagtttacggccttaactttggttccaaggaggatgcaaacgttttcgcctccgctatgatgcacgctctggaggtcctcaactcgcaagaaaccgggcccacactcccacgccagaattcccagctgcctgcgcaggttcaaaacgggccaagccaggaggagctggaaattcagagacgtcagcttcaggagcagcaacggcagaaagagcttgaacgggaacgacttgagcgagagcggatggaaagggagcgtctcgagagggagcgactggaacgggagcgcctcgagcgggagaggctggaacaagagcagctcgaaagggagcgacaggaacgggaacggcaggagcggctggaaaggcaagaacgtctggagcggcaggaacggttagagagacaagagagacttgaccgagaacggcaggaaagacaggaacgcgagcgtctcgaaaggctcgagcgagagaggcaagagcgggaaagacaagagcagcttgaaagagagcagctcgaatgggagagggaaagaagaatctcctctgccgcagcacctgccagcgtggaaacccctctgaacagcgtgctcggcgactcgtctgcaagcgagccaggcctccaggctgcatcccaaccggctgaaacacctagtcaacagggcattgtcttgggcccactagctccaccaccccctcccccgttgcctcccggtccggcccaagccagcgtggctctgccaccccctcctggacccccaccgcccccccccctgcccagcacaggccctcctcctccaccaccgccaccccccctaccgaatcaggtccctccaccacccccaccccctccggcgccccctcttccagccagtggttttttcctggcttctatgtcggaggataatcggcccctaaccgggttggcagcggccatcgccggcgcaaaactgagaaaggtgagtcggatggaagacaccagcttcccaagcggaggaaacgctattggagttaactctgctagctccaaaaccgacactggtcgcggcaacgggccactgcccctgggcggcagcggattaatggaagaaatgtctgctttgcttgctcggcgccggcgtattgcggaaaagggatccaccatcgaaaccgaacagaaagaagacaaaggcgaggactcagagcccgttactagcaaagcctcttcaacaagtactcccgaaccaaccagaaagccatgggagaggaccaacactatgaatggatctaagtctcccgtcatatcacggccaaagtctacccctctctctcagccttccgctaatggagtgcagaccgaaggcctcgattatgaccgtcttaaacaggatatacttgacgagatgagaaaggaactaaccaaactgaaagaggagcttatcgacgccataaggcaggaactatcaaagtcgaacaccgcctag

SEQ ID NO: 14973 - DNA, 1776 bp, Artificial Sequence
  Description of Artificial Sequence: Synthetic coding sequence
atgtctgagcagagcatctgccaggcaagagctgccgtgatggtgtatgacgatgctaataagaagtgggttccagccggaggttccacagggtttagccgcgtccacatctatcatcacacgggaaacaacacctttcgggtcgtgggcagaaagatccaggaccatcaggtcgttatcaactgtgctatcccaaaaggcctaaagtataaccaggctacccaaacttttcatcagtggcgcgacgccagacaagtctacggattgaactttggaagcaaggaggacgcaaatgttttcgccagcgctatgatgcatgcgctcgaagtgctcaactctcaggagacagggccaaccctgccacgccagaacagccaactcccggctcaagtacagaacgggccgtcccaagaggagctcgagatccagaggcggcagctccaggagcagcagcgccaaaaagagctggagcgggaaaggctggagcgcgagaggatggagagggagaggctggaacgcgagagactggagagggaacggctagagagagagcggctcgagcaggagcagctagagagagaacgccaggagcgcgagaggcaggagaggctcgaacggcaagaacggctcgaaagacaggagcgattagagcggcaagagagactggatagggagcggcaggaaagacaggagcgggagaggctcgaaaggctggagagagaaagacaagagagggagcggcaggagcagcttgaacgggaacaactcgagtgggagcgggaacggcggatcagttctgcagcagcccctgcctccgtcgagacccctctgaatagtgtcttgggcgattccagtgcgtccgaacctggcctccaggcagccagccaaccagctgagactccgtcccagcagggaattgtcctggggcccctggctcctcctcctcccccaccactgcctcctggtcctgctcaggcaagcgttgcactgcccccaccgcctggtcctcccccacctccgcccttgccatcaactggaccacctcccccccccccgccgccccctctgcccaatcaggtcccaccgcctccccctccgccacccgccccaccattgcccgcatctggtttcttcctagcttcaatgagcgaggataataggcccctaactggtctggctgccgcaatcgccggagccaagctaaggaaggtatcccggatggaagataccagctttccatccgggggcaatgccatcggcgtcaacagtgcatcatcaaagaccgacaccggacgcgggaacggaccgttgccattgggggggtcaggtctaatggaggagatgtccgctttactagccagacgcaggcgcattgccgaaaaagggagcaccattgagactgagcagaaggaggacaaaggcgaagactcggagcctgttacatccaaagcctcgagtacgagcacccccgaacccaccaggaaaccttgggagagaaccaatactatgaacggctcgaagagcccagtcatatctagacgtgactccccgcggaaaaaccagatagtgtttgacaacaggtcttatgactctttgcatcggccaaaaagcacacctctctcccagcctagtgctaatggcgttcaaactgagggtctcgactacgaccgcctgaaacaggatatcctggacgagatgcggaaggagcttacaaaattgaaagaggaattaatcgatgcaattcggcaagaactcagcaagtcaaacaccgcgtag

SEQ ID NO: 14974 - DNA, 1599 bp, Artificial Sequence
  Description of Artificial Sequence: Synthetic coding sequence
tccgagcagagcatctgtcaggcccgcgcagctgtgatggtgtatgatgacgccaacaagaaatgggtgcccgcagggggaagcacagggttcagcagagttcacatttatcaccacaccggtaacaataccttccgggtggtaggtagaaaaatccaggatcaccaggtcgtgattaattgcgccattccaaaaggactgaagtacaaccaagcaacacagactttccatcagtggcgcgacgcgcggcaggtgtacgggctgaactttggctccaaagaggatgcgaacgtcttcgcttcagccatgatgcatgcccttgaggtgctgaactcacaggagactggccccacactgcctcgccagaactcccaactgccagctcaggtgcagaacggtccatctcaggaggagcttgagattcaaaggaggcagctgcaagagcaacagcggcagaaggagctagagcgtgaacggctggaacgcgagcgtatggaacgggagcggctggaaagagagagacttgagcgggagcggctcgagcgcgagaggctggagcaggagcagctggaaagagagcggcaagaacgggaacgccaagagcggctggagcggcaggaaagattagagcgtcaggaacggctcgagaggcaggaacgcctggatcgggagcgacaggagagacaagagcgtgagaggctggagcggctcgagcgcgagcggcaggagcgcgaaagacaggaacagttagagagggagcagctcgagtgggagcgggagcggcgcattagttccgccggtattgtgctcgggcccctcgccccgccacccccaccaccccttccccctggtcctgcccaggcaagtgtggctctgccgcctccccccggtcctcctcccccgccgcctctcccttcaacaggaccaccccccccccctccgccaccgcccttgccaaatcaggttcccccgcctccaccaccaccacccgctccacccctcccagcatcaggattcttcctggctagtatgtctgaggacaaccgacccttgacaggactggctgcagctattgcaggcgctaagctgcggaaagtgtctcgcatggaggatacttctttcccctccggggggaatgccattggtgtgaacagtgcctcctccaagactgataccggaagaggaaacgggcccctgccgctcggggggtcaggtttaatggaggaaatgagcgctctgttggccagaaggaggcgcattgccgaaaaaggtagcaccatcgaaaccgaacagaaggaagataagggagaagattcggagccagtgacatcaaaagctagcagcacctccaccccagagcctacccgtaagccttgggaacggaccaataccatgaatggaagtaagtcgcctgtaataagcagaccaaagtcaacccctctgtcacagccatctgccaacggcgtgcagacagagggcctggactatgatagactgaaacaggatatactggatgaaatgaggaaagaacttaccaagctgaaggaggagttgattgacgccatccggcaggagttgtccaagtcaaacacggcttag

SEQ ID NO: 14975 - DNA, 1878 bp, Artificial Sequence
  Description of Artificial Sequence: Synthetic coding sequence
atggacaggggaacactccctctcgctgtggccctcctgctggccagctgcagcctgtctcccacatcccttgctgagaccgttcattgcgatctgcagccagttggtccagagcggggtgaagtcacctatactacatcacaagtttcaaaaggctgcgtcgcccaggcgcccaatgcgattttggaagtgcacgtcctgttccttgaatttcctaccggaccttctcaacttgaactgaccctccaggcctctaagcagaacggaacgtggccccgggaggtgctgctggtgctgtccgttaactcatcagtgttcctgcacctgcaggccctcggcatacccctgcatctggcatacaattcgagcttggtgactttccaggaacccccgggcgtgaatacaactgaactgccatcgtttccgaagactcagattctggaatgggctgccgaacgcggacctataacctccgctgcagagctgaacgaccctcagtctatcctcttgagactgggtcaggcccaggggagcctctccttttgcatgctggaagcctcgcaggacatgggccgaaccttagagtggaggccacggacgccagcccttgtgagaggttgtcacttagagggagtggcgggccacaaggaagctcacattctgagggttttacccggacacagcgccgggccgaggaccgtcacggtcaaagtcgagctgtcttgcgcacctggggacctcgacgctgtgctcatactgcaggggcctccctacgtctcctggttgatagacgccaaccataacatgcagatctggacgaccggcgagtacagtttcaaaattttccccgagaagaatattaggggcttcaagctgcctgacaccccccagggactcctgggcgaagcccgcatgctgaacgcaagtattgtggctagctttgtagaattgcctctcgcttccattgtctcactgcatgcttcctcgtgcggtggccggctgcagacgtcccccgcgcctatccaaacaactccccccaaagacacttgttcccccgaactactgatgtccctgatacagacaaagtgtgccgatgatgctatgaccctggttcttaaaaaagaactggtagcccatctgaaatgtactatcaccggactgaccttctgggacccatcttgtgaggccgaggaccggggagacaagtttgtgctcagatcggcttacagcagttgtggaatgcaggtgtccgcatccatgattagtaacgaggcagtggtgaatatattgtcctccagttcaccccagcggaagaaggtgcattgtctcaacatggactcattgagcttccaactggggctgtatctgtccccacacttcttacaggcctccaataccatcgagccaggccagcagtcattcgtgcaggtgcgtgtgagtccttcggtatcggaatttctgctgcaattggattcgtgccacttggaccttgggccagagggaggaaccgtggaactgattcaggggcgggccgcgaaagggaactgtgtgagtcttctcagtccgtcacccgagggcgacccccgctttagtttcttactgcatttttacactgtgccaatcccgaaaacagggactctgtcttgtaccgttgccttacggccaaaaaccggttcacaggaccaggaggtgcatcgcacagtcttcatgcgactgaatataattagtcctgatctctctggctgcactagcaagggtctggtgctccctgctgtcttaggtatcactttcggcgccttcctcatcggtgccctgctgacagccgctctttggtatatatactcccataccagggagtaccctcgccctccacaatag

SEQ ID NO: 14976 - DNA, 1977 bp, Artificial Sequence
  Description of Artificial Sequence: Synthetic coding sequence
atggataggggaaccttacctttggccgttgctctgcttctcgcttcctgttcgctttcccccacctctctggccgagactgtccattgcgacttgcagcccgtaggacctgaaaggggggaggtcacgtataccacttctcaggtgagcaaaggctgtgtggcgcaagctccgaatgccatactcgaggtgcacgtgctgttcctggagttcccaacagggccatctcagctagagctgactttgcaggcctctaagcaaaacggcacgtggccaagagaggtgctcttagtgttaagcgtgaacagctccgtatttctccacctgcaagctctaggaattcctctccatctggcatacaatagttctctggtcaccttccaggagcctccgggggtgaataccactgaactgccgtcttttcctaagacccaaatcctggagtgggccgccgagaggggccccatcacgagcgctgcggagctaaacgatccccagtcaattctgctgcggctgggccaggcccaaggaagcctgtctttctgcatgctggaggccagtcaggatatgggaagaaccttagagtggcgtccgagaactcccgcactggtgcgcgggtgccacctggagggggtagccggccataaggaagctcacatcctgagagtgctcccgggacactccgctgggccaaggacggtgacagtgaaggtggagttgtcctgcgcccctggcgatctcgacgccgtcctcatcctacagggccccccctatgtcagctggctaatagatgcaaaccataacatgcaaatctggaccaccggagaatactccttcaaaatcttccccgaaaaaaacatccgcgggttcaagctgcctgacacccctcagggcttgctcggcgaggctcggatgctaaatgccagcatagttgcttcctttgtggagctgccattagcaagcatcgtgagcttacacgcctcctcatgtgggggccgactgcagacatcgccagctccaatccaaaccacccctcctaaggatacctgtagccccgagctactgatgtcccttatacaaaccaagtgtgcagacgatgctatgaccctggtgctcaaaaaggagctggtggctcatctgaagtgtaccatcaccggactcactttttgggatccgtcgtgtgaggccgaggaccgcggagataaattcgtcctacgttccgcttatagctcctgtggaatgcaggtctcagcttccatgattagtaatgaggctgtcgtgaacatactttctagtagctctccccagcggaaaaaagtgcattgcctgaatatggactcactctcctttcagttagggctgtatctttcacctcattttcttcaggcctcaaatacaattgagcctgggcaacagagttttgtccaagtgagggtttccccatccgtgagtgagttcctcttgcagctcgatagctgtcacttagatctgggcccagaaggtggcacagtggaactgattcagggacgggctgctaaagggaattgtgtgtcactattatcaccctcgcctgaaggagaccctagatttagtttcttgctccacttctatacagtcccaattccgaaaacgggtactctcagctgcactgtcgcactcaggcctaagaccggttcacaggaccaggaagtccatcggacagtatttatgcggctaaatatcatatccccagatttgtcagggtgcacaagcaaggggctcgtgctgccagccgtgctgggcatcaccttcggcgccttcctaattggcgcattgctgacagcagccctgtggtatatttactcccacacccggagcccctcaaagcgggagccagtggtcgctgtggctgccccggcctcttctgagagctccagtactaaccactctattgggtctactcagagtactccatgcagcacctcctcgatggcatag

SEQ ID NO: 14977 - DNA, 1977 bp, Artificial Sequence
  Description of Artificial Sequence: Synthetic coding sequence
atggacaggggcaccttacccctcgccgttgcattattactggcaagctgttctttgagcccaacgtccctcgccgaaactgtgcactgcgatttgcagccagtcggccccgagcggggcgaggtgacgtacacaacttcgcaggtttccaaggggtgtgtagcccaggcccctaatgcaatcttagaggtgcacgtcttatttctcgaattccctacaggtccttcccagctggagctgacattacaggcgtccaaacagaacgggacgtggcctagagaggtactgctagtgctctccgtgaattcaagcgttttcctgcacttgcaggctcttggcattcccttacacctagcttataatagtagcctcgtgacatttcaagaacctcccggtgtgaatactactgaactgccatcgtttcccaagacacagatcctggagtgggctgcggagaggggtcctataacttcagccgccgagctgaatgatcctcagtcaattttattgcggctggggcaggcccaaggcagtctgtcattttgcatgctggaggctagccaagacatgggccgaaccctggaatggcgtcctcgcacaccagcgttagtacgaggttgccacctcgaaggcgtggcaggtcataaggaggcccacatactcagagtcttaccaggccatagtgcaggccccagaacggtgactgtcaaggtcgaattgagctgtgctcctggggacctcgatgcagtcctaatcctgcagggccctccttacgtgagttggctgatagatgctaatcacaatatgcagatctggaccaccggggaatacagcttcaagatcttcccagaaaaaaatattcgggggttcaagttgcccgacactccccagggactgctaggagaagcacggatgctgaacgcctctattgttgcgtcattcgtcgagctgccccttgcgagcatcgtatctctccacgctagtagctgcggggggcgcctgcagacaagtccagccccaattcagacaacacctcccaaagacacatgctctccagagttattgatgtcactcattcagacaaaatgcgctgatgacgctatgacacttgtcctaaaaaaagagctcgtcgctcatctgaagtgcacaatcaccggcctgaccttctgggatccctcctgcgaggctgaggataggggagacaaatttgtcttgagatcagcatactcaagctgcggaatgcaggtgagcgcatcaatgataagcaatgaggccgtggttaacatcctcagtagtagctcccctcagaggaagaaggtccactgtctcaacatggattcgcttagtttccaactcggactgtatctgtcaccccactttctgcaagccagcaatacaatcgaacccggccaacagtcctttgtccaggtcagggtttccccaagcgtatcagaattcctgttgcagttggactcctgccacctggacctggggccggagggcggcacagtagaactaatccaaggcagggccgcaaagggaaattgcgtctctctgctgtcaccttctccggaaggggatcctagattttctttcctgctgcacttctataccgtgccaatacctaagacaggaactcttagctgtactgtggcgctgagacccaagaccggcagccaggatcaagaggttcaccgcacagtgttcatgcggttgaatatcatttctccagatttgagcggctgcacatcaaaaggtctggtccttcctgcggtgctggggataacttttggcgccttcctcattggcgccctgctgactgccgccctgtggtatatctattcacacactcgctcacccagtaagcgtgaaccagttgtggcagtggcagcacctgccagtagcgaaagctcttctacaaatcactccattggttccactcagtcaaccccctgtagcacttccagcatggcgtag

SEQ ID NO: 14978 - DNA, 1431 bp, Artificial Sequence
  Description of Artificial Sequence: Synthetic coding sequence
atgcttgaggctagccaggacatgggcaggactctagagtggcgcccacgcacccctgcccttgtccgcgggtgccaccttgagggtgtggctggccataaagaggcacacattctgcgcgtccttccagggcactccgccggcccacgcaccgtaaccgtcaaggttgaactgtcctgtgcccccggggatctcgacgccgtgcttatcctccagggccctccttatgtatcctggttgatcgatgctaaccataacatgcagatctggacaaccggggaatactcctttaaaatctttccggagaagaatattagggggtttaagctgcccgataccccccagggtctcctgggcgaggcgagaatgctcaacgcttcaattgtggcctcgttcgtcgaattgcccctcgcttccatagtcagcctgcacgccagctcttgtggtggacggctccagacttcgccagccccaatccagacaactccgccgaaagacacttgttcacccgagctacttatgtcgttgattcagacaaagtgcgcagacgacgccatgacactggtcctaaaaaaagagctggtggcccatttaaagtgcacaatcactgggctgaccttctgggaccctagttgcgaggccgaagacaggggcgataagttcgtgctgcgtagcgcctactcgagctgtgggatgcaggtctccgcctctatgatctctaacgaggctgtcgttaacatcctttctagttcatctccccagcgcaagaaggtccattgcctgaatatggattcccttagcttccaactgggcctgtacctttccccacatttcttgcaggcatcaaataccattgaaccagggcagcaaagcttcgtgcaggtgagggtgtcgcctagtgtgagcgaattcctcctgcagctggatagctgtcatctggacctgggcccagagggtggcactgtggaactcattcagggccgcgccgcgaagggtaactgcgtgagcctgctgtcaccctcaccagaaggggacccacgtttttccttcctcctgcatttttacaccgtcccaattcctaagaccggcacactgagttgcaccgtggcactgagacctaagacaggctcgcaggaccaggaagtacataggacagtctttatgaggttaaatatcattagtcccgatctgagcggatgcacctccaaagggctggtccttccagccgtgctagggatcaccttcggcgcctttttgatcggagcgctgctgaccgctgccctgtggtacatatacagtcacacccgctctcccagcaagagagagcctgtggtcgctgttgcagcccccgcatcctcggaatccagctcgaccaaccactcgataggttcaacccagagtactccctgctctacttccagcatggcctag

SEQ ID NO: 14979 - DNA, 639 bp, Artificial Sequence
  Description of Artificial Sequence: Synthetic coding sequence
atggactatctgctcatgatcttctctctgctcttcgtcgcttgccaaggcgcacccgagacagctgttctcggcgccgaactgtcagccgtgggcgagaatggcggcgagaagcctacccccagccccccttggaggctgcggcgttccaagaggtgctcttgtagctcactcatggataaggagtgcgtgtacttctgccacttagacattatctgggtgaacactcccgaacacgtcgtcccttatggactggggtcaccaaggagcaaacgcgccttagagaacctgctgcctaccaaagccactgaccgcgaaaacaggtgccaatgtgccagtcagaaggataagaaatgttggaatttctgccaggcaggtaaagaacttagggctgaagacattatggaaaaagactggaacaaccacaagaaaggaaaggactgctctaagttaggcaaaaaatgtatttatcagcagttagttaggggccgcaagataaggcggtcttctgaggaacaccttaggcagactaggagcgagacaatgaggaactctgtgaagtccagttttcacgatcccaagctgaaaggaaagccctcccgcgaacgttatgtgactcataatcgcgcacactggtag

SEQ ID NO: 14980 - DNA, 1329 bp, Artificial Sequence
  Description of Artificial Sequence: Synthetic coding sequence
atgcagccaccgccgtctctctgcgggagagctctcgtggcattggtcctcgcatgcggcctctctaggatatggggcgaggagcggggcttcccacctgatagggcaaccccccttctccagaccgcagagatcatgacacctcctacaaagaccctgtggccgaaaggtagtaacgcatccctcgctcggtcattagcacccgcagaggtgcctaagggggatagaacagctggctcccctccccgaacaattagcccccctccttgtcaagggcctatcgaaatcaaagagacttttaagtacatcaacactgtggtgtcttgccttgtcttcgtgctcggcatcatcgggaactccacactgctccggatcatctacaaaaacaaatgtatgcgcaacggtcctaacattctgatcgccagtctggccctgggcgacctgttgcacatcgtgatcgacattcccattaatgtgtacaagctcctcgctgaagactggcccttcggcgcagaaatgtgcaaactggtaccttttatacagaaagcatccgtcggaattacggtcttaagcctgtgtgccttgtccatcgatcgctaccgcgcggtggccagctggagtagaatcaaaggtataggcgtgcctaaatggaccgctgtagagatcgtgctaatctgggtcgttagtgtggtgctagcggttccagaggcaattggatttgatattattaccatggactacaagggcagctacctgaggatctgtctgctccatcctgttcaaaagaccgcatttatgcagttttataaaacggctaaggactggtggctgttcagtttctatttctgcttgcccctggctatcacagcctttttttataccctaatgacatgcgaaatgctccgcaaaaaaagcgggatgcagattgcactgaacgatcatttgaaacagagaagagaggtcgctaagacagtcttctgtctggtacttgtgttcgccctttgctggcttccactccatttgtcacggatcctcaaactcacgctttataaccagaacgaccctaacaggtgcgagcttctgagtttcctcctggtgcttgattatattgggattaatatggctagcttaaacagttgcatcaatccgattgcgctgtatctagtgtcaaaacgattcaagaactgtttcaaatcatgtctgtgctgctggtgccagtcctttgaagagaaacagtcccttgaggaaaaacagtcctgcctgaagtttaaggccaacgatcatggctatgataattttaggagttctaataagtactcctcctcctag

SEQ ID NO: 14981 - DNA, 1599 bp, Artificial Sequence
  Description of Artificial Sequence: Synthetic coding sequence
atgaacaagagcacctgtctgatggcggccgagacgccttccaagagatggagattgcattgtcttgcatttagtcaacgctttgtgagagctggccccgcatgctcctccagggaggcctgcagtagtccacgcgcaggctggaaccccgctggctttcgcctcccaggccggtggtccccgttcgtggccctccatctggtttgccagattagggaagccttgaagcttcggagcggacacagaaccccgtcgggtgctggcagcagtatgcagccccctccgtccctgtgcgggcgcgccctcgttgcattggtactggcctgtggactctccaggatttggggggaggaaagaggctttccccccgatagagcgacccccttgctccagactgcagaaattatgactccgcccactaagaccctgtggcctaagggctctaacgctagcctggctaggtccctcgctccggcagaagtccctaaaggggaccgtactgcagggagccccccacgaacgattagccctcccccatgtcagggaccaatcgagatcaaggaaacgttcaagtatataaacacagtggtctcttgtcttgtgttcgtgttgggcatcatcggcaactctacactgctgcgcattatctacaaaaataagtgcatgaggaacgggcccaacattctgatcgcgagcctggctctgggggacttactccacattgtcatagacatccccatcaatgtatacaagctgctggccgaggactggccatttggagccgagatgtgtaagctcgtaccattcatccagaaggcatccgtggggatcaccgttctatctctctgcgcattatccatcgaccggtaccgcgccgtcgcaagttggtcccgcatcaaggggatcggtgtgccaaagtggaccgccgtggaaattgttttgatctgggtggtgtcggtagtgctcgccgtacctgaggccatcgggttcgatatcattaccatggactacaaagggagctatctgagaatctgtttactgcatcccgtacaaaaaaccgcattcatgcaattctataagaccgctaaagactggtggctctttagtttctacttctgtctgcctctggctataaccgctttcttctacacactgatgacttgtgaaatgctacggaaaaagtccggaatgcagattgcattgaatgaccatttaaagcagcggcgagaggtcgccaagacagtgttctgtctggtgctggttttcgcgctgtgctggctacctttacacctgagccgaattctgaaacttacattgtataatcagaatgaccctaacagatgtgaactcctatccttccttttagtgcttgactatatcgggatcaatatggctagtcttaattcttgtataaatccgatcgctttgtatctcgtatccaagcggttcaagaattgctttaagagttgtctatgctgctggtgccagtcttttgaggagaaacagtctctcgaggagaaacagtcttgcctgaaatttaaggcaaatgatcatggctatgacaactttagatcatctaataaatatagcagttcttag

SEQ ID NO: 14982 - DNA, 1311 bp, Artificial Sequence
  Description of Artificial Sequence: Synthetic coding sequence
atgcagccccctccatccctctgcggaagggccctggttgctctggttctggcatgtggccttagtcgcatctggggcgaagaaagggggttcccacccgaccgggccacgccgttacttcagactgctgagatcatgacccctccgaccaagactctatggccaaaaggctccaatgccagccttgctagatcccttgcccccgccgaggtgcctaaaggggaccggactgccggaagtccaccaagaactatctcaccaccgccctgccaaggacctatagagatcaaggaaaccttcaaatacatcaataccgtggtaagttgtttggtcttcgtcctcggaatcataggtaatagcactctgctgcggatcatctataagaacaaatgcatgaggaacggccccaatattctgattgcgtcacttgcactcggtgacctgcttcatatcgtgatcgatattcctatcaacgtttacaagctgctggccgaagactggccctttggagccgagatgtgcaagctcgttccattcattcaaaaagcatcagtcggtatcactgtgttgagcctgtgtgcactgtctattgataggtatagggctgtcgccagctggagtcggattaagggtataggggttcctaagtggactgctgtcgagattgtcctcatttgggtggtgagtgtggtgctcgctgtgccggaggcaataggctttgacattatcaccatggactataagggctcttatctgcggatttgccttcttcatcccgtgcaaaagactgcttttatgcagttttataaaacagctaaagactggtggttgttcagcttttatttttgcttacctctggcgattaccgctttcttttatacccttatgacctgtgaaatgctgcgtaagaaaagcggaatgcagatagcactgaatgatcacctaaaacagcgccgagaggtggccaaaacggtcttctgcttggtcttagtgttcgcgctgtgctggctaccattgcatctgagtagaattttgaagttaaccctctacaatcaaaatgaccccaatcgttgcgaattgcttagtttccttctggtgctggactatattggcattaatatggcaagtttaaactcttgtatcaatccaattgctctgtatctggtgtccaaacggtttaaaaattgtttcaaagccggaccacatgttggaaacaagctagttatgctcttcagtgtgaatatagagtgcgacgggaccgtgaatcaaaatccaacaatgtggccggagcggaaaagcaacaataattag

SEQ ID NO: 14983 - DNA, 2787 bp, Artificial Sequence
  Description of Artificial Sequence: Synthetic coding sequence
atggccctacggcggctgggcgccgccctgctgctgcttccactgttggctgcagtagaggaaacactgatggacagtacaacagccacagctgagcttggctggatggttcacccaccctccggatgggaggaggtgtctggatatgacgaaaatatgaacaccatcagaacatatcaggtgtgtaatgtgttcgaatcttcccagaataattggctgcggactaaattcattcgacggagaggtgctcatcgcattcacgtagagatgaagttctctgtcagggattgtagcagcatccctagcgtacccggctcctgtaaagaaactttcaatctgtactactatgaagccgattttgatagtgctaccaaaacattcccaaactggatggaaaacccatgggtgaaggtcgatactattgctgcagatgaatccttctcgcaggtggacttgggaggtcgggtgatgaaaatcaacacagaggtgcgctctttcggcccagtttcccgctccggtttctatctggccttccaggattacgggggctgtatgtccctcatcgccgttagagtcttctatcgaaagtgtcctcgcattattcaaaatggtgctatcttccaagagaccttgtctggggccgaatctacctctttagtggccgcaaggggaagctgtatcgccaatgccgaggaagtggacgtaccaataaagctctactgcaatggagatggagagtggctggtcccaatcggccgctgtatgtgcaaggcgggtttcgaggcagtggagaacggcaccgtgtgtagaggatgcccgtcaggcacctttaaggctaaccaaggagatgaagcttgtacacattgtcctatcaattctcggactacgtctgaaggtgccaccaattgtgtctgtagaaatggctactatagggctgatctcgatcctctggacatgccctgcacgaccattccatctgcccctcaggccgtgatctctagcgttaatgagacttctttaatgctcgagtggacgccccctagggattccggaggtcgtgaggacttggtgtacaacattatatgcaaatcatgtggctctggccgcggggcctgcacccggtgcggagataatgtacagtatgctccacgtcagctaggactcactgaaccccgcatttacatatctgaccttttggcccacacacagtacaccttcgagattcaggccgtgaatggcgtaaccgatcagagcccctttagtccccagtttgcgtccgtcaatatcaccactaatcaggctgcgccaagtgctgtgtcaatcatgcaccaggtgtctcggaccgtggactcaatcaccctatcttggtcacaacctgatcaacctaacggtgtgatattagattacgagttgcagtactatgagaaagagctgtcagagtacaatgctactgcaatcaaatctccaacaaatactgtcaccgttcaagggctgaaagccggtgctatttatgttttccaagtgagggcgcggaccgtcgctgggtatggcagatactccggcaagatgtattttcagacaatgactgaagtgactccgggcatgaagatttatatcgatccctttacatatgaggacccgaatgaggctgtgcgcgaatttgctaaggaaatcgacattagctgtgtgaagatagagcaggtcattggagcaggagaatttggggaggtatgctcggggcatctcaaattgcccggcaagcgcgaaatttttgtagcgattaaaaccctaaaatcagggtacacagagaaacaaaggagggattttctctcagaggcctcaattatgggtcagttcgaccacccaaacgtgatacacttggagggcgtggtgacaaagtccacccccgtcatgatcatcaccgagtttatggagaatgggagtctggattctttcttaaggcagaacgatgggcaattcaccgtgattcagcttgtcggaatgctgagggggatcgccgctggtatgaagtacctagcggacatgaattacgtacaccgcgatctcgctgcccggaatattcttgttaactccaatttggtgtgcaaagtaagcgactttgggttatcccgattccttgaagacgatacatctgatcctacttatacaagcgctctggggggcaagataccaattcgctggactgccccggaagccatccaatacagaaagtttacctctgcatccgacgtctggagctatgggatagtgatgtgggaagtaatgagctatggcgagagaccgtactgggacatgaccaaccaggacgtcattaatgccatagagcaggattatcgactccctcctcccatggactgcccatctgccctgcaccagttgatgcttgattgctggcagaaagatcggaaccaccggccgaagttcggacagatcgtcaacactcttgacaagatgattagaaaccccaactcattgaaggctatggcacctttgtcgtccggaatcaacttgcccctattggatcggaccataccagactacaccagttttaacaccgtggatgagtggctggaggccatcaagatgggtcagtataaagagtcatttgccaatgcagggtttacaagtttcgatgtggtgtcccaaatgatgatggaagacatcctgcgggttggtgtcactctggcagggcatcaaaaaaagatcctcaattctattcaggtgatgagggcccagatgaaccagatccagagtgtggaagtatag

SEQ ID NO: 14984 - DNA, 2841 bp, Artificial Sequence
  Description of Artificial Sequence: Synthetic coding sequence
atgtgggtgcctgtcctggcactccctgtatgcacttatgccgaaacacttatggattctaccactgctactgcagaactgggctggatggtgcaccctccctcaggctgggaagaggtatccgggtacgacgagaacatgaatacaattagaacataccaagtctgtaacgtgttcgagtcatcccagaataactggcttaggacgaagtttatacggcgccggggagcccacagaattcatgtggagatgaagttctccgtccgtgattgctcatcaattccttcggtcccaggcagttgtaaggaaacctttaatttgtattactacgaggcagacttcgattctgctactaagacttttcccaattggatggaaaacccatgggtgaaggtggacacaatcgctgctgacgagagtttttcacaggtggacctcggggggcgggtgatgaaaattaatacagaggtcaggtctttcggcccggtttcccgctctggattctacctggctttccaggactacggcggatgcatgagcctgatagctgtacgcgtgttttatcggaaatgtccaaggataatccaaaacggggccatcttccaggaaaccctgtcaggcgcagaatctacaagtctcgtagctgctcgtgggtcctgcattgctaatgctgaggaagtggatgtcccgatcaaactttattgcaatggagacggtgagtggctggtccctatcggccgctgtatgtgcaaggctggcttcgaagccgttgaaaacggcaccgtctgtcgtgggtgtcccagcgggaccttcaaggccaatcagggagatgaagcctgcactcactgcccaatcaattcaaggacaacctccgaaggagcaactaattgcgtgtgtagaaatggctactatagagccgacctggatcctttagacatgccctgcactacaatcccgtccgccccacaagccgtgatctcatccgtaaatgaaacttcccttatgctggaatggacacccccacgggattctggtggtagggaggacctagtgtataatattatctgtaaatcttgcgggtctggacgcggcgcctgcaccagatgcggggacaacgtccagtacgccccccgccagttgggcctgaccgagccaagaatatatatcagcgacctgctcgcgcacacacagtacaccttcgagatccaggccgtgaacggtgtaacagaccaatcccctttctctccccaattcgcctcagtgaatattacaactaaccaggccgctccgtctgccgtcagtatcatgcaccaggtatccagaacagtagattccatcactctgagttggtctcagcccgaccagccaaatggggtcatactggactacgagttgcagtactatgagaaacaagagctatctgagtataatgccacggcaattaagtcaccgactaatacggtgactgttcagggcttgaaggctggcgctatctacgttttccaggtgcgggcaaggacggtcgctgggtatggtaggtactcaggcaaaatgtattttcaaaccatgactgaagctgagtaccagacctcgattcaggagaaattgccattgatcatcgggtcctccgccgctggcctggtctttctgattgcagttgtggttatcgcaattgtgtgtaatcggcgaggtttcgagcgagcagattccgaatatactgacaaactgcagcactacacaagcggacatatgacccctggaatgaaaatatacatcgaccccttcacttacgaagatccaaacgaggctgttcgcgaatttgcaaaagagatcgacatctcttgtgtgaagatcgaacaggtgatcggggccggagaattcggggaggtctgctcagggcaccttaagttgccaggcaagcgggaaatatttgtcgccataaaaacactcaagtcaggctacaccgaaaagcaacggcgagactttctgagcgaggcatctatcatgggacaatttgaccacccaaacgtgatccatctcgagggcgttgtcacaaaatccacacccgtgatgatcattaccgagttcatggagaacggctctctggacagcttcttgcggcagaacgacgggcaatttactgtcatacagttggtgggtatgcttaggggcatcgccgccggaatgaaatatttagcagacatgaactacgtccacagggatttagccgccagaaatattctggtgaattcgaacttagtctgcaaggtctccgattttggtttgagccgctttctcgaagacgataccagcgaccctacatacacctccgccttgggcggcaaaattcctattcgttggaccgcccccgaggccatacaataccgtaaattcaccagtgctagcgatgtatggagttacggcatcgtcatgtgggaggtgatgtcttatggtgaaaggccttattgggacatgacaaatcaggacgtgattaatgctatagagcaggactataggctaccaccaccaatggattgtccctctgccctgcaccagctgatgttggattgttggcagaaagatagaaaccacaggcccaagttcggtcagatcgtcaacacacttgacaaaatgatccggaacccgaactctcttaaggctatggcgcctctttctagtgggatcaatttaccattattggataggacaatacccgattatacatcatttaacacggtcgatgaatggctcgaagcaatcaagatgggtcagtacaaggagagctttgccaacgctgggtttacttccttcgatgtggtgtcacagatgatgatggagtag

SEQ ID NO: 14985 - DNA, 2961 bp, Artificial Sequence
  Description of Artificial Sequence: Synthetic coding sequence
atggctcttcgcagacttggcgcggcactgctgctgctgcccttgttagcagcagtggaggaaaccttaatggattccactaccgctactgccgagcttggctggatggtacacccaccctccgggtgggaggaagtcagcggatacgacgaaaacatgaataccattcgcacatatcaggtttgtaacgtgtttgagagttctcagaacaactggttaagaactaagttcatcagaagacggggagctcacaggattcacgtggagatgaaattctccgtgcgcgactgttctagtattccatctgtgcccgggagctgcaaggaaaccttcaacctgtactactacgaagctgattttgattctgcaaccaaaacctttcccaactggatggaaaacccatgggttaaagtcgatacaatcgcggctgacgaatcattctctcaggtggacttgggtggccgggtgatgaaaatcaatactgaagtccgatcatttggcccggtttcacggagcgggttttatttagcttttcaagattacggaggctgcatgtccctgattgccgttagagtcttctaccgcaagtgtccgaggatcatccaaaacggtgctatctttcaagagaccctctccggggccgagagcactagccttgtcgctgcaagagggagttgcatcgccaatgcggaagaggttgacgtcccaataaagctgtattgcaacggcgatggcgagtggctcgtgcccattggccgctgtatgtgcaaggccgggttcgaggccgtcgagaatgggaccgtctgcagggggtgtcctagcggcacctttaaagccaatcagggagacgaggcctgcactcactgccccatcaacagccgaactaccagcgagggagccaccaattgcgtgtgtcgcaacggttactaccgagccgacttggatcccctcgatatgccttgtaccactatcccgagtgcgccccaggcagtgataagctcggtgaacgagaccagcctcatgctggaatggacacctcccagagactccggaggcagggaggatcttgtgtacaacatcatctgcaaatcctgcggtagcggcaggggtgcatgtaccagatgcggagacaacgtccagtatgctcccaggcaattgggattgactgagccaaggatttatatctccgacctgctagcccatactcagtacacctttgagatccaagccgttaacggtgtgaccgaccaaagtcccttttccccccaatttgccagcgtgaatattactacaaatcaggctgctccatccgcagtttctatcatgcaccaggtgtcaaggaccgtagattcgatcaccctctcctggtcccagcctgatcaacccaatggtgtgatcctcgattacgagctacagtactacgagaaggagctctcagagtacaatgctaccgccattaagtcacccactaataccgtgacggttcagggacttaaagcaggagcaatctacgtgtttcaggtccgggcccgaactgtggctggatacgggaggtatagcgggaagatgtatttccagaccatgacagaggccgagtaccagacaagcatccaggagaagctgcctctgataattggttcctccgctgcagggctcgtgttcctcatagccgtggtggtcattgccatcgtatgtaatcgacgtgggtttgaacgcgctgattcagagtataccgacaaacttcagcactatacgagcgggcatatgacacccggcatgaagatttatatcgaccctttcacctatgaagatcccaacgaggccgttcgcgagttcgctaaggagattgacatctcttgcgtgaagatcgagcaagtgataggggcgggggagtttggagaagtctgcagcggtcatttgaaattgcccgggaaacgcgagatctttgtcgccataaagacgcttaaaagcggctacactgagaagcagagaagggacttcctgtcggaagccagcattatgggccagttcgaccatccaaatgtcattcatctcgaaggcgtggtgaccaagtctactcctgttatgatcatcacagagttcatggaaaacgggtccctggactcctttttacggcaaaacgacggacagttcaccgtgattcaactcgtgggcatgttgagaggtatcgcagccggaatgaagtatctagcggatatgaattatgtgcaccgggatctggccgccagaaatattctggtgaattcaaatttagtttgcaaagtgtctgactttgggctttcacggttcttggaggatgacaccagcgacccaacctacacctctgctctcggggggaaaattcctatccgttggaccgcccccgaagcaattcagtataggaagttcacctcagcctccgacgtctggtcttatggaatagtcatgtgggaggttatgtcatatggagagcgcccatattgggacatgactaatcaggatgtaattaacgctattgaacaggactaccgccttccgcccccaatggactgtccgtcagcactccaccaattgatgttggattgttggcagaaagatcgcaaccataggcccaagtttgggcaaatcgtcaacaccctggacaaaatgatacggaacccaaactcactgaaggccatggcacctctgagttctggtattaatcttcccttgctggatcggacaattcccgattacactagttttaacaccgtggatgagtggctggaggccatcaagatgggccagtacaaggaatcattcgcaaacgcaggatttacctccttcgatgtggtcagccaaatgatgatggaggatatcctgagggttggggtgacactggctggacaccagaagaagatcctaaattcaatacaggtgatgcgagcccagatgaaccagatccagagcgtcgaggtctag

SEQ ID NO: 14986 - DNA, 2964 bp, Artificial Sequence
  Description of Artificial Sequence: Synthetic coding sequence
atggctcttagaagattgggagccgctctgcttctgctgcctttgttggccgccgtcgaggagacactcatggactcaaccactgccaccgccgagctagggtggatggtgcacccccccagtggatgggaagaagtgagcgggtacgatgagaacatgaacactatacggacttaccaagtttgcaatgtgttcgagtcttcccaaaacaactggcttaggactaaatttatccggcgccggggggctcacagaattcacgtggagatgaagttcagtgtgagagactgctcttccatcccctctgtgccagggtcctgtaaagaaactttcaacctgtactattacgaagcggatttcgactctgctacaaaaacgtttccgaattggatggaaaatccatgggttaaagtggatacgatagccgcggacgaatcttttagccaggtagatcttggaggccgcgtgatgaagataaacacggaggtgagaagttttggacctgtctctcgatccgggttctacctagccttccaagactacgggggctgcatgagcctcattgcagtcagggtcttttatagaaaatgtcctagaatcatccagaacggagccatcttccaggagaccttatccggagcagagagtaccagcctggttgcagccagaggatcgtgtatcgctaacgctgaggaggtggatgtgcccattaagctttactgcaacggtgatggagagtggcttgtcccaattggccgttgcatgtgtaaggcgggctttgaggcagttgaaaacggcacagtatgccgaggttgcccatctgggacctttaaggctaaccagggcgatgaggcttgtacccactgtccaattaattcgcggaccacgtccgagggcgccactaactgcgtctgccggaatggatactaccgggctgacctggaccctctggatatgccctgcactacgattccgtcagccccccaggcagtgatatcctccgtcaacgaaacttccctgatgctggaatggacgcccccaagagatagcgggggccgggaggatttagtttacaacatcatttgcaaaagctgtgggtctggacgcggagcctgtacccggtgcggggacaacgtacagtacgcccctcgccagctcggcctgacagagcccaggatttacatctccgatctgctggcacatacccagtataccttcgaaattcaagcggttaacggcgtaacagaccagtcccctttctccccacagtttgctagcgtgaatattaccacgaaccaagctgcaccgtctgccgtgtctattatgcaccaggtgtcccgaacagtggatagcataactctcagttggtcacagcctgaccagcccaatggcgtaattttagactacgagttgcagtattacgagaaggaactgtctgaatataatgccacagctatcaagtctcctacaaatactgtgaccgtgcagggcttaaaagctggagctatctacgtatttcaagttcgagcccgcaccgtggctggctacggacgttatagcgggaagatgtacttccagaccatgacggaggcagaataccagaccagtatacaggagaagctcccactgatcatcgggagtagcgctgccgggctggtctttctgatagctgttgtagtgatagctattgtctgtaaccgaaggcggggcttcgagcgcgcagatagcgaatacaccgataagttgcagcactacacctcgggccacatgacgcctggcatgaaaatctacattgatccatttacttacgaagatcctaatgaggctgtcagagaattcgcaaaggaaatagatattagctgcgtgaagattgagcaagtcatcggagccggagaattcggggaggtgtgctcgggtcacctgaagctgccagggaagcgcgagatttttgtagcaatcaaaacactcaagagcgggtacacagagaaacagaggcgagatttcctgtccgaagcgagcatcatgggtcagttcgaccacccaaatgtgattcacctcgaaggagttgttacgaaatcaacaccggtcatgatcattacggaattcatggagaacgggagcttggacagctttctgaggcagaatgatggtcagtttaccgtgattcagcttgtgggcatgcttagaggcatcgccgcagggatgaagtacctggctgatatgaattatgtgcaccgcgacctggccgcccgcaatatcctcgtgaattcaaatctggtctgcaaagtctctgactttggcctgagcaggttcctcgaagacgataccagcgaccccacctatacatccgccctgggcgggaagatcccaatcagatggacagcccccgaggcaatccagtaccgtaagttcacatccgcttccgacgtttggagttacgggatcgtgatgtgggaagtaatgtcttacggggagcgtccttactgggatatgactaatcaggacgtcatcaatgccattgaacaggattatcgtctcccacctcctatggactgcccgtctgccctgcaccagttgatgctggactgctggcagaaggacaggaatcaccgacctaagttcggacaaatcgtgaacacactggataaaatgataaggaatcccaactctctaaaagccatggcccccctgagctcaggaatcaatctcccacttctggatcgaaccattccggactacacttcattcaacacagtggacgagtggctcgaagccattaagatggggcagtacaaagaatccttcgcgaacgctggattcacatcctttgatgtggtgagtcagatgatgatggaagacattctgagggtaggtgtgacactggcaggccaccaaaaaaaaatactgaacagcattcaagtgatgcgagctcagatgaaccagattcaatctgtagaagtgtag

SEQ ID NO: 14987 - DNA, 3168 bp, Artificial Sequence
  Description of Artificial Sequence: Synthetic coding sequence
atggctttgcgtcgcctcggagcagctctactgctattgcccctgctggctgcggttgaggagacactcatggatagcacaaccgctaccgccgagctgggctggatggtacatccgcccagcggatgggaagaggtgtccggctacgatgagaacatgaatacaattcgcacctaccaagtgtgtaatgtgtttgagagctctcagaacaattggctacgcactaaattcattaggcgtcgaggggctcaccggatccacgtggagatgaagttctccgttcgggactgctcatctattccaagcgtgccaggctcctgcaaggagaccttcaatctgtattattatgaggccgactttgacagcgctacaaaaacgttccccaactggatggaaaatccctgggtgaaggttgacaccatcgccgccgatgagtcattttcccaggtggacctggggggtagggtcatgaaaattaatactgaggtgcgatctttcgggccagtgagtcggtcgggcttctatctcgcatttcaagattatgggggatgtatgtctctaatcgcagtgagagtattctaccgcaaatgtccaaggatcatacagaatggggcgattttccaggaaacgctgagcggggcagaaagcacaagtctggtggcagcccgggggagttgtatcgctaacgctgaggaggtggatgtacctatcaagctctactgtaatggcgacggggagtggttggttccaatcggaaggtgtatgtgcaaagctggcttcgaagccgtcgagaatgggacggtgtgtcgaggttgtccatcgggtacatttaaggccaaccaaggagatgaggcttgtacccactgccctattaactctcgaacaacttctgaaggtgcaacaaattgtgtgtgtcgcaatggatactatagagctgatctggaccctcttgacatgccctgtaccaccattccttccgcccctcaggcagtaataagtagcgttaatgagacaagcctgatgttagaatggaccccaccccgggacagcggaggacgcgaagacctggtgtataacataatctgcaaatcttgtggaagtggccggggggcttgcactcgctgtggcgataatgtccagtacgcaccgagacagctcggcttaacagaacccaggatctacatctctgacttgttagcccacactcagtatacgtttgagatccaggccgtaaacggagtgaccgaccagtcccccttctctccgcaattcgccagcgttaacatcacaactaatcaggccgcaccatccgccgtctctatcatgcatcaggtgagcagaactgttgactcaattaccctaagctggagccaacccgaccagcccaatggggtgatactggattacgagctacagtactatgaaaaggagttgtctgagtacaacgcaacggcaattaagtcaccaaccaacactgtgaccgtccagggcctcaaggccggggcgatctacgtctttcaggtgcgcgcaaggacagtggccgggtatggccgttattccggaaagatgtacttccagacaatgacagaggcggagtaccagacatctattcaggagaagctgcctctgatcattgggtcatccgccgctgggctggtgttccttatagcggtggtcgttatagcgatcgtttgcaatcggaggggattcgagcgagccgattccgaatatacagacaagttacaacattacactagcggccatatgacccccgggatgaaaatctatattgaccccttcacctatgaggacccaaatgaagcagtgagggaatttgccaaagagatcgatatctcttgcgtgaaaatcgaacaggtaatcggggccggagagttcggggaagtatgtagcggtcacttgaaacttcctggcaaacgggagatctttgtggcaatcaagaccctcaaaagtgggtacacagaaaaacaaaggcgagactttttatctgaagcttcaatcatggggcagtttgatcaccctaacgtaatccacttggaaggagttgttaccaaatctacccctgttatgatcattacagagttcatggaaaatggctcattggatagttttttgcgccagaacgatggtcagttcaccgtcattcaattggtcgggatgctccgaggaattgcagcgggaatgaagtacctagccgacatgaattacgtgcatcgagatctggcagctcgcaatattctagtcaatagtaatcttgtgtgcaaggtgtctgattttggcctctcacgcttcctggaggacgacacctcagaccccacctacacatcggcgctgggaggaaagattcctattcggtggaccgctcctgaggccatacaatatagaaagtttaccagtgcctcagacgtctggtcttatggcattgttatgtgggaagtgatgagttatggagagcgcccatactgggacatgactaaccaagacgtaatcaacgcgatagagcaagactatcgcctgcccccacctatggactgtccctctgcccttcaccagttgatgcttgactgctggcagaaagatcgcaaccaccgccccaaatttggccagattgtgaacacactggacaagatgatcaggaatcctaactcattgaaagctatggcacctttgtccagtggaattaaccttccgttgttggaccgaacaatccccgactatacttccttcaatactgtggacgaatggttggaagccatcaaaatgggacagtataaagagtcattcgccaacgccgggttcacatcgttcgacgtcgtctcacaaatgatgatggaagatatattaagagtgggtgtcaccctcgctggacaccagaagaagatactgaacagtatccaggtgatgcgtgcccagatgaatcagatccagagtgtggagggccagcccctggcccgcagaccgagggctactgggcggactaagcgatgtcagccaagggatgtaaccaagaagacctgtaacagtaacgacgggaaaaaaaaagggatgggaaagaaaaaaacggatcccggacgagggcgagagattcagggaatcttttttaaagaagatagccacaaagaaagcaatgactgcagttgtggtggctag

SEQ ID NO: 14988 - DNA, 1449 bp, Artificial Sequence
  Description of Artificial Sequence: Synthetic coding sequence
atggcgctcagacgtcttggcgctgccctgctgctattacctctgctcgcagctgtggaggagaccttgatggactccaccacagctactgcagaactcgggtggatggtgcatcccccaagcggatgggaggaagtgtcagggtatgacgagaatatgaataccattcgaacgtaccaggtgtgcaacgtgttcgagagctcgcagaacaattggcttaggaccaagtttatcagaaggcgcggagcacaccgcattcatgtcgaaatgaaattttcagtgagagattgctcctccatcccatccgttcctggtagctgcaaagagacattcaacctctattactacgaggctgacttcgatagcgcaactaaaacattcccaaattggatggaaaacccctgggtaaaggtcgatacaatagctgccgatgagtctttctctcaggtagatcttggcggcagagtgatgaagattaatacagaggttcggagttttggccccgtatcccgctctggattttatttggcatttcaagattatggcgggtgcatgagcctgatcgcagttagagtattctatcgcaagtgccccagaatcatccagaacggcgcgatcttccaagagaccctcagcggggctgagtccacatccctggttgccgccagaggttcatgcatagcgaacgccgaggaagtcgacgtgcccatcaagctttattgtaacggggatggtgagtggctggtgccaattggacgctgcatgtgtaaagccggcttcgaagctgtggagaacgggaccgtttgccgaggttgtcccagcggtacatttaaagcgaatcagggagatgaggcctgcacccattgccccattaatagcaggaccacttctgaaggcgccacaaactgcgtgtgccggaatggatactatcgggctgacctggaccccttagacatgccctgtacaactattccctccgcaccacaggccgtcattagctctgtgaatgagactagcctgatgttggagtggacaccgcctcgcgactcagggggcagagaagacctagtgtacaatattatttgtaagtcatgcggctctggcagaggggcctgtacaagatgtggtgataacgtgcagtacgcaccacgacaactaggcctgaccgaaccacggatttatatctcggacctgctggctcatactcagtatacattcgagattcaggccgttaatggggttacagatcagtctccattcagcccccagttcgcctctgtcaacattaccacaaatcaggccgcccccagcgcagttagcatcatgcaccaggtgtccagaacagtcgactccattaccctcagctggagccaacctgaccagcctaacggagttatcctcgactatgagctgcagtattacgagaagatgaagactcagcggtcttag

SEQ ID NO: 14989 - DNA, 2964 bp, Artificial Sequence
  Description of Artificial Sequence: Synthetic coding sequence
atggagctgcgggtccttttgtgctgggcgtccctcgcggctgcactggaggagaccttgttgaacacaaagttagagacggccgatctgaagtgggtgactttcccacaagtggatggtcagtgggaggaattgtcagggctggacgaggaacagcatagcgttagaacctatgaggtgtgcgacgttcaacgcgcccccggacaggcccactggctcaggaccggatgggtgccaagacggggcgccgtgcacgtatacgctacccttagatttacaatgctagaatgtctttccttaccaagggcgggcagaagctgtaaggagacctttacagtcttctattacgagtctgacgctgataccgctaccgctctaacccctgcttggatggaaaacccttatatcaaggttgacaccgtagctgccgaacatttgaccaggaaacgccccggggccgaagctaccggcaaggttaatgtgaagaccttaagactgggtcccttgtccaaggctggattttacttggccttccaggatcagggtgcatgcatggcgctgctcagcctgcacctgttctataaaaaatgtgcacagcttacagtgaatctcactcgttttcccgaaactgtaccccgggagcttgttgtgccagttgccgggagctgcgtcgtggatgccgtcccggcacccggcccaagtccgtccctctattgcagagaagacgggcagtgggccgagcagcctgtgaccggatgcagctgcgcccccggattcgaggcagctgagggcaatacaaagtgtagggcttgcgcacagggcacctttaagcccctgtccggcgaaggaagctgtcagccgtgcccagctaattcccactccaacacaatagggtctgccgtgtgtcagtgccgagtgggttatttccgcgcccgcacagacccccgaggtgccccatgtacaactccccccagtgcaccgcggtcggtcgtctcaagactcaacgggagctctcttcatctggaatggtccgcccctttggaatctggaggtagggaagacctgacttatgccctccggtgtcgggaatgtcgacccggagggtcatgtgctccttgtggcggcgatcttacatttgatccaggcccaagagacctagtggagccatgggtggtggtcagaggccttaggcctgactttacatatacattcgaggtcacggccctcaacggggttagctcccttgctactggccctgtgcccttcgagccggttaacgtgacaacagatagagaggtccctccagccgtgtcagacattcgggtgactaggagttccccttcctcacttagtctcgcttgggcagtaccccgcgccccttctggcgccgtcttggattatgaagtgaagtaccatgagaagggcgcagaaggaccctcttcagtgcggttcctgaagactagtgaaaatagagcagagctgaggggattgaaacgtggcgcttcctacttagtccaagtgcgagcaagatcagaggcaggctacggaccattcggccaggaacaccattctcagacacagctggacgagtcggaaggctggcgcgagcaattagctcttatcgctggcaccgccgtagtgggggtcgtgcttgtgttagtagtcatcgtggtggcggtactgtgcctgaggaagcagtctaatgggcgcgaggcagaatactccgataagcatggacagtacctcatcgggcacggcaccaaagtgtacatcgatccttttacttacgaagatcccaacgaagcagtaagggaattcgccaaagaaatcgatgtctcatatgtgaagatcgaggaggttatcggagccggggagtttggagaagtatgtaggggacgactgaaggccccaggcaagaaggaatcttgcgtcgccataaagaccttgaagggtggatacactgaacggcaacgccgggagtttctgtctgaggcgtccattatgggccagtttgagcaccccaatatcatcaggctggaaggagttgtgaccaacagtatgccagtgatgatcctaacagaattcatggagaatggagcactcgatagtttcctgcgcctcaatgatgggcagttcactgtgatccagctggtgggaatgttacgaggcatcgcatcaggtatgagatacctggctgaaatgagctacgttcaccgcgatctagcagcccggaacattctggtgaatagcaatctggtgtgcaaggtgtcggatttcggcctctccaggttcctcgaagaaaatagcagcgaccctacttatacttcttcacttggtggtaagatccctattaggtggacagccccagaagcaattgcgttccgaaagttcacttccgcatcagacgcttggagctatggcatagtaatgtgggaggttatgagctttggcgaacgcccctattgggacatgagcaaccaggacgtgatcaatgcaattgagcaggactaccgtcttccaccaccccccgattgccccacatccctgcatcagcttatgctggactgctggcagaaggatcgaaacgctcggccacggtttccacaggtggttagtgccttagacaagatgattcgaaaccccgcctcattgaagattgtagccagagagaacgggggggcatctcatccgctgctggaccagagacagccccactattctgcatttggctccgttggcgaatggctcagagcgataaagatggggcgctacgaagagtcatttgctgctgccggattcggtagctttgagcttgtgagccagatcagcgcggaagaccttcttcggatcggcgtgactctggcagggcaccaaaagaagatcttagcttctgtgcaacatatgaaatcccaagccaaacccggtacaccgggtggtactggggggccggctcctcagtactag

SEQ ID NO: 14990 - DNA, 2808 bp, Artificial Sequence
  Description of Artificial Sequence: Synthetic coding sequence
atggaactgcgcgtgttgctttgctgggcttctctggccgcagccctggaagaaacactgctgaatactaagttggaaacagcagacctcaaatgggtgacgtttccccaggtggatggccaatgggaagagctatccggcctggatgaagagcaacactcagtcagaacttacgaggtgtgcgatgttcagcgtgctcctgggcaggctcattggctcaggaccggatgggtgccacgtcgtggagctgtacacgtttacgcgactctgaggttcactatgttagaatgtctctccctgcctcgcgctgggcggagctgcaaggagacttttaccgttttctactacgaatcagatgccgacacagccactgcactgacacccgcgtggatggaaaacccatatatcaaggttgacacagtggccgcagaacaccttacacgcaaacgtccgggcgctgaagcaactggcaaagtgaacgtgaaaaccctgagactgggtccactgagcaaagcaggattttacctggcattccaggatcaaggcgcctgcatggccctgctgtccctccaccttttctataaaaagtgtgctcaacttaccgtgaatctgactaggttcccagaaaccgtcccaagagagctcgtagtccctgtagctgggtcgtgtgtcgtggacgccgttcccgctccaggccccagcccatcactctactgtagggaggacggacaatgggccgagcagcccgtaacagggtgctcctgcgcgcccgggttcgaagcggccgaggggaacacgaagtgccgcgcttgcgcccaagggacgttcaaaccactgagcggcgaaggcagttgtcagccctgtcccgccaactcacactccaatactattggatcagccgtttgccaatgccgggtgggatacttccgggctcgcacagaccctagaggagcaccctgcactactcctcccagtgctcctagaagtgtggtgagccggttgaatggttctagcctccatttagaatggtccgctcccttggagtccggtggaagggaggacctgacctacgccttgcgctgccgcgagtgcaggcccgggggcagttgtgccccgtgtggtggggatctcacattcgacccgggccccagagatcttgttgagccttgggtcgttgtgcgagggcttaggccagacttcacctacactttcgaagtgacggctcttaatggagtgagtagcctagccaccggtccagtgccatttgagccagtcaacgtgaccaccgatcgggaagtgccaccagcagtctcagatatccgcgtgaccaggtcttccccatcttcgctgagccttgcttgggcagtcccgagagcccctagcggggctgtcctcgattacgaagtaaagtaccatgaaaaaggtgccgaaggaccttcaagcgttaggtttctcaaaacttctgaaaaccgagctgaattgagaggcttaaaacgcggcgcatcgtacctggtccaggtgagagcgcggagcgaagcaggttacgggcccttcggtcaggaacatcattcccagactcagttggacgaaagcgagggatggagagaacagttggcactgattgccggaacagccgtcgtgggggtggttctggtgttagtagttatcgttgtggctgtcctttgccttcgcaaacagtccaacgggagggaggctgaatattctgacaagcatgggcaatacctgatcgggcatgggacgaaggtgtacattgacccttttacttacgaagacccaaatgaagcagttagagagttcgcaaaggagatcgacgtgtcatacgtgaaaatcgaagaagtcattggtgcaggtgagtttggcgaggtgtgcaggggacgtttaaaggctccgggaaagaaagagtcctgtgtggccatcaagacactgaagggtggttacaccgaacggcagcggagggagttcctgtccgaagcatccattatgggtcagttcgagcatccaaacatcattcggctggagggagtggttactaactcaatgccagtaatgatcctgaccgaatttatggaaaatggcgcactggatagctttctccgcctcaacgacgggcaattcactgtgatccagttagtgggaatgttaagaggaatcgccagcgggatgcggtatctcgcagaaatgtcttacgtgcatcgggacttggcagcacgtaacatccttgtgaattctaatttagtttgcaaagtgtctgacttcggtctctcaaggtttctggaagagaattcgagtgatcccacgtacaccagctccctgggtggaaaaatacccatacggtggacggcacccgaagcgattgcctttaggaagtttacgtccgcgtcggatgcatggagctatggaattgtgatgtgggaggtcatgtccttcggcgaaagaccctattgggatatgtcgaaccaggatgtgattaacgcgatcgagcaggattaccgactgcctccaccacccgactgtcccaccagcctgcatcagttgatgctagattgctggcagaaagatagaaacgctagacctcggttcccacaagtggtgagcgccctggacaagatgatcagaaatccggcatcactaaagatcgttgcccgagagaatggcggtgatctgctccggataggagtgaccctcgctgggcaccagaaaaagattctggccagcgtgcagcacatgaaaagccaggccaagcctggcacccctggaggtactgggggacctgcacctcagtattag

SEQ ID NO: 14991 - DNA, 552 bp, Artificial Sequence
  Description of Artificial Sequence: Synthetic coding sequence
atggagttcctgtgggccccacttctgggactttgctgctccttggcagccgccgatcggcataccgtgttttggaattctagtaatcctaaattcagaaatgaggactatacaatccacgtccagctcaacgactatgtggatattatctgtccccattacgaggaccattccgtcgccgatgccgctatggaacaatatatactgtatcttgtggaacatgaagagtaccagctctgtcagcctcagagcaaagaccaagttcggtggcagtgcaatagacccagcgctaagcacggacccgagaagttgtccgaaaaatttcagagatttaccccttttacgttgggtaaagaatttaaagaggggcattcctattattacataagccattctccccaggcacacgacaaccctcaggagaagagactggccgctgatgaccccgaagtgcgcgtcctgcattcaatcggccactccgctgcccccagactttttccgttggcctggacggtgctgctgttgcctttgctgcttttgcagaccccctag

SEQ ID NO: 14992 - DNA, 618 bp, Artificial Sequence
  Description of Artificial Sequence: Synthetic coding sequence
atggagtttctgtgggccccacttctggggttatgttgctctttagcagccgccgacaggcatactgtcttttggaactccagcaatccaaagttcagaaacgaagactacaccattcacgttcagctgaatgattacgtggacataatctgtccacattacgaggaccattcagtagccgatgccgccatggaacagtacatcctctacttggtcgagcacgaagagtaccagctgtgccagccgcagagtaaggatcaggtgcgatggcagtgtaatcgccctagcgccaagcacgggcccgaaaagctctctgagaagtttcagaggtttacccccttcacccttggcaaggaattcaaggagggacacagctactattacatttccaagcccatacatcagcatgaagaccgttgtctgaggttgaaagttaccgtgtccgggaaaattacacattctcctcaggcacatgataacccccaggagaagcggctggcagccgatgaccccgaggtacgggtgctgcacagtatcggtcattcagctgctccacggctgtttccactggcatggaccgtcctgctcctccctttgttattactgcaaactccctag

SEQ ID NO: 14993 - DNA, 1002 bp, Artificial Sequence
  Description of Artificial Sequence: Synthetic coding sequence
atggctgtaaggcgagacagcgtttggaagtattgctggggcgtgcttatggtgctgtgtcgtactgccatcagcaagtcaattgtgcttgagccgatttattggaacagctctaacagtaagtttctgcctggccagggcctagtgctatatcctcaaatcggggacaagttagacattatctgcccgaaagttgattcaaagacagtaggacaatatgaatactataaggtgtatatggtagacaaggatcaagctgatagatgtacgatcaaaaaagagaacacacccctgcttaattgtgctaaaccagatcaagacattaagttcacgattaaatttcaggaattttcaccaaacctgtggggcctggagttccaaaagaataaagactactatatcatctcaacgtccaatggctccttggaggggctggataaccaggagggtggcgtatgccagacaagggccatgaagatattaatgaaggtcgggcaagacgctagctccgcagggtcaacaagaaataaggaccccaccagaagacccgaactggaggccggcactaacggacgctcctcaactacaagcccctttgtcaagccaaatcctggcagctctaccgacgggaattccgctgggcattctgggaataatatcctgggatctgaggtggcattatttgcgggaatcgcttctggctgcattatttttatcgtcatcatcattacccttgtagtgctgttgctgaagtatagaagaaggcaccgcaagcatagccctcagcacaccacaacactgtccctgagcactctggctactccaaagcggagcggtaataataacggatcagaaccatcggacatcattataccactgcgaacggccgatagtgtgttctgtcctcactatgagaaagtatccggggattatgggcaccccgtgtatatcgtgcaggaaatgccaccacaatcacccgctaacatctattacaaagtgtag

SEQ ID NO: 14994 - DNA, 3624 bp, Artificial Sequence
  Description of Artificial Sequence: Synthetic coding sequence
atgctgttaacccttattatcctcctgcccgtggtgtccaagttttcgtttgtgagtctgagtgctccccaacactggtcttgtcctgaggggactctcgccggtaatgggaattccacctgcgtgggcccagctccattcttgatcttttctcacgggaattcgatcttccggatagacaccgaaggcactaactacgagcagctggtggtggacgccggcgtatccgtcatcatggactttcactataacgaaaagaggatctactgggttgaccttgagaggcagctgctccagcgggtgttcctgaatggatctcgccaggagcgagtgtgcaacatcgagaagaatgtgtcggggatggccattaactggataaacgaggaagtcatatggagcaatcagcaggaaggaatcataacggttaccgacatgaaaggaaataacagccacattctgctgtcagccttgaagtaccccgccaacgtggccgtcgaccccgtggaacggtttatattctggtcgagtgaggtggctggcagcctgtaccgagcggacttggatggggtcggcgtcaaggcgttactcgaaacctcagagaaaattaccgccgtctccctggatgtgttggacaagcgattgttttggatccagtacaatcgagagggatctaatagtttaatctgttcatgcgattatgatggcggcagcgtccacatttcgaaacaccccacacagcacaacctatttgctatgtcactctttggcgatcgaatattttatagcacctggaaaatgaagactatatggattgctaacaaacacacagggaaagatatggtgcggatcaacctgcatagcagcttcgtcccattgggcgagcttaaggtcgtgcatcccctggcccagcccaaggcagaagatgatacgtgggaacctgagcagaagctctgtaagttgcgtaaagggaattgcagttctacagtgtgcggccaggatttgcagtcacatctttgcatgtgtgcggagggctatgctctaagtagggatcggaaatattgcgaagatgtgaacgaatgcgctttctggaaccacgggtgtacgctgggctgcaaaaacacaccaggtagctactactgtacatgtcccgttggctttgtcctgttaccagacggaaagcgctgccaccagttggttagttgcccacggaatgtcagtgagtgctctcacgactgcgtactcactagcgaaggtcctctctgcttttgtcctgagggaagcgtgcttgagcgagatgggaagacttgctcagggtgctcgtcccctgataacggaggatgctcccagctttgtgttcctctgagtccggtgagttgggaatgtgactgttttcctggctatgacttgcagttggacgagaaaagttgcgcagcttcaggtcctcagccattcttgctgttcgcgaattctcaggacattcgacatatgcatttcgacggtactgattacggcaccctgctatctcaacaaatgggcatggtctacgccctcgaccatgaccccgtcgaaaacaaaatctacttcgcacataccgcgttaaaatggattgaacgggctaatatggacggtagtcaaagggaaagattaattgaggagggagtcgacgtacctgagggtttggccgtggactggattgggcggcggttctattggacagaccgggggaagagtctaatcggccgatcagatctgaatgggaagcgctccaaaatcattactaaggagaatatctctcagccaagagggatcgctgtccaccctatggctaaacgcttgttctggacggacaccggtatcaaccctcgtattgagagtagctccttgcaggggctggggcggcttgtgattgctagctccgacctaatatggcccagcggaatcactattgactttctgactgataagttgtattggtgcgatgccaaacaatccgtaatcgagatggccaacctcgacggatcgaagagaaggagattgacccagaatgatgtgggccatccctttgccgtagctgtgtttgaagactatgtctggtttagcgattgggccatgccctccgtgatgcgggtcaataaacgcacagggaaggatcgagtgaggctgcagggaagcatgctgaagccctcttcgctcgtagtggtccatcccctcgccaaaccaggggctgacccttgtctgtatcagaacggaggttgtgagcatatttgcaagaagcgacttggcaccgcctggtgcagctgccgcgagggttttatgaaagccagcgatggcaaaacatgccttgctctcgacggacaccagttactggcggggggtgaagttgacctgaaaaaccaggttacaccgctcgacatcctgagcaagaccagggttagtgaggataatattaccgagtcccagcacatgctcgtcgctgaaatcatggtcagtgatcaggacgactgtgcccctgtgggctgctctatgtacgcccggtgcatctcggaaggagaggacgcgacgtgtcagtgtctgaaggggtttgccggagacggaaagttatgtagcgatatcgacgagtgtgaaatgggggtgccggtgtgtcccccagcctcatcaaagtgcatcaatacagaggggggatacgtgtgtagatgctccgaggggtaccaaggtgatggaattcactgtctcgacatcgatgagtgccaattgggcgagcactcttgcggcgagaatgctagttgcactaataccgaaggtggctacacctgcatgtgcgctggacgtctgtccgagcctgggctcatctgccctgattccactcctccacctcatctgcgggaagacgaccaccactattctgtgcggaatagcgactcagagtgccccttgagtcatgatggctattgtctgcacgacggcgtgtgcatgtacatcgaggcgctcgacaagtacgcctgcaactgtgttgttggatatatcggtgaacgttgtcagtaccgagacctgaaatggtgggaactgcgacacgccgggcatggacagcagcagaaggtgatcgtcgtcgcagtatgcgtcgtggtgcttgtgatgctgctgctgttaagcctctggggcgcacactactatagaacacaaaagctgctctctaaaaatcccaaaaatccttacgaagagagtagtcgtgatgtgaggtcgagaaggcccgccgacaccgaagacggaatgtccagctgtccacaaccttggttcgttgtaataaaggagcaccaggatctgaagaatggcggacagccggtagctggggaggatgggcaggctgcagatggatccatgcagcctacaagctggcggcaagaaccacagctttgtgggatggggaccgaacagggctgttggatccccgtgagctccgacaagggcagttgccctcaggtcatggagagatcattccatatgcccagttatggcactcaaaccttagaagggggggtggagaaaccccactctctcttgagtgccaacccactatggcaacagagggccttggatccaccccatcaaatggagctcacccaatag

SEQ ID NO: 14995 - DNA, 3501 bp, Artificial Sequence
  Description of Artificial Sequence: Synthetic coding sequence
atgctcttgacgctaatcatcctgttgcctgtggtgtcaaagtttagttttgtcagcctgtcagccccccaacattggagctgccccgagggaaccttagcgggtaatggcaatagcacgtgtgtagggcccgcaccctttctcatcttctcacacggtaattcaattttcaggatcgacaccgaagggaccaactacgaacagctagttgtggatgccggcgtcagcgtgattatggacttccactacaacgaaaagcggatatattgggtagatctggaacggcaactgctgcagcgggtttttctgaacggaagccgccaagagcgggtgtgcaacatcgaaaagaatgtatcaggtatggcaataaactggattaacgaggaagtgatttggagtaaccagcaggaaggcatcattacagtgaccgatatgaaaggaaacaacagccatatccttttatcagctttgaaatatcccgctaatgtggcagttgatccagtggaacgctttatcttctggagttcagaagtggccggcagtctctatagggcagatctcgacggggtgggtgtgaaagcactcctcgaaacctcagagaaaatcactgctgtgagtctggatgttctcgataagcggctgttctggatccagtataatagagagggttctaacagtcttatctgctcctgtgactacgacggcggatccgttcatatcagtaaacatccaacccaacacaacctattcgcgatgagcttgttcggtgacagaattttttacagtacctggaaaatgaaaacaatttggatagccaataaacacactggcaaagacatggtaagaatcaacctccatagttcttttgttcccctgggagaactcaaggtcgtccatcctctcgctcaaccaaaggccgaggacgacacgtgggaaccagaacagaaactgtgcaagctaaggaagggcaactgcagctccaccgtgtgcggccaagacctgcagtcacatttgtgcatgtgcgcagaaggctacgcgctgtctcgagatagaaagtattgcgaagacgtaaatgagtgcgccttttggaatcatgggtgcactctgggctgtaaaaatacccccggatcatattactgtacctgccctgtcggcttcgtgctcctgcctgacggaaaacgctgtcaccagttggtctcttgcccaaggaacgtgagtgaatgcagtcatgattgcgtgttgacatccgagggtcccctatgtttctgcccggagggatctgtccttgagagggacggcaaaacttgctctggttgctcttcgccagataatggcgggtgctcccaactgtgcgtccccctgagccctgtgagctgggaatgtgactgcttcccaggatacgatctccaacttgatgaaaagagctgtgcggcctccggtccacagccattcctcctgtttgcgaactcccaggatatccgacacatgcactttgatggaactgactatgggaccttgttatcccaacagatgggaatggtatacgctctagatcatgatcccgtggagaataagatatattttgctcatacggctctgaaatggattgagcgtgcgaacatggatggcagccaaagagagcgtctgatcgaagagggtgttgacgtccccgaaggcttggccgtggattggattggcaggagattctactggacagatcgaggaaaatccttaataggaagaagcgacctgaatggaaagcgatctaaaatcattaccaaagagaacatcagtcaaccacggggaatcgcagtccatcccatggccaaacgacttttttggaccgatacgggcatcaacccacgcattgagtcctcatctcttcagggactcggtcgcctcgtcattgcttcctcagatctcatctggcccagcgggattacaatcgatttcctgacggataagctgtattggtgtgacgccaagcagtcagtaatcgagatggctaacttggacggatctaaacgcagacgcctgacacagaacgacgtgggccacccattcgccgttgcagtgttcgaagactacgtttggttttccgattgggccatgccctccgttatgagagtgaacaaaagaacggggaaggatagagtgcgccttcagggcagtatgttaaaaccaagttcactcgtggtggtccatcccttggccaagcctggagccgatccctgtctgtatcagaatggcggctgcgagcacatttgcaaaaaaagattgggaaccgcctggtgctcatgtagagaaggttttatgaaggcatccgacggcaaaacgtgcttggccctggacggtcaccagcttctggcaggaggggaagttgaccttaaaaaccaggtgaccccgttggacatcctttctaagacaagggtctccgaggacaatattactgaaagccagcacatgctggtggcagaaattatggtctccgaccaggatgactgcgcaccagtgggatgttctatgtacgcccgctgcatatcagaaggcgaagacgccacatgtcagtgcctgaaaggattcgcaggagacggcaagctatgctcagacatagacgagtgtgagatgggagtacctgtgtgcccaccggcttctagcaagtgcattaataccgaaggcggctacgtgtgtcgctgttccgaagggtatcagggagatgggatccactgtctcgatagcacacctccgcctcatctacgagaggatgatcatcactactccgtcagaaactcagattctgaatgtcctctgagccatgacggatactgtctccatgacggagtatgtatgtatatcgaagccctagacaaatatgcttgcaattgtgttgtcgggtatatcggcgagcgctgccaatatagagatctcaagtggtgggagctccgtcacgcgggccatggacaacagcagaaggtcattgtggtggccgtttgtgtggtagtcttggtgatgttacttctgctctcactgtggggtgctcattattaccggacacagaagctactaagtaagaacccaaagaacccctacgaagagagctctcgcgacgttaggagccgaaggcccgccgatacagaggatggcatgtcttcttgtccgcagccatggttcgtggtgataaaggagcaccaggacctcaagaatggtggtcagcctgtagctggggaggacggtcaggccgctgatggaagtatgcagcccacgagctggagacaggagccacagctctgcggcatgggcaccgaacagggctgctggattccagtgagctctgataaggggagctgcccccaggtgatggagaggagttttcacatgcctagttacgggacccaaacgctggagggcggagtggaaaagccccactcactgctgtccgccaatccactgtggcaacaaagggccctggatcctcctcatcagatggaattgacacagtag

SEQ ID NO: 14996 - DNA, 3498 bp, Artificial Sequence
  Description of Artificial Sequence: Synthetic coding sequence
atgctgctgacattaatcattctgttacctgtggtctccaagtttagttttgtgagcctgtctgccccccagcactggagctgtcccgaaggcaccctcgctgggaatggcaactcgacctgcgtcggccctgcaccttttttgatatttagccatggtaattctatttttcgcattgacaccgagggcaccaattacgaacagcttgttgtggatgcgggagtttccgtgatcatggattttcattacaatgaaaagagaatttactgggtagacctggagcggcagctcctgcagagggttttcctcaatggttcaaggcaggagcgcgtgtgcaacatcgaaaagaacgtgagtgggatggcaattaattggattaacgaggaggtgatatggtcaaatcagcaggagggaatcattaccgtcacagacatgaagggaaacaatagtcacatcctgctgagtgctctgaagtatcccgccaatgttgccgtagatcccgtggaaagatttattttctggtcgagtgaagtcgccggatccctgtaccgggccgaccttgatggggtgggggtgaaagctctgctggagaccagcgagaaaatcacagccgtttcactggatgtcctcgacaagaggctgttttggatccaatataatcgggagggcagcaactcgttaatttgctcctgtgactacgatgggggctccgtgcacatcagcaagcaccctacccaacataatctgttcgctatgagcctgtttggggatcgaatcttttactccacttggaaaatgaagacaatttggatagcaaataaacacaccgggaaagatatggtgcgcattaatctgcattcttcctttgtgcctctgggagagctcaaggtggtgcaccctcttgcacaaccgaaagctgaggatgatacctgggaacctgacgtgaatgaatgtgcattttggaaccatggatgcaccctgggctgtaaaaacaccccaggctcctattattgtacatgcccagtgggattcgtgcttctgcccgatggcaaaagatgccaccagttggtgagctgcccccggaacgtatcggagtgttcccacgactgcgtgctaacctccgaaggtccactgtgtttttgccccgagggtagcgtcctggagagagacggcaagacctgctccggatgctcaagtcccgataacggggggtgtagtcagctgtgcgtgccactcagccccgtgtcttgggagtgcgactgtttccccggctacgacctgcagttagatgaaaaatcctgcgctgctagcggcccccaaccgttccttctgttcgctaacagccaagacattaggcacatgcacttcgatggcaccgactacggcacactgctcagccaacagatggggatggtatacgctctggatcatgatccagtcgagaacaaaatttacttcgcccataccgcccttaaatggatagagcgggcaaacatggacgggtcacaacgggagcggctcatagaggagggtgtcgacgtcccagaaggcctggccgttgactggatagggagaaggttctactggacggatagaggcaagtctcttattggccgttctgatctgaatgggaaacgttcaaagatcattactaaagaaaatatatcccagccacggggaattgcagtgcatcctatggctaagcgactgttttggacagatacagggatcaatccccggatcgagtccagcagcctccagggtctggggcggctcgtgattgctagcagcgatttaatatggccttctggcataaccatcgactttttaaccgataagttatattggtgcgacgctaaacagagtgttattgaaatggcgaaccttgacgggtctaagcgacgccggcttacccagaacgatgttggccacccatttgccgttgccgtgttcgaggattacgtgtggttctctgactgggcgatgcccagcgtcatgcgcgttaacaagcggacgggaaaggatcgggtacggctgcagggaagcatgctgaaaccttccagcttggtcgttgtgcatcccttggccaagcctggcgctgatccctgcctttatcagaacggcggttgcgaacatatttgcaagaagcggctgggcactgcatggtgctcctgccgagagggcttcatgaaggcaagcgatggcaaaacctgcttggccttggatggccaccaactcttggctggaggggaggtggatctgaagaatcaggtcactcccctagacatcctgagtaagacccgggtgtccgaggacaacatcacagagagccagcacatgctggttgccgagatcatggtctccgatcaggatgattgcgctcctgtgggctgttcgatgtatgccagatgtatcagcgaaggcgaggacgccacctgtcagtgcttgaaagggtttgcaggagacggtaaactgtgttcggatattgatgagtgcgagatgggggtgcctgtgtgtccacctgcctctagtaaatgtatcaacactgaaggaggatatgtgtgtcgatgttccgaaggctaccagggagacggtattcactgcctagacattgatgagtgtcagttaggggagcattcttgcggcgagaatgcttcttgcacaaacacggaggggggttatacttgtatgtgcgccggcaggctgagcgagcctggactaatttgccctgacagtacccctccaccgcatctacgcgaagatgaccaccattacagcgtccggaactctgacagtgagtgccccctatcacatgatggttattgcttacatgacggagtatgtatgtacattgaagcccttgacaaatacgcttgcaactgtgtggtcggctatattggagaacgctgccagtaccgggatcttaaatggtgggagctacgacacgcaggtcacggtcagcaacagaaggtaattgtcgtcgcggtgtgcgtggtcgttttggtaatgctgcttctgttgtcactatggggcgcacattactatcggacccagaagctactctcaaagaatcccaaaaacccctacgaggaatcctcaagagatgtgaggtccaggaggcccgcagataccgaagatggcatgtcaagctgcccccagccttggttcgtagtgattaaagaacaccaggaccttaagaatggcggccagcctgtggccggtgaagatggacaggccgctgatggatccatgcagcccacaagttggcgccaagagccacagctgtgtgggatgggtactgaacagggctgttggatacccgtgagttctgacaagggctcttgcccacaagtgatggagcgctcatttcatatgccttcctatggtactcagacactggaggggggcgtcgagaagcctcattccctgcttagtgccaacccactttggcagcagagagctttagatccccctcaccagatggagctgacccagtag

SEQ ID NO: 14997 - DNA, 3633 bp, Artificial Sequence
  Description of Artificial Sequence: Synthetic coding sequence
atgcgcccaagtggaacagctggcgccgcccttctggcattgctagctgctttgtgccctgcctccagagccctggaggaaaagaaggtgtgccagggcacatccaataaattgacacagctcgggactttcgaagaccatttcttgtcactgcagcgcatgtttaataattgcgaggttgtgctgggaaacctggagatcacctacgtgcagagaaattatgacctgagcttcctcaaaactatacaagaagttgccggatatgtgctgattgccttgaacacagttgagcgtattcccctggagaatctgcagatcatacggggcaacatgtattacgagaatagctatgcgctggcggtgctatccaactatgatgctaataaaacaggactaaaggagctgccgatgcgcaacctgcaggagattctgcacggtgctgtgagatttagcaacaacccagccctttgtaatgtggaaagtattcagtggcgtgatattgtgagctctgattttttatctaatatgtctatggatttccagaatcatctaggcagctgccagaaatgcgacccgtcttgccccaacggtagctgttggggagccggagaagagaattgccagaaattgaccaagattatatgcgcccaacagtgctcagggaggtgccgtggcaaatccccttccgactgctgtcacaaccagtgcgctgccgggtgtacaggcccaagggaatccgattgcctagtatgtcgcaagttcagggacgaagctacttgtaaggatacatgccccccactgatgctgtataatccaaccacctaccagatggacgtgaatcctgaggggaagtactcattcggcgccacctgcgtgaaaaagtgcccaaggaattatgtggtgacggaccatgggtcgtgtgtgcgagcctgcggggccgacagttatgagatggaagaggatggcgtgagaaagtgtaagaagtgtgaggggccctgccgaaaagtatgcaatggcatcgggattggcgagtttaaagactctctgtctatcaacgcaacaaatattaaacacttcaagaactgtacatctatttctggagacctgcacattctgccagtcgccttcagaggcgactcttttacccatacaccgcccttggatccgcaggagttagacatcctcaaaactgtcaaagagatcaccggattcctgctaatccaggcctggcccgagaaccgaactgatctgcacgcttttgagaatttggagattattagaggcagaacaaaacaacatgggcagttcagtctggccgtcgtgagtctcaacatcactagcctcggcctgagatctttgaaagaaatctccgatggggacgtgatcatttctggcaacaaaaatctgtgttatgccaacaccatcaactggaaaaagctgtttggcaccagcggtcagaaaaccaagatcatatcaaatcggggcgagaactcctgcaaagctactggacaggtgtgccacgccctgtgctcaccagaaggatgttgggggcccgaaccacgggactgtgtgtcttgtcggaacgtctccaggggccgggagtgtgtcgataagtgcaatctgctggagggcgaacctcgggagttcgtggagaacagcgagtgtatccagtgtcaccccgagtgtctgcctcaggccatgaacatcacctgtacagggagaggacctgataattgcatccaatgtgctcattacatagatggtccacactgcgtaaaaacctgccctgccggcgtgatgggagagaataacactctggtatggaagtatgcggacgccggacatgtgtgccatctttgccatccaaattgcacctacggttgcacaggcccaggactcgaaggctgtcctacaaatggcccaaagatcccttctattgccactggcatggtgggcgcactgttactcctcctggttgtggctttggggattgggctgttcatgcgccggcgccatatcgttcggaaacggactctgcggcgtctcctgcaagaaagagagttagtggagccccttacccctagtggggaggcgccaaatcaggccctcctgcgcatcctgaaagagaccgagtttaaaaagatcaaagtactcggcagtggtgctttcggcaccgtttacaaggggctatggatccctgaaggagagaaagtcaaaatacccgtcgccatcaaagaactgcgcgaggcaacctctcccaaggcgaacaaagaaattttggacgaggcgtacgtcatggcctcagtcgacaatccccacgtctgtaggcttctaggaatctgcctcacttcgacagttcagctcatcactcagctgatgccctttgggtgcctcctcgactatgtgcgcgagcacaaggacaatatcgggtcacagtacttgctgaattggtgcgtgcaaatcgccaagggaatgaactacctggaggaccggcgcctagttcaccgcgatcttgcagcccggaacgtgcttgtgaagacaccccagcatgttaagatcacagatttcggcctggccaagctgctgggagcagaagaaaaagaataccatgctgaagggggaaaagtgcccataaagtggatggctctggagtctattctgcacaggatctacacccaccagagcgatgtctggagctatggtgtcaccgtttgggagctgatgactttcgggtccaaaccttatgacgggattccagcctcagagatcagctcgatattagagaaaggagagagactcccccagcctccaatctgcaccatcgacgtgtatatgattatggtcaagtgttggatgatcgacgccgactctcggccaaagtttagggagttgatcatcgaattttccaaaatggctcgggacccgcaaaggtacctggtcattcagggggacgagcggatgcacctgccatcaccaactgacagtaatttttatcgagcactgatggacgaggaggatatggacgacgttgtcgacgccgatgagtacctgattccacaacagggatttttcagctcaccatcaacaagtaggacaccattgttgtcatccctctctgcaacatccaataatagtaccgtggcgtgtatagatcgaaatggccttcaatcctgccctattaaggaggattctttcctgcaacgatattccagtgacccaaccggagcactgacggaggactctatcgatgacacctttctgcccgtacccgagtacatcaatcagtcggtgccgaagcggcccgccggcagcgttcagaaccccgtgtatcacaaccagccactgaatcctgccccttccagggatccacactaccaggacccgcattctacagctgttggaaaccccgaatatttaaacaccgttcaacccacctgcgtaaattccacatttgacagccctgctcactgggcccaaaagggctcacaccagatctccctggataacccagattaccaacaggatttcttccccaaggaggccaaacccaacggcatattcaagggatcgaccgccgagaacgctgaatatctgagggttgccccccagtcttctgagtttattggagcgtag

SEQ ID NO: 14998 - DNA, 1887 bp, Artificial Sequence
  Description of Artificial Sequence: Synthetic coding sequence
atgcgcccttccgggaccgcaggcgctgctctgctcgccctgttggcagcgctgtgcccggcctctagggctttggaagagaaaaaagtgtgccagggaacatctaataagctcacgcaacttggtaccttcgaggatcattttctatccctgcaaaggatgttcaacaactgcgaagttgtgctcggaaatctcgagatcacttacgttcagagaaattatgacctcagcttcttaaaaaccattcaggaggtggcgggctatgtcctgattgctctaaatacggtcgagcgcattcccctggagaatctacagatcatcagaggaaacatgtattacgaaaactcgtacgcgctggcggttctctccaactacgatgccaacaaaactggcctgaaggagcttccaatgcgcaatctgcaggaaatactccacggggctgtgaggttctcaaataatccagccctgtgtaatgtcgaatccatccagtggcgggatattgtatctagcgattttctgtccaacatgtctatggactttcaaaaccacctcggcagctgccagaagtgcgatccatcatgcccaaacggaagctgttggggcgccggtgaagagaattgtcagaagctgaccaaaatcatctgtgcccaacagtgctccggaaggtgtcggggaaaatcaccctccgactgctgtcacaaccagtgtgccgctggctgcacgggcccccgggagagtgattgcctagtatgccgtaagtttcgagacgaagctacttgtaaggatacatgcccacccttaatgttatacaacccgacaacctaccagatggatgtgaacccggaaggtaagtatagtttcggcgcaacttgcgttaaaaaatgcccgcgtaactatgtagtaaccgaccacggaagctgcgtgagagcttgtggagcagattcgtatgaaatggaggaggacggggtgcgcaagtgcaagaaatgcgaaggtccgtgcaggaaggtttgcaatggcatcggaattggcgaattcaaggattcactctcgataaacgcaactaacatcaagcactttaaaaattgtacttcgatcagcggcgacctccacattcttcccgttgccttcagaggggatagcttcacccacactccaccgttggatccgcaggaattagatatcctgaagactgtgaaggagattactggctttcttctgatccaggcctggcccgagaaccgaaccgaccttcatgccttcgagaatcttgagattattcgagggagaacaaagcagcacggacagttctccctcgccgtggtgtcactgaacattaccagtctggggctgcgatctctcaaggaaatctcagacggggatgtgataatctctggcaacaaaaatctgtgctacgctaataccataaactggaaaaagctgttcggcacctctggccagaagaccaaaatcatctcaaataggggcgagaactcttgtaaggcaacaggccaggtctgtcacgctctctgcagccctgagggttgttggggcccagaaccccgggactgcgttagttgccgcaacgtgtcaagaggcagggagtgcgttgacaagtgtaacctgctggagggtgagccccgggaattcgttgagaattcagaatgcatccagtgccatcctgaatgcctccctcaagcgatgaatatcacttgtacaggcagaggtcccgacaattgcatccaatgcgcccactatatcgatggcccccattgcgtgaagacttgccccgccggggtcatgggggagaataacaccctggtctggaagtatgcagacgccggacacgtgtgtcacctctgccatccaaactgcacctatggatcgtag

SEQ ID NO: 14999 - DNA, 2118 bp, Artificial Sequence
  Description of Artificial Sequence: Synthetic coding sequence
atgcggccgtccggaactgctggcgcggctttacttgctctcctggcggccctgtgccccgcgtctcgcgccctggaggaaaagaaagtatgccaaggcacctccaacaaactcacacagctggggacgtttgaagatcatttcctgtcactgcaaagaatgttcaataactgtgaagtagtgctgggtaatctggagatcacctatgtgcaaagaaattacgacctttcctttttaaagaccatccaggaggtggcaggatatgtattgatcgctctgaatacagtggagcgaataccactggaaaaccttcagataattagggggaatatgtactacgagaactcttatgcactggccgtgctttcgaactacgacgccaacaaaactggactcaaggagctcccaatgaggaacttgcaagaaattctgcacggggccgtcaggtttagcaacaatccggccttgtgtaatgtagagtcaattcagtggcgcgacatcgtcagttctgacttcctctctaacatgtctatggattttcagaaccatctcggatcatgccagaagtgtgatccaagttgtcccaatggtagctgctggggagctggggaagagaattgtcaaaagctcactaagattatctgcgctcagcaatgttccggtaggtgtagaggcaagtccccaagcgactgttgccacaaccagtgcgccgcaggctgcaccggaccaagggagtctgattgcctcgtctgtagaaagttccgagatgaggctacctgcaaggacacatgcccaccactcatgctttacaatccaacaacataccagatggacgtcaatccggagggaaagtattcctttggcgccacatgcgtgaagaaatgtccccggaactatgtggtgacagatcatggatcttgtgtgcgggcctgtggagctgacagttacgagatggaagaggacggtgtccgcaaatgtaagaagtgtgagggtccctgtcgcaaggtttgtaatggcattggcatcggggagtttaaggattccctctcgatcaacgcaaccaacataaagcatttcaagaattgcacttcgatttcaggggatcttcatatcttacccgtggcattcagaggagattccttcacacacacccccccgctcgaccctcaggagttagacatcctcaaaacggtgaaggaaattactggctttctgctcattcaggcctggcccgagaacagaaccgatcttcatgcctttgaaaatctggagattatacgcggtaggactaagcaacacggccagttcagccttgcggttgtctccctgaacatcacatctctgggtctgaggagcctgaaagagattagtgacggtgacgtgattatcagcggtaataagaacctctgctacgccaacacgataaattggaaaaaattattcggtacctcggggcagaaaacaaaaatcatctccaaccggggtgagaattcctgcaaagctacaggacaagtgtgccacgccctatgcagccccgaaggatgttggggcccagagccacgtgattgtgtttcttgtcgcaacgtatctcgcgggcgtgagtgtgtagacaaatgcaaccttctggaaggagaacctagggagtttgttgagaattcagagtgcatccagtgccatcctgagtgtcttcctcaagccatgaatatcacttgcacggggcggggcccagataattgtatccagtgtgctcactatattgacgggccccattgcgtaaaaacatgtcccgcgggcgtcatgggtgaaaacaatacattggtttggaaatacgctgatgctggccacgtatgccacctgtgtcatccaaactgcacctacgggcccgggaatgaatctttaaaggctatgctcttctgtctgtttaagctgtctagctgcaaccagtcaaacgacggctccgttagtcaccagtctggctctcccgccgcccaagagtcttgcctcggctggataccttcacttctgccctccgagttccaactcggatggggtggttgttctcatctgcatgcatggcccagcgcttcagtaataattacggcctcaagctgtcactag

SEQ ID NO: 15000 - DNA, 3243 bp, Artificial Sequence
  Description of Artificial Sequence: Synthetic coding sequence
aaccgcaccgagggagcagcccatgaaaagtttacgggtaaccccgcctggcggcgcgctgtacagcaacaaccgtgtccggttgtggagtctattcaatggagggatatagtttcaagcgattttctgagcaacatgtccatggattttcaaaaccacctaggatcttgccagaagtgtgatccatcctgccccaatggaagttgctggggcgcgggagaagaaaactgccagaagctcaccaagattatttgtgcccagcagtgtagtgggcgatgtcggggaaaatctcccagtgattgctgtcacaaccagtgcgccgcaggctgtactggccctcgtgaatctgattgtctggtttgccggaagtttagggatgaagccacttgtaaggacacctgccctccactgatgctgtataacccaactacgtatcagatggacgttaatcctgaggggaagtactctttcggtgccacatgtgtgaagaagtgccctcgcaactacgtagtcacggaccatggaagctgcgtccgggcctgcggagccgattcctatgaaatggaggaggacggggtccgaaaatgtaaaaagtgcgaagggccctgtcggaaggtttgtaatggaattgggattggagagttcaaggattcactgtcaatcaatgccacaaacattaaacattttaaaaactgcacctcaatttccggggatctgcatatcctccctgttgcatttaggggcgatagctttacccacacgccacctttggacccacaggagctggacatccttaagacagtcaaagagattacgggatttctcttaatccaagcctggcctgagaaccgtacggacctgcatgctttcgaaaacctggagataatcagaggtcggacaaaacagcacggccagttctctttggccgtagtgtctctgaatattacatctctcggtttgagaagcctgaaggaaatctcagatggagacgttattatatcaggaaataagaacctgtgctacgctaataccatcaactggaagaagttgttcggcacgtcaggacagaagactaaaatcatatctaaccgtggcgagaattcctgtaaggccaccggacaggtatgtcacgcactgtgtagcccggagggctgctgggggcctgaacccagagactgcgtttcttgtcggaacgtttcgagaggacgcgagtgtgtggacaaatgtaacctccttgaaggggagccccgggagttcgttgaaaatagcgagtgtatccagtgtcaccccgaatgtctgccgcaggctatgaatattacctgcaccggacgcggaccagataattgtatccagtgtgcacactatattgatggaccccactgtgtcaagacgtgccctgccggcgtgatgggagagaacaacacactcgtctggaagtatgctgacgccggacacgtgtgtcatctgtgccatccaaactgcacatatggttgcaccggtccagggctagaggggtgccccacaaatggtcctaaaattcccagcatagctactggaatggtgggcgccctgctgctgttgctggtggtggccctcggaatcggcctgttcatgcgccgtagacacattgtccgcaaaagaacactgagaagactgcttcaggagagggaactggttgaacccttgactccatctggggaggcaccgaatcaagctttgctccgaatccttaaagaaacagaattcaagaaaattaaggtcctcggttctggcgcattcggcaccgtctacaagggactgtggataccagagggagaaaaggttaagattcctgtggccataaaggagctgagagaggcaacctcacctaaggcaaacaaggagatcctagacgaggcttacgtgatggcgtcagtcgacaatcctcacgtctgccgattgttaggcatttgcctgacttccacagtccagctgattacgcaactcatgccatttgggtgtctgttggattatgtgcgggaacacaaagacaacataggttcacaatacctcctgaattggtgcgtgcagattgctaagggaatgaactacctcgaagataggcgtttggtgcacagggaccttgcagcgaggaatgtgctggtgaagaccccacagcacgttaagatcaccgacttcggtctggcaaagttgctgggcgctgaagagaaagaataccacgccgaagggggtaaggtgcctataaagtggatggccctcgagagcatccttcatcgaatatatactcatcagagtgatgtctggagctatggagtgacagtctgggagctcatgacctttgggtcgaaaccttacgacggtatccccgcaagcgagatctcctccatactggaaaagggcgaacggctaccacagccccctatatgtactatcgacgtttatatgattatggttaaatgctggatgatcgatgcagattcacgccccaaatttcgggagctaatcatcgagtttagcaaaatggctagggatcctcaaagatacctggttatccagggtgacgagagaatgcacctccccagcccaaccgattcgaacttctaccgagcgctgatggatgaagaagatatggatgatgttgtagatgcagatgagtatctcatcccacagcagggctttttttcgtcaccatccaccagtaggactcccctcctgtcttcgctatccgccacgtcaaataatagtactgtggcctgtatcgacaggaatggactgcagtcctgtccaattaaggaggactccttcctgcagagatactccagtgatcccacgggagccctcactgaggactcaatagacgatacatttcttccagtcccagaatatatcaatcagtccgtgcccaagcgtcccgccggttcagtgcagaatccagtctatcacaaccagcctctgaatccggcaccttctagagatccacactaccaggatccacacagcaccgctgtgggaaatccggagtacctgaacacagtgcagcccacctgcgtgaattcaacatttgatagtccggcccattgggcccagaagggcagccaccaaatttcacttgataatccagactaccaacaggatttcttccctaaggaggccaagccaaatggtatattcaaggggtctactgccgaaaacgcggagtacctacgcgttgctcctcagagcagtgagtttataggagcttag

SEQ ID NO: 15001 - DNA, 1218 bp, Artificial Sequence
  Description of Artificial Sequence: Synthetic coding sequence
atgcggccgtcaggaacagcaggcgcagctctgctggctcttctggcggccctgtgccctgctagcagagctctcgaggagaagaaggtgtgtcaaggaacctcaaacaagctgacgcagcttgggactttcgaggaccatttcttgtctttgcaacggatgttcaataactgtgaggttgtgctgggaaaccttgagattacttatgtccagcgcaactacgatctctcttttctgaagaccatacaggaggtggcaggatatgtgctgattgccttgaatacggtggagcggatccccctcgagaacctgcagatcattaggggaaatatgtactatgagaactcatacgccctcgccgtattatcaaactatgatgccaataagaccggtttgaaagagcttcctatgcggaatctgcaagagattttgcacggggccgtcaggttttccaataatcctgccctttgcaacgttgagagcatccagtggcgggatatagttagctctgattttctttcaaatatgagcatggacttccagaatcacctcgggtcttgtcagaagtgcgaccccagctgtcctaatggatcttgctggggagctggagaggaaaactgccagaagctgacaaagatcatctgcgctcagcagtgtagtggtcgatgtcgcggaaaatcgccttccgactgttgtcacaatcagtgtgctgcagggtgtacgggcccccgcgaaagcgattgtttagtgtgtagaaagttccgggacgaggccacgtgtaaagatacatgtccacctctcatgctgtacaacccaacaacataccagatggatgtcaatcctgagggtaaatatagcttcggagccacatgtgttaagaagtgccctaggaattacgtggtgactgaccacggcagctgcgtgagggcatgtggtgcagactcatatgaaatggaggaggacggagtacgtaaatgcaaaaaatgtgagggcccctgcaggaaagtgtgtaacggaatcggaattggagaatttaaggattccctctccatcaacgctacaaacatcaagcacttcaagaactgcacctcaatctccggcgatttacatattctacctgtggcctttaggggggattcttttacgcacacccccccgctggaccctcaggagctcgatatactgaaaaccgtgaaagagattacaggactcagttag

SEQ ID NO: 15002 - DNA, 1974 bp, Artificial Sequence
  Description of Artificial Sequence: Synthetic coding sequence
atgcgtccatccggtactgcgggagcagcactcttagcgttgctggcagcactgtgccccgctagcagagctctggaggaaaaaaaggtctgccagggcactagtaataaactgacgcagctgggtactttcgaggaccacttcctcagcttgcagcgcatgttcaacaattgtgaagtcgtgctgggcaacctggaaatcacctacgtccagaggaattatgacctgtcatttttgaaaacaatacaagaagtcgccggttatgtgctgatcgctttgaacacggtggagaggattccattggagaatcttcaaattattcggggcaacatgtactatgagaattcctacgcactggccgtgctgagcaactacgacgccaacaagactgggctgaaggagctacccatgcgtaatcttcaggaaatactccatggagcagtcaggttctccaacaaccctgccttgtgtaacgtggagtcaatccaatggcgggatatcgtgagttcagacttcttgtctaatatgtcaatggatttccagaaccacctgggatcctgccagaagtgcgacccttcctgtcctaacggttcttgctggggggcgggcgaggagaactgccagaagctcactaaaattatatgcgcgcaacagtgttccggaagatgccgcggcaagtcccctagcgactgttgccataatcaatgtgcagcaggctgtacgggaccgcgggaaagcgactgtcttgtgtgccgtaagtttagagacgaagccacatgcaaagatacatgcccccccctgatgctgtacaatccaacgacataccaaatggacgttaatccagagggcaagtactctttcggagcaacctgcgtcaagaagtgcccgcgcaactacgttgttacagaccacgggtcgtgcgtccgggcctgcggagctgatagttacgaaatggaggaagatggagtgagaaagtgcaagaaatgtgagggcccatgtcggaaagtgtgcaacggtatcggcattggagagttcaaagattccctgtccatcaatgctactaacattaaacacttcaagaactgcacctcgatttccggagaccttcatatcctcccagtggccttccggggcgactcctttacacacacccctccattggatccacaagagttggacatcttgaagactgtgaaggagatcacgggtttcctcctgattcaggcctggcctgagaatcggacagatctgcacgcgtttgagaatttggagatcatcagaggacgcacaaagcagcatggccagtttagccttgccgttgttagtctcaatattacatccctggggcttcggtccctgaaagagatttccgacggagacgtgatcatcagcggcaacaagaacctgtgctacgctaacacaataaactggaagaagctctttggcacctccggccaaaaaacaaagataatctccaacaggggagaaaattcttgcaaggccaccggacaagtctgccatgctttatgttccccagaagggtgttgggggcccgaaccaagggactgtgtgtcctgtcgaaatgtgtcaaggggcagagagtgtgtcgataaatgcaatctgcttgagggcgagccacgcgagtttgtggaaaatagcgaatgcatccagtgtcatccagagtgccttccacaagccatgaatattacgtgcacaggcagaggtccggacaactgcatccagtgcgcccactatatagacggtccacattgcgtcaaaacctgtcccgccggagttatgggcgagaacaacacacttgtgtggaagtatgccgacgccgggcatgtgtgtcatctttgtcatcctaactgcacctatggatgtactgggcccgggctggaaggatgccccactaacggctcttacattgtaagtcactttccgcgcagcttctacaagatgtccgtccactag

SEQ ID NO: 15003 - DNA, 3474 bp, Artificial Sequence
  Description of Artificial Sequence: Synthetic coding sequence
atgtttaataattgcgaggtggtcctgggaaatttggaaattacctatgtgcagagaaattacgatctctcattcctaaagaccattcaagaagtagccgggtatgtgctcatagctctgaacaccgtggaaaggattccgcttgaaaacttacagatcattcgtggaaatatgtattatgaaaattcttacgctttagccgttttgtctaattacgatgcaaataaaactgggcttaaagaattgccgatgcgcaacttgcaagaaatattacatggagctgtaagatttagtaacaatcccgccctctgtaatgtcgaaagcatccagtggagggacatagtttcctcagactttctgtctaacatgagtatggattttcagaaccacctcggctcctgtcagaagtgtgatcctagctgccctaatggctcatgttggggagctggcgaagagaattgccagaagcttacaaagatcatctgtgcacagcagtgctccggccggtgccggggtaaaagtccctccgattgctgtcataaccagtgcgccgctggatgcaccggcccacgggagagtgattgccttgtgtgtcggaaatttagggacgaagccacctgtaaggatacctgtcctccactgatgctttataaccccacaacttatcagatggacgtgaatcccgaaggtaagtatagctttggtgccacttgcgtgaagaagtgcccccggaactacgtggtgaccgaccacgggtcttgtgtgcgggcttgtggagctgacagctatgaaatggaagaggacggcgtacgcaaatgtaagaagtgcgaaggcccgtgtcgcaaggtgtgcaatggtatcggaattggcgagttcaaagattcactcagcataaatgcaacaaatatcaagcacttcaagaactgtacgtcaatttcaggcgaccttcatattctccccgtggcttttaggggggatagcttcacccacactcccccgctggaccctcaggaactcgatatcctgaagacagtgaaagagatcacagggtttttactgatccaggcttggcctgagaatcgaactgatctacatgcgtttgaaaacctcgaaatcatcaggggcagaacaaagcagcatggccagttcagccttgccgtggtctcactgaacatcacaagcctggggctccgcagcctaaaggaaatctccgacggcgacgtcattatctcgggcaataaaaatttatgctatgccaacacaattaactggaagaaactttttgggacaagcggacagaaaaccaagatcattagtaaccgaggggaaaacagttgcaaggctacagggcaagtgtgccatgctctatgctcacctgagggctgttgggggccggagccccgagattgcgtgtcctgccggaacgtgtctaggggccgcgaatgcgtagacaaatgtaatctcctagagggcgagcccagggaatttgttgagaacagtgagtgcatacagtgtcacccagaatgtctgccccaggcgatgaatattacttgcaccggccgtggcccggataactgcatccagtgcgctcactacatcgacggcccacactgcgtaaagacttgcccagctggagtgatgggagagaacaacaccctggtatggaagtacgcagacgccggccacgtgtgccacctgtgccacccaaactgtacctatggatgcaccggcccaggactcgagggatgccccaccaatggccccaagattccatcaatagcaacgggcatggtgggcgccttgttgctgcttctggtggtggcacttggcatcggattgtttatgcgcaggcgtcacatcgtgcgaaagagaacactccggaggctattacaagagcgggaactagtggagcccctgaccccaagtggtgaggcgcccaatcaggcactgctgagaatcttgaaagagacagaatttaagaagatcaaagtgctgggatctggtgcatttgggaccgtgtacaagggcctctggattccggagggcgaaaaagtcaagatcccagtagccatcaaggaactgagagaagcaacatcccctaaggccaacaaagagatactggacgaggcttacgtaatggcttcagtcgacaacccacacgtttgtcgactcttgggtatctgtctgacgtctaccgtccagttaataacccagctgatgccattcggctgtctgctggattacgtcagagaacataaggacaacataggatcacaatacctgctgaactggtgcgtgcaaatagccaagggcatgaactacctggaagacagaagattagtccaccgtgatttagccgctcgtaatgtactcgtgaagactccacagcatgtgaaaataacggattttggcctggctaagctgctcggagccgaggaaaaagagtatcacgccgagggcggcaaggtgcccattaagtggatggctctggaaagcattctacatcggatttacactcaccagagcgatgtctggtcgtacggggtcacagtttgggaattaatgacctttggctctaaaccgtacgacggcatccctgctagtgagatttccagtatcctggagaagggcgagagactcccacagcctccaatctgcacgatagacgtatatatgatcatggtgaaatgctggatgattgacgcagacagtcgaccaaaatttcgtgagctcatcatagagttttctaagatggctcgggatccacaaaggtacttagtcatccagggagatgagagaatgcacctgccatccccgaccgactctaatttttaccgagctctgatggatgaggaggatatggacgatgtcgtcgatgctgacgagtacctcatacctcagcagggctttttcagttctcctagtacttcccggactcccttattatccagcctctcagctacgagcaacaatagtaccgtagcatgcatcgatagaaacgggctccaaagctgccccattaaagaggacagctttttgcaaagatattcttcggatcctacaggagcgttgactgaggactctattgatgacacgtttttaccggttcctgagtatatcaaccaatcagtgccaaaacgaccagccggatctgttcagaatccagtgtaccacaatcagcctctcaatccagctccgtctagggacccacactaccaagacccacattccactgccgtggggaaccctgaatacctgaatactgtccagcccacctgtgtgaattctacgttcgactcccctgcccactgggcccagaagggctctcaccagatttcattagacaatcctgattaccagcaggacttctttccaaaggaagcaaagcctaacgggatctttaaaggcagtacagcagagaatgcggagtatctgagggtggctccacagagctcagaattcataggggcttag

SEQ ID NO: 15004 - DNA, 3276 bp, Artificial Sequence
  Description of Artificial Sequence: Synthetic coding sequence
atgagaccaagcggcaccgccggtgctgcgttgctcgctctcctagctgctctatgcccagcctctagggcccttgaagaaaagaaggtgtgccagggtacaagcaacaaacttacccagctgggtacgttcgaagatcacttcctgtcgttacagagaatgttcaacaattgtgaagtggttctcgggaacctcgaaattacatatgtccaacggaattatgacctgtcttttcttaagaccatccaggaggttgccggatacgttctcatagctctgaacaccgtagagcgcatcccccttgagaatttacagattattaggggcaacatgtattatgaaaactcctacgccttggccgttctgtccaactacgacgccaacaaaactggactcaaagaactaccaatgcgcaatttgcagggtcagaagtgcgatccctcttgccctaatggaagctgttggggcgcaggggaggaaaactgtcagaagctcactaaaatcatatgcgctcagcagtgcagcggccggtgcagaggcaagtcccccagcgattgctgtcataaccaatgcgcagccgggtgtaccggaccacgggaaagcgactgcttggtgtgtcgcaagtttagagacgaggctacatgtaaagatacatgccccccattaatgctgtacaatcccaccacctaccagatggacgtgaatccagaggggaagtactcgtttggggcaacttgcgtgaaaaagtgcccaaggaactacgtggtcacggaccatgggagctgcgttcgcgcctgcggtgcagactcatacgaaatggaagaggatggggtcagaaagtgtaaaaagtgcgagggcccatgccgtaaagtttgcaacggaatcgggatcggagagttcaaagattctttatctattaacgctacgaatatcaagcacttcaagaattgtacatccatcagtggtgacctgcacattttgcctgtggcattccggggtgattctttcacacatacacccccactggatcctcaagagctggacatcctcaaaaccgtgaaggaaatcactggattcctactaatccaggcctggcccgagaatagaactgatttgcatgcgtttgaaaacttagagatcattcgcggacgcacaaagcagcatgggcaattctctcttgctgtggttagtctgaacataacaagtctgggtctccggagcctgaaagagatctctgatggtgacgtcatcatatcaggcaacaagaacttatgttatgccaatactattaattggaaaaaactcttcggcacatcaggccagaagactaagatcatttccaatcgcggcgagaacagctgtaaagcaaccggccaggtgtgtcacgcactgtgttcacccgaaggctgctgggggccagaaccaagggactgtgtgagctgcagaaatgtgagccggggccgcgagtgcgtggataaatgtaatctcctggagggagagcctcgggagtttgtggagaattcggaatgcatccagtgtcatccggagtgtctgccccaggccatgaacattacctgcactggaagagggccagacaactgtattcagtgtgctcactacatcgatggtccacattgcgtgaaaacctgcccggccggggtgatgggtgagaacaacaccctggtctggaaatacgctgatgcaggacacgtttgccacctctgccatccgaattgcacctacggatgcactgggcccggccttgagggttgtcccacgaacggccctaagattcccagtatcgccacagggatggtgggagccctgctgctactgctcgttgtggcgctgggcatcgggctgtttatgaggcgccgtcacatcgtgcgcaagagaacccttcgccgcctcctgcaggagcgggagcttgtagaacccttaaccccctccggggaggctcctaatcaggcgctcttgagaatactaaaggagactgaatttaagaaaattaaggttctcggatcgggagccttcgggaccgtgtacaagggcctgtggataccagagggggagaaagtgaaaatccccgtggcaattaaagagctccgggaagcgaccagtcctaaggcaaataaggagatccttgatgaggcatatgtgatggccagcgtagacaatcctcacgtgtgcagactgctgggaatttgtctcaccagcaccgtgcagctgatcacccaactcatgcccttcggttgtttgctggactatgtgagggagcataaggacaatattggctctcagtatctcctgaattggtgtgttcagatcgcaaaaggaatgaattatctggaggaccgacgactcgtgcaccgtgacctcgctgcaagaaatgttctggttaagaccccccagcacgttaagataaccgattttggactggctaaacttctcggggctgaggaaaaagaataccacgccgaaggcggtaaggtgcctatcaagtggatggcactcgaatctatcctgcaccggatttacacacatcagagtgacgtctggtcctatggtgtgaccgtctgggaacttatgacctttggatcaaagccatatgatggcatcccggcatcagagatctcatctatcctggagaagggcgagcgcctccctcaacctccaatatgcacaattgacgtttatatgataatggtgaaatgctggatgatcgatgctgattctagaccaaagtttcgcgaactgattattgagtttagcaagatggctagagatccccagcgatacttggtaatacaaggtgacgaaaggatgcacctgccatcccccacagatagcaatttttatagagctctgatggacgaagaggatatggatgatgtggtcgatgccgatgaatatttgatcccccagcaaggcttcttttctagtccctccacctcacgtacacctctgctgtcatccctctctgccacaagcaataattctaccgtggcttgcattgaccggaatggcctccagtcttgtccaataaaagaggatagcttcctgcagcgctattccagtgaccccaccggcgcactgaccgaagactctattgacgacaccttcctgcccgtcccaggtgagtggctggtctggaaacaatcctgctcatcaaccagctccactcattctgccgccgcatctctgcaatgccccagtcaggtgctcccacctgcttctccagagggcgaaacagtggcagatctacagacccaatag

SEQ ID NO: 15005 - DNA, 1395 bp, Artificial Sequence
  Description of Artificial Sequence: Synthetic coding sequence
atgtcaagtctcacgaaaattatctgtgcccagcagtgcagtggtagatgtagggggaaatctcccagcgactgttgtcacaaccagtgcgccgcaggatgcaccgggccaagagaaagcgattgcttggtctgtcgaaagttccgtgacgaggcaacgtgcaaggacacctgccctccacttatgttatacaatcccacaacctaccagatggatgtgaaccccgaagggaaatactcgtttggggctacctgcgttaagaaatgcccacggaactacgtggtcaccgaccatgggagttgcgtccgagcctgcggtgccgattcttacgagatggaggaggatggggtacggaagtgtaagaaatgcgaggggccctgtcgtaaagtgtgcaatggcatcgggatcggcgagttcaaagactctttatccataaacgctactaatattaagcactttaaaaactgcacatcgattagtggggacttgcatatactgcccgtcgctttccgcggagacagcttcactcatacaccgccactcgacccccaagagcttgatattttaaagacagttaaagagatcaccggattcctgctgatacaggcatggccagagaatcgcacggatttgcacgctttcgaaaacctcgaaataatccggggtcgaactaagcagcatggccagttcagcctggccgtggtgagcttaaacatcacctcgctcgggcttaggtcacttaaggagatctctgacggagacgtgataatcagcggcaacaaaaatctatgctacgccaacacaatcaattggaaaaaactgttcgggacatccggccaaaagaccaaaatcatctctaacaggggcgagaattcttgtaaggcgactggccaggtttgccacgccttatgctcccccgaaggctgctggggccctgagcctcgcgactgcgtgtcttgcagaaatgtgtccagaggccgggaatgcgttgataaatgcaaccttctcgaaggtgaaccacgggagttcgtcgaaaatagcgagtgcattcaatgtcatccggagtgtctgccacaggcaatgaacatcacctgtacaggaagaggccccgataattgtatccaatgcgcgcactacatagacggccctcattgcgtaaagacgtgccctgccggcgtaatgggagaaaacaacacgctggtatggaagtatgcagatgccggccatgtttgccatctgtgtcaccccaactgtacctatggttgtaccggccccggattggaggggtgtcctacaaacggtcctaagattccaagtatagcaaccggaatggtgggtgctctcttgctactgttagtggtagctctggggatcggtctcttcatgcgtaggtag

SEQ ID NO: 15006 - DNA, 843 bp, Artificial Sequence
  Description of Artificial Sequence: Synthetic coding sequence
atgcctgcagacattatggagaaaaacagctctagtcccgttgctgctactcctgcttcagtgaacacaaccccagacaagccaaagacggccagcgagcataggaagtcatccaaaccaatcatggagaagcggcgccgagctaggatcaatgaaagcctgtcccagctgaagacactgattcttgatgcgctcaaaaaagactctagtcgacactcaaaactggagaaggctgacatcctggaaatgacggtgaagcaccttcggaatctgcagcgcgcgcagatgactgccgcactgtctaccgaccctagtgtgctgggaaagtaccgggctggctttagcgagtgcatgaatgaggtgacgcgctttttgtccacatgcgagggtgtgaatactgaagtcaggaccaggttgcttggacaccttgccaattgtatgactcagattaatgccatgacctacccgggccagccccatcctgccctccaggctccaccaccccccccacctggccccggtgggccgcagcatgcaccctttgcgcctccccctcctctggtgccgatcccaggtggcgctgccccaccgccaggtggagctccctgtaagttaggatcccaggccggggaggccgctaaagtatttggggggtttcaggtagtgcctgcccctgacggccagttcgccttcctgatcccaaatggagcttttgcccacagcgggccggtgatccccgtgtatacctccaactccggaacttctgtcggccctaatgcagtctctcccagtagtggtccatcattaacagcggactctatgtggcgcccctggagaaactag

SEQ ID NO: 15007 - DNA, 57 bp, Artificial Sequence
  Description of Artificial Sequence: Synthetic coding sequence
atggcggagaatagcgtattaacctctacaaccgggcgaacctcattagctgactag

SEQ ID NO: 15008 - DNA, 2745 bp, Artificial Sequence
  Description of Artificial Sequence: Synthetic coding sequence
atggcagagaattcggtccttacctccacaaccggcaggaccagccttgcagactccagtatcttcgattctaaggtgaccgaaatttccaaggagaacttattgattggcagcaccagctatgtcgaagaagagatgcctcagatcgaaacccgcgtcattctcgtgcaggaagctggaaagcaggaagagctcatcaaggcgctgaagactatcaagattatggaagtccccgtgattaaaatcaaggaaagttgtccaggcaagagcgacgagaaactcatcaaatccgtaattaacatggatataaaggtgggatttgtgaagatggaatccgtcgaagaatttgagggcctggattctcctgagtttgaaaacgttttcgtcgtcaccgattttcaagattccgtgttcaacgacctgtataaggcagattgtagggttattggcccccctgtagtgctcaactgttcacagaaaggcgaacccttgcctttctcttgcagaccattgtactgcaccagcatgatgaatttggtcctgtgcttcacgggctttcgtaagaaggaggagctggtgaggctcgtgacactggtccaccacatgggcggagtcattcgcaaagactttaactccaaggtgacccaccttgtggccaactgtacacagggcgagaagttccgagtcgccgtgtcactggggactccaattatgaaaccagagtggatctacaaggcctgggagcgtcggaacgaacaggatttttacgccgcggttgatgattttaggaacgagttcaaagtgcctcctttccaggattgcattttgtccttcctgggcttttcggatgaagagaaaacgaacatggaggagatgactgaaatgcaaggaggaaagtatctgccactgggagatgaacgctgtacccacctcgtcgttgaagagaatattgtcaaggacctgccctttgagccctccaaaaaactatacgtggtgaagcaagaatggttttgggggtctatccaaatggacgctcgggccggtgagacaatgtacctgtacgagaaagccaacaccccagaattaaagaagagcgtgtctatgctctccctgaacacaccaaactccaacagaaagcgcagacggctcaaggaaaccttagctcagctgagtcgggaaacagatgtcagcccctttccccctcgcaagcgcccgtccgcagagcattcactgagcattggcagccttctggatatttctaacacgccagagtctagcattaattacggggacacccccaaaagctgcacgaaaagttccaagtcctctactccagtgcctagtaaacagtcagctagatggcaagtggctaaggagctgtatcagacagagtctaactacgttaatatcctcgcaaccattatccagctctttcaagttccgctggaagaagaaggccaacggggcggccctattctggccccagaagaaatcaagactatttttggatccatccccgatattttcgacgtgcacacaaagattaaggacgaccttgaggacctcatcgtaaactgggacgaaagcaagtccataggagatatcttcttaaagtactccaaggaccttgttaaaacctaccccccctttgttaattttttcgagatgagtaaagagacaattataaaatgcgaaaagcaaaagcctagattccacgcttttttgaaaataaatcaagctaagccagagtgtggtcgccaatctctggtggagcttttgattagacccgtgcaaagactgccgagtgtggctctgctcctgaatgacctgaagaagcataccgccgacgaaaatcccgacaagagcaccttggaaaaagccatcgggagcttaaaggaagtaatgacacacatcaatgaagacaagcgaaaaactgaggcccagaagcagatcttcgatgtggtgtatgaggtggacggctgtcctgctaacctgctttcaagccatagaagtctggttcaaagggtggagactatttctttgggggagcacccatgcgatagaggcgagcaggtgaccctgttcctgttcaacgattgcctggaaatcgctaggaaacggcacaaggttatcggcactttcagaagccctcacgggcagacaaggcctccagccagtcttaagcacatccacctgatgcctctttctcaaattaaaaaggttttggacatccgagagacagaggactgccataatgccttcgcactgctggttagacctcctaccgaacaggcaaacgtactgttgtccttccagatgacctctgatgaattaccgaaagagaactggctcaaaatgctgtgccgacacgtcgcaaataccatctgtaaggcagatgccgaaaacctgatctataccgcggatccggagtcctttgaggtaaacacaaaggatatggattcaacactgtcacgggcatctagagctattaagaaaacatccaagaaagtgacccgggcattctccttctccaagactcctaagagagcattgagacgggcccttatgacttcacatgggtctgtcgaaggcagaagccccagtagtaatgataagcacgtgatgtcccgcctgagctctacaagttctctggccggtatcccatcaccaagtctggtgtccctgccttcattttttgagaggcgaagtcacaccctcagcagaagcactacacacctgatctag

SEQ ID NO: 15009 - DNA, 480 bp, Artificial Sequence
  Description of Artificial Sequence: Synthetic coding sequence
atggcagagaacagcgttctgaccagtaccacaggacgcacgtcactcgccgatagcagcatctttgactctaaagtcacagagatttccaaagagaacctgctaattgggtcaacaagctacgtggaagaagagatgccacaaattgagacacgggtcatactggttcaagaagctggaaagcaagaggaactcataaaagctctgaaagatattaaggtcggatttgtaaaaatggaatcagtcgaggagtttgagggattggatagtccggagtttgagaatgtgttcgttgtgaccgattttcaagacagtgtctttaacgatctgtacaaggccgattgtcgtgtcatcggtcctcctgtcgtccttaactgctcacagaaaggagagcctctccccttctcttgccggccgttgtactgtacctccatgatgaatctggtcctgtgcttcaccgggttccgtaaaaaagagtag

SEQ ID NO: 15010 - DNA, 2649 bp, Artificial Sequence
  Description of Artificial Sequence: Synthetic coding sequence
atggcagagaactccgtgttgacttcgaccacaggaaggacttccctggccgactcctctatctttgactccaaggtcactgagatatccaaggaaaatttgctcatcggatcaacttcatacgtagaggagatgcctcaaatagagacgcgagtcatcctcgtccaggaggcaggcaaacaggaggagttaatcaaagcactcaaagatattaaggtgggctttgtgaagatggagagtgtagaggagttcgaggggcttgatagtccggaattcgagaacgtgttcgtggtgacagatttccaggattccgtgtttaacgatctctataaggctgactgcagagtgattgggcccccagtagtattaaactgtagccagaaaggcgagcccttgcctttttcctgtaggccattgtattgtacatctatgatgaaccttgtcctgtgctttactgggttccgcaagaaggaggaactggtgaggctggtaaccctcgtacatcacatgggaggcgtgatccggaaagatttcaactcgaaggtgacccacctcgttgctaattgcacacagggcgagaagttcagggtagcagtgtccttgggtacccccattatgaagcccgagtggatttataaggcttgggaacgccggaatgagcaagatttctatgccgcagtagatgattttcgaaacgaattcaaggtccccccatttcaagactgtatcctatcattcctaggcttctctgatgaagagaaaacaaacatggaagagatgactgagatgcagggtggaaaatacttgcctctgggcgacgagagatgtacacatttggttgtcgaggagaacatcgttaaagatttgccttttgaaccaagcaagaaattatatgtggtcaaacaggagtggttctggggatctattcagatggacgcacgagctggagagaccatgtacctttacgaaaaagccaatacacctgagctgaagaaatccgtgtccatgcttagtctgaacacacctaattcaaataggaaaaggaggagacttaaagaaacactggctcagttgagccgcgagactgatgtaagcccctttccgccccgcaaaagaccttccgctgaacacagtttgagcatcggaagcctcctcgacatcagtaacacccccgaatcatctatcaactacggtgacacacctaagtcatgcaccaaatcatccaagagcagtactccagttccttcgaagcaaagtgctagatggcaggtggccaaagagctctatcagacggagtccaattatgtcaatatactcgcgactataatccagctgttccaggtgcccttggaggaggagggtcagcgcggagggcctatcctcgctcccgaggaaataaagacaatctttgggtcgatccccgatatttttgacgtccataccaagatcaaggacgatctcgaggacctgatcgtcaactgggatgagtcgaaatccataggggacatcttcctgaaatattccaaagacttggtaaagacctatcccccattcgtgaactttttcgagatgagcaaggagactatcatcaagtgcgagaaacagaagccgcgatttcacgcgtttttgaaaattaaccaagctaagcccgagtgtggtcggcagtctctggtggagctactgatacggccagtacagcggcttccttccgtcgctcttctcttaaatgacttaaaaaaacacactgccgatgagaacccggacaaaagtaccttggagaaagccatcggatccctgaaagaggtgatgacccacatcaatgaagacaaaagaaagactgaggctcagaagcaaattttcgacgtcgtatatgaggtggacggttgtcctgctaatctgcttagctcccatcgctcactcgttcagcgggtagaaacaatctctctcggggagcatccatgcgatcgcggcgagcaggtgacgctctttcttttcaatgattgtctggagatcgccagaaagcggcataaagtaataggaaccttccgttctccccatggccagactcgcccaccagcttccttgaaacacattcacctcatgcccctgtcccagattaagaaagttctggatatacgggagaccgaggactgtcacaacgcatttgcccttttggtcaggcccccaacagagcaagccaacgtcctattaagcttccagatgacctcagatgagctgcccaaggagaactggttgaagatgctgtgccgccatgtggccaataccatctgtaaagccgatgcagagaatctgatctacacagctgaccctgagtcttttgaggttaatacaaaggatatggactccaccctcagtagagcgagtagagctattaagaagacctctaaaaaggtcaccagagcattttccttttctaaaacccctaagcgtgcgctgcgcagggccctcatgactagccacgggagcgtagagggccggtccccaagctccaacgataaacacgttatgagccgcctttcctccaccagttccttggcaggaatccctagtccgtccctcgtgtcactgccttccttttttgaacgaagaagccatacactgtcccgtagcaccacgcatttaatctag

SEQ ID NO: 15011 - DNA, 321 bp, Artificial Sequence
  Description of Artificial Sequence: Synthetic coding sequence
atggcggagaattccgttctgaccagcactacaggccggacaagcctggctgattcaagtatctttgattcaaaggtgaccgagatcagcaaggagaacctcctgattggatccacaagctacgtggaagaggagatgcctcagattgagacccgcgtaatcttggtgcaggaggcagggaaacaggaggaactgatcaaggctctgaaggatatcaaggtagggttcgtgaaaatggagtctgtggaagaattcgagggccttgacagcccagaattcgaaaacgtgtttgtggtgaccgatttccaggactcagtctag

SEQ ID NO: 15012 - DNA, 2784 bp, Artificial Sequence
  Description of Artificial Sequence: Synthetic coding sequence
atggccgagaactccgttctgacatccacgacaggccggacatccctcgcagactcctcaatcttcgattctaaggtaactgaaattagtaaggaaaatctcctgatcggctccacctcttacgtggaagaagaaatgcctcagatagaaactcgggtgattctggtccaggaggcggggaagcaggaggaacttataaaagccctcaaggacataaaagtgggcttcgtaaagatggaatcagtggaggagttcgaggggcttgatagccctgaattcgagaatgtgtttgtggtgactgatttccaggatagcgtgtttaacgacctgtacaaagctgactgcagggtcatcggtccacccgtcgtgctgaattgctcacagaagggtgaaccactgccatttagctgcaggccgctgtactgtactagcatgatgaatctggtgctatgcttcaccgggttccggaagaaagaagaattagtgcgtctggtaaccctggtgcatcatatgggcggcgtcatcaggaaggactttaattcaaaagtgacacacttagttgccaactgtacccagggcgagaaattcagagtggctgtgtcactgggtactccaatcatgaagccggagtggatttataaagcgtgggaaagacgtaatgaacaggatttttacgctgccgtcgatgacttccggaacgagtttaaagtgccgcctttccaagactgcattctgtccttcctgggattcagcgatgaagagaagacaaacatggaagagatgaccgagatgcagggcggaaagtacctcccgttgggcgatgagcggtgtacccacctggtggtggaagaaaatattgtgaaagatctgccatttgaaccgagcaagaaactgtacgtggtcaagcaagagtggttctggggcagcatccaaatggacgcacgcgcaggggaaaccatgtatctttacgagaaggccaataccccggagcttaagaagtctgtaagtatgctttctctcaatactcctaacagtaatcgaaagcgccggagactgaaggaaacgctggcgcaactttccagagaaactgacgttagccccttccccccacgcaaaaggcccagtgccgagcattcgctctcaattggctccctgctggacatttcgaatactccagagtctagcatcaattatggtgatactcccaaaagctgcacaaaatccagcaagagctcaacccccgtaccgtccaaacaatccgcgagatggcaagtcgcaaaggagctctaccagactgaaagtaactacgtaaatatattggctacaattatccagctgtttcaggtcccactggaagaggagggacagcgggggggacctatactcgctccagaggagatcaaaacaattttcggaagcattcctgacatatttgacgtgcataccaagatcaaagacgacctggaggacctgatcgtgaattgggacgaaagcaagagcattggcgatatctttctcaaatattcgaaagacttggtcaaaacatatcccccctttgtgaacttctttgaaatgtctaaagaaaccataattaaatgcgaaaaacaaaagccccgttttcatgccttcctgaagatcaaccaggccaagcctgagtgcgggagacagtcgctagtggagcttctgatccggcccgttcagcgcctgccatctgtagccctgctacttaatgatctgaagaaacacactgccgacgaaaaccctgacaaatccaccttagaaaaggcaattggctcgctaaaggaggtgatgacccatataaatgaagataaaagaaagacagaagcccaaaaacaaattttcgatgtggtatacgaagtggatgggtgtccggccaatttactatcttctcatcgatccctcgtgcagagggtcgagacaatatcattaggcgagcatccctgtgatagaggagagcaggtgaccttgttcctctttaatgattgtctggagatcgctcggaaacggcataaggtaatcggtacctttcgctctcctcacggtcaaaccagaccccccgcctctcttaaacacatccacctgatgccactttcacagatcaaaaaggtactggacattcgcgaaaccgaagactgccacaacgcattcgcccttttggtaagacctccaacagagcaggctaatgtgctgctgtcgttccaaatgacatcggatgagctgcctaaggaaaactggctgaagatgctctgcagacatgtggcaaatacgatatgtaaggcggatgcagaaaacctgatatatactgccgaccctgagagtttcgaagtcaacacaaaggatatggattctaccctgagtcgggcctctcgcgcaatcaagaagactagcaagaaagttacacgggcctttagcttctcaaagacaccaaaacgagcgcttcgccgggcccttatgacctcccacggcagcgtcgaaggccggtcccctagctccaatgacaaacacgtgatgagccgactgtcttctacttcgagtctggctattacacattccgtcagtacttccaacgttatcggattcacaaagcacgtgtacgtgcagcgcctcaacagtacaggcggacgttctcaatattcttggtttcagagtgtgcggcatagtgcttttcgagcctccttctccgaaatattggagggtaacacagatttttcaaatttcaaaaaggtcctctcaaagtcaagtttgaccttcgtgaagaattag

SEQ ID NO: 15013 - DNA, 2652 bp, Artificial Sequence
  Description of Artificial Sequence: Synthetic coding sequence
atggcagagaattctgtgcttactagtacaaccggtcgtacgagtcttgcagatagttcaatatttgacagtaaggtgactgagatttctaaggaaaatctgctcattggctccacttcttacgttgaggaagagatgccacagatcgagacacgcgtgatcttggtccaagaggccggaaagcaggaagagttaatcaaggctcttaaggacatcaaggtggggtttgttaaaatggagtccgtcgaagaattcgagggattggacagcccagaattcgagaacgtatttgttgtcaccgattttcaggattctgtcttcaatgacctgtataaggccgactgtcgggtgataggccctcccgtggtgctgaattgcagtcagaagggggagccattgccatttagctgtaggcctctgtactgtaccagcatgatgaatttggtgctttgcttcacggggtttcgcaaaaaggaagaactcgtgcgcctggtgaccctggttcaccatatggggggggtcatacgtaaggacttcaacagcaaggtaacacatcttgtggccaattgcacccagggcgagaagttccgtgtggctgtgtccctcggtacgcctattatgaagcccgaatggatttataaagcctgggaacggagaaatgagcaggatttctatgcagccgtcgatgatttcagaaacgaattcaaagtgccgccgttccaggactgcatccttagcttccttggcttttcagatgaagagaagacaaacatggaagaaatgactgagatgcaaggcgggaaatacttgcccctgggggacgagcggtgcactcacctggtggtggaggagaacatcgtaaaagacttgccatttgagccctcaaagaagctgtatgtggtaaagcaagagtggttctggggctctatccaaatggatgccagggcaggagagactatgtatctgtatgagaaggctaacaccccagagctgaaaaagagtgtcagcatgctctctctgaatacacccaatagcaaccgcaaaagacgccggctcaaagagacgcttgcccagctgagccgagagacagatgtgtctccattccctccccgaaagcgaccctccgcggaacatagcctatccatcgggagccttctggatatttctaacacacccgagtcctctattaactatggcgacacaccaaaaagctgcacgaagagctctaagtcaagcactcccgttccttcaaaacagtcggcccgatggcaagtcgcgaaggaactttatcagacagagtccaactacgtgaacattcttgccacaataatccagctttttcaggtcccgctggaggaggagggtcagcgtggtggccctatcctggcccccgaagagattaagaccatcttcgggtcaatacctgacattttcgatgtgcacacaaaaattaaggacgatttagaggaccttatcgttaactgggatgaatcaaaatccattggcgatatcttcttaaagtactccaaggatctcgtgaaaacatatcctccatttgtcaactttttcgagatgtcaaaggagaccattatcaagtgcgaaaagcagaaacctcggttccacgcctttttgaagatcaaccaggccaagcccgagtgtggacggcagagcctggtggagcttctgatccggcctgtgcagcgcttaccatccgtggctttactgctcaatgatctgaagaaacacacagcggacgagaacccggataagagcaccctcgagaaagccatcgggagtctgaaggaggttatgacacacattaacgaggataagaggaagaccgaggctcagaaacagatattcgatgtggtatacgaagtcgacggttgccccgccaatctgctatcgtcacaccgatcactcgtccaacgtgtcgaaacaatctcgcttggagaacacccctgtgatcggggcgaacaagttacacttttcctgttcaacgattgccttgaaatcgcgcggaaaagacataaggtgatcggcactttcagatctcctcacgggcagactaggcccccagcgtccctgaaacacattcacctgatgcccttatctcagatcaagaaagtgctggatatacgggagacagaggattgccacaacgcattcgctttattggtcagaccccctacagagcaggctaacgttctcctgagtttccagatgacctcggatgaattgccgaaagaaaattggctgaagatgctatgtcgacacgtggccaacactatttgcaaggcggacgccgaaaatctgatctataccgccgacccagagtcatttgaagttaacacaaaagatatggacagcaccctatctagagcctccagggccatcaagaaaacctccaaaaaggtgacccgcgcattcagcttctcaaagacccccaaacgggccctgaggcgggccctcatgacatcccatggatcagtggaagggcgctcgccctcttcaaatgataaacacgtgatgtctcgactctcctccacctcgagcttagcagggatcccctccccctccctggtttcactcccttctttttttgagcgcagatcccatacactctctcggagcactacgcacctgatctag

SEQ ID NO: 15014 - DNA, 2745 bp, Artificial Sequence
  Description of Artificial Sequence: Synthetic coding sequence
atggcagagaactctgttttgactagcactaccggcaggacatcattagccgattctagtatttttgatagcaaggtgacagagatcagcaaggaaaatctgttgatcggttcaacgtcttatgtggaggaggaaatgccacagatcgaaacacgcgtgatcttggtgcaggaagccgggaagcaggaggaactgatcaaagcacttaaaacgattaagatcatggaagtgccagttataaagatcaaggagtcttgtccggggaagtctgacgaaaagttgatcaagtccgtgataaacatggatatcaaagttggttttgttaagatggagtccgtagaagagttcgaagggctggattctcccgaatttgagaatgtcttcgtggttactgatttccaagacagtgtattcaatgatttgtataaggcagattgtcgcgtgattggaccacccgtcgtactgaactgctctcagaaaggcgaaccgttgccattttcctgcagacccctttactgcacctcaatgatgaacctcgtgctgtgtttcacagggtttaggaagaaggaggagctggttcgtctcgtcaccctggtccaccatatgggaggggtgattcggaaggactttaacagcaaggtcacccacctagtggcaaactgtacacagggcgagaagttccgtgttgcggtgtcacttggtactccgatcatgaaacccgagtggatatacaaggcctgggaacgaagaaatgaacaggacttctacgcggctgtcgatgactttaggaacgaattcaaagtcccaccctttcaagactgcatactatcatttttggggttttctgacgaggagaaaaccaacatggaggagatgaccgagatgcaagggggtaagtacctcccacttggagatgagagatgtactcaccttgtggtagaagagaacattgtcaaggacctgcctttcgagcctagtaaaaagctgtacgtggtgaagcaggagtggttttggggatctattcagatggacgcaagagcgggcgaaacaatgtacctgtatgagaaagccaatactcccgaactgaagaagtccgtgtccatgctgtcactcaatacacctaattcaaaccgcaaacggagaagactgaaagagaccttagcgcagcttagtcgcgagactgacgtttcccctttccctccccggaagagaccctcggcagaacatagcctcagcatcgggtcactgctggatataagtaacactccggagtcgagtatcaactatggcgatacacctaagtcatgcaccaaaagcagcaaaagtagcacacccgttccctcaaagcaatctgctcgctggcaggtggctaaggagctgtatcagacagagtccaactatgtgaatatactcgccacaatcattcaactgttccaggtgcccttggaagaagagggtcagcgaggagggccgatcctggcaccagaggagattaagacaatctttggtagcattcccgacatattcgacgtccatacaaagatcaaagacgacttggaagacttgattgtgaattgggatgaaagtaagagtataggcgacatcttcctgaaatattctaaagatctagtcaagacttaccccccatttgttaattttttcgaaatgtccaaagagacaataataaagtgcgagaagcagaagcctagatttcatgctttccttaagatcaatcaggccaagcccgaatgcggacgccaatccctcgtggagctgctgatccggcctgttcagcgactgccctcggttgcactcctgctgaatgatctcaaaaaacacaccgcagacgagaatcccgacaagtctaccctcgagaaagccatcggaagcctcaaagaagtaatgacacatattaacgaagataaacggaagacagaagcccaaaagcaaatcttcgatgtcgtgtatgaagtggacgggtgtcccgccaatctactgtcgtcgcacagatcgctggtgcagagggtagagacaatctcactcggcgaacatccatgcgataggggtgagcaggtgaccctatttctttttaacgattgcctcgagattgcccggaaaaggcataaggtcattggaactttcagatcacctcatggacagaccaggcctccagcttccctcaaacatatccacctcatgcccctctcccagatcaaaaaggtgcttgacatacgggaaactgaagattgtcataatgcatttgccttgttggtgcgacctccaacagagcaggctaatgtcttattgtcatttcagatgacctcagatgaactccctaaggaaaattggcttaagatgctgtgcaggcatgtggctaacaccatctgtaaggccgacgctgaaaaccttatctacacagccgacccagagagctttgaagtcaacaccaaagatatggattcaaccctcagtagggcctcaagagctattaagaaaacctcaaaaaaggtaacaagagctttttctttttctaaaacccccaaaagagccctaagaagggcattgatgacttctcacggctccgtcgaagggagatccccaagtagtaatgataagcacgtgatgagtaggctcagcagcacctctagtttggctggaataccttctccctcccttgtctccctgccttcattttttgaaagaaggtctcataccttgtcccgctccaccactcatttgatctag

SEQ ID NO: 15015 - DNA, 1389 bp, Artificial Sequence
  Description of Artificial Sequence: Synthetic coding sequence
atgagcattgccggagtggcagcccaggagatcagagtgccattgaagaccgggtttttgcacaatggtcgggccatgggcaacatgcgcaagacatactggtcttcgaggtcagagttcaagaataactttttaaacatagatcccataaccatggcctacagcctgaactcctctgcacaggaacggttgattccactaggccacgcatcgaagagtgcgccaatgaacgggcactgtttcgcagagaacggaccatcccagaaaagttccctgccccccctgcttatcccaccttccgagaatcttggccctcacgaggaggatcaggtggtgtgtggtttcaagaagctgaccgttaacggtgtctgcgcttcaaccccccctctgacccctattaaaaattccccaagcttgttcccgtgtgcgcctttgtgtgagcggggatccagacccctgcctcccctaccaattagtgaggcgctctcattggatgacactgactgtgaagtcgaatttttgacctcatccgatacagacttcctgttggaggatagcacactttcagatttcaaatatgacgtcccaggcaggaggtctttccgggggtgtggccaaataaactacgcatacttcgacactcccgcagtcagcgctgctgacctctcgtatgtgtctgatcagaacggtggagtgcctgaccccaacccacctcctccacagacccatcgcagactgcgccgttctcacagcggacctgccggatccttcaataagccagccatacggatctctaattgctgtatccatcgggctagtcctaatagcgatgaggataaaccggaggtgccccccagggtcccgatccccccacggccagtcaagcccgattacagaaggtggtctgctgaggtgaccagtagcacatactcagacgaggacaggcccccaaaggtgccgccccgagagcctctgagtccgtcaaactcaagaactccaagcccaaaatctttaccttcgtacttgaatggcgtgatgccgccgacacagtcatttgccccagaccccaaatatgtctctagtaaagctctccaacgtcagaattctgaaggtagcgcttcaaaggtaccctgcatcctgccaatcatagagaacggaaaaaaagtgtcttccacccattattacttgctccctgagaggcccccttatctagacaaatatgaaaaattcttccgcgaagcagaagaaaccaatggaggcgctcagatacagcctctgccggctgactgcggcatttcaagcgcaacagagaaaccggattctaagactaaaatggacctgggtggacatgtgaagcgtaagcacttgagttatgtggtttcaccgtag

SEQ ID NO: 15016 - DNA, 1713 bp, Artificial Sequence
  Description of Artificial Sequence: Synthetic coding sequence
atggctctcaagaaatcttcaccctccttagactccggggatagcgactctgaagaactacccacgttcgcctttctgaagaaagaaccttcctctaccaagcggaggcagcctgaacgggaagaaaagattgttgttgttgatatctctgattgcgaagctagctgtcccccagctcccgaactcttttcacccccagtccctgaaatcgctgagaccgttacccagacccagcctgttcggttgcttagctctgagagcgaggatgaggaagaattcatccccttggctcagcgccttacgtgcaaatttcttactcataaacagctgagcccagaggatagcagctcacctgtgaaatctgtcctggaccaccagaataatgaaggtgcatcttgtgattggaaaaaacctttcccaaagattcccgaggtcccacttcacgacacgccagagagaagcgcagctgacaacaaagacctgatactggatccctgttgccaactgccagcttacctttccacctgtccggggcagtcttcttccttggccgtcactaaaacgaactccgatatcctgcctccacagaaaaagactaaaccctcacagaaagtgcagggcagaggctcccacggctgtcgtcagcagcgacaagccagacagaaggaaagtaccctgcgaaggcaggaaagaaaaaacgccgctctcgtcactagaatgaaagctcagcggcctgaggagtgccttaagcacataatcgtcgttttagaccccgtattgctgcagatggaagggggcggccaactcctaggagctctgcaaacaatggagtgtcgatgcgttatcgaagcccaggctgtgccatgctccgtgacatggagacggagggccggtccatcagaagatagggaagactgggtggaagagccaactgtcttggtcttactgagggccgaagcatttgtttctatgatcgacaatggcaagcaaggcagcttggatagtaccatgaaaggtaaagagaccttacagggtttcgtgaccgatatcacagccaagaccgccggtaaggccctatcgcttgtgatcgttgatcaggagaagtgcttcagcgctcagaatccaccacgcagggggaaacagggagccaacaagcaaacaaaaaagcagcaacaaagacagcctgaagcttccatcgggtccatggttagccgggtggatgccgaagaggctctggtggacctacagctccatacagaagcccaggcccagatcgtgcagtcgtggaaggaactggccgacttcacatgtgcgtttactaaggcagtggccgaggcccccttcaagaaacttagagacgagactaccttttctttttgcctcgaaagtgactgggccgggggcgtgaaagtcgatctggcaggccgaggtttggcgctcgtgtggagacgccaaattcagcaactcaatcgagtttccctggaaatggcaagcgctgtggttaatgcgtaccctagcccacagcttctggtccaagcgtaccagcagtgcttttccgataaagaaagacagaatctgcttgccgacatccaggtcaggcggggtgagggcgtgacgagcacaagccgcaggatcggcccggaactgtcaaggcgcatctatctacagatgactaccttacagccgcatctgtctctcgactccgctgactag

SEQ ID NO: 15017 - DNA, 1752 bp, Artificial Sequence
  Description of Artificial Sequence: Synthetic coding sequence
atggcattgaagaagagctcacctagcctggactccggcgactctgacagtgaggaactgcccacgtttgccttcctgaaaaaggagccctctagtaccaaacgaagacaacctgaaagagaggaaaagatagtagtggttgatatctcagactgtgaggccagttgtccccctgctcctgagctgttttcaccacccgtgcccgaaatagcagagaccgttacacagactcagcccgttcggctattgagctccgagtccgaagacgaggaggaattcatccctctggcccaaagactaacctgcaagttcttaacacacaaacaattgtcacctgaagactcatccagtcccgtgaaaagtgtattggatcatcaaaataatgagggagcttcctgtgattggaagaaaccattccccaagatccctgaggtgcctctgcatgatacaccagagcgaagcgccgccgataacaaggaccttattctggatccctgttgtcagcttcccgcatatctctctacttgccccgggcaatcttctagcctcgccgttactaagaccaattctgacatcctcccaccacagaagaaaaccaaaccaagccagaaggtccagggccgcggatcccatgggtgccgccagcagagacaagccaggcagaaagaaagtaccctacggcgtcaagaaagaaagaacgccgctctagttacacgcatgaaggcccagaggccggaagaatgtctaaagcacattattgtcgtactggacccagtattgctgcaaatggaggggggcgggcagctcttgggcgctctgcaaacaatggaatgccgctgtgtgatagaggcccaggctgtgccttgcagtgtgacatggcgccggcgtgctggcccgtccgaggaccgcgaagattgggtggaagagccaaccgtgctggttctccttcgcgcagaagcttttgtcagtatgatcgataacggcaagcaaggaagtttggattccacaatgaaaggaaaagagacgctgcaaggcttcgtcacggatatcaccgcaaaaaccgcgggcaaagccctctcacttgtgatcgtcgatcaggagaagtgcttctcacttgaactgttatttttcgacttcctgccatgtacgagcgctcagaaccctccccggcgagggaagcagggcgccaacaagcagacgaagaagcagcagcagagacagccagaggccagcatcggctcaatggtgagcagggtggacgccgaggaggccctcgtggatctacagctccatacagaggcacaggcgcagatagttcagtcttggaaggagctggccgactttacatgtgcctttacaaaagctgtcgctgaggcccctttcaagaagctgagggatgagaccactttttctttctgccttgagagcgactgggctggaggcgtgaaagttgacttagctggacgtggcctggcattagtgtggcgccgacagattcagcagctcaacagggtttccttggagatggcctccgcagtcgttaatgcctatccgtcacctcagctgctcgtgcaggcgtatcaacagtgcttctcagataaggaaaggcaaaatctgttggcagatattcaggtccgacggggcgaaggggtcaccagcactagccggagaatcggtcctgaactctctcggaggatctatctccagatgaccaccctgcaacctcacctgagcttggattctgcggattag

SEQ ID NO: 15018 - DNA, 1752 bp, Artificial Sequence
  Description of Artificial Sequence: Synthetic coding sequence
atggctttaaaaaaatcttcacccagcttagactccggtgactcagacagtgaagagctgccgacttttgcattcctgaaaaaggagccttcatcaactaagcggcgtcagcccgaaagagaggaaaagatcgtcgtggtcgatattagcgattgtgaggcatcttgtccaccagcaccagaactgttttctcctcctgtcccagaaattgcggaaaccgtgacacagactcagcccgtgcgcctcctctcatctgagagtgaagacgaggaggaattcattcctcttgcccagcgcttaacctgcaagttccttacgcacaagcaactctctccggaagatagctcatcaccggtaaagtcagtgctggaccaccaaaacaacgagggtgcgtcatgcgactggaaaaaaccgtttcccaaaattcccgaagtgcccctgcacgacaccccggagcggtcagccgccgataacaaggatctgatcctcgacccttgctgtcagctgcccgcctatctttctacatgcccaggccagtccagttcacttgctgtaacaaagaccaattcagatattctgccaccccagaagaaaaccaaaccttctcagaaggtacagggacggggatcacacggatgccggcagcaaagacaggcccggcaaaaggagagcaccctacgaaggcaggagcggaagaatgctgcactggttacgcggatgaaggcacagcggcccgaggaatgtctcaaacatataatcgtggtcctggaccctgtactactccagatggagggcggcggacaactgctgggggccctacagacgatggaatgtcgctgcgtgattgaagcccaggcagtgccttgttctgtgacttggagaaggcgagccggcccctctgaggaccgcgaagattgggtagaagagcccacggtgctcgtgttgctgcgcgcggaggcatttgtgtctatgattgataacggcaagcaaggtagtctcgattctaccatgaagggcaaagagacattgcagggttttgtgacagacatcactgctaaaacagccggcaaggcgttgtccctggtgatcgtggatcaggaaaagtgtttctctctggagctactgtttttcgactttctcccatgcacctctgcgcagaatccacccaggcgcgggaagcagggcgctaacaagcagacaaagaagcagcagcagcgccaaccagaggcaagcattggctctatggtgtcaagggtcgatgctgaagaggcgctggtggaccttcagctccataccgaggcacaagctcagatcgtccaaagttggaaggagttagccgattttacctgcgcattcacaaaggccgtcgcagaggccccatttaaaaaactgcgcgacgaaacaaccttctctttttgtttagaatctgactgggccggaggcgtcaaagtcgacctcgccggacgagggcttgcattggtttggagacggcagatacaacagctgaaccgtgtcagcctggagatggcctcagcagtcgtgaacgcttacccttctccccagctgctggtgcaggcttaccagcagtgttttagcgataaagaaaggcaaaacctcttggccgatattcaggtgaggcggggtgagggagtgacatctactagccgaagaatcggtcctgagttatccaggaggatctacctgcaaatgactaccctgcagccacacctcagtctcgactcggccgactag

SEQ ID NO: 15019 - DNA, 684 bp, Artificial Sequence
  Description of Artificial Sequence: Synthetic coding sequence
atggctgatctcctgggttcaattctcagcagcatggagaagcccccaagtttgggggaccaggaaacccggcgcaaggcccgtgagcaggctgcacggctcaaaaagttacaggaacaggagaaacagcaaaaagtcgagttccgcaagaggatggagaaggaggtgagtgatttcatccaagacagcggccaaattaagaaaaaatttcagcctatgaacaaaatcgaacgttctatactacacgatgttgtcgaagtggccggactcacttcctttagctttggggaggatgatgattgccggtacgtcatgatctttaaaaaggaattcgccccaagcgatgaggagctagacagttatagacgtggagaggagtgggatccgcagaaggccgaagagaagcgcaaactcaaggaacttgctcagcgtcaggaggaggaagcagcccagcagggccccgttgtagtgagtcctgcttccgactacaaggataagtattcacacctcatcggaaagggcgcagcaaaagatgcagcccacatgctgcaggcaaacaagacatacgggtgcgttcccgttgcaaacaagagggacacgcgctctatcgaggaggccatgaacgagatcagagctaagaaacggctgcgccagagcggtgaggaacttcctcccaccagctag

SEQ ID NO: 15020 - DNA, 1788 bp, Artificial Sequence
  Description of Artificial Sequence: Synthetic coding sequence
atgacaatgaccttgcatactaaggctagcgggatggctctgctacaccagattcagggtaacgaactagagcctctcaatcggccacagcttaagattcccctggagcgcccgctgggcgaggtgtaccttgattcaagtaagcccgcagtctacaactaccctgagggagcggcgtacgagtttaacgctgccgctgccgcaaacgctcaagtttatgggcagaccgggctaccctacggccccgggagcgaggcggccgccttcggaagcaatggcttggggggtttcccacccctgaactcagtgtctccatcaccactgatgctcctacacccccctccgcagctatctcctttcctgcagccccacggccagcaggttccttattatttggaaaatgaaccctcgggatacactgtacgggaggccggacccccagcattttaccgaccaaattcagataataggcggcaaggtggacgggagcgtctcgcttcgacgaacgataaaggaagcatggcaatggagagtgccaaggagacaaggtactgtgccgtgtgcaacgactacgccagcggctaccattatggagtctggtcatgcgaggggtgcaaggccttctttaaacgcagcatacagggtcacaacgattacatgtgccctgctacgaaccagtgcacaatcgacaaaaataggcggaaaagttgtcaggcctgtcgcctcagaaaatgttatgaggtgggaatgatgaaaggtggcattcgcaaagaccgccggggcggtaggatgttaaagcacaagaggcagcgcgacgacggggaagggagaggtgaggtcgggagcgctggggacatgcgcgctgccaacctgtggccatcccctcttatgataaaaaggtccaaaaaaaattccctcgccctgtcactgacagcagaccagatggtatctgctctcctggacgccgaaccccccatcctgtatagcgaatacgatccaacacgtccttttagcgaggcgtctatgatgggattactgacaaatctggcggatcgcgaactcgtgcacatgattaattgggccaaacgggtgcccgggtttgtagaccttaccttgcacgatcaggtgcacctgctggagtgtgcttggttggagatcctgatgatagggcttgtctggcggtctatggagcaccctggaaaactgttgtttgccccaaatcttctgctggatcgcaaccagggcaagtgtgtagagggtatggtcgaaatcttcgacatgctcctggccacaagctcgaggtttcggatgatgaatctgcagggcgaggagtttgtgtgtctgaagagtatcatcttgttaaacagcggagtgtatacctttttgagcagcaccctaaagagccttgaggaaaaagaccatattcacagggtgctcgataagatcactgacaccttaatccacctgatggcgaaagctgggctgaccctacaacaacagcatcaacggctcgcccaacttctcctgattttgagccatattcgacatatgagcaacaagggaatggagcacttgtatagcatgaagtgcaaaaacgtcgtcccattatatgatctgctcctggagatgctggacgctcacaggttgcacgcccctacctcgcggggtggagcgagcgtggaagagaccgatcaaagccacctcgcaaccgctgggtccaccagttcccactcattgcagaaatattacatcacgggcgaggccgagggatttccagcgacggtttag

SEQ ID NO: 15021 - DNA, 549 bp, Artificial Sequence
  Description of Artificial Sequence: Synthetic coding sequence
atggaatctgccaaagagacgcgttactgtgcggtctgcaatgattatgcttctgggtaccattacggagtctggtcttgtgaggggtgcaaagctttttttaaacgctcaattcagggacacaacgactatatgtgtccagccactaatcagtgtaccattgacaagaacagacgtaaatcgtgccaagcatgcaggctcagaaagtgttacgaggtgggcatgatgaagggtggaattcgaaaagatcggcgcggcggtcgcatgctgaagcacaaactgctacttatcctatcacacatcagacacatgtctaacaaaggtatggaacacttgtatagtatgaaatgcaaaaacgtggtgcccctgtatgacttgttgttggaaatgctggatgcgcacaggctgcacgctcctacctctcgagggggggcctccgtggaagaaactgaccagtctcatctggcgaccgccggctcaaccagctctcatagcctgcagaagtactacattacaggggaggctgagggtttccccgctacagtctag

SEQ ID NO: 15022 - DNA, 255 bp, Artificial Sequence
  Description of Artificial Sequence: Synthetic coding sequence
atgaccatgaccttacatactaaggcctccggcatggcactcctccatcagatccagggtaatgagctcgaaccattgaatcgaccccagcttaagatccctctggagcgccctctcggggaagtctatcttgattcatccaagcctgccgtgtacaattatcctgaaggagccgcatatgaatttaacgccgctgccgcagcaaacgcccaggtttacggccaaacaggactgccctacggacctggatcatag

SEQ ID NO: 15023 - DNA, 1005 bp, Artificial Sequence
  Description of Artificial Sequence: Synthetic coding sequence
atgaccatgacactacatacaaaagcctcaggcatggcattgctgcaccagattcagggaaatgaactggagcctttaaacaggccccagctgaaaataccactggagcggcccctgggcgaggtataccttgatagcagtaaacccgcagtctataattatccggagggtgccgcgtacgaattcaatgcagcggccgcagcaaatgcacaggtgtacggccagaccggccttccatatggccctgggagtgaagcagccgcttttggatcaaacggactcggcggcttccctccgctcaacagcgtctcccctagcccactgatgttgttacatccgccaccccagctgtctccatttcttcaaccacacggtcaacaggtcccatattacttggagaatgagccttctgggtatacagtcagggaggctggtccccccgcattttaccgaaaccagggcaagtgcgtagaaggcatggtggagatctttgacatgctcctggccactagctcgagatttagaatgatgaacttacaaggagaggagtttgtctgtctgaagtccattatcttactgaacagcggcgtttacacattcttaagcagtaccctaaagtccctagaggagaaagatcatatacaccgggtcctcgacaaaatcaccgacactttaatccaccttatggctaaggccggcctgactttacagcagcagcaccagcgtctggcccaactcctcttgattttgagtcatatcaggcatatgtccaacaagggcatggaacacctctatagcatgaagtgtaaaaacgtggtgccactgtatgatttgctcctagaaatgttagatgcgcatcgcctgcatgcacccactagccgaggcggagcaagcgtggaggaaacagatcagagccatctagccaccgccggttccactagttcacattctctccaaaagtactatatcacaggcgaagctgaagggttcccagctacggtgtag

SEQ ID NO: 15024 - DNA, 324 bp, Artificial Sequence
  Description of Artificial Sequence: Synthetic coding sequence
cacaatgattatatgtgtccagccacgaatcaatgtaccattgataaaaatagaagaaaatcatgtcaggcctgccggctgcgcaaatgctacgaggtaggaatgatgaaaggtggatttgtggatctgaccctgcacgaccaggtccatctcctcgaatgcgcctggctagaaatcctaatgattggtcttgtttggaggtcgatggagcatcccggtaaactcctgttcgcgcccaacctcctcctcgaccgcaaccaaggcaagtgcgttgaggggatggtcgaaattttcgacatgctccttgccaccagcagcagatag

SEQ ID NO: 15025 - DNA, 1167 bp, Artificial Sequence
  Description of Artificial Sequence: Synthetic coding sequence
tagctgaagattatcagttgccagccatcggacaagcctgtgcccccaggcgagaatgccccagaatggcgcgctgggcagccaggcagtgcgcctcgctctcactgcggcaggtccgccgctggaccaggacaccggcggccactttgtgatttcaatggcgagggacctaactccgataataggcggcagggcggccgggaacgtctcgctagcacaaacgataaaggaagtatggcaatggagtcagctaaagaaacaaggtactgtgctgtttgcaacgactacgcctctgggtatcattatggggtgtggtcttgcgagggatgcaaagcctttttcaagcggagcatacaagggcataacgactacatgtgtcccgcaaccaaccagtgtactattgacaagaatcggaggaaatcctgccaggcctgcaggctgcgcaagtgctacgaagtgggaatgatgaagggcgggatcagaaaggatagacgaggaggaagaatgctcaagcacaaaaggcagcgtgacgatggtgaagggagaggggaggtgggcagcgccggcgatatgagagctgcaaatctatggccttcacccctcatgattaaaaggagcaagaagaactccctggcgctgtcattgacggcagatcagatggtgtccgccctactagacgctgaaccccccatcctctactccgagtacgatccgacccgccctttctcagaggcgtcgatgatgggcttactgacaaatctggccgatagagagctcgtgcatatgatcaattgggcgaagagagtcccagggttcgtggatttgacactccacgaccaggtgcacctcctcgagtgcgcctggctcgaaattcttatgattggcctggtgtggcgcagtatggagcaccctggcaaactcttgttcgcccccaacctccttctggatcgcaaccagggtaagtgtgtggaggggatggtggagatcttcgatatgcttcttgccacctctagtcgctttcgcatgatgaacctgcagggagaagaattcgtgtgcctcaaaagtatcatactgcttaatagcggtatttcacatgtggaagctaaaaagcgcatattgaatttgcaccctaaaatttttggaaacaagtggttccctcgcgtatag

SEQ ID NO: 15026 - DNA, 813 bp, Artificial Sequence
  Description of Artificial Sequence: Synthetic coding sequence
atgtgccctgccactaaccagtgcacaatagataagaataggagaaagagctgccaagcctgtagactgaggaagtgctacgaagtgggaatgatgaaagggggcattaggaaagatcgccgcggaggaagaatgttaaagcacaaaaggcagagagatgacggggaaggaaggggcgaggtcggatcggcaggagatatgagggcagccaacctgtggccatcaccactgatgatcaagcggagcaagaaaaattctctagcactttcccttactgcggatcaaatggtaagcgctctgctcgatgccgaaccgcccatcctctactccgagtacgatccgacgaggccctttagcgaggcctcgatgatgggcctcctaacaaatctcgctgatcgcgagctagtgcacatgattaactgggcaaagcgggtgccaggctttgtcgatcttacactgcacgatcaggttcatctgttagaatgcgcctggctggagattctgatgatcgggcttgtatggcgctccatggaacatcccggcaaactattatttgctcccaacttattgctggattcaaataaaggaatggagcatctatattccatgaagtgtaagaatgtggttccgctctatgacctgctcctggaaatgcttgatgcccaccggctgcacgctcctacctccagaggcggggcgtccgtcgaggagacagatcagtcacatctggctaccgccggatccacatcttcacactcactgcagaaatattacatcaccggagaggctgaaggtttcccagcaaccgtatag

SEQ ID NO: 15027 - DNA, 1572 bp, Artificial Sequence
  Description of Artificial Sequence: Synthetic coding sequence
atgactatgactctccataccaaggccagcggaatggcactgttgcaccaaatccaggggaacgaactggagcctccacctttaaactcagtctctccttctcccctcatgctgctccatcccccaccccaactcagtccattcctgcagccacatggacagcaagtcccatattacctagagaacgaacctagcggatatactgtccgtgaggcgggtcccccggcattctataggcctaactctgacaacagaagacagggtggcagagaaagactggcttccaccaatgacaagggcagcatggccatggaaagtgcaaaggaaaccaggtactgcgccgtctgcaatgattatgcaagcgggtaccactacggtgtctggagttgcgaaggctgtaaagctttttttaagaggtccatccagggacataatgactatatgtgccccgctacaaaccaatgcacaattgacaagaatagaagaaagtcttgtcaggcttgccgactgcggaagtgctacgaggtgggcatgatgaagggcggaattcgtaaagacaggcgcggggggcggatgttgaagcataaacggcagcgggacgacggggagggccggggggaagtagggagcgctggggacatgcgcgccgcaaacctgtggcctagcccccttatgataaaacgcagtaagaagaactctctggcccttagcctgactgccgaccagatggtctctgcactcttagacgccgaaccccctattctatactccgaatacgatcccacgcgcccattcagcgaggcctcgatgatgggcctcctgacgaatcttgccgatcgcgaactcgttcatatgatcaactgggctaaaagggtacccggttttgtggatctcacactgcatgatcaggttcatctgctggagtgtgcatggcttgaaatcctgatgatcgggctggtgtggcggagcatggagcatccaggaaaacttctgtttgctcccaacctgctcctcgatcggaatcagggaaaatgtgtggagggcatggtcgaaatctttgacatgctactggcgacttctagcagattcagaatgatgaatctccagggagaagagtttgtctgcctgaaaagtattatcttactgaattcaggagtatacacgtttctttcctctacactgaaaagtctggaggaaaaagaccatatccatagggtgctcgataaaattacagacactctcatccatctgatggccaaggcaggattgacccttcagcagcagcatcaaagactggcccagctgctcctgatcctttctcacattagacacatgagcaacaagggcatggaacatctgtacagcatgaaatgcaaaaacgttgtgcctctgtacgatctattgcttgagatgctcgatgcacatcggctgcacgctcccacaagcaggggcggtgcctcggtggaagagaccgatcagagccacttagccaccgcaggctcaacgtcttcccattctctacagaagtactacattaccggagaagcagaagggtttcctgccactgtttag

SEQ ID NO: 15028 - DNA, 1788 bp, Artificial Sequence
  Description of Artificial Sequence: Synthetic coding sequence
atgacaatgacattacacaccaaagcatccggaatggcccttctgcatcagatccaagggaatgagcttgaacctcttaaccggcctcaactgaagataccgctggagcggcccttgggcgaggtgtacctcgactccagtaagcctgctgtctacaattaccctgagggcgctgcctacgagttcaacgctgctgcagccgctaacgcacaagtctacgggcagactggcctcccctacggaccgggctcagaagctgccgcattcggatccaacggactgggcggcttccctccactcaactctgtgtctccatctccactgatgctgctccaccctcctccacagctgtcgccctttctgcaaccacacggtcaacaggtcccatactatctggaaaacgagccctctgggtataccgtgagggaggccggtcctcctgccttctacaggcccaactcagataacagaaggcagggcggcagggagcgtctggccagcacaaatgataagggctcaatggccatggagagcgcaaaagaaacccggtattgcgctgtctgcaatgactacgcaagcgggtatcactacggggtgtggtcctgcgagggatgcaaagcgttttttaaacggtccattcagggacacaatgactatatgtgtcctgctacaaaccagtgtactatcgacaaaaaccgccgcaagtcttgccaagcatgcagactgaggaagtgttatgaagtcggcatgatgaaagggggaatccggaaggatagaagaggtggccgcatgttaaagcacaagcggcagcgcgacgacggggaagggagaggagaggtgggctctgctggggatatgcgcgcagctaatctgtggccaagccctctgatgatcaaaagaagcaaaaagaactccctagccttgagcctgactgctgaccagatggtcagcgccctgcttgacgcagagcctcccatcttgtactccgagtatgaccctacgcggcctttcagcgaggcgtcgatgatggggctcctcaccaacttggcagacagggaactcgtgcacatgattaactgggcaaaaagggtacctgggttcgtggaccttacactccacgatcaggtgcacctgctcgaatgtgcttggctggagatactgatgatagggttagtgtggagaagtatggagcacccaggtaaactcctgttcgcccccaatctcctcttggacaggaaccagggcaagtgcgtggaagggatggttgagatctttgacatgctgctggctacgtcctcacgcttcaggatgatgaatttgcagggggaggagtttgtgtgtttaaaatccatcattctgctgaattccggcgtgtacaccttcttgtcaagtaccctgaaatccttggaagagaaggaccatatccacagggtattggataagatcacggacactttgatccatctcatggccaaggctggcttgaccctgcaacaacagcatcagcggctcgcacagcttttactcatcctgtcccacatccgacatatgtctaacaaggggatggaacacctgtatagcatgaagtgcaagaacgtggtccccttgtatgacctactccttgaaatgctggatgcgcatcgcttgcacgccccaacaagtagaggcggggcttctgtcgaagagactgatcagtctcatcttgccacagctggctccacgtcttcccattctttacagaagtactatatcacaggggaggccgagggttttcctgcaaccgtgtag

SEQ ID NO: 15029 - DNA, 1788 bp, Artificial Sequence
  Description of Artificial Sequence: Synthetic coding sequence
atgacaatgaccctgcacactaaagcttctggcatggccctgcttcaccaaatccaaggtaacgaactggagccgttgaacaggccccagctgaaaattcccttggaacggccactcggcgaggtctacttggacagctcgaagcctgccgtctacaactaccccgaaggcgccgcctacgagttcaatgctgctgccgctgctaatgcacaggtgtatggccagaccggcctgccatatggacctggatctgaagctgccgccttcggttcgaatgggcttgggggctttcccccactcaactctgtctctccatccccactcatgctcctgcacccaccgccccaactcagccccttcctgcagccccatggacagcaagttccgtattatctggagaatgagccatccggatacacagtgcgggaggcaggacccccagccttttacagacctaactcggacaaccgtagacagggcgggagagaacgactagcctctactaacgataaggggtccatggcaatggagtctgccaaggagacccgctactgtgctgtatgcaacgactacgcatccggatatcactatggcgtgtggtcctgtgaaggatgcaaagcgttttttaagcgctctattcagggtcacaacgattacatgtgccctgccactaaccagtgtaccattgataaaaatcggcggaaaagctgtcaggcttgccgcctgcgcaagtgttacgaagtgggaatgatgaagggcggtattagaaaagatagaagaggcggaaggatgctaaaacataaaaggcagcgcgatgacggcgaaggccgtggtgaagtgggcagtgcgggcgacatgagagcagctaatttgtggccctctccattgatgatcaaaagaagcaaaaagaacagtctcgcactcagcctgacagcagatcagatggtatccgccctcttagatgccgaaccacccattctgtatagcgagtacgaccctacaagaccgttctcggaggcaagtatgatgggactgctgacaaatctcgctgatagagagcttgttcacatgatcaactgggcgaaacgcgtccccggcttcgttgacctgacactacacgatcaggtgcacctgctggaatgtgcatggcttgaaattctgatgatcgggttggtttggcggtccatggagcatcctggcaaactgctgttcgctcccaacctactgctcgatcgtaatcagggcaaatgcgttgaaggaatggtcgaaatcttcgatatgctcttggccacaagctcccgctttaggatgatgaatttacagggagaagaatttgtatgcctaaagtccatcattttgcttaactctggcgtgtatacattcctatcttccacacttaagtccttggaggagaaggaccatattcatagagtactggataaaatcaccgatactcttattcacttaatggctaaggcgggccttactttgcagcagcagcaccagaggctcgcccagttactgctgatattgtcacacatacggcatatgagcaataaaggaatggagcatctgtactccatgaagtgtaaaaatgtggtccccctctacgacctgttactcgagatgctggatgcacatcgacttcacgctccaacaagccgcggcggagctagtgtggaggaaacggaccagagccacttggccaccgccggctccactagctctcactcactgcagaaatactacatcaccggagaggcagaaggctttcccgctactgtctag

SEQ ID NO: 15030 - DNA, 348 bp, Artificial Sequence
  Description of Artificial Sequence: Synthetic coding sequence
atgacaatgacattgcacaccaaagcatccggcatggccctgctgcaccaaatacagggcaacgagctggagcccctgaatcggccacagctcaagatacccctggaacgtcctttgggcgaggtgtatctggattctagcaaacccgcagtgtataattatcccgaaggtgccgcctacgaatttaatgcggctgcagccgccaacgctcaggtgtacgggcaaactgggctcccttatggaccaggttctgaagcggctgcgttcggctcaaacggtctgggaggctttccccccctgaactctgtgagccccagtccccttatgctcctgcatcccccaccatag

SEQ ID NO: 15031 - DNA, 1452 bp, Artificial Sequence
  Description of Artificial Sequence: Synthetic coding sequence
atgacaatgactcttcacacaaaggcttccggaatggccctcctgcaccagattcagggaaatgaactggaaccattgaaccgacctcagctcaagatacccctggagcgccctcttggagaggtgtacctcgattccagtaagccagcagtgtacaattacccagaaggggctgcctacgaatttaacgcagccgccgccgccaacgcacaggtgtacgggcaaaccgggctaccctacgggcccgggagcgaagccgcagctttcggaagtaatggtctggggggctttcctcctctgaattccgtttccccttccccattaatgttgcttcacccaccaccccagctgtccccattcctgcagccgcacggccagcaggtgccttactacctggagaacgagccgtcaggatatacagtgcgcgaagcggggccccccgccttttacagaccaaactcagacaacagaagacagggagggcgagaaaggctagctagcacaaacgataaaggaagcatggctatggaatccgccaaggagactagatactgcgcggtgtgcaacgattacgcatcagggtaccattacggcgtttggagctgcgaaggctgtaaggccttttttaagcgctcaatacaaggacacaatgattacatgtgtcctgccacaaaccagtgcaccatcgacaaaaaccggcggaagtcttgtcaagcatgcaggctacgtaagtgctacgaggtgggcatgatgaaaggcgggtttgtagacctgacactccatgatcaggttcacctgctggaatgcgcatggctcgagattcttatgataggcttagtttggcggtctatggagcaccctggcaagctgctgttcgctcccaatttgcttctagacaggaatcagggaaaatgcgtagagggcatggttgaaatcttcgatatgttgcttgcgaccagctcccggttccgcatgatgaatcttcagggtgaggaattcgtctgcctgaagagtataattctgttgaactccggcgtttacacgttcttgtcctcaaccctaaaatctttagaggagaaagatcatatccacagagtgcttgataaaataacagatacattaatccacctgatggctaaggctggcttgactctccaacagcagcatcagcggctggcacaactcttgctgattttgtcccacatccgacatatgtctaataaaggaatggagcacctgtacagcatgaagtgtaagaatgttgtccccctctatgatcttctgcttgagatgctggacgctcatcgcctgcatgcaccgacttctagggggggcgcctcagttgaagagaccgatcagagtcacctagcgaccgcgggctcaacttcctcccacagcttacagaagtactacatcacaggcgaagccgaaggcttcccagccacagtgtag

SEQ ID NO: 15032 - DNA, 933 bp, Artificial Sequence
  Description of Artificial Sequence: Synthetic coding sequence
atggctatggagagcgcaaaagaaactcggtattgtgccgtctgtaacgattacgcctccggataccactatggcgtgtggtcatgcgaagggtgcaaggctttcttcaaacggagcattcaaggacataacgactacatgtgccctgctaccaatcagtgtaccatcgacaagaacaggagaaaatcctgccaagcatgcaggcttagaaagtgctatgaggtcggcatgatgaaggggggaattaggaaggataggagaggtggtagaatgcttaagcataaaagacagcgagacgatggagagggtagaggcgaggtggggagcgctggggatatgcgggccgctaacctgtggccaagccctctgatgatcaaaaggtcaaaaaagaatagcctggcactgtccctaactgccgaccagatggtgtctgctctccttgatgccgagccccctatactgtatagtgagtacgatcctacccgcccattctctgaggcctccatgatggggctgctgactaacctagctgatcgggagttggtccacatgatcaactgggctaaaagagtccccggattcgtggatctgaccttgcatgaccaagtccacttgctggagtgtgcttggttggaaatcctcatgattggcttagtctggcgcagtatggaacaccccggtaagttgcttttcgcccccaaccttctactggataggaaccaaggaaaatgcgtggagggcatggtggagatcttcgacatgctgcttgcaacaagctctaggtttaggatgatgaacctacagggagaggagttcgtttgcctgaaaagcattatcctgcttaattccggaatctcccatgtggaggccaaaaagagaatcctaaacttgcacccgaagatttttgggaacaaatggttcccacgcgtctag

SEQ ID NO: 15033 - DNA, 1320 bp, Artificial Sequence
  Description of Artificial Sequence: Synthetic coding sequence
atggatattaagaattctccaagtagtctgaacagcccttcttcttacaactgtagccagagtattttacccctagagcacggctctatctatattcctagctcatatgtcgattctcaccacgaatatcctgctatgactttttactctccagccgtgatgaactattcaatcccgtccaatgtgaccaatctcgaaggcggtcctggccggcagaccacgagcccaaacgtactgtggccaactcctggacacttgtcacctcttgtggtgcaccgccagttgtcacacctgtacgccgaaccccagaaatctccgtggtgcgaggcccggagcctggaacacaccctgcccgtcaaccgggaaaccttaaagcgaaaggtttcgggcaaccggtgtgcgagcccagtgacagggccgggcagcaaacgcgacgcccatttctgtgccgtgtgctcggattacgccagcgggtatcattatggggtgtggtcctgcgagggatgcaaggcgtttttcaagcggtcaatccagggccacaatgactacatctgccccgcaactaatcagtgcaccattgataaaaatcgaaggaagtcttgccaggcatgtcgccttagaaagtgctatgaagtcggaatggtgaagtgcggctcgcgccgcgagcgttgtggataccggctggtccgcaggcagaggagcgctgatgagcaattgcactgtgccgggaaagccaagcgttcgggggggcatgccccgcgagtccgagaacttctgttggacgccctgtcccctgagcagcttgttctcactctgctagaagctgaaccacctcatgtgctgatctctcgtcctagcgccccttttactgaggcttcaatgatgatgagcctgacaaagctcgcagacaaggagctggtgcacatgatttcatgggccaagaagatccctggaatgtaccccctggttacagctacccaggatgctgacagctcacgaaaattggcccacctgctcaatgctgtcacagacgcactagtgtgggttatagcgaaatctgggatctcatcacagcaacaaagtatgcggcttgccaacctgctcatgctgttatctcatgtccgccatgcctccaataaagggatggaacacctacttaacatgaaatgcaagaacgtagtcccagtctacgatctcctactcgagatgttaaacgcacatgttctgcggggttgcaaatcttcaattactggatctgagtgttcaccagctgaggactcgaagtcaaaggaggggtctcagaatccccaatcacagtag

SEQ ID NO: 15034 - DNA, 1593 bp, Artificial Sequence
  Description of Artificial Sequence: Synthetic coding sequence
atggacatcaaaaactctccatccagcttgaactccccaagtagctataactgcagccaatccatcttgcccttagaacacggcagtatttatattccttcctcatacgtggacagtcaccacgagtatcctgccatgaccttctactctcctgccgtgatgaactactctattcctagcaacgtgaccaatctggagggcggccctgggcgacagaccacttcacctaacgttctttggccaacacccggtcacctgagcccacttgtggttcaccggcagctttcccatctgtatgcggaaccgcagaagtccccctggtgcgaagcaagatccttggaacacactctgcctgtgaaccgtgagacgctgaaacgcaaggtatccgggaaccgatgcgcgagccctgtcaccgggcctggttctaagcgggacgcgcacttctgcgcagtgtgctcagactacgcatccggataccactatggcgtgtggtcttgcgagggttgcaaggctttctttaagcggagcatccaggggcataacgactacatctgtccagcaaccaaccaatgtaccattgacaagaatcgacgcaagtcatgccaggcgtgtagactccgcaagtgttatgaagtgggaatggtaaagtgtggctcccggcgcgaaaggtgtggctataggctggtccgacgccagagaagcgccgatgagcagttgcactgtgctggcaaagctaaacggagcggtgggcacgctccaagggttcgagagctgcttctcgatgcgctgagtccagagcagcttgtactgaccctgctggaggccgagcctccccacgtgctgatatcgagaccaagcgctccatttacagaggcatcaatgatgatgtccttaactaaattggccgacaaggagctggtccacatgatttcttgggctaaaaagatacctggttttgtggagctgagtctgttcgatcaggtgcgattgctcgagtcttgttggatggaagttctgatgatggggctgatgtggcgaagtatagatcacccgggcaagctaatttttgcccctgatctcgtcttagatcgggatgagggcaagtgcgtggaaggcatcctggagatctttgacatgctgctcgcaactacttcccgattcagggagctgaaactgcaacacaaggaatatctctgcgtgaaggctatgattctcttaaactcatccatgtatccccttgtgacggcaacccaggacgcggacagctcaaggaaacttgcccacctgctgaacgctgttaccgacgcactcgtgtgggtgatagccaaaagcggtatcagcagccagcagcagtccatgcggctggccaacctcctgatgcttctcagccacgtacgtcacgcgagtaataaagggatggagcaccttttgaatatgaagtgcaaaaatgtggtgcctgtgtatgatctccttcttgagatgcttaatgcccatgtgcttagaggctgcaaatcctccattaccggcagtgagtgtagcccggccgaagactctaagagcaaggaagggtcacagaacccacagtcacagtag

SEQ ID NO: 15035 - DNA, 1488 bp, Artificial Sequence
  Description of Artificial Sequence: Synthetic coding sequence
atggacatcaaaaattcccctagctcattgaactccccatcttcgtataactgctcccaatcgatccttccgctggagcatggatccatctatattccatctagctacgtggacagccatcacgagtatcctgctatgaccttttattcacctgcagtaatgaactatagcattccatccaatgtcactaacctcgaaggcggtcccggacgccagaccacaagccccaatgtcctgtggcccacccctggtcatttgagtcctcttgtagtgcatcgacagttgtcgcacttatatgccgaaccccaaaaatccccatggtgtgaggcccgcagtctagagcacacactgcccgtgaatagagagactctgaaacgaaaggtctcaggtaatagatgtgcgtctcccgttactggcccagggagcaagagggatgctcacttttgtgctgtctgttcagactatgcgtcagggtaccactacggagtgtggagctgcgagggctgcaaggcctttttcaagcggagtatacagggacacaatgattatatatgccccgccacaaaccagtgtacgattgacaagaacaggaggaagtcttgccaggcctgtagacttcgaaaatgttatgaggtggggatggtgaagtgcggaagccgcagggagcgctgcgggtatcgcctggtgcgacggcagagaagcgccgatgaacaattgcactgtgccgggaaggcaaagagatctgggggacatgcccctagagtgagagagcttcttctggatgcactgtcccccgagcagctcgtgctgaccctcctggaagcggaacccccgcacgtgctgattagtagaccatccgctccgtttacggaggctagcatgatgatgagcttgacaaaactcgccgacaaggaacttgtccatatgattagctgggctaagaagattcccggctttgttgagctatctctgtttgaccaggtgagattgctcgagtcgtgttggatggaagtgcttatgatgggtctgatgtggcgatcaatagaccatcctgggaaactcatctttgcaccggatctcgtcttggatcgcgacgagggcaaatgcgtggagggaattctggaaatctttgacatgctgctggctaccacttcgcgttttcgcgagcttaaactgcagcacaaggaatatctgtgcgtaaaagccatgatcctcctaaacagctcgatgtatcctctagtgacggctactcaggacgctgactcttcccggaaattagctcacttgcttaacgctgtcaccgatgccctcgtgtgggtcatagctaaatcaggaatctccagtcaacagcagagcatgagactcgccaatttactcatgctgctttctcatgtcagacacgcaagagctgagaaagctagtcagacgctcacatcgttcggaatgaagatggaaacacttctccccgaggccacgatggaacagtag

SEQ ID NO: 15036 - DNA, 1446 bp, Artificial Sequence
  Description of Artificial Sequence: Synthetic coding sequence
atggatattaagaattctccctcaagtctgaattcaccaagttcttacaattgcagtcagtccattctccctctcgagcacggcagcatttatattccctcatcgtacgtagactcacatcatgaatatcccgctatgactttctacagcccggccgttatgaattatagcatcccctccaatgtgacaaatttggagggcgggcctgggcgtcagacaacgtctcctaatgtgctttggccaacaccaggtcatctctcacccttggtagtacataggcagcttagtcacctttacgcagaaccccagaagtcaccatggtgcgaagctcgcagcctggaacacaccttgccagtgaacagggagactctgaaacgaaaggtctccgggaaccgatgcgcgagtccggtaaccggccccggcagtaagagggacgcccatttctgcgcagtgtgcagcgattatgcgagcggctatcactacggcgtgtggtcttgtgagggttgtaaagctttttttaagaggtcgatccaaggacacaacgattatatctgtccagcaacaaatcagtgtacgattgacaaaaaccggcgcaaaagttgtcaagcatgcaggctaagaaagtgctatgaagtcggaatggtcaaatgtggtagcaggcgggagcggtgcgggtaccggttggtacgaagacagcggtcagccgatgaacagctgcattgcgcgggcaaggccaaaaggtctggggggcatgccccgcgcgtccgggagttgttgctcgacgcattgtcccccgagcaattggtcctcacccttcttgaagcagaacccccccatgtgctgatttcaagaccgagcgccccatttactgaagctagtatgatgatgagtcttaccaagctagcagacaaagagctggtgcacatgatcagttgggcgaaaaaaattcccggattcgtggaactctctctgtttgatcaggtccgcctgctggagtcctgctggatggaagtcctcatgatgggcttaatgtggcgtagtattgaccacccaggcaagcttattttcgctcctgatttggtgctggaccgcgatgagggcaagtgcgtggaggggattcttgagatattcgacatgttactggcaacaactagccgcttcagggaactgaaacttcagcataaggagtacctgtgtgtgaaggccatgattctgcttaatagctctatgtatcccctagtgactgctacacaagacgcagattcatctcggaaactggcacacctccttaacgcagtcaccgacgcccttgtttgggtaatcgcgaaatccggtatcagttcccagcaacagtctatgaggctggctaatctactcatgctcttgtcccacgttagacatgcccgctggggagaaaagcagtttatccatcttaaactgtcatag

SEQ ID NO: 15037 - DNA, 1488 bp, Artificial Sequence
  Description of Artificial Sequence: Synthetic coding sequence
atggacatcaaaaactctccctcctccctcaactctccttctagctataattgctcacaatcaatcctacctcttgagcatggctctatctacatccctagctcctacgtggatagccatcacgaatatcccgccatgaccttttatagcccagccgttatgaattactcaatcccgtcaaacgtgacaaatcttgagggaggcccgggtaggcagactaccagtccaaacgtactgtggccgacgcctggacatctttcccctttggtggtgcaccgacagctaagtcacctgtacgctgaacctcaaaaaagcccttggtgcgaagccaggtcacttgagcacacccttccagttaaccgggagacactaaaacggaaagtgtcgggcaatcggtgtgccagtcctgttacagggcccggttccaagcgtgacgcccacttctgtgctgtctgttccgactacgcttcaggataccattatggcgtgtggtcttgcgaaggttgtaaggcgttttttaagcgctccatccaagggcacaacgattatatctgtcctgctacaaaccagtgtaccatcgataaaaatcgaaggaaatcctgccaggcctgccggctgcgcaagtgttatgaagtggggatggtcaagtgcggatcccgtagggaacgctgcggctataggctcgtgagacggcaaaggtccgccgacgagcagctgcattgcgccgggaaagccaaaaggtccggcggtcatgccccccgtgtcagggagctgctactggatgctttgtccccagaacagttagtgcttactctgttggaggctgagcctccgcacgtacttatttcccgcccttcagcgccctttaccgaagcctctatgatgatgagtttaaccaaactggctgacaaggagcttgttcacatgatttcctgggccaagaaaatcccaggctttgtagaattgagccttttcgaccaagtgcgtctgttggagagttgttggatggaggtcttgatgatgggactgatgtggcggtccatcgaccatccaggaaaactgatcttcgccccagacctagtactggacagagatgagggcaagtgcgttgagggtattctggagatttttgacatgcttctcgcgactacttcacgtttccgggaactcaaactacagcacaaggaatatctctgcgttaaagccatgatacttttgaatagtagcatgtaccccctggtaaccgctacgcaggatgcagatagttctagaaaactggcgcacctactgaacgccgtcacagacgcactggtgtgggtaatcgcgaagtctggcatatctagccagcagcagtccatgcgcctcgcaaacctcttgatgctgctgagccacgtgagacacgccagggcagagaaggccagccagacactcacatccttcggcatgaagatggagaccctgctgccggaggccacgatggagcagtag

SEQ ID NO: 15038 - DNA, 1542 bp, Artificial Sequence
  Description of Artificial Sequence: Synthetic coding sequence
atggacatcaagaattcgccatccagccttaactcgccgagctcttataattgcagccagtctatcctgcctctggagcacggctctatttatatcccttcaagttatgttgattcacatcatgaatatccagcaatgacattctattcaccggctgttatgaactattccatcccatcaaatgtcacgaacctcgaaggaggccctggccggcagacaactagcccaaacgtgttgtggcccactcccggtcacctgtcaccacttgtggtccataggcaactcagccatctctacgcggaaccccagaagtccccatggtgcgaagcaaggtcgctcgaacacactctgcctgtaaatcgtgagaccctcaagcggaaagtttccggcaataggtgcgcctcacccgtgaccggcccagggtctaaaagggacgcccatttctgtgcagtttgttcagactatgcgtctggttaccactacggggtgtggtcctgtgaggggtgtaaagctttcttcaagcggtcgattcaggggcacaatgactacatctgtcctgctacaaaccaatgcacgatagataaaaatcgtaggaaaagttgtcaggcatgcaggctccggaaatgttatgaggtaggcatggtgaagtgcgggtcccgtagggagcgctgtgggtataggctggtgcgtaggcagcggtcggctgacgaacagctccactgcgcaggcaaagctaagagaagtggtgggcatgcgcctcgggttcgggagcttttgctggatgcactgagccccgaacaactggtgcttacactgctagaggcagagccacctcacgtgttaatctcacgcccgtccgcgccttttacagaagcgagcatgatgatgagtcttaccaaactcgcggacaaggagctcgttcacatgatttcatgggccaaaaagattccagggtttgtcgagctctcactgttcgatcaagtccgacttttagagtcgtgttggatggaagtgttaatgatggggttgatgtggagaagcatcgatcaccccggaaagttaatcttcgcccccgacttagtacttgatcgggacgagggcaagtgtgtcgaaggaatcctggaaatatttgacatgctgctcgcaactacatcccgctttcgcgagctcaaattacagcacaaggaatacctctgtgtgaaggcaatgatactactcaattcctcaatgtaccctctcgtgactgctacacaagatgctgattcgtcaaggaaactcgcacacctgctgaatgctgtgacagacgcactcgtatgggtgattgctaagtcgggaataagttcccagcaacaaagcatgagactggctaatctgctaatgctcctgagtcacgtccggcacgcatcgtccctctcactttcttggaggctcttcatgctcagagaagcgtcttgccacggcgtgcgccaaacgcctggtggggcacacgtttccgttagccgaagtcggtcgttcgaagcctgtcaacagcctcgcgagtag

SEQ ID NO: 15039 - DNA, 1488 bp, Artificial Sequence
  Description of Artificial Sequence: Synthetic coding sequence
atggatattaagaactcaccaagcagcctaaattcaccaagctcctacaactgctctcagtccatactccctctagaacacggaagcatctacatacccagcagctacgtggattctcaccacgagtacccagccatgactttttattctcccgccgtcatgaactacagcatcccctcaaacgtgacaaacttggaaggagggccggggcgccagactactagtcccaacgtactttggccgacccctggccacctctcacccctggttgttcatcggcagctgtcccatctatacgcagagccacaaaaatcaccctggtgtgaggccagaagcctggagcatacgttacccgtgaatagggaaaccctcaaaaggaaggtgtcaggtaaccgctgtgcgagccctgtgacagggcctggatccaagcgagacgcccacttctgtgctgtgtgctctgactatgcatccggctaccactacggggtgtggtcgtgcgaaggttgtaaggctttttttaagcggtcaatccaaggacacaatgactacatctgccctgctacaaaccagtgcacgatcgataagaacagaaggaagagctgtcaggcttgccgactgcgaaagtgttacgaagtcggtatggtcaagtgcggttcgcgtcgcgagcggtgtggctatcgattggtgcgacggcagaggagcgcagacgaacaactgcattgcgcaggaaaagccaagaggagtggcgggcacgccccgcgagtgcgcgagctgttactagacgctctcagccccgagcaacttgttctcaccctgctggaggctgagccccctcacgtgttgatttcgcgacctagtgccccttttacagaggccagcatgatgatgtccctcaccaaacttgctgacaaggaattggtccacatgatatcttgggccaaaaagattccggggtttgtggagttaagtctgtttgaccaggttcggttgcttgaaagctgctggatggaggtcctgatgatgggcctgatgtggagatcaatcgatcaccctggaaaacttattttcgccccagatctagtcctggaccgagacgaaggtaagtgcgttgaggggatacttgaaatcttcgacatgctcctcgctaccactagtaggtttcgcgaacttaaattacagcataaagaatatctttgcgttaaagccatgatcctactgaattcctccatgtaccccctcgtgacggccacacaggatgcagactcttccagaaagttggctcacctgctgaatgctgtgacagacgccctagtctgggtgattgccaagagtggtattagttcccaacaacagagcatgagactggccaacctgcttatgctgctgagccacgtgaggcacgcccgagcggagaaagccagccagacattaactagctttggaatgaaaatggagacccttctgcctgaagccacgatggaacaatag

SEQ ID NO: 15040 - DNA, 1419 bp, Artificial Sequence
  Description of Artificial Sequence: Synthetic coding sequence
atggatattaagaactcgccttcaagccttaactctcccagcagttacaattgttcccagtctatcttgccactggaacacgggtcaatctatattccttcgtcttacgtggactctcaccatgagtatcccgcaatgacattttattcgccagcagtaatgaactattcgattccatctaacgttactaatcttgaaggcgggcctggccgccagaccaccagcccaaatgtattgtggccaaccccgggccatctctcacccctggtggttcaccggcagctgtcacacctgtacgctgaacctcaaaagtctccgtggtgcgaggcacggagtttagaacatacgctacccgtgaatcgggagaccctgaaaagaaaagtaagcggcaaccgctgtgcttcaccagttaccggaccagggtcaaagcgagacgcacatttttgtgcggtatgttctgattacgcctcgggttaccattatggagtctggtcctgtgagggctgcaaggccttcttcaagaggtctatccaaggccacaatgactacatctgccccgctacaaatcagtgtactatcgacaaaaaccgtcggaagtcctgccaggcatgtcgattgcgtaaatgttacgaggtggggatggttaaatgcgggagcagacgtgagcgctgcggctacaggctggtccggcgacagcgaagcgcggacgagcagctgcactgcgcgggcaaggccaagcgctccggggggcacgcgcccagggtaagagaactccttttggacgccctgagccctgagcaattagtgttgactctgctggaggccgaaccccctcatgtcctcatcagccgccctagtgcgcctttcacagaagcatctatgatgatgtcactgactaaacttgccgataaggaattagttcatatgattagctgggcaaagaaaatccccgggtttgtggagctaagcctattcgatcaggtgcggctgctcgaatcctgttggatggaagtgttgatgatgggcttaatgtggaggtcaattgatcacccaggcaagcttatctttgccccagatctggttcttgacagggacgaaggcaagtgtgtagagggtatcttagaaatctttgatatgctcctggccaccacttcgagattccgcgagctgaagttgcagcataaggagtacttatgcgtcaaggcgatgattctcctgaacagcagtatgtatcctttggtcacagctacacaagacgccgactcaagccgcaagctcgcacacctcctaaacgcagtgacggatgcactggtgtgggttatagccaaatccggaatcagttctcagcagcagagcatgcggcttgccaatttattgatgctgttgtcccacgtacgtcacgccagatacgctccatag

SEQ ID NO: 15041 - DNA, 1446 bp, Artificial Sequence
  Description of Artificial Sequence: Synthetic coding sequence
atggatatcaagaattctccctcctccctgaactcaccttcaagctataattgctcacagagcattctcccacttgaacacggctccatctacattccctcttcgtacgtagacagccaccatgagtacccagctatgaccttctactctcccgctgtcatgaactactctataccctctaacgtaactaacctcgagggcggcccgggacgacagaccacgagcccaaacgtgctgtggccaacccccggccatctgtcacccttggtcgtgcacagacagttgtcacacctctacgccgagccacaaaaaagcccttggtgcgaagccaggagtttggagcatacgctcccagttaatagggagactttgaaacggaaagtgtctgggaaccggtgcgccagtcccgttactggaccaggatccaaaagagatgcacatttttgcgccgtatgtagcgattatgcctctggataccactacggtgtgtggagctgcgagggctgcaaagcctttttcaagcgatcaatacagggccacaacgactatatctgtcccgctactaaccagtgtacaatcgacaagaatagacggaagagctgccaggcctgccgccttcgtaaatgctacgaggtgggcatggtcaagtgtggatcccggagagagcggtgtggatacagactcgtgagacgccagagatctgccgatgagcagttgcactgtgccggaaaagcaaaacgatccggcggacacgctcctagagtgagagaattgcttcttgatgcattatctcctgaacagctcgtgctgactctccttgaagccgagcctcctcacgtgctgatttctcgcccctcagccccgtttaccgaggcttcgatgatgatgtctctgacaaaattagcggataaggaactcgtgcatatgatttcatgggcgaagaaaatcccggggttcgtggaactgagcctatttgatcaggtgcggctgcttgagagctgttggatggaggttctcatgatgggcttaatgtggaggtctatcgaccacccaggcaaattaatcttcgcacccgatctcgtgctggatagggatgagggtaagtgcgtcgaaggcattctcgaaattttcgatatgctactggccacaaccagtcggttccgcgagctgaaattacaacataaagagtacctgtgcgtgaaggccatgatcttgctgaattcgagtatgtaccctctggtgacagcaacccaggacgcagacagctcgaggaagcttgcacatctcctaaatgcagttacggatgctcttgtttgggtaatcgccaagtccggcatttcctcccagcagcagtctatgcgtctggccaatctgctcatgttgctgagtcatgtgaggcacgctaggtggggggaaaagcagttcatccacttaaaactgagctag

SEQ ID NO: 15042 - DNA, 1380 bp, Artificial Sequence
  Description of Artificial Sequence: Synthetic coding sequence
atggacggtttctatgaccaacaggtcccctatatggtgacgaattcccagagaggaaggaattgcaacgagaagcctaccaacgtgcgcaaacgcaaattcatcaaccgcgaccttgctcacgattcggaagagttattccaggatctgtctcagctccaagagacatggctggccgaggtcgctttccacggactccctttgaaaatcaaaaaggagcctcactccccctgttccgaaattagctccgcgtgttcccaggaacagccttttaaattctcatatggagaaaagtgcctgtataatgtgagtgcatacgaccaaaagcctcaggtgggaatgcgccctagtaatccaccgaccccatctagtaccccagtgtctcctctgcatcacgcctcacctaacagcactcacactccgaagcccgaccgggcctttcccgcgcatttgcctccctcccagtccataccagattcttcctatccaatggatcatcgattcaggcggcagctgagcgagccctgcaactccttcccacctctgcccaccatgccccgggaagggcggcccatgtatcagaggcaaatgtccgagcccaacatccctttcccaccccaggggtttaaacaggaataccatgatcccgtgtacgaacacaacaccatggttggaagcgcggcctcacagtcttttccaccccccctcatgataaagcaggagcctcgcgacttcgcatacgattctgaagttccctcctgccattccatctacatgcggcaagaagggttcctcgctcacccaagccggacggaagggtgtatgttcgaaaagggccccagacagttctacgacgacacatgtgtggtgccggagaaatttgatggagatattaaacaggagcccggcatgtacagggaaggccccacatatcagcgccgaggtagccttcaactttggcagttccttgtggcattgttggacgacccctccaatagtcactttattgcatggacgggcaggggcatggagtttaagctgattgaaccggaagaggtcgctaggaggtgggggatccagaagaacagaccagcaatgaattatgataagctgtcccgttcattgcgctactattacgaaaaagggatcatgcagaaagtggcaggagagagatatgtttacaagttcgtgtgcgaccccgaagcattattcagtatggcttttccagataatcagaggcccctcctgaagactgatatggaacgccacatcaacgaggaggacacggtgcctctatctcatttcgacgagtccatggcttatatgccagagggcgggtgttgtaatcctcatccctacaatgaagggtacgtatactag

SEQ ID NO: 15043 - DNA, 1380 bp, Artificial Sequence
  Description of Artificial Sequence: Synthetic coding sequence
atggacggtttttacgaccagcaggtaccctatatggtgaccaattcccagcgagggcgcaactgcaacgaaaagccaacgaatgtacgcaaacggaaatttattaatcgagacttagcccatgactctgaggaactgtttcaggatctttcacagctccaggaaacgtggttagccgaggttgcgtttcacgggctgcccctgaaaatcaagaaagaaccccacagcccttgtagcgaaatctcaagcgcctgttcccaggagcaacccttcaaattcagttatggagagaaatgtctgtacaacgtgtccgcatacgaccagaagccacaagtagggatgcgcccctctaacccacctacaccaagctcgacaccagtttctcctttgcaccacgcctcacctaattctacccacactcccaagccggatcgtgcgtttcctgcgcacttgcccccctctcagtcgatccccgacagtagctacccaatggaccataggttccgtcggcagcttagtgaaccctgcaattctttcccccccctgccgactatgccgagggaaggacggccaatgtaccagcggcagatgtccgaacctaatatcccctttccaccccaggggttcaaacaggagtaccatgaccccgtgtatgagcacaacactatggtgggcagtgccgcatcacagtctttccccccacccctaatgatcaaacaggaaccgagggactttgcgtacgactccgaagtaccatcctgtcattcgatttatatgaggcaggaaggattcttagcccatccaagtagaacggaaggatgcatgtttgagaaggggccgaggcagttctacgacgatacttgcgttgtgccagagaaattcgatggcgatatcaaacaggagccaggaatgtatcgggagggacctacataccagagacgaggttcactccaactgtggcagtttctcgtcgctctgctcgatgacccctctaacagtcactttatcgcctggaccgggagaggcatggaattcaagttgatcgagcccgaggaggtggccagacgatggggcattcagaaaaatcgaccggctatgaattatgacaagcttagtaggagtctccgctactactacgaaaagggaatcatgcagaaggtcgccggagaacgctatgtctataagttcgtgtgcgaccctgaagcactgttctctatggcctttcccgacaaccagagacccctgctgaagacggatatggaaagacacatcaatgaggaggacactgttccactgtcacattttgacgaatccatggcttacatgcccgaagggggctgctgcaatcctcacccatataatgaggggtatgtgtactag

SEQ ID NO: 15044 - DNA, 1125 bp, Artificial Sequence
  Description of Artificial Sequence: Synthetic coding sequence
atgcttcaggacctgtctgccagcgttttcttcccaccttgctcacagcacagaacattagctcaagtcccagataatgatgaacaattcgtacccgactatcaagcagaaagcctagcttttcatgggctccccctgaagatcaaaaaggagccacattccccttgtagtgagatctcctctgcttgctctcaagaacagccattcaagtttagttatggcgagaagtgtctgtacaacgttcggtttagaagacagttgagtgaaccctgtaactcattcccacctctcccaaccatgcccagggaagggcgccccatgtaccagagacagatgagcgagcctaatatacccttcccaccgcaggggtttaagcaagaatatcacgatcccgtgtatgagcacaacacaatggtcgggtctgccgctagtcagagctttccaccaccgctgatgatcaagcaagaacctcgggatttcgcatatgatagtgaggttcctagctgtcattcaatttacatgcgccaggaagggtttttggcccacccatcccgtactgagggctgcatgtttgagaagggcccacggcagttctacgacgacacctgcgtggtcccagaaaaatttgacggagacattaagcaggagccaggaatgtaccgggaggggccaacatatcagcggcggggctctctccagctgtggcagtttctagtcgctctcctggacgaccccagcaattctcacttcatcgcctggaccgggagagggatggagtttaagcttattgaacctgaagaggtcgctagacgatgggggattcagaaaaaccgcccggccatgaattacgataagttgtccagaagtcttcgctactattatgagaaagggattatgcagaaggtcgccggagagagatatgtctataaattcgtgtgcgatcctgaagccttattcagtatggcctttccagacaatcaaaggcccctcctgaagactgacatggaacgacacatcaacgaggaggacaccgtgcctctctcccactttgacgagtcaatggcttacatgcctgaaggcgggtgttgcaatcctcatccgtacaacgaagggtacgtgtattag

SEQ ID NO: 15045 - DNA, 1380 bp, Artificial Sequence
  Description of Artificial Sequence: Synthetic coding sequence
atggacggcttctatgatcagcaggtcccttatatggttactaattcacagcgaggtcggaactgtaatgaaaaaccaacaaatgttaggaaacgaaaattcataaatagagaccttgctcacgattcggaagagttattccaggacttaagtcagctccaagagacttggttggccgaagtggcgttccacggccttccactaaagatcaagaaggaacctcactctccatgcagtgaaatctctagcgcctgtagccaggaacagcccttcaaatttagttatggagagaagtgcctatacaatgtttccgcatacgatcagaagccccaagtgggtatgcgtccctccaatccacctacaccatcttccacaccggtgtcacccctgcaccatgccagccctaactccactcacacccctaaaccagacagagcctttcctgctcacctgcctccaagccagtccattcccgattcaagctaccccatggatcatcggtttagacgccagctgagtgaaccatgcaacagttttccacctctgcccacaatgcctcgcgaaggaagaccgatgtaccagaggcagatgtcagaaccgaacatcccgtttccacctcagggcttcaaacaagagtatcatgatcctgtgtatgagcataatactatggttggatctgctgcatctcaaagtttccctccccctctgatgatcaaacaggagccacgcgacttcgcatacgatagcgaagtgccttcctgccactccatctatatgcggcaagaaggtttcttggcacatcccagcaggaccgagggctgcatgttcgaaaaaggtccccggcaattttatgacgatacctgtgtcgtacccgagaagtttgatggtgatataaaacaggagcctgggatgtacagggagggccctacctaccaacgaagaggctcattgcaactgtggcaattcctagtagctctgctggacgatccaagcaattcacattttatcgcttggacagggcgggggatggagtttaagctgattgagcctgaagaggtggctcgccggtggggtatccagaagaatagacccgccatgaactacgataaattatctcgcagcctgaggtattattacgagaagggtattatgcaaaaggtcgccggtgagcggtatgtgtataaatttgtgtgtgatccggaggccctttttagtatggcttttcccgacaaccagcggcctctcctgaagactgacatggagagacacataaatgaggaggacactgtgcctttatctcactttgacgaatctatggcctacatgcccgaaggcggatgttgcaatccccacccctataacgaggggtacgtgtattag

SEQ ID NO: 15046 - DNA, 1434 bp, Artificial Sequence
  Description of Artificial Sequence: Synthetic coding sequence
atggacggattttatgaccagcaggtgccatatatggttaccaattcccagagggggagaaactgcaatgagaagcccacgaatgtgaggaagcgcaaatttattaatcgcgacctggctcacgacagcgaagaactctttcaggacctgagccagctacaggagacatggttggccgaggcccaggtccctgataacgacgagcagttcgtgcctgattaccaagcggaaagcctggccttccatggtctgcctctgaagattaaaaaagagccgcactcaccatgcagtgagatctcatctgcgtgctctcaagagcaaccttttaagttcagttacggagaaaaatgtctgtacaacgtgagcgcctatgatcagaagccacaggtggggatgaggcctagtaacccccccaccccatcttccacacccgtctccccactgcaccatgcctctcctaacagtacgcacacccccaagcctgaccgggctttcccagctcacctgcccccatctcaatccattcccgacagctcctatcctatggatcatcgattccggagacaactttcagagccctgcaactcttttccgccattgccaactatgccacgggagggcaggcctatgtatcagcgtcagatgtccgagcctaacatcccattccctccacagggatttaagcaagagtaccatgacccagtgtacgagcacaatactatggtcgggagcgccgcaagccagtcattccctccccctttaatgatcaaacaggagccgagagacttcgcatacgattccgaagtaccctcctgtcactcaatttatatgcggcaggagggatttttagctcacccctcccgcactgaggggtgtatgttcgagaagggtccgaggcaattctatgatgacacatgcgtagtacccgagaaattcgatggcgacataaagcaggagcctggcatgtatagggagggacctacttatcagcggagagggtcattacaactctggcagttcttggttgccctactggacgatcctagtaactctcacttcatcgcttggacgggccggggaatggagttcaaattaatagagcctgaagaagtggcacgccgctgggggatccagaagaatcggccggccatgaattacgataagctatcccggagtcttcgatactattacgagaagggtattatgcagaaggtcgctggggaaaggtatgtgtataagtttgtctgtgatcctgaggcactgtttagtatggctttcccagacaatcaacgccctctcctgaagaccgatatggaacggcacattaatgaagaagacacggtacccctcagtcactttgatgagtcgatggcttacatgcctgaaggaggctgctgtaacccacacccttacaacgaagggtatgtgtactag

SEQ ID NO: 15047 - DNA, 1260 bp, Artificial Sequence
  Description of Artificial Sequence: Synthetic coding sequence
atgctccaggacctttcagcatctgtgtttttcccaccatgcagtcagcaccgaacacttgtggctttccatgggctcccgctcaaaattaagaaagagcctcatagcccttgctcagaaatctcatccgcatgtagccaggagcagcctttcaagttttcttacggcgaaaagtgcctctacaacgtcagcgcctacgaccagaagccgcaggtgggaatgcgcccatcaaacccacccaccccttctagcacccctgtcagtccacttcaccatgcctctcctaactctacacacactcctaaacccgatagggccttccccgcccacctacctccctcccagagcatccccgactcatcgtatcctatggaccatcggttcagacggcagctatccgagccctgtaacagcttccccccgctgcctaccatgcctcgcgaaggcaggccgatgtatcaaagacaaatgtcagaacccaacatcccatttcctccccagggcttcaagcaagagtaccatgaccctgtctacgagcataatacaatggtcggatccgcagcttcgcagtcctttccaccacctttaatgattaagcaagaaccaagggattttgcttatgacagcgaggtgccgtcttgtcactccatttacatgaggcaagaagggttcctcgctcatccctccagaaccgagggctgcatgtttgaaaaggggccacgccagttctatgacgacacctgcgtggtacccgaaaaatttgacggcgatatcaagcaggaaccagggatgtacagggaggggcccacgtatcagaggcggggatccctgcaactttggcagtttctcgtcgccctgctggacgacccatcaaactcacactttatcgcatggaccggcaggggcatggagtttaagttgattgagcccgaagaagtagcacggcgctggggcattcagaagaacagaccagcaatgaattacgacaaactctctcggagcctccggtactactacgagaaaggaattatgcagaaggtggccggagaaagatacgtgtataagtttgtgtgcgaccctgaggcactcttctctatggcctttcctgacaaccagagacctctgctgaaaactgacatggaacggcatattaatgaggaagatacagtgccactgtcacatttcgatgagtccatggcctacatgccagaaggcggatgttgcaatccacatccttataatgaaggctatgtgtactag

SEQ ID NO: 15048 - DNA, 372 bp, Artificial Sequence
  Description of Artificial Sequence: Synthetic coding sequence
atggatggcttctacgatcaacaggtcccctatatggtaaccaatagccagcgcggtagaaactgtaacgaaaagccgacaaatgtgaggaagagaaagttcattaatcgggacctagcccatgacagtgaagaacttttccaggacctgagccagctgcaggaaacatggctcgccgaggctcaggttccagacaatgatgagcagtttgtcccagactaccaagccgaaagtctggcttttcatgggttgccattaaagattaagaaagaaccacattccccgtgttcggagatttctagcgcatgcagtcaggaacagcccttcaaattcagctacggagagaagtgcctctacaatgtttcagcctag

SEQ ID NO: 15049 - DNA, 1434 bp, Artificial Sequence
  Description of Artificial Sequence: Synthetic coding sequence
atggacggtttctacgaccagcaggttccatatatggtaacgaactctcagaggggtcgtaactgcaatgaaaaaccaaccaacgtgcggaaacgcaaatttatcaaccgggatctcgcgcacgatagcgaggagttattccaggacctttcgcagctgcaggaaacctggctggctgaagcccaggtgccagacaatgacgaacagtttgtgcctgattaccaggcagaaagtctggccttccacgggctacctcttaagatcaaaaaggaacctcattctccgtgttccgagatcagttccgcttgctcgcaagagcagcccttcaaattcagctacggcgaaaaatgcttgtacaacgtgtctgcttatgatcagaaacctcaggtcggaatgagacctagcaatcctcccaccccttccagtacacccgtgtctccactccaccatgcttcccccaactctactcacactccgaagcctgatagagcctttccagcccatctacccccaagccagagtatccctgattcctcctatcccatggatcataggttccgtagacagctctccgaaccttgtaactctttccccccattgccaacaatgccacgagagggccgtcctatgtatcagcgccagatgtcagagccgaacatacccttcccccctcagggcttcaagcaggaataccatgatcctgtgtatgagcacaacacgatggttggcagcgcagccagccagagttttccccccccgctcatgattaagcaggagccgcgggactttgcatacgactctgaggtgcctagctgccactcaatctacatgcgccaggagggtttcctcgcacaccctagccgaactgaggggtgcatgtttgagaaaggtcccaggcaattctacgatgacacctgtgtggtcccagagaagttcgacggtgacattaaacaggagcccggtatgtacagggaaggaccgacgtatcagcgcagggggtccctgcaattgtggcagttcctggttgctctccttgacgaccccagcaattcccatttcatcgcctggacagggcgcggcatggagtttaaacttatcgaacctgaggaggtcgccaggcgctggggaattcagaaaaaccggcccgctatgaactacgataagctgagccgttctctgagatactactacgagaagggcatcatgcaaaaggttgccggagagagatatgtctataagtttgtgtgcgatccagaggctctcttttccatggcctttcctgataaccagcggcccctgctgaagactgatatggaacgccacattaacgaagaagacactgtgccgttgtcccatttcgatgagagcatggcttatatgcctgaagggggctgctgcaacccacacccatacaatgaaggctacgtctactag

SEQ ID NO: 15050 - DNA, 288 bp, Artificial Sequence
  Description of Artificial Sequence: Synthetic coding sequence
atggacggcttctacgatcaacaggtgccctacatggtgactaacagccaaagaggaagaaactgtaatgagaaacctactaacgtgcggaagagaaaattcatcaatagggatcttgcccacgactcagaagagctattccaggacctttcccaactgcaggagacatggctcgctgaggcccaagtcccggacaatgacgagcagtttgtgcccgactaccaggccgagtcacttgcttttcacggactgccacttaaaattaagaaagagccccactcaccttag

SEQ ID NO: 15051 - DNA, 63 bp, Artificial Sequence
  Description of Artificial Sequence: Synthetic coding sequence
atggacggtttttacgatcagcaggtgccatacatggtcactaattcacagcggggcaggtag

SEQ ID NO: 15052 - DNA, 1314 bp, Artificial Sequence
  Description of Artificial Sequence: Synthetic coding sequence
atgctccaggatctgtcagcttcagtattttttcccccttgctctcaacataggactctagcacaggtacccgataacgacgagcaatttgtcccggattatcaggccgaatccctggctttccatggcttgcccctcaaaatcaagaaggagccccacagcccttgttccgaaatatcttcagcttgctctcaggaacaacctttcaaattctcatatggcgagaaatgtctgtataacgtgtctgcctatgatcagaaaccacaggtgggaatgcggccttccaatccacctactcccagcagcacacctgtgtccccattgcatcatgcttcgccaaactccacacatacacccaagccagacagggcattccccgcacatcttccccctagtcagtcaatcccagattcctcatatcctatggatcacagattcagaagacagctgagcgagccctgcaacagctttccacccctcccaaccatgcctcgagagggccgaccaatgtaccagaggcaaatgtcggagcctaatatccctttccctccacaggggttcaagcaggagtaccacgaccccgtgtacgaacacaatactatggtcggcagcgctgcctcacagagctttccaccgccactgatgataaagcaagaaccccgtgattttgcatacgacagcgaggtgccgtcttgccactctatttatatgaggcaagaaggattcttagcgcatccgagtcggacagagggatgtatgtttgaaaaggggccccgccagttttacgacgacacttgcgttgtccctgagaaattcgatggtgatatcaaacaggagccgggaatgtaccgcgaaggccccacttatcaaaggaggggttcattgcagttgtggcagtttctagtcgccctgctagacgatcctagcaattctcactttatcgcatggaccggcagagggatggagttcaagctaattgaacctgaagaggtcgcccggaggtggggaatccagaagaatagacctgccatgaactatgacaagctctctcgcagtctgagatactattacgagaaggggatcatgcagaaggtggctggggaaaggtacgtgtataagttcgtgtgtgaccccgaggcgctatttagtatggcttttcctgacaatcagagaccacttttaaagacagacatggagaggcatattaacgaggaggatacggtgcccctgtcccatttcgacgaaagcatggcctatatgccagaaggcggctgttgcaatccgcacccgtacaacgaaggatatgtatactag

SEQ ID NO: 15053 - DNA, 1365 bp, Artificial Sequence
  Description of Artificial Sequence: Synthetic coding sequence
atggacggattctatgaccagcaggttccttatatggtgaccaactcccagcggggccgcaattgtaatgagaaacccaccaacgtacgcaaacgaaagttcattaacagggatttggcccatgattccgaggagctcttccaggatctgagccagctgcaagagacctggctggccgaggcccaggttccagataatgatgagcagttcgtccccgattatcaggcagaaagcctggcattccacggtctcccgcttaaaatcaagaaggaaccccacagcccgtgttcggaaatctcaagtgcctgttctcaggagcagccctttaagttctcgtatggagagaagtgcctctacaacgttagcgcttatgaccaaaaaccgcaggttggaatgcgccccagtaacccccctactccgtcaagcacgcctgtcagccctctacatcatgcatcaccaaattctactcacactccaaagccagacagggcgtttcctgcacacctccccccttcgcagtctatccccgactcttcctaccctatggatcacaggttcagacggcagctcagtgaaccttgtaactcatttcccccactccctacaatgccacgcgagggtcgtccgatgtaccagagacagatgtcagaacctaatattccatttccaccccaggggttcaaacaagaataccacgaccccgtgtacgaacacaacacaatggttggatctgcggcgagccagtcatttcccccgcccttgatgattaaacaggaaccacgggatttcgcttacgactcagggtgcatgttcgaaaagggcccgaggcagttttacgatgatacgtgtgtcgttccggagaaattcgacggcgatatcaagcaggaaccaggcatgtaccgggaaggtcctacttatcagcggaggggttctcttcaattatggcagttcctggtggcactcctggacgacccgagtaactcacattttatcgcttggaccggacggggaatggaattcaaactgatcgagcctgaggaagtagccagaagatggggtatccagaagaaccgtccagcgatgaactatgacaagttgtcacgatcgcttaggtactactatgagaagggtattatgcaaaaagtggctggcgaaaggtacgtttataagtttgtgtgtgacccagaggctcttttctcaatggcgttccctgataaccagaggccactactgaagacagatatggaaagacacattaatgaagaggatactgtgcctctttcccattttgatgaatccatggcctatatgcccgagggagggtgctgtaatccccacccctacaacgaggggtacgtgtactag

SEQ ID NO: 15054 - DNA, 1455 bp, Artificial Sequence
  Description of Artificial Sequence: Synthetic coding sequence
atggagcggaggatgaaagcagggtacttggatcagcaggtgccttacacattctcatctaagtcacccggcaacgggtcattgcgagaagcgctcatcggcccacttggaaaattgatggatcctggaagcctgccccctctggattcagaagacctgttccaggatctgagtcacttccaggagacttggctggctgaagcacaggtaccagacagtgacgaacaatttgtgcctgattttcattcagaaaatctggcatttcactcaccaacaactaggatcaagaaggagcctcagtctcctcggactgaccctgctctgagttgtagtagaaagcctccgctcccctaccatcacggcgagcagtgcctctacagctcggcctacgacccgccgaggcaaattgccatcaagtcacctgcgccgggtgcattgggacagtcgccgctgcagccttttcccagagcagagcagagaaattttctgcgatcttctggcacatcacagccacatcctggccatgggtacctcggggagcatagcagcgtctttcagcagcctcttgacatatgtcactcatttacctcacaaggaggtgggagggaaccattgcccgccccctaccagcatcaactgagtgagccttgccccccttacccacaacagtcttttaaacaagaataccatgatccactgtacgaacaggctggccagcctgccgtagaccaaggaggcgtcaatggccatcggtacccgggtgcaggcgttgtcattaaacaggaacagaccgactttgcctacgactccgatgtcactggatgtgcatctatgtatctccacaccgaggggttttctgggccatcccccggtgacggcgccatggggtatggctacgaaaagcccttacgcccatttccggacgatgtatgtgtcgttcccgagaaatttgagggggacataaaacaggaaggtgtgggtgccttccgagaggggccaccctatcagcgtcggggcgccctgcagctctggcagttccttgtcgccctccttgatgaccccaccaatgcccactttatcgcctggaccgggcggggaatggaattcaagctcatcgaacccgaagaggtggcacggctgtggggaatccagaaaaaccggccagctatgaattatgacaaattgagccggagcctaaggtattactacgaaaaggggataatgcagaaggtagccggggagcgatatgtgtacaagttcgtttgtgagccagaggcccttttctccttagcattccccgacaatcagcgccctgcacttaaggcggaattcgatcgtcccgtcagtgaggaggacaccgtacctctgtcccacttggatgaatcgccagcttatctacccgagctggccgggcccgcgcagccatttggaccaaagggcggatacagctattag

SEQ ID NO: 15055 - DNA, 1455 bp, Artificial Sequence
  Description of Artificial Sequence: Synthetic coding sequence
atggagaggagaatgaaagccggatatctcgaccagcaggtcccatacacattcagctccaagagcccagggaatgggtcgttgcgagaagccctgatcggcccgctggggaagctgatggacccaggcagtctccccccactggacagcgaggacctgtttcaggatctatctcatttccaggaaacctggctcgccgaagctcaagtgccggacagtgacgaacagtttgtgcctgatttccacagcgaaaatctggcgttccattcgccaaccacacgaataaagaaggagccgcaaagccctcgcacagatcctgctctgagttgctcaaggaaaccccccctgccctaccaccacggtgagcaatgtctttacagctcagcatacgatccaccaagacaaattgccatcaagtcccctgctccaggcgcgctcggacagtccccactgcagccgttccctcgggcagaacaaaggaactttctcaggtcttctgggacatcacagccacacccaggacatggctatcttggggagcacagcagcgtgtttcagcagcctttggatatatgtcattcctttactagccagggcgggggaagagagcctctaccagccccataccagcatcaactctccgaaccatgtcccccctacccacagcagagtttcaaacaggagtatcacgacccactgtatgagcaggccggtcaaccagccgttgatcaggggggtgtgaacggacaccgatacccaggtgcgggcgttgtgatcaaacaggagcagacagatttcgcgtatgactctgacgtgacggggtgcgcctccatgtatcttcatacagagggcttctcaggcccgtcccctggagatggcgcgatgggatacgggtatgagaaacccttacgtcccttccccgatgatgtgtgcgtcgtgcccgaaaagtttgaaggagacattaaacaggagggcgtgggtgcatttcgagaagggccaccttatcagcggaggggggcgctgcaattatggcaatttctggttgcgctgctggacgacccgactaacgcacactttatcgcttggacaggaaggggaatggaatttaagttaatcgagcctgaggaagtggcccgtctttggggcattcagaaaaatcggccagcgatgaattacgataagctgagcagatcacttcggtactattacgagaagggcatcatgcagaaagttgcaggagaacggtacgtctataagttcgtgtgcgagccagaagccctcttctctctcgctttccccgacaaccagcggcccgctctcaaagctgagttcgacagaccagtatctgaggaggacacagtaccgctgagccacttggatgaaagccccgcttaccttcctgaattagcaggccctgcacagccatttgggcctaaaggcggctactcttattag

SEQ ID NO: 15056 - DNA, 1338 bp, Artificial Sequence
  Description of Artificial Sequence: Synthetic coding sequence
atggaccccggatctctaccccccctggatagtgaggatctattccaggatctgagccacttccaggagacctggctggcagaagctcaagtccccgacagtgacgagcagtttgtacccgactttcacagcgagaacttggcgttccattcgcccaccactcgaatcaagaaggagccacaaagccctcgaacggatcccgcactaagctgcagtcgaaagccaccgctgccttaccaccatggtgagcagtgtctgtattcctcagcatacgatcctcctagacagatcgcaattaaaagccccgctcctggtgctttggggcagtcccctttgcagcccttcccacgcgccgaacagcgtaacttcctgcggagttctggcacaagtcagccccaccccgggcacggctaccttggcgagcacagcagcgtgttccagcaaccactggacatttgccattccttcacctcgcagggtgggggaagagaacccctgcctgctccgtaccaacaccaactttctgagccatgtcctccctatccccaacaaagctttaaacaagagtaccacgatccattgtacgagcaagcaggccagccagccgttgatcaaggcggcgtgaatggccaccgctaccccggcgcaggagtcgttatcaaacaggagcagacagactttgcctatgactctgacgtgacggggtgcgcttccatgtacctccacacggagggcttcagtgggccaagccccggtgacggggcaatgggttacggttacgagaaaccactccggccattccctgacgacgtctgtgtcgtacccgagaaattcgagggtgatattaagcaggaaggcgtgggagcttttcgcgaaggccccccataccagcgaaggggcgcgctccaactctggcagttcctcgttgccctcttggatgaccccaccaacgctcatttcatagcctggacaggcagaggcatggaattcaaactgatcgaacctgaagaggtggcacgcttgtggggtattcagaagaacagacccgcaatgaattacgacaaattaagcagatcgctccggtactactatgaaaagggtattatgcagaaagtcgcgggagaacgatatgtgtataagttcgtatgcgagccggaggcacttttttctctcgcctttcctgataatcagcggcccgctctgaaagctgaattcgatagacccgtgagtgaagaggatactgtcccactgtcccaccttgatgaaagcccggcttaccttcctgagctggccggaccggcccaacctttcggtcccaagggagggtatagctactag

SEQ ID NO: 15057 - DNA, 1293 bp, Artificial Sequence
  Description of Artificial Sequence: Synthetic coding sequence
atggaacgcagaatgaaggccgggtatcttgatcaacaggtgccatatactttcagttcgaagtctccaggaaacgggtcactacgggaagcgctgatcggccctctggggaaactcatggatccaggtagccttccacccctcgatagtgaggacctcttccaggatttgtcccacttccaagagacgtggcttgctgaagcccaggtaccagacagcgatgagcaatttgttcccgatttccactctgagaacctcgctttccacagcccaacaaccagaatcaaaaaagagcctcagtcaccacgcactgacccagcgctgtcctgtagccgtaagccccctctgccttaccatcatggcgagcagtgcttatacagcagcagcgttttccaacagcccctggacatatgccattcatttacaagtcaggggggcggaagagaacctctccccgccccttaccagcaccaactcagtgagccctgccctccctatccccagcagtcttttaagcaggagtatcacgatcctctgtacgaacaggcaggccagcctgctgtggatcagggtggggtcaacggtcatcggtacccgggagccggcgtggtgattaaacaggaacagacagacttcgcctacgatagcgatgtgaccggttgcgcatctatgtacctgcacaccgagggcttctccggtccctcacctggcgatggggcgatggggtatggctacgagaaacctctgcgacctttccctgacgatgtttgcgtggtacctgagaaattcgagggcgatatcaagcaggaaggagtgggtgcattcagagaaggccctccatatcagcggaggggtgcactgcagctgtggcaatttcttgtggcactcttggatgacccgaccaatgcccacttcatcgcttggaccggacgggggatggaattcaagctaattgagccagaggaggttgctagattatggggtatccagaagaacagaccagctatgaactacgacaagttgtccagaagcttgcgttactattatgaaaaaggtattatgcagaaggtggcaggcgaacggtacgtctacaagttcgtttgtgagcccgaggctctgttctctctggcatttccagacaatcagcgccctgctctgaaggccgagttcgacagaccggtgtcagaggaagatacggtaccgctgagtcatttagatgagtctccagcatatcttcctgaacttgccggacccgcacagccctttggacccaaaggcggttacagctactag

SEQ ID NO: 15058 - DNA, 1338 bp, Artificial Sequence
  Description of Artificial Sequence: Synthetic coding sequence
atggacccaggttcactgccccccctggactctgaggacctgtttcaggacctcagccacttccaggagacctggctagcggaggcccaggtgccggatagtgacgagcagttcgttccagatttccattctgaaaatttggctttccattcacccaccacacgcattaagaaggagcctcagagcccccgcacagaccccgccctgtcttgctcacgcaaaccacccctgccttatcatcacggagaacagtgcctatactctagcgcttacgatcccccccggcaaatagctattaaatctcccgcccccggagcactgggccaatcccccctgcagccgtttccacgggccgagcagcggaatttcctgcgcagctctggaaccagtcagccacaccctggccacggctatttgggtgaacattcttctgtgtttcaacaaccactggatatttgccactcattcaccagccagggcgggggacgggaaccgctccccgccccttatcagcaccagctctcagaaccctgtcccccatacccccagcagtcctttaagcaagagtaccatgaccctctctacgagcaggccggacagcctgccgtggatcaaggaggagtgaacggacataggtacccgggggccggcgtcgtaatcaaacaggagcagacagacttcgcttacgactccgatgtgactggctgcgcctccatgtatctccataccgagggattttctggccccagccctggagacggagccatgggttacgggtacgagaagcccctgcgaccatttccagacgatgtatgcgttgttccggaaaagtttgaaggagacatcaaacaggagggcgtgggcgcgttcagagagggacctccttaccagcggcggggcgcgctacagctgtggcagttcttggtggcactgttggatgaccctaccaatgcccattttatcgcctggacaggacgcggcatggagtttaagctcatcgagcctgaagaggtcgctcggttgtggggtatacaaaaaaatcggcccgccatgaattacgataagctgagtcgttctcttcgttactattacgagaagggtattatgcagaaagtcgcaggcgagaggtatgtgtacaagttcgtatgcgaacctgaagcactcttctctttggcctttccagataaccagcggcctgcactgaaggcagagttcgaccgcccagtgagcgaggaagatacagtgccgttatcccacctggacgaatcccccgcctacttgcccgaacttgccgggccagcgcagccgttcggtccaaaaggtggctactcgtattag

SEQ ID NO: 15059 - DNA, 1791 bp, Artificial Sequence
  Description of Artificial Sequence: Synthetic coding sequence
atggccggtcggagggtgaatgtgaacgtgggcgtgctcgggcacatcgattctgggaagacagctcttgcgcgagccctgtctacaaccgcctcaacagctgcattcgacaagcaacctcaatcccgagaacgcggaataacgctcgatctgggtttttcctgtttctcagtaccgttgccagcccgactgcgttctagcctcccagaatttcaggctgccccagaagccgaaccagagcctggcgagccattgctacaggtgacattagtggactgtccaggtcacgctagtttgattcgaaccatcatcgggggcgcacagattatcgacctcatgatgctggttattgacgtcacaaagggcatgcagacccagtccgccgagtgcctggtgattgggcagattgcatgtcagaaactggtcgtggtcctgaataaaatcgacctgctgcctgaaggcaagaggcaagcagccatcgacaagatgacaaagaaaatgcagaaaaccttagaaaacaccaaattccgaggcgcccccattatcccggtcgctgcaaaacctgggggccctgaggccccagaaaccgaggctccacagggcatccctgaactgatcgagctcctgacatcccagatcagcatacctaccagagatccaagcgggccatttctcatgtccgtggatcactgtttcagcataaaagggcagggtacagtaatgacaggtacaatcctgagtggctccatatctctgggtgatagcgttgagatccccgcgctgaaagtcgtaaagaaggtcaaatctatgcagatgtttcacatgccaatcaccagtgccatgcagggagacagacttggcatctgtgtcacccaattcgatcccaaactcctggagagagggctcgtgtgtgctccggaaagcctacacacagtccacgccgcgctcatatccgtcgaaaagatcccctactttagggggcccctacagaccaaagcgaagttccatattactgtgggccatgagacggtcatggggcggctgatgttcttttccccagcacccgataacttcgaccaggaacccatcttagactcttttaactttagtcaggagtaccttttccaggagcagtacctatccaaagatttaacgcccgccgtcaccgataacgacgaggctgacaagaaggccggtcaggcgactgaagggcactgtcctagacagcaatgggcattagtagagttcgaaaaaccagtgacatgtcctagactgtgtctggtgattggtagcaggctggatgccgacatccacactaacacgtgtcgcctagcctttcacgggatcttgcttcacggattggaagataggaactatgcagacagctttctacctcgactgaaagtgtacaagctaaagcataagcacgggctggtagaacgtgccatggatgattattccgtgattggtagaagcttatttaagaaagagacgaacatacaactgtttgtcggccttaaggtgcacctgtcaaccggggagctggggatcattgacagcgccttcggacagtctggtaaatttaaaatccacatcccaggcgggctgtctcccgaatccaaaaaaatattaacgcctgcgctaaagaagcgggctcgagccggtcggggggaagctaccaggcaggaggaatcagcagaacgaagcgagccttcacagcacgtagtccttagtttgacattcaagaggtacgtgttcgatacccacaaacgaatggtgcagtcaccatag

SEQ ID NO: 15060 - DNA, 1233 bp, Artificial Sequence
  Description of Artificial Sequence: Synthetic coding sequence
atggctgccgaaattcactcaagacctcagtcttctcgtcctgtgttgctgtcaaagattgaagggcatcaagatgccgttaccgctgctcttttgattcccaaagaagatggggtgattacagcaagcgaagatcggactatccgagtctggctaaagagagacagcggtcagtactggccatccatttaccacaccatggccagcccctgtagcgctatggcctatcaccacgacagtcgtcgaatttttgtgggccaggataatggggcagtgatggaatttcacgtttcggaagatttcaataagatgaattttattaaaacttacccagcacatcagaacagagtaagcgccatcatcttctcgctcgcgacagaatgggtcatcagcaccggacacgacaaatgcgtgtcttggatgtgtacacgcagtgggaatatgttaggccggcacttcttcacctcatgggcgtcatgcctgcaatatgactttgacacccagtatgctttcgtcggcgattatagcgggcagatcacgctgttgaaactggagcaaaacacatgctctgttattacgacactcaaagggcatgaagggagcgtggcgtgtctctggtgggaccccatccagagactgcttttttccggagcctccgataatagcatcatcatgtgggacattggcggaaggaagggtcgtacactactattgcagggccaccacgataaagtgcagtcattatgctacttgcagctgacccgtcagcttgtgtcctgttccagcgacggagggatcgctgtctggaacatggatgtgtcccgggaggaggccccacagtggctggagtccgactcttgtcaaaaatgcgagcagccctttttctggaatattaaacaaatgtgggatacaaaaacgttggggctgcgccagcaccattgccgcaagtgtggccaggccgtatgtggtaagtgttcctcaaagcgaagttcttaccccgtgatgggcttcgaattccaagttagggtatgcgattcttgttacgattccattaaggatgaggaccgcacgtcattggcaaccttccacgaaggaaagcacaacatatcacacatgtctatggacatcgcccgcggcctgatggtgacctgtggcacagaccgcatcgtgaaaatctgggatatgactcctgtagttgggtgtagcctggcaaccgggtttagtccacattag

SEQ ID NO: 15061 - DNA, 1092 bp, Artificial Sequence
  Description of Artificial Sequence: Synthetic coding sequence
atggctggcgacttgtccgccggtttctttatggaggagctcaacacctaccgccagaagcagggcgtcgtattaaagtaccaggaactcccgaatagcgggccacctcacgatcgcaggtttaccttccaagtcataatcgatggacgcgagtttccagagggcgaagggcggagcaaaaaagaagctaaaaacgccgccgcaaaattagccgtcgaaatcctgaacaaagagaagaaggctgtttcccccctgctactcacaactaccaacagttcggagggtcttagtatgggaaactacattggcttgatcaaccggattgcccagaaaaaaaggctgactgtgaattatgagcagtgcgccagtggcgtgcacggaccggaaggatttcattacaaatgcaagatggggcagaaggagtactccatcgggacaggctcaactaagcaggaagcaaagcagctggccgcaaagttagcttatcttcagatcctgagcgaggagacgtctgttaagagcgactatctgagctctgggtctttcgctaccacatgtgagtcgcagtccaactctttagttacctcaacgttagccagtgagtcatcctcagagggggattttagtgccgacactagcgagattaacagtaacagtgacagcctgaactctagctcactgctcatgaatggtttacgaaataatcagcgtaaggctaaacgctcgctagctcccaggttcgacttaccggatatgaaagagactaagtacaccgtggacaaacgctttggtatggattttaaagagatagagttgattgggtccgggggatttgggcaggtgttcaaagccaagcatcggatcgacggaaagacttatgtgattaagcgggtgaagtacaacaatgagagtaagactaaatgtctgtttatccagatggagttttgtgacaaggggacactcgagcagtggattgagaagaggcgcggtgagaagctcgacaaggtgctggctctggaactgtttgagcagatcactaagggagtcgattacatccacagcaagaagaaaaaaaagaaaaaaaaaaaatag

SEQ ID NO: 15062 - DNA, 309 bp, Artificial Sequence
  Description of Artificial Sequence: Synthetic coding sequence
atggctggcgacctttccgccggattcttcatggaggaacttaatacttaccggcaaaaacagggcgtggttttgaaatatcaggagctgcctaactccgggccaccccacgaccgacgcttcacttttcaagtgatcattgacgggcgagagtttccagagggcgaggggcgctccaagaaggaagcaaagaacgccgccgccaaactggccgtagaaatccttaataaagagaaaaaagctgtttctcctctgctgctaaccactacgaatagctcagagggcttgagcatgggcaattatatttag

SEQ ID NO: 15063 - DNA, 1656 bp, Artificial Sequence
  Description of Artificial Sequence: Synthetic coding sequence
atggccggagacctgtccgccgggtttttcatggaggaactgaatacttaccggcagaaacagggagtggtcttaaaatatcaggagctacctaactccggccccccacatgacagacgctttacctttcaagttattattgatgggcgagagttccctgaaggagaaggaaggtctaaaaaagaagccaagaacgctgctgcaaaattagccgtagaaattctcaacaaggaaaaaaaagcagtgtcccctcttctgctgaccaccactaattcctctgaaggactatccatggggaactatattggccttattaacagaattgcccaaaagaaacgcctgacggtgaactatgaacagtgcgcatcaggtgtgcacgggcccgagggattccactacaaatgcaagatgggtcagaaggaatacagtataggcaccgggtctaccaagcaggaagccaagcaactcgctgcgaaactggcatacctgcagatactcagcgaggagacatcagtgaagagcgattacctgtctagtggaagttttgcgactacctgcgagtctcaaagcaactcacttgttacttcgacactggctagtgagtcctccagtgagggggacttctcagcggacacgtcagaaattaactccaactcagacagcctgaacagcagctctcttttgatgaacggcctgcgcaataaccagcgaaaagccaagcgaagtttggcaccccgctttgacctcccggacatgaaggaaacaaagtacactgtggacaagcgatttgggatggacttcaaggagatagagctcattggctcaggcggcttcggacaggtgtttaaagccaagcacagaatcgacggaaaaacatacgtgatcaagcgcgtgaagtataataacgagaaagctgagcgcgaggtgaaggcactcgccaagctcgatcacgtcaacattgtccattacaatggttgctgggacggatttgactacgacccagagacatccgatgattccctcgaaagttccgactacgaccccgaaaactccaaaaattcaagtcgcagcaagaccaagtgtctgtttatccagatggaattttgtgacaaaggcacacttgaacagtggatagagaagaggcgcggggaaaagctcgacaaagttctcgctctcgagctcttcgagcagattacaaagggcgtcgactatatacactccaagaagcttatccacagggatttaaaacctagtaatatcttcctggtcgacacgaagcaagtgaagataggagactttggactggtgacctcactgaaaaatgatggcaagcgaacccgaagcaagggaacactgcgctatatgagccctgagcagattagctcccaagattatggcaaagaggtagatctgtacgccctgggcctcatactcgcagagctgctgcatgtctgcgataccgctttcgagaccagtaagttttttacagaccttagagacggaatcattagtgacatctttgacaaaaaagagaagactctgctccagaagctcctatcaaagaaaccagaagaccggcctaacactagcgagattctgagaactctcaccgtgtggaaaaagtctccagagaagaacgagcggcacacatgctag

SEQ ID NO: 15064 - DNA, 351 bp, Artificial Sequence
  Description of Artificial Sequence: Synthetic coding sequence
atggcaggcgacttgagtgcaggattttttatggaggagctcaatacctatcgtcaaaagcagggcgtggtcctcaagtaccaggagttacctaattcaggtcccccccatgacagacgtttcaccttccaggtcattatcgatgggcgcgaatttcccgaaggcgagggtagatcaaaaaaggaggctaaaaatgcagcagccaagttggctgtagaaatactcaataaggaaaagaaggccgtttctcccttactgttgacaactaccaactctagcgagggcctgtccatggggaattacattgggcttattaacagaatcgctcaaaaaaagcgtttgaccgtttag

SEQ ID NO: 15065 - DNA, 1533 bp, Artificial Sequence
  Description of Artificial Sequence: Synthetic coding sequence
atggcgggtgatcttagcgccgggtttttcatggaagagttaaacacgtacagacagaagcagggcgtcgttctgaagtatcaggagttgccaaatagcggaccaccacacgatcggaggttcacctttcaggtcattatcgatggccgcgaatttccggaaggggaggggaggtcaaaaaaagaggctaagaacgcagccgccaagctggcagtggagattctaaacaaggaaaagaaggctgtgtccccgctgctcctgacgacaacaaatagttccgagggcttgagcatgggcaattatattgggctgatcaaccgcatagcccaaaaaaagagactgacagtgaactacgaacagtgtgctagtggggtacatggcccagaagggtttcactacaaatgcaagatgggtcagaaggagtattccattggcacaggttcaaccaaacaggaggctaaacagctcgcagctaaactggcctatctgcaaatcctgtccgaagaaacctctgtgaaaagtgactatctgtcgtcaggcagcttcgctacaacttgtgaatctcagtctaattctctggtgacgtctactctggcttcagagagtagcagcgaaggggacttttccgctgacacttcggaaattaatagcaattccgatagccttaactcatccagcctgttgatgaatggcctaaggaataaccagcgaaaagctaagcggagcctggctcccagatttgatctgccagacatgaaggagactaaatatactgtggataaaaggaaagccgagcgcgaagtaaaagctctcgcgaagctggaccacgtcaacattgtacactacaacgggtgttgggacggattcgactacgaccccgaaacaagcgatgacagtctggaatcctcagactatgaccccgagaactccaagaacagcagcaggtccaagacaaaatgtctgttcatacagatggagttctgtgataaaggaacgctggaacaatggatcgagaagcgccgcggcgaaaaactggataaggtcctggcactggagttgttcgagcagatcactaagggggttgactatattcatagcaagaaactgatccacagggacctgaagccttccaacatctttctcgtcgacactaagcaggttaaaatcggagatttcggtctcgttacaagtctgaaaaacgatggtaaaagaacaaggtctaaaggtactctgcgctacatgtcaccagaacagatatcttctcaggactacggtaaggaggttgatctgtacgcactggggttaatcctcgcagagctgctgcatgtgtgtgacaccgccttcgagactagcaagttttttactgatctccgagacggaatcataagcgatatcttcgataagaaagagaagacactgctgcagaaattactgagtaagaaaccagaagacaggcccaacacttctgagatcctgagaactctgaccgtgtggaagaagagccccgagaagaacgaaaggcacacttgttag

SEQ ID NO: 15066 - DNA, 4800 bp, Artificial Sequence
  Description of Artificial Sequence: Synthetic coding sequence
atgaacaaggcaccacagtctaccggccccccaccggccccgtctcccgggctgccacaaccggccttcccccccggacagacagccccagtggtgttttctacaccccaggcgactcagatgaacacacctagtcagccgagacagcatttttaccctagtagagctcagccgccctcctccgccgctagccgggtgcagtcagccgctccggctaggcctggcccggcagcgcatgtgtacccagctggatctcaggtgatgatgatcccatcacagatcagctaccccgccagccagggggcctactacataccaggccagggaaggtcaacatatgtcgtgcccacccagcagtacccagtccagccaggcgctcccggattttaccctggcgcttcccccacggaatttggaacatacgctggtgcctactaccccgctcagggcgtacagcagtttcctaccggagtcgctcctaccccagtgcttatgaatcaacctcctcaaatcgctccaaaacgcgaaaggaaaacaattaggatcagggacccgaatcagggcggcaaggacatcacagaggaaattatgtcgggcgcaagaacagcttcaacgcctacccccccacagacaggtggtgggctggaacctcaggcaaacggtgagacaccacaggtggccgtcatcgttcgccccgatgatcgatctcagggagccatcatcgcggacagacctggcctccccggaccggagcactctccctctgaatcacagccctcctcgccaagtccaaccccttctccaagtcccgtgctggagccaggcagcgaacctaatttggccgtgctcagcattcccggcgataccatgactacgatccagatgtctgtggaagaatctacccctatttcccgggagaccggcgagccttatcgactgagccccgagccgacacctctggctgaacccatccttgaggttgaggttacgttgagcaagcctgtgcccgagtctgaatttagcagtagccctctgcaggctcctaccccgctggccagtcatactgtcgagatccatgagcccaatggtatggttccatccgaggacctggagccagaggtcgaaagcagccctgaactggcacccccaccggcgtgccctagcgaatccccagtgcctattgctcccactgcgcaaccagaggaactgttaaatggcgctccgagcccaccagccgtggatctaagcccagtcagcgagccagaagagcaggcaaaagaagtcactgcgtctatggcaccacccaccataccttccgctaccccagccacagcaccttccgccacttctccagcgcaggaagaagaaatggaggaggaagaagaggaggaagagggagaggctggcgaagcgggcgaggccgagagcgaaaaaggcggagaggaactgctgccaccggaatctacaccaattcccgctaatttaagccagaacctggaggctgctgcagccacacaggtggctgtctctgtccccaaaaggagacgcaaaattaaagagctgaacaagaaggaagccgtcggcgaccttcttgatgcgttcaaggaggcaaatcctgcagtgcctgaagtcgaaaatcagccacccgctggttctaacccggggcctgagagcgagggatctggggtacccccacgaccagaagaagccgatgaaacgtgggattccaaggaagacaaaattcataacgctgagaacatccagccaggggagcagaagtacgagtacaagtctgatcaatggaagccgctgaacttggaagaaaaaaagaggtatgatagggaattcttattaggctttcagttcatcttcgcttctatgcaaaagcctgagggactgccccacattagcgacgtagtgcttgacaaagctaacaaaacccccctcaggccactagaccctactcgcttgcagggcataaattgcgggcctgatttcaccccctcttttgccaatctggggagaacaactctaagtacccgcggcccacctagaggtggccctggcggggaactgccccgggggccggcgggactaggaccacggaggtcacagcagggacccagaaaagagccccggaagatcatcgcaaccgtgctcatgaccgaggatattaaattgaataaagccgaaaaggcctggaagccatcaagcaaacgcactgccgcagataaggatcggggcgaggaagacgctgacggatccaagacgcaagacttgtttaggagggtgcgctctattctcaacaagttgactcctcaaatgtttcaacaactgatgaagcaagtcactcagcttgctattgatactgaggagcgcctaaagggcgtcattgatttgatttttgagaaagcaatttccgagccaaactttagcgtggcctatgccaacatgtgccgctgtcttatggccctgaaggtgcccaccacggaaaagcctacagtgacggtgaattttcgcaaactcctgctcaaccggtgtcagaaggaatttgagaaggataaggacgacgacgaagttttcgaaaaaaagcagaaggagatggatgaggcggcgactgccgaggaacgcggcagactgaaggaggagctggaggaagcacgggatatcgccagacggaggtctcttggaaacatcaagtttattggggagttgttcaaactgaagatgctcaccgaagctattatgcacgattgtgtcgtgaagctgcttaaaaaccacgatgaagaatctctcgaatgtttgtgcaggctcctgaccactattgggaaggatctagacttcgagaaggccaagcctagaatggatcagtatttcaaccagatggaaaaaattattaaggaaaagaagactagtagcaggattcggtttatgctgcaggatgtgttggatctccgggggtctaattgggttccgaggcgcggagatcagggccctaaaacaattgaccagatccataaagaagccgagatggaggagcacagagagcacattaaagttcaacagctaatggctaagggtagtgataaaagaagaggaggaccacccggccccccaatatccagaggattgcccctggtggatgatggaggttggaacaccgtgcctatctccaaaggctctagaccaattgacactagtcggctaactaaaataaccaaacccggctcaatcgactcaaataaccaattgttcgctcccggtggccgcctttcatggggtaaaggatccagcggagggtctggggcaaaaccttctgacgccgccagcgaagctgcgcggccagccacatccaccctcaaccggttcagcgctcttcagcaagctgttcccactgaaagcactgataatcgtagagtggtccagcgcagttcactgagccgcgagaggggagagaaagccggcgacaggggcgatcgcctcgagagatctgaacggggcggcgaccgaggggatcggcttgatagagcccgaaccccagccacaaagagatctttcagtaaagaagtggaggaaagaagccgtgagcgcccttcccagccagaagggcttcgcaaggctgcttccctgaccgaggaccgggaccggggcagagacgctgtgaaacgagaggccgcactgccaccagttagccccctgaaggcagcgctctccgaggaggagctggagaaaaagtcaaaggccattattgaggagtacctgcatttaaatgatatgaaggaggccgtgcagtgtgtccaggagctcgcttcccctagccttttatttatttttgtgcgacacggcgtcgagtctaccctagagcggtctgcgatcgcaagagaacatatgggccagctgctacaccagctactgtgtgccgggcacctgtcgactgcacaatattaccaggggctgtatgaaatcctcgaactggcagaagatatggagattgatataccacatgtgtggttgtacctggccgagctggtgaccccaatattacaggaaggaggtgtccctatgggagagctgtttagagaaattacaaagcctctacgccctctgggaaaggcagctagcctcctgctggaaattctcggactgctgtgcaagtcaatggggcccaaaaaggtcgggaccctgtggcgcgaggcgggcctgtcttggaaggaatttctgcccgagggccaggacatcggagcgttcgtagccgaacaaaaagtggaatacactctcggggaagaaagcgaagctcctgggcagagagcacttccttctgaagagctgaatcgccagttagagaagctgctaaaagaagggtcatcaaatcagagggtgttcgactggatcgaggcgaacctgagcgagcagcagatcgtcagcaacacactggtccgcgctctgatgaccgcagtatgctactcggccatcatcttcgaaaccccactgagggtggacgtagctgtgctgaaagcgcgagctaaactgctgcagaaatatctgtgcgacgagcagaaagaacttcaggccctctacgcgctgcaggcactggtcgtcactttggaacagcctccgaacctcctgcggatgttttttgacgccctgtacgacgaggacgtggtcaaagaagatgcattttacagttgggagagctcaaaggacccggcggaacaacaggggaagggagtggcactgaaaagcgtgacagccttcttcaagtggctgcgggaagcagaagaggagagtgatcacaactag

SEQ ID NO: 15067 - DNA, 4803 bp, Artificial Sequence
  Description of Artificial Sequence: Synthetic coding sequence
atgaataaggccccccagtctactggtccacctcctgccccatcacccggcctgccacagcctgcctttcctcctgggcagaccgctccggtagttttcagtacacctcaggctacacagatgaacactcctagtcagcccaggcagcacttctacccctccagggcccagcccccaagtagcgcagccagtcgcgtgcaatcggcagcccccgcgagaccaggtccggccgcccacgtgtatccagccggctctcaggtcatgatgatcccttcacagatctcttacccagcaagccagggagcatactatatccctggacaagggcgtagtacttatgtcgtgcccacgcagcagtatcccgttcaacccggagcaccaggattttatcctggcgcgtcccctaccgagtttgggacttatgctggtgcatactacccggctcagggggttcagcaatttcctacaggtgtggcccccacccccgtgcttatgaaccaacctccacagatcgcaccaaagcgagagcgaaagaccattaggatacgggaccctaatcagggtgggaaagatattactgaggagatcatgagcggtgccaggactgcttccacgcctactcctccacagactggaggtggattggagcctcaagccaacggcgagaccccccaggttgcagtgattgtccggcctgatgatagatcccaaggcgccataattgccgaccgaccagggctccctggccctgaacacagcccgtcagagtctcaaccaagttccccatctcctactccctctccatcacctgtgcttgagcctggttcagaacctaatctagccgtgctgagtataccaggggacaccatgacaaccatacagatgtctgtagaggaaagcacacccatcagccgggagaccggtgaaccgtaccggctcagccctgaacctacccctctggccgagccaattctggaggttgaagtgacactgtcaaaacctgtccctgagtcagaattctcttcttcacccctacaggcgccaacaccgttagcaagccacacagttgagattcacgagccaaatggtatggttcccagtgaggacttagaaccagaagtcgaaagcagtcccgaacttgctcccccccccgcctgcccgtcggagagcccagttcctatcgcaccaacggcacagcccgaagaactgctgaacggcgcgccctcccctccagcggttgatttgagcccagtttctgagccggaggagcaagctaaagaggtgactgccagcatggctcctcccactataccaagcgccacccctgccacggccccaagtgccactagccccgctcaagaggaagaaatggaagaggaagaagaggaagaggagggcgaggctggcgaggcaggtgaagcagaaagtgagaagggcggggaagaattgcttccacccgaaagtacccctatccccgctaacctatcgcagaatctcgaggctgctgccgccacgcaagtggcagtctccgtgcctaagaggcggaggaaaattaaagaactgaacaagaaggaggccgtgggtgatctgttagacgccttcaaggaagctaatccagccgtccctgaagtggagaaccagcctccggccgggtcgaaccccggaccagaaagcgagggcagcggtgtcccacccagacccgaagaagctgacgagacatgggattccaaagaggataagatacataatgccgagaacatccaacctggggaacagaaatatgagtataagtcagaccagtggaaaccattaaatctggaggagaagaaaaggtacgatagagaattcctgctgggcttccagttcatatttgcaagtatgcaaaagcccgagggactccctcatattagtgatgtagtcttagataaagctaataaaacgccccttcggcctctggacccaacccgcctgcagggcatcaattgtggtcccgatttcactcctagttttgcaaatcttggaagaaccactctgagcactagaggtcccccgaggggcggccccggcggcgagcttccccgcggccctcaagcaggcttgggccccaggagatcccaacaggggccccgtaaggagccacgcaagataatcgctacggtattgatgaccgaggatatcaagctcaacaaggctgaaaaggcatggaaaccatcaagtaaacgaaccgccgcagataaagatcggggagaagaggacgctgatgggagcaagacgcaggatctgttccggcgcgtcaggtccattctgaacaagctaaccccccagatgttccagcagctgatgaaacaggtgactcagttagctatcgacacagaagaacgtctgaagggagtgatcgatttaattttcgaaaaagccatcagtgaaccgaacttcagtgttgcctacgccaatatgtgccgctgcttgatggcacttaaagtccctacaacagagaagcccaccgttaccgtgaattttcgcaaactgcttctgaacagatgtcagaaagagtttgagaaagataaagacgacgacgaggtgtttgaaaagaaacagaaagagatggacgaggccgctaccgccgaggagaggggaagactgaaagaagaactcgaagaagctagggacattgctcgcaggagatccctaggaaacatcaagttcataggcgagctctttaaactgaaaatgctgaccgaagcaattatgcatgactgtgtggttaagttgctcaaaaaccatgatgaggaatcactggagtgcttatgtcgccttctcactactatcggtaaggatttagattttgagaaagccaagcctaggatggaccagtacttcaatcaaatggagaagataataaaggaaaagaagactagcagccggataaggttcatgcttcaggacgtactggacctgcgggggtctaactgggtacccaggagaggcgaccagggacccaagacgatcgaccagatccataaggaggcagagatggaggaacaccgcgagcacatcaaagtgcagcagttgatggccaagggatccgacaagcggcgtggcggcccgcccgggccgcccatttcaagaggactcccccttgttgacgacggaggatggaacaccgttccgatttccaaaggtagcaggcccatcgatacctcaaggctaaccaagattactaaaccaggatccattgattccaataaccaactgttcgcaccaggcggcagattaagctggggtaaggggagctccgggggaagtggagccaaaccctctgacgccgcctcagaggctgcaaggcctgccacctcaactctgaataggttcagtgcactgcagcaggctgtgcccaccgagtcaactgacaaccgccgtgtggtacaacgtagtagcctctctcgcgagcggggggaaaaggcaggagacagaggagaccgactcgagcggagcgaaagaggtggggaccggggggaccggctagatcgagcgcgcacaccagcgacaaagcggtccttctctaaggaggtcgaagaaagaagcagggagcggccatcacagcctgaaggtctgagaaaggcagcctctcttactgaggaccgggatcggggacgcgatgccgtgaagagggaagcagcgctgcctccagtgtctcccctcaaagccgccctctctgaagaagaactcgaaaaaaagagcaaagcaatcatagaggaatatctgcatctgaatgacatgaaagaagccgttcagtgcgtccaggagctcgcctccccctccctgctcttcatttttgttcggcatggggttgagagtaccttggaaaggtccgcaatcgccagagagcatatgggacaactgctccaccagctactctgtgctggccacctcagcaccgcccagtattatcaagggctgtacgaaatcttggagctcgccgaagatatggaaattgatattccccatgtttggctctatctggctgagctagtaactcccatcctccaggaggggggggtccccatgggggagctctttcgagagattacgaaaccacttcggccattaggtaaagcagcaagtcttctacttgaaatattgggcctgctttgcaaatccatggggccaaagaaggtgggtacactctggcgggaagccggactcagttggaaggagttcctcccagaagggcaggacattggggcgtttgtagcagaacagaaggttgagtataccttgggggaggaatccgaggcacccggccagagggccctcccgtctgaggagctcaatcgtcaattagagaagttactcaaggagggctctagcaaccagcgagttttcgactggatagaggcaaacctttctgagcagcagattgtcagtaacacactagttcgggctctgatgacagctgtgtgctacagtgccatcatttttgagactccgttacgcgtggacgtggctgtgctgaaggcacgagccaagttgctgcagaagtacttgtgtgatgaacaaaaagaactgcaggcactgtacgccctccaggcgctggtggtgactctggagcagcctccgaacttattgcgcatgttcttcgacgctctttatgatgaggacgtggttaaagaagatgcgttttatagctgggaatccagcaaggatcccgccgagcagcaagggaagggagtggctctgaagagtgtgacagcgttcttcaagtggctgagggaggccgaggaggagagtgatcataattag

SEQ ID NO: 15068 - DNA, 4800 bp, Artificial Sequence
  Description of Artificial Sequence: Synthetic coding sequence
atgaacaaggctcctcagtctaccggcccgcctcccgccccttcacctgggttgccgcagcctgcattcccccccggccagacggcccccgtagtgttttccaccccccaggcaacccagatgaacactccatcacagccacggcagcacttctacccctcacgggcccagcctcccagctctgccgcttcacgtgtacaatctgctgcacccgcacgtccagggcccgcggcacacgtctacccggcagggagccaggtgatgatgattccctctcagatctcataccccgccagccaaggtgcctactacataccagggcagggaagatctacctacgtcgtgcctacacagcagtaccccgtacagcccggtgcccccggattttaccctggggcaagtccgacggaattcggtacttacgctggcgcctattatccggctcaaggcgtgcagcagtttcccaccggcgtagcaccaactcccgtactcatgaaccagcctccccaaatcgcccctaagcgtgagcgcaagacaatcaggatcagagacccaaatcagggcgggaaggacataacagaggaaattatgagtggcgcaaggaccgccagcacccctacacctccacaaacaggaggtggcctggagccccaagccaacggtgaaacaccgcaggtggcagtaattgttcgcccagacgacaggagccagggagctatcattgctgaccggcccgggctgcctgggccagagcacagtccatccgagtcccagccatcctcgccttcaccaactccaagcccgagccccgtgttggagcctggcagcgaacctaacctagccgttctaagcatcccaggcgacacaatgaccactatacagatgtctgttgaagaatccactcccatttctagggagacaggcgagccataccgtctatctcccgaacctactcccctggccgaacccattctcgaggtggaggtgaccctctctaagccagtcccagagtccgagtttagcagcagtcctctacaggcacccaccccacttgccagccacacggttgaaatccatgaacccaatgggatggtgccttcagaagatctggagccggaagtggagtcaagtccggaactggccccaccaccggcttgtccttccgaatctccagttcccatagcccctacggcccagccagaggagctgcttaatggtgccccgtctccacctgcggtggaccttagccctgtctcagagccggaagaacaagcaaaggaggtaaccgcctccatggcgccacctactatcccctccgccacaccagctacagcgccctcagccacctccccagctcaagaagaagagatggaggaagaggaggaagaggaagaaggcgaggccggagaggcaggcgaagccgagtccgagaaagggggagaagagctgctccctccagagagcacacctatccccgcaaaccttagccagaatctggaggctgcggccgctacgcaagttgccgtgtcggtgccaaaaaggaggcgcaagatcaaagagctgaacaaaaaagaagcggtcggtgatctgctggacgctttcaaagaggcgaatccagccgttcctgaagttgaaaatcaaccccctgccggatctaatccagggccagagtctgaggggagcggcgtgccacccaggccggaagaggccgacgagacatgggattccaaagaggacaagatacacaacgccgagaacattcaaccgggcgaacaaaaatacgaatacaagagcgatcagtggaaaccgcttaacctggaggaaaaaaaaagatacgacagagaatttttacttggattccaatttatctttgcctctatgcagaaaccagaagggctgcctcatatctctgatgtagtgctagacaaggccaataagacaccactgaggcccctggaccctacccgactgcaggggatcaactgtggcccagatttcaccccctcatttgctaacctgggaagaaccacactgtcgactcggggcccccctcgcggtggcccagggggtgagctgccccgcggtcctgccggtttgggcccacgaaggtctcagcagggacccaggaaagagccaagaaaaattattgccaccgtccttatgacggaggatatcaaactgaataaggccgaaaaggcctggaagccatcgagtaagcgcacggccgctgacaaagaccgcggtgaggaggacgcagacggctctaaaacccaggatctctttcgacgcgtacgctctatcctcaacaagttgactccccagatgttccagcagctgatgaaacaggtaactcagctggcaattgacactgaggagcggctaaaaggggtcatcgacttgatatttgagaaggccatcagcgagcctaacttctccgtggcttacgcaaacatgtgtcgctgtttgatggcgcttaaagtgccaaccactgagaaacctaccgtaacagtgaacttcaggaaattactgctgaataggtgccaaaaggagttcgaaaaggataaggacgatgatgaggtctttgagaagaagcagaaagagatggatgaggcagcaacagcagaggagcgaggcagactcaaagaagaacttgaggaagctagggatatcgcacggaggagatcccttggtaatatcaaattcattggcgagctctttaagctaaagatgcttacggaggccattatgcatgactgtgttgtcaagttgctgaagaatcacgatgaagagtccctagaatgcttatgcagactccttaccacaatcggtaaggacctcgactttgagaaggccaaaccgagaatggaccaatacttcaaccagatggagaagatcatcaaagagaaaaaaacctcttctaggattcgatttatgctccaggatgttttagatttaaggggctccaattgggtcccaaggcgcggggaccaagggccaaagaccattgaccagatccataaggaggccgagatggaggagcaccgcgagcatattaaggttcaacagctcatggcgaaaggtagtgataagcgacgcggaggcccgccaggcccacccattagcagaggccttcctctcgtggacgatggcgggtggaacacggttccgatctcaaagggttctagacccatcgataccagcaggttgactaagattaccaagccaggctccatcgactcgaataaccaactctttgcgcccggcgggcggctctcatggggaaaaggcagcagtggtggctccggggccaaaccatctgatgccgctagtgaagcggcccggccggcaacatcaaccctgaatcgcttttcagctctacagcaggccgtgcctaccgaaagcaccgacaatcgtcgcgtggtccaaaggtcttccctgagtagggaaagaggcgagaaggccggagataggggagacagactcgagcgatcagagaggggtggcgacaggggggatagactggacagggcacgaacaccagccaccaaacgcagtttttccaaggaggttgaggaacgttcacgcgaacgcccaagccagcctgaggggcttcggaaagccgcatcccttactgaagatagggatcgcgggagggacgcggttaagagggaggcggcgttgccaccagttagccctctcaaagccgctctctctgaggaagagctcgaaaagaagtccaaagctattatagaagaatatctgcatctcaacgacatgaaggaagccgtgcagtgcgtgcaggagctggcaagccctagtttgctctttattttcgtgcggcacggggtggagagtacacttgagcgcagcgccattgccagagaacacatgggacagctgctccaccagctgctctgcgccggacatctctccacggcacagtactatcaggggctgtatgagatcctggaactggctgaggacatggaaatcgatattccccacgtttggctgtacctcgcagagctagtgacccctatactgcaggaggggggggtgcccatgggcgagctgtttcgggaaatcacaaaacctctgagacccttgggcaaagcagcctctttgttattggaaattttgggtctgctgtgtaagtctatgggaccaaagaaggttgggactctgtggcgcgaggccggtctaagctggaaagagtttcttcctgagggtcaggacattggggcattcgttgccgaacagaaggttgaatacacactgggcgaggagtctgaggcacccgggcaacgggctttaccctcagaggaactgaatcggcaacttgagaaactactcaaggagggttcctccaaccagagggtctttgattggatcgaggcgaatcttagcgaacagcagattgtcagcaatactcttgtacgagcccttatgaccgcagtttgttactccgcaattattttcgaaacacctttaagggtggatgtagctgtgctgaaagccagggctaaactgctccagaaatatctctgcgatgagcagaaggagctccaggctttatatgcactccaggcgctcgtcgtgaccctcgagcagccgccaaaccttttacggatgttttttgacgccctgtacgacgaggatgtggtgaaagaagatgcattctactcatgggagagcagcaaagatcccgccgaacagcagggtaagggggtggctctgaagtccgtgaccgccttcttcaagtggttgcgtgaagcagaggaggagagcgaccacaactag

SEQ ID NO: 15069 - DNA, 4308 bp, Artificial Sequence
  Description of Artificial Sequence: Synthetic coding sequence
atgaaccagccaccacagatcgcccccaaaagagaaagaaaaacaatccggatcagagacccaaatcagggcggaaaagatattacagaggagatcatgagcggtgctaggactgccagcacacccacccctccacagactggcggtggccttgaaccgcaggctaatggggaaacgcctcaggtcgcggtgattgtgaggcctgacgacagatctcagggagcaattatcgcagaccgcccgggcctgcccgggccagagcacagcccctctgagtcacagccttcaagtccatcaccaaccccatctccaagccctgtgttagagcccggctctgaaccgaatctcgctgtcttatccatccccggcgatacaatgaccaccatacagatgtccgtcgaggagtcgactcctatctcacgtgagacgggagaaccctaccggttgtctcctgagccaaccccactcgcagaacccatcctggaggtggaggtgacactctctaaacctgtccccgagtctgaattcagttcgtctccactacaagcccctacgcccctcgccagtcacactgtggaaatccatgagcctaacggtatggtaccatccgaggacctggaacctgaggttgagagcagtccggagctggccccaccgccagcatgtccaagtgagagtcctgtgcctatagcacccacagcacagccagaggaactgttgaacggagccccatccccgcccgcagtcgacctgtctcccgtgtcagaacccgaggaacaggcaaaggaagtgactgcctctatggcccctccaactattccctctgccacgccggctaccgcgcccagtgccacgtcaccagcccaggaagaggaaatggaggaggaagaggaagaagaggagggagaagccggggaagccggagaggctgagagtgagaaaggcggcgaagaactgctgccgcctgaatctactccaatccccgctaatctgtcccaaaatttagaagcagcggccgccactcaggtggccgtgagcgttcccaagagaagacggaagattaaggaattgaacaaaaaggaggcagttggcgacctcctcgatgccttcaaggaggccaatccagcagtccctgaagtggaaaaccagccgccagcaggctctaaccctggtcctgaatccgagggctcaggcgtgcccccccgtcctgaagaagcggacgaaacctgggattcaaaggaggataagatacataacgccgagaacatccagccgggcgaacaaaagtatgaatataagagcgatcagtggaagccactgaacctggaagagaaaaagagatacgatcgggaatttctgcttgggtttcaattcatatttgcatctatgcaaaagccagaggggctcccccacatcagtgatgtggtgctggataaggccaacaagaccccgttgcgaccactggacccaacccgactgcaggggattaactgcggccccgactttacaccctcatttgctaacctgggtcggacaacactgtctacccggggcccgcctcgaggtggccctgggggagaacttcctagggggccagccggcctaggaccaagacgctcacaacagggacctcgaaaggagccgcgaaagattattgcgaccgttttgatgactgaggatattaagcttaataaggccgaaaaggcgtggaagccaagcagcaaaagaaccgcggccgacaaagataggggagaagaagatgccgacggcagcaagacacaggacctctttaggcgagtgcgttctattctgaataaactcactccccagatgtttcagcagctcatgaaacaggtgactcagttggcaattgacaccgaagaacggctaaaaggggtgattgatctcatttttgagaaggctattagtgagccaaacttcagtgtagcctacgctaatatgtgcagatgcctgatggctttgaaggttcctaccacagaaaaaccaaccgtcactgtgaatttccggaagctgcttctgaatagatgtcagaaagagttcgagaaggacaaggacgacgatgaggtgtttgagaagaagcagaaagaaatggacgaagcagccactgctgaggagagagggcgactaaaggaagagctagaggaggcccgggatatagcccgccgcagatcgctgggcaatatcaaattcatcggagagctttttaaactgaagatgctcactgaggctattatgcatgactgcgtggtgaaactcctcaaaaatcatgacgaagaatctctagagtgcctttgtcggctcctcaccaccatcggcaaggatcttgatttcgagaaagccaaacctagaatggatcagtacttcaaccagatggaaaagatcatcaaggaaaaaaaaacttcaagccggatccggtttatgttacaggacgttctagacctgagaggctcaaactgggtgccccgtcggggtgatcaggggcccaaaactatcgaccaaatccacaaggaagcagagatggaagagcaccgggagcacatcaaggttcagcagttaatggcgaaaggctccgacaagcgacggggcggacctccagggcccccgatctcccgaggtctcccgcttgttgacgacggaggttggaacactgtcccaatcagtaagggaagcagaccgatcgacacctctcgcttgaccaagattaccaagccaggctccattgacagcaacaaccagctctttgccccaggtggcaggctgtcctgggggaagggatcatctggcggctcgggtgcgaaaccatcggacgcagcttcagaggctgcgcggcccgctacgagtactctgaatcgattcagcgcactgcagcaggccgtgcctaccgagagcactgacaatcgaagggttgtgcagaggtcttctctgtccagagagcggggcgagaaagccggcgaccggggtgatagactggagcggtccgagagggggggagacagaggcgaccgtctggatcgcgctcgcacccctgccacaaaaagaagtttcagcaaagaggtcgaggaaagatcccgggaacggccctcacaaccagagggcctccgtaaagctgcctctctgacagaggatcgtgataggggcagagatgccgtcaagagggaagccgctctgccccccgtctccccattgaaagcagctctgtccgaggaggagcttgaaaaaaagtccaaggcgatcatcgaagaatacttgcacttgaatgacatgaaagaggcggtgcaatgtgtccaagagctggcctccccatcactcctttttatctttgtccgacacggggtggaatctaccttagaaagaagcgccatagcccgagaacatatgggtcaactactgcaccagctgctgtgtgcgggccacctgtccaccgctcaatactatcagggcctctatgaaattttagaactagccgaggacatggagattgatatcccccacgtctggctgtacctcgccgaactggtaactccaatcctgcaagagggcggagtaccaatgggcgagttgtttcgggagataactaaacccttacgccctctgggcaaagccgcctctttactcctggagatccttggactcctgtgcaaatcgatgggcccgaagaaggtgggcacactgtggagagaagcagggctgtcctggaaagagtttctgccagagggacaggatatcggagccttcgtggcagagcagaaggtcgaatacactctgggagaagaaagcgaagcacccggccagcgcgcgctacccagcgaagaactgaacagacagctggaaaaactgttgaaggaaggatcctctaatcaacgcgtctttgattggattgaggcgaatttgtcagagcagcaaatcgtctctaatactctggtgcgggcgttaatgacagctgtgtgctactctgccatcatcttcgaaactccgttgcgggtcgatgtggcagtgctgaaagcaagagctaaactcctacagaagtatctgtgtgatgaacaaaaggagctgcaggctctgtatgcactgcaagcattggtcgtaactctggaacagcctccaaatctcctgcgaatgttctttgacgctttgtacgacgaagatgtagtcaaagaggatgctttttattcatgggagagcagcaaggaccccgcggagcagcaaggcaagggtgtggccttgaagtcagtcactgcgttttttaaatggctcagggaagcggaggaagaatccgaccataactag

SEQ ID NO: 15070 - DNA, 4821 bp, Artificial Sequence
  Description of Artificial Sequence: Synthetic coding sequence
atgaacaaagcgccacaaagtacaggacccccacccgctccgtcccctggtctacctcagccagccttcccacccggacaaacggctccggttgtgttctctacaccacaagcaacgcagatgaacacgccctcgcagcctcgccaaggcgggttcaggagtctgcagcacttttacccttcccgcgctcagccgccttcctctgctgcttcaagggtgcaatccgctgctcccgccaggcccggtcccgctgcccacgtctacccagccgggtcacaggttatgatgattccatcccagatctcttaccccgcctcccagggcgcatattatatcccaggccaggggcgttccacatacgtggtccctacccagcagtatcctgtccagcctggcgcccccggtttctaccccggggccagccctactgagtttggaacgtatgctggtgcctattatccagcccagggggtgcagcagttccccactggggtggcccctacgccagtgctcatgaaccagccacctcagatcgcccctaaaagagaacggaagaccataagaattagggaccccaaccagggtggcaaagacattaccgaggaaatcatgtcgggcgcacgcaccgccagcacgccaacgccacctcagacaggagggggacttgaaccccaagccaatggggagacaccccaggtagcggtcatcgtgcgcccggacgaccgctcacagggagctattatcgctgaccgcccaggacttccaggccctgagcacagcccatctgagtcccagccttcttcaccctcgcctacacccagcccctcaccagtccttgaacccggatctgagccgaatctggcggtgttgagcatacctggggacactatgacaaccatacagatgtccgtggaggaatctacgcccatctctagggagaccggcgagccatatagattgagccccgaaccaaccccactggctgagcccattttagaggtcgaagtgactttatccaaaccagtccccgagtccgaatttagcagctccccgctgcaggctcccaccccactcgcatctcacaccgttgaaatccacgaaccgaatggcatggtgccaagcgaggatcttgagcctgaggtcgagagcagccccgaattggcccctccgccggcgtgccctagtgaaagccccgttccaatcgcaccgacggcccagccagaagagctgctgaacggcgcacccagcccaccggccgtggatttaagccctgtgtctgagccagaggaacaagcaaaggaggtgaccgcctcaatggccccaccgactattccgtcggctactcctgcaaccgcaccctcagcgaccagcccagctcaagaggaggaaatggaagaagaggaggaagaggaggagggcgaagccggcgaggccggtgaggctgagtcagagaaaggaggggaggaactgctgcccccagagtctacaccgatccccgccaacttgtcacagaacttagaggccgccgctgcaactcaggtggctgtatctgtccctaaacgcaggagaaagatcaaggagctcaataaaaaggaagccgttggcgatctcctggacgcctttaaggaggccaatcctgctgtcccggaagtcgagaaccagcctccagccgggagcaatcctggacctgagtctgaggggtctggggtaccaccacgccccgaagaggctgatgaaacatgggactctaaggaagacaagattcataatgcggaaaacatccagccgggcgagcagaagtatgagtacaagagcgatcagtggaaaccacttaatttggaggagaaaaaacgatacgatagagagtttcttttaggattccagttcatatttgcatccatgcagaaacccgaaggtctgccacacatttccgacgtcgtattggataaggcgaataaaacaccattgcggcctctggaccccacgaggctccagggtataaattgtggacccgacttcactccctcattcgcaaacctggggcgcaccacactctccactcgcggtcctcctagaggggggcctggaggggaattgcccaggggtcccgccggcctgggtcctcgccgcagtcagcagggaccgaggaaagagccacggaagattatcgccacagtgttaatgacagaggacatcaaactcaacaaagcagagaaggcctggaaacccagctcaaaacgaacggcggcagacaaagatcgtggtgaagaagatgctgacgggagcaagactcaagatctgtttaggcgggtccgcagtatcctgaacaaattgactcctcaaatgttccagcagctaatgaaacaggtgacacagctggcaattgacaccgaagagaggctgaagggggtgatagacttgatatttgaaaaggctatatccgagccgaatttctctgttgcctacgcaaatatgtgccgctgccttatggccctgaaggtgccaactacagaaaagcccacggtgaccgttaactttcgcaaactgctgttaaatcgctgtcagaaagagttcgagaaggataaagatgatgatgaagtgtttgaaaaaaagcaaaaagagatggatgaggccgcgaccgcagaagagaggggtagactgaaagaagagcttgaagaggctcgcgacatcgcccgtcgacgatctctggggaatatcaagttcattggcgagttgtttaaactgaaaatgcttacagaggctatcatgcacgactgcgtggtgaagttgctaaagaatcacgatgaagagtctcttgaatgcctgtgcagacttctgaccacaatcgggaaggacctcgattttgagaaagctaaacctcgaatggaccagtacttcaaccagatggagaagataattaaagagaaaaagacttcaagcaggattagattcatgttacaggacgtcctagatctccgagggagtaattgggtgccacgaagaggggatcagggtccaaaaactattgatcagatacacaaggaagccgaaatggaggaacatagggagcacatcaaagtgcagcagttgatggccaaaggctcggataaacgtcggggcggccccccagggcccccaattagccgcggtctgcctctggtggacgatggggggtggaataccgtccctatcagcaagggctctcgcccaatcgatacctcccgcttaaccaagattacaaaacctgggtctatagacagtaataatcagttgttcgcacccggtgggcgacttagctggggtaaaggatccagcgggggtagtggcgccaaaccaagcgacgctgcctcagaagctgcccgacctgccacttcaactttaaatcgcttcagtgctcttcaacaggcggtgccaacagagtcaacagataatcgcagagttgtccaaaggtctagtctgagtagagaaagaggcgaaaaagcaggagaccggggggatcggttggaacggtctgagagagggggcgatcggggagaccggcttgaccgggcacgcacccctgccaccaagcgaagttttagcaaagaggtcgaggagagaagtcgcgaacggccctcccagcctgaaggtctgaggaaggcagcctctctgaccgaagatcgagatcgcggtcgcgacgcagtcaagagggaggctgctctaccgccagtcagccctctgaaagccgccctgagcgaggaggaactggaaaagaaatccaaggccattattgaagagtatctgcaccttaacgacatgaaggaggcggtgcagtgcgttcaagagctagcatcaccgagtctgcttttcatctttgtgcgtcatggcgtggaaagtacactggagaggagcgccatcgcgcgcgagcacatggggcaactactgcaccagctgctgtgcgccggccatctaagtactgcccagtactatcaaggtttatatgagatactggagttggcggaggatatggagatagacatacctcatgtgtggttatacttggccgagttggtgacacctattctgcaagaagggggggtgcccatgggggaattgtttagggagataacaaagccactcaggcccttgggcaaggccgctagtctgctgctcgagatcttaggcctgctttgtaaatctatgggcccgaaaaaggtggggacgttgtggcgagaagcagggctgtcatggaaagagttcctgccagaaggtcaggacattggggcgttcgtggccgaacaaaaggtggaatatacgctaggagaggaatccgaggcacctggccagcgggccctgcccagcgaggagctgaatcgtcagctggagaagctgttaaaggaaggatcctctaatcaacgagtatttgattggattgaagctaacctcagcgagcagcagattgtgtcgaataccttagtgcgagcactgatgacagctgtgtgctattccgccattatctttgagaccccactgagagtcgacgtcgcagtcctcaaagccagggccaaacttctccagaagtacttgtgcgacgagcagaaggaattacaagccttatacgctcttcaagccctggtggtgaccctggagcaaccccccaatctgcttcgtatgttcttcgatgccctgtacgatgaggatgttgtgaaagaggacgcattttactcctgggagtccagtaaggatccagccgaacagcaaggtaagggggttgccctgaagtccgttactgcttttttcaagtggttgcgggaagctgaagaggagagtgatcacaattag

SEQ ID NO: 15071 - DNA, 4821 bp, Artificial Sequence
  Description of Artificial Sequence: Synthetic coding sequence
atgaataaagcccctcagtccaccgggcctccccccgcgccctcacctgggctcccacagccggcctttcccccaggccagactgcgccggtcgtgtttagcacaccgcaggctacccagatgaatacgccatctcagcccaggcagggtggctttcggtccttgcaacacttctatccttctcgcgcccagcccccaagctccgccgcttcacgggtccagtcggccgctccagcacgacccggcccggcagcacacgtgtaccctgctggctcccaggttatgatgattccctcgcagatcagttatcctgccagccagggcgcatattacatccccgggcagggacgaagcacctacgtggtgcccacccagcaataccctgtgcagccaggagcaccgggcttctaccctggggcgtcccccactgaatttggcacatatgccggagcttattatcctgcccagggggtccagcagtttccaaccggcgtggcgcccacccctgttctgatgaatcagccacctcaaatcgcacccaagagggaacgcaagacgatccggattagggatcctaaccagggcggaaaagatatcaccgaggagatcatgtctggagccaggaccgcatctactcccactccccctcaaactggtggaggcctggaaccccaggccaatggagagactcctcaggtagcggtcatagtgagaccggacgaccggagtcaaggtgctatcatagcagatcggccaggcctccccggacctgagcactccccaagcgaatcacagccttcgagtccgtctcctacaccttctccctcacctgtcctagagccggggagcgagcccaatcttgccgtgctgagcatcccaggagacaccatgacaactattcaaatgtcagtggaggagagtacacctatctctagagaaactggtgaaccctaccgactttccccagaacctacacccctcgcagagcccattctggaggtggaggtaactctttccaagcccgtgcctgagtccgagttctcaagtagtcctctacaggccccgacacctctagcatcacacaccgttgagatacacgagcccaatggcatggttccatcagaggatctcgaaccagaggtcgagtcatcacctgaactggcaccacctcctgcatgtccttcggagagccctgtcccaatcgcccccacagcccagccagaagagctccttaacggcgccccgtcaccgcccgcagtggacctgtctcccgtatctgagccagaagagcaggcaaaagaggtgaccgcgagcatggccccacccaccattcccagtgccacacctgctacagccccatctgctactagtcctgctcaggaggaagagatggaggaagaggaagaggaagaggagggggaggccggcgaggccggtgaagccgagtctgaaaaaggcggggaagagctccttccacccgagtctacccctatccctgcaaacctctcccaaaatttggaagcggccgccgcgacccaggtcgccgtgtccgtacctaagcgaaggcgaaaaatcaaagagttaaataaaaaagaagccgtgggtgacctgctggacgcattcaaggaggcgaaccccgccgtgcccgaggtggagaaccagcccccggctggcagtaatcctggaccggaaagcgaagggtctggggtgccaccacggcctgaggaagccgatgagacctgggattctaaggaagacaagatccataatgcggagaatatccaacctggggaacaaaaatacgagtacaagtccgatcaatggaagccccttaacttggaagaaaaaaagcgatatgatcgcgaattcttgctcggttttcaatttatcttcgccagtatgcagaagcccgaaggtctgccgcacatcagtgacgtggtgctggacaaagccaataagacccccctgaggcccctggaccctactcggttgcagggaattaattgtggcccggacttcacaccttccttcgccaacctgggcagaacgaccttgagtacacgaggccctcctcgtggagggccaggtggagagctccctcgcgggcccgccggcctcggacctaggcgcagccagcaggggccccgaaaagaaccacgcaagataatcgcaaccgtcctcatgacagaagatattaaactgaataaggctgaaaaggcctggaaaccttcctccaagcgaacggccgctgataaggaccgcggcgaggaggacgctgacgggagtaagacgcaggatctgttcaggcgggtgcggagtatcctcaataagctgacaccgcagatgttccagcaactaatgaagcaggtgactcagttggcaatagatacagaggagaggctgaagggagtcatcgacctaattttcgagaaagccatctcagaacccaatttctccgtggcctacgccaatatgtgcaggtgtctcatggcgcttaaggtgcctactacagaaaagcccacagtcaccgtcaactttagaaagctgctgctgaaccgatgccaaaaagagttcgagaaagacaaagacgatgacgaagttttcgagaagaaacagaaagaaatggacgaagcagctactgccgaagagcgcggtcgtctcaaggaggagctcgaggaggctcgagacattgcgcggcgaagatccttaggcaatatcaaattcatcggggagctctttaagcttaaaatgttaaccgaggccattatgcatgattgcgtggtaaaactgctcaagaatcatgatgaagagtccctcgagtgtctctgcaggctccttactaccatagggaaggatcttgacttcgagaaggccaagccccgcatggatcaatattttaatcagatggagaaaattattaaggaaaaaaagacctcaagcaggatcagatttatgctacaagacgttctcgatctacggggatctaattgggttccaaggaggggggatcaggggcccaaaaccatagaccagatccacaaggaagccgaaatggaagaacatagggagcacataaaagttcagcagcttatggccaaaggatctgacaaacgaagggggggccctcccggacccccaatttcccggggcctaccactagttgatgacggcggctggaatacagttccaatctccaaagggagtcggccaatcgacacaagcaggctgaccaaaatcacaaagccagggtcaatagactcgaataatcagttatttgcccctggcggcaggcttagctggggaaaggggtcttcaggaggatccggcgccaaacccagcgacgcggcctctgaagccgcacgacccgcgacaagcacactcaatagattttctgcactgcaacaagctgtgcccactgagagcaccgataacagaagagttgttcaaaggtctagccttagccgggagcgcggcgagaaggcaggcgatcgcggcgatcgattggagaggtcagagcgcgggggcgaccgtggtgacaggctggatcgggctcggaccccggcaacaaagaggtctttcagcaaagaagttgaagaaaggtctcgggagcgaccttcccagcccgaaggactgaggaaggccgcttctctgacggaggaccgggacagagggagagacgccgtgaagcgagaagccgcactgccccctgtgtctcccctgaaggccgctctgtctgaagaagaacttgagaagaaaagcaaggctattatagaggagtacctccacctgaatgatatgaaggaagctgtgcaatgcgttcaggaactcgcgtctccctccctgctgttcatcttcgtacgccatggagttgagtccactctggagagaagtgctatcgccagagagcacatgggtcaactgttgcaccagttgctttgtgccgggcacctgagcacggctcaatattaccagggcttgtatgaaatcctggaactggctgaggatatggaaatcgacatccctcacgtgtggttgtatcttgctgagctggtgactccaatactccaggaaggaggtgtgcccatgggggagctatttcgggagattaccaagccgcttcgacctcttggaaaggccgcttctttgctccttgagatcctggggctgctgtgtaaaagcatgggtcctaaaaaagtgggtaccctttggagagaagcagggctttcgtggaaggagtttctgccggagggtcaggacatcggagcttttgtcgctgaacaaaaagtcgaatacactctgggcgaggaatctgaagctccggggcagagggctttacccagtgaggagttaaaccggcagctggagaagctcttgaaagaaggaagtagcaatcaaagggttttcgattggatagaggccaaccttagtgagcaacagattgtgagcaatactctcgtccgtgcacttatgaccgctgtttgctatagtgctatcatctttgagactcccttaagagtggacgtagcagtgttaaaggcccgggctaaactcttacagaagtatctttgtgatgagcagaaggaactgcaggctctgtatgccttgcaggcgcttgttgtcaccctggagcaaccccccaacctgctgcgaatgttctttgacgccctctacgacgaggatgtggtgaaggaggacgctttttactcatgggagagtagcaaggacccagctgaacaacaaggcaaaggtgtcgctctgaaatctgttactgctttcttcaaatggctcagagaagccgaagaagagtccgatcacaattag

SEQ ID NO: 15072 - DNA, 4539 bp, Artificial Sequence
  Description of Artificial Sequence: Synthetic coding sequence
atgatgatcccctctcaaatctcgtatccagcctctcagggagcttactacatcccgggacagggaaggtctacctacgtggtgcctacccagcagtacccagtccaaccaggcgcccctggcttctaccctggcgccagccctactgagttcggcacctatgctggtgcgtactatccagcacagggcgtgcagcagtttccaactggagtagcccctacacctgtgttgatgaaccagccgccacagatcgcacctaagcgcgagaggaaaactattaggatcagagatccaaaccaggggggaaaagacattacggaggagattatgtccggagcgcgaacagcctctaccccaactccaccccagacaggaggcggactggagccacaggctaatggggaaaccccacaggtggcagtgattgtcagaccagacgacaggtcacagggggcgatcatagctgatcgaccaggcctaccaggacctgagcacagtccctcagagagccagcccagctcaccttctccaacaccatccccgtctcctgtcttagaaccaggatccgagcctaatctggcagttctcagtattccaggggatacgatgaccacaatacagatgtctgtcgaggaatcaaccccaataagcagagaaactggcgaaccgtatcgcctctcccccgagccgactcccctggctgaacctatccttgaggtcgaagtgactctcagcaaaccggtgcccgaaagcgaattctccagcagccccctgcaggcccccacccctttggctagccacaccgtcgagattcacgaacctaacgggatggtgccatctgaggatctggaacctgaagtagagtcatcccctgagctggccccgccaccggcatgtccctccgagtcccccgttcccattgctcctactgctcagcccgaggaactactcaacggcgcgccatccccacccgccgtggacctatctcctgtaagcgagcccgaagaacaggctaaagaggtgacagccagcatggcacctccaacgattcctagcgccactcctgcaactgcaccgagcgcaacaagccctgctcaggaagaggagatggaagaagaagaggaggaagaagagggggaagccggtgaagccggagaggccgaaagcgagaaagggggtgaagagctgttgccccccgagtctactccaatccctgctaacctaagtcaaaaccttgaagccgcggcggcgacacaggtcgccgtgtccgtccctaagcgtagaaggaaaattaaagaattaaataaaaaggaggcagtgggagaccttttggatgcatttaaggaggctaaccccgctgtcccagaagtggaaaatcagcccccagctggctccaaccccggtccagaatctgagggttctggcgtgccgccccgccccgaagaggccgatgaaacctgggattctaaagaggataagatccacaacgccgagaatattcagcctggtgagcaaaaatatgaatataagtcagaccagtggaagcccttgaatctggaagaaaaaaaacggtatgaccgtgaatttctgctcgggttccagtttatcttcgcctcaatgcagaagccagaaggcctgccacacatctccgacgttgtgctcgataaagcaaataagacccctctcagaccactagacccaacgcgcctgcaggggataaactgcggaccagacttcacccccagttttgctaacctgggaagaaccaccttgtcaacccgtgggccacctagaggcgggccgggcggggagctgcccagggggccagctggacttggtcccagaaggtctcagcagggccctagaaaggagccaaggaagatcatcgccactgtgctgatgactgaagacatcaagctaaataaagctgagaaagcatggaagcctagctcaaaaaggacggccgctgacaaggatagaggggaagaagacgccgatggatcgaagacccaggacctgttcaggcgggttcggtctatcctgaacaagctcaccccccaaatgttccagcaactgatgaagcaggtaactcaattagcaattgacactgaagaacgcctgaaaggcgtgatcgatttaatcttcgagaaagccatttctgagcctaatttctctgttgcttatgccaacatgtgtcgctgtctcatggcgttgaaagtgcctaccaccgagaagcctactgtcactgtcaactttcgtaaattactactcaacaggtgccaaaaggagttcgaaaaggacaaggacgatgacgaagtgttcgagaagaagcaaaaagagatggacgaggccgccacagctgaggagaggggtcgtctaaaagaagaactggaagaagctcgagatattgcgcgcaggcggtccttggggaatatcaagtttattggagagttattcaaacttaaaatgctgaccgaagccatcatgcacgactgcgtagtgaagctcctgaagaatcacgacgaagagtccctggaatgcctttgtcggcttctgaccaccattgggaaagatttggacttcgaaaaggcaaagccaagaatggatcagtactttaatcagatggaaaaaattattaaggagaagaagacctccagccggattcgtttcatgctacaggatgttcttgatctacgaggctcgaactgggtgccgaggaggggtgatcaaggaccaaagaccattgatcagatacacaaggaagccgagatggaggagcatcgagagcatattaaagtccagcagcttatggcaaagggatcggacaagcggaggggaggtccacccgggcccccaataagtcgcggcttacctctcgtagacgacggaggctggaatacggtgccaatatcaaagggctccagacctatcgacacttctaggctgactaaaataactaaacccggcagcattgattcgaataaccagttgtttgcgccgggcggcagactgtcctgggggaaaggtagtagtgggggctccggagccaaaccgagcgacgctgcttccgaggctgctagaccagcaacctccactttgaataggttcagcgccctgcagcaggcggttcctaccgaaagcacagataaccgcagggttgttcagaggtccagtcttagtcgcgaacgtggggagaaggctggagacagaggcgataggctggagaggtctgagagaggcggggatcgcggagatcgtctggacagggcaagaacgcctgccacaaagaggtcattcagcaaggaggtggaggaaaggagccgcgagaggcctagtcagccagagggactgcgcaaggcagcaagtctgacagaagatagggacaggggcagggatgccgtcaagagagaggctgccctcccccccgtgagccccctgaaagctgcccttagcgaggaggaactcgaaaaaaaaagcaaagcaatcatcgaggaatatcttcaccttaacgatatgaaggaggccgtgcagtgcgttcaggagctggctagccctagcttgttgttcatattcgtccggcacggggtcgagagcacccttgaacggagtgcaatagcccgagaacacatgggtcaattgctccaccagctgctttgtgctgggcacctatctaccgcccagtactaccaaggactctatgaaatcttggagctagccgaggatatggagatcgatatccctcatgtctggctttacctggcggagcttgtgactcccatattgcaggagggcggagtgcccatgggagagctcttcagggagattacaaagccactgaggcccctgggcaaggctgcttctctgttgctggagatactgggcctcctgtgcaagtccatgggtcccaagaaggttggcaccctctggcgcgaggcaggcttgagctggaaggaattcttgcccgaaggtcaggacatcggtgcattcgtggcagaacaaaaggtggagtataccctaggggaagagagcgaagcgcctggccagcgcgctctgccctctgaggaactcaatagacagctcgagaagctgctgaaggagggctcctctaatcaaagggtattcgactggatcgaagcgaacctctccgaacagcagattgtatccaatactcttgtgcgggctctgatgacggctgtctgctacagcgccattattttcgagacaccactcagggtggatgtagctgttttgaaagcgagggctaaactcctacaaaagtatctctgtgacgaacagaaagagctgcaggccttatatgccttacaggccctggttgtgaccctggaacaacctcccaacctgctgaggatgttctttgatgccctttacgacgaggatgtagttaaagaggatgccttttattcttgggagtcaagtaaggaccccgcagaacagcaggggaagggcgtcgctctgaaatctgtgaccgctttcttcaagtggcttagagaggccgaagaggagtcggaccacaattag

SEQ ID NO: 15073 - DNA, 4539 bp, Artificial Sequence
  Description of Artificial Sequence: Synthetic coding sequence
atgatgatcccttctcaaataagttacccagcgtctcagggtgcttactatattccaggccaggggagaagtacctacgtggtgccgacacagcagtatccagtccagcccggcgcacctggattttatcctggagcgtcacccactgagtttggaacctatgcaggcgcttattatccagcgcaaggcgttcagcagttccctacaggtgtggcacctacacccgttctgatgaaccagcctccacagatcgccccaaaacgggaaagaaaaaccattagaattcgtgatccaaatcaagggggaaaggatattacagaggagatcatgagcggtgcccgaaccgcctcgacccccactccccctcaaaccgggggaggactggagccacaagcaaacggcgagactcctcaagtggccgtgattgtaaggccagatgaccgtagccagggcgcgattatagccgaccgcccaggattgccgggcccagaacactcaccctcagaaagccagccatcatcgccctctccaacacccagcccgagtccggtcctcgagcctggttccgaacctaacctggccgtactcagtattcccggagacacaatgactaccatccaaatgtctgtagaagaatccactcccatcagcagagaaacgggggagccttatagactgagcccagaaccaaccccgctcgcagaacccatcctggaggtggaagtgacacttagcaagcctgtccccgagagcgagttctcttcatcgcctttgcaggccccaacgcccctcgcgtctcataccgtagaaatccacgaacctaatgggatggtccctagcgaagacctggagcccgaggtggagtcttctcctgaactagcacctcccccagcttgcccctcagaaagccctgtacctattgcccctacggcccagccagaggaactgctgaatggcgcacccagcccccccgctgtggatctgagtccagtgtctgaaccagaggagcaggccaaagaggtcaccgctagcatggcaccacctactatcccctccgccacccctgccacggctccttccgccacgtcacccgcacaggaggaggagatggaggaggaggaggaagaggaagagggagaggcgggcgaggctggagaagccgaaagcgaaaagggaggtgaggagctactaccccctgagtccacacctatccctgccaatctgtcccagaacttggaagctgccgctgccactcaggtggccgttagcgttccgaaacgtcgtcgaaaaataaaggaactgaacaaaaaggaggcggtgggtgacttattggatgcgttcaaagaagcgaaccctgccgtgccagaagtggagaaccagccccccgcagggtcgaaccctgggcctgaatccgaaggcagcggcgtgccccctcgccctgaggaagcggacgagacttgggacagcaaagaggacaaaatccataacgccgaaaatatccagcccggcgagcagaagtacgaatacaaaagcgatcagtggaaacctctgaacttggaggaaaagaagcgttacgaccgcgaatttctgttaggcttccaattcatttttgctagtatgcagaagccagaaggactaccccatatctctgacgtggtgctggacaaggcgaacaagacaccgctgcggcccctggacccaacaagactgcaggggatcaactgcggaccagattttactccaagcttcgcgaaccttggccggaccacattaagcacacggggccccccccgcggtggaccaggaggggagctgcctcgcgggcccgcagggctcggcccgcgacgatcccagcagggccctaggaaggagccaagaaagatcatagccactgtgctgatgacagaagatatcaaactgaacaaagccgagaaagcttggaagccatcctctaagcggacagccgcagacaaagatcgcggtgaggaggacgcggacggctcgaaaactcaggatctgttcagacgcgtgcgctctatcctgaacaagttgacaccccaaatgttccagcagcttatgaagcaagtaacccagctggctatagataccgaagagcgccttaagggagttattgacctcatctttgaaaaggcaattagtgagcccaacttttcagtggcttatgccaatatgtgccgatgtctgatggccctgaaggtgcctacaacagaaaaacctactgtcacagtgaacttccgcaagctcctgcttaacagatgccagaaggagtttgagaaggacaaggacgatgatgaagtctttgaaaagaagcagaaggaaatggatgaggctgcaactgccgaagagcgcggtaggctgaaggaagagcttgaggaagcccgcgacatcgcccgccgtcggagtctgggaaacataaaatttattggcgagctgttcaagcttaagatgctgaccgaagccattatgcacgactgtgtggtgaaactgctgaagaaccatgacgaagagagcctggagtgcctttgtaggctcctgaccactatagggaaggacctggactttgagaaagcaaagccacgcatggaccagtactttaaccaaatggaaaagatcataaaagagaagaagacttctagtcggattagatttatgcttcaggacgtcttggatttgcgcggaagtaactgggtaccacgccggggcgatcagggccccaagaccattgaccagatccacaaggaagctgagatggaggagcacagagaacatattaaggtgcagcagttgatggccaaaggaagtgacaaacgtcggggtggacctcctgggccacccatttcacgggggttgcccctcgtggatgacggagggtggaacaccgtgcctatttctaaaggcagcaggccgatagacacgtcacgacttaccaaaattaccaagccaggctccatagacagcaacaaccaactattcgccccagggggccgactgagctgggggaaagggagtagcggaggcagtggagccaagccgtctgatgccgcatctgaagcagcaagaccagctacaagcacactcaataggtttagcgccctgcagcaggctgttcccaccgaatctaccgataaccggagagtcgtgcagagatcaagcctgtccagagagaggggggagaaagccggagatcggggcgaccggcttgagcgcagcgagcgcgggggggaccggggggatcgtttagacagggcacgaacacccgcaacaaagcgctcgttctccaaggaggtggaggagagaagtagggagcgacctagccagcctgagggactgcgcaaggctgcctccctcaccgaggatagggatcgaggcagagatgctgtgaagcgggaagccgctcttccacctgtgagtcccctcaaggccgccctcagcgaggaggagctcgagaagaagtctaaggcaatcatcgaagagtatctgcatctgaatgacatgaaggaggctgtgcagtgtgtccaggagctggcctctcccagcctgctcttcatatttgtcagacatggagtggagtccacccttgagaggtcagcaatcgcccgtgagcacatgggccagctgctgcatcagctactgtgcgcaggacacctgagcacagcacagtactatcaaggcctgtacgagatactggagctggctgaggatatggaaatagatatcccccatgtgtggctgtacctcgcagagttagttactcccattcttcaggagggtggggtacccatgggggagcttttccgggagattactaaacccttacgtccgctgggcaaagccgcttccctcctccttgagatcctcggcctgctctgcaaaagcatgggccccaagaaggtgggcacgctatggcgcgaggccggacttagctggaaggagttcttaccagaagggcaggacatcggcgcttttgttgcagaacagaaggtggagtacactctgggagaggaatccgaggcccccggccagagggcactgcccagcgaggaactcaatcgccagttggaaaaacttctcaaggaggggagcagcaatcagcgagtcttcgactggatcgaggctaatttgagcgagcagcagattgtttcaaacacccttgtaagggcacttatgactgcagtgtgctactctgccattatcttcgagacccctctgagggttgacgtggccgttctgaaagcaagagcaaagctgctgcaaaaatatctttgtgacgagcaaaaggagctgcaggccctgtacgctttacaggccctcgtcgtaactctcgagcagccgcctaatttactccggatgttcttcgatgcactgtacgatgaggacgtggtaaaagaggacgccttctattcatgggaatcgtcaaaagaccccgctgagcaacagggcaagggtgtcgctctgaaatccgtcaccgcattcttcaaatggttaagggaagccgaagaagagtcagatcataactag

SEQ ID NO: 15074 - DNA, 4683 bp, Artificial Sequence
  Description of Artificial Sequence: Synthetic coding sequence
atgaacacaccatctcagcctaggcaacacttttatccttccagagcccagcccccttcctcagctgcttccagggtccagagcgcggctccggccagacccgggccagcagcccacgtgtaccccgcagggagccaggttatgatgatcccgtcccagatctcatatcccgcctcacagggggcatattatattccaggccaagggaggtctacgtacgtagtcccaactcaacaatacccagtacagcccggggcaccaggcttctatcccggggcaagccctacagagttcgggacgtatgcaggggcatactatcccgcccagggtgtccagcaatttcctaccggggtggcgccgacacccgtcctgatgaaccagcctcctcagatagcaccaaaacgcgagcgaaagaccatccgcattagggacccaaatcagggtgggaaggatatcaccgaagaaatcatgtcaggggccaggactgcctccacacctacccccccacaaacgggcggtggtctcgagccacaggccaatggtgagacaccacaggtggcagtcatcgtgcggccagacgacaggtcccagggggcaataatagcagatagacccggtttgccagggcctgaacattcaccctccgagtctcagccgtcaagcccctcaccgactccatccccatcccccgtcctcgagcccgggtctgaaccaaatctagcggttctctcaatacctggcgatacaatgacaacgattcagatgagtgttgaagagtcaacacctatctcaagagaaactggagaaccctatcgcctatcccctgagccaacccccctcgccgaacctatcctggaggtcgaagtgactttaagcaagcccgtgccagaatccgagttttccagcagcccactacaggccccgaccccactcgcatcacacaccgtggagattcacgagcctaacgggatggtgcctagtgaggacctggagccagaagttgaaagttctccagaattggctccaccacccgcctgtccatcagagtctcccgtgcccattgcgccaacagcccagcccgaggagctgctgaacggagctccctctcccccagccgtggacttgagccctgtgtccgagccggaggagcaggccaaagaggtgaccgcaagtatggcacctcctaccatcccatccgccactcctgccacggcaccctctgctacttcaccagcgcaggaggaagagatggaagaagaagaggaggaggaagaaggggaggctggcgaggctggcgaggctgagtccgaaaaagggggggaggaattactcccccctgagtctacaccaatccccgcaaatctctcacagaacctggaagccgccgcagctacccaggtggcagtgtccgtgccgaaaagaaggcgcaagatcaaagaactgaataaaaaagaggctgttggagacctgctggatgcgtttaaagaggcaaaccctgccgtaccggaggtagagaatcaacctcctgcggggagcaaccccggtcccgagtctgaaggctccggtgtaccaccgagaccagaggaagcagatgaaacttgggactcaaaggaggataaaatccacaatgcagaaaatatacagcctggggagcagaaatacgagtacaaaagtgaccagtggaagcctctgaacctcgaggagaagaaacggtatgaccgggagttcctgcttgggttccaattcatctttgcttctatgcaaaagccagagggcctccctcacattagtgacgtggtcttggacaaggccaacaaaacacctcttaggcccctcgatccaacccgacttcagggaataaactgtggcccagatttcacccccagcttcgctaaccttgggaggactacccttagcactcgcggacctcccagaggtggcccaggcggcgaacttcctcggggaccccaagcaggactaggcccgaggcgcagccagcagggccctaggaaagagcccagaaagatcatcgcaactgtgctgatgactgaggacatcaagctgaataaggccgagaaagcctggaagccctccagtaagaggaccgccgctgacaaggaccgtggggaggaggacgccgatggaagcaagacacaggacttatttcgccgcgtccggagtatcttgaacaagctaacaccccaaatgttccagcagcttatgaaacaggtgacccagctggccatcgatacagaggagcgtctcaaaggggtgattgatctgatctttgaaaaagctatctctgagccaaacttttctgtcgcctatgctaacatgtgcaggtgtcttatggctctgaaagtcccaactactgagaagcctaccgttactgtcaacttccggaaactactactcaaccgatgtcagaaagagtttgaaaaggataaggacgacgacgaggtgttcgaaaaaaaacagaaggaaatggatgaggccgccaccgccgaagagagaggacggttaaaggaggagcttgaggaagctcgtgatattgcgcggcggagaagcctcggtaacatcaaatttataggcgagctgtttaagctcaaaatgctgaccgaggcaatcatgcacgattgtgttgtgaaactgctgaaaaatcatgatgaggagtctctagagtgcctgtgcaggttgctcacaaccatcggcaaagatctcgatttcgagaaggccaagccgagaatggatcagtacttcaaccagatggagaaaatcatcaaagaaaagaaaactagtagccggatacgattcatgctccaggacgtgctcgacctgaggggaagcaactgggttcccaggagaggagaccagggtccaaagaccatcgaccagatccataaagaggcagagatggaggagcatagagagcacatcaaggtgcagcaactgatggctaagggctccgataagagacgcggcgggccacccggcccgcccatctcaaggggccttccgctcgtggacgatggtgggtggaacaccgtcccaatatcgaagggctcccgtcccatcgacacaagtcgactgacgaaaatcacaaaacctggaagcattgacagtaacaatcaattatttgccccagggggccgcttatcgtggggcaaaggctccagtggcggctccggtgcgaagccatccgacgctgcctcagaagctgccaggcctgcaacttctacgctgaaccgcttctctgctctccaacaggctgtaccaacagaaagcaccgacaacagaagggtggtgcaacgcagttcgctctcccgggaacgcggggagaaagctggcgaccgcggagataggttagaaagatctgagagggggggcgaccgcggagaccgcttggaccgcgctaggactcccgctaccaagcggagctttagcaaggaagtcgaggagcgtagccgcgaacgtccctcgcaaccagaggggctccggaaggccgcctcactcacagaggacagggatcgagggagagatgctgtaaaacgcgaagcagccctgcccccagtgtcccctctcaaggccgctctgagtgaagaagagctcgaaaagaaatcgaaggcgatcatcgaggaatacttgcacctgaatgatatgaaagaagctgtgcagtgcgtccaggagctcgccagccccagcttgctgttcatctttgtgcgacatggagtggaatccaccttagaacgctcagcaattgctagggagcatatgggccagctgcttcatcagctgctgtgtgccgggcatctgtctactgcacagtattaccaggggttatatgaaattctcgagctggcagaggatatggagattgatattccacatgtttggttgtacctggcagaactggtgactcccatcctccaagaagggggggtgcccatgggggagcttttcagggaaattactaaacccctcaggccgttggggaaggccgcaagcttgttactcgaaatcctggggctgttatgcaagtccatgggccctaaaaaagtgggcactctgtggcgcgaggccggactgtcttggaaggaatttctgcctgagggacaggatattggcgccttcgtcgccgagcagaaagtggagtatacgctgggcgaggagtctgaggcccccgggcagagggccctgcccagtgaggagctgaaccgtcagcttgagaagctgctcaaggagggcagctcaaatcagagagtattcgattggatcgaggcaaatcttagcgagcagcagatcgtatctaatacactggtccgcgcgctgatgaccgccgtgtgctattcggctattatattcgagacacccctaagggtggatgtggccgttctcaaggccagggctaagcttcttcagaagtacttgtgcgacgaacagaaagaactccaggctctctatgcgctgcaagctcttgtggtgaccctggaacagccacctaacttactgcgcatgttcttcgatgccctctatgacgaggatgtagtgaaagaggacgccttctattcatgggagtcatctaaagatcccgctgaacagcaagggaaaggtgttgccttgaagtcggtaacagccttctttaaatggctgcgggaggcagaagaggagtctgatcataactag

SEQ ID NO: 15075 - DNA, 4680 bp, Artificial Sequence
  Description of Artificial Sequence: Synthetic coding sequence
atgaatactccttcccagccacgacagcacttttacccatcgagggctcagcctccttcttcggccgccagccgtgttcagtctgccgctcccgcacgccccggacccgctgcacacgtctatccagctgggtcacaagtgatgatgattccatcacagatcagttacccagctagccagggagcatactacatccctgggcaggggcgatccacttacgtcgtgcccacacaacagtatcccgttcagcccggcgcgccaggtttttatccaggcgcctctcccacggagtttgggacttacgccggggcctattaccctgctcagggagtgcaacagtttccaaccggagtggcccccacacctgtgttgatgaatcagcctccacagatcgctccgaaaagggaaagaaagactattcgcatcagagatcccaatcagggagggaaggatatcactgaggaaattatgagcggggccagaacagcgagcacaccaacacctccacaaacaggcggcggcctcgagccccaggccaacggtgaaacgccccaggtagccgtgatcgtgcggcctgacgacagaagccagggcgctatcattgcagatcggccgggtcttccaggccccgaacatagcccaagcgagtcccagccaagttcgccatctcccacaccatctccctcgcccgtcctggaacctggtagcgaaccaaacctggctgttctctcaattccaggcgatactatgacaactatccaaatgtcggtcgaagaaagtactccaatctcaagggagacaggggaaccctaccggctcagccctgaacccactccactggccgaaccaattctcgaggtggaagtgacattaagcaagccagtgcctgaatccgaattctcctcctcccccctccaggcccctactccactggccagccatacggtagagatccacgagcctaacggtatggtgcctagcgaggaccttgaacctgaagtcgagtcctcacccgagctggctccaccaccagcctgtccctccgagagccctgtccctatcgccccaaccgctcagccggaggagctcctgaacggtgcgcctagtcctccagcggtagacctatctccagtgagtgaacctgaggagcaggctaaggaagtgactgcttctatggctcccccaaccattccttctgctacgcctgcaactgctccctccgctacttcaccagcacaggaggaggagatggaagaggaagaagaggaggaggagggggaggccggcgaagccggggaggctgagtccgaaaaaggaggggaagaactgctcccccccgaaagcacaccaattccagccaatctctctcagaacctggaagctgcggctgctacgcaagtagccgtctcggtccctaagcgcagaaggaaaatcaaggagttgaacaaaaaagaggctgtaggcgacctgctcgacgctttcaaagaggcgaaccccgccgtgcccgaggttgaaaaccagccaccagctggctccaaccctggtccggagtctgaaggctcaggcgtgcctccccggccagaggaggcagacgagacgtgggatagcaaagaggacaagatccacaacgctgagaacatccagcccggtgagcaaaagtatgagtacaaatccgatcagtggaagccgctgaatctggaggaaaagaaaaggtatgacagagagttcctcctcggttttcagtttatctttgcgtcaatgcagaaaccagagggactgccacacatctcagatgttgtgctagacaaggccaataaaacccctctgcggcccctggatcccacgcgccttcaagggattaattgcggaccggacttcaccccaagcttcgcaaatctgggaagaacaactctgagtacccgtgggcccccaaggggcgggcctggcggtgagctgccacggggccccgccggcttagggccgagaagatcccagcagggccctagaaaggaacccaggaagatcatagcgacagtgctcatgaccgaagatatcaagctaaataaggccgagaaggcatggaagccatctagcaagcgcacagctgctgataaggaccggggcgaagaggacgccgatggctcaaagacacaagatctattccgacgcgtccgatccatcctaaacaaactaacaccacagatgtttcagcagctgatgaagcaggtaacccagctggctattgacaccgaggaaagattgaagggagtcatcgaccttattttcgagaaggcaataagtgagcccaatttctctgtggcttatgccaatatgtgcaggtgtttgatggctctcaaagtacccaccaccgaaaagcccactgtgacagtgaacttcagaaaactcttactcaatcgctgtcagaaagaattcgagaaagataaggacgatgatgaagtctttgagaagaaacagaaggaaatggatgaggcagccaccgccgaggagcgtggaaggcttaaagaggaactcgaggaggctagagacatagcccgccgtagaagcttagggaacatcaaatttattggggagctgtttaaactgaaaatgttgacagaagcaatcatgcatgactgcgtggtgaaactattaaaaaaccacgatgaggagtctctcgagtgcttgtgccgacttctaaccacaatcggaaaagacctggactttgagaaggcaaagccacggatggatcagtactttaatcagatggaaaaaataattaaagagaagaagacttcttcacggattaggttcatgttgcaggatgtgctggatctcaggggctccaactgggttccccggaggggcgatcaggggccaaaaactatcgaccagattcacaaagaggccgaaatggaggagcatcgggaacatatcaaggtgcagcagttaatggccaagggttcagacaaacgccggggaggtcctccagggccaccaatctcacgaggactacccctcgtggacgacggtggttggaacacagtccccatctccaaaggcagccggcctattgacacctctcgtctcacgaagattacaaagcctgggagcatagactcaaacaatcagctgttcgcaccaggcggccggctgtcttggggaaaggggtcttctggggggtccggagctaagcctagtgatgccgcaagtgaagcagctagacctgctacgagcaccctcaatcggtttagcgcattgcagcaggctgtcccaacagagtctacagataataggagagtggttcaacggtctagcttgagccgagaaagaggcgagaaagcgggagaccgtggagacaggctggagcgctccgagagagggggcgataggggggacagattggatcgcgccagaacgcctgccacaaagcgaagcttttccaaggaagttgaagagcgttcaagagagagaccctcgcagcctgagggacttcggaaagcggcctctctgaccgaggacagggacaggggccgtgatgccgtgaagagggaggctgccctcccacctgtcagccctcttaaagctgctctcagtgaggaggaactcgaaaaaaagtcgaaggcaatcattgaggaatatctccatctaaacgacatgaaggaagcagtgcagtgcgtgcaggagctggcatcaccttcccttttgtttatcttcgtgcggcacggagtggaatcaacccttgaaaggagcgccatcgctagggagcacatggggcaattgttacaccagcttttgtgtgcagggcacctgagtactgcgcagtattaccaggggctctatgaaatactggagctggctgaagacatggagatagacattccacatgtatggttatacctcgccgaactggtgacgcctatcctccaggagggaggcgtccctatgggcgagctcttcagggagataacgaaacctcttcgacccctcggaaaagccgcgagccttctgctggagattctcggcttgctctgcaaatccatgggccctaaaaaggtgggaaccctgtggagagaggcaggtttgtcctggaaggaatttctgcctgagggtcaggacatcggggcatttgtagctgagcagaaggtcgagtacaccctgggagaggagtctgaggcacccgggcagagagctttgccaagcgaggagctgaatcgccagctagagaaacttttaaaggagggatcatccaaccaacgcgtgtttgactggattgaagccaacctctcagaacagcaaatagtttcaaacaccttagtcagggccttgatgacggctgtgtgctatagcgccattatttttgagacccccctgcgggtcgatgtggctgtcttgaaagcccgggccaagcttttacagaagtatctgtgtgatgaacagaaagagcttcaggctctttatgccttgcaggcgctggttgtgaccttggagcagcctcctaatcttttacgcatgttttttgatgcactgtatgacgaggatgtggttaaggaagatgccttctatagctgggagagtagtaaagaccctgccgagcaacagggaaagggtgtcgccttgaaaagcgtgacagcattctttaaatggttgcgggaagccgaggaggagtctgatcacaattag

SEQ ID NO: 15076 - DNA, 4821 bp, Artificial Sequence
  Description of Artificial Sequence: Synthetic coding sequence
atgaacaaggccccccagagtaccggcccccctcccgcgccatcacccggcctcccccagcccgcttttcctcccggccagacagctccagtggtgttctccactccccaggccacacagatgaataccccctctcaacccaggcagggcggattccgatccctacagcacttttaccccagccgagcacagccaccaagttctgcagcttctcgggtccaaagcgcagcacctgcgaggcccggtcctgccgcccatgtataccctgccgggtcacaggtgatgatgatcccttcgcagatatcctaccccgccagccagggagcatactacattccggggcaaggaagatccacctacgttgtgcctactcagcaataccccgtgcaacccggggcaccgggattctacccgggtgcgtcccctacagagtttggaacgtacgccggggcttactacccagctcagggcgtgcagcagtttccgacgggagtggcgcccactcctgtgctcatgaatcagccaccgcagattgctcctaaacgcgagagaaagactatccgcatccgcgacccaaaccaaggcggcaaagacatcacagaggagattatgagcggtgcgaggactgcgagcaccccgacgccaccccagactggcggcggactggaaccacaggctaacggcgaaacaccccaggtggccgttatcgtacggcctgatgacagatcccagggagctatcatcgcagaccgcccaggactcccggggccagagcattctccctccgagtcccagccctccagcccctcccctaccccgtctccgtcgcctgtcctcgaaccgggatccgagcccaacctggccgtcttgagtattcccggcgatacaatgacaactatccagatgtctgtggaggagtctacacccatatctagggagactggcgaaccttatcggctctcgccagagcctactcccctcgccgagcccatccttgaagtcgaggtcacgctttccaaaccagtacccgagtccgagttcagctcttctccactgcaagcccccacacccctcgcaagtcacaccgtggaaatacacgagccaaatgggatggttccgtccgaagacctcgagcctgaggtggagtcgtcaccagaactggcaccaccccctgcatgtccttcagaatctccagttccaatcgcacctaccgctcaaccagaagaactactaaatggtgccccttctccccctgccgtcgatctgagcccagtttctgaacccgaagagcaggcgaaagaggtcactgcctccatggccccgcccactattcctagcgcgacgccggcgaccgctccctctgccacttcacccgcgcaggaggaagaaatggaagaggaggaagaagaggaggagggtgaggcgggagaagctggcgaggccgagtcagaaaaaggcggggaagaactgctgccgcccgaatctactcccattccagccaacctcagtcaaaacctcgaagccgccgcagctactcaagttgccgtttccgttcctaagagacgtcggaagatcaaagaactaaataaaaaggaagcagtcggagaccttttagacgctttcaaggaggctaatcccgcagtccccgaagtcgaaaatcagccacctgccggttcaaaccccggacccgaatcagagggcagtggggttcctccacgacccgaagaggcggacgaaacatgggactcgaaggaggataaaattcacaatgctgagaacatccagcctggggagcagaagtacgagtataagtcagaccagtggaagcccctgaatttagaagagaagaaacgctacgaccgcgagtttctgttgggattccagtttatcttcgccagcatgcagaagcccgaaggtttgccgcatatttcggacgtcgtgctcgacaaagccaacaaaacccctttgcggccactggatccaacccgtcttcagggaataaattgtgggccagattttaccccctcttttgccaaccttggaagaactaccttgtcaactcgaggaccaccccggggaggaccaggaggggagctgccaagagggcccgcgggcctcggcccacgccgaagccagcagggacctcggaaagaaccaagaaaaattatcgccactgtgctgatgactgaggacatcaaactgaataaggcagagaaagcctggaagccatcctccaaacgcaccgccgctgataaggaccggggggaagaagacgccgatggaagtaagacccaggaccttttccggcgtgtgaggtcaattctgaataagctgacgccacagatgtttcagcaactcatgaagcaagtgacacaactggccatcgataccgaagaacggcttaagggggttatcgacctcatcttcgaaaaggctattagtgagccaaatttcagcgtggcgtatgcaaatatgtgcaggtgcctgatggcactaaaggtacccaccactgagaagcccacagtgactgttaatttccgcaagctgctgctgaaccgatgtcagaaagagtttgagaaggacaaagacgacgacgaggtgttcgaaaagaagcagaaagagatggatgaagcggctacagcagaagagcgtggtcgcctcaaggaggagctcgaggaagctcgggatatagctcgcagacggtctctcggaaatatcaagtttatcggagaattgttcaagctgaagatgttgaccgaagccattatgcacgactgcgtagttaagcttctgaaaaaccacgacgaagagagtctggagtgtctctgccggctactgactactattggtaaagacctggattttgagaaggcgaagccacgaatggatcagtacttcaatcagatggaaaagattatcaaggagaagaaaacctccagccgaattcgtttcatgctccaagacgtgcttgacttacgcggctccaactgggtccccagaaggggagaccaggggccaaaaacaatcgatcaaatccacaaggaagcagagatggaggagcatagagagcatatcaaagtccagcagctcatggctaagggcagtgacaaacgcagggggggtccaccgggaccgcctatatctagaggactacccctcgtggatgatggaggctggaataccgttcctatcagtaaaggctcaaggccgatcgatacttccaggctcactaagatcaccaagcctgggagcattgactcaaataaccagcttttcgcgcctggcgggaggctatcttggggcaaagggtctagcggaggatctggggctaaaccctccgatgcggcatccgaggccgcacgacctgccacctccactctgaacaggttcagcgcgctccagcaggccgtgcctactgaatcgaccgacaatcggagggtggtccagcgatcttctctttccagggagcgaggggagaaagccggggaccggggggaccggctggagagatccgagcgggggggcgaccggggagatagactggatagagctagaacgcccgctacaaaacgcagtttttccaaggaagtcgaggagagaagtagggaaaggccctcacagccggaggggcttaggaaagctgcaagtttgacagaagaccgggaccgcggtagagacgctgtaaaacgagaagctgctctgcccccagtgagccccttgaaggccgctctatctgaggaggaactggagaagaaatcgaaggccattattgaggagtatctgcacttgaacgacatgaaagaagccgtccagtgcgtccaagaattggcatccccatccttactgttcatcttcgtgcgacacggagtggagagcacactggaacggtcagcaatcgcaagggagcatatgggccagttacttcaccaactcctctgcgctggacacctgtcaacagctcaatactaccaaggactttacgagatactggagctcgcagaggatatggagattgatataccgcacgtttggctctaccttgccgaactggtaaccccgattttacaagaaggcggagtgccgatgggcgaactatttcgggagatcaccaagcctctccgacccctggggaaagctgctagcttgttgttagagatcctgggcctgctttgtaaaagtatgggacctaaaaaggtggggacattgtggcgggaggctggcttgagttggaaggaatttttgcctgaagggcaggacatcggagcgtttgtcgcagagcagaaagtggaatacacactaggggaggaatcagaggctcctggccagagagccttaccctctgaagaactaaaccgccagctggaaaaacttctgaaagaagggtcatctaatcagagagtcttcgattggatcgaagccaacctctccgagcagcagattgtatcaaacacgcttgttagagcacttatgacagccgtatgctacagcgccatcatctttgagacccctctgagagtggacgtggccgtcctcaaggcgcgcgccaagctcctgcaaaagtacctatgtgacgaacagaaggagcttcaggctctgtatgccctgcaggccctcgtcgtgacgcttgaacagcctccaaatctcctgagaatgttcttcgacgcgctgtacgatgaggacgtagtgaaggaggacgccttttacagctgggagagcagcaaggatccagcggaacaacagggtaagggggtggccctaaaatccgtgaccgctttttttaaatggctccgggaggcagaggaagagtccgatcacaactag

SEQ ID NO: 15077 - DNA, 492 bp, Artificial Sequence
  Description of Artificial Sequence: Synthetic coding sequence
atgtccggagcaaggactgcatccacacccacgccaccccagacaggcggaggccttgaaccacaggctaacggcgagaccccgcaggtggcggtcattgtccgcccagatgaccgcagccagggtgcgattatcgctgaccgacctggactgcctggccccgagcactccccatcagagtcacagccttccagtccatcaccgacgcctagtccgagtcccgtgctggaaccaggcagtgagccgaacctcgcagttcttagtattcctggtgacacaatgaccacaattcaaatgtcagtcgaagaaagtacccccatctcccgtgaaacaggggaaccttatcgcttgagcccagagccaaccccactcgctgaaccaatactcgaagtggaggtgactctcagtaagccagtgccagagtccgaattttcctcttcacctttacaagccccaactcccctcgccagtcacaccgttgagatccactag

SEQ ID NO: 15078 - DNA, 4542 bp, Artificial Sequence
  Description of Artificial Sequence: Synthetic coding sequence
atgatgataccctcccagatttcatacccggcgagtcagggtgcctactacatccctggtcaggggagaagtacttacgtggtaccaactcagcagtatcctgtccagcctggcgcccccggcttttatccgggcgccagtccaaccgagttcggcacctatgccggcgcctattatcccgcacagggcgtgcagcagttccccacgggcgtggcccctacccctgttctcatgaaccagcccccccagattgcccctaaacgcgagaggaagactattcggataagggatcccaatcagggtgggaaggatatcactgaagagattatgtccggagcacgcaccgcttcaactccaactccaccacagacgggaggtggactagaacctcaggctaacggcgagacaccgcaagtcgctgtgatcgtaaggcctgacgaccgatcccaaggtgcaataatcgctgaccgaccaggcttaccgggccctgagcattctccatccgaatcccagccgagcagcccaagtcctactccaagtcccagtccagtcctggagcccggttccgaacccaatttagccgtgttatctatccccggtgatactatgaccacaattcagatgagcgtcgaagagagtactccaatttcccgggaaacaggagagccgtaccggctttcccccgaaccaacaccgctcgccgagccaatacttgaggtcgaagtgacattgagtaagccagtccctgagagtgagtttagcagcagtcccctacaggccccgacccctcttgctagtcacactgtcgaaattcacgagccaaatgggatggtgccctcagaggaccttgagcctgaagtggagagttcccccgaactggcacccccgcccgcttgcccaagcgagagtcccgtgccaatagccccgaccgcccagccggaggagctgttgaatggggctccttctccacccgctgtggacctctctccagtctcagaacctgaggagcaggccaaggaagtgaccgcctcaatggcccctccgacgatcccctccgcgactcccgccactgcccccagcgcaacgagccctgcccaagaggaagaaatggaagaggaagaagaagaggaagagggcgaggcaggagaggctggagaagccgagagcgagaaaggcggagaagaacttctaccccctgagtcaacgcccatcccggcaaacttgagtcaaaacctggaagccgccgctgcaacacaggtggctgtaagcgtgccaaaacgcagacgaaagataaaggagctgaataaaaaggaagcggtgggtgatttactggatgccttcaaagaggctaaccccgccgtgcctgaagtggaaaatcagccacccgcagggtcgaacccaggacccgaatctgagggaagtggcgtgcccccccggccagaggaggcggatgaaacctgggactcaaaggaagacaagatccacaatgccgagaatattcagccaggagagcagaagtacgagtataagtccgaccagtggaagcccctgaatctggaggagaaaaagaggtacgaccgtgagttcctcctgggctttcagttcatctttgcttccatgcagaagcctgagggcctgccccatatctcagacgtcgtcctcgacaaggcaaataaaaccccactgaggccgctcgatcccacccgtttgcagggcatcaactgtggacccgatttcacaccctcattcgcaaatctgggtagaaccaccctgtctacacgtgggccaccccgcggtgggcccggcggggagttaccacgcggcccgcaggctggtctgggtcccagacgatctcaacaagggcccaggaaggagcctcggaaaattatcgcaactgtcctcatgactgaagacattaagctgaacaaggccgaaaaggcttggaagccttcaagtaaaaggaccgctgccgacaaagataggggggaggaagacgccgatggaagtaaaacccaggaccttttcaggagagtacggtcaattcttaacaagctgacccctcagatgttccagcaattgatgaagcaggtcacccagctcgccattgacaccgaagagagactaaaaggtgtgatagacctcatttttgaaaaagccatatctgaaccaaatttttccgtagcatacgccaatatgtgcagatgtctgatggcattgaaagtacccaccactgaaaagccaacagtaacagtcaatttccgcaagcttctgctgaaccgatgccaaaaagagtttgagaaagataaggatgatgatgaggtctttgagaagaagcagaaagaaatggacgaagctgccacagcggaggaacgtggtagactgaaggaagaactagaagaggctcgcgatatcgcacgtcggagaagtctgggcaacataaaattcataggcgaactgttcaagttaaagatgttaaccgaggccattatgcatgattgcgttgttaagctgcttaagaaccatgacgaggaaagtctggaatgcctttgcagattactgacaaccataggaaaggacctcgacttcgaaaaggccaagccccggatggatcagtactttaaccagatggagaagatcattaaggaaaaaaagacaagcagtaggatcagatttatgctccaggacgttttggacctcaggggaagcaactgggtgccacgcaggggggaccagggccccaagacaatcgatcaaatccataaagaggctgagatggaagagcaccgcgagcacatcaaagtccagcagctgatggctaaggggtcagataagcgtcgggggggcccaccagggcccccaatctccagaggacttcccctggtggacgacgggggctggaatactgtacctatctcaaagggtagcaggcccattgacacttcgcggttgaccaagatcaccaaacccgggtcgattgattctaataaccagctgtttgcgcctggaggaagactctcttggggaaagggctcgagcggcggcagcggcgccaagcccagcgacgccgcctccgaggctgcgagaccagctaccagcacactgaatcgcttcagcgcgttgcaacaagctgtcccgaccgagtccacggataatcggcgcgttgtccaaaggagcagtttaagccgcgagaggggcgagaaggcaggggaccggggcgataggctcgagcgaagcgaacggggcggagatcggggcgaccggctagatagagcgcgaactcccgccacaaaaagaagtttttccaaagaggtcgaagagcggagtagagagagaccttcccagcccgagggcctccgcaaggctgcatctctaactgaggaccgcgatcgggggagggatgccgtgaaaagggaggcagctctgccgcctgttagtccgcttaaggccgccctgagcgaggaggagctggagaagaagtccaaagctatcatagaggaatacctgcacctcaatgatatgaaagaggcagtacagtgtgttcaggaattggcttcaccgtcactccttttcattttcgtgcgccatggagtggaatcaacgttagaacggagcgcaatcgcaagggagcacatgggacagctcctgcaccagctgctgtgtgcaggtcacctgtcaacagctcagtactatcaaggattgtacgagatcctggagctcgctgaggatatggagatcgacatcccacacgtgtggttatacctcgccgagctggtcactccaatactccaagagggtggggttccaatgggcgagctgtttagagaaataacaaaacccctgagaccgcttgggaaagcagcctccctgctgctagagattctgggcctactctgtaagtccatggggccaaaaaaggtggggacactatggagggaggcgggcttaagctggaaagagtttcttcctgaaggccaggacatcggtgccttcgtcgccgagcagaaagtcgaatacactctgggggaagagtccgaagcacccggccagcgcgctctcccgagtgaggagcttaaccgccaactggaaaagttactgaaagagggctcctctaatcagagggttttcgattggatcgaggctaacttgtctgagcaacagattgtgtctaatacactggtcagggccctcatgacggcagtttgttattctgccatcatcttcgaaacccctctgcgagtggatgtggcagtcctgaaagcaagagccaagctgttacagaagtacctctgtgacgaacagaaggaactgcaagccctatacgctttgcaggctctggtcgtgacactcgagcagccccccaacctgctcaggatgttcttcgacgccctgtacgatgaggatgtcgttaaggaagacgccttttacagctgggaatctagtaaagatcccgccgaacagcagggcaagggagtcgcattgaagagcgtcacggcatttttcaaatggcttcgcgaggcagaagaagagtccgaccacaattag

SEQ ID NO: 15079 - DNA, 432 bp, Artificial Sequence
  Description of Artificial Sequence: Synthetic coding sequence
atgtccggtgcaaggaccgcttcgactcctacacccccacagacaggcggggggctggaacctcaggccaacggggagaccccccaggttgccgttatcgtgcgccctgacgatagaagtcagggcgcaatcatcgctgatcggcctgggcttcccggaccagaacattctccctctgagagtcagccgagctccccttcccccacaccatctccctcgccggtgctagagcctggttctgaacctaacctcgccgtcttgagcatccctggggataccatgaccacaatacagatgtccgtcgaagagtctacacccataagtcgagaaacaggagagccatatcgcttgtcccctgaacccactcccctggctgagcctatcctagaagtggaagttactctgtctaagccagtacctgagagcgagtag

SEQ ID NO: 15080 - DNA, 4215 bp, Artificial Sequence
  Description of Artificial Sequence: Synthetic coding sequence
atgtcgggtgccagaaccgcttctactcccactcctcctcagaccggtggagggctggagccccaggcaaacggggagacaccccaggttgctgtaatcgtgcgaccggatgaccgttctcagggcgctatcattgccgacaggcctggactccccggacctgagcactcgccctccgaatcacagccctcctccccgagcccaacaccatcacccagccccgtgctggagccgggatccgaaccgaacctagcagtgctgtccatccctggcgacaccatgactaccatccagatgtctgtagaggagtccacccctatctctagagagacaggcgagccgtacaggctgtcgcccgagccaacacctttggcggaaccaattctggaagtagaagtcacactcagcaaacctgtgcccgagagcgagttctcatcatcccctcttcaggcccccacccccttagcatctcatacagtggagatacacgagccaaatgggatggtgccctcagaggatctcgaaccggaagtcgaatccagccctgagctcgccccaccccctgcctgcccttcagaatcccccgtgcctattgcccctacggcccagcctgaggagctcctgaatggcgcgccctctccaccagctgttgacctgagccccgtcagcgagcccgaagagcaggccaaagaagttaccgccagtatggcccctcccactataccctcagccaccccagcaactgcaccctctgcaactagtccagctcaagaggaagaaatggaggaagaggaggaagaggaagaaggtgaggctggagaagcaggcgaggctgagagcgagaagggaggcgaagagttgctgccaccagagtccacacccattccggctaacctgtcacagaacctagaagcagcagcggccacacaggttgcagtttccgtgccaaagcgtagacgcaaaatcaaggagctcaacaagaaggaggctgtcggcgaccttttagatgcttttaaagaggcgaatcccgctgtgccagaggtcgagaatcaacccccagcgggatctaaccctgggcccgaatccgagggatcaggagtccccccccggcctgaggaggccgatgagacctgggactcaaaagaagacaagatccacaatgccgagaacatccaacctggggagcaaaagtacgaatataaatccgatcagtggaagcctctcaacctcgaagagaagaagcggtacgaccgtgaattcctcctcggtttccaatttatttttgccagtatgcagaagcccgagggcctgcctcatatttcggatgtagtgctggataaggccaacaaaacgccactgcgaccactggatccaactaggctgcaggggataaactgtgggccggattttacacctagcttcgctaacctgggcaggacaactctgtccaccaggggccccccgaggggcggtcctggtggagaattgccaagagggccacaggcaggcttgggaccccggcgcagtcagcagggcccacgtaaggaacccagaaagataattgccacggtgttgatgactgaagacatcaagctgaacaaggccgaaaaagcttggaagccgagctcgaaacgcactgctgccgacaaggatagaggtgaggaggacgcggacggcagcaaaacgcaggacctttttcggcgcgtccgaagcattttgaataaattgacaccccaaatgttccagcagttgatgaagcaggtcacacagctggcaattgacactgaggaacggcttaaaggagttattgacttgatctttgaaaaagccataagcgaacccaatttttctgttgcatacgccaatatgtgtcgatgcctcatggcattaaaagtacccacaaccgagaaacccacagtaaccgtcaatttcagaaaacttctactgaacagatgccagaaggagttcgaaaaagataaggatgatgacgaagtatttgaaaaaaagcagaaggagatggacgaggcggctaccgccgaagagaggggtagactcaaggaggagctggaggaggcgcgggacatcgctaggcggagaagcctcggtaatataaaatttattggtgaactgttcaagttgaagatgcttacggaggcaattatgcatgattgcgttgtcaaattgctgaagaaccacgacgaggaatcactcgagtgcctctgtcgcctcctgaccaccattggaaaggacctggatttcgaaaaggcaaagccacgcatggaccagtattttaaccagatggaaaagataattaaagaaaaaaaaacctcctccaggataagatttatgctgcaggatgtcttggacctgcgaggatcgaattgggtccccaggcggggagatcaagggccaaaaaccattgaccagatccacaaggaagctgagatggaggaacaccgggaacatattaaagtgcagcaacttatggccaaggggtccgacaaacgccgtggggggcccccgggccccccaatctccagagggctgccactcgtggatgacggcgggtggaacaccgtgccaatctcaaaaggcagccgccctatagacacctcccgcctcaccaaaattaccaaacccggcagcattgattctaataatcagctctttgcccccggcggacgattgagttggggtaaaggctcatcggggggctcaggcgcgaaaccgtctgacgccgcatcagaagctgctcgacccgctacttccaccttgaaccgattttcagccctgcagcaggccgtgccaactgaaagtactgataacagaagagtggtgcagcgatcttccctgtcccgggaacgcggcgaaaaggcaggcgaccgaggagatcgtcttgaaagatctgagagaggaggagataggggtgatcgccttgacagggctaggacaccagccaccaagaggagtttcagcaaggaggttgaggagcgctctcgcgaaaggcccagccaacctgaagggctcagaaaagccgcaagtctcaccgaggacagggataggggcagagatgctgtcaaacgtgaggccgcactgcctccagtaagtcccttgaaggcagctctttctgaggaagaacttgaaaagaagagtaaagctattattgaagagtatttgcacctgaatgatatgaaggaagccgtgcaatgcgtccaggagcttgcatcaccttctctcctattcatctttgtgcggcatggagtcgaatctacgcttgaacggagcgccatcgccagggaacacatggggcagctgctacaccagctgctttgtgccgggcacctcagcacagcccaatattatcagggactttacgaaattctcgaactggcagaagacatggagattgacattccccatgtttggctctatctggccgagctcgtgaccccaatcctgcaagagggcggcgtccctatgggcgaactttttcgggaaattaccaaacccctccgccctcttggcaaggccgccagcctgttgctggagatcttggggcttctatgtaagtccatgggaccaaagaaggtgggtacattgtggcgcgaagcaggtctctcttggaaggaattcttacccgaaggccaggatataggggccttcgtggccgagcagaaagtcgagtacacattaggtgaggagtcggaagccccaggacaaagggcactgccatccgaggagctcaataggcagttagaaaagttattaaaggagggatcctctaatcagagagtgttcgactggatagaggctaatctgtccgaacaacaaatcgtctcgaacaccctggtacgggctctgatgactgctgtgtgctattccgctatcatcttcgaaacacctcttcgagtcgacgtggccgtcctcaaggcccgtgccaagctccttcagaagtacctgtgtgacgagcaaaaagaattgcaggccctatacgctttgcaggccctggtcgtgactctggaacagccacctaacttgttgaggatgttttttgatgcactgtatgatgaggacgttgtaaaagaggacgcattttactcatgggaatcgtcaaaggaccctgccgaacagcagggaaagggcgttgcactgaagagcgtgacagcattctttaagtggcttcgtgaagctgaggaagagtcagaccataattag

SEQ ID NO: 15081 - DNA, 4212 bp, Artificial Sequence
  Description of Artificial Sequence: Synthetic coding sequence
atgtctggagctagaacagcctctacgccgacccccccccagacgggcgggggactcgagccccaggccaacggcgagaccccccaggtggcagttattgttagacctgatgaccgcagtcagggtgctattatcgctgatagacctggcctgcccggtcctgaacacagcccctcagaatcccagccgtcgtcaccttcccctactccgtcccctagtcccgtcttggagccgggttctgaacccaatcttgctgtcctctccatcccaggggacacaatgaccacaatacagatgtccgtggaagagtctacccctatcagtagggaaactggggagccttatagactgagccccgagcccacaccgctggccgagcctatcctggaggtggaggttacactgagcaagccagtgcccgaaagtgagttttcatccagccccctgcaggccccaacccccttggcatcacatactgtagagattcacgagccaaacggcatggtaccatccgaggatctggagcccgaagtcgaaagttctcccgaactcgcacctcctccagcctgcccgagcgagtctcccgtgccgatcgccccaaccgcccaacctgaagagctgctgaatggcgctccatctccacctgccgtcgatctttcccccgtgtccgaaccagaggagcaagcaaaggaggtgacagcttctatggctcctcccaccatccctagtgcaacccctgccactgcgcccagcgcaaccagccccgcacaggaggaggagatggaagaggaagaggaggaggaggagggggaggccggggaggctggggaggccgaatcagaaaaggggggggaagagctgctccctccagagagcaccccaatcccagctaacctatcccagaacctggaggccgcggccgcaacccaggtggcagtatctgtcccgaagcggaggaggaagatcaaggaattgaataagaaggaggcagtcggggacctgctcgacgctttcaaggaggcaaaccccgctgtgcccgaagtggagaaccagccacccgctgggtccaatcctggacctgagtccgaaggttcaggagtgccacccagaccagaggaggcggatgaaacctgggattccaaagaggacaaaattcataacgcagagaatatccagccaggggagcagaagtacgagtataagtcagaccagtggaagccattgaacttagaggagaaaaaacgttatgaccgcgagtttttgcttggattccagttcatctttgcctcaatgcagaagcccgaaggactgccacatatctctgatgtggttctagacaaagccaacaagactcccctccgcccactggatccgactcggctgcaagggatcaattgcggaccggacttcacccctagctttgccaatttggggcgaactaccctgagcacccggggcccccccagaggggggccaggcggagagctgcctagaggcccagcaggtttaggcccgcgaagatcacaacaggggccaagaaaagaaccacggaagatcatcgcaaccgttctgatgactgaggatataaaactgaataaagctgaaaaggcctggaagcctagctccaaaaggacagctgcagataaggatcggggcgaagaagatgcagacggctcaaagacccaggacctgttcaggcgcgtacgcagcatcttaaacaagctcactccccagatgtttcaacagttgatgaaacaggtgactcagttggccatcgacactgaagagcggctgaagggggttattgatctcatatttgagaaggcaatctcggaacccaacttcagcgtcgcatacgccaacatgtgtcgctgcctgatggcattaaaggtcccaaccacagagaaaccgaccgtgaccgtgaattttcggaagctcctcttaaacaggtgccagaaggaattcgagaaggacaaggatgacgacgaagtgttcgaaaagaagcagaaggagatggatgaggcagccaccgctgaagagaggggcagactcaaagaagagttggaagaggcccgcgatattgcacgaagaaggtccctagggaatattaaatttataggagagctatttaagcttaagatgctgaccgaggccattatgcacgattgcgtggtgaagctgctgaagaatcacgatgaggagtcattagagtgtctgtgccggctgctcacgaccatcggtaaggatctggactttgagaaagctaagcctcgcatggaccagtatttcaaccagatggagaagataattaaggagaagaaaacaagcagcaggataagattcatgctccaggacgttctcgatcttcggggttctaattgggttcctagacggggagatcaaggccctaagacaatcgatcagatacacaaggaggctgagatggaggaacatagagaacacatcaaggtgcaacaactaatggctaagggatctgataaacgcaggggagggcctcctggacccccaattagccgcggactacctctggtagacgacggtggatggaacacagtacccatcagtaagggatctaggccaatcgacacgtctcggctgacaaagataacaaagccagggtccatcgacagcaataatcagcttttcgcacctggtggcaggctgagctgggggaaaggcagtagcggcgggagtggtgcaaagccgagcgacgcggcctctgaggctgcccgcccagccacatcaaccctgaatcggttttccgcactacagcaggctgtcccaactgagagcactgataacagaagggtggtgcagaggtctagcctaagccgagagagaggagaaaaggctggagaccgcggagatagactggagcgcagtgaaagaggcggagacaggggggatcggctggaccgagctcgaactccagcaaccaaaagatccttttccaaggaggtggaggagcgctcccgggaaagacccagccagccggagggcctgcgaaaagccgcatctctgacggaagatagggaccggggcagggacgccgttaaaagagaggccgcccttccccccgtcagcccactaaaggccgcgctgagtgaggaggaactcgagaaaaagtcaaaagctattattgaagaatatctgcacctgaacgacatgaaggaagcagtacaatgcgtacaggagctagccagtccaagcttgctgttcatctttgtcagacacggcgttgagagcaccttggagcgctccgccatcgcaagagagcatatgggccagctattacaccagctgctgtgcgcaggacacctctctactgcacaatactaccagggtctttatgagatcttggagctggccgaagacatggagattgatattccccacgtctggctatacctggccgaattggtcacgcccatactgcaggagggaggcgtccccatgggcgagttgtttcgggagataactaaaccactgaggcccctcggcaaagctgcaagtttgttactggagattttgggactgctatgcaagtcgatggggccgaaaaaggtgggcacattatggagagaggcgggcttgtcttggaaagaattcctgcctgaagggcaggacataggcgctttcgtggccgaacagaaggtggagtacacacttggcgaggagagcgaggctcccgggcagcgggcactaccgtccgaagaactcaatcggcaactggagaaacttcttaaggaaggatcttctaatcaacgcgtctttgactggattgaagcaaacctttctgagcagcagatcgtgtctaataccctggtccgagccctcatgacggctgtatgttattccgctatcattttcgagactcccctacgggtggacgtcgccgtgctaaaggcacgcgctaagttactgcagaagtacctctgtgacgagcagaaggagttgcaggccctttatgccctgcaggctctggtggtcacattagagcaacccccaaatctgcttagaatgtttttcgacgccctgtacgatgaggatgttgtgaaggaggacgctttttactcttgggagagttccaaggatccggccgagcagcagggcaagggcgttgccctgaagtctgtgactgcgttctttaaatggctccgtgaagctgaagaggaatccgatcataattag

SEQ ID NO: 15082 - DNA, 4311 bp, Artificial Sequence
  Description of Artificial Sequence: Synthetic coding sequence
atgaaccagcctcctcagatagctcccaaaagagagcgcaaaaccatcaggattcgagacccaaatcagggcggtaaggatatcacagaggaaatcatgtcaggagcacgcacagcctctacacctactccccctcaaacaggaggaggtttggagccccaggctaatggagaaactccacaagttgcagttatcgtcaggccagacgaccgttcacagggcgccattattgctgaccgtcctggacttccgggtccagaacattcccccagcgagagccagccctcctccccatcaccgacgccttccccctcccccgtactggaacctggaagcgagcccaacctcgcggtgttatccataccaggcgataccatgacaaccatccagatgagcgtcgaagagagcacacctatcagtagagaaacaggtgaaccataccgcctaagcccagagccgactcccttagctgagccgattctggaagtggaggtgaccctctccaagcccgtgcctgaatcagagttttccagctcgccacttcaggctccgacaccgctcgcctctcatactgttgagattcacgagcccaacgggatggtgccctcagaggatcttgagccagaagtagagagctctccagagcttgccccgccacccgcatgtccgagtgagtcccccgtccccattgcacccactgcacaacctgaggaattacttaacggggccccaagccccccagctgtggacttatctcctgtctccgaacccgaggagcaggcaaaagaggtcacggcttctatggcaccaccgacaattccatccgcaacacctgcaactgctccatcagccacctcacccgcacaggaggaggaaatggaagaggaagaggaggaagaggaaggcgaagctggcgaagccggtgaagcggaatctgaaaagggaggagaagaattacttcctccagaatctactcccatcccagcaaatctgagccagaacctggaagcggcagccgcgacacaagtggctgtgagtgtccctaaaagaaggaggaaaatcaaagaacttaacaaaaaggaggctgtgggcgacctgctggacgcattcaaagaggcaaaccctgccgtgcccgaagtggagaaccaacccccagccggatcaaatccggggcccgagagtgaagggagcggggtgccccctaggcccgaagaagcagacgagacttgggactccaaggaggacaagattcacaacgctgagaatatccaacccggtgagcagaaatacgagtataagagcgatcagtggaaaccccttaacctggaggaaaagaagagatacgaccgggaatttttgctcggatttcagttcatattcgcgtccatgcagaaacccgagggcctcccccacatctctgacgtggtgctcgataaggccaacaagactcccctaaggcctttagatccgacacgcctgcagggaatcaactgtgggccagactttactccgtcatttgccaacttggggagaacaactttgtcaacccgagggccaccacgaggtggtccaggcggcgagttgccgagaggaccacaggccggcctcggcccccggcggagtcaacagggtcctcgcaaggaacccaggaagatcattgcaactgtgttgatgacggaggacattaaacttaacaaggcggagaaggcgtggaagccaagctccaagcgcacggctgccgataaggacagaggggaagaagacgcagatggcagcaagactcaagacctcttccggcgagtcagaagcatccttaacaagctgacacctcagatgttccaacagttgatgaagcaggtgacgcaacttgccatagatactgaggaaagactgaagggggtgattgatctgatatttgaaaaggcaatatctgagcctaacttcagcgttgcgtacgctaacatgtgccgatgcttaatggctctcaaggtgcctactacagaaaagcccactgtgaccgtgaatttcagaaagctgctactgaaccggtgccaaaaggaattcgagaaggataaggacgatgatgaagtctttgaaaaaaagcaaaaggaaatggatgaggcagctacagcagaggaaagaggacggctcaaggaagaattggaggaggcaagagacatcgccagacgaagaagcctcggcaacattaagttcataggggagttgtttaaactaaagatgttgacggaggccattatgcatgactgcgtggttaaactcctcaagaaccacgatgaagaaagtctcgagtgcctgtgtaggttgcttaccactattggcaaagatctggacttcgagaaggccaagcccaggatggatcagtatttcaaccagatggagaaaattatcaaggagaaaaaaacatcttctcgaatcaggttcatgctgcaggacgtcctggatttacgtgggtccaattgggtgcctcgtcgcggggatcagggaccaaagaccatcgaccagatccacaaggaagctgagatggaggagcaccgagagcatattaaagtccagcagctgatggccaaaggaagcgataaacgtagaggtggcccaccaggtccccccattagtaggggcctgcccttggtagacgatggcgggtggaatacagtgcccatttccaagggttctagaccaattgacacaagccgtttaacgaaaattacgaaaccgggatccatcgactccaataaccagttgttcgctcccggaggcagactgtcttggggtaagggaagttccggcgggtcaggtgcaaagccatcggacgccgcctctgaggccgcccgccccgccacttccacactgaataggtttagcgctttacagcaggccgtgccgaccgagtcgaccgacaataggagagtggttcagaggtctagcctcagtcgcgaacggggcgagaaagccggagatagaggtgacaggctcgaaaggtccgaacgtggaggggacaggggtgataggcttgaccgtgccaggacgcctgccacaaaacgctctttcagcaaggaagttgaagagcgctctcgagagcgcccctcccaaccggagggcctgaggaaagccgcttcactgacagaggatcgtgaccggggcagggacgctgtgaaacgtgaggccgccctgcctccagtgagtcctctgaaggccgccctgtccgaggaagagctcgaaaaaaaatctaaggcaatcatcgaggaatatttgcatttgaacgatatgaaggaggcagtgcaatgtgttcaggagctggcatcaccctctttgctcttcatcttcgtccgccacggggtggaatcaacattagagcgaagcgcaattgccagagaacacatgggccagttactccatcagcttctgtgtgcaggacatctctcgacagcacagtactaccaaggtctgtatgagattctcgagctcgcggaggacatggagatagatattccgcacgtgtggttgtacctcgcagagctcgtcactcctattctgcaggaaggaggcgtgcccatgggtgagttgttccgggagatcaccaaacccctgaggcctttaggaaaggcagcttctttacttttggagattctgggactgctgtgcaagagtatgggacctaaaaaggtgggcaccttgtggcgggaggccggactgagctggaaggaattcttgcctgagggacaagatatcggagctttcgtcgcagagcagaaggtggagtacacccttggtgaggagagtgaagctccggggcagcgggcattgccgtcagaagagctgaacagacaactcgagaaactgctgaaagaaggctcgtccaatcaaagggtatttgattggattgaggctaatctctctgaacagcaaattgtttcaaacacattggtccgggctttaatgaccgcagtttgttacagcgccatcatatttgagactccattacgcgtggacgtggctgtgctcaaagccagggccaagttgctccaaaagtacctctgcgatgagcaaaaggaactgcaggccttgtatgctctgcaggctctagttgttaccctcgagcaaccgcccaaccttcttcgcatgttttttgatgctctctatgacgaggacgtagtgaaggaagacgctttttattcttgggaaagttctaaggatcccgcagaacaacagggaaagggagtcgcacttaagtcagtcacagcgttctttaaatggctgagagaagcagaggaagagtccgatcataactag

SEQ ID NO: 15083 - DNA, 384 bp, Artificial Sequence
  Description of Artificial Sequence: Synthetic coding sequence
atgtcaggagccagaacggcttcaaccccaaccccaccccagaccggcggaggtttggaaccccaggccaatggagagacaccacaggtagcagtaatcgtgcggccagatgacaggagtcagggagccataattgccgatcggcctggactgcctggacccgaacattcgccgagcgagagccagccatccagtccctcccccaccccatccccatccccagtgctggaaccaggaagtgaacccaacttggccgtgttgagcatccctggcgatacaatgacaacaatacaaatgagcgtggaggagtcaacaccgatttccagggagaccggggaaccgtatcgcctgagtcctgaaccgacccctcttgccgagccttag

SEQ ID NO: 15084 - DNA, 264 bp, Artificial Sequence
  Description of Artificial Sequence: Synthetic coding sequence
atgaacacaccaagccagcctcgacagcacttctacccttctagagcccagcccccaagttctgctgcctcacgggtacagagtgctgccccagcacgccccggacctgcggcccacgtgtaccctgccggctcgcaggtgatgatgattccctcccaaattagttatccagcctcccagggagcctactacattccaggacagggtaggagcacttacgttgtgccgactcaacagtatcccgtgcagccgggggctccctag

SEQ ID NO: 15085 - DNA, 858 bp, Artificial Sequence
  Description of Artificial Sequence: Synthetic coding sequence
atgagcggggctagaactgccagcacacccaccccaccccagaccgggggaggtctagagccccaggccaatggtgaaactccgcaagttgctgtgattgtgcggccagacgaccgatctcagggggcgatcatagcggatcggcccggactcccaggcccagaacacagccccagtgaaagtcaaccatccagcccctcgcccactccgtctcctagcccagtccttgaacctggctccgaaccgaatctggcagttctctcaattcccggcgatactatgacaacaatacaaatgtcggtggaagagtccactcctatttctcgagagactggtgaaccttaccgactgtcccccgagccaactccattggcggaaccaatccttgaagtagaagtcactctatccaagcctgtgccagagtctgagtttagtagctctcctcttcaagctcccacgccgttggcctcacacactgtggagatccatgaacccaacgggatggtcccctccgaagatctcgagccggaggtcgagagctcacccgaattagctccccctcctgcatgtcctagtgagagccctgttccaatcgcacccactgcacagcctgaggagttgctgaatggcgctccatccccccctgcagttgatctgtcccccgtctcggaacccgaggaacaggctaaagaggtcaccgctagcatggcgccacccactattccctccgccaccccagccaccgcaccctctgccacttcaccagcacaggaggaagagatggaggaggaagaagaagaagaggaaggagaggccggagaggctggagaggccgagtctgagaagggtggcgagtag

SEQ ID NO: 15086 - DNA, 1836 bp, Artificial Sequence
  Description of Artificial Sequence: Synthetic coding sequence
atggccgcctctgccaagaagaaaaataagaaagggaagacaattagtctgaccgatttccttgctgaggatggcggcacagggggaggctccacctatgtatccaagcccgtgagctgggctgacgagacagacgacctcgagggagacgtgtccactacttggcattccaacgacgacgacgtataccgagcaccccctatcgacagatccatcctgcccactgcgccaagagctgccagagaaccaaacattgacaggtccagacttccaaagagccccccctacacagcattccttggcaatcttccctacgatgtgacagaggagagtattaaggaattcttcaggggactgaatattagcgccgtccggctgcctagggagccctctaaccccgagcgactgaagggatttggatacgcagagtttgaagacctggattcactgttgagcgccttatcattgaatgaggagagccttgggaaccgacgtatacgggtggatgttgcggatcaggcccaagacaaagatagagacgataggtcctttgggcgcgacagaaatagggatagcgacaagaccgacactgattggcgcgctcgaccagctacagatagttttgatgattaccctccccgtaggggcgatgactcatttggagacaaatacagagaccggtacgattcagacaggtacagagatgggtaccgagacggttatcgtgatggacccagaagagatatggaccgatatggcgggcgtgatcggtatgacgataggggttccagggactatgatagagggtatgactccagaatcggttctgggcgccgggccttcggaagcgggtaccggagggacgacgattacagaggcggaggcgaccgatatgaggacagatatgacaggagggatgatcgctcgtggagtagcagggatgactattccagggacgattaccggcgagatgatcggggcccaccccaaagacctaaactgaacttgaagccccgctctacccccaaagaggacgactccagcgcaagtacctctcagtccacacgagccgcttctatttttggtggtgccaaaccggtagataccgcggcacgagaaagagaagtggaagaaaggctccagaaggaacaggagaagctgcagagacaacttgatgaacctaaattggagaggcgtcctagagaacgtcacccatcctggaggtctgaagagacccaggagcgcgaaaggtccagaaccggcagtgagagtagccagaccggaactagtacaacatcttccagaaatgcccggagacgggaatctgaaaaatccctcgaaaacgaaacgctgaataaggaggaggattgtcactctcctacaagcaagccaccaaaacccgatcaacccttaaaagtcatgcccgcaccgccaccgaaagagaacgcttgggtcaagcggtcgtccaaccctcctgcgcgttcccagagctctgacactgaacaacagtcgcccacctctggcggcgggaaggttgcgcctgcacagccgtcagaggagggtcctggacgcaaagacgaaaacaaagttgacggtatgaacgcgccaaaagggcagactggcaactcatctcgcggtccaggcgatggaggaaatcgggatcactggaaggaatccgataggaaagacgggaagaaagatcaggatagtcgttcagcacctgagcctaagaagccggaggagaacccagcaagcaaatttagcagtgccagcaaatatgcagcactgtctgtggatggagaagatgagaacgagggggaggattatgccgagtag

SEQ ID NO: 15087 - DNA, 1764 bp, Artificial Sequence
  Description of Artificial Sequence: Synthetic coding sequence
atggcagcctctgctaaaaaaaagaacaagaagggcaagacaatctcactgacagatttcctggccgaggatgggggaaccgggggcgggagtacttacgtgagcaaaccggtgtcgtgggctgatgaaacagacgacctcgagggggacgtctctacgacttggcactctaatgacgacgatgtgtaccgagcacctcccattgatcgcagtatcctgccgactgctcccagagctgcaagagagccgaacattgaccgctcccgtctgcctaaatctccaccatatacagcatttcttgggaacttaccttatgacgtgacagaggagagcattaaggaattctttcggggactgaacatcagtgcagttcggctcccgcgcgaaccatcgaacccagagcgcctcaagggctttggatatgccgaatttgaggatcttgacagtctcctctcagcactgtcacttaacgaagagtctctcggcaatagaaggatccgggtggatgtcgccgaccaggcccaggataaggatcgggatgacaggtcattcggcagagacagaaatagagatagcgataagacggatacagattggcgcgcccgtccagccacagactcttttgacgactacccccctcgcaggggggatgattcattcggggataagtatcgggatcgatacggtggacgggaccgctatgatgatcgcgggagtcgagactacgaccgcgggtacgacagcagaatcggctcaggccgacgtgctttcggctccggctatcgaagagatgacgactataggggaggcggcgatcgttatgaggacaggtatgacagaagagatgatcgaagctggtcgtcacgtgacgactacagcagggatgattatcggcgcgacgacagagggcctccccagagaccgaaacttaatctcaagccgaggagcacccccaaagaggatgattcttctgcgagcacgtcgcaatccacacgcgcagcatctattttcggaggcgccaaacccgtggatactgctgcaagagagagggaggtggaagaacgcctgcagaaagagcaggagaagttgcagcggcagctggatgaacctaagttagaacggcgtcccagagagaggcatccaagttggaggagcgaggagacccaggagagggagcgatcaagaaccggatccgaaagcagccaaacaggtacatctactacttcgtcgcgaaacgctcgaagaagggagagcgaaaagtcattggagaatgagacactcaataaggaggaggactgccacagcccaacctccaaaccccccaaacctgaccagcctctgaaagtgatgcccgccccaccccccaaagagaatgcctgggtcaagcgaagttcgaacccccctgcaagatctcagtcgtccgacaccgaacagcaatctccaacctctggcggggggaaggtggcacctgcccaaccgagtgaggaggggcccggacgcaaggacgaaaacaaggttgatgggatgaatgctcccaaaggacagactggaaatagttctcgtgggccaggagacggcggaaaccgcgatcactggaaggagagtgacagaaaggacggtaaaaaggatcaggatagtaggtctgcacccgaacccaaaaaacccgaagaaaatccggcttctaagtttagtagcgcatctaaatacgccgccctcagtgtggacggagaggatgagaatgaaggggaggactatgccgaatag

SEQ ID NO: 15088 - DNA, 714 bp, Artificial Sequence
  Description of Artificial Sequence: Synthetic coding sequence
atgctagacctgacatcccgtggacaagttggtactagtcggcggatggccgaggcagcctgcagcgcacatttcttagagaccacgcccacgcctaaccctcccaccacggaggaagagaagactgaatctaatcaagaggtggccaatccagagcactacatcaagcaccctctgcaaaacaggtgggctttgtggtttttcaagaacgataaatctaagacctggcaggcgaatctacgcctgatatccaagttcgatacggtagaagacttctgggccttgtacaatcacattcaactcagcagcaatctaatgccaggctgtgattattccctcttcaaggatggcattgagcccatgtgggaggacgagaaaaataagcgtggcggaaggtggctcattacattgaacaaacagcagaggaggagcgacctggatcggttctggctggagacactgctgtgtttaatcggggagtcattcgacgactattccgacgacgtatgcggagcagtagtgaatgttcgtgccaagggtgataaaattgccatctggacgactgagtgtgagaaccgggaagccgtgacccatatcgggcgtgtttacaaggaaagactgggtcttcccccgaagatcgtgataggttatcagagtcacgccgacacagccaccaagtcaggtagcacaacgaagaaccggtttgtggtgtag

SEQ ID NO: 15089 - DNA, 654 bp, Artificial Sequence
  Description of Artificial Sequence: Synthetic coding sequence
atggccacagttgaacctgaaaccacacctacccccaacccccccactactgaggaggagaagacagagagcaaccaggaggtcgctaatcccgaacactatataaaacatccgttgcagaaccggtgggctctctggttctttaaaaatgataagtcaaaaacttggcaagcaaacctccgcctcatctcaaagtttgacacagtggaagacttttgggctctgtacaaccatattcagctgtcttcaaacctgatgcctggctgcgattacagcttgttcaaagacgggattgaaccaatgtgggaagatgagaaaaacaagagagggggaagatggctgatcacattgaataagcagcagaggaggtccgacctggatcgcttctggctcgaaacactgctgtgtctgataggtgagtcttttgatgattattctgatgacgtctgcggtgcagtggtgaatgtgcgggccaaaggcgacaaaatcgctatctggaccacagagtgtgaaaatcgggaagcagtcactcacattggtagggtttacaaagagcgcctaggactgcctccgaaaatcgtgattgggtatcaatcgcacgctgatacggccaccaaatccgggagtacgactaaaaataggtttgtcgtgtag

SEQ ID NO: 15090 - DNA, 747 bp, Artificial Sequence
  Description of Artificial Sequence: Synthetic coding sequence
atggcgactgtagaaccagaaactacgccaacacccaaccctcccaccaccgaggaagaaaagacggagtcaaatcaagaagtcgcaaatccagaacactacatcaaacaccccctccaaaaccggtgggccctgtggttttttaaaaacgacaagtccaaaacatggcaggctaatttgcgtctgatatccaagttcgacacagtggaagacttctgggctctctacaaccatatacagctgtcctccaaccttatgccgggctgtgattattccctttttaaggacggaatcgagcctatgtgggaggatgagaaaaacaaaagaggcggacggtggctcattacactcaataagcaacaaaggaggtctgatcttgacaggttttggttagaaacccggtgggatctggcaatgcttcctcgcctggtgagcaacttttggccacaggtcatactccccttacagccacccaaagttctcgagctccagctgctctgtctgataggcgaatccttcgatgactatagcgacgacgtgtgcggcgctgtcgtgaacgtgagggcaaaaggggataagatcgccatttggacaaccgagtgcgagaatcgcgaggccgtaacccatataggaagagtatacaaggaaagactcgggctgccaccaaaaatcgtgatcggataccagtcacacgcagacacagcgaccaagtcaggctccaccacaaagaataggtttgttgtgtag

SEQ ID NO: 15091 - DNA, 357 bp, Artificial Sequence
  Description of Artificial Sequence: Synthetic coding sequence
atgagtggaggcagttcttgctctcaaacaccatctagggcgattcccgctactcgtagggtggtccttggcgatggcgtccagttgccaccgggggactattctaccactcctggtggtacgttatttagcacaacccctggaggcaccagaatcatatatgatcgcaagtttttaatggaatgtagaaactctcccgttacaaaaacccctccccgcgatctgccaactatcccgggcgtaacttctccaagcagcgatgagcctcctatggaggcgagccagagccatctgaggaacagcccggaggataagcgcgccggcggcgaagagtcccagtttgaaatggacatatag

SEQ ID NO: 15092 - DNA, 1857 bp, Artificial Sequence
  Description of Artificial Sequence: Synthetic coding sequence
atggcttctaccgattactccacctatagtcaggccgctgcgcagcagggttactctgcttacactgcgcagccaacacagggctatgcccagaccacccaggcctacgggcagcaatcatacggtacctatggacagccgactgatgtatcttacactcaggcccaaactactgccacatatgggcagaccgcttatgccaccagctacggtcagccaccaacgggctacacaacaccaacagcaccccaagcctattcccaacccgtccagggctacggaactggtgcttatgataccaccaccgccaccgttaccaccacacaagcaagttacgcagctcaaagtgcctacggtactcagcccgcatatccagcatacgggcagcaaccggctgccactgcaccaacgagaccacaggatggtaacaagcctactgaaacgtcacagcctcaatcgagcaccggagggtataaccagcctagccttggatacggtcagagtaactactcatacccccaggtccctggttcatatcccatgcagccagtgaccgccccgccttcatacccccccactagctattcttcaactcagcctacttcctacgatcaatcctcttactcacagcagaacacatacgggcagccaagttcttatggtcagcagtccagttatggccagcagagctcctatggccagcagccgcctaccagctatccaccccagaccggttcttactcccaggctcctagccagtattcccagcaaagctctagctacggacagcagtcctcattccggcaggaccatccgtcttctatgggcgtctacggacaggagtctggaggattcagcggtcccggcgaaaatcgctctatgtcagggccagacaacagggggcggggccgcggcggcttcgacaggggcgggatgagccgggaccccgacgaggattccgacaattctgccatttacgtgcagggacttaatgacagcgtgactttagacgacttagcggatttcttcaagcagtgtggtgtagtgaaaatgaataagcggactggacaacctatgatccacatctatctggacaaagagactggcaagccgaagggcgatgctacagtgtcttacgaggatccccctactgctaaggccgctgttgagtggttcgacgggaaggatttccaaggcagtaaattaaaagtgtctctggcgcgtaagaagcctcccatgaactcgatgcgtggggggctgcctccaagggaaggaagaggtatgccgcctcccctccggggcgggccgggtggccctggtgggcctggcggtcctatgggaagaatgggtggtagaggaggcgacaggggtggcttcccacccagaggccctcggggcagtagggggaaccctagcggtggcggtaatgtacagcacagggccggcgattggcagtgcccaaatcccgggtgtggcaaccaaaactttgcatggcgaaccgagtgcaatcagtgtaaagccccaaagcctgaggggttcctgcctcccccctttcccccaccagggggcgatcgcggccgtggcggtcctggaggcatgcggggagggagaggtgggctgatggatcgcggagggcccggcgggatgttccggggcggccgtggaggggatcgtggtggatttaggggcggccggggaatggaccgcggagggtttggtggtggcaggagaggaggccccggtggcccccctggtccactcatggagcagatgggaggaaggagaggcgggaggggcggcccgggaaaaatggacaaaggagaacataggcaggagcggcgcgaccgcccctactag

SEQ ID NO: 15093 - DNA, 1803 bp, Artificial Sequence
  Description of Artificial Sequence: Synthetic coding sequence
atggccagcaccgattattcaacctattcccaggccgcagcgcagcagggttactctgcttataccgctcaacccacccagggatatgcccaaacaactcaggcttacggccagcagagttatggtacctatggccaacctacggatgtatcatacactcaggctcagactaccgcaacctatggacagacagcctatgccacctcgtacgggcagcccccaactggatatacaaccccaaccgctcctcaggcttactctcagcctgttcaagggtatggcacaggggcttacgacaccacaacagcgactgtgaccaccacccaagcttcgtatgctgctcagagcgcctatggcacccaacctgcctaccctgcatacgggcagcagcccgcagcgacagcccccacttcttacagtagcacccagcccacgagctatgatcagtcaagctactctcagcagaacacgtacggtcagcccagcagctatggccagcagtccagctacggccaacagtcttcctatggccagcagcctccaactagttaccctcctcagacagggagctacagtcaggcaccctcacaatatagtcaacaatcaagtagctacggccaacagtctagctttaggcaagatcatccctctagcatgggggtatacggacaagagtcgggtggattctccggccccggagaaaatagaagtatgagtggaccagacaaccgcggccggggaagaggaggatttgatcggggggggatgtctagagggggaaggggtgggggccggggcggcatggggagcgccggtgagcggggcgggtttaacaaaccaggtggccccatggacgagggaccagatctagaccttggccccccggttgacccagatgaggactctgacaacagcgccatctacgtccaagggctcaacgattcagtcacgcttgacgatctcgccgacttcttcaaacagtgtggcgtagtaaaaatgaacaaacgaacaggccagccgatgatccatatttatctcgacaaggaaacagggaaacctaagggggacgctaccgtgagttacgaagatccgccaacggctaaagccgctgtagagtggtttgacgggaaagatttccagggatccaaactcaaggtgtcactagcgagaaagaaaccacccatgaattcaatgagaggcggccttcccccacgggagggccggggaatgccacctccgctgcgcggcgggccaggtggccccgggggacccggaggtccaatgggccggatggggggcagaggaggcgatcgcggaggttttcccccccgtggtcctcggggaagccgtggcaacccctcagggggcgggaacgtgcagcacagagcaggcgactggcagtgccctaaccctggttgtggtaaccaaaatttcgcctggaggaccgagtgcaaccagtgtaaagcccctaagcccgaagggtttttgccccctccatttccccccccaggaggcgaccgggggcgtgggggtccaggcggcatgcgcggcggccggggcggtctgatggaccgcggggggcctggtgggatgttcaggggggggcgaggaggtgaccggggtggcttccgagggggaaggggcatggaccgtggaggattcggcggtggccgtcggggaggaccggggggacccccaggacctctcatggaacagatgggcggccggaggggtggcagaggcggcccaggcaagatggataagggcgaacataggcaagaacgacgggacagaccgtactag

SEQ ID NO: 15094 - DNA, 1752 bp, Artificial Sequence
  Description of Artificial Sequence: Synthetic coding sequence
atggctagcactgactattctacctattcgcaggctgctgcccaacaggggtactccgcctacaccgcccagcctacccaggggtacgctcagactactcaagcctacggtcagcagagctacggaacatacggccaacccacagatgttagctacactcaggcccaaactaccgcaacatacggccagaccgcttacgccacaagctatggacagccccctaccggctatacaactcccaccgccccccaggcctacagtcagcccgtgcaggggtatggtactggtgcttacgacactaccaccgcgaccgttacaaccacacaagcttcttatgcagctcagagcgcttatggaacccagcccgcttatcccgcttacgggcagcaacccgctgcaacagcaccaaccagacctcaggatggcaacaaacctaccgaaacctctcagccccagtcctcaaccggcgggtacaaccagccgagtctggggtatggtcaaagtaattattcttacccccaggtgccagggtcttatcctatgcagcctgtgacggcccctccttcatacccccctacgtcatactctagcactcagcccaccagttatgaccagtcgtcttacagccagcagaacacctatggacagccatcttcctatggtcagcaaagtagttatgggcagcagagtagttatggccaacagccacctaccagctacccccctcaaaccgggtcttacagccaggccccatctcagtatagccagcagagctcctcctatggccagcagagaccaatggacgagggacctgacctggatctcggaccacctgtcgatcccgatgaggactctgacaactctgcgatatatgtgcaaggcctgaacgacagcgtcaccctggatgatctagccgatttcttcaaacagtgcggagtcgtgaaaatgaacaagcgcactgggcaacccatgattcatatctatctcgataaggagactggtaagccaaagggtgacgcaactgtgtcttacgaagatcccccgaccgccaaagcagcggtggaatggtttgatggcaaggacttccagggttcaaagctgaaggtaagtttagcgcggaagaagccccccatgaactctatgcggggaggacttcctccgcgggagggaaggggtatgcctccacccctgagagggggtccggggggacccggagggccaggcggcccaatgggacgaatgggaggtaggggcggggatcgagggggcttccctccccgcggaccaagggggtcacgaggtaatccgagcggggggggcaatgtccaacatcgggccggcgattggcagtgcccaaatcccggatgcggtaaccaaaatttcgcttggagaacggaatgcaatcagtgcaaggccccaaaacctgaaggcttcttaccgcctcctttccctcctccaggaggagaccgcgggaggggtggcccggggggtatgcgggggggtagaggtggactcatggatcggggcggcccgggcggcatgtttcgcggaggccgtggtggggacagaggaggctttaggggcgggcgggggatggaccggggtggatttgggggtgggaggcgaggtggcccaggggggcctcccggaccacttatggagcagatgggcgggaggagaggtggccggggtggcccaggaaagatggataaaggcgaacatcgacaggaacgccgtgacagaccatactag

SEQ ID NO: 15095 - DNA, 1971 bp, Artificial Sequence
  Description of Artificial Sequence: Synthetic coding sequence
atggcatcaacagattacagcacctactctcaggccgctgcccagcaggggtatagcgcctacactgcccagccaacccaagggtacgcgcagacgacacaagcttacggccagcaaagctatggaacgtatggtcaaccaaccgatgtgtcctatacacaagcacagactaccgctacttacggccaaactgcatacgcaacatcatacgggcagcctccaacaggttatacgaccccaactgcgcctcaggcgtactctcagcctgttcaggggtacggaaccggggcttatgacacaacgaccgcaaccgtcaccacaactcaggcctcctatgccgcacaaagtgcatatggtacccaacccgcataccccgcttacggccagcagcctgctgccacagcgccaactcgtccccaagacggcaataagcccacagagacctcgcagcctcagtccagtaccgggggatacaaccagcccagcctgggatacggtcagtcaaattacagctatcctcaagttccgggtagctaccctatgcaaccagttaccgcaccgccttcttacccccccaccagctatagcagcacacagcctacgagttacgatcagtcttcttacagccagcaaaatacatatggccagcccagcagctacgggcagcagtccagctacgggcagcaatcttcctacggacagcagcccccaacctcctacccccctcaaaccggctcctattcgcaggctccctcccagtattcccaacagagttcgtcctatggacagcagagcagtttcagacaagatcacccctcaagcatgggcgtctacgggcaggagagtggcggtttctccggccccggggaaaaccggagtatgagtggacctgacaataggggtagggggcggggaggattcgatcgcggcggaatgagccgcggaggcagaggcggtggtagggggggcatgggttcagccggagagaggggtggctttaacaaaccaggaggacccatggatgagggccctgacctggacttggggcctcccgtggacccggatgaggacagcgacaactctgccatctacgtccagggacttaacgacagcgtgactcttgatgacctggccgacttcttcaagcagtgcggcgtcgttaagatgaacaagcgcacaggccagcctatgatccacatatacctggacaaggagacaggtaagcctaagggagacgccaccgtgagctatgaggaccccccgacagccaaggcggccgtcgaatggttcgacggaaaggacttccagggctccaagctcaaagtttcgctcgcccggaagaaacctccaatgaacagtatgaggggaggccttccccctagagagggccgcgggatgcctcctccactccgcggtggccctggtggccccggaggaccaggaggccctatgggacgaatgggtggacggggcggcgatagaggcgggttcccaccccggggtccacggggcagtagaggtaatccctctggtggaggcaacgtccagcaccgcgctggggattggcagtgtccaaatccggggtgcggcaatcagaactttgcatggcgaacagaatgcaaccagtgtaaggctcccaagcccgagggattcctcccgcctccgtttcctccccccgggggagacagggggcggggcggcccaggtggcatgcgcggggggcgcggcggcctcatggacaggggggggcctggaggcatgtttagaggggggagggggggggaccgcggcggatttagaggcggccgcgggatggatcggggcggatttggaggaggtaggcgaggagggcccgggggccctcctggccccttaatggagcagatgggtggcaggcgcggtggccggggcggtcccgggaaaatggacaagggcgagcacagacaggagaggcgcgacaggccctattag

SEQ ID NO: 15096 - DNA, 1968 bp, Artificial Sequence
  Description of Artificial Sequence: Synthetic coding sequence
atggcatcaacagattatagcacctactcacaggccgctgctcaacaggggtactccgcctacaccgcccagcccactcagggatacgcgcagacaacacaagcctacgggcagcagtcatacggtacttacgggcagcccacagatgtgagttacactcaggcccaaacaactgcaacttatgggcagacagcttacgccacatcctatggacagcctcctaccgggtatactacacctactgcaccacaggcatactcccagcctgtgcaaggctatggcacaggtgcttatgacaccactacagccaccgttactacgacccaggcttcctacgctgctcagtccgcctacggcacccagcccgcctatccggcgtatgggcagcagcccgctgcgactgctcccacacgccctcaggatggcaacaagcccaccgaaacatctcagccgcagtcatctacgggaggatacaatcaacccagcttggggtatggacagtctaactatagctatcctcaagtgccaggaagttatcccatgcagccagtgaccgcccctccttcctatccaccgacctcctattcaagcacccaaccaacctcatatgatcagagctcttactcacaacaaaatacctacggtcagccttctagttacgggcagcagagctcgtacgggcagcagtcttcttacggccaacagccacccaccagctacccccctcaaaccggctcatacagtcaagccccctcccagtactctcagcaatcttcctcatacggccaacagtcttccttccggcaagaccaccctagcagtatgggggtttacggccaagagagtggagggttttccggtccgggggagaataggtccatgtctgggcccgacaatcgcgggaggggtcgtggaggtttcgaccggggcgggatgagcaggggtgggagaggaggtgggcgaggtggaatgggcgccggagaaagaggtggatttaataagccaggagggcctatggacgaggggccagatctcgacctcggaccacctgttgaccccgacgaggactccgacaacagtgcaatatatgttcagggattgaacgattccgtgactctggacgacctcgccgacttctttaaacagtgcggtgtagtaaagatgaacaaaaggacggggcagcctatgatccacatttacctggacaaggaaaccggcaaacccaaaggggatgcaactgtgtcttatgaggatccacctacggctaaagccgccgtcgagtggttcgacggaaaggatttccaaggcagtaagctcaaagtgtccttagccagaaaaaaacctccaatgaatagcatgagaggtgggctgccccccagggagggccgcggcatgccaccacctctaagggggggaccgggggggcccggtggcccgggcggcccgatgggtcggatggggggaaggggaggcgatcgaggaggctttccaccacgtggaccaagggggagccggggtaacccaagtggtggcggtaatgttcagcacagggcaggtgactggcagtgcccgaatccaggatgcggcaaccagaattttgcctggagaactgagtgtaaccagtgtaaagctccaaagcctgagggctttctccccccgcctttcccgccacctggcggcgatagaggacgggggggcccaggagggatgaggggtggaagagggggtctcatggaccggggcggtccagggggaatgttccggggcggacgtggcggagaccgaggcggtttcagagggggaaggggaatggaccgtggagggtttggcggtggacgtcggggcggtccaggggggccaccaggtcctctcatggaacagatgggaggccgccgtggggggcgcggcggcccagggaagatggacaagggtgaacatcggcaggagcggagggacaggccatattag

SEQ ID NO: 15097 - DNA, 1986 bp, Artificial Sequence
  Description of Artificial Sequence: Synthetic coding sequence
atggcaagcaccgactattcaacctacagtcaggctgcagcacaacaaggttactcagcgtacacagcacaacctactcagggatatgctcaaacaacacaggcttatggccagcagtcgtacggcacctatggacagcctaccgacgtctcctatactcaggcccagactactgccacctacgggcagacggcgtacgctacttcctacggccaacctccgacagtcgagggtactagcaccggatatacaacaccaactgctccccaggcttacagccaacctgtgcagggatatggcacaggagcgtatgatacgaccacggccactgtgactaccacacaggcttcgtatgccgctcaatccgcctacggaactcagccagcctacccggcatatggacagcagccggccgcaactgctccaaccaggccacaagatggtaacaaaccaacggagacgtcgcagcctcagagttctacgggcgggtacaaccaaccttcgttgggctacggccagagcaactattcttaccctcaggtgcctgggtcttatccaatgcagcccgttacagctcccccttcgtaccctcccacctcctactccagcacccaacccaccagctacgaccagtcaagctattcacagcagaatacatacgggcagccgtctagctacgggcagcagagctcttatggtcagcaaagttcatatggacagcagccccccacttcgtatccgcctcagactggcagctactcccaagccccctcacaatatagccagcagtcctctagctatggtcagcagagttcttttcggcaagaccatccaagctccatgggtgtgtacggtcaggaaagtggaggattttctgggcccggtgagaacagatcaatgagcggcccagataaccgggggcgaggaaggggtgggttcgaccggggcggcatgtcccgagggggcagggggggaggccggggcggcatgggggcaggagagagaggaggctttaacaaaccaggcgggcctatggacgaggggcccgacctggacttgggtcctcctgtggacccggatgaggactccgataactcagccatctatgtccagggcttgaacgacagcgtaacccttgatgacctggccgatttctttaagcaatgtggagtagtgaaaatgaataaacgaactggccagccaatgatccacatttacctggataaagaaacaggcaaaccaaagggagacgccacagtttcgtacgaggacccccctactgccaaggctgctgtagagtggttcgatggtaaagatttccagggcagtaagttgaaggtttctttagcaagaaaaaaacctcctatgaactcaatgcgaggcgggctcccacctagagagggcagaggaatgccccctccgctgagaggagggccagggggacccggcgggccaggaggtccaatgggccgtatgggtggacgcggtggcgaccgtggaggcttccctcctcgcggaccaagaggatcccgggggaatccctccggaggcggaaatgttcaacaccgggccggagactggcagtgtccgaaccctggatgtgggaaccagaatttcgcttggcgcactgagtgtaaccagtgcaaggccccaaagccggagggattcctccctcccccattcccccccccagggggcgacaggggacgcgggggaccgggtgggatgaggggaggccgtgggggactgatggacagggggggccctgggggtatgtttaggggtgggaggggaggcgaccgcggcggctttaggggcggcagagggatggatcgcggaggcttcgggggaggacgcagagggggccccggggggcctccaggacccctgatggagcaaatgggaggaaggagaggtggccgcggggggccaggcaaaatggacaagggcgagcatagacaggaacggcgggaccggccatattag

SEQ ID NO: 15098 - DNA, 543 bp, Artificial Sequence
  Description of Artificial Sequence: Synthetic coding sequence
atggcaagcacagattattctacctactcacaagccgccgcccagcagggctactcagcatacaccgcccaacccacccagggttatgcgcagacaactcaagctagttatgctgctcaaagcgcctatgggacccagcctgcctaccccgcatacggccaacagcccgcagcaaccgcaccaacgagaccccaggacggaaataaaccaaccgaaacgtctcagccccagagctcaaccggaggctataatcaacccagcctgggatacggccagtctaactattcttaccctcaggtgcccgggtcttatcccatgcagcccgtgaccgccccaccaagctaccccccgacatcgtacagcagtacccagcccacttcatatgatcaatcttcgtactcgcaacagaacacatacggtcagccctcctcctatggacagcagtcttcttatggccagcagtcctcgtacgggcagcagccccccaccagctacccaccacagactgggtcatatagccaagctccgagccagtacagctag

SEQ ID NO: 15099 - DNA, 1065 bp, Artificial Sequence
  Description of Artificial Sequence: Synthetic coding sequence
atggcctcgacagactactctacgtacagtcaagctgctgcccagcagggctacagcgcctacactgcccagccgactcagggctacgcgcagactactcaagcttatggccaacaaagttatggaacatacggacagccaaccgacgtctcctacacccaagcacagactacagccacatacggacagacagcctacgcaacatcttatggacagccaccaacggggtatacgacccccacagccccccaagcatacagccagccagtacagggctacggcacgggggcttatgatacgacgacggccaccgtcaccaccacccaagcgtcttatgcagcccagagcgcttatggcactcagccggcttaccccgcttacgggcagcaacccgcggctaccgctcccacacgtcctcaggacggaaataagccaacggagacatcccagccgcagagctctaccggagggtacaaccaaccatccctgggctatggccagtcaaattactcatacccacaggttcccggctcgtacccaatgcaacctgtcactgccccaccctcttatccacctacaagctactccagtactcagcctaccagctatgatcagtcctcatactcccaacaaaatacgtacggccaaccatcctcatacggacagcagtccagttacggacagcaatccagctatggacagcaacccccaacaagctatcctccacagacaggttcatatagtcaggccccctcgcagtacagccaacagtcatcctcttacgggcagcagtcttccttcaggcaagatcatcccagttctatgggggtgtacggacaggagtctggcggtttcagcgggccgggtgagaaccggtcaatgagcgggcccgacaaccgcgggcggggacggggcggattcgaccgggggggtatgagcagaggcggacgtggcggagggcgcggcggcatgggcctgcagtccgaatccctcgtgtacacatcaatcctgaaaaaatacccctacagcgtgctttcccgccaacataatgagaaatgggattag

SEQ ID NO: 15100 - DNA, 972 bp, Artificial Sequence
  Description of Artificial Sequence: Synthetic coding sequence
atggaccccggaaaggataaggaaggcgtgccacagccatctggacctcccgctcggaaaaaatttgtcattccactcgacgaggatgaggtgcctcctggtgtggcaaaaccgctgttcaggtccactcaatccctgccgactgtggatacgtctgcccaagccgcaccacagacctacgctgagtacgctatctcacagcccctggagggcgccggggccacatgtccgaccggatctgagcccctggccggggaaacaccgaatcaggcgctgaaacctggcgctaagtctaactcaatcatagtaagcccacggcaacgagggaatcccgtcctgaaattcgtgaggaacgtcccttgggaatttggcgatgtcattcccgactatgtactcgggcagtccacctgcgccttgttcttatcactgcgctaccacaatttacaccctgactacatccacggcagactgcaatctctggggaagaattttgccctacgagtactgctcgtgcaagtggatgtgaaggaccctcagcaggctttgaaagagctcgccaaaatgtgcattcttgcagactgtactctcattctcgcatggtctccagaagaagccggtagatatcttgagacttacaaagcctatgagcagaagccggcagatcttctcatggagaagcttgaacaggatttcgtgtcccgggtgaccgagtgtctcaccactgtgaagagcgtaaataaaacagattcccagacactgcttacgacgttcggtagcctcgagcagctcatcgccgcgtctcgcgaggacttagccctctgccctggactgggacctcaaaaggtgcgggctctgggcaaaaatcctcggtcttggggcaaggagagggccccgaacaaacataacctgaggccgcagagctttaaggtaaaaaaggagcctaagactaggcactccgggttccgactgtag

SEQ ID NO: 15101 - DNA, 894 bp, Artificial Sequence
  Description of Artificial Sequence: Synthetic coding sequence
atggaccccggaaaggacaaggaaggggttccccagcccagtggaccgcccgctcggaagaagtttgtgataccactggatgaagatgaagtcccccctggagtggccaagcccctgtttagatctacccagtctctgcctacagttgacacaagcgctcaagctgcacctcaaacctatgcagaatacgccattagtcaacccctggagggcgccggtgccacatgcccgaccggtagcgagcctctggctggcgagacccccaaccaagcactcaaacctggtgccaagagcaatagcatcatcgtcagtcctcggcagcgtggcaacccggtgttgaaattcgtaagaaatgtgccctgggagtttggcgatgtgatccccgattatgtgttgggacagtcaacttgtgccctatttctgagcctccgctatcacaatctacaccctgactacatccatggcaggctacagtctttgggcaagaatttcgccttaagggtgttactcgtccaggttgatgtaaaagatcctcaacaagcgctgaaagaattggccaaaatgtgcatactggccgattgcacattgattctggcgtggtctccagaagaggccggtagatatcttgaaacatacaaagcctatgagcaaaaacctgctgacctgctgatggaaaagctggagcaagactttgtcagcagagtgacggagtgccttacaacagttaaatctgtgaataaaactgatagtcagaccctactcaccaccttcggcagtttggaacagcttatcgccgcctcaagagaggacctggcactgtgtcccgggctgggcccccaaaaagctaggcgtttatttgacgtgttacatgagccattcctgaaagttccatag

SEQ ID NO: 15102 - DNA, 822 bp, Artificial Sequence
  Description of Artificial Sequence: Synthetic coding sequence
atggacccaggcaaggacaaagaaggagtcccacagcccagcggaccaccagcgaggaagaagtttgtgataccactggatgaagacgaggtcccccctggggttgccaaacccctttttaggagtactcagagtctgccgacggtggatacttccgcccaagcggcccctcagacttatgctgagtatgcaatcagccagcctctggagggcgccggggccacgtgtccgacaggatctgagccattggccggggaaacaccaaaccaagccttgaagccgggcgctaagagcaactcaattatcgtgtcgccaagacagcgaggcaatcctgtcttaaaattcgtgaggaacgtcccctgggagtttggagatgtgatccctgattacgtgcttgggcagagtacttgcgccctatttttgagtcttcgttatcacaacctacaccccgactatatccatggccggctgcagtctctcgggaagaactttgcactgagagtgctgttagtccaggtggacgtgaaggatccacagcaggcattgaaggagctcgccaagatgtgcattctggccgactgtacactgattctggcctggtcccctgaagaggcaggacggtacctcgagacctataaggcgtacgaacaaaagcccgctgacttactaatggaaaagttggagcaggacttcgtttcacgctcactggaacagctgattgcagcttcacgtgaggacctagcgctgtgccccggcttagggccacagaaagctagacgcctgtttgatgttttacatgaacccttcctgaaggtcccgtag

SEQ ID NO: 15103 - DNA, 678 bp, Artificial Sequence
  Description of Artificial Sequence: Synthetic coding sequence
atggatcccggtaaagataaagaaggtgtcccccagccaagtgggcctcccgccagaaaaaagttcgtgatccctttagacgaagacgaagtcccaccgggagtgcgcggaaacccagtgctgaaattcgtgcggaatgtgccgtgggaatttggagatgtaatccctgattatgtattgggacagtcaacatgcgccttgttcttatccctcaggtaccacaacctgcatcccgactacatacacggcaggttgcagagtttaggcaaaaactttgccctcagggtgctattggttcaggtagacgtgaaggatccgcagcaggcgctgaaggaattagcaaaaatgtgtatcctggcggactgcaccctgattcttgcttggagccccgaagaggccggcaggtaccttgagacttacaaggcttacgagcagaagccggcagatttactcatggaaaagctggagcaagattttgtgagcagagtgaccgagtgtctgacgacagtaaagtccgtgaacaaaaccgactctcaaaccttgctgacgactttcggaagcctggaacagctgatcgccgcgtcgcgggaagacttggccctatgcccaggtctgggcccccagaaggcaaggcggctgttcgacgtattacacgagcctttcctcaaagtgccatag

SEQ ID NO: 15104 - DNA, 120 bp, Artificial Sequence
  Description of Artificial Sequence: Synthetic coding sequence
atggatccagggaaggacaaggaaggtgtcccacagccttccggaccgcccgctaggaagaagttcgttattcccctggatgaagacgaagttcctcctggtgtctccaaacccttgtag

SEQ ID NO: 15105 - DNA, 726 bp, Artificial Sequence
  Description of Artificial Sequence: Synthetic coding sequence
atggctagcctaagcggactcgcctcagccctcgagtcttataggggccgggaccggctgatccgagtactaggctattgttgccagctggtcggaggggtgctcgtcgaacagtgccctgctcggagcgaagtgggtacacgccttttggtagtgagcacccagctctctcattgtcggaccattctgagactgtttgatgaccttgccatgtttgtttataccaaacagtacggtcttggcgcccaggaggaggacgctttcgtgaggtgtgtaagtgtgttgggaaacctggccgatcaattgtattacccttgcgagcacgtggcctgggccgccgatgcacgtgttctgcacgtagattcatcccgctggtggactctctctactactttatgggccctatctctgttactcggggtggctaggtctctttggatgctgctgaaacttaggcagcggttaagatctcctactgcccccttcacatcacccctgccacggggcaagcgcagggcgatggaagcccagatgcagagcgaagcactctctctcctttcaaatcttgcggacttggctaatgccgttcactggttgccaaggggagtactgtgggctgggcgattcccgccttggctcgtggggttgatgggcacaataagtagcattcttagcatgtatcaggccgcaagggctggaggccaggcagaagctactacaccttag

SEQ ID NO: 15106 - DNA, 1218 bp, Artificial Sequence
  Description of Artificial Sequence: Synthetic coding sequence
atgcgcgaactgaagcggaccctggacgccaaaggacacggggtactcgagatgccttctgggacggggaagacagtcagcctgctcgcgctgatcatggcctaccagagggcttacccacttgaggtgacaaagctgatctactgcagtcgcacagttcccgagatcgaaaaggtgatcgaggaattaaggaaactgctgaatttctacgagaagcaggagggggagaagctccctttcctcggtcttgccctcagttctcggaagaatctgtgcattcaccccgaagtcactcctctgagatttggcaaagatgtggacggaaaatgccacagcctgaccgcctcctatgtccgagcgcaatatcagcacgacacaagcctgccccattgcagattttatgaagagtttgatgcacacggccgagaggtccctctccccgccggcatctacaatctcgacgacttgaaagctttggggagacgccaggggtggtgcccttatttcctcgcccgttacagcattttacacgcgaatgtagtggtctacagctaccattacctgctggatcccaaaatcgctgatctggtttcaaaagagctggctcgaaaagccgtggtggtgttcgatgaggcgcataatatcgataacgtttgtatcgattccatgtccgtcaacctgacacgaagaacactcgaccgctgtcagggcaatctcgagactctgcagaagacagtgctcagaatcaaagaaacggacgaacagcgactgcgggatgaataccgccgactagtcgaaggcctgagagaggcttccgcggcccgcgaaactgatgctcatttggctaatcccgtgctgccggatgaggtgttacaggaggccgtccctggctcaatacgaaccgcagagcatttcctcggattcctccgccgtctgctggagtatgtcaagtggcgcttacgagtccaacacgtcgttcaagagagccccccagccttcctgagcggcctcgcccagagggtgtgcattcagcggaagccgctgcgattttgtgccgagaggctgcggagtttactccacaccctggaaataacagacctggcggacttttcgcctcttaccctgttggctaatttcgccactctggtatctacctacgctaagggtcaggcgcagcactgtggtagttccagaaatcagaaacgatcgcatccatag

SEQ ID NO: 15107 - DNA, 2133 bp, Artificial Sequence
  Description of Artificial Sequence: Synthetic coding sequence
atgagggagttgaagcggacgttagatgccaaagcataccccctcgaggtcacgaaacttatctattgttcaaggacagtaccggagatcgagaaagtcatagaggaactgagaaagctcctgaatttctatgaaaaacaagagggagaaaagctgccctttctaggacttgcattgtcaagcaggaagaatctgtgtatacatcccgaggtgacccccctccgatttggcaaagatgtagacgggaagtgtcattctctgaccgcctcttatgtcagagcacagtaccagcatgatacaagcctcccacactgtcgcttctacgaagagttcgacgcccacggccgagaggtgccattacccgcagggatttataacctagacgatctgaaagctctcggaaggcggcagggctggtgcccatattttttggccaggtactcaatcctgcacgctaacgtcgtcgtgtattcgtatcactacctgctagatcctaaaatcgcggatttagtctctaaagaactggcccgaaaggctgtcgtcgtgtttgatgaggcgcacaacatcgacaatgtgtgtattgattccatgtccgtcaatttgactcgccgaacgttagatcggtgtcagggaaatttagagactcttcagaaaacagtcctccggattaaagaaactgatgaacagcgccttcgtgacgagtaccggcgcttggtagagggcctgagggaagcctctgctgcacgtgaaactgacgcacatttagccaacccagtgttgccggatgaggtgcttcaagaggcagtcccaggttcaattcggaccgcagagcattttcttgggtttctccggcggcttctcgagtacgtgaaatggagattaagggtccagcatgttgtgcaggagtcacctcccgctttcctgagtggcctggcccagagggtttgcattcagcggaagcctctacggttctgcgccgaaaggctgcgatcactgctgcatacactggagattaccgatctcgcagatttctcccccttgactttactggctaacttcgcaactctcgtgtcaacctacgctaagggctttacaatcatcattgagcccttcgatgataggactcccaccatagccaaccccatactccacttcagctgcatggacgctagtctggcaattaagcccgtcttcgagcgatttcaatctgttataatcacgagcgggaccctctcacccctggacatctaccctaagattctcgacttccaccctgtgacgatggccactttcacaatgacgctggcccgggtttgcctgtgtccgatgataatcgggagaggtaacgaccaagttgccatcagttctaagttcgaaactcgcgaggacattgccgtcatccgtaattatggcaacctcctcctggaaatgagcgcagtcgtaccagatggaattgtcgcattcttcacttcttaccagtatatggagtcgactgtagcgagctggtacgagcagggaatcttagagaacatccagcggaacaagcttctgtttatcgagacccaggatggcgcggagacatccgtcgctttggagaagtatcaggaagcctgcgagaatggccgtggggcgattttactctctgtggctcgcgggaaagtctcggaggggattgacttcgtccatcattacggcagggccgtgattatgtttggcgtgccttacgtctacacacagtcaaggatcctgaaggctagactggaatacctccgtgaccagttccagattcgggaaaatgactttttgacctttgacgcaatgcgacatgccgcccaatgtgtcggcagggcaatccggggtaaaactgattacggactgatggtcttcgctgataaacgctttgctaggggcgataagagaggtaaactgcctcgctggatccaagaacatctcacagacgcaaacctgaatttgactgtagatgaaggggtgcaagtggccaaatacttcctgcgtcagatggcccagccctttcaccgagaggaccagctcggactgtccctgctgtccttggaacaactggaaagcgaagagacgctgaagagaattgagcagatcgcgcagcaactgtag

SEQ ID NO: 15108 - DNA, 2211 bp, Artificial Sequence
  Description of Artificial Sequence: Synthetic coding sequence
atgcgagagctgaagagaaccttggacgctaagggccacggcgtgctagagatgccttccggcacaggaaaaacagtgtccctgctggcgctgattatggcctatcagagggcatatccgctggaagtgactaagctgatctattgctcacggacagtgcctgagatcgagaaggttatcgaagagctccgcaaactactgaatttttacgagaagcaggagggggagaaactaccattcctcggcttggcactgagtagccgcaagaatctctgcattcacccggaagtgactccactacgctttgggaaggacgtggatgggaaatgccacagcctcactgcctcgtatgtcagagcacagtaccagcacgacacatctctgccccactgccgcttttatgaagaattcgacgcgcacggtagagaagtcccccttccagctggaatctataacttagacgacctcaaggccctggggcgccggcagggatggtgcccatacttcctggctcggtacagtattctgcacgccaatgtggtggtctactcataccactacttgctggatccaaagatcgccgatctggtgagcaaagagctcgcccgcaaggctgtagtggtttttgacgaggcgcataatattgacaatgtgtgtatagattccatgagtgtgaatctcactcgcaggacccttgaccgatgtcagggtaatctggaaactctacagaagaccgtcttgcgaataaaggagaccgacgagcagcgcctcagagatgagtataggagattggttgagggcctccgggaggcatctgccgctcgcgagaccgacgcccatttggcaaatcccgtgctgccagatgaggtgctccaggaagctgtccccggatccatacgcacagccgaacattttctggggttcttgagaaggctactggagtacgtgaaatggaggctccgcgtgcagcatgttgtgcaggagtcgcctcctgctttcttgtccggactggcccagcgggtctgtatccaacggaaacctcttaggttctgtgccgagagactgcggtctctccttcataccttggaaatcactgacctggccgatttctcgccactgactctgctagcaaacttcgccacacttgtgagtacctacgcaaaagggttcactatcatcatagagccatttgacgatcggacgcctacaatagccaatcccatcctccatttctcctgtatggacgcctcacttgcgatcaagccagtgtttgagcgatttcagagcgtaatcatcacatctggaacactgtcacccctggatatctatcctaaaatccttgactttcatccagtcaccatggctacatttacaatgaccttagctcgggtctgcctatgccctatgattatcgggaggggaaatgaccaggtggccatctcaagtaagttcgagacccgggaggacatcgcagttattcggaactacggaaaccttctactcgagatgtctgcagtcgtacctgatgggattgtggcctttttcacatcataccagtatatggagtcaactgtggcttcatggtacgagcaaggcattctggagaacatacagcgcaataaacttctcttcattgaaacacaggacggcgccgaaacttcagtggccctggaaaaataccaggaagcgtgtgaaaacggacggggtgcaattttactcagcgttgcccggggtaaagttagtgagggaattgatttcgtccaccattacggacgagcagtgatcatgtttggggtgccatacgtttacacacaaagtaggattctcaaggcaaggcttgagtacctcagagatcagtttcagatacgggagaacgactttctcacatttgatgctatgagacacgctgcacagtgtgtcggaagggcgatcagaggaaagaccgactacggattaatggtttttgctgacaaacggttcgccaggggggacaaaagagggaagctgccccggtggatccaggagcatcttactgacgccaacctcaatttgaccgtggacgaaggagtgcaagtcgccaaatactttcttcgacagatggctcagccttttcatcgagaggatcagcttggactttctctgctttccctcgagcagctcgaatccgaagaaaccttgaaaaggatcgaacagatcgcccagcagctatag

SEQ ID NO: 15109 - DNA, 2049 bp, Artificial Sequence
  Description of Artificial Sequence: Synthetic coding sequence
atgaaactgaatgttgatggactgctggtatacttcccatatgactacatttaccctgagcaattctcttacatgcgggagctgaagcgcaccctcgacgccaagggccacggtgtgctggagatgcccagtgggactggaaaaacagtatccttgcttgcgcttattatggcttaccagcgagcctatcctcttgaggtgaccaaactcatttactgtagtagaacagtgcccgaaattgaaaaagttattgaagagctgcgcaaactgctaaatttctatgagaaacaggagggtgaaaagctcccattcctcgggctagccctgagttctcggaagaatctgtgtatccaccctgaaattctccatgccaacgtggtcgtgtactcctaccactaccttttagaccccaaaatcgccgacctggtgtctaaggagctcgcgaggaaagctgttgtggtcttcgacgaagcccacaacattgataatgtatgtatcgactctatgtctgttaacctcacacggcgcaccttggaccgatgccagggcaatctcgagaccctgcaaaaaaccgttctccgaattaaagagacagacgaacaacgcctgagggacgagtatcgaagacttgtggaggggctgagagaagcctctgcggccagggagactgatgcacacctggctaatcctgttttgcccgatgaggttcttcaggaagcagtgcctggctccattcgcacagccgaacatttccttggttttctgaggagactgctggaatatgttaaatggcgcctccgcgtccagcacgtggtccaggaatctccgccggcctttctgtctgggttggcacagcgggtgtgtatccagcgcaagcccttgcgcttctgcgccgaaagactgcgctcactcttgcacactttggaaatcaccgatctcgccgatttttcacctctaaccctgcttgccaatttcgccaccctggtgtctacttatgcaaagggatttacgatcataatagagcccttcgacgacaggactcccacgatcgccaatcctatcctgcatttctcttgcatggacgcttcacttgccatcaagcctgtcttcgaaagattccagtcggtgatcattacatcgggcactctgtctcctttggatatctatcccaagatcctagactttcacccagtcacaatggcgacatttactatgactctggccagagtatgtttgtgtcccatgatcatcgggcggggaaatgaccaggtggcgatttcctctaagttcgaaacacgcgaggatatcgctgtaatcagaaactacggtaacttgctccttgaaatgagtgctgtcgtccccgatgggatcgtggctttctttacaagttaccagtacatggaatctaccgtcgcttcttggtatgagcagggaattctcgaaaacatccagcgtaataaactgctgttcattgaaacccaagacggtgctgaaaccagcgtcgcactcgagaaataccaggaagcatgcgagaacggcagaggcgctatcctcttatccgtcgctaggggcaaggtgtcagaaggcatagactttgtgcatcactatggacgagccgtcatcatgttcggcgtgccatacgtttatacccagtcccgcatcctgaaggccagactcgagtacctgagggaccagtttcagataagagaaaacgactttctcaccttcgacgcaatgcggcacgccgcacaatgtgttgggcgcgccatcaggggcaagactgattatggtcttatggtctttgccgataagaggttcgcccgcggagataagcgcggaaagttacccaggtggattcaggagcaccttaccgatgccaacctgaatttgactgttgatgagggtgtgcaggttgcaaaatatttcctgcgccagatggcacaaccttttcacagagaagaccagttgggactgagcctactctccctcgaacagttggaatcagaagaaacactgaagcgtattgaacagatcgcccagcagctttag

SEQ ID NO: 15110 - DNA, 2283 bp, Artificial Sequence
  Description of Artificial Sequence: Synthetic coding sequence
atgaaactgaacgtcgacggattgctcgtgtattttccatatgactatatctaccccgaacagttctcatacatgcgagagcttaagcgcacactggatgccaaaggacatggggttctggaaatgcccagtggcacgggcaaaacagtctccctcctggcactcatcatggcctatcaaagggcctatcccctggaggttacgaaactaatttactgctctagaaccgtcccagaaattgagaaggtgatcgaagagctccgcaagctgctaaacttctatgaaaagcaggagggcgagaagctgccttttcttggactggcactttcaagccgaaagaatctgtgcatccacccagaagtgactccattacgatttggcaaggatgtggacggcaaatgtcacagtttgacagcttcgtacgtgcgtgctcagtaccagcatgatacttccctgccgcactgcaggttctatgaagaatttgatgcacacgggcgggaagtgcctctgccggccgggatttataatctggacgacttgaaagcccttgggcggcgccagggatggtgtccttacttcctggcaagatactccatccttcatgcaaacgtagtcgtctacagctatcactatctcctcgatcctaagatcgctgaccttgtctctaaagagttagcacggaaagccgtggtcgtcttcgacgaggcccacaatatcgacaatgtgtgcattgactctatgtccgtgaatctgacccgcaggaccctggacaggtgccagggcaatttggaaactctgcagaaaactgtactcagaatcaaggaaacagatgagcagcgcctgagagatgagtatcgtcgcttggtggagggtctacgtgaggccagcgccgctagggagactgatgcccatttagctaatcccgtcctgcccgacgaagtactgcaagaagccgttccgggatctatcagaaccgctgaacattttttaggtttcctaagacggttactagaatatgtgaagtggagattaagggtgcagcatgtcgtgcaagaatctcctcccgcattcctcagtggcctggcccaaagagtatgcatccagcggaagcctcttcgcttctgcgccgaaaggctaaggagcctgttacacacccttgaaatcactgacctggcagattttagccctctgacactcctggccaactttgccactctggtgagtacctacgctaaagggttcactataatcattgagcctttcgatgacagaacccctacaatcgctaatcctatcctgcactttagctgcatggacgcctcgctagcaatcaaacctgtgtttgagcgatttcaatctgttatcatcacaagtggaacactgtcccctctggacatatatccaaagatcctcgacttccatcctgtcacaatggccactttcacaatgactctcgcacgagtgtgtctgtgccccatgatcataggcagaggtaacgaccaagttgccatatcctcaaaattcgagacacgtgaagacatcgctgtaatccggaattatgggaatctcctccttgaaatgagcgctgtggtgccagacggaattgtggcatttttcacaagctatcagtatatggagagcacagtggcttcatggtacgaacaggggatacttgagaacattcagagaaacaaactcctgttcatagagacccaggacggcgcagagacatctgttgccttagagaagtaccaagaggcctgtgaaaatggcagaggggccattctgttgtcagtggcaagagggaaggtctctgagggcatagacttcgtgcatcattatggaagggctgtcatcatgttcggagtcccatacgtgtatacccagtcgaggatcctcaaggctcggctggagtaccttagagatcaattccagattagagaaaatgacttcctgactttcgacgctatgaggcatgctgcccaatgcgttggtcgcgccattcgaggtaagactgactatggcctgatggtgttcgctgacaaaaggtttgcaaggggcgacaaacgtgggaaactccctcggtggattcaggagcatctgaccgacgccaatcttaacctgactgtcgacgagggagtacaggttgccaaatattttttgaggcagatggcccagcccttccaccgggaggatcagctcggcctgagcctcttatccttggaacagctggagagcgaggaaaccctgaagaggatcgaacaaattgctcaacagctttag

SEQ ID NO: 15111 - DNA, 2751 bp, Artificial Sequence
  Description of Artificial Sequence: Synthetic coding sequence
atggagtccggacagccggcacgtagaatagctatggctcccctcctggaatacgagcgccagcttgtgctcgagttattagataccgatggtctcgtcgtctgcgccagaggcttgggcgctgaccgcctcttatatcactttttgcagttacattgtcaccccgcttgtctcgtgttagtcctgaacactcagccagcagaggaagagtacttcattaatcagctgaaaatcgaaggagtggagcatctccctaggcgcgtaactaatgaaattactagcaacagccgttacgaggtatatacccagggcggcgtgatttttgctacttcacgaattctggtggtcgatttccttactgatcgcattccctcggatttgatcaccggcatactggtatatcgagcccaccgtattatcgagtcttgccaagaagcctttattttaaggctgtttcggcagaaaaataagcgaggtttcatcaaagccttcacagacaacgctgttgcctttgacacaggattctgccatgtggaaagagtgatgagaaacctcttcgtgcggaagctgtatctctggccgagatttcacgtggctgtgaattcctttctagagcaacacaaaccagaagttgtagaaatccacgtgagtatgaccccaacgatgctggcaatccagactgcaatactggatattctaaacgcttgtcttaaggagcttaaatgccacaatccaagtctggaagtggaggatctaagtctagagaatgctattggcaagccatttgataagaccatccgacactacctagatcctctttggcaccagctaggcgcaaagaccaaatctctggttcaggacctgaaaatcctccgaaccctgttacagtatttgtctcaatacgactgcgttacgttcttgaacctcctggaatcgcttcgggcaaccgagaaagccttcgggcagaattccggctggttgtttctggactcatctaccagcatgtttattaatgctcgagcaagggtataccacttacccgatgctaaaatgagcaagaaagagaaaatctcagaaaagatggaaattaaggagggagaagaaaccaaaaaggagttagtgttagagagtaatcccaaatgggaggctttaactgaggtgctgaaggagatcgaagctgagaataaagagagcgaggcgttagggggccctggccaggtattgatctgtgcttctgacgaccggacatgttcacagctgcgagattatattacgcttggtgccgaggcattcctcctccgactgtaccgcaaaactttcgagaaggatagcaaggcagaggaggtctggatgaaattccggaaggaagactcgtctaagagaatacgcaaatcacataagagacctaaggacccgcagaacaaagagcgcgcctccacgaaggaaaggactttgaagaagaagaaaaggaaactcacattgactcagatggtgggaaagcctgaggagctcgaagaggaaggcgatgtagaagaagggtaccgccgggaaatctcgtcgtcccccgaaagctgtcccgaagagatcaagcacgaggagttcgacgtgaacctttcaagtgacgcagcctttggcatcctcaaagagcctttaacgatcatacaccccctgcttggttgttctgacccctatgctctcacaagagtgctgcatgaggtcgagcctcgctacgttgtgttgtacgacgctgagctgacattcgtaaggcagcttgaaatctaccgagcctcccgcccaggaaaacctctgagagtctactttctgatctacggtgggtcaactgaagagcaaaggtacctgaccgcgctgaggaaagaaaaggaggcctttgaaaaactgatacgtgaaaaagccagtatggttgttcccgaggaacgagaaggcagggacgaaactaacctggacttggtgagaggtactgctagtgcagatgtgagcacagacacccgtaaagcagggggccaggagcagaatggaactcaacagagcattgttgtggatatgagagagttccggtctgagctgccaagccttatccaccgccgcggaatcgatattgagccggtgacattagaagttggagactatattctcacccctgagatgtgcgtcgaaaggaaaagcatcagcgacctgataggatccctcaacaacggccgcctgtattctcagtgtatttctatgtctcgttactataaacgtcctgtcctgctgatcgaatttgacccaagcaagccatttagcctcaccagccgcggagccctatttcaggagatttcatccaatgacatttctagtaaacttacactcctcacactgcactttcctagactgcgtatcttgtggtgcccgtctcctcacgcgaccgccgaattgtttgaggaactgaaacagtcaaagcctcagcctgacgctgccaccgccttagccattaccgccgacagcgagactctgccagaaagtgaaaagtacaaccctggcccgcaggacttcttgctcaagatgcctggcgtgaacgccaagaactgtaggagcttgatgcaccacgtaaagaacatcgcagaactggcagccctctctcaggatgagctcaccagcattctggggaacgcagccaatgctaaacagctttacgactttatacatacttcttttgccgaggtggtatccaaaggcaagggtaagaaatag

SEQ ID NO: 15112 - DNA, 2715 bp, Artificial Sequence
  Description of Artificial Sequence: Synthetic coding sequence
atggctcctctgctcgagtacgagcgtcagctggtactagaactgctggatactgatggactggtcgtgtgtgcaaggggattgggcgcagaccgactactctaccatttcctccagcttcactgtcacccagcttgtctcgtgttggtgcttaacactcagccggccgaagaagagtacttcatcaatcagctgaagatcgagggagttgaacacctacccaggcgggttaccaacgaaatcaccagcaacagcagatacgaggtttacacccaggggggcgttattttcgcaacaagccggatacttgttgtggacttcctgaccgatcgcatcccatccgatctcattactgggattctggtctaccgcgcacaccgtattattgagtcatgccaggaggcattcattttgcgactctttcggcaaaagaataaacgggggtttatcaaggcattcacggataatgcagtggccttcgacactggtttttgccatgtggagagagtgatgcgaaatctgtttgtgagaaaactgtatctttggccccgattccacgtcgcagtgaacagctttctagagcaacacaaacccgaagtggtggagatccacgtgtcaatgacacctaccatgctggccatacagaccgctatcctcgacatcctcaacgcttgcttgaaggagctcaagtgccacaaccccagcctcgaggtcgaggatttgtctctggagaatgcaatcggaaagcccttcgacaaaacgataaggcactacctggacccactgtggcaccagctgggcgccaagacaaagtctctagttcaggatcttaaaattctgcgtaccctcctccagtatctgagccagtacgattgtgtaactttcttgaacctgctcgagtcattacgcgcgactgagaaggcctttggacagaattccggctggctgttcctggattcctctacgagcatgttcatcaacgcacgggcccgggtgtaccatttaccagacgctaagatgagtaaaaaagagaaaatttcagagaaaatggaaataaaagagggggaggagacaaagaaggagctcgtgctcgagtcaaaccctaaatgggaagccctcaccgaagtgctgaaagagatcgaggcagagaacaaagagtcagaggcgcttggaggaccaggccaggtgctgatctgtgcgtctgatgacagaacctgctcccagctcagagactacatcactctcggtgccgaggcctttctgctgagactgtacaggaaaacgtttgaaaaggactcaaaggcagaggaagtctggatgaagttccggaaagaagacagcagcaaaaggatacggaagtcccataaacgtcctaaagacccacagaacaaggagcgggcttctaccaaagaaaggactctcaaaaaaaagaaaaggaagctcacattgacccagatggtcggcaagcctgaagagctcgaggaggaaggagatgtcgaggaaggttaccgccgcgaaataagttcttcacccgagtcatgtccagaagaaatcaagcacgaggagttcgacgtcaacctttctagcgacgccgcgtttgggattttaaaagaaccactgacaatcatccatcccctcctcggatgttcggatccatacgcgctcacccgggttcttcatgaagtggagccccgctacgtggtcctgtatgatgcggagctgacattcgttcgccaactggaaatttatagggcaagtcgacctggaaagcccttgcgatattttctgatttacggaggatctaccgaagagcagagatacctgacggcacttaggaaggaaaaagaggccttcgaaaagcttattagggaaaaggcctccatggtcgtgcctgaggagagggaaggacgagatgaaacaaatttggatctggttaggggaactgcatcagccgacgtctctactgatacaaggaaggctggaggccaggaacagaacggcacccagcagagcatcgtcgtggacatgcgggagttcaggagcgaactgccctccctcatccacaggagaggaattgacattgagccagttacactggaggtgggagactacatactcacccccgagatgtgcgttgagagaaagagtatctctgaccttataggatccttaaataatggccgattgtattcacagtgcatctcaatgtcccggtactataagcgccctgtgctgctgattgaattcgatccctctaaaccattcagcctgacaagtagaggggccctgttccaagaaataagctctaacgatataagctctaagctcacccttttgaccctccacttcccccgactccggatcctgtggtgcccgagtccacacgctaccgccgaactattcgaagaacttaagcagtctaagccacagcctgacgcggctacagctcttgctattaccgcggatagcgaaactctacctgaatctgagaaatataacccaggacctcaggattttctcctcaagatgccaggcgtgaatgcaaagaactgcaggagcctcatgcatcacgtcaaaaatattgccgagctcgccgcactgtcacaggacgagttgacttccatcctgggtaacgctgccaatgccaaacaactgtatgactttatacacaccagcttcgccgaagtggtgagtaaaggaaaaggtaaaaaatag

SEQ ID NO: 15113 - DNA, 1071 bp, Artificial Sequence
  Description of Artificial Sequence: Synthetic coding sequence
atggctcccctcctagagtacgaacggcagctggtgctggaactgcttgacacggatgggttggtggtgtgtgcccgtggcctaggagcggatcggctgctatatcactttctgcaactgcattgccatcctgcgtgtctagttctggtcctcaacactcagccagccgaagaggaatactttattaaccagctcaagatcgaaggagtggagcacttaccgagaagggtcacaaacgagatcacgtcgaattcacggtatgaagtatacacacagggaggtgttatatttgccacttctcggattttagtggtggacttcttgactgaccgtatcccatctgaccttataaccgggattctagtgtaccgcgcccatcggattattgaatcctgccaggaggcatttatcctgcgcctgttccgtcagaagaacaaaagaggatttataaaagctttcacagataacgccgtcgctttcgataccggcttttgtcacgtggagcgtgtaatgcgtaatctgttcgtccgtaaactgtatctctggccccggttccatgtggcagtgaatagtttcctggagcagcacaagcccgaagtcgttgagatccacgtttcgatgacacccaccatgcttgctatccagactgcaatactggatatcctcaatgcctgtctgaaggaactgaaatgccacaatccgtccctcgaagtggaagatctgtccctagaaaacgcaatcggcaagccctttgacaagacaatccgccactatcttgacccattgtggcaccagttgggggccaaaacaaaaagcctcgtgcaagacttgaagatccttcggaccctactgcaatacctgagccagtatgattgcgtgactttcttaaatctcctggagagcttgcgggcgacggagaaggcgttcggccagaattccgggtggttatttttggatagtagcacaagtatgtttattaatgcaagagccagggtatatcacctgccagacgcgaagatgtccaaaaaagagaagatcagtgaaaaaatcaagaaaaaaaaaaaaaagtag

SEQ ID NO: 15114 - DNA, 3561 bp, Artificial Sequence
  Description of Artificial Sequence: Synthetic coding sequence
atgggggtgcaaggactctggaagctgctggaatgctccgggcgacaggtatcacctgaggccttggaggggaaaattttggcggtggatatctccatttggctaaatcaagctctgaaaggcgttcgagacaggcacgggaattccatcgagaaccctcacctcctgactctgttccaccgactctgtaagctgctcttcttcagaatccgcccaatctttgtgttcgacggagacgcccctctacttaagaagcaaacactcgtgaagcgtaggcaacgaaaggatttggcatccagtgattctagaaagacaacagagaaattgctcaaaacattccttaaaagacaggcaatcaaaacagcatttcggagtaaaagagatgaggcactcccctccctcactcaggtacggcgggagaacgatttatatgtcttacctcccttacaggaagaagaaaagcattcatcagaagaagaggacgagaaagagtggcaggagcggatgaaccaaaaacaggcacttcaggaggagttcttccacaatccacaggccatcgacatagagtctgaagacttctcaagcctgccccccgaggtgaaacacgaaatcctgactgacatgaaagaatttactaagcggagacgcacactcttcgaggcgatgcctgaagagtccgacgacttctcgcaataccagctcaaaggacttttgaagaaaaactatttaaatcagcacattgaacatgtgcaaaaggagatgaatcagcagcactcagggcacatccgccggcaatatgaggacgagggaggattccttaaggaagttgagagtaggagagtcgtctctgaggataccagccactacatcctcatcaaaggtattcaggccaaaactgtcgccgaagtggactccgagtcattgcccagtagttccaaaatgcacggcatgagcttcgatgtgaagtctagcccttgcgaaaaacttaagaccgaaaaggaacccgacgctacacctccatcgcccagaacgctgctcgccatgcaagccgcactattgggctcctcttctgaggaagaactcgaaagtgagaatcggaggcaggccagagggagaaacgccccggccgcggtggacgagggctctatctcgccaagaacactttccgcaattaaaagggctctcgatgacgacgaagacgtgaaggtatgcgcaggtgatgacgtccaaactgggggacccggcgctgaagaaatgaggattaatagcagcacagaaaattccgacgaaggtcttaaggtcagagacgggaagggcataccgtttaccgctacgctagctagttcttcggtaaattcagccgaggagcacgtcgctagcacaaatgaggggcgagaacctactgacagtgtcccaaaggagcagatgtccctcgtgcatgtgggaacagaggcatttcctatctcagatgaatccatgatcaaggaccgaaaggatagattacccttggaaagcgccgtggtgagacactctgacgctcctggcctcccaaatggacgagaactgacccctgcaagtcctacatgcaccaactctgtttcaaaaaacgagactcacgctgaggtcttagaacagcaaaacgagctgtgtccttacgaaagcaaattcgattcatctctgttgagcagtgacgacgagacaaagtgtaaaccaaattcggcaagtgaggttatcggcccggtgtccttgcaggaaacttcctctatcgttagtgtgcccagcgaagctgtggacaatgtggaaaacgtggtttcattcaatgcaaaggagcatgagaactttctcgagactattcaagaacagcagacaactgagagtgctggacaggatttgatttccatccccaaagcggttgagcccatggaaatagactccgaagaaagcgagtctgacggttcctttatagaagtgcagtccgtcatctccgatgaagagctgcaggccgagttccccgagacatctaagccaccttcggagcagggggaagaagaactggtaggtacgagggaaggcgaggctccagctgaatcagaatcgcttctgcgtgacaactcagagagggacgacgtagatggagagccacaggaggcagagaaagacgctgaggatagtctacacgagtggcaggacatcaatctggaggaactcgagacattggagtccaaccttctggcccagcagaacagtctgaaggcacagaaacagcagcaggagcggatcgcggccaccgtgaccggtcagatgttcctcgagtcacaggagctgctgcgactctttggcattccgtacatccaggccccaatggaggctgaggcgcaatgtgctatacttgaccttaccgatcagacgtctggcaccatcacggatgattctgacatctggctgttcggcgccaggcacgtctatcgcaactttttcaacaagaacaaattcgttgaatactaccagtacgtcgacttccacaatcaattaggcttagatagaaataagctaatcaacctcgcctacctactgggcagcgactataccgaaggcatccctaccgtcggatgtgtgaccgcaatggagattctcaatgaatttcccggccacgggctagagccgctgttaaaattttctgaatggtggcacgaggcacagaaaaaccctaaaatccgcccgaatccccatgacacaaaagtgaaaaaaaagctcagaaccctgcagcttacccctgggttccccaaccccgctgtcgcagaagcatacttaaagcctgtggtggatgattccaaaggttctttcctgtggggcaagcctgatctcgataaaatcagagagttttgtcagcgctattttgggtggaaccgcaccaagaccgacgagtcgctctttccagtcctgaagcagctagacgctcagcaaacgcagctcaggattgactctttctttcggcttgctcagcaggagaaagaagacgccaagcgcatcaagagccaaaggcttaacagggccgtgacctgcatgctgaggaaggaaaaggaggcagccgcctccgagatcgaagctgtgtcggttgccatggagaaagaatttgaacttttggacaaagcgaaggggaaaacccaaaagcgaggcattaccaacaccttggaggaatctagcagcctgaagcgcaaaaggctgtctgactctaaaggcaaaaacacttgtggaggtttcttgggagagacatgcctatctgagagttccgatggcagctcttctgaagacgccgaatccagctccctcatgaacgtgcagcggcggacagctgccaaagaacccaagacatcagcctcagacagccagaattccgtgaaggaagcccctgttaagaatggcggggctaccacttcttcatcaagcgacagcgacgacgatggtggaaaggagaaaatggttctggttaccgctagatctgtgtttggcaagaaaaggagaaagctgcgcagagccagagggcgcaaacgtaagacctag

SEQ ID NO: 15115 - DNA, 1260 bp, Artificial Sequence
  Description of Artificial Sequence: Synthetic coding sequence
atgttcctcgagtctcaggaactgctgcgtctatttggcatcccatatattcaggcacctatggaagctgaagcccagtgcgccatcctggatttaacagaccagactagcggtactatcaccgatgactccgacatttggctgtttggcgcgcgacacgtctatcggaatttcttcaacaagaataaattcgttgagtattaccaatatgtagattttcataatcagctgggcctcgaccgcaacaagcttattaacctggcatatctgcttggatccgattataccgagggaatccccacagtgggctgtgttacagccatggagatcctgaatgagttcccagggcacggacttgagcccttactgaaattttctgagtggtggcatgaggcccaaaagaaccccaagattcgtcctaatccacacgatacaaaagtgaagaaaaagctgcgcactctgcagctgacgccgggctttccaaatcctgcagtggccgaggcatacctcaaaccagttgtagatgactcaaagggatcttttctgtggggcaaaccagatcttgataagatcagagaattctgccaacgctatttcgggtggaaccggacaaagactgacgagtcactgtttcccgtcttgaagcagctggacgcccagcagactcagctgcgcatcgatagcttcttccgacttgcccagcaggaaaaggaggatgcgaagcggattaaaagtcagagactgaacagggccgtgacctgcatgcttagaaaagaaaaggaggctgccgcctccgaaatagaagcagtcagcgtagccatggaaaaagaatttgagctgctagacaaggctaaaggcaagactcaaaagagaggaattacaaatactcttgaggagtcatcgtccctgaagaggaaacgactgtccgactccaagggtaagaatacctgtggagggttcttgggggaaacttgtctgagcgaaagttccgacgggtcttcaagcgaagatgctgagagcagtagccttatgaatgttcagaggaggaccgctgctaaggagccaaaaacctcagcatccgattcacagaactccgtcaaggaggcccctgtgaaaaacggaggcgctaccacatcttccagttccgatagtgacgatgacggcgggaaggaaaagatggtactggtgaccgcccggtcggtcttcggaaagaagcgtaggaagcttagacgagcacgtggcaggaaaagaaagacatag

SEQ ID NO: 15116 - DNA, 3057 bp, Artificial Sequence
  Description of Artificial Sequence: Synthetic coding sequence
atgaaccaaaagcaagcccttcaggaggagttttttcataatccacaggccatcgatatcgaatcagaggacttcagtagtctgccccctgaagtgaaacatgagatcctgaccgacatgaaggagtttacaaaaagaagaagaacactattcgaagctatgcctgaagagtccgatgatttcagccagtaccagctgaaaggtttgttgaagaagaattatctaaatcagcatattgaacacgtccaaaaggaaatgaatcagcagcatagcgggcatataaggcgacagtacgaggatgagggcggctttctgaaggaagttgagagcagacgcgttgtctctgaagacacatcccactacatcctcattaaaggcatccaggctaagaccgtggccgaggtggattctgagtccttgccatctagcagcaaaatgcacggcatgtccttcgacgtgaagagctccccctgcgaaaaattgaagactgagaaggagcctgacgcaacacctccctcccctaggacactgctagccatgcaagccgccctgctgggcagctcctcagaagaagaactggagtctgagaatcggagacaggcacgaggccggaacgcaccggctgcagtcgatgaagggtccatcagccctagaactctgagcgccatcaagcgcgccttagatgatgacgaggatgtaaaggtctgcgccggagatgatgttcagaccggaggccccggcgcagaagagatgcggattaattcgagtacagaaaactccgatgagggcctgaaagtaagagatgggaaagggattccattcacagcgacactcgcttcttcttcagtgaatagcgccgaagagcacgtggcctccaccaacgaaggccgcgagcctacagattccgtgcctaaagagcagatgtctctcgtgcatgttggcactgaagcattccctatatctgacgaatccatgattaaagataggaaggaccggctgcctctggagtcagcagtggttcgccactcagatgcccctggcctgcccaatgggcgggagctgacccccgcttccccaacgtgcactaattcagtctctaagaacgagacacacgccgaagtgctcgagcagcaaaatgagttgtgtccctacgagtccaagttcgactctagcctgctcagcagcgatgatgagactaaatgtaagccaaactctgccagcgaggttattggtccagtgtcgctccaggagacatcctccattgtgtcagtgccttccgaggctgtcgacaacgtagaaaatgtggtctcctttaatgctaaggaacacgaaaatttcctggaaaccatacaggagcagcagacaactgagagcgccggacaagacctgattagcatccccaaggccgtcgagccaatggaaatcgatagtgaggagtctgagtcagacggctcttttatcgaggtgcaaagtgtgattagtgatgaggaactgcaggcggaattccctgagacctcgaagccgccctctgagcaaggcgaggaggagctcgtcgggacaagagagggggaagcacccgcagaatcagaatcactgctgagggacaattccgagcgagacgacgtggacggcgagccacaggaggctgaaaaggacgccgaggatagcttgcatgagtggcaggatattaatttagaggagcttgagactctggagagtaacctgctggcccaacaaaactcgttgaaagcacaaaaacagcagcaggagaggatcgctgctacggtgaccggacagatgttcttggaaagtcaggaacttctgaggctgttcggaatcccatatatacaagcccccatggaggcagaggcccagtgcgccatactggatcttacggaccaaactagtggtaccattacagacgactctgacatttggctctttggggcaaggcatgtctatcgaaacttcttcaacaagaacaaatttgtggagtactatcagtatgtggacttccacaatcagctgggactcgaccggaacaaactcataaatctggcctatctgctgggatcagattatactgaagggatacccaccgtgggttgtgtaacagccatggagatcttgaacgaatttccgggacatggcctggagcctctcctcaagttttccgaatggtggcatgaggcccagaagaaccctaaaatcaggccaaaccctcacgataccaaggtgaagaaaaaactgaggacccttcagctgacacccggatttcctaacccagcggtggctgaggcttacttgaagcctgtggtggacgattcgaaaggcagcttcctctggggaaaaccggatttagataagatccgcgagttctgtcagcgatatttcgggtggaaccgtacgaagaccgacgaatccctgttccccgttttgaagcagctcgacgcccagcagacccagctgcggattgatagcttctttagacttgcccagcaagaaaaggaggatgccaagcgcataaaaagccagcggctgaatcgcgcagtgacctgtatgctaagaaaggagaaggaagccgctgcaagtgaaatcgaggcagtctccgtggcaatggagaaggaatttgagttgctagacaaagctaagggtaaaacccagaaaaggggcattactaacacactagaggaatccagttcactcaagaggaaaaggctcagtgacagtaagggcaaaaacacctgcggcgggtttctgggcgaaacatgccttagcgagtcctcagacggctcatctagtgaggacgcagagagctcttctctaatgaatgttcagaggagaaccgctgctaaggagccaaaaacgtcggcttcggacagtcagaatagcgttaaggaagcaccagtgaaaaacggcggcgccacgacaagctcctcatccgacagcgacgacgacggcggcaaggaaaagatggtgcttgtaactgccagatctgtctttggtaaaaagagacgaaaactgagacgtgcccgggggagaaagagaaagacctag

SEQ ID NO: 15117 - DNA, 4836 bp, Artificial Sequence
  Description of Artificial Sequence: Synthetic coding sequence
cagggtgctgtgaagtctttctgcacttccgccagcggcgcaccgctggggcccaagggggatggccattacccctggtcatgtcctgtcacacacacccgggaaaagatatatgctatctgcagcgattacgcttttctgaaccaggccacatctatttacaagactccaaatccaagccgcagcccttgcttgcctgactcaactagtctgtcagccgggaataactcttccaggtacattggcattcctacctcaacctccgaaattatctacaacgaagaaaacagcttggagaatctgagcaattcccttggcaagctcccactggcttgggaaatcgacaagtcagagttcgacggtgtcaccacaaactctaaacataagagcggcaatgcaaagaagcaggtgtctaagcgtaagaccagcgacaaaaaaggcaggtatcaaaaggaatgtccgcagcattcaccccttgaagacattaaacagcggaaagttttagatcttagaaggtggtattgcattagtaggccacagtataaaactagctgtggtatctctagcctgatctcttgttggaacttcctgtattctaccatgggggccggtaatctgccccccatcacccaagaagaggcactgcacattctggggttccaacctcctttcgaagatattcgcttcggaccctttactggaaacacaaccttgatgaggtggttccgacagatcaatgatcactttcacgtaaagggctgttcgtatgtcctgtataaaccgcacgggaagaacaaaacggctggagaaactgcctccggcgcgctttccaaactcacacgcggacttaaggacgagagtctagcttatatctaccactgccagaatcactatttctgcccgatcggcttcgaagccacccccgttaaggcgaacaaggcattctctcgaggcccactgagcccccaggaagtagagtactggattctcattggagaatccagccgtaagcaccccgcaatccactgcaagaagtgggccgacattgtgaccgacttaaatactcagaaccccgaatacttggatataagacatctcgagaggggtttgcaatatagaaaaaccaagaaggttggtggtaaccttcactgcattattgcattccagaggttaaattggcagcggttcgggctctggaactttccgtttggtacgattcgtcaggaaagtcagcctccaacccacgctcagggcatcgcaaaatctgagtcggaggataatatctccaagaagcagcacggaagactgggccgctcattttctgcctcctttcaccaggactcagcttggaagaagatgtcaaacatttcaatctggctgaaccaggccctgaagggcgtccgcgaccggcacgggaattccatcgagaatccccacctcctaacactgttccataggctctgtaagctgctgttcttccggattaggcctatctttgtgttcgatggggatgctccattgctaaaaaagcagactctcgtgaaacgaaggcagcgaaaagacctcgcaagtagcgattcaagaaaaaccaccgagaagctgctgaaaactttcttaaagagacaagctatcaaaactgccttcaggtcgaagagggatgaagcactgccttcactgacacaggttcgccgggaaaatgacctttatgtcctgccccctttacaggaagaggaaaaacattcatcggaggaagaagacgaaaaagagtggcaggaacgtatgaaccagaaacaggcactgcaggaagagtttttccacaacccacaagcaattgacatcgaatctgaagatttctcgagcctgccccctgaagtgaaacacgaaatcctcaccgatatgaaagagttcactaagaggcggcggaccttattcgaggcgatgccagaggagtccgatgacttctctcaatatcaacttaaaggtctgctaaagaaaaactacctgaaccagcatatagaacatgtacagaaagagatgaatcagcaacattcgggccacatcaggagacaatatgaggatgagggcgggtttctaaaggaagtggaatcccgtagggtggtaagtgaggacacttcccattacattcttatcaaaggcatacaggcaaagaccgtcgccgaagtggattcagaatctctgcccagcagcagcaaaatgcacgggatgtctttcgatgtcaagagtagcccttgcgagaaattaaagaccgagaaggaaccagatgccacacccccttcacctcggactttactggctatgcaggcagctctgctcggcagctcatccgaagaggaattagagtcagagaatcggcgacaggccaggggacggaacgcccccgccgctgtggacgaaggatccataagcccgagaaccctctcagcgataaagagagcactggacgacgatgaagatgtgaaggtttgcgccggagacgacgtccagactggaggccccggagccgaggagatgaggatcaattcaagtaccgaaaactcagacgaaggactcaaggtgcgggatggcaaaggaatccccttcaccgcgacactagcatcctcgagcgttaactcagccgaagagcatgtagcttccaccaacgaaggtcgcgaacccacagattccgttcccaaagagcaaatgtcattggtacatgtggggacggaagcatttccaattagcgatgaaagcatgatcaaggatagaaaagatcggttgcccctggagagtgctgtggtgcggcacagtgatgccccgggtctgccgaacggccgtgaactcacacctgcctcccctacatgtactaacagcgttagcaaaaatgaaacccatgctgaagtcctggagcaacagaacgaactctgcccttacgagagcaagtttgattcttccctcctgtcttcagacgacgaaacaaaatgtaagccgaattcggcttcagaagtgattggtcccgtttcacttcaagaaacctcttctattgtgtccgtgcctagcgaggcagtggacaatgtggaaaatgtggtcagctttaacgctaaagaacacgagaatttcttggagacaatccaggagcagcaaactaccgagtccgcaggtcaggacttgatcagtattccaaaggcggtggagccaatggagatagacagtgaggaatcggagagcgacggcagtttcatcgaggttcagtcagtcatatccgacgaagagctgcaggcagaattccctgagacctctaagccgccgtcagaacagggggaagaggagttagtgggaacccgggaaggagaagctccagccgagagcgaaagccttttgcgagataattcggagagggatgacgtcgatggggagcctcaggaggctgagaaagatgctgaagatagcctgcacgagtggcaggatatcaatctcgaagagttggaaacccttgagtcgaacctcctcgcacaacagaacagtctaaaagcccagaagcaacaacaggaacgaatagctgccacagtcacaggccagatgttccttgagtcccaggagctgctacgtctctttggaatcccatacattcaggcccccatggaggctgaagcccaatgtgcgatcctcgatctaaccgaccagacctccggcacaatcacagatgacagcgatatctggctgttcggcgcaagacacgtttatcgtaactttttcaacaaaaataagtttgtggagtactaccagtacgtggacttccacaaccagttaggcctggacagaaataaactcataaaccttgcctacctactggggtcagattacactgaagggattccgacagtgggctgtgttactgccatggagattctaaatgagtttccgggacacggccttgagcccctccttaaattctcagaatggtggcatgaagctcaaaaaaaccccaagatcagacctaatccacacgacacgaaggtcaaaaaaaaactgcggaccctgcagttgacacctggattccctaaccctgctgtagcggaagcatacctgaaaccagttgtggatgacagtaagggatcattcctgtggggaaagcctgatttagataaaattcgagaattttgccagcggtactttggatggaacagaacaaagactgacgagagcctgttcccagtgcttaagcaactcgatgcacagcagacacagctcagaatagactcatttttccggttagcccagcaggagaaggaggatgctaaacggattaaaagtcaacgcctaaacagggcagtgacttgtatgctccggaaagaaaaagaagctgctgcttcagagatagaggctgtctccgtggccatggagaaagaatttgaactgctagacaaagctaaagggaaaacacagaagagagggatcactaatactcttgaagagtccagcagcctcaaacgcaaacggctgagcgattctaagggaaagaatacttgcggcggcttcctcggcgaaacatgcttatccgagagctcagatggaagctctagcgaggacgctgagagcagctctcttatgaacgtgcaacggaggaccgccgcgaaggaacccaaaactagcgcgagcgactcccagaacagcgtgaaggaagcacctgtgaaaaacggaggcgcaactacatcaagtagctcagacagtgacgacgacggcggcaaagagaagatggttttggtgaccgcacgctcggttttcggcaagaaacggagaaagttgagacgagcccgtggacgtaaaagaaagacttag

SEQ ID NO: 15118 - DNA, 699 bp, Artificial Sequence
  Description of Artificial Sequence: Synthetic coding sequence
atgggagtgcagggtctctggaaactcctcgaatgtagtggaaggcaggtgagccccgaggcactcgagggaaaaatcctcgccgtcgacatcagtatctggttaaatcaagcactcaaaggagtgagagatcgccacggtaatagcatcgaaaatccccatcttctcacattgttccaccggctttgtaagctgctgttctttaggatccggccaatcttcgtgttcgacggcgatgctcctctcctcaagaagcagacattggtgaaacgcagacagcgaaaggacctcgcgtcatcagactctaggaagacaactgagaagttgttgaaaacctttctcaaaaggcaagcaatcaagactgcttttcggagtaaaagggatgaggctctgccttccctcacccaggtccggcgtgaaaatgatctgtacgttctcccgcctctgcaggaagaggagaagcatagttctgaggaggaggacgaaaaagaatggcaagaacgaatgaaccagaagcaagctcttcaggaagaattcttccacaatccacaagcgattgacattgagtcagaagattttagctctctgcctcccgaggtcaagcatgaaatactaacagacatgaaggagttcacaaagaggcggcgaacgctattcgaagctatgccagaggtgtatttacccttgctacaaccctag

SEQ ID NO: 15119 - DNA, 4482 bp, Artificial Sequence
  Description of Artificial Sequence: Synthetic coding sequence
atgccaaatgagggcattccccattcttcacagacccaggagcaggactgtctgcagagccaacctgtcagtaacaacgaagagatggccataaagcaggagagcggcggcgatggcgaggtggaggagtacttgagtttccgcagtgtgggcgatggtctgtctacctcagccgtcggctgcgccagcgcagcccccagaagggggcccgcgttgcttcatattgatcggcaccagattcaggctgtagaaccatctgctcaagccctggagcttcagggattgggagtcgacgtatatgaccaggacgtgctggaacaaggtgtcttacagcaggtggataacgctattcacgaggccagcagagcctctcagctggtggacgtggagaaggaatatcgttctgtcttggacgacctcactagttgcactaccagtctgcggcaaatcaataaaattatagaacagctttctccccaggcagccacttctcgcgacattaatcgcaagctggattctgtgaaacggcaaaagtacaataaagagcagcagctgaaaaaaattacagcgaagcaaaaacacttgcaagccattctcggaggggccgaggtcaagatcgaactggaccacgcctccctagaggaagacgctgagccaggtccttccagtctcgggagtatgcttatgccagtccaggaaacagcctgggaggagctgatccgtactgggcagatgaccccattcggcacacaaataccccaaaagcaggagaaaaaaccccgcaagatcatgctgaacgaagcctctggctttgaaaaatacctggccgaccaagctaaactcagttttgagagaaagaaacaggggtgtaacaagagggctgctaggaaggctccggcccctgtaacgccccctgcacccgtccagaacaagaataaacctaataagaaagccagggttctgtctaagaaggaggagagactgaaaaagcacataaagaagctccaaaagcgagctttgcagtttcagggcaaagttggcttgcccaaggctagacgaccttgggagagcgacatgaggccggaagccgaaggggactccgagggagaggagtctgagtacttcccgaccgaggaagaggaggaggaagaggacgatgaagtggaaggggccgaagctgacctgagcggcgacgggaccgattacgagctgaagcccctcccaaagggcggcaagcgacagaaaaaggttccagtgcaggagatcgacgatgactttttcccctccagtggagaagaggccgaagcggctagtgtgggggagggcggcggcggcggccggaaagtgggcaggtaccgtgacgacggagatgaggactattataagcaaaggttaaggaggtggaacaagctgagattgcaggataaggaaaagaggctgaagctggaggacgactccgaagaaagcgatgccgaatttgatgagggtttcaaggtacccggctttctttttaaaaaactattcaaatatcagcagaccggcgtgaggtggctgtgggaactgcactgtcagcaagcaggaggcatacttggcgacgagatgggtcttgggaagaccatccagatcatagccttccttgccggactgtcttattccaaaatacgcactaggggctccaattaccggtttgagggcctggggcccacagtgatcgtttgtccaaccactgtgatgcaccaatgggtgaaggagtttcatacgtggtggccaccttttagagtcgcgattctccacgagaccggctcatatacacataaaaaagagaaactcatcagggatgtagcccattgccacgggattttaatcacgtcctatagttatatcagactgatgcaggacgatatcagccgctacgactggcactatgtgatcctggacgaggggcacaaaattcgcaatccaaacgccgctgtcaccctggcatgcaagcagttcaggacacctcatagaatcatcctgtccggtagtcccatgcagaacaacctccgcgaactctggtcactctttgattttatctttcctggtaaactgggcaccctgcctgttttcatggagcagttctcagtgcccatcaccatgggcggctatagcaacgcctcaccagtccaggtcaaaactgcttacaaatgtgcctgcgtgctccgtgacaccataaatccttaccttctgagaaggatgaaaagcgacgtgaaaatgtccctcagtcttcctgacaagaacgaacaggtgctattctgtcggctcaccgatgagcagcacaaggtttaccaaaacttcgtcgactctaaagaagtttatcgaatcctgaacggagaaatgcagatctttagcggtttgattgcgctccgtaagatctgtaatcaccccgatttgttcagtggcggccctaaaaacctaaaaggattgcccgatgacgagctggaagaggaccagttcggatattggaaacggagcggcaaaatgatcgtggtggagagcctgctaaagatctggcataaacaggggcaacgtgttctccttttcagtcaaagccgccagatgctggacattttggaagtattcctgcgggcacagaagtacacctatctgaagatggacggaaccaccaccatcgcctcaaggcagccattaatcacacgttacaatgaagatacctcaatctttgtgtttctgctcaccactcgggtcggaggccttggcgtcaatctgactggcgcgaacagagtggtcatctatgaccccgattggaatcccagcaccgacacacaggctagggaacgcgcttggcggattgggcagaagaaacaagtgaccgtgtaccgcttgctgactgctggcaccattgaagagaaaatttaccatagacagatcttcaaacaatttctgaccaatcgtgtccttaaagaccctaaacagagaagattttttaagtctaacgacctttacgaactgttcaccctgaccagccctgacgcatcccagtccaccgagacaagtgctatttttgctgggactggttccgacgtgcaaacacccaagtgccatcttaaaaggcgcattcaaccggctttcggggccgatcatgatgttccaaaacgaaaaaaattccccgcctccaacataagtgtcaacgacgcaacatcatctgaggaaaagagcgaagccaagggcgctgaggtgaatgccgtaaccagcaacagatctgatccccttaaagatgatcctcacatgagctccaatgtgacttccaatgatcgcttgggagaggaaaccaatgctgtgagtggtcccgaggaactgtcagtcatttctgggaatggagagtgcagcaacagctctggcaccgggaagaccagtatgccaagtggggacgagagcatcgacgaaaagctaggcctgtcctataaaagggaacggcctagtcaagcgcaaaccgaagccttctgggaaaacaagcagatggagaacaacttttacaagcacaaatccaagactaagcatcatagcgtcgcagaggaagagacgctggagaaacatctgagacctaagcagaaacctaagaatagtaaacattgtagggatgcaaagttcgaaggaactcgtatacctcacttagtgaagaagagacgttaccagaaacaggattcggaaaataaaagcgaagcgaaggaacaatcgaatgatgactacgtgttagagaagctcttcaagaagtccgtcggggttcatagcgtcatgaagcatgatgctattatggatggcgcctcacccgactatgtgcttgttgaggcagaagcaaacagagttgcccaggacgcgctgaaggctctcagactgtccagacaaaggtgcctgggggctgtgtctggagtgcctacatggaccggccacaggggcatctccggagcacctgcgggcaaaaagtcaagattcggtaaaaagcggaacagcaacttcagcgtgcagcaccctagttccacatctccaaccgaaaagtgccaggatggcatcatgaaaaaggagggcaaggataatgttcccgagcactttagtgggcgagccgaggacgctgatagttcatcaggccctctggcgtcatctagcctactggccaagatgagggctaggaaccacctcatcctgccagagagacttgaatcggagagcggccacttgcaggaggcatctgcgttgttgccgactacagagcatgacgacctgctggtagagatgcggaactttatcgcctttcaagcacatacagacggtcaggccagcaccagggaaattctccaggaattcgaatctaagttgtccgcgtctcagagctgtgtgtttcgagagctgcttcgcaatttgtgcactttccaccgcactagtggaggtgagggtatctggaagctcaaacccgaatactgttag

SEQ ID NO: 15120 - DNA, 2613 bp, Artificial Sequence
  Description of Artificial Sequence: Synthetic coding sequence
cagcagccattccataggcatttgctgatgacgactgccttacattcggagaaactgatccgcgacgtggctcactgccacggaattctgatcacgagttactcatatatccgcctcatgcaggatgatatttccaggtacgactggcactacgtgatcctggacgagggccataagattcgaaatccgaatgccgcggtcaccttagcctgcaagcagttcagaacccctcaccgcatcatactgtctggatcccctatgcagaacaatctgagagaactgtggtctctttttgatttcatttttcccggcaaattgggtacgttaccggtctttatggaacagttctccgtgccaattaccatggggggctattccaatgcaagccccgttcaggttaaaaccgcttataaatgtgcctgtgtactgagagacaccattaatccatacctgttacgccgtatgaagtccgatgtgaagatgagtctctctctcccagacaaaaatgaacagatcttctcaggactgattgccctgaggaaaatttgcaaccatcctgatctgttctctgggggcccaaaaaatctcaaagggctacctgatgatgagttggaggaagaccagttcggctactggaaaagatctggtaaaatgatcgtggttgaaagcctgctgaagatctggcataagcaggggcagagagttctcctatttagtcagagccgccagatgctggatattttggaggtctttttgagagctcagaagtatacctacctaaagatggacggaaccactacgattgcctcacggcagcccctgattacacggtacaacgaagacacaagtatttttgtgttcttactgacaacacgggtgggcggattgggcgtaaatctgaccggcgccaaccgcgtagttatatacgatcccgattggaacccttctacagatacccaagcgcgagaaagagcctggaggattggacaaaagaaacaagtgacagtgtatcgcttgctgactgccggcactattgaggaaaagatttaccatcgtcagattttcaagcagttcctcaccaaccgcgttctcaaagacccaaaacaacgacggttctttaagtctaacgacctgtacgagctgttcactctgacctcccccgatgcctcgcagtccacagagacgagcgctatctttgccggtaccgggagtgacgttcagacccctaaatgtcatctgaagagaaggattcagcctgcttttggtgccgatcatgatgtccccaagaggaagaaatttccggcgtccaacataagcgttaacgacgctacatcatcagaagagaagtcggaagcaaagggcgcagaagttaacgccgtgacgtccaatcgcagcgatcccctgaaggacgacccacatatgagttccaatgtcacttccaacgatagactgggcgaggaaaccaacgctgtgtcagggcctgaggagctgagcgtgatctccgggaacggtgagtgtagtaattcgtccggcaccggcaagacatccatgccctcaggcgacgagagcattgatgaaaaactgggactttcctataaaagagaacgtcccagccaggcccagacggaggccttctgggaaaataagcagatggagaacaatttttacaagcacaaaagcaagaccaagcaccactctgttgcagaggaggaaaccctcgaaaaacaccttcggcccaagcagaagcccaagaacagcaaacactgccgagacgcgaaatttgagggaactagaattcctcacctggttaaaaagaggcgataccagaaacaagactcagagaacaagtcagaggcaaaagagcaaagtaatgacgactatgttcttgagaaactttttaagaaaagtgtcggagtccactccgtaatgaagcacgacgcaattatggatggagccagccctgactacgtcctcgtggaggccgaggccaacagagtggcccaggatgccctgaaagctttgagactgtctcgtcagagatgtctgggcgcagtcagcggtgtccccacttggactggccaccgcgggatcagcggggctccagctggtaaaaagtcaaggttcggcaaaaagcgcaattccaacttttctgtgcagcacccttcttcaacaagccctactgaaaagtgtcaggacggtataatgaagaaggagggcaaggataatgttcctgaacatttctctggccgagcagaagacgctgactcctcatccgggcccctagcatctagctctctgcttgcaaaaatgagagcaagaaatcatttaatcctacctgagcgcttggagtcagaatccggccacctgcaggaagcctctgccttactgcccactaccgaacacgacgacctgcttgtagagatgcgaaattttatagcctttcaggctcataccgatggacaggcatccacaagggaaatcctgcaggaattcgagtccaagctttccgcgtcccagtcttgtgtttttcgggagcttctgcgcaacctctgtaccttccaccgaacgagcgggggagagggtatctggaaactcaaacccgagtactgctag

SEQ ID NO: 15121 - DNA, 540 bp, Artificial Sequence
  Description of Artificial Sequence: Synthetic coding sequence
atgcccaatgaaggcatccctcacagtagccagacccaggaacaggactgtcttcagtctcagcccgtgagcaataatgaagagatggcaatcaagcaggagtcaggaggtgacggggaagtggaagaatacctcagtttcagatccgttggagacggactctccaccagcgccgtgggatgcgccagtgccgcccccagaagagggccagctttgctgcatattgaccgacaccagatccaggccgtcgagccttctgcccaggctttagaactgcaggggctgggcgtggatgtctatgaccaggacgtgcttgagcagggggtgctgcagcaagtggataatgctattcacgaagcttctcgcgcaagccagctagtggatgtcgagaaggagtatcggagcgtcctcgatgacctgacctcttgtacaacctccttgcggcagattaacaaaataatagagcagttgtcgccacaggctgccacctcccgtgatatcaatcgaaaactagacagtgtgaagagacaaaaatattag

SEQ ID NO: 15122 - DNA, 318 bp, Artificial Sequence
  Description of Artificial Sequence: Synthetic coding sequence
atgtcgctgagtttgcccgataaaaacgagcaagtgctgttctgccgcctgacggacgaacagcacaaagtctatcagaactttgtggacagtaaggaagtatacagaatactcaacggagaaatgcaagaggttctccagtcctttacatccattcatctgcacgaaagcccactgaacttctttaggtcgttccaagttcgcgggagccgatcccactaccccggtaaaggcatgcagacaaccctcggcattgtgaacttcttggttgtaactctcaaaagaaagaagcgcaatcggttcagtccagacctgtag

SEQ ID NO: 15123 - DNA, 2592 bp, Artificial Sequence
  Description of Artificial Sequence: Synthetic coding sequence
atgcaggacgatatctccagatatgactggcattacgtaatactggacgaggggcacaaaatcaggaatccgaacgccgcagtgacattggcgtgcaagcaatttcgcacgcctcaccgcattattctctcgggatcacccatgcagaataatctacgcgaactatggtctctgtttgacttcatttttccaggtaagctgggaaccctaccagtgttcatggagcagttcagtgtgccaatcaccatgggggggtactctaacgctagccccgtccaggtgaagacagcttacaagtgcgcatgcgtccttcgagacactataaatccttatttgcttcgtagaatgaagtcagacgtgaaaatgtcactgtcactgcctgacaaaaacgagcaagtactcttttgcagactgaccgacgaacaacacaaagtctatcagaattttgtggactccaaggaagtgtacaggattttaaatggagaaatgcagatctttagcgggctcatcgcgctgcggaagatttgtaatcacccagacttattttcaggagggcctaagaacctcaaaggcttacctgacgatgaactggaagaagaccagttcgggtactggaagagaagcggcaagatgatagtggtcgagtctctgttaaagatttggcataaacagggccagcgcgtactgctgttcagtcagtcgaggcaaatgctggacattctggaggtatttttgagagcacaaaaatacacttatttgaagatggacgggacaactacaatagcatcccggcagcccctcatcacacggtataatgaagacaccagtatctttgtgtttttgctgacaacacgagtcggcggtctgggcgtaaacctaactggagccaatagggtggtgatttacgacccagattggaatccgtctaccgacacacaagcaagggagcgcgcctggcggataggtcagaaaaagcaagtgaccgtctatagacttctgacggcggggaccattgaagagaagatctatcatagacagatcttcaaacagttcctgacaaaccgggtcttaaaggacccaaaacaacgtagattcttcaagagtaacgacctttatgagttgttcactttgacgagtcccgatgcttcccaaagtaccgagacaagcgccatatttgctggtaccggcagtgatgtgcagactccaaagtgtcacctgaaaaggagaattcagcccgccttcggagctgatcatgacgtccccaaaaggaagaagttccctgcttctaatatttccgttaatgacgctaccagttccgaggagaaatcagaggccaaaggagctgaggtcaacgctgtgactagcaatagatccgacccactgaaggacgaccctcacatgagcagtaacgtgacttcgaacgataggctgggcgaggagaccaacgccgtgtccggcccagaagagttgtctgtgatttccgggaacggtgagtgcagcaatagtagtggtaccggaaaaaccagcatgccctcaggtgacgaaagcatcgatgagaaactcggcctcagttacaaacgcgaacggccatcccaggcccagacagaagcattttgggagaataaacagatggaaaataatttctacaagcataaatctaagaccaaacaccattctgttgcagaagaggagactttggagaaacacctgcgacctaaacagaaacccaagaactcaaagcattgccgtgatgcaaagtttgaggggaccaggattccccatttggttaagaaacggagataccagaaacaggatagtgaaaacaagagcgaggccaaagaacagtctaatgatgactacgtccttgaaaagttattcaaaaaaagcgtcggtgtgcatagcgtgatgaagcacgacgcgattatggacggcgccagtcccgactacgtactggtagaggctgaggccaaccgggtggcacaagacgcccttaaggcccttcgcctctccaggcagcgttgcttgggcgccgtttctggagtgccaacctggaccggccaccgcgggatttcaggggctcccgccgggaagaaaagtaggtttggaaaaaagcgtaattcaaattttagtgtgcagcacccttcatctaccagccccactgagaagtgccaggatggcatcatgaagaaagagggaaaagacaacgtccctgaacacttctcagggcgagccgaagacgccgactcctcaagtggaccattagcctcgagtagcttactcgctaaaatgagggcacggaaccatctgatccttccggaacgacttgagtccgagtcaggtcacttgcaagaagcctccgctctcctgcctaccacggagcatgacgatctcctggtggaaatgcggaattttattgccttccaggcccacactgacggtcaggcttctacccgcgagatcctgcaggagttcgagagtaagctgagcgcaagccagtcttgcgtattccgcgagcttcttcgcaacctgtgcacttttcaccggacatctggcggcgagggaatttggaagctcaaacctgagtactgttag

SEQ ID NO: 15124 - DNA, 1191 bp, Artificial Sequence
  Description of Artificial Sequence: Synthetic coding sequence
atgctgggcttccttagcgcccgtcaaacaggtctggaagaccccttgaggttgcggagggctgagtccacacggagggtgctgggactggagttaaataaagaccgggacgtggagagaattcatggaggcgggatcaacacactcgacatcgaaccagtggaaggtcgttatatgcttagtggagggtcggatggagttattgtgctttatgatctggagaattcctctaggcagtcttactatacttgtaaggccgtgtgcagtatagggcgtgaccacccagacgtccaccggtactctgtggaaaccgttcagtggtaccctcacgacaccggcatgttcacatcctcatccttcgataagaccctcaaggtgtgggacaccaacactctacagacagctgatgtcttcaacttcgaggaaacggtgtacagtcatcatatgagccccgtctctaccaagcattgtctcgtcgcggttggcactcgtgggcctaaagttcaactgtgcgatcttaagtctgggtcctgtagccatattctacaaggacaccggcaggagatcttggccgtgtcctggagtcctcggtatgactatatattagccaccgcttctgccgactctagggtaaagctctgggatgtgaggagagccagtgggtgcttaattactctggatcagcacaacggcaagaaaagccaagcagtggagagcgccaacactgcccacaatggcaaagttaacggcctgtgtttcacctcagatggtctgcatctgctcaccgtgggcaccgacaaccggatgcgcctgtggaattccagcaacggtgaaaatactctcgtgaactacggcaaagtatgtaataactctaagaaagggcttaagtttactgtgtcctgcgggtgctctagcgaatttgtatttgtgccctacggctctacaattgctgtctacactgtttattccggggagcaaataacaatgttgaagggccactataaaaccgtggactgttgtgttttccaaagtaactttcaggaactgtactcgggctcacgcgattgtaacattttggcatgggtgccatctctctatgagcccgtgccggacgatgacgaaacaactaccaagtcccagctgaacccagctttcgaagacgcatggtcttcatccgatgaggaggggtag

SEQ ID NO: 15125 - DNA, 1017 bp, Artificial Sequence
  Description of Artificial Sequence: Synthetic coding sequence
atgctgtctggggggtcagatggcgtgattgtactgtacgatctggagaattcaagtcgccaaagctattacacgtgtaaggccgtgtgttccatcggtagagatcaccctgacgtgcatcgctacagcgttgagactgtccagtggtacccccacgacacagggatgttcaccagttccagtttcgacaagacacttaaggtctgggatactaatactctgcagacagcggacgtgttcaattttgaagagactgtctactcacatcacatgagcccagttagcactaaacactgcttggtggcagtaggaacccgtggccctaaggtgcagctgtgtgatctcaagagcggttcctgtagccacattttgcagggccacaggcaggaaatactagccgtgtcttggagccctcgatatgactatatcctagctacagcttctgccgatagccgggtgaagctctgggatgtgagaagagcaagcggctgcttgatcaccttggatcagcataacgggaagaagagccaggccgtggaaagcgctaacacagcacacaacgggaaggtgaacggtctgtgttttacgtccgacggcttgcaccttctgaccgtcggaactgacaatagaatgcgactgtggaactcttctaatggagaaaacactctggtgaattatggaaaagtgtgcaataattccaagaaaggtctcaagtttacagtttcctgcggctgcagcagcgaattcgtgtttgtgccctatggatccaccatagcagtctatacagtttacagtggggaacagatcacaatgctgaaaggtcattataaaaccgtggattgttgcgtttttcagtccaatttccaggaattgtacagtggcagcagggattgcaatatcctagcctgggtgccatcactttacgaacctgttcccgacgatgacgagaccacaactaaaagtcagctgaacccggccttcgaagacgcctggtctagcagtgacgaggaaggctag

SEQ ID NO: 15126 - DNA, 1188 bp, Artificial Sequence
  Description of Artificial Sequence: Synthetic coding sequence
atggccacgtcgtctgcgcccgctggagtaagaaccaggtatgctggggtctttgtgcggacaccaaatgggtttggaggcccttcttctcccagtgaatctcgcgtgaataccgaatcctttgggacaggcatcaatacattagacatcgagccagtggaaggacggtacatgctcagtggaggctctgacggcgtgatagtgttatatgatttagagaacagttcaagacaaagctactatacgtgtaaggccgtatgcagcatcggaagggatcaccccgacgtccatcgctattcagtggagaccgtacagtggtatcctcacgataccgggatgtttacttccagctcctttgacaagacgctgaaggtgtgggacactaacacactgcagactgccgatgtcttcaactttgaagaaacagtgtatagccatcacatgtctccagtctctacaaaacattgccttgtcgccgtcggaacccgcggccccaaagtgcagttgtgcgatctgaaatctggttcttgctcccacatcctgcagggccatcggcaagaaatcctggcagttagctggtccccacggtatgactacattcttgctaccgcgtccgccgacagcagagtgaagttatgggacgtccgtagagcctctgggtgtttgattaccctggatcagcacaatggcaagaaatcccaggccgtggaatcagccaacacagcccacaacggaaaagtcaacggactgtgcttcacaagcgacggactacacctgctcacagttggcaccgacaacagaatgcgcctatggaacagttccaatggagagaatacactagtaaactatgggaaggtgtgcaacaattccaagaaaggcctgaaatttaccgtttcctgcggctgttcttcagagtttgtgtttgtaccttacggatccaccatagctgtgtacactgtctattcgggcgagcagatcacaatgctcaagggccattataaaacagtcgactgctgtgtgttccagtccaatttccaggagctgtatagtggatcccgagattgcaacatcctggcctgggtgccatcgctttacgagcctgtacctgacgatgacgagacaactacaaagtctcagttgaaccctgctttcgaggatgcttggtcctccagcgatgaggaaggatag

SEQ ID NO: 15127 - DNA, 732 bp, Artificial Sequence
  Description of Artificial Sequence: Synthetic coding sequence
atgggctataagtatatcactattggcacacgtggtcctaaagtgcagctttgcgaccttaaatccggctcctgttcacatattctgcaggggcacagacaggagatccttgcagtgagttggtctccgcggtatgactacatcctagccactgccagcgcagacagccgcgtgaaactctgggacgtccgccgggccagtggctgtctcatcacgctagaccaacacaacggtaagaagtcacaggccgttgagagtgccaacaccgctcacaatgggaaagttaacggcttatgctttacgagcgatgggttgcacctgctgaccgtcggcacagacaatcgcatgaggctctggaactcaagtaacggtgagaacactttagtgaattacggtaaggtctgtaataactccaaaaagggcctgaagttcactgtctcttgtgggtgttccagtgagtttgtgttcgtcccatacggctccacaatcgcggtgtacactgtgtattcgggggagcagatcacaatgctgaagggacactacaaaacagtcgactgctgtgtgtttcagtcaaacttccaggagctctacagtgggagccgagattgcaatattctggcctgggtgccttctctttacgagcctgtccccgacgacgatgaaacaacgacaaaatcccagctgaatccagcatttgaagacgcctggagctccagtgacgaagaggggtag

SEQ ID NO: 15128 - DNA, 2541 bp, Artificial Sequence
  Description of Artificial Sequence: Synthetic coding sequence
atgggcatacaggggttgctgcagtttatcaaggaagcctcagaaccaatacacgtgcgaaagtacaaaggacaggtggtagctgtcgacacctattgttggcttcacaaaggcgccatcgcttgtgcggagaagctggctaagggcgaaccgacggacagatacgtcggcttctgtatgaagtttgtgaatatgttgctttcccacggcatcaaacccatcctagtatttgatgggtgtactctgcccagcaagaaagaggtcgagagaagcagaagggagcgacgccaggccaatctgctgaagggcaagcaactgttgagagagggaaaagtgtcagaggcccgcgagtgtttcactaggagtattaacattacccatgcgatggcacataaagtgataaaggccgcccgatcccagggggtggactgccttgtcgcaccctatgaagccgacgcgcagctcgcgtatctaaacaaagctggtattgtccaggcgatcattacagaagattctgacttgctggcctttgggtgtaaaaaagtcatactgaagatggaccaattcggtaacggactggagattgaccaagcccggctgggaatgtgccgacagttgggcgacgtatttacagaggaaaagtttcgatatatgtgcatccttagtggctgcgactatttgtcgtccttgaggggcattggcctggcaaaggcttgtaaggttctgcggcttgcgaacaaccccgacatcgtgaaggtcattaagaaaatcggtcattatctcaagatgaacattacggtgcctgaggattacataaatggctttatccgggctaacaatacatttctgtatcagcttgtgttcgatcctattaagagaaagctgatccctctgaatgcctacgaagacgatgtagaccccgagaccctatcctacgcaggtcagtatgtcgatgacagcatcgctcttcagatcgccctggggaacaaggatataaacacatttgagcaaatcgacgactataaccccgacaccgctatgccagcacattcgcggtctcactcatgggacgacaagacatgtcagaagtccgcaaacgtaagttccatttggcatcgtaattacagtccgagacccgagagtggtaccgtgtctgacgcccctcagcttaaagagaatccaagcaccgtcggagtagagagggtaatctcaacaaaaggcctcaatcttccacgtaagtcaagcatcgtgaaaaggcccagaagcgccgaactgagcgaagacgatctacttagtcagtattccttgtcgtttacaaagaagactaagaagaactcctccgaagggaacaagtccctgagcttctccgaggtgttcgttccagatctggtaaacggtccgactaacaagaaatcagtgtccacgccgccacgtacacggaataagttcgctactttcttgcagcgcaagaatgaagagtctggtgccgtcgtcgttccagggacaaggtcaagattcttctgctccagcgatagcacagattgcgtgagtaataaagtgtctatacagcctctagacgagaccgcagtcactgacaaggaaaacaacctgcacgagtctgaatatggcgaccaggaaggaaagagacttgtggataccgatgttgccaggaattcctccgatgacatccctaacaaccatatccctggagaccacattcctgacaaagccactgtatttacggacgaggaatcatattcctttgaatcttcaaaatttacccgcaccatctcacctccgacgttgggaacactgagatcttgtttctcctggtcaggagggctgggcgatttctccaggactccaagccctagccccagtaccgcgctgcagcagtttcgtcgcaagagcgatagtccgacatcgctccccgaaaacaatatgtccgatgtctcacaactaaaatccgaggagtccagtgacgatgagtctcaccccctcagagaggaggcctgttccagccaaagccaagagtctggcgagttttccctgcagtctagcaatgcatcaaagctgtcccagtgctcgtccaaagactccgacagcgaagaaagcgactgcaatattaagctgctggactcacaatcagaccaaacctctaagcttaggctgtcgcatttctcaaagaaggataccccactcagaaataaagtgccagggctgtacaaatcctcttccgccgatagtctgagtaccaccaaaatcaagcctctgggtcccgctagagcttccggactgagtaaaaagccagcatctatccagaagcggaagcatcataatgctgagaataagcccggccttcagatcaaactgaatgagttgtggaaaaattttggctttaaaaaggacagcgagaaactcccaccctgcaagaagcccctgtcacccgtccgagataacatccagcttaccccagaggcagaggaggacattttcaacaagcctgagtgcggcagagtgcagcgcgcaatcttccagtag

SEQ ID NO: 15129 - DNA, 510 bp, Artificial Sequence
  Description of Artificial Sequence: Synthetic coding sequence
atgggaatacagggactgttgcaattcataaaggaagctagcgagcccattcatgttcgaaagtacaaggggcaggtggtggcagtcgacacctattgttggctgcataaaggggcaatagcttgcgccgagaaactagccaaaggggagcccaccgatcgaaggagacaagctaacctacttaagggcaagcagctactgcgggagggaaaagtgagcgaagccagggaatgtttcactcggagtatcaatatcactcatgccatggcacacaaagttattaaggccgcgagaagccagggcgttgactgtctggtggcgccctacgaggccgacgcacaactggcctatttgaacaaggcagggattgtgcaggctatcataaccgaagatagtgacctgctggcatttggatgcaagaaggtgatccttaaaatggaccagttcggtaacggcctagagatcgaccaggctcgactcggaatgtgtcgtcaactgggggatgtgtag

SEQ ID NO: 15130 - DNA, 2541 bp, Artificial Sequence
  Description of Artificial Sequence: Synthetic coding sequence
atgggtattcaggggctcctgcagttcataaaagaagcgtcagaacctatccatgtgcggaaatataaaggccaggtggtggcggtcgacacctattgttggctccacaagggcgcaatcgcttgtgccgagaagctggctaaaggggaaccgaccgatcggtacgtcggtttttgcatgaagtttgtgaacatgcttctgagtcacggtatcaagcccattttagtcttcgatggttgtactttgcctagtaagaaggaggttgagcggagtaggagagagcgccggcaagccaacttgctcaagggaaagcagctccttagggagggaaaggtgagcgaagccagggagtgctttacacgatctattaacatcactcacgctatggcccacaaagtaattaaagcggcgcggagtcaaggtgttgactgcctggtggcaccctatgaggccgatgcacagctggcatacctaaacaaggcggggatcgtgcaagcgattattactgaggactcagacctgttggcttttggctgtaaaaaagtcattctgaagatggaccaattcgggaacggactggagatcgatcaggcacgtttgggtatgtgtagacagctgggggacgtgtttacggaggaaaagtttagatacatgtgcatcttgtccggctgcgactacctctcctccttgcggggcattggactggctaaagcatgtaaggtcctgaggttggccaacaaccctgatatagtgaaggttatcaagaaaatcggccactacctcaaaatgaatatcaccgtgcctgaggactatattaacggtttcattagggccaataatacttttctgtatcaactcgtgttcgaccccataaagcgcaaactgatccccctcaacgcatacgaagacgatgttgaccctgagactctctcctatgccggccaatatgttgacgactcgattgccctgcagatagctctggggaacaaggacattaacacctttgaacagatcgatgactacaatccagacacggctatgcctgcccattccaggtcacatagctgggatgataagacttgccagaaatctgcgaatgtgagctcaatctggcaccggaactattctccacgaccagagagcggaaccgtgagcgatgctcctcaacttaaggaaaacccatctaccgtgggagtcgagcgcgtgatcagcacgaagggcctcaacctgcctcgcaaatcctctattgtgaagcgcccaagatcagcagagttgagcgaggacgaccttctttcgcagtatagcctttcttttactaagaagacaaaaaaaaacagcagcgagggaaataaatcactttcattcagcgaggtgtttgttcccgatcttgttaacggcccgacaaacaagaagagtgtatccacaccacccaggacgcggaacaagtttgctacttttttgcagcgcaagaacgaagaaagtggcgcagtagtcgttccaggaactcgaagccgctttttttgctcctcagactctaccgactgtgtcagtaataaggtgtcaatacaacctctggacgagaccgctgtgacagataaagagaacaatttacatgaatccgagtacggcgatcaggagggcaaacggttagtcgatactgacgtcgcgaggaactcctcagatgacataccgaataatcatattccaggggaccacattcccgataaggctactgtgtttacagacgaagagtcttatagtttcgaatcgagcaaatttacccggaccatctcacccccaacactggggaccttgaggagctgtttctcgtggtctgggggactgggagatttttcccgtacccccagtccatccccatccactgccttgcagcaattcaggcgcaagtcggatagcccaaccagtctgcccgagaataacatgagcgatgtctcacagctgaagtcggaagaatcttctgatgacgaaagccatcccctgcgtgaggaagcttgctccagccagtcacaggagtcaggagaattttctctgcagtcttctaacgcgtcaaagttgtcgcagtgctctagtaaggacagtgattccgaagaatcagattgtaacatcaaattactggattctcagagtgatcagacgagtaaactgagattgtcgcatttcagcaagaaggatacacccctgcgaaataaggtcccgggcctgtataagtcctccagtgctgattccttgagcaccactaagattaaaccattaggaccggcccgggcctcgggcctttccaagaaacctgcctcgatccagaagagaaagcatcataacgctgagaacaaacccggtctgcagatcaagttgaatgagctgtggaagaattttgggtttaagaaagacagcgagaaactgcccccttgtaaaaaacctctgtcccccgtccgggacaatatacaactcaccccagaagccgaagaggacattttcaacaagccagaatgcggtcgggtccagcgcgcaatattccaatag

SEQ ID NO: 15131 - DNA, 408 bp, Artificial Sequence
  Description of Artificial Sequence: Synthetic coding sequence
atggggatccagggcctgttgcagttcatcaaggaagcttccgaacctatccatgtccggaaatataaggggcaggttgttgctgtggatacctactgttggttgcataagggtgctatcgcatgcgcagaaaagctggcgaaaggcgaacccacagacagatacgtcggcttttgtatgaaattcgttaacatgttactgtctcacggcatcaaaccgatcctcgtgtttgacggatgcaccctaccgtctaaaaaggaggtggagagaagccggagggaacgaaggcaggccaaccttttaaagggaaagcaactcctgagggagggcaaggtcagcgaggccagggagtgctttacacgctctattaacattactcatgccatggctcacaaagtgattaagtag

SEQ ID NO: 15132 - DNA, 2412 bp, Artificial Sequence
  Description of Artificial Sequence: Synthetic coding sequence
atggggatccagggtttgctgcaattcattaaagaggcatcggaacccatccacgtgcgaaaatacaaaggtcaggttgtggcagtagacacatactgttggctccacaagggcgccattgcctgcgccgagaaactcgcgaagggagaaccaaccgaccgatatgtgggcttttgcatgaagttcgtgaacatgctgctttctcatggtattaagcccatcctagtatttgatgggtgcacactcccctccaaaaaggaggttgagcgatccagaagggagcgcaggcaggcgaacttgctgaagggcaagcaactgctgcgcgaggggaaggtgagtgaggcgagggagtgcttcactaggagtataaatatcactcatgccatggcccataaggtgattaaagcagcccgcagtcaaggagtggactgcctggtggcaccttatgaggctgatgcacaattggcctatcttaataaggcaggtatagtgcaagcgattatcactgaggactcagatcttttggccttcggatgcaagaaggtgatactcaagatggaccagtttgggaatgggttggaaatcgaccaggctcgattgggcatgtgcaggcagctgggggatgtgttcaccgaggagaaatttcgttatatgtgcatcctcagtggctgtgactacctttcaagtttacgggggatcggtctcgcaaaggcatgtaaagtgctcaggttggccaataaccctgacattgttaaggttattaagaaaatcggacattacctcaagatgaacattaccgtgcccgaggattatattaacggattcattcgcgcgaataatacctttctataccaactggtattcgaccccatcaagcggaaactcatcccgttgaatgcctacgaggacgacgtggaccccgagacactatcctacgcgggccagtatgtggatgattccattgctctgcagatcgcacttggcaataaggatataaacacgttcgaacaaatcgacgattataatcctgacacagcaatgcccgcacattctaggtcccatagctgggatgataaaacctgccaaaagagcgctaatgtgagttctatatggcaccgtaactacagccctagaccagaatctggtactgtgagtgatgccccgcagctgaaggagaatcctagcacagtgggggtcgaacgggtgatctcaaccaagggcctgaatctgccgcggaagagttcaattgtgaagcgtcccagaagtgcggagctcagtgaagatgatctcctatcacaatatagtctatctttcaccaagaaaaccaagaagaactcttctgaaggaaacaaatcgttaagcttctctgaggtcttcgtacccgacctcgtaaatggtccaactaacaagaagtcagtatcaactccacctcgcacaaggaataagtttgccacttttctgcagcgtaaaaatgaggaatctggagccgtcgtagtgccgggcactcgtagtagattcttctgctcaagcgactccactgactgcgtgtccaacaaggtgagtatccagcctttggacgagaccgccgtaacagacaaagaaaacaaccttcacgagagtgaatatggcgaccaggagggaaagagactagttgatacagatgtcgctagaaacagctctgacgacataccgaacaaccatattcctggagatcacatccctgacaaagcaacagtttttaccgatgaagaatcctactcatttgagagcagtaaatttacccggactatttcaccaccgacactgggtacgctgcgaagctgtttctcctggagcggagggctcggcgatttcagtagaaccccctctccatcaccttccactgcgttgcagcagtttcgtcgcaaaagcgattcacctaccagcctgcccgaaaataatatgagcgatgtctctcaactcaagtcagaggagtcaagcgacgatgaatcccaccccttgcgcgaggaagcttgctcttctcagtcacaggaatctggggagtttagtctccagagttcaaacgcatctaaactctcacaatgctctagcaaagatagcgatagcgaggaaagcgattgtaatataaagttactggactcccagagcgaccagacttccaaactgcggctgagccacttttctaaaaaagacaccccgctgcgtaacaaggtaccaggcctctataagagtagctctgctgattcactgtctaccaccaaaatcaagcccctcggacccgctcgggcatccgggctaagcaagaaacccgcttccatacagaagcggaaacaccataatgctgaaaacaaaccgggcctgcaaattaaactgaatgaactatggaagaatttcggatttaagaaattctag

SEQ ID NO: 15133 - DNA, 36 bp, Artificial Sequence
  Description of Artificial Sequence: Synthetic coding sequence
atgggcattcaaggccttctacaatttatcaagtag

SEQ ID NO: 15134 - DNA, 2241 bp, Artificial Sequence
  Description of Artificial Sequence: Synthetic coding sequence
atgcaggccaagaagcgctactttatactcctctctgccgggagctgtctggctctgttgttttatttcggtggattacagttcagggcttccagatcccattcccgtcgggaagagcatagtggacggaacgggctgcatcacccatctccagaccacttctggccccgttttcccgacgcgctacgcccatttgtgccttgggaccagctagaaaatgaggattcttctgtacacattagcccacgccagaaaagagacgccaatagctctatttataaagggaagaagtgccggatggaatcttgttttgacttcaccctatgtaagaagaatggattcaaggtctatgtgtaccctcagcagaaaggagaaaaaattgcagagagttatcagaatattctcgcagctattgaaggcagccggttctacacctctgacccaagccaggcttgcctattcgtgttgagcttggatacactcgaccgggaccagctttctccccaatatgtgcataacttaagatccaaggtgcagtccctccatctctggaataacggacggaatcatctaatttttaatctgtactcaggcacctggccagactataccgaagacgtggggtttgacattggccaggcaatgctggcaaaggcctctattagtacagaaaactttaggccaaatttcgatgtgagtattccactcttctctaaagaccacccacgaacggggggtgaacgcggcttcctcaagttcaacaccatccccccactacgtaaatacatgcttgtatttaagggtaagcgatacttgacaggaataggtagcgacacccgaaatgcattgtaccacgtacacaacggagaagacgtggtgcttttaacaacctgcaagcacggaaaggactggcagaaacacaaagacagcaggtgtgacagggacaataccgagtacgaaaaatatgattatagagagatgcttcacaatgccacgttctgtctggtgccgcgcgggcgccggctaggctcgttcagattcttagaggccctgcaagcagcttgcgtccccgtgatgctgagcaatgggtgggagttaccttttagcgaagtaatcaactggaatcaggctgctgtcataggcgatgaacggttgttgcttcagattccctccactattcgcagtatccatcaggacaaaatcttggccttaaggcaacagactcagtttctttgggaagcctacttttcttccgtcgagaagatcgtgttgaccactctagaaatcatccaggatcgtatattcaaacacattagtagaaatagtctgatttggaacaagcatcctggggggctgtttgttttaccacagtattcttcctacttaggggatttcccatactattatgccaaccttggattaaagccaccttcaaagttcaccgccgtcatacacgcagtgacccctctggtgtcccagtctcagcccgtcttgaaactgctcgtggctgctgcaaagagccagtattgcgcccagatcattgtcttatggaactgcgacaagccattacctgccaagcacaggtggcccgctaccgctgtcccggttgtcgtgatcgagggcgagtctaaagtaatgagctccaggtttctcccatacgataatattatcactgatgcggttctgagcctggacgaagataccgttctgagcacgaccgaagtggacttcgctttcaccgtgtggcagtcttttccagaacgcattgtaggatacccagcccgatctcacttttgggataactcaaaggaaagatggggctatacctcaaagtggacaaacgactactctatggtcctcactggcgctgctatctatcacaagtactaccactacctatacagccattacctccccgcaagcctgaagaatatggtggaccagctggctaactgtgaagatatcctaatgaacttcctggtgagcgccgtgaccaaactcccacctatcaaggtaactcaaaagaaacaatataaagaaactatgatggggcagaccagtagagcatcacgctgggcagaccctgaccacttcgcgcagcggcagagctgtatgaacacttttgcctcctggtttggttacatgccgttgatccattctcagatgagactggatccagttttatttaaggatcaggttagcatcctgcggaaaaagtaccgcgatatcgaaagactgtag

SEQ ID NO: 15135 - DNA, 2157 bp, Artificial Sequence
  Description of Artificial Sequence: Synthetic coding sequence
atgtgcgcgtctgtcaaatataatattagaggccctgcgctaattccgcgcatgaaaaccaaacatagaatctactacattaccctcttttccatcgtgctcttgggcctcattgctacgggtatgttccagttctggccacactccatcgaatcttctaacgactggaacgtggaaaagagaagcatcagggacgttcctgtagtcagactgccggccgatagcccaattcccgagagaggcgatctgtcttgcagaatgcatacttgctttgacgtgtacaggtgcggatttaaccccaagaataagataaaggtttatatttacgctctcaaaaaatacgtggatgatttcggggtgtccgtgtcaaataccatctccagagaatataacgaacttctgatggccatctctgactctgattattacacagacgatatcaaccgagcctgcctttttgtcccatcaattgacgtattgaatcaaaacactcttaggatcaaagaaaccgcccaggcaatggcccagctgagcagatgggataggggaacgaaccacctcctgtttaatatgctgccggggggaccccccgattataatactgctttagacgtgccaagggatcgagccttattggctggcggaggattttcaacgtggacttacaggcaagggtacgacgtatctatcccagtgtacagtccattgtccgcagaggtggatcttccagaaaaaggccctggaccccggcagtatttcctgctgtcctctcaggtggggctgcatcccgagtatcgtgaggacttggaggccctacaagtgaagcacggcgagtccgtgctggtgctcgacaaatgcactaatttatccgagggggtgctgtctgtgagaaagagatgccacaagcatcaggttttcgattaccctcaagtgctgcaggaggccacattttgtgtggtgcttagaggggctcgtttaggacaagccgtattgtccgacgtcttacaggcaggttgcgttccagtggtcatcgcagactcatatatcctccccttctctgaggtcctcgactggaagcgtgcctctgtcgtggttcccgaggagaagatgagtgatgtgtacagcatcctccagtcaattccgcagagacagattgaggagatgcagagacaggctaggtggttttgggaagcttatttccaatctatcaaggccatagcacttgcgacccttcagatcataaacgacaggatctacccctacgcagccatttcttacgaagaatggaatgatccccctgcagtgaagtgggggtcggtctctaatcccttgttcctgcccttgattcccccccagtcgcagggcttcaccgccatagtgcttacatacgaccgagtcgagtccctgttccgagtaatcaccgaggttagtaaggtgccatccctttctaaactcctcgtcgtgtggaataaccagaataaaaatccacccgaggactctctctggcccaagatcagggttcccctgaaagtggtgcgcacggcagagaataaactgtctaacaggttttttccgtatgacgaaatcgaaaccgaggcagttctcgccattgacgacgacataataatgctgacatctgatgagcttcagtttgggtatgaggtatggagagagttccctgaccgcttggtcgggtacccaggtcgccttcacctttgggaccatgaaatgaataagtggaagtatgagtccgaatggactaatgaggtatcaatggtgctgaccggtgctgccttttatcataaatacttcaactatttgtatacctacaagatgcctggcgatatcaaaaactgggtcgatgctcacatgaactgtgaagatatagctatgaatttcctggtggccaacgtgacaggcaaggctgtgatcaaagtcactcctcgaaagaagtttaagtgtcctgaatgtaccgcaatcgatgggctctctcttgaccaaactcatatggttgaacggtctgagtgcattaataaatttgcttcggttttcgggacgatgcccctgaaggtggttgagcaccgggccgacccagttctttataaagacgacttcccagagaagttaaagtctttcccaaacatcggaagtctgtag

SEQ ID NO: 15136 - DNA, 2187 bp, Artificial Sequence
  Description of Artificial Sequence: Synthetic coding sequence
atgtgcgcctctgtgaaatataacatcagaggccctgctctcattccccggatgaaaaccaagcataggatttattacatcactcttttctctatcgtactcctgggtctcatcgctacaggcatgtttcagttttggcctcatagtatcgagagctctaacgactggaatgtggagaaaaggtcgatccgcgatgtgccggtggtgagattgcctgctgattccccaatccccgagcggggcgacttgagttgtaggatgcacacctgcttcgatgtctacagatgtggcttcaatcccaagaacaaaattaaagtgtacatatatgcgctcaagaagtatgttgatgactttggcgtgagcgtctctaatacaattagcagagaatataacgagcttctgatggcgatctccgactctgactactacacagacgacatcaatagggcttgcttgtttgtgccaagcattgatgtcctgaaccagaatactctgcggatcaaggaaacggcccaggcaatggcccagttatcacgatgggaccgcggcactaaccaccttctctttaacatgttgcctggtggcccacctgattacaacacagcgctagatgtgccacgggatcgggccctgttggcgggcggcgggttctctacgtggacttataggcagggatacgacgtttctatcccggtgtattccccattgtctgcagaggtggatctgccagagaagggtccaggacccaggcagtatttccttctatcgagccaggtgggcctccaccccgagtacagggaggacctggaggcactgcaggtaaaacacggcgaatcagtcctggtactggataagtgcaccaatctgagtgaaggagtgctgagtgtgcggaagcgatgtcataaacatcaggttttcgattaccctcaggtcttacaggaggccaccttctgcgtggtgctgcgtggcgccagactgggtcaggcagtgctgtccgatgttctgcaggcagggtgcgttcccgtcgttatcgcagatagctatatcctgcccttttctgaggtgctcgactggaaacgcgctagcgtggttgtgcccgaagagaaaatgtccgatgtgtactcaattctgcagtccattcctcagagacagattgaagagatgcagcgtcagttatttatggagcccgccagaagggagaactggagtgcggctaaccaccagatgaactcccttatttggcctagagagcagtgggatagccagattattaacgaccggatttacccctatgcagctatctcatatgaggagtggaatgatcctcctgcagtcaagtggggttcagtatccaacccacttttcctgccactcatccccccccagagccagggtttcacagccattgttctgacctacgatagagtggagtcacttttcagagttatcacggaggtgagcaaggtgccaagtttgagtaagctgctggtggtgtggaacaatcagaacaaaaacccaccagaagactccttgtggcccaagatccgtgtgcccctgaaggtcgttcgtactgcggagaacaagctgagcaacagatttttcccttacgatgaaatagagaccgaagccgttttggcaattgatgatgacattataatgctgacatccgacgagttgcagttcggctatgaggtctggagggaattcccagaccgcctggtaggataccctggcaggctgcacctctgggatcatgagatgaacaagtggaagtacgagtcagagtggaccaacgaggtctctatggtcttgactggagctgccttttaccataaatactttaactatctgtatacctacaagatgccaggcgatatcaagaactgggtcgacgctcatatgaattgtgaagacatcgcaatgaacttcctggtggcaaacgtgaccggaaaagcagtgattaaagtcaccccgagaaaaaagttcaagtgcccagagtgcactgcgatcgacggactgtctctggatcagactcatatggtcgagcgcagcgagtgtatcaacaaattcgcatctgtgtttggcacgatgcctttgaaggttgttgaacatagagctgaccccgttttatataaagacgacttccccgaaaagctgaaatcctttcccaacatcggcagtctgtag

SEQ ID NO: 15137 - DNA, 2256 bp, Artificial Sequence
  Description of Artificial Sequence: Synthetic coding sequence
atgtcctgtgcaagtggcagcggaggaggactccggcacccactccggtgccagaagccatgggatgaagaatgcgaagaggaagccgtgtgcgtgataatgtgcgcatccgtgaaatacaatattagaggcccagctttgatccccagaatgaaaaccaaacatagaatctactacattacgctattcagcattgtgcttctcgggttaattgcaacagggatgttccaattctggcctcacagcatcgaatcctccaacgactggaacgttgaaaagaggtcgattagggatgtgccggtggttcggctcccagccgacagccccattcctgagcggggagatctgagctgccggatgcacacctgttttgacgtgtatcgctgtggttttaacccaaagaataaaatcaaggtatacatctatgccttgaagaagtatgtggacgatttcggtgtctctgtgagcaataccatctcgagagaatacaatgaactcctgatggccatttcagacagcgactactacacagatgatataaaccgcgcatgcttgttcgtaccttctattgacgtgctcaaccaaaacaccttaaggataaaagagacggcacaagccatggctcagctaagccgttgggatcgcggcaccaaccatttgctctttaacatgctccccggcggaccaccggattacaataccgccttggatgtccctcgcgaccgggccctccttgctggggggggcttttctacatggacttataggcaggggtacgatgtttccatacccgtctattcacctctctctgccgaggtagacctgccagagaagggaccaggaccgcgtcagtatttcctgctgtccagtcaggttggtttgcacccagagtatcgcgaagatttggaagcactgcaagtaaaacacggcgagtccgttctcgtactggacaaatgcacaaatctcagcgaaggcgtgctgtcggtgaggaagcggtgtcataagcatcaggttttcgattatccccaggtactgcaggaggccaccttctgtgttgtgcttaggggggctagactaggccaggccgtacttagcgatgtgttgcaggccggatgcgtgcctgtggttattgctgactcctacatcctgccattttcggaagtgctggactggaaacgagcttccgtggtggtcccagaagaaaagatgtccgatgtttacagtattctccagtcgatcccccagcgtcagattgaggagatgcagagacaggcccgttggttctgggaggcttacttccaaagcataaaagcaatcgctctcgccaccctgcagataattaatgatcgcatctacccctacgctgctataagctacgaagagtggaacgacccccctgcggttaagtggggatcggtgtctaatccgttgttcctccctcttatccccccccagtcgcagggattcacggctattgttctcacgtatgatagagtggagagtctatttcgggtcatcacggaggtgtccaaagtcccgagtctgagcaaactgctcgtagtctggaacaaccagaacaaaaacccacccgaggacagcctctggccaaaaatcagagtacccttgaaggttgtgaggacagccgaaaacaagctcagtaaccgatttttcccgtatgacgagatcgagacagaagctgttcttgctattgacgacgacattattatgctgacctcagatgagctgcaatttggttatgaagtatggcgggagttccccgatcgccttgttgggtaccccggccgcctgcacctttgggatcacgaaatgaacaagtggaagtacgagtcagaatggacaaacgaagtgagcatggtgctgaccggagcagctttttatcacaaatacttcaattacctgtatacctataagatgccaggcgacatcaagaactgggtcgacgctcatatgaattgtgaggacattgccatgaacttcttggtggcgaacgtaaccggaaaggcagtgatcaaggtgactcctaggaaaaagtttaaatgccctgagtgcacagctattgatggactgtcactggaccagactcacatggtggagcgctcagagtgcattaacaagtttgcctcggttttcggcactatgcccctcaaggtagtggaacaccgggcagatccggtgctgtacaaggatgacttccccgagaaactcaagagttttccgaatatcgggtccctgtag

SEQ ID NO: 15138 - DNA, 339 bp, Artificial Sequence
  Description of Artificial Sequence: Synthetic coding sequence
atgtgtgcttcagttaaatataatatccgaggaccggccttgatccctcggatgaaaaccaaacaccggatctactacataaccctcttctctattgtactccttggcctcatcgcaaccggcatgtttcagttctggccgcactctatcgaaagcagtaacgattggaatgtggaaaaaagaagcattagggacgtgcctgtcgtccggctgcctgccgactcccctatccccgagcggggagaccttagttgtcgtatgcacacttgtttcgacgtctatcgttgcgggtttaaccccaagaacaagatcaaggtctatatctacgccctgaaatag

SEQ ID NO: 15139 - DNA, 150 bp, Artificial Sequence
  Description of Artificial Sequence: Synthetic coding sequence
atgtgtgccagcgtgaagtacaatatccgcggccctgcattgattccccgtatgaaaactaagcataggatctactacattacgctgtttagcatagttctcctgggcttgatagcaacagggatgtttcagttttggccccactcttag

SEQ ID NO: 15140 - DNA, 2157 bp, Artificial Sequence
  Description of Artificial Sequence: Synthetic coding sequence
atgtgtgccagcgtcaaatacaacatccgagggccagcactcatccctcgtatgaagaccaagcataggatttactatatcacactcttctcaattgtgctgctgggtctgattgctacggggatgttccaattctggccccactctatcgagtcttctaacgattggaacgtcgagaaaagatccatcagggacgtgcccgtggtgcgcttgcccgcagatagccctatacccgagcggggtgatctgtcctgccggatgcacacatgcttcgacgtatatcggtgtgggtttaatccaaaaaacaagattaaggtgtacatctatgcacttaagaagtacgtcgacgattttggcgtgtctgtgagcaatacaatcagtcgagaatacaacgagctattgatggcaatttctgattcggactactatacagacgacatcaaccgggcttgcctgttcgtgccgagcatcgacgtgcttaaccaaaatacgctccgcatcaaagaaacggcacaggccatggctcagctgtcgcggtgggaccgcggaacaaatcatctgcttttcaatatgttacccgggggtccccccgattataacaccgccctcgacgtcccacgtgaccgagccctgctggcggggggcggcttctcaacctggacctaccgccagggctacgacgtgtctatccctgtgtattcaccactgagcgccgaggtggacctgcctgaaaaaggtccagggccacggcaatatttcttgctttcaagccaggtcggactgcatccggagtatcgcgaagatctcgaggccttacaagtgaaacatggagagagcgtgcttgtgctggacaagtgcaccaatctctctgagggggtgttaagtgtccgcaagagatgccacaagcatcaggtatttgactacccgcaggtactgcaggaggctacattttgtgtagtgctccgaggcgcccggttaggccaggccgtcctgagcgacgttcttcaggctggctgtgtgcctgtggtcattgctgattcttatatattgccattttccgaggtgctggattggaagcgcgcgtccgttgtcgtgccggaggaaaagatgtccgacgtgtacagcatacttcagtcaatcccccagcgccagatcgaagagatgcaacggcaggcacgctggttttgggaagcatacttccagtctatcaaagccattgctctggcgactttacagattataaatgatcggatctacccatacgccgcaattagttatgaagagtggaacgatccccctgcagtcaagtgggggagcgtgagtaacccgttgtttttacccttgatcccgcctcaaagtcagggatttactgcaatagttctgacatacgatagggtggaaagccttttccgggtgatcactgaggtctccaaagtgccctccctgtccaagctccttgtcgtttggaacaatcaaaacaagaatccccccgaagactctctgtggcccaagattagggtgcccctgaaagttgttcgaacagcggaaaataaactgagcaaccgattcttcccctacgatgaaatcgaaaccgaagcagttctggctatagatgatgatatcataatgctgacctctgatgagttacagtttggctatgaagtctggcgcgaatttcctgaccggttggtgggttatccgggccgcctgcacttgtgggaccatgagatgaacaaatggaaatacgagtcagagtggaccaacgaggttagtatggtcctgaccggggccgcattttaccataagtactttaactacctatacacctataaaatgcctggcgatataaaaaactgggtggatgcacacatgaactgcgaagacattgcaatgaacttcctcgtggcgaacgtaacaggaaaagccgtgatcaaggtgactccaagaaagaagttcaagtgccctgaatgtaccgcaatagatggcttgtccttggatcagacgcacatggtagagcggtctgagtgcataaataagttcgcatctgtgttcgggaccatgccactaaaggtggtagaacatcgagccgatccggttctgtacaaggatgatttcccagagaaactgaagagcttcccaaacattggctcactttag

SEQ ID NO: 15141 - DNA, 1761 bp, Artificial Sequence
  Description of Artificial Sequence: Synthetic coding sequence
atgccgaaaccaattaacgtgagggtcactacaatggatgcagagctcgaatttgcgatccagcccaataccaccggaaagcagttgttcgatcaggtggtgaaaaccattggcttgcgggaggtttggtacttcggcctacactatgttgacaacaaaggctttccaacctggctcaagctcgacaagaaggtgagtgcccaagaagtacggaaagagaacccactccaatttaagtttcgagcaaaattttacccagaagatgtggcagaagagttgatccaagacatcacccagaagttattttttttgcaggtcaaagagggcatcctctccgacgagatctattgtccccctgagacggctgtgttgctggggagttatgccgtgcaggctaaatttggtgactataataaggaggtccacaagagcggctacttgagctccgagcggcttattccccagagagtgatggaccagcataagctgactagggaccagtgggaggacaggattcaggtgtggcatgccgaacatcgggggatgctgaaggacaacgctatgcttgagtaccttaagatcgctcaggacctagaaatgtatggcataaattacttcgagataaaaaacaaaaagggcacagacttgtggctgggtgtagatgccctggggctaaacatctacgaaaaggacgataagctgacccctaaaatcggattcccctggtcagaaatccggaatatttccttcaatgacaaaaagttcgtgattaaacccatcgataagaaggctcccgatttcgtgttttacgccccacgactgagaattaacaaacgtattttacagttatgtatggggaaccacgagctctacatgcgcaggcgcaaacccgataccatcgaggtccagcaaatgaaagcgcaagcacgggaagagaagcatcaaaaacagctggagagacagcagttagaaacagagaagaaaaggcgtgagactgtagagagagagaaagagcaaatgatgagggaaaaggaagagctgatgctgcgcctgcaagactacgaagagaagacaaagaaagcagagagggaattgtccgagcagatccaaagagctctgcagctggaagaggaaaggaagcgggctcaagaagaggccgaaagacttgaagccgatagaatggccgccctacgagccaaagaggaacttgagagacaggccgtcgaccagatcaagtcacaggaacagctggctgccgagctcgccgagtataccgctaaaatagccttactggaggaggctcggaggaggaaggaggatgaggttgaggagtggcagcatcgcgccaaggaagcccaagatgacttagttaagacaaaagaggagctccatcttgtgatgaccgcaccaccaccccccccacccccagtgtacgaaccagtcagttatcatgtccaggaatctctgcaggacgagggcgctgagcccactgggtacagcgcagaactatcaagtgagggtatccgtgacgatagaaatgaggagaagagaattacagaggccgaaaagaatgagcgcgttcagagacagctcctcactctgtcctccgaattgtctcaggcccgggatgagaacaagagaactcataatgatataatccacaatgagaacatgaggcaaggtagagataagtataagacccttagacagatccgacagggcaatacaaaacaacgcattgacgaatttgaggccttatag

SEQ ID NO: 15142 - DNA, 1761 bp, Artificial Sequence
  Description of Artificial Sequence: Synthetic coding sequence
atgcccaaaccgatcaatgttcgagtgaccaccatggatgccgagctcgagtttgccatccagcctaataccacagggaagcagctcttcgaccaggttgttaagaccattggcctccgtgaggtgtggtacttcgggttgcattacgtggacaataaaggctttccaacttggttgaaactcgataagaaagtgtcggctcaggaggtacgaaaagaaaatcccctccaattcaaattccgggccaaattctatcccgaagacgttgctgaagagctcattcaggacataactcagaaattgttctttctgcaggtgaaagagggaatcctgtctgacgaaatatactgtccacctgaaacggctgtactgcttggatcatacgctgtacaggcaaagttcggagattacaacaaagaggttcacaaaagtgggtatctttcctcagaaaggctgatccctcagagggtcatggaccagcacaaactcacgagagatcagtgggaggatcgaattcaggtgtggcatgccgagcaccgcggaatgcttaaagacaacgcgatgctggaataccttaaaatcgcccaagatcttgaaatgtatggaattaattactttgagattaagaataaaaagggtacagacctctggctgggcgtggacgcgctgggtttaaacatctatgaaaaagatgacaaactcaccccgaagatcggttttccttggtccgagatccggaacatctccttcaacgacaagaagttcgttataaagcctattgacaagaaggccccagatttcgtgttctacgcaccgcgcttacgtattaataagaggatcctgcaactgtgcatgggcaaccacgaactgtacatgagaagacgaaaaccggacaccattgaagttcagcagatgaaagcacaggcccgggaggagaagcatcagaagcagctggaacgtcagcagcttgaaaccgaaaaaaagcgtcgggagacggtggaacgagagaaagaacagatgatgcgggagaaggaggaactgatgcttcggttacaggattatgaggaaaagacgaaaaaggcagaaagagagctgtccgagcagatccagcgggcattgcagctggaggaagaaaggaagagggctcaggaagaagcagagcgactggaagcagacagaatggcagcccttcgcgccaaagaggagctggagagacaggcagtggaccagataaaaagccaggagcagctggccgcggaacttgcagaatataccgccaagatcgctctgctggaggaggcacgcagaaggaaggaggatgaggtggaggagtggcagcaccgtgctaaagaagcacaagatgatttagtcaaaactaaagaagaattgcatctggtaatgacagcccctcccccgcctccaccccctgtgtacgagccagtcagctatcacgtccaagaatccctgcaagatgagggagctgaaccaactggttactccgcagaattatcatcggagggaatcagagatgacagaaacgaggagaaaagaattaccgaagccgaaaaaaacgagagagtccagcggcagcttctcaccctgagctctgagcttagtcaggctagagacgagaacaaaaggacccacaatgatatcatccataatgagaacatgcgccaaggccgcgataagtacaaaactttacgccagattcgacaggggaacacaaaacaaagaatcgacgaattcgaagcactgtag

SEQ ID NO: 15143 - DNA, 1665 bp, Artificial Sequence
  Description of Artificial Sequence: Synthetic coding sequence
atgcccaagcctatcaatgtccgggtcacaaccatggatgccgaactggagttcgcaattcaacccaataccaccggaaaacagctctttgaccaggtcagtgctcaggaggtgagaaaagagaacccactccaattcaagttcagggccaaattctaccctgaggacgtcgccgaagagctcatccaggatatcacacagaaactcttttttttacaagtaaaggagggcatattatcagacgagatctattgccctcccgaaaccgctgtactgctcgggagttacgcggtgcaggccaaatttggagattacaacaaggaggtccacaaatcaggttacctatctagcgaacgcctgatcccgcagagagtgatggatcaacacaaactgacccgagaccagtgggaggatcgcatacaagtttggcacgcggagcacaggggaatgctgaaagataatgctatgctggagtatcttaagatcgcccaggatcttgagatgtatggcatcaattactttgagattaagaataaaaagggcactgatctgtggctcggcgtggacgctcttggccttaacatctacgaaaaagatgacaagctaacaccaaaaatcggatttccctggagcgagatccggaacatctcctttaacgacaaaaagttcgttattaagccaatcgacaagaaagctcctgacttcgtgttctatgcccctaggctgagaatcaacaagcgtatcttgcagttgtgcatgggaaatcatgagctttatatgaggcggaggaagcctgatacgatcgaagtccagcagatgaaggctcaagcccgggaggaaaagcaccagaaacagctcgagcgccagcagctggagacggagaaaaagagacgggagaccgtggaaagagaaaaagagcagatgatgcgggagaaagaggagctgatgctgaggcttcaggactatgaggaaaaaactaaaaaggcagaacgagagctgtccgagcagatccaaagagcccttcagctggaggaggaacgcaaacgggcgcaggaggaggctgaacgcttggaagccgataggatggccgctctgcgcgccaaagaggagctagaaaggcaggctgtggaccaaataaaaagtcaggaacagttggcggccgagctggccgaatatactgccaagattgcacttttggaggaggcaaggaggcgtaaagaagacgaggtggaggaatggcaacatcgcgccaaggaggcccaagacgacctcgttaagaccaaggaagagctgcacctcgtcatgacagccccccctccacctcctccccccgtttatgagccagtcagttaccatgttcaagaatcgctgcaagacgaaggagccgagcccactggatattcggccgaattgtcctctgaggggattcgggatgaccgcaacgaggagaagaggatcaccgaggctgagaaaaatgaacgcgtccagcgacaactactgacgctgtcctctgaattatcacaggctcgggatgaaaataagcggactcataacgatatcatacataacgagaacatgaggcaaggacgtgacaaatataagacactgcggcagatccgccaaggcaatacaaagcaaaggatcgacgagttcgaggccctgtag

SEQ ID NO: 15144 - DNA, 900 bp, Artificial Sequence
  Description of Artificial Sequence: Synthetic coding sequence
atgggtacgaaagctcaggtggaacggaaactcctttgcctgtttatcctcgcgatcctgttgtgcagcctggcgctggggtctgttaccgtgcactcctccgagcccgaggtccgaattcccgaaaacaaccccgtgaaattgtcctgcgcttacagcggctttagctctcctagggtggaatggaagtttgaccagggggacactaccagactggtctgctacaataacaaaattaccgcttcctatgaggatcgggtgactttccttcctacagggattacattcaagtcggtgacacgggaagataccggcacttacacctgcatggtgagcgaagagggcggtaattcctatggcgaggtaaaggtgaaactgatcgttctggttcccccatccaagcccacagttaatattccttcatccgcaaccattggcaaccgtgctgtgttgacctgcagcgaacaggacggtagccctccgtccgaatatacctggtttaaagatggaattgtgatgcccaccaatcctaaatctacacgtgctttctccaatagcagctacgtgctgaacccaactaccggggagctggtattcgaccctttgagcgcttccgatacaggcgaatacagttgcgaggccaggaatggctacggtacacctatgacttccaacgctgtgagaatggaagccgtcgagaggaatgtaggcgtgatcgtcgcggctgtgctggtgactctcatactgcttggaattctggtcttcggcatctggttcgcctattctagaggccatttcgatcgcaccaaaaaaggcacgtccagcaagaaagtgatttactcacagccgtctgctagaagtgaaggagagtttaagcagactagctccttcctggtctag

SEQ ID NO: 15145 - DNA, 900 bp, Artificial Sequence
  Description of Artificial Sequence: Synthetic coding sequence
atgggcaccaaagcacaggtggaaagaaaactactatgcctgtttatactggccatcctattgtgttctctggcattaggctcagtaacagttcacagcagcgaaccagaagtccggatccccgagaataatccggtgaaactgagttgcgcttacagtggcttttcgagcccacgagtggagtggaagtttgaccagggtgacactacaagactcgtgtgttataacaacaaaatcaccgcaagctacgaggacagagtgacattccttcccaccgggattacattcaagagtgtgacgagggaggacaccgggacttacacgtgcatggtgagtgaggaaggaggaaacagctacggggaggtgaaggtaaagttaattgtccttgttcctccttccaaacctacagtcaatattccgagctccgctacaattggaaatcgcgccgttcttacgtgttcagaacaggacggcagtccaccgagcgaatatacctggtttaaagacggcatcgtaatgccaactaatcccaagtcaactagggctttctccaattcttcttatgttctgaatcccacaaccggagagctggtgttcgaccctttgtctgcaagtgatacgggtgaatactcctgtgaagctcgcaatggctacgggacccccatgaccagcaatgccgttcggatggaggccgtggaaagaaatgtgggagtgatcgtggcggcagtactggtaactttgattttgctgggtatcctcgtgttcggaatctggttcgcttactcccggggtcattttgaccgcactaaaaaaggtacttcatccaagaaggtgatttactcccagccttcagcccgctctgagggggaattcaaacagacttctagtttcctggtgtag

SEQ ID NO: 15146 - DNA, 900 bp, Artificial Sequence
  Description of Artificial Sequence: Synthetic coding sequence
atgggaaccaaggcccaagtagaacgaaaactcctgtgtctgttcatactggcaatcttactctgttctcttgctctgggatccgttactgttcatagttcggaacctgaagtccgcattcctgagaacaatcccgtgaaactgtcatgcgcttactccggattctcctctccgcgagtggaatggaagtttgatcagggcgacaccacccggctcgtgtgttataataataaaatcacagcctcttacgaggaccgagtgaccttcctgccgaccggcattaccttcaagagcgttactcgagaagatactgggacctacacgtgtatggtgagtgaggaaggcggcaattcgtacggtgaggtgaaagtgaagcttatagtgttagtaccaccaagcaaacctacagtcaatattcccagctctgccacaattggaaatagagccgtgcttacatgctcggagcaagacggatcacctccctctgaatacacctggtttaaagatggcatcgttatgcccacaaaccccaaatccacacgggctttttctaactccagctacgtgctgaaccccacaactggggagttggttttcgatcccttgtctgcctccgacacaggcgaatattcttgcgaggcacggaatggctacggcaccccaatgacctccaacgcggtgcggatggaggccgtcgaacgtaacgtgggggtcattgtggccgctgtcctagtgactctcatcctactcgggatcctggttttcggaatttggtttgcctactccaggggtcatttcgacaggaccaagaagggtacttcctctaaaaaggtcatttacagccaacctagtgctagatccgagggggaattcaagcagacatcgtcttttctcgtctag

SEQ ID NO: 15147 - DNA, 912 bp, Artificial Sequence
  Description of Artificial Sequence: Synthetic coding sequence
atgctgcaagcacctagagggagagctagagccgcgcttaggagactggctgtcgctactcggaccatggctggaggctcactcgcactcggaagcgtgaccgtccattcctcagaaccagaagtcaggattccagagaataatccagtgaaactgtcttgcgcgtactccgggttctcctctccacgcgttgaatggaagttcgatcagggcgatacaactagattggtttgctacaacaacaagataacagccagctacgaggaccgggtaaccttcctgcctacaggaatcaccttcaagtccgtgactagggaagatacgggaacctacacctgcatggtctccgaagaggggggtaacagttacggcgaggtgaaggtgaaattaattgtccttgtgccgccctcgaaaccaacagtaaacattccctcatccgccactattggtaaccgcgcggtcctgacctgcagcgagcaggatggctccccaccaagtgagtacacatggtttaaggacggcatcgttatgccaacaaatccaaagtcaacgcgtgcctttagcaacagctcttacgtcctgaaccccactacgggcgagctggtgttcgacccactgagtgcctccgacactggggaatattcttgtgaagctcgaaacggatatggtacaccgatgacatctaatgcggtgcgcatggaagccgtggaacggaatgtgggagtcatcgtggctgctgtactcgtgacattaatcctcctgggcattcttgtttttggcatctggtttgcatacagcagagggcactttgatcggaccaagaaaggaacatcaagcaagaaggtgatttacagtcaaccctccgcgagaagcgaaggcgagttcaagcaaacctcctcattcctggtgtag

SEQ ID NO: 15148 - DNA, 753 bp, Artificial Sequence
  Description of Artificial Sequence: Synthetic coding sequence
atgggaacgaaagctcaggttgaacgaaagctgctctgtttgttcattctcgcaattctgctttgttctcttgctctggggtccgtgactgtacattccagtgaacctgaagtgagaatccccgaaaataatcccgtcaaactaagctgcgcctattctggattctcctcgcctagggttgagtggaaatttgatcagggtgataccacacgcctggtttgttataataacaagataaccgtccctccaagtaaaccaacagtgaacattcctagtagcgctacaatcggaaacagagccgtcttgacatgtagcgagcaagacggaagcccccctagcgaatacacctggtttaaggacggaatagtcatgcccacaaaccccaagagcacaagggcattctctaatagtagttacgttctgaacccgacaaccggcgagcttgtgttcgatcccctatccgcctctgataccggtgaatattcttgtgaagcacgcaacggatacggtacgcctatgacttccaacgctgtcagaatggaagcagtggagcggaacgtcggagtgatagtcgccgccgtcctcgtaaccctgatcctgctcggcatcctggtctttggcatatggtttgcttatagcagagggcacttcgacagaacaaaaaaaggcacctcctccaaaaaggtcatctacagtcagcctagtgctaggtctgaaggcgagtttaagcagacttcttcatttctggtctag

SEQ ID NO: 15149 - DNA, 3357 bp, Artificial Sequence
  Description of Artificial Sequence: Synthetic coding sequence
atgggagttcaaggatttcaagattatattgagaaacactgcccatcggccgtagtgcccgttgagttacagaagctggcccgcggctccctcgtcggcggcgggcgccagcgtcctccccaaacgccactgcgacttttagtcgatgctgacaactgccttcatcgcctctatgggggtttctacacagactgggtctctggaggtcagtggaatcatatgctggggtatcttgcggctctagccaaggcatgcttcgggggcaatatcgaactgttcgttttttttaatggagccctcgaaaaggcacggctgcacgagtgggtgaaaagacagggcaacgagaggcagaccgcccagcagatcgtatcccacgttcagaataagggaacaccacctcctaaggtgtggtttttgcccccggtgtgcatggctcactgcatacgcctggcattaatacgctttcacgttaaagttgctcagtctatagaggatcaccaccaggaggtgataggcttttgtcgcgagaatgggttccatggtctcgttgcctacgattccgactatgccctctgcaatattccatactacttctccgcccacgctctgaagttgtcccggaacggcaagagtcttacaaccagccaatatctcatgcatgaggtggctaagcagctggacctgaatcctaacaggttcccaatctttgctgcgctgctgggcaatcacattctgcccgatgaagatctcgcctctttccattggagtctgcttggaccggaacatcctttggccagcctcaaagtccgtgcacatcagctcgttttacctccctgtgatgtggtgattaaggccgtagctgattatgttcgaaacattcaggatactagcgacctcgacgcgatcgccaaagacgtttttcaacatagtcagtcgagaaccgacgacaaagtaatccgctttaagagggcgattggctactattcagccacctccaagcctatgtcatttcaccccccgcactaccttgctgctaggcccggccccttcggcatgcccgggatggtccctccgcacgtgccccctcagatgctcaacatcccacagacaagcctacaagcaaaaccagtggccccacaagtcccatcccctgggggagcccctgggcagggaccctacccctattctctgagcgagcccgcccccctcactctcgatacctccggcaagaacctgactgaacagaattcttatagtaacatcccccacgagggaaaacatacgccgttatacgaaaggtcaagccctatcaacccagcccagtccggtagcccaaaccatgtcgattccgcgtactttccgggcagttctacgagttcctctagcgataatgacgagggatccgggggggccaccaaccatattagcgggaacaagattgggtgggaaaagactggatctcattctgagcctcaggctaggggcgacccaggcgaccagaccaaagcggagggatctagcaccgcctcctccgggagccaacttgcagagggaaaaggaagccagatgggaacagtgcaacctatcccttgtctccttagtatgccaactcgtaatcatatggacatcaccacccccccccttccacctgtcgcccctgaggtcctgcgagtggctgagcaccgtcataaaaaggggcttatgtacccatacattttccacgtcctcaccaaaggggaaattaagatagccgtatcgatagaggatgaagcaaataaggacctccctccggccgccttgttgtaccgaccagttcgccagtacgtgtacggagtgttgttctccctagcagagagtaggaagaaaacagagaggctagcgttccgtaagaacagactgccccctgaattttcccccgtaatcatcaaggagtgggcagcttataaaggaaagtctcctcaaacaccagaactggtggaagccctggcattcagagaatggacttgtccaaacctgaagcgattatggctgggcaaggcagtcgaggacaagaataggaggatgagagcatttttggcatgtatgcgctcagacacccccgccatgctgaaccccgcaaacgttccgacacacctgatggtgctctgttgcgtgctgcgctacatggttcagtggcccggagcccggatcctgcggcggcaagagctggacgccttcttggctcaagcgctcagtcccaaactgtacgaacccgatcagctgcaggaactgaagatcgagaatctggacccacgtggcattcagctcagcgcactttttatgtccggcgttgatatggccctgttcgcgaatgacgcttgcggtcaaccgattccttgggagcactgctgtccctggatgtacttcgatgggaaactgttccagtccaaattgctcaaggccagtagggagaagactcccctcattgacctttgcgacggtcaggctgatcaggccgccaaggttgaaaagatgcgacaatccgtactggaaggcttatccttttcgcggcaaagtcacactctgcctttccccccacccccagcgttacctttttacccagcttctgcttacccacgccattttggacctgtgccgcccagtcagggacgtggtaggggctttgccggggtgtgtgggtttggcggaccatatggtgaaacggtggccactgggccttatcgggcttttcgtgtcgctgctgcttccggacactgcggagctttcagtgggagcgattcttcaagaaccagtaaatcccaggggggcgtgcagccgatcccctcacagggtggtaaactagaaatcgctggcaccgtagtgggccattgggcggggtctcggcgagggcggggaggacgtggcccgttccccttacaggtagtgagcgtgggagggcctgctcgcggtcgtccaagaggggtgatcagtactccagtgatcaggaccttcggcaggggcggcagatactacggccgcggatataaaaaccaggctgctatacaggggcgcccaccttacgcagcaagtgcggaagaagtggcgaaggaactgaaatccaagtcgggagagagcaagagctctgctatgtccagcgacggatccctcgctgaaaacggggtgatggctgaggaaaagcccgccccacagatgaacggcagcaccggggacgctagggccccctctcacagcgaaagtgcactgaataatgactcgaagacctgcaacacgaatccccatctgaacgccctgagcactgactctgcctgtagaagggaggccgccctggaggctgccgtgttaaataaggaagaatag

SEQ ID NO: 15150 - DNA, 3441 bp, Artificial Sequence
  Description of Artificial Sequence: Synthetic coding sequence
atgggcgtgcaaggattccaggattatatagagaagcattgtccctcagccgtcgtgccagtggagctccaaaagctggcccgtgggagcctggtgggtgggggccgacagcgtcccccccagacccctctccgcctgctcgtggatgccgataactgtctgcacagactctacgggggcttctacacagactgggtgagtggcggacagtggaatcacatgcttggatacctagctgctctggcaaaggcttgctttggggggaacatcgagctttttgtatttttcaacggagccctcgagaaagctcgtctgcacgagtgggtgaagcgccaggggaacgagcggcagaccgcacagcagatagtctcgcatgttcaaaacaagggcactccgccacctaaggtctggttcctgccacctgtctgcatggcacactgtattaggcttgcgctgattcgcttccatgtcaaggtcgcccagtcaattgaggaccaccaccaggaggtcataggcttctgcagagaaaatggattccatgggctggtcgcttacgacagcgactatgccctgtgcaatattccctactacttctccgcgcatgcactgaagcttagcagaaacgggaagtctctcacaacttcccagtatcttatgcacgaagtggcaaaacagttggatctgaacccaaatcgttttcccatcttcgccgctctgttgggcaaccacatattgcctgacgaggatctagcttctttccattggtccttgctggggccagagcacccactggccagcctgaaggttagggcacaccagcttgtcctgcccccctgcgacgtggtgattaaagcagtagccgattatgtgaggaacatccaggacacttcagatttggatgccatagctaaagatgtgttccagcatagccagtccagaacagacgataaggtcattagattcaagcgagccatcggctactactcagcgacttcaaagcctatgagctttcatcctcctcactaccttgctgccagaccaggcccttttgggatgcctggcatggtccctccccatgtcccaccccagatgctcaatatcccacagacgagtctgcaggccaagccggtggcaccccaggtgccttcacctgggggcgctccaggtcagggtccctacccatacagcttgagtgaaccagccccccttaccctggacacgtcaggtaaaaatctaacggagcaaaactcctactccaatatccctcacgagggaaagcatacacccctctatgaacgctcctcgcctattaaccctgctcagtcgggctcccccaatcacgtggacagtgcatatttccccggtagtagtactagctcttcctcagacaatgatgagggcagtggcggggccactaaacctttccagctgtatttgcagaagaacttcgtgttccataaagaaaatagtatcgtgctgtgcagcaggatcctcaggcacggacacatatcaggaaacaagatcgggtgggaaaagacaggctctcatagtgagccgcaggcccgaggagatcctggggaccaaactaaagctgagggttcctctaccgcctcctctggaagtcagctggcggaaggcaagggttctcagatggggactgtccagcccatcccatgcctgttgtctatgccaactcgtaaccatatggacattactaccccaccactaccgcctgttgcaccggaagtcttgagagttgctgagcaccggcacaagaaagggctgatgtatccctatatctttcatgtccttaccaagggggagattaagatcgcagtctcaatcgaggacgaggccaacaaggacctgcccccagccgcactcctgtacagacccgttcgacagtatgtgtatggtgtgttgttcagccttgctgagtctagaaagaaaacagagcggctggccttcaggaagaaccgtctccctcccgaattctctcctgtgatcattaaagaatgggccgcatacaaaggaaagtcaccgcagacacccgagctcgtggaggccctggcatttagggagtggacttgtccaaatttgaaacggttatggctgggcaaggcagttgaagacaaaaataggaggatgagggcctttctggcttgtatgcggtccgatacccccgccatgctcaacccggctaacgtccctacacatctcatggtcctctgctgtgttctgaggtatatggtacagtggcctggggcccggatcctccgcaggcaagagcttgacgcatttctcgcccaggcgttatctcccaagctgtatgaacccgaccagctacaggagttaaaaatagaaaatcttgatccacgagggatacaactgtctgccttgtttatgagtggggtggacatggcgctgttcgctaatgatgcatgtggccaaccaatcccttgggagcattgctgtccttggatgtacttcgacggcaaactattccagagcaaacttctgaaagcaagtagggaaaagacaccgcttatcgacctgtgcgatggtcaggcagatcaggcagcaaaggttgagaaaatgcggcagagcgtgctggaaggactgagtttttcgaggcagtctcacacactgccctttcctcctcctccagccctgccgttctatccggcaagcgcctacccaagacactttggtcctgttccaccgtcccaggggcgcggcagaggctttgccggggtctgtgggtttgggggcccgtacggcgagaccgtcgctaccggtccatatcgcgcattcagggtggccgcggcttcaggccactgcggggcgttcagcggtagcgactcatcgcggacttctaagagtcaagggggcgtacagccgatacccagccagggcggtaaacttgaaattgccggcactgttgtagggcattgggcagggtcacgacgaggcagaggcggaagaggaccttttcccctgcaggtcgtgtcagtcggtggcccggctcgcgggcggccgagaggggtgatcagtacccccgtgattaggacgttcggtagaggcgggaggtattatggacggggatacaagaaccaggccgctatccaaggcaggcctccctatgcggcctccgcggaagaagtagccaaggagctgaaaagtaagagcggcgagagcaaatcgagcgctatgagttctgatgggtcactggccgagaacggagtcatggcggaagaaaagcccgccccccagatgaatggaagcacgggggacgcacgtgcaccaagtcacagtgagtccgccctgaacaacgattcaaagacttgcaacaccaaccctcacctcaatgcccttagtacagattctgcatgcaggcgagaagctgcactggaggctgccgtgctgaacaaagaagaatag

SEQ ID NO: 15151 - DNA, 3219 bp, Artificial Sequence
  Description of Artificial Sequence: Synthetic coding sequence
atgggtgtgcaggggttccaagattatatcgagaaacactgcccctctgccgtggtgcctgtcgagttgcagaaactggcaagaggaagcctggtaggaggaggcagacagaggccccctcagacacccctgcgcctgctcgtcgacgcggataattgcctgcaccgattgtacggaggtttttacacagattgggtaagcggaggacagtggaatcatatgttgggctacctcgccgccctcgccaaggcttgctttggggggaatatcgaactgttcgtgtttttcaacggagctctggagaaagcccgcctccatgagtgggtgaagcgccagggaaatgagaggcaaaccgcacagcagatcgtcagccatgtccagaataaaggcacacctcccccaaaagtgtggttcctgccccccgtgtgcatggcccactgtatacggctagcactgatacgctttcacgttaaagtggcccagagcattgaggaccatcatcaggaagttattggcttctgccgggagaatggcttccacggcttggtggcttacgattctgactatgcactctgtaatattccttattacttcagtgcccacgctttgaagttgtctaggaacggcaagagcctgaccacgagccagtacctgatgcacgaggtggctaagcagttagaccttaatcccaataggtttcctatttttgccgcacttctagggaatcatatcctgccagatgaagatttggctagtttccattggagtctgctcgggcctgaacacccacttgcatcccttaaggtgagggcacaccagttagtcttgcctccatgcgatgtcgtaatcaaagcagttgcggattatgtgcggaatattcaggacacttctgacctagacgctatagcgaaggacgtctttcagcatagccagagccgaaccgatgataaagttatccgatttaagcgggctatcgggtattacagcgcaacctccaaacccatgtcattccaccctccgcattatctcgccgctagaccaggtccctttggaatgcccggtatggtgccacctcatgtgcctcctcaaatgctcaacataccacagaccagcctgcaggcgaaaccagttgccccccaggttccgagtcctggaggagccccgggccagggtccgtacccgtacagcctgagcgagcctgctcctttgaccctggacacatccggaaaaaacctaaccgagcagaattcctactccaacattccccacgaaggtaagcacactcccctctatgaaagatcaagtccaatcaacccagcacagtctggctcaccgaatcatgtggactccgcatacttccccggatccagcacatcgagtagttcagataacgatgaaggatcagggggagccactaaccacatctccggtaacaagatcggctgggagaagaccggatcacactctgagccacaggcgcgcggcgaccctggcgaccagaccaaggcggagggaagcagcacggcgagctccggctcacagctcgcagagggtaagggttcccagatgggcactgtccagcccattccatgtctgctgagcatgccgactagaaatcacatggatataacaacgccacctcttccaccagtggccccggaggtgctgcgggtcgccgagcataggcataagaagggcctgatgtacccctatatcttccacgttctgaccaagggggagattaagattgccgtctccatagaagatgaggcgaataaggacttgccacctgccgccctgctctataggccggtcagacagtacgtgtatggagtgttgttttctctcgccgaatcccggaagaaaacagaacgcctggcatttaggaaaaaccggttaccaccagaattttcacctgtaattattaaggagtgggccgcgtacaaggggaaatcccctcagacacctgagttagtagaggccttagctttccgagaatggacttgtccaaatcttaaacgcctgtggctcgggaaggctgtcgaggacaagaataggcgtatgcgggcttttctggcgtgtatgagatctgatacccccgcaatgcttaaccctgctaacgtgcctacccacctaatggtgttatgctgtgtgctcagatacatggtccagtggcccggtgctaggatacttcgacgacaggagctggatgcctttttagctcaggcactctcacccaaactgtacgagccagatcagctacaggaacttaaaatcgagaacctcgatcctcggggaattcagctctccgcattgttcatgagtggcgtcgacatggcactgtttgcaaacgatgcatgtggacagcctatcccatgggaacattgttgcccctggatgtacttcgacggcaaactcttccaatccaagctactgaaagcatcaagagaaaagactcctcttatcgacctttgcgacgggcaagccgaccaggccgccaaggtagaaaagatgcgccagagtgtcctggaggggctgtcctttagcagacagagccacacactcccattccctcccccacccgcgctacccttttatccagcttcagcgtatccccgccattttggacctgtcccacctagccagggccggggaaggggcttcgcgggcgtacagcctattccctcgcaaggcggcaagctcgaaattgccggcactgtggtgggccattgggctggatcccggagggggagaggcggacgcggccccttccctctgcaagtggtgtcagttgggggcccagcacggggacggccacgaggagtgatctcaacccccgtgatccggacattcggaagaggcggccgctactacggaagaggctacaagaatcaagccgccattcagggacggccaccctacgccgcatccgccgaggaagtggccaaggagttgaaatctaaaagcggggagtcaaagagctccgccatgtctagcgatggtagtcttgctgagaacggagtgatggccgaggagaaacccgcaccccaaatgaatggttccactggggacgccagggcacctagccatagcgagagcgctcttaacaacgacagtaagacttgcaatactaaccctcacttgaatgccctgtccacagactctgcatgtcggagagaggccgctctagaggccgcggtgcttaacaaggaggagtag

SEQ ID NO: 15152 - DNA, 1887 bp, Artificial Sequence
  Description of Artificial Sequence: Synthetic coding sequence
atgggtgtgcagggattccaggattacattgagaagcactgcccatctgcagtggtgccagtcgaacttcagaaattggcaaggggatcactggttggagggggccgtcagagacccccgcagacaccactgcgccttttggtagatgcagacaactgccttcaccgcttatatgggggattttacaccgattgggtctccggcgggcagtggaaccacatgctggggtaccttgccgctctggcgaaggcctgctttgggggtaacatcgagctgtttgtgttctttaacggagctctcgagaaagccaggcttcacgaatgggtgaagcgccagggcaacgagcggcagactgctcaacagattgtttcccatgtacaaaacaagggtactccaccccccaaggtctggttcctgcccccagtctgtatggcccattgtatccggctcgccttgatccgctttcacgtgaaagtggcacagtccatcgaggaccaccaccaggaagtcatcggattttgtcgggagaatggattccacggtctggtggcgtatgactctgactatgcgctttgtaatattccatactacttctccgcccacgccctgaagctgtctcgtaacggaaaatctctaaccacttctcaatacctgatgcacgaggtggctaaacaactggatctgaaccccaaccggttccccatatttgcagcactgctggggaatcacattctgcctgacgaagatttagcttcctttcattggtcactgttgggtcctgagcatcccctcgcctcactgaaagtgcgagctcatcagctggtcctgcccccctgtgacgtggttattaaggccgtggctgactacgtgcggaatatccaagataccagcgatctggacgctattgccaaggatgtttttcagcactcccagtctcgaacggacgataaggtaatccggttcaaacgggctatcggctattatagtgccaccagtaaacccatgagtttccacccacctcattatctggccgcgagacccggaccttttggaatgcctggaatggtgcccccccatgttccccctcaaatgctcaacatccctcaaacgtctctccaggcaaagcctgtggccccacaggtgccatccccaggaggcgctccgggccagggaccatacccctatagcctctccgaaccagctcctcttaccctagacacctcgggcaagaaccttaccgagcagaactcctattccaatatcccccacgaggggaagcatacaccactttacgaacgctctagtccaatcaaccctgctcagtcaggatcaccaaatcacgtcgactctgcatacttccctggctcatccacctcctcatcttccgataatgacgagggatccggtggagccacgaaccatatcagcggcaacaagataggatgggagaagacgggatcccatagcgaaccccaggcccgcggcgaccctggtgaccaaacaaaggcggaggggagctcaactgccagctccggaagccagctggccgaagggaaggggagtcagatggggacagtgcaaccaatcccctgcctgctttctatgcctacacggaaccacatggatatcacaaccccgcccttgcctccagtggcccccgaggtgctacgcgtggctgagcaccggcataagaaggggcttatgtatccctacattttccatgtgttgaccaaggtgttatcgaagggcccatggagcggtttctgttacctgatgtccggccattcctacggctgctttgtacttctcagctttttcgagcccttcttctgtctcactaacctgcttgaaactaagtttacattcccattcctcaatattgaatag

SEQ ID NO: 15153 - DNA, 1485 bp, Artificial Sequence
  Description of Artificial Sequence: Synthetic coding sequence
ggggagataaaaattgctgtgagcattgaagatgaggcaaacaaggatctgcccccagccgcactactgtacagacctgttcgccagtacgtctacggggtgctgtttagcctggccgaaagccggaaaaagacggagcgcctggcatttcgcaagaaccgtttacctcccgagttctcgccggtcataattaaggaatgggctgcctacaaagggaagagtccgcagactcctgaattagtcgaggcccttgctttcagggagtggacctgcccaaatctcaaaaggctctggctcggaaaggccgtcgaagataaaaacagacggatgcgagccttcctggcttgtatgagaagcgatactcccgccatgcttaaccccgcaaatgtgcctacacatctgatggtcctttgttgtgtgctgagatacatggtccagtggcctggagcccgaatcctccggaggcaggagcttgacgcttttctggcccaggctttaagtccgaagctgtacgaaccggaccaattacaagaacttaaaattgaaaacctggatccacgcggcatacaactcagcgccctgttcatgagcggggtggacatggcactctttgccaatgacgcatgtggacagcccatcccttgggagcattgctgtccgtggatgtactttgacggtaaattgttccagtccaaactcctcaaggcttcacgagaaaagacaccgctgatagatctttgcgatgggcaagccgatcaggccgctaaagtcgagaagatgcgacagtccgtgctcgagggactgtcattctcacggcagtcgcatactctgccctttccacccccgcctgcactcccattttatccagctagcgcttacccccgccacttcgggccagtgccaccctcccaggggcggggcagaggcttcgctggcgtccaaccaatcccctctcaaggtgggaaactggagatcgccgggactgtggtcggacactgggcaggatcccgacgaggccgaggtggcaggggacccttccccctccaggttgtgtccgtgggaggtcctgcccggggtagacctcggggggttatcagtaccccggttattagaacgttcggacgagggggcaggtactacggacggggctacaaaaaccaggctgctatccagggccgacctccctatgcagcctctgccgaggaggtagctaaggaactgaaaagcaagagcggggagtctaaatcaagcgcaatgtcatcagatggcagtttagcagagaacggcgtgatggctgaggagaaacccgccccccaaatgaacggctccacgggtgacgcacgcgcaccatctcatagcgagtccgcccttaataacgattctaaaacttgcaacactaatccgcatctcaatgctctcagcaccgacagcgcgtgccgcagggaagctgcactcgaggccgctgtactgaacaaggaggagtag

SEQ ID NO: 15154 - DNA, 1485 bp, Artificial Sequence
  Description of Artificial Sequence: Synthetic coding sequence
tgagtcgcccagtctatagaggaccaccatcaagaggttataggattttgcagggaaaatggtttccatggcctcgtggcctacgattctgactacgcattgtgcaacattccctattatttcagtgcccatgccctaaagctatcaagaaatggcaagtcattgaccacctcccagtacctcatgcacgaagtagcaaaacagctcgatctcaacccaaaccggttccctatctttgccgctctactgggaaaccatatcttgcccgatgaagacctggctagtttccattggtcacttcttggtccggagcacccactcgcttcactgaaggtccgcgcccaccagctagtgctgccaccctgcgatgtagtgatcaaagcggtggctgattacgtaaggaacatacaggatacttccgatttggatgctattgccaaggatgtgttccagcacagccagtcacgcacggacgataaagtgatccgctttaaaagggccatcggctactattccgccacatcaaagccaatgtcttttcatcccccccattacctcgcggctcgcccgggtccttttggcatgcccgggatggtgccgccccacgtccccccacagatgttaaatattcctcagaccagtctgcaggcaaagcctgtggccccccaagtgccatctcccggcggggctcctggccagggcccatatccgtatagtctgtctgagcctgcccccttgaccctggacacttccgggaagaacctcaccgaacagaactcatattcgaatattccacatgaaggaaagcatacccctttgtacgaacggtccagccctattaaccctgcgcaatcgggttctccaaatcatgtggactcagcttatttcccagggagcagcacctcgtctagtagtgacaacgacgaaggtagtggcggagccacaaatcacattagtggtaataaaatcggctgggagaagaccgggtcacatagcgagcctcaggcccggggcgaccctggcgatcagacaaaggccgaaggctcgagtaccgcttcttccggctcgcagctggcagaagggaagggatcacaaatgggaactgtccagccaatcccttgcctgctgagcatgcccactaggaatcatatggacatcacaacaccacctctgccccccgtggccccagaggttctgcgcgttgcggagcacaggcataagaaaggactgatgtatccttacattttccacgtccttaccaaaggcgagatcaagattgcagtgtcgatagaagatgaagccaataaggatttacctcctgccgccctcctgtatcggcccgtccgtcagtacgtgtacggagtactttttagcttggctgaatctagaaagaagacggagcggctcgcattcaggaagaaccgtctcccacctgaatgcatgtactgtaacaacccattatttgtttttctgggcacgtcctag

SEQ ID NO: 15155 - DNA, 969 bp, Artificial Sequence
  Description of Artificial Sequence: Synthetic coding sequence
atggtagcagatctcgaactgcaacaggatctcatagtgcctttggggcatactcccagccaggagcactttctgttcgagattttcagaaggagactgcaggcgctgacgtccggctggtctgtggctgcaagtttgcagagacaaagggagttactgatgtataaacgaatccttctcagactgccctccagcgttctctgcggcagttcttttcaggctgaacagcccatcacggcacgctgtgaacagtttttccaccttgtgaattctgagatgcggaatttttgtagccacggaggcgctctgacgcaggatattaccgcgcacttctttcgtggtctcctgaacgcgtgcctgcggtcacgagatccttctctgatggtggacttcatacttgcgaagtgtcagaccaaatgtcctttaatcctcacttcggcacttgtttggtggccatctttggagccagtgctcttatgccgctggaggcgccactgccagagcccactgccacgggaattacaaaagctgcaggaaggaagacagtttgcatccgacttcctcagtcctgaagccgccagtcctgcccccaaccctgactggctctccgctgctgctctgcattttgccattcagcaagttagagaagagaacattaggaaacagctgaaaaagttagactgcgagagagaggaactccttgtgtttctgtttttctttagcctcatgggactcttatcctcccacttgacctccaactccaccaccgacctgcctaaagccttccacgtgtgcgccgcaatactggaatgtctggagaaaaggaagataagttggctcgccctcttccagctcacagagtccggaaagaaacacgcagccgaagcacagatgagacgggccgcattgtttaggggcattctgcagatggtcaagaacgaaccttcccttcgcttcctcgcaaaatag

SEQ ID NO: 15156 - DNA, 4368 bp, Artificial Sequence
  Description of Artificial Sequence: Synthetic coding sequence
atgtccgactcctgggtgccaaacagcgcaagcggtcaggatcccggtggtcgccggcgtgcctgggccgaactgttggctgggagggttaaaagggaaaagtacaacccagagagagcccagaagctgaaagagtccgccgtgagactgctacgtagtcatcaggatttaaacgccttgcttctcgaagtcgaaggaccactctgtaaaaagcttagcctgtctaaggtgatcgactgtgacagctctgaggcttacgctaatcacagctccagtttcatcggaagcgcgctgcaggaccaggcttccaggttgggcgtacccgtgggcatcctgagtgccgggatggtggcctcctccgtggggcagatttgcacggctcccgccgaaacaagccatcctgtactgctgacagtggaacagcggaaaaaactctcctccctgctggaattcgcacaatatttgctcgcccattccatgttcagtcgcctcagtttttgtcaggagctgtggaagatccagagctctctcctgctggaggctgtgtggcacctgcatgtgcaagggattgtcagcctccaggaattactcgagtcacaccctgacatgcatgcagtcggctcttggcttttccgtaacctctgctgtctgtgcgagcagatggaagcctcctgtcaacatgcagatgttgccagagcaatgctcagtgatttcgtccaaatgtttgttctgcgaggttttcagaagaatagcgacctcagaaggaccgtggaaccggaaaagatgcctcaggtaacagttgacgttttacaaagaatgttgatatttgccctcgatgcactcgccgccggagtgcaagaggaatcctccacccataaaatagtgcgatgttggttcggcgtcttttccggtcacactctcggctcggtaatttccacagaccccctgaagcgattcttttctcacacactgacccagatccttacccactcccccgtgctgaaagcctcggacgctgtccagatgcagagggaatggtctttcgcaaggacgcatcctttacttacaagtttgtacagacgcttatttgtgatgctcagtgcggaagagctggtcggacatctgcaagaagtcctcgagacgcaagaagtgcactggcagcgggtgctaagtttcgtgagtgctctagtggtgtgcttccctgaggcccaacaactgctggaggactgggttgctcgcctgatggcgcaagccttcgaatcctgccagctcgactccatggttacggccttcttagtggtgaggcaagccgcgctcgagggcccttccgccttcctgtcgtatgccgattggttcaaggccagttttggatcaaccaggggctatcacggttgttccaaaaaagccctggtttttctgttcacctttctgtcagaactcgtgccattcgaatctccaaggtacctgcaagtgcacatcctgcatcccccacttgtgccaggaaaataccggagccttttaaccgactacatatctctagcgaagacgcgtctggccgatctgaaggtttccattgaaaacatgggcctgtacgaggatttgtcctctgctggagacatcaccgaaccccacagtcaggccctccaagatgtcgaaaaagcgatcatggtgttcgagcataccggaaacattcccgtgacagtcatggaggcgtctatctttaggcgcccttactacgtgagccacttcctgccagccctcctgacgccccgagtgctgcccaaagtgcccgactcccgcgtcgccttcatcgagagcctgaagcgcgccgataaaattcccccttctttgtattctacatactgtcaggcttgtagcgctgctgaggagaagcctgaagacgccgcactgggggttagagctgagcctaactccgcagaggagcctttgggccagctgacggctgctttaggggagctaagggcaagcatgactgacccatcccagcgggacgtcatttcggcacaggtggcagtgatttcagagaggctcagagccgtcctgggccataatgaggacgactctagcgtggagatctcaaaaatacagctctctatcaatacgcctaggcttgagccacgagagcatatggcagtagatctactgttaacatctttttgccaaaatttgatggcagcctcgtcagttgcgccgcccgagagacagggtccatgggccgcactgtttgtccggaccatgtgcggccgcgtgcttcccgcagtacttacacgcctgtgtcagcttttacgccaccagggccctagtctgtccgctccccacgtcctggggctcgcggctctggccgttcacctaggtgaaagccggtccgctctccccgaagttgatgttgggccacccgcccctggcgccggactgccagtccccgcactcttcgacagtcttctgacctgtagaaccagggattctcttttcttttgccttaagttttgtactgccgccatctcatacagcttgtgcaaattctcgagtcaaagtcgcgatactttgtgttcttgcctttcaccaggcttaataaagaaattccagttcctaatgttccggctcttttcggaagcccgccaaccgctgagcgaagaagacgtggccagcctttcttggaggccactgcatctgccctctgctgattggcaacgggctgcattgtctctgtggacacaccgaaccttcagggaggttctgaaggaagaggatgtgcaccttacttatcaggattggctccatctggaattggagattcagccagaagcagatgctctcagcgatacggagcggcaggacttccatcagtgggctattcatgaacacttcctgccagagtcctccgccagtggaggatgtgatggagatctccaggctgcttgcaccatactagtcaatgcgttgatggatttccatcagagcagccgaagttacgatcattcagagaactcagacctggtttttggtggaaggacaggaaatgaggatattatatctagactccaggagatggtggcggaccttgagctgcagcaagatcttatcgtgcccctgggccacacacctagtcaggagcacttcttgttcgagatttttagacggagactccaggctctgacctcaggctggagcgtcgcagctagtttgcagcgacaacgcgaactactgatgtacaaacggatattgctgcgcctgcctagcagtgttctctgcggctccagcttccaggctgagcaacccatcactgcacgctgtgagcaattctttcatctggtgaactctgaaatgagaaacttctgctcccatggcggggctctgacccaagacatcactgctcacttcttcaggggccttctaaatgcatgcctcaggagtagggacccatccctgatggtcgactttatcctggccaaatgccagactaagtgccctctgattctgacaagtgccctcgtgtggtggccttccctcgaacctgtgctgctgtgtcgctggagacgccattgccagagccccctgcctagggagctccagaaactacaagaagggcggcagttcgcttcagatttcttatcacctgaggccgcttcaccagcacctaatcccgactggttaagcgccgcggccctgcacttcgcaatccaacaggtgcgcgaagagaacataagaaaacagttgaaaaagctggattgtgaacgggaggaattgctcgtctttctcttcttttttagtttgatgggcctcttatcaagccatcttacaagcaattctacgacagacctgcccaaggccttccatgtctgcgccgccatcctggaatgccttgaaaagaggaagatcagttggctggcattgtttcagttgactgagtctgatttaagactgggccgactgctgctgagggtcgcacccgaccagcacacaagactgctccccttcgctttctacagcctattgtcatactttcacgaggacgcagccattcgcgaggaagcctttctgcatgttgccgtggacatgtaccttaagctggtgcaactcttcgtggccggcgacacctccacagttagcccacccgctggaagatcactggagctgaaggggcaaggcaatcctgtagagctgatcacaaaggcccggctgtttttactccagctaatacccagatgccccaagaagtctttttcccacgtggcagagttactggcagatagaggcgactgcgaccctgaagtttccgctgcactgcaatcccgccagcaggctgccccagatgccgatctaagccaagaacctcacttgttctag

SEQ ID NO: 15157 - DNA, 894 bp, Artificial Sequence
  Description of Artificial Sequence: Synthetic coding sequence
atgagcgactcctgggtgcccaatagcgctagtgggcaggacccaggaggaagacgacgcgcctgggccgagctactcgccggtcgtgtgaaaagggaaaaatacaatccagagcgcgcacagaaacttaaggagagtgctgtccgactgctgcgcagccatcaggatcttaacgccttgttgttggaagtggaggggcctctgtgcaaaaagcttagcttatctaaggtaatcgattgcgacagcagcgaggcatatgcaaaccattcctcatcgttcattggtagcgccttgcaggaccaggccagcaggctcggtgttcctgttgggatcctgagcgccgggatggtggcaagcagtgtgggccagatttgtactgcgccggccgagacctcacatccggtgctgctgacagtggagcagagaaaaaagctgtcctctctgctcgagttcgcacagtacttattggcccacagtatgttcagtagactttccttttgccaggagctttggaagatccagtcaagtctcctgctggaggccgtatggcatctgcatgtgcaagggattgtttccctgcaggagctcctcgagtcacatccagacatgcatgctgtaggatcctggctgtttaggaatctgtgctgcctatgtgaacagatggaggctagctgccagcatgcagatgtcgcgcgtgccatgctcagtgactttgtgcagatgtttgtgctgcgcggattccagaaaaacagcgatttaagacgaacagttgaaccagagaaaatgccacaggttactgttgatgtacttcaacgcatgctgatctttgctctggatgcgcttgccgccggtgttcaagaagaatcctctacccacaagatcgtcaggtgctag

SEQ ID NO: 15158 - DNA, 909 bp, Artificial Sequence
  Description of Artificial Sequence: Synthetic coding sequence
atgagtgatagttgggtgccaaactcggcatctgggcaggatccaggcggacgacgccgtgcttgggccgaattgctggcaggcagggtcaagagagaaaaatacaaccccgagcgcgctcaaaaactgaaagaatccgcggtgagactactgcggagccaccaggacttaaacgctctgcttctggaggtggagggccctttatgtaaaaaactgtctctgtcaaaggtcatcgattgcgactcaagcgaggcatacgctaaccacagctccagcttcatcggctctgccctgcaggaccaggcatcccggctgggcgtacccgtcggaatccttagcgccggaatggttgccagttctgtgggccagatctgcacggctccagcagagaccagccatcctgttctgttgactgtggagcagcggaaaaaactgagtagccttttggagttcgcccagtatctgctggctcattcgatgttcagcaggctgtccttctgtcaggaattgtggaagatccaatcatctttgttgctggaggctgtctggcacctccacgtacagggcatcgtgtcgcttcaagagctgcttgaatcgcaccccgatatgcatgccgtcggatcatggctgtttagaaacttgtgttgtctgtgcgaacagatggaggcctcttgccagcacgctgacgtggcacgggccatgctaagcgacttcgtacagatgttcgtcctaaggggctttcaaaagaattcagatctacggcggacagtggagcctgagaaaatgccacaggtcaccgtcgatgtactccagcgcatgctaatcttcgcactggatgctcttgctgctggcgtccaggaagagtcatcgacacataagatcgtccgagcctcagctgcgcgttcatag

SEQ ID NO: 15159 - DNA, 798 bp, Artificial Sequence
  Description of Artificial Sequence: Synthetic coding sequence
atgtctgattcctgggtgcctaacagcgcgtccggtcaggaccccggtgggcggcgacgtgcctgggccgaactgctggccggcagggtgaagcgggagaagtataacccagagagggcccagaagttgaaagagtctgcagtccgactgctcagaagccatcaggacctgaacgccttgctgttagaagttgagggccccctgtgcaaaaagttatcgctgtctaaagtgatcgactgcgactccagcgaggcatacgccaatcacagttcttctttcataggatcagcactccaggaccaggcgtcccggcttggagtgcccgtcggcattctctcagctggaatggtggcctctagcgtcggacagatctgtactgcccccgcagaaacaagtcacccagtgctgctcactgtcgaacagcgcagttcgttgctccttgaagcagtatggcacctgcacgtgcagggaattgtgtcactgcaagaactcctcgagtcacacccagatatgcatgccgtgggatcttggttgtttcgcaacctctgctgcttgtgcgagcaaatggaggccagctgccagcatgcagacgtggctagagctatgctgtccgactttgtccagatgttcgtcttacgtggattccagaaaaatagtgacctccggaggacggtcgagccagagaaaatgcctcaagtcacggtggatgtgttgcagcgcatgctgatattcgccctagatgcgttggctgctggagtgcaagaagagagcagcacccacaaaatcgtccgctgctag

SEQ ID NO: 15160 - DNA, 1869 bp, Artificial Sequence
  Description of Artificial Sequence: Synthetic coding sequence
atgtccaggcagactacatccgtgggaagtagttgcctcgatctatggagggagaaaaacgacagactggtgcgccaggctaaggtcgctcagaactctggtcttactttacgtcgccagcagctggctcaggacgccctcgagggtcttcgcggcctgctgcatagcctgcagggcctgcccgccgcagtccccgttcttccactagagctaacagtgacctgtaatttcatcatcctacgcgcaagcctggctcaggggttcacagaagaccaggcccaagatattcagcgatcccttgaaagagtcctggaaacccaagaacagcaagggccacgactggagcaggggcttagagaactgtgggattccgtactgcgagcgtcctgtctgctaccagaattgttaagtgctctgcataggctggtcggcttgcaggccgccctctggctttccgccgataggctgggcgacctggccctactgcttgagaccttaaacggaagtcagtctggggcaagtaaagacctacttttgctgctaaagacttggtcccctccagcggaggagctggacgcacccctcaccctgcaagacgcccagggactcaaggacgtcctacttactgcgttcgcatacaggcaaggactgcaggagctgattactggaaatccagacaaggcacttagctcccttcacgaagccgccagtggtttgtgtcctagaccagtcctggtgcaggtgtacaccgctttgggtagctgtcacaggaagatgggaaacccacaacgcgctctgctttacctggtagctgctctcaaagaagggagtgcttgggggccgcctctgttggaggctagcaggctgtatcagcagttaggcgacaccaccgccgagctggagagtctggagctgctggtggaggccctgaatgttccttgttcctccaaagccccccagttcctcattgaggttgaacttttactgccgccccccgacttagcaagccccctccattgcggcacacagtcacagaccaagcatatcctagcttctcggtgcctgcagaccggcagagctggtgatgctgctgagcactacctcgacttactggcactcctgttagactcatccgagccaagattctcgccacctcccagtccgcccgggccctgtatgcctgaggtttttttggaggcggccgttgcgctaatccaggcgggccgcgcccaggacgcccttacactgtgcgaagaactactgagtcggacctcctctctacttccaaaaatgtcccggctgtgggaagacgcccgaaaaggaacaaaggaacttccttattgccctttgtgggtctcagctacacatctcctccagggccaggcttgggttcagctcggcgcccagaaggtagcaatttctgaattttcacggtgcctggagctgttattcagggcaacccccgaggaaaaggagcagggggccgcattcaactgtgagcagggctgcaagagcgacgccgcactgcagcagctccgcgccgctgccctaatctctcgagggctcgagtgggttgcttcagggcaggacaccaaggcactgcaggattttctgctgtctgtgcagatgtgcccgggtaacagagacacttacttccatctgctacaaacactcaagcggttggaccggagagacgaagctacagccctttggtggcggctggaagcgcaaaccaaaggcagccacgaggacgctctgtggagtcttcccctatatctggaatcttatttaagctggattcgcccctctgaccgggacgcttttttggaggaatttaggacgtcccttcccaagagctgtgacctgtag

SEQ ID NO: 15161 - DNA, 648 bp, Artificial Sequence
  Description of Artificial Sequence: Synthetic coding sequence
atgtctcgccagacgacatctgtaggctcctcctgtcttgacctgtggcgcgagaaaaacgatcggcttgtgcgccaggccaaagtggcacagaatagtgggttgaccctgagaaggcagcagttagctcaagacgctcttgaaggtctgagggggctgcttcattcgctgcagggcctcccagcagctgttcctgtactgccactggagctcaccgttacttgtaacttcatcatcctcagggccagcctggcgcaaggctttactgaagatcaagcccaggacattcagcggtcactagagcgtgtgctggagactcaagaacaacagggccccaggctggaacagggtttgagggagctctgggacagcgttctgcgagccagttgcctattaccagagctactgtccgctctgcaccgattggtgggtctccaagctgctctatggctttcagctgataggctgggcgatcttgccttgttgctggagacactcaatggaagtcaaagcggagcctcaaaagacctcctgctgcttctgaagacctggtcaccaccggctgaggagctcgacgcacccttgactctgcaggatgcccaggggctgaaggatgtcctcttgacagcctttgcatacaggcagtag

SEQ ID NO: 15162 - DNA, 1347 bp, Artificial Sequence
  Description of Artificial Sequence: Synthetic coding sequence
atgagccgccagacaacctctgtgggctcttcttgcctggatttgtggcgagagaagaatgatcgactagtgcgacaggcgaaggtggctcagaatagcggcctgaccctcagaaggcaacaactggctcaggatgccctggagggactgagagggctcctccactctctgcagggtctgccagcagctgtgcccgtgctcccactagagctgactgtgacctgtaatttcattatcctccgcgccagtctggctcagggattcactgaagaccaagcacaggatatccagcgaagccttgaacgggtcttggagactcaggagcagcagggccccagactcgaacagggactaagagagctgtgggatagcgtattgagggcctcttgcctgcttccagagctgctgagtgcattgcacaggttagtcggactgcaggctgctctgtggctgagcgccgacaggctgggtgacctggctttgctcttggaaacactcaatggaagccagtcgggagccagcaaggatttgctactactcctcaagacttggtccccccctgcagaggagctggacgcccctctcaccctgcaggacgcccaaggtctgaaagacgtattgcttaccgcctttgcgtaccgacaaggtctgcaggagctaataaccggtaatcctgataaggccctgtcttcattgcatgaagcagcctctgggctgtgtccccgccctgtactagtgcaggtttacaccgccttgggaagctgccaccggaagatgggcaatccccagcgcgctctgctttacctggttgcagctctgaaggaggggtctgcatgggggccaccattactcgaggcatcccgtctataccagcagctgggggatactactgcggagctggagtccctggagctcctggtggaggctttaaatgttccttgcagctcaaaagccccacagttcctgatcgaggtcgaattgctcctcccacccccggacctcgcatcaccactgcattgcggaactcagtcacagaccaagcacatacttgcctctcgctgcctgcagacaggcagagccggcgacgcggctgaacactacttggatctcctcgcactgctgctcgactcaagcgagccgcgctttagccctccacctagccctccaggaccatgtatgcccgaggttttccttgaagccgccgtggctttgatccaggcaggtcgtgctcaagatgcgctcacattatgtgaggaactgctgtccaggacatcgtcgctactgccaaagatgtcaagactgtgggaggacgcaaggaagagaacacgcgggagcttccagctctag

SEQ ID NO: 15163 - DNA, 663 bp, Artificial Sequence
  Description of Artificial Sequence: Synthetic coding sequence
atgctgggcatatggacattgttacctctcgtgctcacttccgttgcacgtctgtcctctaagagcgtgaatgcccaagtaacagatattaacagcaaagggcttgagctcaggaaaaccgtcactactgtggagactcaaaacttggagggacttcatcacgacggacaattctgccacaagccatgccccccaggcgagcgaaaggctcgggattgcacagtgaacggagacgagcctgattgcgtgccctgccaggagggcaaggagtacacagataaagctcatttctccagtaaatgtcggaggtgtagactttgtgacgaaggacacggcctcgaggtcgaaatcaactgtactcgcacgcaaaacaccaaatgcaggtgtaaacccaattttttctgtaactctacagtgtgcgaacactgtgacccctgcactaagtgtgagcatgggataatcaaagaatgcacactcacaagcaacaccaagtgcaaggaggagggcagccgctccaatctcggctggctgtgcctgttgctgctgcctatccccctgatcgtgtgggttaaacgcaaggaagtgcagaagacctgcagaaagcaccgaaaagagaatcagggctcccacgagagcccaacgttaaacccaatgcttacctag

SEQ ID NO: 15164 - DNA, 1008 bp, Artificial Sequence
  Description of Artificial Sequence: Synthetic coding sequence
atgctcggaatatggaccctcttacccctcgtgctaacaagtgtggcccgcctgtcaagcaaatcagtcaacgctcaggtcacggatatcaacagcaagggactcgaactgaggaagaccgtcaccacagtcgaaacccagaacttagagggcctccatcacgacggtcaattttgtcacaaaccatgtccccctggggagagaaaggctagggactgcacggtgaacggcgatgaacctgactgtgtgccctgccaagagggtaaagagtatactgataaagcacatttctccagtaaatgccgtcgctgtcggctgtgcgacgagggacacgggctggaggtggagatcaactgcacaaggacccagaacacaaaatgcaggtgcaaaccaaattttttttgcaacagtaccgtttgcgaacattgcgacccctgcacgaagtgcgagcacggtataattaaagagtgcactcttacgagcaacacaaagtgcaaggaggagggatcccggtcaaacctggggtggctttgcctcctcctgctccccatccccctgatcgtttgggttaaaagaaaggaggtgcagaaaacctgcaggaaacataggaaggagaaccaggggagtcacgaaagcccaacactgaaccccgagaccgtggccatcaatctcagcgatgtggacttgtccaagtacatcacaacaatagctggtgtgatgactctgagccaggtaaaaggatttgtaaggaagaacggcgtgaacgaggctaagatcgatgagataaaaaatgataacgtgcaggatacagcagagcagaaagttcaactgttgagaaactggcaccagttgcatggcaaaaaggaagcctacgatactctgattaaagatcttaaaaaggccaacctgtgtactttagcagagaaaattcagacgattattttaaaggacatcacgtcagattctgaaaatagcaattttagaaacgagattcaatcactggtctag

SEQ ID NO: 15165 - DNA, 945 bp, Artificial Sequence
  Description of Artificial Sequence: Synthetic coding sequence
atgctggggatttggactcttctgccgcttgtactgacatcggtggcccgactctcttctaagtcagtaaatgcccaagtcaccgacattaatagtaaaggactggagttacgaaagactgtcacaacagtggagacccagaatttagagggtctgcatcacgacggccagttttgtcataagccctgcccccccggcgagcggaaggccagagattgcaccgtaaacggcgacgaaccggactgtgtcccttgccaggaagggaaggaatataccgataaggcccacttttcttcaaagtgcagacgctgtcgtctgtgtgatgaagggcacgggcttgaagtggagatcaactgcacccggactcagaataccaagtgccggtgtaaaccaaatttcttctgtaactcaaccgtgtgcgaacattgcgatccctgcacaaagtgtgaacacggcattatcaaagagtgcacactgaccagcaacacaaagtgtaaagaagaagttaagagaaaggaagtgcaaaaaacatgccggaagcataggaaggagaaccaagggagccatgagagcccaacactgaaccccgaaactgtggccatcaatctgagcgatgtggatctgtcgaagtatattactacgattgcaggcgtgatgacactctcccaggtaaaagggtttgtgagaaaaaatggggttaacgaggccaaaatagatgagattaaaaatgacaacgttcaggacactgctgagcaaaaagtccagctgctgcggaactggcatcagttacacggcaaaaaggaagcgtatgacaccctgatcaaggatttgaagaaggcgaacctgtgtactttagccgagaaaatccaaacaattatactgaaggatattacttcagatagcgaaaatagtaactttcggaatgaaatccagtccctcgtatag

SEQ ID NO: 15166 - DNA, 735 bp, Artificial Sequence
  Description of Artificial Sequence: Synthetic coding sequence
atgctcggtatttggacactgctaccgttggtgctaactagcgttgctcggctcagcagcaaaagcgtgaatgctcaggtcaccgacatcaatagtaagggccttgagctgcggaaaaccgtgactaccgtggaaacacaaaacttagaaggacttcatcatgacgggcagttctgccacaaaccttgtcctccaggggagcggaaagcgagggattgcacagtgaacggcgatgaacccgactgcgttccttgccaagagggtaaagaatacacagataaggctcacttttcgtccaaatgccggagatgtaggctgtgtgacgaaggacacggattggaggtggagattaattgtacccgcactcagaatactaaatgcaggtgtaagcctaacttcttttgcaacagtactgtctgtgagcattgtgacccatgtactaaatgtgagcatggtatcataaaggagtgcacactaaccagcaacactaaatgcaaagaggaggggtccagatccaacctgggatggctgtgcctgctgctgctgcccattcccttgatcgtgtgggttaagaggaaagaagtgcaaaaaacctgtagaaaacaccgcaaggagaatcaaggctctcatgaaagccctactctcaatccagagacagttgcgatcaacttgtcagatgtagacctttccaagtatcatcattactgctggtcacatgacaccaaaagctcttag

SEQ ID NO: 15167 - DNA, 1089 bp, Artificial Sequence
  Description of Artificial Sequence: Synthetic coding sequence
atgctgagggtgtgcgcccaggggtggcacgcccaggggctgccacatggcactaacagtttactgaaaggcggcactgaaacctctctgtccacccctacacggctggtggttctgacgtcagtggctcggctaagctctaagagtgtaaacgcccaggttacagacatcaatagcaaaggactcgaactcagaaaaacggtgacaaccgtggagacacagaatttggagggcctccatcacgacggacagttctgccataaaccatgtccaccaggcgagaggaaggccagggactgcaccgtgaatggagacgagccagattgcgtcccctgccaagagggcaaggagtacactgacaaggcacacttctcttccaagtgtcggaggtgccgcttatgcgatgaagggcatggtctggaggttgaaatcaactgcacaagaactcagaacacaaaatgtcgatgtaagcccaattttttctgcaactcaaccgtctgtgaacactgtgacccatgcactaaatgtgagcatggcatcatcaaagagtgcacattaacctccaacacaaaatgcaaagaagagggctcaagatccaaccttgggtggctgtgcctgctgctgctgcctatacctctcatcgtgtgggtgaagcgaaaagaagtgcaaaagacctgcaggaagcatagaaaggaaaaccagggatcccacgaatcgccaactctcaatcccgtgggtatcgagatcgattttagtgacgtggatctcagtaaatacatcacaactatcgccggtgttatgacactttcccaagtgaaagggttcgtgaggaagaatggggtgaacgaggctaaaatcgacgagattaagaatgacaatgtccaggatacagcggagcagaaggttcagcttttgaggaattggcaccagcttcacgggaagaaagaggcctatgacaccctcatcaaggacttgaagaaggctaatttgtgcactctggcagagaagatccagaccattatattgaaggatataacttccgactcggagaatagcaattttcgcaacgaaatacagtctctcgtgtag

SEQ ID NO: 15168 - DNA, 627 bp, Artificial Sequence
  Description of Artificial Sequence: Synthetic coding sequence
atggatccgtttctcgtgctgctgcactcagtatccagcagtttaagttcttccgaactgactgagctgaagttcctttgcctgggaagagtggggaagaggaagcttgagcgcgtgcagtccggtttggaccttttcagcatgctcttggagcagaacgacctggaacctggtcacacagaactgctgcgcgaactacttgcgagcctgagacgtcacgatctgctcagaagagtcgacgactttgaggcgggtgccgccgctggagccgctccaggagaagaggacctgtgcgccgctttcaacgtgatctgtgacaacgttgggaaggattggcgaagattagcgcggcagctgaaagtgagcgacacaaagattgactctatcgaagatcgctatcctcggaacctgacagaacgagtgagagagtccttgaggatctggaagaacacggaaaaggaaaatgctacggtagcccacctggtcggtgccctaaggagttgccagatgaatctggttgctgatctggtgcaggaggtgcagcaggctagagacctccagaaccggtctggcgccatgagtcccatgtcctggaactcggacgcgtccacctctgaggcttcttag

SEQ ID NO: 15169 - DNA, 384 bp, Artificial Sequence
  Description of Artificial Sequence: Synthetic coding sequence
atgcaacagccctttaactacccctacccacagatttactgggtcgacagttcagccagcagtccttgggcgccgcctggcacagtcctcccttgcccaacttcagttcccagacggccaggccagcgacgcccacctcctcctcctcctcctccaccattgcccccccctccacctccaccacctctgccacctcttcccctcccacccctgaaaaaacgcggaaatcacagcacaggcctgtgcttgttggtcatgttctttatggtactggtggccctggtgggtttggggttgggtatgtttcagctgtttcacctgcaaaaagaactggcggagctgagagaagccaccccagtgcatcctctcaagaaacgaagctag

SEQ ID NO: 15170 - DNA, 846 bp, Artificial Sequence
  Description of Artificial Sequence: Synthetic coding sequence
atgcagcagccatttaactatccttatccccaaatttactgggtcgattcttcagcatcttctccatgggcacctccaggcaccgtcctcccctgtccaacttcggttccgcgcaggccaggccagcgaaggcccccgccacctccacctccccccccactaccacctcctccgccaccacctccacttccacccctccctctccctcctctaaagaagagggggaaccacagcaccggtctatgtttgctggtgatgttcttcatggtcctggtggcgctcgtgggcttaggacttggcatgtttcagcttttccacctccagaaagagctggctgaattaagagagtcgacatctcagatgcacacagcctcctcgctggaaaagcaaatcggccacccatctccacctccagaaaagaaggagctacggaaagtggcacatctgaccggtaaaagcaatagtagatcgatgcctctggagtgggaggatacttacggaattgtgctgctgtcgggcgtcaagtacaaaaagggcggactcgtcatcaacgagacaggtctgtactttgtttactctaaggtgtacttccgcggtcagtcttgcaataatctgcccctttcacataaagtgtacatgaggaatagcaaatatccccaagacctggtgatgatggaaggaaagatgatgtcatactgcactactggccagatgtgggcacggtcctcttacttgggagccgtgttcaacctcaccagcgcggaccacctctacgtgaatgtaagcgagctgagcctggtgaatttcgaggagagccagaccttcttcggcctgtacaagctctag

SEQ ID NO: 15171 - DNA, 13773 bp, Artificial Sequence
  Description of Artificial Sequence: Synthetic coding sequence
atgggcaggcacctcgctctgttacttctgctgctgttactttttcagcacttcggagactcagacggctctcaacggctagaacagacccctcttcagttcacacatctggagtataacgtcaccgtgcaggaaaacagtgccgccaaaacctacgtgggccacccagtcaagatgggagtttacattactcatccagcttgggaagtgcgatataagatcgtgtccggggactccgagaacctcttcaaggctgaggagtacattctgggcgacttttgcttcctcaggatcaggactaaagggggcaacacagcaatcctgaacagggaggtgaaggaccactataccttgattgtgaaggctttagaaaagaacacaaacgtggaagcccgaactaaggtccgagttcaggtgctcgataccaatgatttacggccactgttcagcccgacaagctattctgtgagtctcccagaaaacaccgccataaggacctccatcgcacgagtgtccgctacggatgccgacattggcacaaatggcgagttctattactcgtttaaagaccgcactgacatgttcgcaatccacccaacaagcggcgtgattgttctgaccgggaggctcgactacctcgagaccaaactttacgaaatggaaatccttgctgcagatcgcggtatgaagctctacgggagctctgggatttctagcatggctaaactgaccgtgcatatagagcaagcaaacgagtgcgctcctgtgatcacagctgtcactctgtcaccatcagaactggatcgcgacccagcgtacgccattgtgacagtcgacgattgcgaccaaggtgccaatggagatatagcatccttatcgatcgtggccggcgacctgctgcagcagttccgaacagtgagatcatttcccggttcaaaggaatacaaagtgaaagccataggcggcatcgactgggactcgcacccctttgggtacaacttgacacttcaagctaaggacaagggaactccgcctcagttctcctccgtaaaagtcatccacgtgacatccccccaattcaaagctggaccagtaaaattcgagaaggacgtttatcgcgccgagattagcgagtttgctcctccaaatactcccgtcgtgatggttaaggccatcccagcctattcccatctacggtacgtgtttaagtcgacccccggtaaggcaaagttctctctgaactacaataccggattaatctctatacttgagccagtgaagagacagcaggcagctcactttgagcttgaggtgaccaccagcgaccgaaaggcaagcaccaaagtgctggtgaaagtccttggcgccaatagcaacccccccgagtttacacagacagcatataaagccgcgttcgacgagaatgtgcccatcggtaccaccgtgatgtcactgtctgcggtggaccctgatgaaggtgagaacgggtacgtgacctacagcatcgccaatctgaaccatgttccatttgccattgatcattttacaggcgcagtttctacaagcgaaaacctcgattatgagttgatgcccagagtctataccctgcgtatccgtgcttctgattggggcctgccctatcggcgagaggttgaagtgctagcaaccataacattgaacaatctcaacgataatacaccactcttcgaaaaaattaactgcgaaggcacaatacctcgcgacctgggagttggcgaacaaatcaccacagtgagcgcaattgacgcagatgaactgcagctggtgcaataccagattgaagccgggaacgaacttgatttctttagtcttaatcctaatagtggcgtcttgtccttgaagaggtccctgatggatggcctcggagccaaagtgtcctttcatagtctcaggatcactgctaccgatggcgagaatttcgctacaccgctatatattaacatcaccgttgccgcttcccacaagctggtgaatcttcagtgcgaagaaaccggggtggccaagatgttagcggaaaaactactgcaagctaataaactccataaccagggcgaagtggaagatatctttttcgatagccactccgtgaatgcacacattccacagtttaggagtaccctgcccactggaatccaagtcaaggagaatcagcccgtgggttccagtgtgattttcatgaattcgaccgacttggacacagggttcaacggaaaactcgtgtatgccgtttccgggggcaacgaagacagttgctttatgattgacatggagactggcatgcttaagatcctgagtcctcttgacagggagactactgacaagtacactctaaatatcacagtgtatgacctgggcattccacagaaggccgcctggcgccttctacacgtggtagtggttgatgctaacgacaatcctcccgaatttctgcaagagtcttactttgtcgaagtgtccgaagacaaggaggtgcattccgagattatccaggttgaagctacagacaaagatctgggccccaatggtcatgtcacatattcgatcgtcactgacacagatacattcagcatcgattccgtgaccggcgtagtgaatattgccaggcccttggacagagaacttcaacacgagcatagtctgaagatcgaggcccgcgatcaggcgcgagaggaacctcagttgttttcaactgtggtggttaaagtatcccttgaggacgtgaatgataatcctcctacctttatccctcccaactatagagtaaaggttagagaagaccttcctgagggcacagtaattatgtggttagaggcccacgatcctgacctgggccagagcgggcaggttaggtactctctgctcgatcatggggaggggaattttgatgttgacaagctcagtggcgccgtccgcatcgtccagcaactcgacttcgaaaaaaaacaggtatataatctcactgtcagagccaaagataaaggcaagcccgtctccctgtccagcacatgttatgtggaagtggaggtagtagatgtcaacgagaacttacacccccccgtgttctcgtcctttgtcgagaaaggtactgtcaaagaggatgccccagtggggtccctggtgatgactgtctctgcccacgatgaggatgcgagacgcgatggggaaatccggtattctatccgggatggctccggggttggcgtctttaagattggggaagagaccggagtcatcgaaacatcagatcgccttgaccgagagagtacctctcactattggttgaccgtgttcgcaacggaccagggggtggtgcccctgtcaagtttcattgaaatttatatagaggtcgaagatgttaacgacaatgcaccccagaccagtgaaccggtgtactatcctgagattatggagaactcacctaaagatgtcagcgttgtgcaaatcgaggccttcgaccccgactcatcgagcaacgacaaactgatgtataagatcacttccggtaaccctcaggggttcttttccatccatcccaagacgggcctgatcactacaacctccagaaagcttgacagagaacaacaggatgagcacatcctcgaggtaactgtgacagataacggatcacctcccaaaagtaccatcgcccgcgtgatcgtgaagattcttgatgagaacgacaacaaaccacaattccttcagaagttttacaagatccgtctgcctgaaagggaaaagcccgatcgggaaagaaatgcccggcgcgagccactttaccacgttattgcaacagataaggacgaggggcctaatgcagagatcagctatagcatagaggacggaaatgaacatgggaagtttttcattgaaccaaaaactggtgtcgtgagcagcaaaaggttcagcgctgccggggaatatgatatcctcagtattaaggccgttgataacgggaggccgcaaaagtcttcaaccacaaggctgcatatagagtggatttccaaacccaaaccatctcttgagcctatctcttttgaagagtcatttttcacatttacggttatggagagtgaccctgtggcccacatgatcggcgtgatctccgtagagcccccgggcattcctttatggttcgatatcaccggaggaaactatgactcgcacttcgacgtagacaaaggaaccggtaccataatcgttgccaaaccactggatgcagagcagaagagcaattacaaccttacggtagaggctactgacggaaccaccacgattttgacccaagtttttatcaaagtgatcgatacgaacgaccataggccccagtttagtacctccaagtacgaagtggtgattcctgaggacacagcccccgagacggaaattttacaaatttccgcggtcgatcaagacgagaagaacaaactcatatacacactgcaatcctctagagatcccctgagtctgaagaagttccggctggacccagcaacaggatccttatatacctccgagaagcttgaccacgaggcagtcccagcccatctcacagtgatggtgagagatcaggacgtccctgtcaagaggaactttgctagaattgtagtgaacgtgagcgacacaaatgaccacgcaccctggttcactgcaagttcctacaagggcagggtttacgagtccgccgccgtaggatctgtggttctgcaggttacagcactggacaaggacaaggggaaaaatgccgaggtgttgtattccattgaaagtggaaccttcgggaacatcggcaacagctttatgattgatccggtactcgggtcgatcaaaactgccaaggagttagatagatctaatcaggccgaatacgacctcatggtaaaagccaccgataagggcagcccacccatgagtgaaattacgagcgtaaggatctttgttaccatagcagataacgcatcacccaagttcacctccaaagagtactcggttgagctgtctgagactgtgtccattgggtcctttgtgggcatggtcacagcccactctcagtctagcgtcgtctatgaaattaaggacggaaacacgggtgatgctttcgatatcaatccacatagcggaactatcatcacacagaaggctctggacttcgagacgctgccaatctacactcttatcatacagggcaccaacatggccggtctttctaccaacactaccgtgctcgtacatctgcaagatgaaaatgataacgcccccgtattcatgcaggctgaatatacgggactgatcagcgagagtgccagcattaattcagtggttttgactgatagaaacgtaccacttgtaataagggccgctgacgccgataaggattccaacgccttgctggtctatcacattgttgagccttccgtgcacacttactttgctatcgactctagtactggggccatccacaccgtgctgtcgttggactatgaagagactagcatcttccattttacagttcaggtacatgatatgggtacccccaggctgttcgcggaatatgccgcgaacgtcacagtacacgtaatcgatatcaacgactgtccaccagtgttcgctaaaccactgtatgaagcgagtcttttgctgcctacttacaagggcgtaaaagtcataaccgtgaacgccaccgacgccgatagtagcgcattttctcagctgatctattctattactgaggggaacattggtgaaaaattcagtatggactacaagacaggggctctcactgttcagaacaccacacagttgaggtcccggtacgagctgacagtccgcgctagcgatgggcgcttcgctggcctcacttcggttaagattaatgttaaggagtctaaggagagccacttgaagttcacccaggacgtgtattcagccgtcgtaaaggaaaattctaccgaggcagaaactttggccgtaattacggctattggcaaccccatcaatgaaccactcttctatcacatcttgaacccagaccgaagatttaagatctcaaggaccagcggagttctttctaccactggaacacctttcgatcgcgaacagcaggaggccttcgacgttgtggtggaggtgacggaggagcacaagccttcagctgtagctcacgtggtggtgaaggtaattgtagaggatcaaaacgacaatgctcctgtgtttgtcaatctgccgtactatgctgtggtgaaggtggacacggaggtcggacatgtgatccgatacgtaactgccgtggatagggatagcggcaggaatggagaggtgcattattacttaaaggagcaccatgagcatttccaaatcggtcctctcggcgagatttctctgaagaagcagttcgagctggacacactcaacaaggagtatttggtgactgtggtggcaaaggacggcggcaacccagctttttcagctgaggtaattgtgccgatcacagtcatgaataaagcaatgcccgttttcgagaagcccttctacagtgccgaaatcgcagaaagcatccaggttcacagtccagtggtgcatgtccaggcaaactccccagaagggctgaaagtcttctatagtatcaccgacggggaccccttttctcagtttacgatcaacttcaataccggagttatcaatgtcattgctccgctggatttcgaggcccatcctgcttataagctgagtatcagggcaaccgattcacttactggcgcccatgccgaagtcttcgtagatattattgtggacgacataaatgataaccccccggtttttgcacaacagtcatatgccgtcaccttgagcgaagcatccgtgattggcaccagcgtcgttcaggtgcgcgcaacagactctgatagtgagccaaatagagggatcagctaccagatgttcgggaatcattccaagtcccacgaccattttcatgtggactcaagtacaggtttaatctcccttctgcgcacactagactacgagcagtcccggcagcatacaatcttcgttagggccgtagacggcgggatgccaactttaagttctgatgtcattgtgaccgttgatgtgactgatttgaatgataacccccctctcttcgaacaacaaatctatgaggcaagaatctcagaacatgctcctcacgggcatttcgtgacatgcgttaaggcctacgatgctgattcttccgacatcgataaactgcagtattctatcctgtcgggaaacgaccacaagcactttgtcatcgatagtgccaccggtattatcactttgtctaatttgcatagacatgctctgaagcccttttactccctcaacctgtccgtgagcgatggggtttttagaagtagcacacaggtccacgttactgtcatcggtggtaatctgcacagccccgcctttctgcaaaacgaatacgaagtagaattggccgagaatgcaccactgcacacgttggtgatggaagtgaagacaacagatggagacagcggcatttatggtcatgtgacctatcacatcgtaaatgatttcgcgaaagatagattttacatcaatgaacgcggtcaaatcttcaccctcgagaaattggatagggagactccagcagagaaggtgatctccgtgagactgatggcaaaggacgccggcggaaaggtagctttttgtactgtgaatgtgatcctaaccgatgataacgacaacgccccccagttccgtgctaccaagtacgaagtcaacattggctcttccgctgctaaaggcaccagtgtcgtgaaggtgctggcctccgacgccgacgagggtagtaacgctgatataacatatgcaatcgaagcagactcagagagcgtcaaagaaaacctcgagattaacaagctgtccggggtgatcactactaaagagagcttgattggcctggaaaatgagttttttacattttttgttcgagccgttgacaacggctcaccgagcaaggaaagcgtcgtacttgtatatgtgaagatcttgcctcccgaaatgcagctacctaagttctcagagcccttctacacttttacggtgagtgaggacgtgccgattggcaccgaaattgatctcattagagcagaacacagtggcaccgtcctgtattcccttgttaagggaaatacacccgagtccaaccgagacgaaagttttgttatagaccgtcagtccggacgacttaagctggagaagtcactggatcacgaaaccacaaagtggtaccagttctccattctggctcggtgtacccaggatgatcacgagatggtagcctctgtagacgtgagcattcaggtgaaagatgccaacgataactcacccgtcttcgagagctctccctacgaagcttttatcgtcgagaaccttccgggcggttctcgcgtaattcagatccgcgcctcggatgccgactcaggaactaacggccaggttatgtactctctggaccaaagtcagtccgttgaagtgatcgagtcttttgccatcaatatggagacggggtggatcacgaccctcaaagaacttgatcatgaaaaacgagacaattatcagatcaaagtagtggcatccgaccacggcgagaagatccagctatccagcacagccatcgtggacgtcaccgtcaccgacgtgaacgacagcccaccacgctttaccgcagagatctacaaaggcaccgtatcagaggacgatccccagggcggcgtgattgctatcctctctaccacagacgctgatagcgaagagattaatcgccaggtaacttatttcatcacagggggcgatcctttgggccaattcgctgttgagaccatccagaatgagtggaaggtttacgtgaaaaaaccactggaccgagaaaaacgggacaactatctccttactataacggccacagacggtacattctccagtaaagccatcgtagaggttaaagtgctggatgctaacgacaactctccagtctgcgagaagacgctttactccgatacgatcccagaagacgtgctgcctggcaagctgattatgcaaattagtgccactgatgctgacattaggagcaatgcggagatcacctacaccctgctcgggagtggggctgaaaaatttaaactgaatcctgacactggggaattaaagacttccacccccttggaccgagaagaacaggctgtgtaccacttgcttgtgcgtgccacggatggcggtggtagattttgccaggctagcattgtgttgactctggaggacgtcaatgataatgcaccagaattctcagccgacccgtacgccatcactgtatttgaaaacaccgagccgggaacacttctgactagggtgcaagccaccgatgcagatgccggcttgaacagaaaaatcctctattcactgatcgactcagctgatggtcagttctctatcaatgagttaagcggcatcatccagttggagaagccactggacagagagttacaagccgtgtatactttaagcctgaaggctgttgaccagggattgcctcgtaggctaactgccaccggcactgtcatcgtcagtgtgctagacataaacgacaatccccctgtttttgagtacagagagtatggcgccaccgtgtcagaggatatcctcgtgggcacagaggtccttcaggtctatgccgcttctagggacattgaggcaaacgccgagatcacatactctatcattagtggaaatgagcacggaaaattcagcattgacagtaagaccggggccgtgttcattatagagaatttagactacgaatcttcgcacgagtactatctgacggtggaggcgacagacggaggcactcccagtctctctgatgtcgcaacggttaacgtcaacgtaacagacattaatgacaacacccccgtgttcagtcaggatacgtataccactgtgatcagcgaggatgccgtactggaacagagcgtgattactgtgatggcagacgacgccgatggcccttcgaattcacatatccactactccatcatagacggaaaccaggggtcgtccttcaccatcgacccggtccgcggcgaagtgaaggtgacaaaacttctggatcgcgagaccatatccggctatacgttgaccgtgcaggcatctgataatgggtcacctcctagggtgaacactacgactgtgaacattgatgtaagtgatgtgaatgataacgcacctgtttttagccgcggcaattatagcgttatcatacaggagaataagcctgtgggattcagcgtgctccagcttgtcgtgacggatgaagattccagtcacaatggacccccattcttttttacaattgtcactggtaatgacgaaaaagcctttgaggtgaacccccagggggtcctgctgacgtcttccgctatcaagcgaaaggaaaaggatcactacctgttacaggtgaaggtggcagacaatggaaaaccacagctgtcatccctgacctatatcgacatcagggtgattgaggaatctatctacccacccgccattctaccgctcgaaatcttcatcacgtcttcaggggaggaatactctgggggagtgatcgggaaaatccacgcaacagatcaagatgtctatgacaccctgacatactccctggatccacagatggataacctcttttcggtttcctccactggcgggaaactgatcgcccataagaagttggacatcggccagtacttattgaatgtcagcgtgacagacgggaagttcacaacagtggccgacattaccgttcatatcaggcaggtgacacaggagatgctgaatcacacgatcgccattagattcgccaacttgacaccagaggaattcgtcggcgactattggcgcaacttccagcgggcgctgagaaacatcctgggcgttcgaagaaacgacatccaaattgtgagtctccaatctagcgaaccgcatccccacctcgatgtcctcttattcgtagagaagccgggatcagcgcagattagcactaagcaactactccacaaaatcaacagcagtgtcactgacatcgaagaaatcatcggggttcggattctgaatgtcttccaaaagctctgtgccggcctcgactgtccctggaagttctgtgatgaaaaggtgagcgtagacgaatcagttatgtctactcattccacagccagactcagctttgtgactccacgtcatcaccgggcagcagtgtgcctctgcaaagagggcaggtgtccccccgttcaccacgggtgtgaggatgacccttgccccgagggtagtgagtgtgtgtccgacccttgggaagaaaaacacacatgcgtctgccccagcgggaggtttggccaatgccccggatcttcttccatgacactgactgggaactcgtacgtgaaatataggctgacagagaatgagaacaaacttgagatgaaattgacaatgagactgcggacgtactcgacacacgcagtggtcatgtacgcacgcgggacagattattctatcctggagatccaccacggcaggctgcagtacaagttcgattgtggctctggtccggggatcgtgagcgtgcagagtatacaagttaacgacggacagtggcacgcagtggcactggaagtaaacggtaactatgctcggctggtgctcgaccaggtccacacagcttcagggactgctccaggaactcttaagaccctaaacctggataattatgtttttttcgggggccacatcagacagcagggcacaaggcacggaagatccccccaggttggcaatggcttcagaggctgtatggatagcatctacctgaacggacaggaattgccccttaattccaaacctcgaagctatgcccatattgaggaatctgtggatgtttctccgggatgttttctcacagccacggaggattgtgccagcaacccatgtcaaaatgggggtgtctgcaacccttctcctgcaggcggttattattgcaaatgttccgcactgtatattggaactcattgcgagatcagcgtgaacccctgctccagtaagccatgcctgtatggcggaacttgtgtggtggacaacggcggtttcgtttgtcagtgtcgcggtctgtatactggccagcggtgccagctctctccttactgtaaggacgagccatgcaaaaacggcggtacttgctttgactcactggatggggctgtatgccaatgcgattctggcttccggggcgaaaggtgtcaatcagatatcgacgagtgttctgggaatccttgtctgcacggggccctttgtgagaatacacatgggtcctaccattgcaattgttcccatgagtatagagggcggcattgcgaagacgccgcgcctaaccaatacgtaagcactccttggaatattggcctggcagaggggattggcatcgtggtgttcgtcgctggcatttttcttttggtcgtcgtgttcgtactgtgccgcaaaatgatcagtcgcaaaaaaaagcaccaggccgaacccaaggacaagcatctcggtcccgccaccgccttcctgcaaaggccatacttcgacagcaaattaaataagaacatctacagcgacatcccaccacaggtccctgtgcggcccatctcttacacacctagcataccaagtgattcccggaataacctcgacaggaacagcttcgaagggagcgctattccagaacaccccgagtttagcacatttaacccagagtctgtgcatgggcatcggaaagcggttgccgtgtgctcagtcgcccccaatctacctccgcccccgccaagcaactcgccctctgattctgactccatccagaaaccatcttgggacttcgactatgataccaaggtggttgacctggatccttgtctgtccaaaaaaccactggaagagaagccatcgcagccatattccgcacgggagtccctctctgaggttcaatctcttagttcattccagagcgagagctgtgacgacaatggataccactgggacacatcagactggatgccttccgtccccctgccagacattcaggaattcccgaactatgaggtgatagacgaacagactccactctattccgctgatccaaacgccattgatacagattattatccaggtggctacgatattgagtctgacttcccccccccccccgaagacttccctgcggccgacgagttacctccgctacccccagagttctcaaatcagttcgagtcgattcatccgcctagggacatgccagctgcgggttcactgggaagtagcagccgaaatagacagcgcttcaaccttaatcaatacctcccgaacttctaccccctggacatgagcgaaccgcagacaaagggcaccggagagaattctacttgccgggaaccccatgcaccctatccgcccgggtatcagcgccattttgaggctcctgcagtggaaagtatgcccatgtctgtctacgcttctacggcgagctgctccgatgtatctgcttgctgcgaggtggagtcggaggttatgatgtccgattacgagagtggcgacgacggccacttcgaagaagtgacaataccacctttagacagtcagcagcacacagaggtgtag

SEQ ID NO: 15172 - DNA, 13767 bp, Artificial Sequence
  Description of Artificial Sequence: Synthetic coding sequence
atgggtcggcacttagcactcctgctcctcctgttactcctctttcagcatttcggcgacagcgacggttcccagagactggagcagacccccttacaattcacacacttagaatacaatgtaacagtgcaagaaaattccgctgctaagacttacgtcggccaccccgtcaaaatgggcgtgtacattacccacccggcatgggaggtcaggtacaagattgtgagcggtgattcagagaatttgtttaaggccgaggagtacatcttaggtgacttttgctttctccgaatccggactaaaggcgggaatacggcaattctcaacagagaggtgaaggaccactacacattaattgtgaaggctctggaaaagaatacgaacgttgaggccaggaccaaggtcagagtgcaggtgcttgatacaaacgacttaagacccctgttcagcccaacatcctattctgtaagccttcccgaaaacaccgcaatcaggaccagtattgcaagggtgtcagccacagatgccgatattggtacaaacggtgagttctactactctttcaaagaccgaacggatatgttcgctattcaccctacttccggggtgatcgtcctgactggaagactggactatctggaaaccaaattatacgagatggaaatccttgccgctgataggggaatgaaactgtacggcagcagtggcatatcgtcaatggctaaactgacagtgcatattgagcaggccaacgagtgtgcccccgtgatcaccgccgtgactctgagtccaagcgagctggaccgggatccggcatacgccatcgttactgtggatgattgcgatcagggcgcgaacggagacattgcgagccttagcatagtcgctggggacctgttgcagcagttcagaaccgtgcgaagctttccaggctccaaggagtacaaggtgaaggcgatcggaggcatcgactgggatagtcacccctttggctataacctcactctgcaggctaaagacaagggtacccctccccagttttcaagcgtgaaggttatacatgtgacttctccgcaattcaaagcaggtccagtgaagtttgaaaaagatgtctacagagccgaaatcagcgaatttgccccaccaaatactccagtggtgatggtcaaggccatacctgcttatagccatctccggtacgtgtttaaatctactcctggaaaggccaaattctctctgaactataacaccggcttgatctcaattctggagcccgtaaagaggcagcaggcagcacacttcgagctcgaagtcacaacatctgatcgcaaagccagcactaaggtgttggtgaaggtgctgggggccaattctaacccccccgagttcacacagaccgcttacaaggctgcattcgacgagaacgttcctattgggacaacggttatgtccctgagcgcggtggatccggacgagggcgaaaacggatatgttacctattcaattgccaacttaaaccatgtcccttttgccattgaccactttacaggggctgtttccacctctgaaaacttagactacgagctgatgccccgggtttatacactcagaattagagcctcagattggggcctgccttaccggagggaagtggaggtgctggcgaccataacactgaataatcttaatgataataccccgctattcgaaaagattaactgtgagggaacaatcccccgtgacctgggcgtcggagagcaaattactacagtgtctgcaattgacgccgacgagctgcaactggtgcagtaccagatcgaggccgggaacgagctcgacttttttagtctgaatccaaacagcggcgtactgtctcttaagcgatccctcatggatgggttaggggcgaaggtgagctttcattccttacgcataacagcgaccgatggtgaaaattttgccacaccactttatattaacattacagtggccgcctcacataagttggtcaacctgcaatgcgaggagaccggtgtggcaaagatgttggcagagaagctactgcaggccaacaaactccataaccagggcgaagtggaagatatcttctttgacagtcacagtgtgaatgctcatattcctcagttccgatccacactgcccaccggcatacaggtaaaagagaatcagccggtggggagcagcgtaattttcatgaattccaccgatctcgatacaggcttcaatggaaaactggtgtatgcggtaagcggcggaaacgaagatagctgctttatgatcgacatggaaaccggcatgctaaagattctgtccccattggatagggaaaccactgacaagtatacactgaatattaccgtgtatgatttgggtataccacagaaagcagcctggcggttgctccacgtggtcgtcgtggacgccaacgacaatccccccgagtttctgcaggaatcctacttcgtggaagtcagtgaggacaaagaggtgcacagcgagattattcaggttgaggccacagacaaggatctcggcccaaatgggcatgttacctacagtatcgttaccgacaccgatacctttagcatcgacagcgtgactggtgttgtgaacattgcgagaccactcgatcgggaattacagcacgagcactccttaaaaatcgaagctagagatcaggcaagggaggaaccccaactgttctctacagtcgttgttaaagtgtccctcgaggatgtcaacgacaacccaccaaccttcataccccccaactatcgcgtgaaggtgcgcgaggacctgcctgagggcaccgtcatcatgtggcttgaggcccacgatcccgatttgggacagtccgggcaggtgcgctactccctattggaccacggcgagggaaacttcgacgttgacaagctttctggagcagtgaggatagtgcagcaacttgatttcgagaagaaacaggtttacaacctcactgtgcgcgccaaagacaaggggaagcccgttagcctctcatccacatgctacgtcgaagttgaggtggtggatgtgaacgaaaatctgcatccgccagttttttctagctttgtggaaaaaggaacagttaaagaagacgctccagtgggtagtctggtgatgaccgtcagtgcgcacgatgaagatgcacgtcgagacggggagattcggtatagcatcagagatggttccggagtaggcgtctttaagattggcgaggagactggcgtgatagaaacttcggatcgcctggaccgggaatccacctcccactactggctcacagtgttcgcgacagaccaaggggtggtgcctctctcatcctttattgagatttacattgaagtcgaggatgtaaacgataacgccccccagacttctgaacctgtgtattatcctgaaattatggagaatagcccaaaagatgtgagcgtggtacagattgaggcctttgatcctgactcctcatccaacgataaactgatgtacaaaataacatccgggaatcctcaaggctttttctcaattcaccccaaaaccggacttataacaaccacaagcagaaagttggatagggagcagcaggacgagcatattttggaggtcaccgtgacagacaatggttctccccccaagagcactatagccagggtgatcgtaaaaatcttggatgagaacgacaataagcctcagttcttgcagaaattttacaagatcagactgcctgagcgggagaagcccgatcgtgagcggaatgctagacgggagcctctgtatcacgtgatcgccacagataaagatgagggaccaaacgccgaaatctcctactcaatcgaggatgggaatgaacatgggaagtttttcatagagcctaaaacgggcgtggtttcttccaagagattttctgcagctggtgagtatgacattctcagcatcaaggccgtcgacaatggacgcccacagaaatcctcaacaacccgtctgcacatcgagtggataagtaaacccaagccatctcttgagccaatctcgttcgaggaaagcttttttacatttactgtcatggaatccgatcccgtcgcccatatgattggcgtcatctctgtggagcctccagggatcccactctggttcgatattaccggtggtaattacgactcccatttcgatgtggacaaaggcactgggaccatcatagtggccaaacctcttgacgccgagcagaagtccaactataacctgaccgtcgaggctacggatggaaccacaacgatcttgacacaggtgtttatcaaagtgattgacaccaacgaccaccgaccccagtttagcacgtcaaaatatgaggtcgttatccccgaggacacagcccccgaaacagagattctgcagatatctgccgtggaccaggatgaaaagaataagcttatctacacacttcagtcttctcgcgaccccctgtctctgaagaaatttcggttggatcctgcgaccggatccctatatacctcagaaaagctagatcacgaagccgtacatcagcacacactgacagttatggtcagagaccaggacgtgcccgttaagcgtaacttcgctcgcattgtcgtgaacgtctcggacacaaatgaccacgccccttggtttactgcatcttcctacaagggaagggtttacgagtccgctgccgttggatcagtggtgctgcaggttactgccttagacaaggacaaaggaaagaacgctgaggttctgtacagtatcgagtctggtaatattggaaatagctttatgattgaccccgtgctcgggtcaatcaagaccgctaaggaactggaccggtctaaccaggccgagtacgatttaatggttaaagctaccgacaaagggagtccacctatgtcagagatcactagcgtccgtatctttgtcactattgctgataacgcgtctcctaaatttacttccaaagagtattccgttgaactcagcgaaaccgtgagtattggatcttttgtgggaatggtgacagctcactcgcagagctctgtggtgtatgaaatcaaggacggaaatacaggcgacgcgtttgacattaatccgcactcaggaaccattataacacagaaagccctcgactttgaaaccctgccaatctataccctgattatacagggaaccaacatggccggcctttccacgaacaccaccgtgctggtccatctgcaggatgagaatgacaatgccccagtcttcatgcaagctgagtacaccgggctaattagcgaatcagcttcaatcaattcagtggtgctgacagatcggaatgttcctttggtgataagggccgctgatgctgataaagacagcaatgccctcttagtttaccatatcgtcgaaccttccgtgcatacatatttcgcaattgactcaagtaccggcgcaatccatactgtgctgtccttagactatgaggagacttccatcttccacttcacggtgcaggtccacgatatggggacaccgagactgttcgctgaatacgcggccaatgttaccgtacacgtaatcgatatcaacgactgtcctcccgtgtttgctaagcctctgtacgaagcaagccttctcctgccgacatacaagggtgtaaaggttattactgttaacgcaactgacgccgactcttcagccttctcgcagttaatctactccattactgagggtaatatcggcgaaaagttttcaatggattacaaaacaggcgctttaactgttcaaaatacaactcaactccggtcccgctacgaactgaccgtccgcgcatcagatggtcgcttcgcagggctcaccagtgtgaagataaacgtcaaagaaagcaaggaatctcaccttaagttcacccaggacgtttactccgcagtagtcaaagaaaactctaccgaggccgaaaccctggcagtgattaccgccataggcaacccaatcaatgaaccactgttctaccatattttgaatccggaccgtcgattcaaaatttcaaggacttcaggcgttcttagtactacagggaccccatttgacagggagcagcaagaggcgtttgacgtcgtagttgaagtcaccgaagaacacaagccttcggcagtggcccacgtggtagtgaaagtcatcgtggaagatcagaacgacaacgctccagttttcgtgaatctgccttattacgccgtggtcaaagtcgacactgaggttggccacgtgattaggtatgtgactgccgtggatcgcgactccggcaggaacggagaggttcattactatcttaaagagcaccatgaacattttcagattggaccactcggtgaaatctcacttaagaaacagttcgagttggacacactaaataaggagtacctcgtaaccgtagtcgctaaggacggtggaaatcccgcattctcagcagaggtaatcgttcccataactgtgatgaacaaggctatgccagttttcgagaagcctttctacagcgccgaaattgccgagagtatccaggtgcactctccggtggttcacgtacaggcgaacagtcctgaggggctgaaagtattctattctatcacagatggggacccgttctcacaattcactatcaatttcaatacaggagtgatcaacgtgatagctcccctggacttcgaggctcacccagcttataaactttccatccgggccacagatagtctgaccggggcccacgccgaggtgttcgtggatattatcgtggatgatattaatgataacccaccagtttttgcacagcagtcctacgctgtcactctgtcagaggcgagcgtgattgggactagcgttgtacaggttcgggccactgattctgacagcgaacctaacaggggtatctcctatcaaatgttcggcaatcatagcaagtcgcatgaccacttccatgtggattcatctactggcttgatctccctgctgaggaccttagactacgagcagtccaggcagcatactatttttgtccgggcggtggacggggggatgcccactctgagcagtgacgttattgttacagtggacgtgaccgatctaaacgataacccgccactcttcgaacagcagatctatgaggcccgtataagtgaacatgccccccacgggcattttgtcacttgtgtgaaagcctacgacgcggactcaagcgatatcgacaagttgcagtactcaattctgtccggcaacgaccataaacattttgtgattgactcggccacgggtattataactctgtccaatcttcacagacatgcgttgaaacctttttactcactaaacttgtccgtgtcagacggcgtttttaggagttctacccaggtgcacgtgacagtgatcggggggaatctgcactcccccgccttccttcagaatgagtatgaagtggaactggcggagaacgctccactgcacactctggtgatggaagtaaaaactactgacggtgactccggtatttatggtcatgttacctaccacatcgtcaatgattttgctaaagataggttctatattaacgaacgaggtcaaatcttcacactggagaaactggatagagaaacaccagccgaaaaggtgatctcggtgcgcctgatggcaaaggatgccggtgggaaggtcgccttctgtaccgtgaacgtgattttgacggatgacaacgacaatgcgccccagttcagggccacaaaatacgaagtgaatataggctcctcagccgcaaaggggacttcagtggtgaaggtcctggcatccgacgcagatgaggggagcaacgccgacatcacctatgcaattgaagctgattcagagtcggtgaaggagaacctggagataaacaaattgagcggagtcattactaccaaagaatccctaatcggtctagagaatgagttcttcactttcttcgtcagggcagtagacaacggatcaccttctaaggaatctgtggtcctcgtttacgtgaaaatactcccccctgaaatgcagctccccaagttctcagagccattttacacattcacagtgagcgaggacgtgccgatcggaaccgaaattgatctcatccgcgcagaacattctggtacagttttatacagcctggtgaagggcaacactccagaaagtaatcgcgacgagagctttgtaatagacagacaaagtgggaggctgaagttggaaaaaagcttagatcatgaaactacaaagtggtatcaattttcaatcctcgctcgttgtactcaggatgatcatgaaatggtggcctctgtcgacgtgtcaatccaggtgaaggacgccaatgacaattctccggtattcgaaagcagcccctacgaggccttcatcgtggagaatctgcccggtgggtctcgagtgattcaaatcagagccagcgatgcagatagtggaacaaatggccaagttatgtattctcttgaccagagccagagtgtggaagtgatcgagagtttcgcaattaatatggagaccgggtggatcacaacactgaaggaactggaccatgagaagagagataattaccaaattaaagtggtcgccagcgatcatggtgagaaaatccagctgagcagcactgccatcgtcgacgtaactgttactgacgtaaacgatagcccacctcgctttaccgccgagatctacaagggtaccgtttccgaggacgatccacaaggcggagtgatagcaatcctgagtacaaccgatgccgattctgaggagatcaatagacaggtgacctattttattacaggaggggacccactgggtcagttcgctgtggagacgattcagaacgaatggaaagtgtacgtcaagaaaccccttgacagagagaaacgtgacaattatttgttaaccatcaccgccaccgacggcactttttccagtaaagccatcgttgaggtgaaggtccttgatgccaacgataactcacccgtgtgtgagaagactctgtactctgacactatccccgaagacgttctacctggaaagctgatcatgcaaatttcagctacagatgctgatattaggtccaatgccgaaatcacatatacgttgctgggtagtggcgctgagaaattcaagctaaaccctgatactggggagctcaagacatccacacccctggatcgggaagaacaggcagtataccacttgctcgtccgagctaccgacggcgggggaagattctgccaggctagcatcgtattgaccctggaggacgtgaacgacaacgcaccagaattcagcgcggatccatacgctattacagtcttcgaaaatactgagcccggcaccctgctgacgcgggtgcaggctaccgacgcagatgcaggccttaatagaaaaatcctatacagcctcattgacagtgccgatggccagttctcaatcaatgaactgtctggcataattcagctggagaagccccttgaccgggagttgcaagccgtgtacaccctcagtctcaaagccgttgaccagggactcccgcggcgcttgaccgccactggtacggtgatcgtcagtgtcctggatatcaatgacaaccctcctgtgtttgagtaccgagaatacggcgccacggtttctgaggacatcctcgtgggaaccgaggtactccaggtgtatgcagctagtagagatattgaggccaacgccgaaatcacttacagtatcatatccggcaacgagcacggcaagttctccatcgactcgaagacaggagccgtgttcatcatcgaaaacttggattatgaaagcagccacgagtactacctgaccgtagaggccacagatggtgggaccccaagtctgtctgacgtggctaccgtgaacgttaacgtgaccgatattaacgacaatacgcccgtattttcacaggacacatataccacagtaatttcggaggacgctgttctggaacagtcagtcatcaccgttatggccgacgacgcggacggaccctctaatagccacattcattatagtataatagacggtaatcaaggaagctcatttacaatcgaccccgtcaggggtgaagtgaaggtgacgaagctgttagacagagaaacaatcagcggatatacccttacagtgcaagccagcgataatggatctccaccgagagtgaatactactacagttaacatagatgtctccgacgtgaacgataacgctccagtgttttctagagggaactactcagtcataatccaagaaaataagcctgttgggttttctgtactgcagttggtggtgacagatgaagacagctcacacaatggtccccccttcttcttcaccattgtgacggggaacgatgaaaaagctttcgaagtgaacccccaaggtgtcctactcaccagttcggcaatcaaaagaaaggagaaagatcactaccttcttcaggtgaaagtcgcagacaatgggaagccccagttgtcctctctcacatatattgacataagggtgatagaggagagcatctacccaccagccattttgccgcttgagattttcatcacatcaagcggggaagaatattcaggaggagttattggtaagatccatgccaccgaccaagacgtgtacgatacccttacgtattctctggacccacagatggataatctgttcagtgtgagctccaccggaggaaagcttatagcacataagaaactggacattgggcagtatctcctcaacgtgagcgtgacagatgggaaatttactactgtcgccgatattacagtacatatcaggcaagtcacccaggaaatgcttaaccatactatcgctataaggttcgccaacctgacaccggaagaattcgtcggggattactggaggaactttcaaagggcactgcgaaatattctcggagtccgccggaatgacatacaaatcgttagcctacagtcatcagaacctcacccgcatcttgacgtcctgctgttcgtcgagaagccagggagtgcacagatttccactaaacagctgctgcataagatcaattcttcagttaccgacattgaagaaatcattggcgtgcgcatactcaatgtcttccagaaactttgtgcaggcctggactgtccttggaaattctgcgacgagaaagtttctgttgatgagtcagtgatgtcaacccattcgactgccagattgagtttcgtcacccctagacaccaccgtgcagcagtttgcctttgcaaagaaggacgatgcccaccggttcatcacggatgcgaagatgatccttgccccgagggctcggaatgcgtaagcgacccatgggaggaaaagcatacatgtgtgtgccccagtggccggttcggacagtgtcccggctccagctccatgaccctcacgggaaacagctatgtcaaatacagattgactgagaatgagaacaagcttgaaatgaaactcactatgagactcagaacctacagcacacacgcagtggtcatgtacgccagaggaaccgactatagtattctggagatacaccacggtcgcctgcaatataagtttgactgcggtagtggccccgggatcgtcagtgtgcagtctatccaggtgaatgatggccagtggcacgccgtggccctggaagtgaacggcaattatgctagactggttctcgaccaggttcacactgcctccggcacggctcccgggaccctcaaaactttaaatctggacaactatgtgttttttggcggacatatacgtcagcagggtacaagacacggtcgctctccacaagtaggtaatggtttcaggggatgtatggacagtatctatctcaacggacaggagcttcctctgaactctaagccgagatcatatgcccacatagaggaatcagtggatgtgtctcctgggtgttttttgaccgcaacagaggattgtgcgtccaacccatgtcagaacggcggcgtgtgtaacccaagccccgcaggcggctactactgcaaatgtagcgcactgtacattggcacccattgtgaaatttccgttaatccctgttcctcaaagccttgtctgtacgggggtacttgtgtggttgacaacgggggattcgtttgccagtgcaggggattatacacagggcaacggtgccagctttcaccttactgcaaagacgaaccctgcaagaacggaggtacgtgtttcgactccctagacggggctgtgtgccagtgtgattccggttttcgaggcgagcgctgtcagtctgatatcgatgaatgttcagggaacccttgcttgcacggcgccctctgtgagaatacacatggcagttaccactgcaattgctcccacgagtatcgaggcagacattgtgaagacgccgctccaaatcagtatgtttctactccatggaacataggtcttgcagagggcattggaattgtcgtgttcgtggcgggcattttccttctagtggttgtctttgtgctctgtagaaaaatgattagtcggaagaaaaagcaccaggcagaacccaaggacaaacatctgggacctgctacagcctttcttcagcggccatacttcgacagtaagttgaacaaaaacatatatagcgatatccctccccaagtgcctgtgagaccgatctcatataccccatccataccgtccgactctcggaacaatttggatcggaatagttttgaggggagtgctattcctgagcatcctgagttcagcaccttcaacccggagagtgtgcacggtcacaggaaggcggtggccgtgtgctcggtggccccaaacctaccccccccgccccctagtaacagcccctcggactcggattccatccagaagccttcctgggattttgattatgacaccaaggtggtggatctggacccctgtctctcaaaaaagcctttggaggaaaaaccgagccaaccctacagtgctagagagtctctgtccgaggtgcagagtctcagctcgtttcaatcagaaagttgtgacgacaatggttaccactgggacactagtgactggatgccttctgttcccctcccggatattcaagaattcccaaactacgaagtgatcgatgagcagacgcccctgtattcggccgaccccaatgcaattgatactgactactatccagggggctatgacatagaaagtgacttcccaccacctcctgaggacttcccagccgcagacgagctgccgcctctccctcccgaatttagcaaccaattcgagtctatccatcctccacgggatatgcccgcagccggcagtctgggatcttcctctcgcaacaggcagcggttcaacttaaatcagtatctgcccaatttctatcctttggatatgtctgaaccgcagacaaagggcactggggagaactctacttgcagagaaccccacgctccataccccccggggtaccagaggcactttgaggcacctgccgttgagagtatgccaatgtccgtttatgccagcaccgcgagttgtagcgatgtctccgcgtgctgtgaggtcgagagcgaggttatgatgtctgactatgagagcggcgacgacggccactttgaggaagtgaccattccccccctggattctcaacagcatacagaggtgtag

SEQ ID NO: 15173 - DNA, 1467 bp, Artificial Sequence
  Description of Artificial Sequence: Synthetic coding sequence
atgggccgccaccttgcactgctgttactgctcctgcttctgttccagcactttggggattcagatggttcccagagactggagcagaccccacttcagttcacccacttggaatataacgtcactgttcaggagaattccgctgcgaagacctacgtaggtcacccagttaagatgggggtgtacatcacccatccggcctgggaggtccgctacaagattgtgagcggtgacagcgaaaacctcttcaaagctgaagaatacattttgggagacttttgttttctgcgtattagaaccaagggcggcaatacggctatccttaaccgtgaagtaaaggaccactatactctcatcgtaaaggcactcgagaagaataccaatgtggaggcaaggactaaagtgcgggtgcaagtcttggataccaatgacctgcgtcctcttttcagccctacgtcctacagcgtgtccctgcctgaaaacacagccatacgtacaagtatcgctagagtaagtgccacagacgccgacattggcaccaacggtgaattttactacagttttaaagacagaacggatatgttcgccatacaccccacatcgggcgtgattgtccttactggtagattagattacctggaaaccaaactctacgaaatggagatcctcgccgccgaccgtggaatgaagctctatgggagctccggaatttcttccatggcaaaactcaccgtacatatcgagcaggctaacgaatgcgccccagtcattaccgctgtcacactcagtccatccgagctagatcgtgacccagcctacgccatagttaccgtggacgattgtgaccaaggtgctaatggcgatatagcttcactatcaatcgtggcaggtgacctcctgcaacagtttaggaccgtgcgatctttccctggttccaaggagtacaaggttaaagcaattggaggaatcgactgggacagccatccattcggctacaacttgacattgcaggcgaaggacaaagggacacccccccaattcagctcagttaaggtaattcatgtgacctcccctcagtttaaggcaggccccgtcaagtttgagaaggacgtatacagagctgagatcagcgagtttgcaccaccgaatacgccagtcgtgatggtaaaagccattcctgcgtatagccatctgcggtacgtgttcaaatcaacccccgggaaggctaagttctcattgaactataacacgggcctgatatcaattctggaacccgttaaacgacaacaggccgcccactttgagctggaagtcaccacatcagacaggaaagcatcaactaaggtactcgtgaaggtattgggggcaaatagcaacccccccgagtttacacagacagcatataaagctgcattcgacgaaaacgtgcctatcgggaccacagtgatgtccttatccgctgtctag

SEQ ID NO: 15174 - DNA, 399 bp, Artificial Sequence
  Description of Artificial Sequence: Synthetic coding sequence
atgtgtgatgcattcgtgggcacctggaagctagtcagtagcgaaaactttgacgattacatgaaggaggtgggcgtggggtttgcaacacgcaaggttgctggaatggcaaaacctaatatgattattagcgttaatggagatgtcataactatcaagagtgaaagcacattcaagaacaccgagattagcttcatcctcggacaggaattcgacgaagtcaccgccgacgaccgtaaagtgaagtccactattacactggacggtggcgtgctggtacacgtgcagaaatgggacggcaaatccactacgatcaagaggaaacgcgaagacgacaagctggtggtggagtgcgttatgaaaggcgttacctctacccgcgtgtatgagagggcctag

SEQ ID NO: 15175 - DNA, 7536 bp, Artificial Sequence
  Description of Artificial Sequence: Synthetic coding sequence
atggaagaggtggtgatagctggtatgagtggtaaattaccagagtcggaaaatctgcaggagttttgggataatctgattgggggcgtggatatggtgacagacgacgaccgcagatggaaagctggcttgtatggcctgcctcgccgttcagggaagctgaaggacttgagccggtttgatgcttccttctttggggtccacccaaaacaggctcatacaatggatcctcagctcaggctgctgctggaggtgacctacgaggccatcgtagacggaggcatcaaccccgactcactgcgggggacacacactggcgtctgggtgggcgttagcggctccgagaccagcgaagcactttcccgcgatcctgagacactcgtgggatacagcatggtggggtgccagcgagccatgatggctaaccggctctcgtttttcttcgatttcagagggccaagcattgccctcgacacggcatgctcttccagcctgatggccctacagaacgcgtaccaagctattcactcaggccagtgtcctgcggcgattgtgggaggtataaatgtactactgaaacccaatacctctgtgcagtttctgcgcctaggtatgttgtctcctgaagggacatgcaaagccttcgacaccgcaggcaacggctactgccgcagcgagggggtggtagctgttcttctgactaaaaagtcactagcccgcagagtctacgctaccatcttaaatgcgggaactaacacagacggctttaaggagcagggggtgacttttccttccggtgatattcaggaacagctgataaggtctttgtatcaaagtgctggcgtggcccctgaatcctttgaatacatagaagcgcatggcacaggaacgaaagttggcgaccctcaagagctgaacggcatcactcgggctctttgtgccacacgccaggaacctctgctaattgggtccactaaatccaacatgggacaccccgagccagccagcggcctagcagcgttggctaaagtgctcctgtctctggaacacggattatgggcaccaaacctgcactttcactctcccaaccccgagataccagctctgctcgatggtaggcttcaggtagtagatcaacccctcccggtgcgaggtggtaacgtgggcatcaattcctttggcttcggaggttcgaatgtgcatatcatcctgcggccgaatacacagccccccccagcccccgccccccatgccaccctgccaagactgttgcgcgcctcaggacgcacaccagaagctgtgcagaaactgctggagcagggtctgcggcattcacaggacctcgccttccttagtatgctgaatgatatcgctgccgtgcccgccactgcgatgccctttagaggttacgcggtactgggaggcgaacggggtggacccgaagttcagcaagtgcctgcaggagaacgcccgttgtggtttatttgctccgggatgggaacacagtggcgtggcatgggcctaagccttatgcgactcgaccggttcagggactccatcctgcggtccgacgaggctgtgaagccgtttgggttgaaagtgtcacagctgctgttatccacggacgagtctacatttgatgatattgttcacagttttgtgagtttaacagcaattcagataggactcattgatttgttgagctgtatgggactgcgccctgacgggatcgttgggcattctctgggcgaagttgcatgtgggtacgctgacggatgtctctctcaggaggaggccgtgcttgcagcctactggaggggccagtgtattaaagaagcgcaccttccccctggagccatggcagcagtcggcctgagctgggaagagtgcaagcagaggtgtccacctggtgtcgtgccggcatgccacaactccaaggacactgtgaccatctcggggccgcaggcccccgtcttcgaatttgtggagcagctcaggaaggagggcgtcttcgccaaagaagttaggaccggaggcatggcttttcactcgtacttcatggaggcaattgctcctccccttctccaggaattgaagaaggtcatccgcgagccgaagccaagaagcgcaagatggctctccacttctattcccgaagcccagtggcattcctccctggccaggacctccagtgcggagtataatgttaacaacctggtatccccggttctcttccaggaggctctgtggcatgtccccgaacatgctgtcgttttggaaatagctccccacgctttgctgcaggcagtactcaaaagagggctcaagccaagttgtaccatcatcccccttatgaaaaaagatcatcgcgacaatctcgaatttttcctggccgggatcggaagacttcacctgtccgggattgacgcgaatccaaatgcactgtttcctcccgtggagttccctgctccacgcgggactcccttaatctcccccttaatcaaatgggatcactccctcgcctgggatgtgcccgccgcagaggacttccctaacgggtccggcagtcctagtgccgcaatatacaatatcgatacatcatctgagtcacctgaccactatcttgtggaccacaccttagacggtcgggtgctgttcccagcgacagggtatttgtccatagtgtggaagactttagctcgggcccttggcctgggagtggagcagttgccggttgtttttgaggatgtggtgctccatcaggctactatcctaccgaaaacggggacggtgagcctggaagtccgcctgcttgaggcaagcagggcttttgaggtttcagagaatgggaaccttgtagttagcggcaaggtgtaccagtgggacgatcccgacccgagactgttcgaccatcccgagtccccaacacctaatcctaccgaacctctatttctggctcaggctgaagtgtataaggaacttagactccgcggctacgactacggtcctcactttcagggcatacttgaggcaagcctggaaggggactctgggcggttactatggaaggataattgggtgagtttcatggataccatgctccaaatgtcgatcctggggagtgcaaaacacggactttaccttccaactcgggttacggcaatccacattgatccggctacacatcgccagaaactctatactttgcaagacaaggcccaagtagcggatgtggttgtaagcagatggctgagggtcaccgtggctggcggtgtacacattagcggtctgcacacagagagtgcgccgcggcgacaacaagaacagcaggtccctatccttgagaagttttgcttcacccctcatacagaggaagggtgtctgtctgagagagcggcgctgcaagaagaacttcagctctgcaagggtctcgtacaggcgctgcagaccaaagtcacccagcaagggctgaaaatggtggttcccggactggacggcgcgcagattccacgagacccatcccaacaggaactacctcgtctgctgtcagctgcctgccgcctgcagttgaacgggaacctccaacttgaactcgcacaggttctggcccaggaacgcccaaagcttcccgaggacccactgctaagcggcctgctggacagccccgccctcaaagcctgtctggacactgccgtagaaaatatgccaagcctcaaaatgaaggtggtggaggtcctggccggacacggacatctgtactcaagaataccagggctgctgtctccacaccccctgttacagctttcatatactgccacggatagacacccgcaggctctcgaggctgcccaggctgagttgcagcaacatgatgtggctcaggggcaatgggaccccgctgatcccgcacccagcgccttgggaagtgcggaccttctggtgtgcaactgcgcagtggctgctctgggggatccagcgagcgctctttctaacatggtggctgcattacgggaggggggattcctactgctgcatacccttctgcgcggtcatcccttaggggacattgtggcctttctcacctctacagagccccagtacggacaaggaattctcagtcaggatgcatgggagagtcttttttcgcgggtctcgttgagactggttggactgaaaaagtccttttacggcagtaccctctttctatgccgcagaccaactccccaggatagtccaatcttccttcctgtggacgacacatcattccgttgggttgaaagcctgaagggcatcctggcagacgaagatagcagccgcccagtttggctgaaagctatcaattgcgcaacatccggggtggtggggcttgttaactgtttgagacgggagcccggaggaaaccgacttcgttgcgtgctactgagcaacctgtcatccacgtcccacgtcccagaggttgacccgggctcagccgagctgcaaaaggtattacagggcgatttggttatgaacgtgtacagggacggtgcgtggggggcttttcgacatttcctgctggaagaagataagccagaagagcccacggcccacgccttcgtctcaacccttacgaggggggacttgtcctctatcagatgggtctgtagctcacttagacacgctcagccaacatgtccaggcgctcagttgtgtacagtgtactacgcctctcttaatttccgtgatatcatgctggccacaggcaagctctctcctgacgcgatcccgggaaagtggacaagccaggactcgctcttgggcatggagttttccggccgagacgccagtggtaaacgcgtaatggggttggttcccgccaagggactggcgactagtgtcctcctgtcacctgactttctgtgggacgtgccgtccaattggacactggaagaggcagcttccgtgcctgtcgtgtacagtacggcctactacgctctggtggtgcgtggaagggtcaggcccggagaaactctgttgatccactcgggcagcggcggcgtgggacaggctgccatcgcgattgcactatccctggggtgccgtgtgttcactacagtcggcagcgctgaaaaaagggcttacctccaggccagattcccccagttagactctacatccttcgcaaattccagagatacgtcttttgagcagcatgtgctttggcacacaggcggaaaaggagtcgatctagtgctcaattcactagccgaagaaaagttgcaggcctcggtgcggtgcctcgccactcacggtcgctttctggagatcggaaaatttgacctgtcgcagaaccaccccctggggatggcgatattcctgaagaacgtaacgtttcatggggtgttgcttgatgcattcttcaatgagtcctcagcggattggagagaagtgtgggctcttgtgcaagcaggcataagggacggcgtggtgcggccgttaaaatgtacagttttccacggtgcacaagtggaggacgcatttagatacatggctcagggtaaacacataggcaaggtagtggtgcaagtgttagctgaggagcccgaggctgtcctgaaaggtgccaagcctaagcttatgtctgctatcagtaagactttctgtcccgctcataagagctacatcatcgccggcggcctcgggggcttcggcttagagcttgcccagtggctgattcagagaggtgtacagaagctagtgttaacctcccgctcaggaatccgtactggttaccaggcgaaacaagtacgccgctggcgtagacaaggcgttcaagtgcaggtaagcactagcaacatatcttctttggaaggcgcacggggacttatcgccgaagcagcacagctagggccggtaggaggcgtgttcaacttggctgtcgtgcttagggacggccttctcgaaaaccagactccggagttttttcaggacgtttgcaagccaaaatactctgggaccttaaatttagaccgtgtgactcgggaagcatgtccagagctggattactttgtggtgttcagctccgtgtcctgcggccggggaaacgccggccaaagtaactacggattcgccaactctgctatggagagaatctgcgaaaagaggagacatgaaggactgcccgggttggccgttcagtggggtgcaatcggcgatgtgggtatcctcgttgagacgatgtccaccaacgacacaattgtatccggcacgctgcctcaacgcatggccagttgcctagaggtcctggatcttttccttaaccagccccatatggttttgtcgtcattcgtgcttgccgaaaaggcggccgcgtaccgagatcgggatagtcagagagacctggttgaggctgtggcccatatcctcggtatcagggatctggcagcagttaatttagatagttctctggccgatttgggtcttgatagcctgatgagtgttgaagtgagacagacactggaacgcgaactgaacctggtgctgtccgtgagggaggtgcgccagctcaccctgcgcaaactccaggaactatccagcaaggctgacgaggcgagtgaactagcgtgtcccacgcctaaagaggatgggctagcccagcagcagacacagcttaaccttagatccctactggtgaacccggagggcccgaccctgatgcgtctcaacagtgtccagagtagcgaacggcccctgttccttgtgcatccaatagaggggtcaactactgtttttcactccctggccagcaggctcagtataccaacttatgggctgcaatgcaccagggccgcaccactggacagtattcattcacttgccgcctattatattgactgtatccgtcaggtccagccagagggtccctaccgagttgctgggtatagctatggtgcctgcgttgcattcgaaatgtgctctcagctacaagcccaacagtctccagctcctacccacaacagtctgttcctctttgatggaagtcctacatacgtgctggcctacacccagtcctaccgggcaaagctgacgcccggctgcgaagcagaagcggaaactgaagcgatatgcttttttgttcagcaatttacggatatggagcacaatagggttctcgaggcactgctgccgttgaagggactagaagagcgggtggcggctgctgtggacctcataatcaaaagccaccaggggttagaccgccaggagctgtcatttgcggcaaggagcttctattacaaattgcgagccgctgagcaatatactcccaaggcaaaatatcacggtaatgtgatgctcctccgcgcaaaaacaggtggcgcgtatggcgaagatctcggtgcagactataacttgtcccaagtctgtgacgggaaagtttcagttcatgtaatagagggtgatcaccggacccttcttgaaggctccggtctagaatccataatcagcataatacacagctctttagcagaacctcgcgtatcagtgagagagggctag

SEQ ID NO: 15176 - DNA, 2502 bp, Artificial Sequence
  Description of Artificial Sequence: Synthetic coding sequence
atgtccatcctaggatccgctaagcacggcctgtatttgcctacccgggttactgccatacacatcgatcccgcgacccatagacagaaactctacacactccaggataaagcgcaggtggccgacgtcgtcgtctcccgctggttgcgtgtcacagttgcaggtggagtgcacatttcaggtcttcacacagagtctgccccaaggagacagcaggagcagcaggtcccaattcttgagaagttctgcttcacaccacatacggaagagggatgcctctcagaacgtgccgccctgcaggaagaactgcagctgtgcaagggcctggtgcaggcactgcaaactaaggtgactcagcaagggcttaaaatggttgtgccaggcctcgacggcgctcagatccctagagacccctctcagcaggaactccccaggctgttgtcggcggcctgccggctgcagctgaatggaaatctacaactcgagctggcacaggtgctcgctcaggaacgccctaaactgcctgaagatcctcttttgtccggtttactggactcccctgctcttaaggcgtgcttagataccgctgttgagaacatgccaagtctcaaaatgaaggttgttgaggtgctggcaggccacgggcatctgtatagccggatccctgggctcctgtctccccatcctctgttgcagctctcatatactgcgaccgacaggcacccccaggccctggaagccgctcaggctgagctccagcaacatgacgtggcacagggccagtgggaccccgcggaccccgccccttctgctctcgggtctgcagacctcctcgtgtgcaattgtgctgtggccgccctgggagatccagcgtctgcactgtcaaatatggtcgcggccctgagggagggcgggtttttgctcctccatacattgctgcgaggccatcctttaggagatatcgtggcctttctgacatctaccgaacctcaatacggccaggggatcctgagccaggacgcatgggaatcccttttcagccgcgtgagcctcaggcttgtggggctcaaaaagtctttctatgggagcaccctctttctgtgccgaaggcctaccccccaggatagtccaattttcttaccggttgacgacacttcatttagatgggtggagtccttgaaaggcattttagcggacgaggacagttcacggccagtgtggctgaaggcgatcaactgcgccaccagcggagtcgtgggcctcgtaaactgtctcaggagagaacctgggggtaataggttgcggtgtgtcttgttatctaacttgtcctctacaagccacgtacctgaggtagatcctggatctgcggagctgcagaaagtcctacagggcgaccttgttatgaacgtgtatcgtgacggcgcttggggcgcttttcgccactttctgttggaggaggataaaccagaggagcctactgcacacgcttttgtaagcaccttaacacggggagacctgagctctatcaggtgggtctgcagtagtcttagacacgcccaacccacatgtcccggggcacagctgtgtactgtgtattacgccagcttaaacttccgtgacatcatgcttgctaccggcaagttgtcgcctgacgccatcccaggcaagtggaccagccaggattctctgctgggtatggagtttagcggacgagacgcttctggcaagcgcgtcatgggtttggtgcctgccaaaggcctggctacttccgtgcttttgtcacctgatttcttatgggatgtgccatcaaattggactcttgaagaagcagctagcgtgcccgttgtctactcaacggcctattacgctctagtcgtccgaggtagagtgagacctggggagacgctcctgatacactccggctcgggcggagtgggacaggccgcaatagccatcgcactgtcgctcggttgccgggtttttaccaccgtgggcagtgccgaaaaacgggcctatctccaggctcgtttcccacaattggactctacttcttttgcaaactctagagatacctccttcgagcagcacgtgctttggcacaccgggggcaagggggtcgatctggtcctaaacagtcttgccgaggaaaaattgcaagcttcagtcagatgcttggccactcacggtcggttcctcgaaataggaaaattcgatctatcgcagaatcaccctctgggtatggctatcttcctgaagaacgtaacttttcacggagtgctactggatgccttctttaacgaatcttccgctgattggcgggaggtctgggccctggtacaggccggtatcagggacggtgtggtacgcccgttaaaatgcacagtattccacggcgcccaagtcgaggacgcctttcgctacatggcccaggctaaagcttcacaagcctggccttgcagcggcgcccccagcgccacctgggctttttggtggagacgctag

SEQ ID NO: 15177 - DNA, 1143 bp, Artificial Sequence
  Description of Artificial Sequence: Synthetic coding sequence
atgatgttctccggattcaacgcagattatgaagcttccagttcaagatgttccagcgcctcccctgccggcgatagtcttagctactatcacagtcccgcagattctttttcatcaatggggtcaccggtgaatgcccaggatttttgtacagacctggcagtttcatctgctaattttatccccaccgtgacggccattagcacctcacctgacctacagtggttggtgcaacccgccttggtcagcagcgtcgccccctcccaaactagggccccccacccttttggcgtcccagccccttctgcaggggcctactcaagagcgggagtcgtgaaaacaatgaccgggggtagggcccaatctatcgggagacgggggaaggtggagcagctcagccccgaagaggaggaaaagcgccgcatccgtagggagaggaacaagatggccgctgcgaagtgcagaaacaggcgtcgcgaactgacagataccctgcaggctgaaactgatcagctggaggacgaaaagtctgctctgcaaactgaaattgccaacttactaaaggagaaggagaaactcgaatttattctcgccgcccatagacctgcatgcaagatccccgatgatctaggctttccagaggaaatgtctgttgcctccctggacctcacaggaggcctgcctgaggtagcgacccctgaaagcgaagaagcgtttacattgcctctccttaatgatccagagccaaaaccttcagtcgagccagtcaaatccatatcctctatggagctcaagacagagccttttgatgattttctatttcctgcatccagtcggccttctggctccgagaccgcccgctccgtgcccgatatggacttgagcggcagtttctacgcggcagactgggagcctcttcattctggtagcctggggatgggtcctatggctaccgaattggagcccctgtgtactccagtggttacttgtacaccaagctgtaccgcctacacgagcagctttgtgttcacatatccagaggctgattccttcccatcctgtgctgccgcgcatagaaaagggtcctctagcaacgagccctcttccgactccctgagtagccccactttgcttgctttatag

SEQ ID NO: 15178 - DNA, 966 bp, Artificial Sequence
  Description of Artificial Sequence: Synthetic coding sequence
atggaggaaggacagtatagcgaaatcgaggagcttccaaggaggagatgttgccggagaggtactcagattgttctgctcgggctcgtaactgctgccttatgggcggggctcctgactctcctgttgctgtggcactgggacactacgcagagtctcaaacagctggaggagcgggcagcccgcaacgtatcccaggtaagcaagaacctcgaatctcaccacggagatcaaatggcgcagaagtcacagagcacgcagatatcgcaggagttggaggagctgagagctgaacagcaaagactcaagtcccaggatctagaactgtcctggaacttaaacggcctgcaggcagatctctcctcatttaaaagtcaggaactcaatgagcgcaatgaggccagcgatcttctggaacgactccgtgaggaggtcaccaaattgaggatggagctgcaggtgagcagcggattcgtgtgcaacacatgtcccgagaagtggatcaactttcagcgaaagtgctattactttggcaagggcacaaaacagtgggtgcatgcccggtacgcctgcgatgacatggagggccagttagtctctattcacagcccagaggaacaagatttcctcacgaagcatgcctctcataccggctcttggatcgggctgcgcaacctggatctgaagggcgaattcatttgggtggatgggagtcacgtggactactcaaattgggccccaggggagcccacgagccgctctcagggagaggactgcgttatgatgaggggctcaggccggtggaacgatgctttctgtgacagaaagttgggcgcctgggtgtgcgacagattagcaacatgcacgccaccggcttctgaaggatcagccgagtcgatgggccctgacagtcggcccgatccagacggaaggttgccaactccctccgcgcccctccatagctag

SEQ ID NO: 15179 - DNA, 963 bp, Artificial Sequence
  Description of Artificial Sequence: Synthetic coding sequence
atgaatccaccaagtcaggagattgaagaattgcctaggaggagatgctgcagaaggggcacccagattgttcttttaggcctagtcaccgcagccctgtgggctgggttgttaaccctcctgctactttggcactgggacactacccagtcactgaaacagctggaagagcgcgcggcacgtaatgtttcacaggtgagcaagaacctggaaagtcatcatggggatcagatggcacagaagtcacagtccacccagatttcacaagagctcgaggagttacgtgcagagcagcaacgattaaagagccaggatttagagttaagctggaatctaaacggactacaggctgacctgagttcttttaaatcacaagaactgaatgaaagaaatgaggcatccgatctccttgagcgattgcgcgaagaggtcaccaaactgaggatggagctgcaagtgtcaagtgggttcgtgtgtaacacatgtcccgagaagtggattaattttcagcgcaagtgctactacttcggcaaaggtaccaagcagtgggtgcacgctcggtacgcttgcgacgacatggaagggcagctggtgtcaatccacagtcctgaggagcaggatttccttactaaacatgcgtctcacacaggtagttggattggcctccgcaacctggatctgaagggagaatttatctgggtagacgggagccatgtcgattattcaaactgggcacccggagagccaacctcccgctctcagggtgaggattgtgtcatgatgcgaggaagcggacggtggaatgacgctttttgcgaccgcaagttgggcgcctgggtgtgcgataggctggctacatgtacaccacctgcatcagaagggagtgccgaatccatgggccccgactccagacccgaccctgatgggaggctcccaactccctctgcccctctgcattcctag

SEQ ID NO: 15180 - DNA, 1125 bp, Artificial Sequence
  Description of Artificial Sequence: Synthetic coding sequence
atgtggtttcttacgaccctcctgctgtgggtaccagttgatgggcaagtcgatactactaaagccgtgattaccctccagcccccgtgggtgagcgtcttccaggaagagacagtgacactgcactgtgaggttctgcatcttcccgggtcctccagcacccagtggttcctgaatggaactgcaacacagacctccacaccgagctaccgaatcacgtccgcctctgtcaacgactcaggtgagtaccgctgccaacgtggattgtcaggccggagtgatcctatacagctagaaatccaccgggggtggctcctgctgcaagtttctagccgggtgttcacggaaggagagccacttgcccttaggtgccacgcgtggaaagataaactagtgtacaatgtgctctactaccgtaatggtaaggccttcaaattcttccactggaacagcaatcttaccattttgaagacaaatatctcacacaatggaacttatcactgttctgggatgggcaagcaccgttacacctcagccggaatcagcgttaccgtgaaggagctcttccccgcaccggtgttgaatgcctccgtgacatccccactgttagaggggaatctcgtcacccttagctgtgagacaaagctgctcctgcagagacccggtcttcagttgtatttctctttctatatgggtagcaaaacgctgagaggtagaaatacctcatcagaataccagatcctcacagcgcggcgggaagattcaggactgtactggtgtgaagcagccaccgaggatggcaacgtgttgaaaaggagtcctgaactagagctccaggtccttggacttcagctgccgacgccggtgtggtttcacgtgctcttctacctggctgtcggcatcatgttcctcgttaatactgtcctgtgggtgacaatccggaaggaactcaagcggaaaaagaagtgggatcttgaaatctcattggatagcgggcatgagaagaaggtcatctcatctttacaggaggaccggcacttagaggaagagcttaagtgtcaagaacagaaagaggagcagctgcaagaaggggtccatcggaaggagccccagggagcaacatag

SEQ ID NO: 15181 - DNA, 723 bp, Artificial Sequence
  Description of Artificial Sequence: Synthetic coding sequence
atgtggtttctgacgacgctgctgctgtggggatggctcctgctgcaggtgtcttctagagtgtttaccgaaggggaacccttggccctgagatgtcacgcttggaaggataagctcgtttataacgttttgtactatcgcaacggtaaggcattcaaattctttcattggaacagcaatctgactatcctgaagaccaatatatcacacaacggaacctaccactgcagcggcatgggaaaacacaggtacacaagcgctgggataagcgtcaccgtgaaggagcttttccctgccccagtcctgaacgcgtccgttacgagcccgcttctcgagggcaatctggtgactctttcctgcgagactaagctccttcttcagcggcccggacttcagctctatttttccttctacatgggatccaagactctccgtggaaggaacacctcttctgagtatcaaattctgactgcccggagggaagactcaggtctctactggtgcgaggcagccacggaagacggcaatgttctgaagagatcacccgaactcgaactacaagtgctgggcctgcagctgccgacacctgtctggttccatgtcctgttctaccttgctgtggggatcatgttcctcgtgaacactgtgctgtgggtcactatacgtaaggagctcaaacggaagaagaaatgggatctggaaatttccctcgatagtgggtag

SEQ ID NO: 15182 - DNA, 2469 bp, Artificial Sequence
  Description of Artificial Sequence: Synthetic coding sequence
atgggcttctctagtgagctttgctcccctcagggccatggcgttctgcagcagatgcaagaggcggaactgaggttgctagagggcatgcgaaagtggatggcccagagggtgaaatctgaccgggagtatgccggattgctgcatcacatgagtctgcaggatagcggcgggcaaagcagagcaatctctccggatagcccaattagtcaatcctgggcggaaatcacgtcccagaccgagggactgtcacggctactgcggcagcatgctgaagatctgaacagcggcccactctccaagctttcattactcattcgggaaagacagcaactgcgcaaaacatacagcgaacaatggcaacagcttcagcaggaacttacaaaaacacattcacaagatatcgaaaagctaaaatcccagtaccgcgcactcgccagagatagtgcccaggcaaaacgcaaatatcaagaggcctctaaggataaggacagggacaaagccaaggacaagtatgtgcgaagcctgtggaaattgtttgcccaccacaatagatatgtcttgggcgttagggctgctcagttacaccatcagcatcaccaccagttgctgctcccaggcctccttagaagcttgcaggacttgcacgaggagatggcttgtattcttaaagaaatcttgcaggagtatctggagatttcttctctcgtccaggacgaggtcgtggcaatccatcgggagatggcagccgcagcggctagaatccaacctgaggccgagtaccagggattccttcggcaatatggaagtgcacccgacgtaccaccttgcgttactttcgacgagtcccttctcgaagagggggagcctctagagcccggcgagctacagcttaacgagcttaccgtcgaatctgtccaacacacgctgacaagtgtgaccgatgagttggcggtggctacagagatggtcttcaggcggcaggagatggtgactcagttgcagcaggagcttaggaatgaagaggagaacacacacccacgggaacgggttcagctcctgggaaagcggcaggtgcttcaggaggccctacaggggctgcaggtggcgctctgcagccaggcaaaactgcaggcccagcaggaactgttgcaaaccaagctcgagcatctcggtccaggagaacctccccccgtcctacttctgcaggacgatcgacactccacctcttcttctgaacaggagcgtgaagggggaagaacgcccacattggaaattctgaaatcccatatctctgggatttttcgaccgaaattctcactgccaccccccctacagctcattccagaggttcaaaaacctctccatgaacagttgtggtaccacggcgcaatacctagagccgaagtagcggaactgctggtccacagtggcgacttcttggtccgggaaagtcagggcaaacaagaatacgtgctcagcgtcttgtgggacggactcccgaggcattttatcatacagagcctggataacctgtacaggctagagggcgaaggatttccctctatcccactgttgatcgaccatctgctgtccactcagcaaccgctgaccaagaagtcaggcgttgttcttcacagagcggtgcctaaggataagtgggtcctgaatcacgaggacctggtgttgggggagcagataggccgcggtaactttggtgaggtattcagcggacgtctgcgcgccgacaacacgctggtagctgtgaaatcttgcagagagaccctgccaccagatctgaaagctaagttcctgcaagaggcacgcatccttaaacaatactcacatccgaatatcgttaggctcattggggtctgtactcaaaagcagcccatatatatagtcatggagttggtgcagggaggtgatttccttacatttctccgaacagaaggagctcggctccgagtcaagacgttgctccaaatggtaggcgatgcagcagctgggatggagtatctggagagtaaatgctgtatccatcgcgacctagccgcccgaaattgcttggtgacagagaaaaatgtgttgaaaatctctgactttgggatgtctcgcgaggaggcagacggagtctatgccgcaagcggcggactgcggcaggtgccagtgaaatggacagccccagaagctcttaattatggccggtactctagcgagtccgacgtttggagctttgggattttgctatgggaaacctttagtcttggggcctctccttaccccaatctatctaatcagcagactcgggaatttgtggagaaaggaggcaggctaccctgcccagaattatgtccagatgcagtgtttcgactcatggagcagtgctgggcttatgagcctggccagcggccctccttctctacgatctatcaagaactgcaatccataagaaagagacacaggtag

SEQ ID NO: 15183 - DNA, 2295 bp, Artificial Sequence
  Description of Artificial Sequence: Synthetic coding sequence
atgggttttagttcagagctgtgctccccgcaaggacatggcgtactgcagcagatgcaggaagcagaattgcgcctcttggagggaatgagaaagtggatggctcaaagagtgaagtcagatagagaatacgccgggctcctgcatcacatgtctctgcaggactcaggaggtcaatcccgggcaattagccccgacagccctatttctcagacacattcgcaggatattgaaaagctcaaatcgcagtatcgcgcgcttgcccgagattctgcccaggcaaagcggaagtaccaggaggccagcaaagacaaggatcgggacaaggcgaaggataaatacgttcggtcgctgtggaagttgttcgcacatcataaccgttacgttctgggcgttcgggccgcccagctacatcaccaacaccaccaccagttgttgctgccgggcctcctccgaagtctgcaggacttacacgaagagatggcttgtattcttaaggagatccttcaggaatatttggaaatcagttccctggtccaggatgaggttgtcgccatacaccgtgagatggccgccgccgctgcccgtatccaaccggaggcagaataccaagggttcctgagacaatatgggtccgcacccgacgttcccccctgtgtgactttcgacgagtcactgctggaagagggcgagccgctggagccaggtgaattgcagctgaacgaactcactgtcgaaagcgtacagcatacacttacttcagtgactgatgagctagccgtagccaccgaaatggtctttcggagacaggaaatggttacacaactgcagcaggaactcaggaacgaggaggagaacactcatcctcgggaacgggtgcagctcctaggcaagagacaagtgctgcaggaagccctgcagggtctgcaggtagccctgtgctcccaagctaagcttcaagcccagcaggaactgctacagacaaaattggagcatcttgggccaggggaacccccaccagtgctgctgcttcaagacgacaggcacagtactagcagcagcgagcaggaaagagagggcggcagaacacctactctcgagatcctcaagtcacacatatctgggatcttccgaccaaagttcagcttgcccccccctctgcagctcatccccgaggttcagaaacctctgcatgaacagctttggtatcacggcgcaatccctagagccgaggtagctgagctcctagtgcactctggagactttttggtccgcgagtcacagggcaagcaggagtatgtgctatccgtcctgtgggatggtcttccacggcattttatcatacagtccttagacaatctgtatcgactagagggggagggcttcccatcaattccactgttgattgaccatctgctcagcacccagcaacctctcacaaagaagagcggcgtggtgttacacagggcagtgcctaaagataaatgggtgctgaaccatgaggatttagtgttgggggagcaaattgggaggggcaactttggggaggtcttctctggcagactcagagcggacaacacactcgtggctgtcaaatcctgcagagagacgctgcccccggacctgaaggcaaagtttctgcaggaagcccgcatactgaagcagtactcccaccctaatattgtacggctgattggagtctgtacgcagaagcagcccatctatatcgtgatggagctggtacagggcggagactttctcacgtttctccgaacagaaggtgcccggctgcgcgtgaaaactctcctgcagatggtgggtgatgccgccgccggaatggagtaccttgagagtaagtgctgcatccacagggatttggcagcgaggaactgcctcgtcaccgagaagaacgtgctgaaaataagtgatttcgggatgtctagagaggaagcggatggggtgtatgcggcatccggcggcctgaggcaggttccggtcaagtggaccgcacccgaagctttgaattatggccgatattcgagtgaaagtgatgtgtggtcttttggtatactgttatgggaaacattcagcctgggtgcctccccctatcccaacctcagcaaccagcagactcgggagttcgttgagaaggggggacgtttgccctgtccggaactgtgccccgacgcagtttttcggctcatggagcagtgctgggcatatgaaccgggacagcggccctccttcagcaccatctatcaggaactccagtcgatccgaaaacgccatcgctag

SEQ ID NO: 15184 - DNA, 2046 bp, Artificial Sequence
  Description of Artificial Sequence: Synthetic coding sequence
atgggatttagcagcgagttatgctcacctcaaggtcacggtgtcttgcagcagatgcaggaagctgagctccggctactcgaaggaatgcgaaaatggatggctcagagggtcaaaagcgatagggaatatgccgggctgctgcatcacatgagccttcaagacagcggcgggcagtcccgagcaatatcacccgactcacccatctcccagacccacagtcaggacatcgagaaactcaagagccagtaccgggccttagcacgggattcagcacaggctaaaagaaagtaccaggaggcctccaaggacaaagatcgggacaaagccaaagacaagtatgtgcgcagtctgtggaagctcttcgcccaccataatcgctacgttttaggggtcagagccgctcaactccatcaccagcatcatcatcagctcctcttgcctggcctgttgcgtagccttcaggatctgcatgaagagatggcctgtattctgaaagaaattctccaggagtatctcgaaattagttccctcgttcaagatgaggtggtggccatacatagagagatggccgccgccgccgcccgaatccagcccgaggctgaatatcagggctttctgcgacagtacggctccgcacctgatgtgcctccgtgcgtcaccttcgatgagtcacttctagaggaaggggaacccttagagcctggagagctgcaactcaatgaacttactgtcgagagcgtgcaacacactctcacatctgtcactgatgaactggctgtggcaaccgagatggtatttaggaggcaggagatggtaacccagctgcaacaagaactgagaaacgaggaggaaaatacgcaccccagagagagagtccagctgctcgggaaaaggcaggtgttacaggaagctctgcagggtctccaagtcgcgctctgctcacaggccaaattgcaggcacagcaggagttactacagaccaaactagaacatctgggacctggtgagcctcctccagtcttattgctccaagacgatcgtcactctacctccagcagtgagcaggaaagagaaggcggacgcacccccacactcgaaatactcaagagtcatatctccggaatttttcgacccaagttttcaaacctctatagactcgaaggcgagggttttccatctatcccgctgctgattgaccacttgctgtccacacagcagcctctcactaagaagtctggcgtcgtgttgcaccgcgctgtgccgaaagacaagtgggtgttaaaccacgaagaccttgtcctgggggaacaaatcggccgtggaaattttggcgaggtattctcagggcggctgagagcagacaacacactggtcgccgtgaaatcttgcagggagaccttgccccctgaccttaaagccaagtttcttcaagaagccagatcttccccatctacatccagctggtccctctgtcgcgggtcttctcctcccgctggcggcgatttcctcacatttctgcgcaccgagggagcaagactccgagtgaagaccctgctgcaaatggtcggggacgccgcagctggaatggagtacctcgaatccaaatgttgcattcatagggacctggctgccagaaactgcctggtcacagagaaaaatgtcttgaagattagcgattttgggatgtcaagagaggaagccgacggagtctacgctgcctcaggagggctgcggcaggttccagtcaaatggacggcaccagaggccctgaactacggacgatatagctcggagagtgatgtgtggtcattcggcattctactgtgggaaacattctctcttggggccagtccataccctaatctgtccaatcagcaaacccgcgagttcgttgagaagggcggaaggctgccctgccctgaactctgccccgatgccgtattcaggttgatggaacagtgctgggcctacgaaccgggccagagaccctccttttcaactatctaccaggaacttcagagcatccggaagcgtcatagatag

SEQ ID NO: 15185 - DNA, 2085 bp, Artificial Sequence
  Description of Artificial Sequence: Synthetic coding sequence
atggggttttccagcgaattgtgtagtcctcagggtcacggggtacttcagcaaatgcaggaagcggaactgaggctactcgaagggatgagaaagtggatggctcaacgcgtgaaaagcgatagggaatatgctggactgctccatcatatgagtctgcaggattctggggggcagtctcgggcaatctctccagattcaccgatcagccagacgcatagccaggacatagagaagctcaagtcccagtaccgtgctctggcccgcgatagtgctcaggccaaaagaaagtaccaggaagcaagtaaggacaaggaccgcgataaagccaaagataaatatgtaagaagcctttggaagctcttcgcacatcataatcgctacgtgctcggagttcgcgccgcccagctgcatcatcagcatcatcatcagttgttgctgccggggctcctgaggtctcttcaggatctacatgaggagatggcatgtatcctaaaagaaatactacaggaataccttgaaatcagcagtctggtccaggacgaggtcgtcgcaatccacagggagatggctgctgctgccgctaggatccaacctgaagcagaatatcaggggtttctgaggcagtacgggtccgctccagatgtgcctccctgtgttacattcgatgaatccttgctggaggagggggaacccctcgagccaggtgagctccagttaaacgagctgaccgtagaatctgttcaacataccctcacctcggtgacagatgagctggcagttgccaccgagatggtctttaggagacaggagatggtgactcagctgcagcaggaattgcggaatgaggaggagaacactcacccacgggaacgtgttcaactcttgggcaaaagacaggtgttacaggaggctttacaggggttgcaggtggcgctttgttcacaggctaaacttcaggctcagcaggagctgctacagacaaagctggagcacctgggacctggggaaccgccacctgttctcctgctgcaggacgatcgccactccacatcgagctcagagcaggagcgcgagggaggcagaactccgacccttgagatcctcaagtctcacatttccggcatatttaggcccaagttcagcaacctgtatcgcctggagggagaaggattcccatccatcccattgttaatagaccatctgctgtccacccaacagccacttaccaagaaatcaggcgtggtgctccatagggctgtcccaaaggacaaatgggtattaaaccacgaggatttagttctcggagaacagattggtagaggcaattttggtgaggtattcagcgggcggctgagagctgacaataccttggtcgcggtgaagtcgtgcagagaaactcttccaccagacctgaaagcaaaatttttacaagaggcgagaattctgaaacagtatagccatccaaatatcgtccggttaattggcgtatgcacccaaaagcagccgatatatattgtaatggaattggtgcagggaggagacttcctcacattcctccgaactgaaggcgccagactcagagtcaagacactgctacagatggttggggatgctgctgccggtatggaatacctggagtcgaagtgctgtatccatcgagaccttgcggctagaaattgtctcgttactgagaaaaatgtgttgaagattagcgacttcggcatgtctcgggaagaggccgacggtgtgtatgcagccagtgggggactgcggcaagtgccagtgaagtggacagctcccgaagcgctgaattatggtagatattcaagcgagtcagacgtgtggagttttggaatcctcctttgggagactttttccctcggcgccagcccttaccccaacctgagtaaccagcaaaccagagaattcgtggagaagggtgggcggctgccatgcccggaactttgtccggacgcggtattccgtctgatggagcagtgttgggcctacgagcccgggcaacgaccttctttctctaccatttaccaggaactgcagagtattagaaagcggcatcgttag

SEQ ID NO: 15186 - DNA, 129 bp, Artificial Sequence
  Description of Artificial Sequence: Synthetic coding sequence
atgggcttctcttccgagctgtgtagtccccaggggcacggcgtgctgcagcagatgcaggaagccgaattgcgactcctcgagggaatgcggaagtggatggcacagagagtcaaaagtgaccgctag

SEQ ID NO: 15187 - DNA, 348 bp, Artificial Sequence
  Description of Artificial Sequence: Synthetic coding sequence
atggggttcagcagtgagctgtgctctccacaaggccacggcgtcctccagcagatgcaagaagccgaacttcgcctgctggaaggcatgcgaaaatggatggctcagagggtgaagagtgatagggagtacgccggcctcttacaccatatgtcattgcaggattcaggaggtcagtcccgtgctatctcgccagatagtcccattagtcagagttgggcagaaatcactagccagactgaaggattaagtcgtcttctcaggcagcacgcggaggatctgaattctggcccgttgagtaaactctcacttttgattagagagcggcagcagttgcgtaagacctag

SEQ ID NO: 15188 - DNA, 2259 bp, Artificial Sequence
  Description of Artificial Sequence: Synthetic coding sequence
atgggattttcgtctgagctatgctcccctcaaggacacggcgtgttgcagcagatgcaggaagccgagctacgcctgctggagggaatgcggaaatggatggcgcagagggtgaaatccgaccgagaatatgccggactcctgcatcatatgtctctgcaagattctggcggccagtctcgggccatctcaccagattccccgatctcccagtcgtgggccgaaattacttcccaaacggaaggcctctctcggcttcttagacaacacgcagaggaccttaattcaggcccacttagcaaacttagcctgctgatccgggagaggcagcagctcagaaagacctattcagaacagtggcagcagctgcagcaggagctgactaagacacacagtcaggacatcgagaagttgaagtctcaataccgggccttggctagagacagtgcccaggctaaaagaaagtaccaggaggcttccaaagataaggacagagacaaggctaaagacaagtatgttaggtccctgtggaagctcttcgctcaccacaacagatacgtgctgggtgttcgcgccgcccagctccatcaccagcaccaccaccagctcttacttcctggccttctccgcagcctgcaggacctgcatgaagaaatggcgtgcattttgaaagagatcctgcaggaatacctggaaattagctctctggtgcaggacgaggtagtggcaattcaccgtgagatggcagctgccgccgcaagaattcagccagaggcagagtaccaggggttcttgcgacagtacggctccgcccctgacgtcccaccttgcgtgacattcgacgagtctctgttggaagaaggcgaaccattagagcctggggagctgcagctaaatgagctgacagtggagtccgtacaacacacactgacttctgtgacggatgaactggctgtcgctacggagatggtttttaggaggcaggagatggtgactcagctgcaacaggaactgagaaatgaagaagagaatacccaccctcgagaaagagtccagctgttgggcaagcgacaagtcctgcaagaagccctgcagggcctgcaagtggccctgtgttcccaggctaagctccaggcgcagcaggaactcctgcaaacaaaactagaacatctcggcccaggtgagccaccaccagtactgctgctacaggatgatcgccatagcacaagctctagtgaacaggagagagagggcggacgtactcccaccttggagatcctgaaatcccatatctctggtatattcaggcccaagttctctaatctttacaggctagagggcgagggcttccctagcatacccctgctcatcgatcaccttctttctactcagcagcccctgaccaaaaaatcaggcgtggtgttgcatagggcagtcccaaaggataagtgggtgctgaaccatgaggacttagtcctgggcgaacaaatcgggcggggaaatttcggagaggtgtttagcggcaggttacgcgccgacaacactttggtggcggttaagagctgtagggagacgctccctcctgacttaaaggctaagtttcttcaggaggcccggatattaaaacagtactcacatccaaacatcgtcaggctcattggtgtttgtacacagaagcagcctatttatatagtcatggaattagtgcaaggtggcgacttcctcacgtttctgcggacagaaggggcacggctgagggttaagacacttctccagatggtcggcgatgccgccgcgggtatggagtacttggagtcaaaatgctgcatacatagggacctggctgctagaaactgcctcgttaccgaaaagaacgtccttaaaatttccgactttggtatgagtagggaggaggccgatggtgtatacgctgcatcgggcggactgaggcaagttccagtcaagtggaccgctcctgaagccctcaattacggaagatattcatccgagtctgatgtgtggtcctttggcatccttttgtgggaaactttttccctcggtgcctcaccataccccaacttgagcaaccagcagacaagggagtttgtggagaagggtggtcggctcccgtgcccagagctctgtcctgacgctgtcttcaggcttatggagcagtgctgggcttacgaaccaggtcagcgaccatcgttcagcaccatctaccaagagcttcagagcatcaggaagcgccacaggtag

SEQ ID NO: 15189 - DNA, 2085 bp, Artificial Sequence
  Description of Artificial Sequence: Synthetic coding sequence
atggggtttagctcagagctctgcagtcctcaggggcacggtgtgctgcagcagatgcaggaggcagagctgaggctcctcgagggcatgagaaagtggatggctcagagagttaagtccgaccgggagtacgctggactactgcatcacatgagcttgcaggatagcggcggtcagtcaagagccatctcccccgatagcccaatttcgcagacacacagccaggacattgaaaaactgaagtcccagtaccgggcgttggccagagacagtgcacaggcaaaaaggaagtatcaggaggcatcaaaggacaaagacagagacaaggccaaagacaagtacgtaagaagtctttggaagctattcgcacaccacaatcgttatgtactgggggttagagctgcccaactgcaccatcagcaccatcaccagctgcttttaccaggcctgttacggtcactccaggatctgcatgaagagatggcctgtatactgaaggagattctccaggagtatctcgaaatctcctccctagttcaggacgaggtggtcgccatacacagagagatggccgctgcggccgccagaatccagccagaagcagaatatcaggggtttctgaggcagtatggctctgctccagatgtgcctccctgcgtgactttcgacgagagcctgctggaagagggagagccattagaaccaggcgagcttcaacttaacgaactaacagtcgagagtgtgcaacacactctgacatccgtgaccgacgaactagccgtggcaacagagatggtgtttaggcggcaggagatggtgacccagctccagcaagagctgagaaatgaagaggaaaatacgcaccctcgtgagagagtgcaactactgggcaaacgccaagttcttcaggaagctctccaagggttgcaggtcgcgttgtgctctcaggcgaagcttcaggctcagcaggagttactccaaactaagctggaacacctgggtcctggcgaacctccacccgtactgttactccaggacgatcgtcactctaccagttccagtgaacaggaacgcgaggggggccgtacgcctaccctggagattctcaaatcccacatcagtgggatctttaggcccaagttcagcaatctgtataggttggaaggggagggttttccaagcattcccctgctgattgatcacctgctcagcacgcagcagcccttgaccaaaaagtctggtgtggtccttcacagagccgtgccgaaggataagtgggtgctaaatcatgaagacctcgttctgggagaacaaattgggaggggcaatttcggtgaagtattttctggacggctgagagcagacaataccttggtggccgtcaagtcctgccgggaaacactgcccccggatctgaaggcaaaatttcttcaggaggctagaatcctcaaacagtatagccaccctaatattgtcagacttatcggcgtctgcacacagaaacagccaatctacattgtcatggagctggtacaaggtggcgactttctcaccttccttcgaacagagggggcccgcctcagagttaaaacactcctccagatggttggtgatgctgcagctggtatggagtacctggagtctaagtgttgtattcatagggatctggctgctcggaactgccttgtaactgagaagaacgtcctgaagatttccgattttggcatgtccagagaggaagctgatggtgtctatgcagcctctggcggattgcgacaagtgcccgtcaaatggaccgctccagaggccctaaactatggcagatactcctctgaaagcgatgtgtggtcattcgggatcctgttgtgggaaacattctcgctcggcgcttctccgtacccaaatctttcaaaccaacagactagggagttcgtcgaaaaaggcgggcgactgccatgtcctgagctttgcccagacgctgtcttccgcctgatggaacagtgttgggcctatgaaccaggccagaggccttcatttagcacaatctatcaggagttacagagcataagaaagaggcaccgatag

SEQ ID NO: 15190 - DNA, 444 bp, Artificial Sequence
  Description of Artificial Sequence: Synthetic coding sequence
atgggctttagcagcgaactgtgcagtcctcagggccatggggttcttcagcagatgcaagaagcagagctgaggctcctggagggcatgaggaagtggatggctcagagagtgaaaagcgaccgtgagtacgcagggttgctgcatcacatgtctctgcaggattccggaggacagtctagggccatatcaccagacagtcctatttcgcaaagctgggccgagatcacatcacagacagagggcttgtcaaggctgctccggcagcacgctgaggacctcaacagcggacccctgtctaaactctcgctcctgatcagggaacggcaacagctgcgcaaaacttacagtgaacaatggcagcaattacaacaggaactaaccaagacccattcccaagatatcgaaaaacttaaatcccaatacagagccttggctcggtag

SEQ ID NO: 15191 - DNA, 1638 bp, Artificial Sequence
  Description of Artificial Sequence: Synthetic coding sequence
atgggtttttcttcagaactctgttcgccacaggggcatggcgttcttcaacagatgcaagaggccgaactaagactcctggagggaatgcgaaagtggatggcccagcgggtgaaatctgaccgggaatatgccggattactgcatcatatgagtctgcaggatagcgggggccagtctagagcaatttccccagattcaccaatcagccagagctgggctgaaatcacgagccaaaccgagggactttcacgactactcaggcagcacgccgaagacctcaactctggacctctgtctaagctaagtcttctcatccgggaaagacagcagctgcgcaagacttattccgagcagtggcagcagctgcagcaggagctcaccaaaacccattctcaggacatagaaaagttgaaatcccagtatcgggctctggcgcgggattccgcccaggccaaacgaaagtatcaagaagcatcgaaggataaagatcgggataaagccaaagacaaatatgtgagatcgctgtggaagctgtttgctcaccacaaccgatatgtgctgggcgttcgggctgcacagctgcatcaccagcatcatcaccaactcctcctgcctgggctactacggtcactgcaggacctccacgaggagatggcatgtatcctcaaagagatcttacaggagtatctggaaataagttcactggtgcaggacgaagtcgtggccatacatcgagagatggccgcagccgccgctaggattcagccggaggcagagtaccagggcttcttgcggcagtatgggtccgctccagacgtgccaccgtgcgtgaccttcgatgagtccctcttggaggagggtgagcctctggagcccggcgagctgcagttgaacgagctgaccgtggaaagtgtgcagcacacattaacaagcgtgaccgacgagctggctgtggccacagagatggtgtttcgacgccaggagatggtaacacagctgcagcaggaattaaggaacgaggaggagaacacacaccctagggagagggtacagctattgggtaaacgtcaggtgttgcaggaagccctgcagggcctccaggtcgccctttgttcccaggccaaattgcaagcccaacaggaattgttgcagaccaaactcgaacacctaggaccaggcgagccacctcccgtacttctgctccaggacgaccgacattctacctcctcctcggaacaagagcgtgagggtgggcgcaccccaactttagagattctgaaatctcacatttccgggatcttccgcccaaagttctcccttcccccacctctgcagctgattcccgaggttcagaagcctctgcatgagcagctgtggtaccacggagcaattccaagggccgaagtagccgaactgctggtgcatagcggcgacttcctggtccgggaaagtcaaggcaaacaggagtacgtgctgtcagtgctctgggatgggctgccgagacacttcatcatccaggctcacgcaccttcagaatggaggctgctgacccccggacccctgccctgcaggacctgtaccgactggaagggcaaagcattcttagccttcctctgctcatctaccacctactag

SEQ ID NO: 15192 - DNA, 366 bp, Artificial Sequence
  Description of Artificial Sequence: Synthetic coding sequence
atgggattttcatccgagctgtgctcaccccaggggcacggagtactccagcagatgcaagaggcggaactccgactgttagaaggtatgagaaagtggatggcccagagagtgaagtcagacagggagtatgctggcctcttacaccacatgagccttcaagactctggggggcagagcagagctatctcgcctgattccccaataagtcaggtgggcctgtatgggactttagtgggggctggatgtatttgcttgctacttcccctgctgggagccttatgggggtcgggatggaggagcggaaggcctatgttgggtagccactgcgcaccactccctgcttcacctatctgtgcagtttag

SEQ ID NO: 15193 - DNA, 510 bp, Artificial Sequence
  Description of Artificial Sequence: Synthetic coding sequence
atgggtttctcttccgagctgtgctcaccccagggccacggtgtactacaacagatgcaagaggccgagctacggctcctggaaggaatgcggaagtggatggcccagcgggtcaaatcagatagggaatatgccgggctcttgcatcatatgagtctgcaggattctggcgggcagagtcgggcaatctcccccgattccccgatctcacagtcatgggctgagataacctctcagacggaggggttgtcacggcttctgaggcagcatgctgaggatctcaattcaggcccgctgagcaagctgtctctgctaattagggagcgacagcagctgagaaagacctacagtgagcaatggcagcaattgcaacaggagctgactaaaacacactcacaggacatcgagaagctgaagagccaatatagagctttggccagagatagtgcacaggccaagcgaaagtatcaggaagccagcaaggacaaagaccgagacaaagcaaaatag

SEQ ID NO: 15194 - DNA, 2283 bp, Artificial Sequence
  Description of Artificial Sequence: Synthetic coding sequence
atgaagacatgggtcaagatcgtgtttggcgtggcaacaagcgcggttctggcgcttctcgtgatgtgcatcgtgctgcgtccctcccgggtgcacaattcagaagaaaacaccatgcgtgctttgacattaaaggatattctgaatgggactttcagctacaaaaccttttttcctaactggatctccggacaggaatatctacaccagtctgctgacaataatatcgttctgtataatatagagactggtcagagctacactatactctcaaacaggacaatgaagtctgttaatgcctctaattacgggctcagtccagatagacaattcgtgtacttagaatccgactacagtaaattgtggagatatagctatacggccacttattacatctatgatctgagtaacggcgaatttgttcgcgggaatgagttgccgcgtccaatacagtatctgtgttggtctcctgttggttcaaaactcgcctacgtataccagaacaacatctatctcaaacagcgcccaggcgacccccccttccagattaccttcaatggacgcgagaataaaatttttaacgggattcctgactgggtgtacgaggaagaaatgctcgctactaagtatgcgctgtggtggagccccaacgggaagtttctcgcatacgctgagttcaatgacacagacatcccagtgattgcatactcctattacggcgacgaacagtaccctcggaccattaacataccctatccgaaggctggggcgaagaaccccgtggtgcggatctttatcattgataccacctaccccgcctacgtgggtcctcaggaagtgccggtgccagcgatgatcgcatcgtctgattattacttcagctggttgacatgggtcacggacgaaagagtgtgcttacagtggttgaagagagttcagaatgtatccgtgctttccatctgcgacttcagggaagactggcagacatgggattgcccaaaaacccaggagcacattgaagagtcgaggacaggctgggcaggcggattctttgtttccacgcccgtgttttcgtacgacgccatcagctactataagatattcagcgacaaagatgggtacaagcacattcattacattaaagacacagtggagaatgcaattcagattacgtctgggaagtgggaggctattaacatcttcagggtcactcaagattcactcttctatagttccaatgagttcgaggagtatcccggtcgccgcaacatttataggatctcaataggaagttatcccccgagcaagaagtgtgtcacatgtcacctaaggaaggaacggtgtcagtattacacagcttcgttctcagactacgccaagtattacgccctggtgtgttacggccccggaattcccatatcgactctgcatgacgggaggaccgaccaggagatcaaaattttggaagagaacaaggagctcgaaaacgcactgaagaatattcagctgcccaaggaagagatcaaaaagcttgaagttgacgaaatcacactttggtacaagatgatcttacctccccagttcgaccggagcaaaaagtatccacttctgatccaagtgtatgggggcccatgttctcagagtgtgcgatcagtgttcgccgtgaattggatcagttacttggcgtctaaggaaggaatggtcattgctcttgtcgatggccgtggaacagcatttcagggcgataagctcctttatgcagtttacaggaaattaggggtttacgaagttgaggaccagattacggcagtgagaaaatttatcgagatgggtttcatcgatgagaagagaatagccatatggggatggtcttacggtgggtacgttagttctctcgcccttgcgtctggcactggactgttcaagtgtggcattgccgtggcccccgtcagctcctgggaatactatgccagtgtgtatacagaacgcttcatgggcctgcccaccaaggacgacaatctggaacattataaaaattcgaccgtaatggcacgcgccgaatatttcagaaacgtagactacctacttatccacggcaccgctgacgacaatgtacactttcagaactccgctcaaatcgccaaggccctggtcaacgcacaggttgactttcaagcgatgtggtacagtgatcaaaaccacggactgagcggcctcagtactaatcacctttacacgcacatgacgcactttttgaaacagtgttttagcctaagcgattag

SEQ ID NO: 15195 - DNA, 2208 bp, Artificial Sequence
  Description of Artificial Sequence: Synthetic coding sequence
atgaagacttgggtaaagattgtttttggcgtggcaacatccgcagtcctggcgttactggtgatgtgtatcgtactgcggcccagtcgggttcataattctgaagaaaatactatgcgcgctttgacgctgaaagatatcctcaatggcacctttagctacaaaacattttttcctaactggatcagtggccaggaatatctgcaccaatctgcagataacaatatcgtcctctataatatcgagactggtcagagctacacgattttgtctaacaggaccatgctttggcgatattcatacactgcaacatactacatctacgatcttagtaacggagagttcgtgaggggaaacgaactaccccggccaattcagtacttgtgctggagccctgttggaagtaagctcgcctatgtgtaccagaacaacatctatctcaagcagagaccgggcgacccaccattccagattaccttcaacggtcgtgagaataaaatatttaatggcattccggactgggtctatgaggaggagatgctggccacaaaatacgccttgtggtggtcaccaaacggaaaatttctggcatatgcagagtttaatgacaccgacatccctgtgatcgcctattcatattatggagacgaacaatatcctcgcaccatcaatattccctatcccaaggctggggcaaaaaaccccgtagttcgtattttcattattgacaccacttaccctgcgtacgtggggccacaagaggtgccagtaccggccatgatagcttccagtgactactacttttcttggttgacctgggtaaccgatgaaagagtgtgcctgcagtggctcaagcgagtccagaatgtgagcgtactctctatctgtgatttccgcgaagactggcaaacatgggactgtccgaagacacaggagcatatagaggaatcaaggactgggtgggccggcggattcttcgttagcaccccagtgttctcgtatgacgccatcagttattataaaatttttagcgataaagatgggtataagcatatccattacataaaagacaccgtcgagaatgcgatacaaatcacctccggaaagtgggaggcgatcaatatattcagagtgactcaggattcactgttttatagctccaacgagttcgaggaataccctggccggaggaacatttatagaatctctattgggtcgtaccccccctcgaagaagtgcgtaacttgccacctccgtaaagagcggtgtcagtattacaccgcatcgtttagcgactatgccaagtattacgccctggtatgttacggacctggcattcctatttctaccctccacgacggcagaaccgatcaagaaattaagatactagaggagaacaaagagctcgagaatgcacttaaaaacattcaactgccgaaggaagaaattaagaagttagaagttgacgagatcaccctctggtataagatgatcttgccccctcagtttgaccgcagcaagaagtaccccctactgattcaagtgtatggcggaccctgctctcagtcagtccgtagtgtctttgccgtgaattggattagctatcttgcgtccaaggagggcatggtgatcgcgctcgtagatggccggggaaccgcattccagggcgataagttactctatgctgtttataggaagctgggcgtgtatgaagtggaagaccagataactgccgtgcgcaagtttattgaaatgggctttatcgacgagaagaggatcgccatatggggttggtcatacggaggatatgtgagctcactcgctctcgcctcagggacagggctgttcaaatgcgggattgcagtcgctccggtatcctcctgggagtattatgcctccgtgtacaccgaaagattcatggggctgcccaccaaggatgacaacctggaacattacaaaaacagcaccgtaatggcccgtgcagagtatttccgaaatgtggattatctcttgattcatggaacagccgacgacaacgttcatttccagaattctgcccaaattgcaaaagcccttgtcaacgcccaggtagactttcaggccatgtggtacagcgatcagaaccatggtttaagcggactctctactaaccacctctacactcacatgacgcattttctgaaacaatgcttctcactgagcgattag

SEQ ID NO: 15196 - DNA, 468 bp, Artificial Sequence
  Description of Artificial Sequence: Synthetic coding sequence
atggccgagggcgaaatcaccaccttcacagcgttgacagaaaagttcaatctgccccctgggaattacaaaaagcctaagctcctgtattgctccaacggaggacacttcttgcgcattctaccagacgggaccgttgatggaacgcgcgacagaagtgaccagcatatccagcttcagctatccgctgagagcgtgggcgaagtgtatatcaagtccactgaaactgggcagtacttagccatggacactgacggcttgttgtacggaagccagactcccaatgaggagtgtttgttcctagagcgcctggaggagaaccactataatacgtacataagcaagaagcatgcagaaaaaaattggttcgtcggtcttaagaagaatgggtcttgcaagaggggcccgcggacacactatggacagaaagcaatcctgttcctccccctccctgtctcctcggactag

SEQ ID NO: 15197 - DNA, 468 bp, Artificial Sequence
  Description of Artificial Sequence: Synthetic coding sequence
atggcggagggcgagataactacattcacagcactgacagaaaaattcaatctgcctccaggcaactacaaaaaaccaaaactgctttactgctctaatggtggccacttcctacgtatcctgcccgacggcacagttgatgggacccgcgatcgctccgatcaacatattcaactgcagctgagtgccgaatcagtgggtgaggtctatattaaaagtacggaaacgggccagtatctggccatggacaccgatggcttgctttatggcagtcagactcccaatgaagaatgcttattccttgagaggctcgaggaaaaccattataatacctacatttcaaagaaacatgcggaaaaaaattggttcgttgggctcaagaaaaacggctcatgcaagcgcggtcctcgcacacattacggacaaaaagcgattctctttctacctttgccggtgtcatccgactag

SEQ ID NO: 15198 - DNA, 468 bp, Artificial Sequence
  Description of Artificial Sequence: Synthetic coding sequence
atggccgaaggggaaattactacatttaccgcactgaccgagaagttcaatttgccccccgggaattataaaaagccaaaactgttatattgttccaacggtggccattttttgagaattttgcccgatgggacagtcgatgggactagggaccgatccgatcagcacatccagctgcaattaagcgccgagagcgtcggtgaggtatatatcaagtcaaccgagacaggtcagtacctcgcaatggacacagacggactactgtacggaagtcagacccccaatgaagagtgtcttttcctcgaacggctcgaagaaaaccattataatacctatataagcaagaagcacgctgagaagaactggtttgtcggcctgaagaagaatggttcatgtaaacgagggccgagaactcactatggacaaaaggccattctgtttttgccacttcccgtatcgtcagattag

SEQ ID NO: 15199 - DNA, 177 bp, Artificial Sequence
  Description of Artificial Sequence: Synthetic coding sequence
atggctgagggagagattactactttcactgcactcactgagaaattcaacctacctcccggaaactataagaaaccaaaactgttgtattgttcgaatggaggacattttttgcggatactacccgacgggacggttgacggcactagggacagatctgaccaacatattcaatag

SEQ ID NO: 15200 - DNA, 126 bp, Artificial Sequence
  Description of Artificial Sequence: Synthetic coding sequence
atggccgagggagagatcacaacattcaccgctctgactgagaaattcaacttaccccccggaaactacaagaaacctaagctgctgtattgttcaaatggcggccactttctgcgaattctgtag

SEQ ID NO: 15201 - DNA, 468 bp, Artificial Sequence
  Description of Artificial Sequence: Synthetic coding sequence
atggctgagggggagatcacaacctttacggccctcacagaaaaatttaacctccctccagggaactacaaaaaacctaagctgctgtattgtagcaatggcggccactttctgcggatcctgcctgacgggacagtcgacggcacgagagataggtcagaccaacacattcagctgcagctttccgcagagtctgtgggcgaagtgtacattaaaagcacggagaccggacagtacctggcaatggacacagacggattgctgtacggatctcagactcccaatgaagaatgcctttttttggaacgtctcgaagagaatcattataatacatacatctccaaaaagcacgccgaaaaaaattggttcgtcggactgaagaaaaatggatcttgcaaaaggggaccacgtacgcactatggccagaaggccatcctgttccttcccctgcccgtttcaagcgattag

SEQ ID NO: 15202 - DNA, 468 bp, Artificial Sequence
  Description of Artificial Sequence: Synthetic coding sequence
atggccgagggcgagatcaccacctttaccgctcttaccgagaagtttaacctgcctccaggaaattacaagaaaccgaagctactttactgtagtaatggaggccacttcctgaggatactcccggacggtaccgtcgacggcacccgcgaccgttctgaccagcacattcagcttcagttgagcgctgagagtgtgggagaagtgtacatcaaatctaccgagacgggtcagtacctcgcgatggatacagacggactgctgtacggcagccagacacccaatgaggagtgcttgtttttggaaagactcgaggaaaaccactataacacttacatctctaagaaacatgccgaaaaaaactggtttgtcggtctcaaaaagaatgggagctgcaagcgaggccccaggactcattacgggcagaaagctattttatttctgcccctgccggtgtcaagcgattag

SEQ ID NO: 15203 - DNA, 183 bp, Artificial Sequence
  Description of Artificial Sequence: Synthetic coding sequence
atggccgaaggagagatcaccacgttcacagcattaacagaaaagttcaatctccccccaggtaattataagaagcctaaactgctgtattgctccaatggcggccacttcctgcggatcctgcccgacggcactgtggatgggacgcgggaccgttccgatcaacataccgacacaaaatag

SEQ ID NO: 15204 - DNA, 627 bp, Artificial Sequence
  Description of Artificial Sequence: Synthetic coding sequence
atgtggaaatggatattgacccactgcgcctcagcgtttcctcaccttccaggctgctgttgctgctgctttttgctgctgtttttggtgtccagtgtgccagttacttgccaggcccttggtcaggacatggtctcccccgaggccacgaattcaagctccagttccttttcctcacccagttccgctggcaggcatgtcaggtcatacaatcatctgcagggcgacgtccgttggagaaagctcttctcattcacaaagtattttctgaaaatcgagaaaaatggaaaagtctccggcaccaaaaaagagaattgtccttatagtattctggagattacttctgtcgaaatcggtgttgtcgccgtgaaagccatcaactccaactactatctagctatgaacaagaaggggaaactctatggctctaaagagttcaacaatgactgcaagttaaaagaacgcatagaagagaatggttacaatacctacgcttccttcaattggcagcataatggtagacagatgtacgtggcccttaacggcaagggcgcgccacgaaggggccaaaaaacacggcgtaaaaacacttctgcacacttcctccccatggtggtgcactcttag

SEQ ID NO: 15205 - DNA, 201 bp, Artificial Sequence
  Description of Artificial Sequence: Synthetic coding sequence
atgtggaagtggattctcacacactgcgcctcagcctttcctcacttgcctgggtgctgttgttgctgcttcctgttgctgtttctagtctcaagcgtaccagtgacgtgtcaggctctgggtcaggatatggtctcccccgaagccacgaacagttcctctagcagtttcagcagtccatcatcagcaggccgccactag

SEQ ID NO: 15206 - DNA, 867 bp, Artificial Sequence
  Description of Artificial Sequence: Synthetic coding sequence
ctggttggtgttgggggcggtgacgttgaggatgttaccccccggcctggtgggtgtcaaatctcaggccggggcgcacgagggtgcaacggcattcctggagccgctgcttgggaggccgcattgccgaggaggcgaccaagaagacacccaagtgttaaccccagaagccgggccgctggaagtcctcgcaccaggggaagacgcacggaagagagaccatccggctcccggctgggggatcggggccgcggcagggcactgccgggcggccgcctgggaggccggggcagaggacgcgcccccgagcgagtcggcgggcgcggccgcggccggggcactgctgccccaagggcggcgccagctgcaagaggatcacgccccggacccgctggaacaatggccgcgggaagcatcaccaccttgcctgcattgcctgaagacggcgggtcaggtgcatttccccccggccacttcaaggatccgaagagattatactgcaaaaacggcggattctttctgaggatccaccctgatggtagagtggatggagtgagggagaaaagcgatcctcatatcaagctgcagttgcaggctgaagaaagaggtgttgtgtccattaaaggtgtatgtgcaaatcgctacctcgccatgaaagaggacgggcgcctactggctagcaaatgtgtgacagacgaatgtttcttcttcgaaagattggagtccaacaactacaacacataccggagccgaaaatatacctcttggtacgtggcactaaaacggacgggacagtataaattgggatcaaaaaccgggcctggccagaaggccatccttttcctgccaatgagtgccaaatcctag

SEQ ID NO: 15207 - DNA, 585 bp, Artificial Sequence
  Description of Artificial Sequence: Synthetic coding sequence
atgcacaaatggattcttacttggatactgcctaccttgctgtacagatcatgtttccatatcatatgtctcgtaggaaccattagcctggcatgtaatgatatgactcctgagcagatggcaactaacgtgaactgttcatcacctgagcggcatacacgcagctacgattatatggaaggcggcgacatccgggtccgccgcctgttttgtcgtactcagtggtacctccgcatagacaagcgaggtaaggtcaagggcacccaggagatgaaaaacaattacaacattatggagataaggactgttgcagtgggcatcgttgcaatcaaaggagtggagagcgagttttatcttgctatgaacaaggaaggcaagctttatgcaaaaaaagaatgcaacgaggactgtaattttaaggagttgatcctggaaaatcactataacacctacgcgagtgcaaaatggacacataacggcggagaaatgttcgtggccctgaatcagaagggcatccccgtccgcggcaaaaaaactaaaaaagaacagaaaaccgcccactttctgcccatggcaattacatag

SEQ ID NO: 15208 - DNA, 585 bp, Artificial Sequence
  Description of Artificial Sequence: Synthetic coding sequence
atgcacaagtggatattgacctggatccttcccacccttctttatcggtcatgttttcatattatttgcttagtgggcacgattagtctcgcttgtaacgacatgacccccgagcaaatggctaccaacgttaactgctcatccccagagcgccatactagatcctacgactatatggagggtggggacattagagtgagacggcttttttgccggacccagtggtatttaaggattgacaagcgaggcaaagtgaaaggcacacaagagatgaagaacaactataatattatggagatccgaactgtcgccgtcggcatcgtggccataaaaggggtggagagcgagttttacctggctatgaataaagaagggaagctgtatgcgaagaaggaatgtaacgaggattgcaacttcaaagagttaatattggagaatcattataacacttatgccagtgccaaatggactcataacgggggagagatgttcgtcgctctgaaccaaaaggggatccccgtccggggtaaaaagacaaaaaaggagcagaaaacagcccatttcttacccatggccattacctag

SEQ ID NO: 15209 - DNA, 705 bp, Artificial Sequence
  Description of Artificial Sequence: Synthetic coding sequence
atgaaaatctgctcactcaccttgctgagcttcttgctgctggctgcccaggtgctcctggtcgaaggaaagaagaaggttaagaacggcttacatagtaaggtggtttcagaacagaaggataccttgggcaacacccagatcaagcagaaatctcggcccgggaataagggaaagttcgtcacaaaggatcaggccaattgtcgctgggctgcaacagagcaagaggagggcatctctctaaaggtagaatgtactcaactggatcacgagttctcatgcgtctttgccggtaaccccacctcctgcctaaaactgaaggatgagcgggtctactggaaacaggtggcacggaacctgcggagccaaaaggacatatgccggtatagcaaaacggctgtcaagacacgtgtttgccgcaaggatttcccagaatcatccctgaaactcgtctcctcaactctttttgggaacaccaaaccaaggaaagagaaaaccgaaatgtcacctagggaacacatcaaaggcaaggagaccactccgagtagcctggcggtcacacagactatggccactaaggctcccgaatgtgtggaagacccggatatggcaaatcagagaaaaacagctctggaattttgcggcgagacctggtcgtccctgtgtacattcttcctgtcgattgtacaagacacatcttgctag

SEQ ID NO: 15210 - DNA, 705 bp, Artificial Sequence
  Description of Artificial Sequence: Synthetic coding sequence
atgaaaatctgctccctcacccttctctcattccttctgctcgccgctcaggtgctattggtggaaggaaaaaagaaggtgaagaatgggttgcactcaaaagtagtgtcagagcaaaaagacacgctgggaaacacacagattaagcagaagtcgagacctggtaataagggcaaattcgttactaaggatcaagccaactgtcggtgggctgcaacggaacaggaagagggaatcagcttaaaagtggaatgcacgcagttggatcacgagttcagttgtgtcttcgccggaaatcccacttcatgcctgaaactgaaagacgagagagtgtactggaaacaggtcgccaggaatctgcggtctcagaaggatatatgtagatatagtaagacagcagtgaaaactagagtctgcagaaaagatttccctgagtcgtccctgaaacttgtgagcagtacgcttttcggtaacactaagcccagaaaagagaagaccgaaatgtccccacgggaacacattaagggcaaggagactaccccaagttctttggcggtgacacaaaccatggcaacgaaagcccccgagtgcgtagaggatcctgacatggcaaaccagcgtaagacagcactggaattctgcggagaaacctggagtagcttatgtactttctttctgtccatcgtacaagatactagctgctag

SEQ ID NO: 15211 - DNA, 2421 bp, Artificial Sequence
  Description of Artificial Sequence: Synthetic coding sequence
atgggcgcacctgcctgtgccctggcactgtgtgtggcagtggctatcgtggcaggcgcgtcttctgagtcactgggcaccgaacaacgggtcgttggtagggccgcggaggtcccaggccccgagccaggacagcaggagcagttggtttttggttcaggcgatgcggtggaactgagctgtccaccacctggaggtggccctatgggtccaaccgtatgggtcaaggatggcacgggcctggtgcccagcgaaagggtcctggtaggaccacagcgtctgcaggtacttaatgcttctcacgaagacagtggggcttactcttgccgccaacggctgactcagcgtgttctgtgccacttttccgtccgagtaactgacgctcctagctcaggagatgatgaggacggcgaggacgaagctgaagacactggcgtcgataccggcgccccttattggacacggcctgaacgcatggataagaaattactggcggtgcctgccgcaaataccgtcagattcagatgtccagccgccggtaaccctactcccagcatttcctggctcaagaacgggcgagaatttcggggcgaacacaggattggtggcataaaactccgccaccagcaatggtcattggtgatggagtctgttgtgccctcagaccggggcaactacacctgcgtggtcgagaacaaattcggatccattcgccagacatacacgctagacgtcctggaaagatcccctcacaggccaatcctgcaggcaggactgcccgccaaccaaacagcagtgcttggatccgatgtcgaatttcattgtaaggtgtacagcgacgcacagccacacatacagtggctgaagcacgtcgaggtgaacgggagtaaggtcggccccgatggtactccgtacgtcaccgtgcttaagacagccggcgcaaataccacagataaagaactggaagtgttgtccctgcataacgtgacttttgaggacgcaggagagtacacttgcctggctggcaacagcataggcttcagtcatcattcagcttggttagtagtgttgccagctgaggaggaactggtagaagctgatgaagcggggtccgtttacgcagggatcttaagttacggcgtggggttcttcctgtttattttggtggttgctgctgtgaccctgtgtagattacggtcacccccaaaaaaagggctggggagtcccactgtgcacaagatctcccgcttcccacttaagaggcaagtgtccctcgaaagcaatgcttcgatgtcttctaacacccccttggttaggatcgctcgtctaagcagtggcgagggtccaacactcgcgaacgtgtcagagttggaactgccggcggaccctaaatgggaactgtctagagcccggctgacgcttggaaagcccttaggcgagggatgcttcggccaggttgtaatggctgaagctatcggtattgataaggacagggccgcaaagccagtgaccgtcgctgttaagatgctgaaagatgacgcaacagataaggatctgtccgacctggtttcagagatggagatgatgaaaatgattggcaagcacaaaaatattatcaatttgctgggcgcatgtacccaagggggccccctatacgtgcttgtggaatacgcagcaaaaggaaaccttcgcgagttcctgagagcacgacgaccaccagggctcgattacagcttcgacacttgcaaacctccggaggaacaactgacatttaaagatctggtcagctgtgcgtaccaggtggcccgtggtatggagtatctggcttcacagaaatgcattcatagggatctagccgcccgcaatgtgctggtgaccgaggacaacgtcatgaagatcgctgacttcggcctggcgagggatgttcataatctggactactataagaagaccacaaatggacggctaccagtgaagtggatggcgcccgaggccctgttcgatcgagtttacacacaccagtcggacgtctggtccttcggggtcctcctctgggagatctttacactgggcgggtctccttacccaggaattcccgttgaagagttatttaagctcctgaaggagggccaccgcatggataaacctgcgaattgcactcatgacctgtacatgatcatgcgcgaatgttggcacgccgccccctcccagagacctacgtttaaacaactcgtcgaagatctagaccgcgtcctcacagtcacttctactgacgagtaccttgatctcagcgcccccttcgagcaatactcacctggcggccaggacacgcctagctccagttcaagcggcgacgattccgtgttcgcccatgatctactgcccccagctccccctagcagcggcggttctaggacatag

SEQ ID NO: 15212 - DNA, 513 bp, Artificial Sequence
  Description of Artificial Sequence: Synthetic coding sequence
gaataccttgatctgagtgccccgttcgagcagtattccccaggtggccaggacaccccaagctcttcatcctccggcgacgattccgtattcgcccacgatttactcgccacaggcccacagcagtgcgagggcagcctggctgcccaccccgctgctggtgcccagcccctgcccgggatgaggctgtccgccgacggtgagaccgccacccagtcattcgggctatgtgtctgcgtctgtgtctgtgtctgctgcacaagtgcctgcgcatgcgtgcgggctcatcttgcaagcaggtgtcgagggaccctcggagtgcctgcagcggtacagaggagccccgactggtgttgctctactgaggggccgctcttttggggagaccctgttcagaatgtctcaggtccaactcgatgggatcctgggcagggcgcaggaccggacatgagaccactgccactgcatcacggcacctcccagggccttggaccatctcatacccagtcctag

SEQ ID NO: 15213 - DNA, 2427 bp, Artificial Sequence
  Description of Artificial Sequence: Synthetic coding sequence
atgggagcccccgcgtgcgcactcgcactgtgcgtcgcggtggcgattgtcgccggagcatcctcagaatccctggggactgagcaaagggtcgtcggccgagctgccgaggtgcctgggccagagcccgggcagcaagagcagctggtcttcggtagtggcgacgctgtggagctgagctgtcctcctcctggagggggccccatgggacccactgtctgggtcaaggacggtactgggctggtcccaagtgagagagtgctggtgggccctcagaggctgcaggttctcaacgcatctcacgaagactctggagcatattcatgccgacaaagattaactcagcgtgttttatgtcacttctcagtccgcgtgacagatgctcctagctcgggagacgacgaagatggagaggatgaggccgaagatacaggcgtcgacacaggcgcaccttactggaccagacctgagcggatggacaagaagctgctggccgtccccgctgctaatacagttaggtttcggtgccccgccgctggaaaccccacaccatcaatctcttggctcaagaatggtcgcgaatttcgaggtgagcacaggataggcggcataaagttgcgccaccagcaatggtccctagtcatggaaagcgtggtacctagcgataggggtaattacacatgtgtcgttgaaaataaattcggcagcatccgccaaacatatacccttgatgttttagaacgatccccacatcgtcccattttacaagccggcttgccagctaatcaaactgccgtccttggaagcgatgtggaatttcattgcaaggtgtactctgatgcacagcctcacattcagtggttgaaacacgtcgaggtgaatggatctaaagtgggacccgatggaactccttatgtgaccgtgctgaagagctggatctctgaatctgttgaagcagacgtgcggctgagactggcaaacgtgtctgaaagggatggcggggaatacctgtgccgagctaccaattttatcggagttgctgaaaaggccttttggttgagcgtgcacggtccccgagccgcagaggaggaactggttgaagcagacgaagccgggtccgtgtacgctggaatcctctcctatggcgtgggattcttcctgttcatactcgtggttgccgccgtgacattatgtcgcctcagatccccaccgaaaaaaggacttggaagcccgacagttcacaagatcagtagatttcccttgaaaagacaggtttctttggaatccaacgcatcaatgagctccaataccccattggtgcggatcgctcggctgtcttcaggggaaggccctactcttgctaatgtgagcgaacttgaactcccagccgaccctaagtgggaattgtctcgggcacggctgaccctcggaaaaccactcggagaaggatgctttggccaggttgtgatggcagaggctattgggattgacaaggaccgcgccgcaaagccggtaactgttgccgtgaagatgctcaaagacgacgccacagacaaagatctgagtgacctggtgtccgagatggagatgatgaaaatgatcgggaagcacaaaaatatcataaatctgttgggagcctgcacccaaggcggaccactatacgtactagtggagtatgctgctaaaggcaatctgcgtgagttcctcagggcgcggcggcctcctggcctagactactcctttgacacatgtaaacccccggaagagcagttgactttcaaagatcttgtcagttgcgcttaccaggtcgcccgaggcatggagtacctggctagccagaagtgcatccacagagatttggctgcccgaaatgtgctagtgacggaggacaacgtgatgaaaattgccgactttgggttggctcgcgatgtgcacaacctggattactataagaaaaccaccaacggtcgcctaccggtgaagtggatggcgcctgaagcgctgttcgaccgcgtttacacacatcagagcgacgtgtggtccttcggggtgcttctctgggaaatcttcaccttgggcgggagtccttatccaggcatccctgtcgaggaacttttcaaactgcttaaggaggggcacaggatggacaagcctgcgaattgcacgcacgatctttatatgattatgcgggaatgttggcatgcggccccttcacagcggccaactttcaaacagttagtggaggatctagaccgggtgctcaccgtgaccagtactgacgagtacctggatctgagtgcccctttcgagcagtatagtcctggggggcaagacactccgagttcttcttcatctggcgacgattccgtgttcgctcatgaccttttaccacctgcccctccttcaagcggaggctcccgaacgtag

SEQ ID NO: 15214 - DNA, 2085 bp, Artificial Sequence
  Description of Artificial Sequence: Synthetic coding sequence
atgggcgctcccgcatgcgcactggctctgtgcgtggctgtcgccatcgtggctggggcctcctccgagagtctcgggaccgagcagcgggtggtaggccgtgcagccgaagtgcccggcccagagcccgggcagcaggagcagctggtgttcgggtctggggatgcagtggagctttcctgtcctcccccaggcggcggacctatgggccctacagtgtgggtcaaagacgggaccggactcgttccttccgagcgggtgctggtcgggccccaaagactgcaggtgttaaatgcaagccacgaagattctggggcctactcctgtagacagcgccttactcagcgggtgctgtgtcatttctctgtgcgggtgaccgatgcaccttcctcaggggacgatgaggatggggaggatgaggctgaggacactggggtggacactggcgccccctactggacaagacctgaaaggatggacaagaaattactcgccgtgccagcagccaacactgtgagattccgctgtccggctgctggaaacccaactccaagtatctcctggctaaagaatgggcgagagtttcgcggggagcaccgtattgggggaattaaattgcggcaccaacagtggagcctggtgatggagagcgtcgtgccctctgacaggggtaactacacctgcgtggtcgagaataagtttggatctatacgccagacgtatacactcgatgtactagagcgatcccctcatcggccaatcctgcaggctggcctgcccgctaatcagacggctgtgctgggcagtgatgtggaattccactgcaaggtgtattccgatgcccagccccacattcagtggctgaaacatgtcgaggttaacggttctaaggtggggcctgacgggacaccgtatgtcacagtgctcaaggtgagcctcgaatctaatgcttcgatgtcgagtaacacccccctcgtaaggatagcccgactcagcagcggagaagggcctaccttggctaacgtaagcgaactggaactacccgccgaccctaagtgggagctctcacgcgctcgactcacattgggtaagcctctgggcgagggctgttttggacaggttgtgatggcggaagctatcgggattgacaaagacagggcagccaaaccagtgactgtggcagttaaaatgctgaaagacgacgcaaccgataaggacctgtccgacttggtctctgaaatggagatgatgaagatgattggaaagcataaaaacattattaacctacttggcgcttgtacccagggcgggcctctgtacgtgcttgttgagtacgctgctaagggcaaccttcgcgaatttcttagggccaggcggccccctggcctggactattcatttgacacgtgtaagccacctgaagagcagcttacgttcaaagatctggtgagctgtgcctaccaggttgctcgtggcatggaatacttggcgtctcaaaaatgcatccaccgcgacctagccgcccgtaacgtgttggtcacggaggacaacgtgatgaagatagccgattttggactggcacgcgatgttcataacttggattattataagaagaccaccaatgggcgcctgcccgtgaagtggatggcgcccgaggcactttttgatcgcgtgtacactcatcagagcgacgtgtggtcctttggagtcctgctgtgggagatttttacactcgggggaagtccgtatcccggaattccagtagaggaactttttaagctcttgaaagagggacacagaatggataagcctgcaaattgtactcatgatttgtatatgataatgcgggaatgctggcacgccgccccctcacagaggccaaccttcaagcaactcgtagaagacctggaccgcgtgctcacagttacctcaacggacgaatacctggatttatccgccccctttgaacagtattctcccggcggccaggacactccctcttcaagttcatctggcgatgactccgtcttcgcccacgatctgctcccccccgcccctccctcgagcgggggatcgaggacgtag

SEQ ID NO: 15215 - DNA, 2421 bp, Artificial Sequence
  Description of Artificial Sequence: Synthetic coding sequence
atgggggcccccgcctgtgctctggctttgtgcgtcgctgtggctattgtcgctggcgcttcttctgaatccctgggcactgaacagcgggttgtcggacgggccgccgaggtacccgggcccgagcccggacagcaggagcagctggtgtttggatctggggacgcggtggaactaagctgcccaccccccgggggcggaccaatgggaccaactgtgtgggtgaaggatggtacaggcctggttccaagtgaaagagtgctggtgggcccacagagactgcaagttcttaacgcttcgcacgaggacagtggggcctacagctgcagacaacgactcacccagagggtgctctgccatttcagcgtgcgagtgacagatgctccgtcaagcggcgacgatgaagacggtgaagacgaggctgaagataccggtgtggacactggggcaccttactggaccaggcccgaacgaatggacaagaagcttcttgctgtacccgcagccaacacagtccggtttaggtgccctgcggcggggaaccccacgcctagcatatcatggctgaagaacgggagagaattcaggggcgagcatcgaattggtggaattaagctgcgtcaccagcagtggtctcttgtaatggaatcagtggttccgtcagatcgagggaattatacctgcgtcgtcgaaaacaaattcggatccattcggcagacttatactctggacgtgctggagcgcagcccgcatagacccattttgcaggctggcttacccgcgaaccagacggctgtccttgggtcagatgtggagtttcattgcaaggtgtactcagacgcccagccacatatccagtggctcaagcacgttgaggtgaacggtagcaaagtaggccccgatggaaccccttatgtgactgtcctgaagactgcaggagcaaataccaccgataaggaattggaagtactgtcccttcacaacgtaacctttgaggatgcgggtgaatatacttgcctcgcagggaacagtataggcttcagtcaccactctgcttggctggtggtgttgcccgccgaagaggaactggtggaagctgacgaggctggcagtgtctacgctgggatcctctcttacggcgtcggcttcttcctgttcatcttagtcgtcgcagccgttactctgtgcagactaaggagcccgcccaagaagggactgggctcccccactgttcacaaaatatccagatttccactgaagcgacaggtttcattggagagtaatgcaagcatgtcatccaacaccccactggtgagaatcgcccggctatcatcaggagagggtccaaccttggcaaatgtgagtgaactagaactacctgccgaccctaagtgggagctctcccgcgcgagactgaccctgggtaaacctcttggcgaagggtgcttcggccaggtggtgatggccgaagctattggaattgataaagatagggcagccaaaccagtaaccgttgccgtaaaaatgttgaaggacgacgcaaccgataaggatctcagtgacctggtctccgaaatggagatgatgaagatgattggcaaacataagaacatcatcaacttgttgggggcatgcacccaggggggccccctgtatgttttagtggagtacgcggctaaagggaatttgagggagttcctccgtgcccgtagaccacccggactggattactccttcgacacatgtaaacccccagaagagcagcttacttttaaagatctggtgtcatgcgcctatcaggttgccagaggaatggagtatctggcctcacagaagtgcattcatagggacttggctgcccgcaatgtcctggtaacagaagacaatgtcatgaagatagctgatttcgggctggcccgagatgtgcacaatctggattattacaagaaaacaactaatgggcggcttccagtgaagtggatggcgccagaggccctgttcgacagagtctacacgcatcaatctgatgtctggtccttcggcgtcctgctgtgggagatcttcaccctgggggggtctccgtatccggggattccggtggaggagctattcaaacttttaaaggagggacaccggatggataaaccagccaattgtacccacgatctctatatgatcatgcgcgagtgttggcatgcagcccccagtcagcgacccacgtttaagcagctggtggaagacttagatagggtgctgaccgttacctcaactgatgaatacttagacctgagtgcaccatttgaacaatactcaccaggtggtcaggataccccaagttcttcttcaagcggagatgatagcgtcttcgcccacgacctgctgccaccggctccaccttcgagtggaggctctcgtacttag

SEQ ID NO: 15216 - DNA, 2379 bp, Artificial Sequence
  Description of Artificial Sequence: Synthetic coding sequence
atgggagctcctgcctgcgctctggccctgtgcgtggcggttgctatcgtagcgggcgcgagtagtgaaagcctggggaccgaacaaagagttgtgggacgcgccgcggaggttccaggccccgagccaggacagcaagagcagttggttttcggttccggcgatgcagttgaactgagctgtccacctcccggaggcggtcctatgggccccaccgtgtgggtgaaggatggcacaggactcgtgccttccgaacgggtgcttgtcgggcctcaacggctgcaggtgctgaacgcctcccacgaagactctggggcctatagttgtcggcaaagacttacgcagagagtgctttgccacttcagcgttcgggtcacagacgccccatcaagtggagacgacgaagatggagaggacgaggccgaggacactggggtggacacaggcgcgccatactggacaagacctgaacgcatggataaaaaattgctggccgtgccagctgctaatactgtccgcttccgctgccctgccgcaggcaacccaacccctagcatttcttggctgaagaacggccgagaatttaggggtgagcataggattggaggtattaaactgcgccatcagcagtggtcattggtgatggaatccgtggttcccagtgaccgggggaattacacctgcgtcgttgaaaacaagttcggctccatcaggcagacctataccctggatgtgttagagcggagcccgcaccgaccaatacttcaggctgggcttcccgcaaatcagaccgcagttctcggcagtgacgtggaattccattgcaaagtctacagcgatgcacaaccacacatccagtggctcaaacacgtcgaggtgaacggcagtaaagtgggaccagacgggaccccatacgtcaccgtcctcaagaccgccggggcgaacactaccgataaggagctggaggtgctatcactgcataacgttactttcgaggatgcgggagagtacacatgtctggctggtaatagtatcggatttagccatcatagcgcctggctcgttgtgctgccggcagaggaggaactcgttgaagccgacgaggctgggtcggtctatgcaggcattcttagctatggcgtgggcttcttcctttttattctagttgtagcagcggtgaccctgtgcagacttaggagcccccctaaaaaagggctcggaagcccaaccgtccacaagattagccgattccctctgaaaagacagcaggtgagcttggaaagtaatgcgtctatgagctccaatactcccttggtgcggatcgcacgcttgagttccggcgagggacccaccttggcaaacgtttctgaattggaactcccagcggacccaaaatgggagctgtctagggcgcgcctaaccctgggaaagccactcggcgaaggctgctttggacaggtcgtgatggccgaagctattggaatagacaaggatagagcggctaaaccagtgacagtggcagtaaagatgctcaaggatgacgcaaccgataaggatctctctgaccttgtgtcagagatggaaatgatgaagatgattggcaagcacaagaacattatcaacttactgggcgcctgtacgcaaggaggacctctctatgttctcgtagagtatgctgcaaagggcaaccttagggaatttcttcgtgccaggcggcctccaggcttggattactcattcgatacttgcaaaccgccggaagaacaactcacctttaaagatctcgtgagctgcgcttatcaagtggcgcgtggaatggaatatctcgctagccaaaaatgcatacacagagacctggccgcaaggaacgtgctggtgacagaggacaacgttatgaaaatcgctgactttggactggctagggatgtccataacctggattactataagaaaactacaaatctggtgctgtgggggccagccttaggagacctgcacgctggcggcctgccggtccctaggcacccatgtggtggagcactgcaggctgccgaaggtggacctccccacggacaagcacgtcaactacacacacgtccagttcacgatcatgccggggtgttggcctgccgcgctctccctgaggcccacctgcaagccgcagggggcggccctggcccttgtccatatcgagatgtccaccgccgggtacctggacccgtgggagcctttagagccgtactgccgggctggccaggtcatcctcaactccagctgctccggggcagactgagagtgtgccccagaccagctgctccgggcccgacccagcagtgggggctggccgacgtgaaaggacactggtctccaactatgtag

SEQ ID NO: 15217 - DNA, 2409 bp, Artificial Sequence
  Description of Artificial Sequence: Synthetic coding sequence
atgcgccttttactggccctgcttggagtgttgctctccgtccctggcccccccgtcctgagcctggaggcaagtgaagaggtcgaactcgagccttgtctggccccatctctggagcaacaggagcaggagctgaccgttgcacttggtcagcctgtgcggctgtgctgtggcagggccgaaagaggcgggcattggtataaggaaggatcccggttggcaccagcaggtcgcgttcgtggctggcgtggccggttggagatcgcttcattcttgcctgaggatgcgggccggtacctgtgtctcgcccggggatcgatgatcgtcttgcagaatctcacactgattactggcgacagccttaccagttcaaatgacgatgaagatccgaagagccatagggatccatccaatcgacactcctacccccagcaggcaccatactggactcatccacagcgtatggagaaaaaactgcacgcagtacctgctggcaacaccgtgaaattccggtgccctgcagctgggaacccgaccccgaccatcagatggctgaaagacggacaggcctttcatggcgaaaaccgaattggtggtattaggctaagacaccagcattggtccctggtgatggaatctgtggtgccttcagatcgtgggacatacacttgtctggttgagaatgctgtgggatctattcggtataattacctgttagacgtactggagcggtctcctcatagacccatattacaagctggactgcccgccaacacaactgcggtagttggttctgatgtggaactgttgtgtaaggtgtacagtgacgctcagcctcatattcagtggctaaaacacatcgtcatcaacggtagttccttcggggccgatggcttcccctatgtgcaggtcttaaaaaccgcagatattaactcttctgaggtcgaggtgttatatctgcggaacgtgagcgcggaagatgccggggagtacacatgtttggccggcaattcaattggactcagttaccagagcgcttggctcacggtgttgccggaagaggatcccacttggactgccgcggcccctgaagcccggtatacagacattatcttgtacgcctcggggagcctggcccttgccgtacttcttctcctcgccgggctgtatcgcggccaggcattacacggccgacatccacgaccgccagcaaccgtgcagaaactgagccgctttccattggcacgtcagttcagtctggagtcaggaagcagtgggaaaagctcgtccagtctggttcgtggagtgcgtctctcctcctctggccccgcgttactagccgggctggtcagtctggacctgcccttagaccccctttgggagttcccacgggaccgcctcgtactgggaaagcctctgggagaagggtgttttgggcaggtcgtgagggcagaagcctttggcatggacccagcccgacctgatcaggcatctacagtagcagttaagatgttgaaagacaatgcctccgataaagatctagccgatctggtgagcgagatggaggttatgaagctcattggcaggcataaaaatatcataaacctgctaggcgtgtgcacccaggaagggcctctgtacgtcattgttgagtgtgcagcaaaaggcaaccttcgggaatttctgagggcacggcgtcccccaggccccgacctgtcgcctgacggccccagatcgtccgagggaccgctgtcttttcctgtactagtatcatgtgcctatcaagtagcgaggggtatgcagtaccttgaatccaggaaatgtatacatcgagatctcgctgcccgtaatgtgctcgttaccgaagataatgttatgaaaatcgccgattttggattggcgcggggcgtgcaccacatcgactattataagaagacaagtaatggacggcttcctgttaagtggatggcacctgaggctttattcgacagggtttacacccaccagagtgacgtgtggtcgtttggcattctcctttgggagatcttcactctgggtggctccccatacccagggattcccgtggaggagctgtttagcttgctccgggagggccaccggatggatcgccctccacattgtccccctgaactctacggactgatgcgcgagtgttggcacgccgctccaagccagcgccccacctttaagcagctggtggaggcattggacaaggtgttgctcgctgtgtctgaagaatacctagatctgcgtctgaccttcggcccctatagccccagcgggggggacgcttcttccacatgctctagctccgacagcgttttttcgcatgatccattgcctttggggagctcctctttcccgttcggctccggagtccagacgtag

SEQ ID NO: 15218 - DNA, 2289 bp, Artificial Sequence
  Description of Artificial Sequence: Synthetic coding sequence
atgcgactcctcttagcgcttctcggtgtcctcttgagtgtccccggcccccctgtcctgtccctcgaagcatccgaagaagttgaactggagccatgtcttgctccctctctcgagcagcaggagcaggaactgacggtagcgttgggccaaccagttcggctctgttgcggtagggcagagcgcggcggccactggtataaggagggctcacggctcgccccagctggccgtgtgagaggttggagaggaaggttggaaatagcgtccttcctccctgaggacgctgggagatacctgtgtctggccagaggcagtatgattgtgcttcagaacctgaccttaatcactggcgactctcttaccagctcaaacgatgacgaagaccctaagagtcacagagacccctccaatcggcactcttatccacagcaggccccttactggactcatccccagaggatggagaagaagctgcacgccgttcctgctggcaacaccgtcaagttccggtgccccgcggccggcaatcccacccccaccattcgttggctaaaagatggccaagcgttccacggcgagaatcgaattggagggattagactccgccaccaacactggtccctggtcatggaatcagtggtcccctcggacaggggcacctacacttgtctggtggaaaatgccgtcggctcaatccggtacaactacttgctggacgtgttagaacgatcccctcacagacccatcctccaggcaggcctcccagccaataccaccgcagtcgtggggtctgacgtcgaactgctgtgtaaggtttactctgacgcccaaccccacatacaatggctgaagcatatcgtgatcaatggttcttcatttggggccgacggctttccttatgtgcaggtgcttaagacggcagacatcaacagtagcgaggtagaggtactctacctacgtaatgtgagcgcggaagacgccggcgagtacacatgcttagctggcaattctatcggcctgtcctatcagtcagcttggttaacggttttgcctggaactggacgcataccacatttaacctgtgacagcctcacccccgccgggcgcacaaaaagtccgaccctgcaatttagcctggaaagcggtagctctggtaagagtagttctagcctcgttcgtggcgtgagactaagctcctctgggccagccctcctggctggccttgtaagtcttgatcttccactggacccactctgggagtttcctcgcgatcgtttagtgctgggaaaacctctgggagagggctgctttggccaagtagtgagagcggaggctttcggcatggatcctgccagaccggaccaggcttccaccgtggcagtcaagatgctgaaagataatgcatctgataaggacttggctgacctggttagcgagatggaggtgatgaaacttattggtcggcacaagaatattatcaatttactcggtgtgtgtacccaggagggcccattatatgtgattgtggaatgcgctgccaagggtaatcttagagagttcttgcgcgcccgaagaccccctgggccggacctgagtcccgatgggccacgcagtagcgagggacccttaagtttccccgtgctggtcagctgtgcgtaccaggttgccagagggatgcagtacctggaatctcggaaatgtatccatcgagatctcgctgcccgaaatgtgctcgtaactgaggataacgtgatgaagatcgcagactttggactggccaggggggtccatcacattgactattacaaaaaaaccagtaacggccgcctgccagtgaaatggatggctccagaggcattgttcgatagagtgtatacccaccagagcgacgtgtggagttttggcatcctgctctgggaaatcttcacgctgggaggtagtccctatcctgggatcccagtagaagagctattctctctgctccgtgagggccacaggatggaccgaccacctcactgccctccagagctctacggactaatgcgcgagtgttggcacgccgcgccaagccagcgccccaccttcaaacagctagtggaggccctggacaaagtgctactggcagtgtctgaggagtacctagatttgcgcctgaccttcggcccctatagcccttccggcggcgacgccagcagcacttgttcgtcctctgactcagtctttagtcacgacccccttcctctgggatccagttcttttcctttcggaagtggcgttcagacctag

SEQ ID NO: 15219 - DNA, 3093 bp, Artificial Sequence
  Description of Artificial Sequence: Synthetic coding sequence
ccatgcatgtggcaccagcagcacgtgccctgcgtctgcgtttgtccatatgtgtgtgtctgtatgagggtatgtgtttgcgtatgctggcctctcagttgcgccctaaacgcggtatgcgtgacgtgtcctaagtccgtggcctttgcacttggtgtcgccagcgcagcctgcggctgtgtcggtgtcaaagaatggtggctcctgcagcacgccttgcaatctgcctgcgcattgcacgtccgctgcgtgctgtgtacacaagaagccgcaagcgacggcgctgccgggtcggccgacctgtgccctctacccacggaaccgtgtcttgctcctagtttggagcaacaggaacaggagttgactgtggcattgggccagcctgtacgtctatgctgtggccgtgcagagcgtggcggccattggtataaagaaggtagccgtctagctcccgctggtagagttcgagggtggagaggacggctagagattgcaagctttttacctgaggacgcggggaggtatctgtgccttgcccgcggttccatgatcgtactccagaatctgactcttatcacaggggacagtcctcctgcgaccatgatgaggaccccttcccctataggaacaccccgaatcggcactgtaacgccgagcaaagtgtcacgttctcccaggacctgcgttcctgctgctgcccacctcatcactgagaagagaagaccagtctgggagcatacagttatactcggtgccttcccttgcccacctgcgccatactggacccatcctcaaagaatggagaaaaaactacatgcagttcctgcagggaacactgtgaagttcagatgtcccgctgctggaaatccgactcctactataagatggctcaaagatggtcaggcgttccacggggaaaaccggatcggagggatccggttacgtcatcagcattggtcgctcgtgatggagtccgtggtcccttccgaccgcgggacgtatacgtgcctggtggagaacgccgtgggttctatcaggtacaactatctccttgacgtgttggaaaggtcacctcaccgtcccatactccaggctggcctacctgctaacacaaccgccgttgtcgggtccgatgtggaactcctttgtaaagtctactctgatgctcaaccccacattcagtggttaaagcacattgtgattaatggatcttcctttggagccgatgggttcccctacgtgcaagtgctgaagacagccgacattaactcttccgaggtggaagtgttgtatttaagaaatgtgtctgctgaggatgcaggggaatacacatgtctggcaggcaacagcattggcctgtcttaccagagcgcatggttgaccgtactaccaggcgaacatctgaagggacaggagatgctacgggacgcaccacttgggcagcagtgggggctgtggcccgtgggatggtcagtttccgtcggcctgtggggtctcgcctggggggcagtgtgcggtttcgtaggactgagctgtatgacagcccccctctgcctcagtactcgagggcggccctgcgacagacttctgcggtgtgggtgccttggcttggggatcaccaccgcctcttcagtgtgtgtgccgacttacgtgggctcttgggaaggcctggggtgcaccggccgccccgtcagccccttaacttcactgagtgtgtgtgtgtgcccatgcgctcgggccgaggaagatccaacatggaccgccgccgccccggaagcacgttatacagatataattctatacgcttccggttccctggcccttgccgtactgcttctactcgctggtctataccggggtcaggctctccatggaagacacccaagacctccagccactgtgcagaagctcagtaggttcccacttgcgcgtcagttctctcttgagtcgggatcatccggcaagagttcctcctccctggttcggggagtgcggttgagctcatctggaccagcactgctggctggtctcgtgtccctggatctgcccctcgaccctttgtgggaattccctagggaccgattggtgctgggcaagcccctaggcgagggctgcttcgggcaggtggtgcgagcagaagctttcggtatggatccagctcgtcctgatcaggcctccaccgtcgctgtgaagatgctgaaggacaacgcatctgataaagaccttgctgatctcgtttccgagatggaggtgatgaagctgattggcaggcacaaaaatattataaacctgctgggcgtgtgcactcaggaagggcccctctatgtgatcgtagaatgcgcggcgaaaggaaacctccgcgagttccttagggcccggcggccaccaggaccggatctcagccccgatggcccccgaagttccgaaggaccgctgagcttccctgtgctggtaagctgtgcttatcaggtcgccagaggcatgcagtatctagagagcaggaagtgcatccaccgcgatctggcagctagaaatgtgctggtgactgaagataatgtcatgaagattgccgacttcgggctggcaagaggcgtccatcatattgactactacaagaagaccagcaatggacggcttcctgttaaatggatggctcctgaggctctgttcgatcgagtctatacccatcaaagtgacgtgtggagcttcggcatcctgctctgggagatctttacactgggaggcagcccttacccgggcattcctgtcgaggaacttttttcgctgttgagagaaggacacagaatggacaggccaccgcattgtccacccgagctctacggacttatgcgtgagtgctggcacgcagcgccctcacagcgccctacattcaagcagcttgtggaggccctggacaaagttctgctggctgtgtcagaggagtatctcgacctgcggctgacttttggcccttattccccatctgggggcgacgcaagctccacttgcagtagttcagatagcgtgttctcccatgaccctctcccattaggaagctcatctttcccattcggctctggagtccagacatag

SEQ ID NO: 15220 - DNA, 2289 bp, Artificial Sequence
  Description of Artificial Sequence: Synthetic coding sequence
atgagacttttattggctttattgggtgtgctgctctccgttcccggcccgcctgttctgagtctggaagcctccgaggaagtcgagctcgaaccctgtctggccccctcccttgaacagcaggagcaagagctcacagtcgcactaggacagcccgttcgactgtgctgtggccgtgctgagagaggtggtcattggtacaaagaaggatcacgccttgcccctgccggccgggtgcggggctggcgcggcaggcttgagattgcctccttcctccctgaggatgcaggcaggtatctgtgcctcgcccgggggagcatgatagtactgcagaatttaacgctgattacgggcgactctctcacctctagcaacgatgacgaggacccgaagtctcatagggatcccagcaatcgacattcctacccccagcaagctccctattggacacacccacagcgaatggagaagaagctccacgcggtccctgctggcaacacggtgaaattccgctgtcctgcagctggcaatccgactccaacaattcgctggcttaaggacggccaagctttccatggcgaaaacaggattggggggatccggctgaggcaccagcactggtcactcgtcatggagagtgtcgtgccgagtgacagggggacatacacttgtctcgtagaaaacgccgttggatctataaggtataattacctgctggatgtgctggagcgctctcctcatcggcctatccttcaagcaggtttacccgcaaacactacagctgtagtaggctctgacgttgagctgctctgtaaagtgtactccgatgctcagccccacattcaatggctaaaacatatcgtgattaacggttcaagctttggagccgatggatttccttacgtgcaggtgctgaaaaccgccgatatcaactcaagtgaggttgaagtcctctacctgcgaaatgtaagtgccgaagacgccggcgagtacacctgcttagctggaaacagtatcgggttaagctatcagtccgcgtggctcaccgtcttgcccggaacaggaagaataccacatcttacttgtgattctctgacacccgctggaaggacaaaatcccccaccttgcaatttagtctcgagtcgggaagctcaggaaagtcttctagctcattagtgcggggcgtgcgcctgagctccagtggacctgctctgcttgccggcttggtgtcactcgatctgcccctcgatcctctgtgggagtttcctcgcgacaggctggtgctaggcaaaccccttggagagggatgctttggccaagtggtcagggctgaagcatttggcatggatccagccaggccagaccaggcttctactgtggccgtgaaaatgctgaaggacaacgccagtgacaaagaccttgctgacctcgtaagcgagatggaagtcatgaaattgataggtcgccataaaaatattatcaacctcctgggtgtgtgcacacaggaagggccactgtatgttattgttgaatgcgcggcgaaaggcaaccttcgagagtttctgcgggctagaagaccccctgggccagacctgagtcccgacggacccaggtcatctgaaggccccctgagctttcccgtgctcgtgagctgcgcttatcaggtcgcacgtggcatgcagtatctggagtcacggaagtgtatacaccgagacctagccgcccgcaatgttctggtcactgaagacaatgtaatgaagattgccgactttggattggcacgtggcgtgcaccatattgactattacaagaaaacctctaacgggaggcttccggtgaaatggatggcaccagaagctctattcgacagggtgtacactcaccagtctgatgtgtggtctttcggcatcctgctgtgggagatattcacacttggcggatcaccttacccagggatccccgtcgaggagctttttagtctgctccgtgaggggcaccgcatggacaggccacctcattgtcctcccgaactgtacggcctgatgagggagtgttggcacgctgcaccctctcagaggccaacattcaaacagctcgtcgaagctctggataaagtcctgttggctgtatccgaagagtatctcgatctgcggctcacgtttggcccctacagtccctcaggaggcgatgcctcttcaacctgcagcagctctgactcagtgtttagccacgaccctttaccgctggggtctagcagctttccatttggtagcggcgtgcaaacctag

SEQ ID NO: 15221 - DNA, 2409 bp, Artificial Sequence
  Description of Artificial Sequence: Synthetic coding sequence
atgaggttattgctcgcactgctgggcgtactgctttcagtccctggccctccggttctctccctggaggccagcgaggaagtggagttagagccttgcctcgcacccagtctggaacaacaggagcaggaacttaccgttgcgttgggacaacctgtccggctgtgttgtggcagggccgagagggggggccattggtacaaggaaggctctagactggctccggcagggcgtgtgagaggttggaggggaagactcgaaatagcgtcatttttgcctgaggacgccggtcggtacctatgtctggcccgtgggagcatgatagtcctacaaaacctcaccttaataaccggtgactcactgaccagctccaacgacgacgaagatcccaaatctcatcgagaccccagcaatcgtcacagctaccctcagcaggctccttactggacacacccacagcgaatggaaaaaaagctgcacgcggtaccagcaggcaatactgttaagttccgctgtccagcagcaggaaatccaacccctaccatcaggtggctgaaggatggccaagcattccacggagaaaaccgcatcgggggtataagattaagacaccaacactggtccctggtcatggagagtgtcgtgccgtccgacaggggaacctacacttgcctcgtcgagaatgccgtgggcagcatccggtacaattatctgttggacgtactggagcgttctcctcaccgccctatcctgcaggccgggctcccagccaatacaaccgctgtggtcgggtccgatgtggagctgttgtgcaaagtatacagcgacgcccaacctcatattcaatggttgaaacatatcgttatcaatggttcatcctttggcgctgatggcttcccctacgtgcaggttctaaaaacagccgacatcaactctagtgaagtggaagtgctttaccttagaaatgtgtctgctgaggatgccggcgaatatacatgcctggcaggcaatagcatcgggctaagctatcaatccgcttggttgacagttttacccgaagaagaccctacatggaccgcagcagcccctgaagcacgatatacggacatcattctgtacgcctctggctctcttgccctggccgtccttctgctcttggccggcctgtaccgcggacaggccctgcacggccgacacccacgaccccccgcaacagtccagaagttgagcaggtttcccttagctcgccagttcagcctggaatccggatcatccggcaagtcatctagctcattagttcggggagttaggctgagcagctctggccccgcccttttagccggtctggtgtccctcgacttaccccttgatcctctttgggagtttccccgggatagactcgtgctcgggaagccactgggagaggggtgttttggccaggtcgtccgggccgaggcctttggcatggatcctgcccggcctgatcaggcctccactgtggccgtaaagatgctgaaggataatgcctcagacaaagatcttgcagacctggtgtctgaaatggaagtgatgaagcttattggacgtcacaagaacatcattaacttattgggtgtctgtacacaagagggacctctgtacgttattgtggagtgtgcggcaaagggcaatctgcgcgagtttctacgcgcccggagaccccccggacccgacctgagcccagatggaccacgcagcagtgaggggcccttgtcttttcccgttctggtaagttgtgcatatcaagtggcaaggggaatgcagtacctcgagtctaggaaatgcatccatcgggatctggccgctcgcaacgtactggtgacagaggataacgttatgaaaattgcagacttcggcctggcacgtggcgtgcaccacatcgactattataagaaaacttctaacgggagactgcccgtaaaatggatggcaccagaagccctgttcgatagagtgtacacccatcagtccgacgtatggagctttggaatcttgctgtgggaaatattcactctgggcggcagcccctatcccggcataccggtggaggagcttttctcactgctgagggaggggcacagaatggataggcctccacattgccccccagagctttacggtttgatgcgcgaatgttggcatgccgccccctcacagaggcctaccttcaaacagctggtggaagccctggataaagttctgcttgcagtcagtgaagagtacttggacctccgtctgacatttgggccttactcgccctccggcggtgatgcaagttcaacctgcagctcaagcgattcagtgttttcacatgatcccttgccactgggcagctcttccttcccatttggctcaggagtgcagacttag

SEQ ID NO: 15222 - DNA, 606 bp, Artificial Sequence
  Description of Artificial Sequence: Synthetic coding sequence
atgaggttgcttctcgcactcctcggggtcctcctgtcagtaccgggccccccagtgctctctttggaagccagcgaggaggtcgaactagaaccttgcttggctccttctctggagcaacaggaacaggagctgaccgtggccctagggcagcctgtgcggctgtgctgcggtagggcggagaggggcggccattggtacaaagaagggtccagactcgccccagccgggagggtgcggggatggcggggacgcctggagattgccagcttcctgcctgaagatgcaggccgctatctgtgtctcgcccgggggtctatgatcgtgcttcaaaatcttactctcatcactggggactccttgacaagctctaacgacgacgaggatcccaagtcacaccgcgatccctccaacaggcactcttatccgcaacaagcaccttattggactcacccacagagaatggaaaaaaagctccacgctgttcctgccgggaacacagttaaatttcgctgtcccgctgctgggaatccgaccccaacaattagatggctcaaagacgggcaggctttccacggggaaaatagaattggcggtatcaggtag

SEQ ID NO: 15223 - DNA, 264 bp, Artificial Sequence
  Description of Artificial Sequence: Synthetic coding sequence
atgcgactgctgctggccctgctaggggtccttctcagcgttccagggccccccgtgctgtcactagaagcttcagaggaggtggagttagaaccgtgcttggccccatcactggagcagcaggagcaggagctgaccgtcgcactgggtcaacctgtgaggctgtgctgcgggagagccgagaggggggggcactggtataaggagggttcccgtctggccccagccggccgcgtgcgaggctggcggggacgtctcgaatag

SEQ ID NO: 15224 - DNA, 327 bp, Artificial Sequence
  Description of Artificial Sequence: Synthetic coding sequence
atgaggctattattggcgcttttgggggttttgctgagcgtccccggaccacccgtgctgtctctcgaagccagcgaggaggtggagttagagccttgtctcgccccctccctggagcagcaagagcaagagctgacggtcgccttgggccagcccgtaagactctgctgcggtagggctgaacggggcggacattggtataaggaaggatcaaggctcgcccctgcaggccgggtccgcggttggagaggacgattagagatcgcctcattcctcccagaagacgccggaagatacctgtgtttggcaagaggtagtatgatttag

SEQ ID NO: 15225 - DNA, 345 bp, Artificial Sequence
  Description of Artificial Sequence: Synthetic coding sequence
atgcgcctgctgttagcattactgggcgtccttttgagcgtgcccggaccccccgtcctttctctcgaggcctccgaggaagtggagttggagccatgcttagcaccatctctcgaacagcaggaacaggaactaacagtggcccttggccaaccagtgagactctgttgcggtagggctgagcgcgggggtcactggtataaggaaggtagcagattggcccctgccggcagggtgagaggttggcgcggacgattggaaattgccagttttctgccagaggacgcagggcggtacctctgcttggcccggggttcgatgattgttcttcaaaatttaacatag

SEQ ID NO: 15226 - DNA, 7164 bp, Artificial Sequence
  Description of Artificial Sequence: Synthetic coding sequence
atgctgagaggtccaggacctggcttacttctcctggccgtgcaatgtctgggcacggccgtcccgagcactggtgcgagcaagagtaagcgacaagcgcaacagatggtgcagcctcaaagtccagtggccgtcagccagtctaagcccgggtgttatgataacgggaaacattaccaaataaaccagcagtgggagcggacttatcttgggaacgcactggtgtgcacttgctatggcggaagccggggttttaattgcgaatccaaacccgaggccgaggagacatgctttgataagtataccggcaacacataccgggtgggcgatacttacgaacgtccaaaggatagtatgatttgggattgtacatgcatcggggccggtcggggacggatctcatgtacaattgccaatcgttgccacgaagggggacagtcttataagattggcgacacctggagacgcccacacgaaacaggcggctacatgctcgaatgcgtgtgcttaggtaacggcaagggggagtggacgtgcaagcctatcgccgaaaagtgctttgatcatgcggcgggcactagctacgtggtgggcgagacatgggaaaaaccttaccaggggtggatgatggtggactgcacatgtcttggcgaaggatcaggccgcattacctgcacttcaagaaatcgctgcaatgatcaagatactcgaacgtcctatcggattggcgacacatggtccaaaaaagataacaggggcaatctgctgcagtgcatatgtacaggaaatggccgaggtgagtggaaatgtgagaggcatacctccgtgcaaacgaccagtagtggtagcggacccttcaccgacgtcagagcggctgtctatcagcctcagcctcatccccagccccctccgtatggccactgcgtgaccgactctggagtcgtctatagtgtgggcatgcaatggctgaaaacccagggcaacaagcagatgttgtgcacatgcctcggcaacggcgtatcatgtcaagagactgctgtaactcagacctacggcggaaacagcaatggcgagccttgcgttctgccatttacctacaatggccgtacattttacagctgtacgaccgaaggccgccaggacggtcatctgtggtgcagcaccacttccaactatgagcaggatcagaagtactctttctgcacagaccataccgttctcgtgcagacccggggtggcaactctaatggcgccctgtgtcacttcccatttctctacaacaaccataactacacagattgcacatcagaaggcagaagggacaatatgaaatggtgcggaacaacacagaactacgatgcagaccagaaattcggattttgtccgatggccgctcatgaggagatttgtaccaccaacgaaggggtgatgtatcgtatcggtgaccagtgggataagcaacacgacatgggccacatgatgcgatgtacttgcgtcggcaatggaagaggcgagtggacctgcattgcttacagccaactgagagatcagtgtatcgtagacgatatcacctacaacgtgaacgacaccttccacaagaggcatgaggaggggcatatgttaaactgcacctgcttcggccaggggcgcggacgctggaagtgtgatcccgtcgaccagtgccaagatagtgaaaccggtacattttaccagattggcgattcctgggagaagtatgtacatggagtccggtatcaatgttattgttacgggagaggaatcggagaatggcattgtcagcccctgcaaacatacccatcctcttccggtcccgtcgaggtctttatcacagagacacccagtcaaccaaacagccacccaatccagtggaacgctccacaacccagccatatctcaaaatatatcctgcgatggcgacctaagaattccgttgggcgctggaaagaagccacaattcccggccatcttaactcctacacgattaagggtcttaaaccaggcgtcgtgtacgagggtcaactgatatctattcagcagtatgggcaccaggaggtcaccagattcgattttactaccaccagcacgtccacaccagtgacatccaacacagttacgggcgaaaccactccctttagccccctggtggcaacatctgagagcgttacagagattactgcctcatcctttgtcgtgagctgggtgtccgccagcgataccgtatccggatttcgggtggagtacgaattgagtgaagaaggggacgaaccacagtacctggacctgccttcaacagcaacttccgtgaacatcccagatttgctaccaggcagaaagtatatcgtgaacgtgtaccaaatctccgaggatggcgagcagtccttgattctttccacgagtcaaacgaccgcacccgatgcaccacccgatacaacagtcgatcaggtggacgatacctcaattgtggtccgttggagccggccacaggcaccaatcaccgggtacagaatcgtgtacagcccctctgtagaaggatcaagcacagagcttaatttgccagagacggctaactcagtgaccctgtccgatctccagcctggcgtacagtataacatcaccatttacgctgtggaggaaaaccaagagagcactcccgtagtcattcaacaggagacaactggcacgccgcgctccgacaccgtccccagccctcgcgaccttcagtttgtagaggtgacagacgtcaaagttaccataatgtggaccccccccgagagcgccgtgaccgggtacagggtggatgttatccctgtgaacctccctggagaacacgggcagaggctcccaatatcgcggaatacgttcgctgaggtcaccgggttaagccctggggttacatactattttaaggtgttcgctgtttctcatggtcgtgagagcaagccgctaacagcacagcagaccaccaagctggatgctccgaccaatttgcagttcgtgaacgaaaccgactcgacggtgctcgttcggtggacccctcccagggcccaaataactgggtatcggctcacggttgggctcacccgccgcggtcagccccgccagtacaatgtcggtcctagcgtgtccaagtatcccctgcgaaatctgcagccagcttccgaatacacagtgagcctcgttgcaattaagggtaaccaggagagcccgaaagccaccggagtgttcacaaccttacagccaggcagcagtatccctccatacaataccgaagtgaccgagactacaatagtgattacatggacgccggcaccccggataggattcaagttgggagttcggcccagccaagggggggaagccccaagagaggtgactagtgacagcggatctattgtggtatccgggttgacccccggggtggagtatgtgtatacaattcaggtcctccgggacgggcaggaacgggacgcccctatcgtgaacaaagtggtcactcccctgtcgcctccaaccaaccttcacttagaggcaaacccggatacaggtgtgctgactgtttcatgggaacgtagcacaaccccggatatcacaggatacagaattaccactacgccgactaatggccagcagggaaattcattggaggaagtcgtccacgcagaccagtcttcctgcacctttgacaatctgtctccaggattagaatataatgtgtccgtgtacaccgttaaggacgataaagaaagtgtgcccatatccgacacaattattcccgaggtcccacagctcactgacctgagttttgtggacattacagattctagtataggcctgcggtggacacccctcaactcctcaacaatcatcggataccgcattacagtagtcgccgcgggtgagggcatccccattttcgaagactttgtcgactccagtgtgggatattacaccgtcaccggactggagccgggtattgactacgatataagcgttattacgttgataaacggtggtgagtcagcccctactacactcacccaacagaccgccgtccctcctccgactgatcttcggttcttttctgatatcactgccaatagctttacagtgcattggatcgcacccagagctacgattacagggtaccgcattcgccatcaccctgaacattttagcggacgcccaagagaggatcgggtaccgcattccagaaactcgataacattgaccaatttgactccagggacagaatacgtggtaagcattgttgcgctaaatggacgcgaggaatctccactgttgatcgggcagcagagcactgttagcgacgtgccaagggatttagaggtcgtcgccgccaccccgactagcttgctcattagttgggacgcgccagcagtcacagttaggtattacagaattacctacggcgaaaccgggggaaacagcccagtccaagagttcacagtccccggcagcaaatctactgccacaatttcaggcctgaagcctggagtggattatacaattacagtgtatgctgtgactggcaggggcgacagccctgcgtcaagtaagccaatctcgattaattaccggactgagatcgataagcctagtcagatgcaggttactgacgttcaggataacagtatcagcgtcaagtggctccctagtagctctccagttaccggataccgcgtgacaactactcccaaaaacggtcccggcccgactaaaacaaaaacggcaggaccggaccaaaccgagatgactattgaggggcttcaacccactgtcgaatatgtagtctctgtgtacgcgcagaaccccagcggggagagtcagccgctggtccaaacggccgtcacgaacatagacaggcccaagggactggcctttacagacgtggatgtggacagcatcaagatcgcctgggagagtccacagggacaggtcagccgctatcgcgtgacctacagctctccggaagatgggatccacgagttgttccccgcacctgacggagaggaggacacagcagaattacaaggcttacggcccgggagcgagtacactgtgagtgtcgtcgcactgcacgacgatatggagtcgcaaccactgatcggaacccagtctaccgcaatccctgcgcccactgaccttaaatttactcaagtgacccccacttccctctctgcgcagtggacgccccccaatgtacagttgaccggatatagagtgcgggtgacgcctaaagagaagaccggtccgatgaaggagattaacttagcacccgacagtagctctgtggttgtgtctggactgatggtcgctactaagtatgaagtgagtgtgtatgcgctgaaagacacactgaccagcaggcctgcccagggcgtcgtcactacactcgagaatgtcagcccacctagacgagcgagagtcactgacgccactgagacaacgatcacaattagttggaggactaaaacagagacaatcaccgggttccaggtagatgccgtgccggctaacggacaaactccaatccagaggaccatcaaacccgatgtgagatcctacacaatcaccggcctgcaacctggcacggactataagatttatctttatactctcaacgataacgctcgcagcagtccagttgttatcgatgcatctactgcaattgacgccccatccaacttacggttcttggccacaacccccaactccctccttgtgagctggcaacctccccgcgccagaatcactggctacattatcaagtatgaaaaacccggcagtccccctagggaggtggtgccacggccgcgacccggagtaactgaggctacaatcacgggtctggagcctggcacagagtacaccatctatgtcatcgctctgaaaaataatcagaagagtgaacccttaattggtaggaagaaaactgacgaactgccacagctggtgaccctcccacacccaaacctgcacggtcccgagatactcgacgtaccatcaacggtgcaaaaaaccccttttgtcacacacccagggtatgacaccgggaatggcatccagctgcctggcacttcaggccagcagcctagcgtcggtcaacagatgatatttgaggagcacggattccggaggacaactcccccgaccacagccacacccataagacacagaccacgaccttatccacctaacgtgggtgaggagatacaaattggacacatcccaagagaggatgtcgattatcacttgtatccacacggcccgggccttaaccccaatgcttcaaccggccaggaggctctttcccaaactactatcagttgggcccccttccaggataccagcgaatatattatttcctgccatcctgtgggaacggatgaggagccactgcagtttcgagtgccaggaaccagtacatctgcaacactgactggtctaactagaggtgcaacatacaacgtcatcgtggaggctctgaaggaccagcagagacataaggtgagggaagaggtggtcacggtcggaaattccgttaacgagggcctgaaccagcctacggatgattcttgcttcgacccatacacagtaagtcattacgcagtgggggacgaatgggagagaatgtccgagagcgggtttaaactgctctgccaatgcctggggtttggatctgggcatttcagatgcgactcctcacggtggtgccacgacaacggtgtaaactacaagataggtgaaaagtgggatagacagggtgagaatggacagatgatgtcgtgtacgtgcttgggcaatggcaaaggtgaatttaagtgcgacccccatgaggctacctgctacgacgatggcaaaacataccacgtcggggagcagtggcagaaagagtacctgggtgctatttgtagctgtacatgttttggagggcagagggggtggcggtgtgacaactgcagacgaccgggcggcgagccctccccggaggggacaaccgggcaatcttacaaccaatactcacaaagataccaccagcgaactaatactaacgtcaattgtcctattgagtgttttatgccgctggatgttcaagccgatagagaagatagtcgcgagtag

SEQ ID NO: 15227 - DNA, 7341 bp, Artificial Sequence
  Description of Artificial Sequence: Synthetic coding sequence
atgctccgcgggccaggcccaggcctgctgctgctcgcagtgcagtgcttgggtactgctgtcccgagcactggagccagcaaaagcaagagacaggcgcagcagatggtacagcctcagagcccagtggccgtttcgcaatctaagcctggatgctacgacaacgggaaacactaccagatcaatcagcagtgggagcgtacttacttaggcaacgcactggtgtgtacgtgttacggcggtagccggggctttaattgcgagtctaagcctgaagcagaggaaacatgctttgacaagtacactgggaacacatatcgggtcggcgacacgtatgagcgacccaaagattctatgatttgggattgcacgtgtattggggcagggcggggtcgaattagctgcacaattgccaatcgttgtcacgaaggagggcaaagctataagattggggacacctggcgccgcccccatgagaccggcgggtacatgttagaatgtgtgtgcctgggcaatggcaagggcgaatggacctgcaaaccaatcgccgagaaatgttttgatcatgcagccggtaccagttacgttgtgggtgagacatgggagaaaccctaccagggttggatgatggtagattgtacctgcctcggtgaagggtcaggtagaatcacatgtacctctagaaaccgatgtaatgaccaggatactcgcacttcctatcgcatcggcgacacctggtcaaagaaagacaacagaggtaacctgttgcagtgtatctgtacaggaaacggacgcggcgagtggaaatgtgagagacatacatctgtccaaaccacctcctcagggagcggcccattcaccgacgtgcgagcggctgtgtatcagccccaaccccacccacagccccccccctacgggcactgcgtcacagactccggagtggtttacagcgtgggcatgcagtggttaaaaacacaaggcaacaagcaaatgctttgcacttgtctgggtaatggtgtctcctgccaagagacagccgtgactcagacttacggcggaaacagtaacggagaaccttgtgtcttaccttttacctataacggtcggacgttctatagttgcaccacggaaggccgtcaagatggacacttgtggtgctcgactacctccaattatgagcaggaccagaagtatagcttctgtactgaccacaccgtattggtgcaaaccaggggcgggaactctaacggggctctctgccacttcccattcttatacaataatcacaactacactgactgtacatcagaggggcggcgagacaacatgaaatggtgcgggactacccagaactatgacgcagatcagaagtttggtttctgcccaatggccgcccatgaggaaatttgcaccactaatgagggcgtcatgtacagaattggggaccaatgggataagcagcacgacatggggcacatgatgcgctgcacttgcgtgggcaacggccgcggtgaatggacttgtattgcatatagtcagcttcgggatcagtgcatagtggacgatattacatataacgtcaatgataccttccataaacgtcatgaagagggtcatatgctcaactgtacctgttttggccaggggagaggtcgatggaaatgcgatcctgtggaccagtgccaggactctgagacaggcacattttaccagattggtgactcttgggagaaatatgtccatggcgttcgctaccagtgttactgttatggaaggggcatcggcgaatggcactgccagcccctccaaacataccctagttcctccggaccagtcgaagtgttcatcaccgagacgccgtcacagcccaacagtcaccctattcagtggaacgcgccccaaccaagccatatttctaaatatatcctgcgatggagacccaaaaacagcgtgggcaggtggaaagaagcgactatccctggccacttgaattcatacacgataaagggattgaaacctggtgtggtgtacgagggccagttgatctccattcagcaatatgggcatcaagaagtgactagattcgactttacgacaacctctactagcaccccggttacttcaaacacagtaactggtgagaccacacctttctctccccttgtggccacttcggagtcggtcacagagatcaccgcctcctccttcgttgtcagctgggtcagtgcgtcggacactgtcagcgggtttcgggtggaatacgaactgagcgaagagggagacgaaccgcagtatctggatctgccttcgactgcaacctcagttaatataccagatcttcttcctggacggaaatatatcgtgaacgtgtaccaaatttcagaagacggcgagcagagcctcatcctctcaaccagccagactactgccccggacgccccacccgatactacggtggatcaagtcgacgacacttccatcgttgtcaggtggtcaagaccacaggctccaatcaccggctatcgcatcgtgtactcacctagtgtggaaggctcctccacagagctgaacttgcccgaaactgcaaactcagtaacactttcggatctacaacccggtgtgcagtataatatcactatatacgcagtggaggaaaaccaagaatccaccccagtggtaatccaacaggaaacaaccggaaccccgagatctgacaccgtcccgagccctcgcgacctccagtttgtcgaggttacagatgtgaaagtgacgataatgtggacacctcccgagtcagcagtaaccggttatcgggtggacgttattcccgtcaatctgcccggggagcatgggcaacggcttcccatctctcgtaatacatttgcagaggttaccggactgagccctggtgtgacctactatttcaaagtctttgccgtctcacacggaagggagtccaaaccactgacggcacaacagaccacaaaattggatgccccaaccaatctgcagttcgtgaatgagaccgactctacagtgcttgttaggtggactccacctcgtgctcaaatcaccggttatcggctgaccgttggcctgactagacgcggacagccacggcagtataacgtggggccaagcgtttctaaataccctctgcggaacctccagccggcttctgagtacacagtcagtttggtggccattaagggtaatcaagaaagccccaaggcaacaggtgtgttcacaaccctccagccaggatcctcaattcctccatacaatacagaggttaccgaaaccacgatagtcattacttggacgcccgccccgagaattggattcaagctaggagtgagaccaagccaggggggcgaagctcctcgggaagtaacgagtgactcaggctctattgtggtttcgggtttaaccccgggtgttgagtacgtgtacacgattcaagtgctgcgtgatggacaggaacgggacgctcctatcgttaataaggtcgtcactccgctatctccccccacaaatttacaccttgaggctaatcccgacacaggcgttctgaccgtcagttgggaaagatccaccacacccgacattaccggctatcgcataacaactacacctacgaatggacagcagggaaacagcctggaggaggtcgttcacgccgatcaatcctcctgcaccttcgacaacctgagccccggtctcgagtacaacgtctctgtatatactgtgaaggatgacaaagagtcggttcctattagcgatacaattattccagaagtccctcaactcacagatctttctttcgtcgatatcacagattcatcgattggtctcagatggactcctctcaacagctccacaattattgggtataggatcacagtggtagccgccggcgaaggaatccccatattcgaggacttcgtcgactctagcgtgggttattacaccgtgaccgggcttgagcctgggatcgactacgacatcagcgtgatcacactgatcaatgggggagagtccgctcctacaaccttaactcagcagaccgcggtgcctccccccacagacctccgcttcacaaacatcgggcccgataccatgagggtgacctgggccccgcctccgtccatagacctgacgaattttctggttcggtattcacctgtgaaaaatgaggaggatgtggctgagctctctatcagcccatccgacaatgcagtggtgctcaccaacctgctgccaggcaccgaatacgtcgttagtgtctcctccgtgtacgagcaacacgaatcaacccccctgcggggccgacagaagactggcctggattcacccactggaatagacttcagtgacatcactgcgaattcgtttaccgtccactggatcgccccaagggctacaataactggctaccgcatacgccaccacccagagcatttttctggacggccccgggaggacagggtgcctcacagcaggaacagtataactctaacgaatctgacaccaggaaccgaatacgtcgtaagtatcgtcgccctaaatggcagggaagaatcacctctgcttataggccagcaatcgacggtgagcgacgtccccagagacttggaagtcgtagctgccactcccacatccctgttgatttcttgggatgctcctgcagtcacggtgaggtattacaggattacatacggcgaaacaggtggcaactcccctgtacaggagttcactgtgccaggtagtaaaagcacagctaccatctccgggcttaaaccgggcgttgactacactattaccgtgtatgctgtcacgggccgcggtgacagtcccgcgtcttccaagcctattagcatcaattatcgcaccgagatcgataagccctcccagatgcaagtgaccgacgtccaagacaattccattagtgtgaaatggttaccaagctcttccccggtaaccggttatagggtgacaacaacaccaaaaaacggtccaggacctaccaaaacgaagaccgccgggcccgatcagacagaaatgaccatagaaggtttacagcccaccgttgagtacgtggtgtcagtgtacgcccagaaccctagcggtgagtcacagcctctcgttcagaccgcagtcaccaatattgatcgcccaaagggcctcgcttttactgacgttgatgttgactcaattaaaatcgcctgggagtccccccagggccaggtttcgcgatatcgcgtgacatattctagccccgaggatggaattcatgagctgttccccgcaccagatggggaagaggatactgcggagcttcagggcctgcggcctggaagcgaatacaccgtgagcgtagtagctctccacgacgacatggaaagccaacccctgattgggacccagtcaacggccatccctgccccaacggacctcaagttcacgcaggtcacacctacatccctttctgcccagtggacaccacccaacgttcagctcactgggtatcgcgtgagggtcactcccaaggagaagacgggccccatgaaagagatcaatctggctccggacagctccagcgtggtagtgagtggcttaatggtggccacgaagtacgaagtatcagtgtatgcactaaaggacactttgacatccaggccggcccagggcgtggtgacaactttagaaaacgtgtccccacctaggcgagcccgggttaccgacgctactgagaccacaatcactatcagctggcggacgaagacggagaccattacagggttccaggtggacgcagtgccagctaacggtcaaacacccatccagaggacaattaagccagatgtgcgatcttatacaattactggcttgcagcccggcacggattataagatctacctctacaccctgaatgataacgctagatcttctccagtggtcattgacgcttctacggcaatcgatgctccttcaaatctgcgattcctggcaactaccccgaacagcctgctggtttcctggcagccgcccagggcccgcataactggctatatcatcaagtatgaaaaacctgggtcaccaccaagagaagttgttcccaggcctagaccgggagttaccgaagccacaattaccggcttagaacctgggactgaatacactatttatgttatcgccctcaaaaacaatcaaaaatctgaacctctgatcggccgtaaaaagaccgacgaactacctcagctggtcacgctgccacacccaaacctgcacgggcccgagattttggatgttccttcaacagtccagaaaactccctttgtgacccaccccgggtacgataccgggaatggcatccaactgccaggaacatctgggcagcagccatcagtgggccaacagatgatttttgaggagcatggatttcgccgaaccacccctccgaccacagctacacccatcaggcatcggcccaggccctatcccccaaacgtggggcaagaggcactttctcagacgaccatcagctgggcccctttccaagacacatctgagtacataattagctgccatccagtgggaacagacgaggagccactgcagtttagggtgcctggtaccagtacctcagctaccctcaccgggcttacacgcggagccacctacaacgtgatcgttgaagcccttaaagaccagcagagacataaagtcagagaagaagtggttacggtgggtaattctgtgaatgagggactgaaccagcctactgatgatagctgtttcgatccttatactgtgagccactatgccgtgggcgatgaatgggagagaatgtctgagagcggatttaagctgctgtgccagtgcttaggattcgggagcggtcattttagatgcgactcctcccgttggtgtcatgacaatggggtgaattataaaatcggagagaagtgggaccgccagggtgaaaatgggcagatgatgagttgcacctgcttaggcaacgggaagggggaattcaagtgcgatccacacgaagccacgtgttatgatgatggaaagacctaccacgtcggcgagcaatggcagaaagaatacctgggcgctatctgctcatgcacctgtttcgggggccagcgaggatggaggtgtgataactgccgtaggcccgggggggaaccttcccccgaggggaccaccggccagtcttacaatcagtactctcagcgttaccatcagagaacaaatacaaacgtcaactgtccaattgagtgttttatgcccctagacgtacaggcagatcgcgaggatagtcgggaatag

SEQ ID NO: 15228 - DNA, 7068 bp, Artificial Sequence
  Description of Artificial Sequence: Synthetic coding sequence
atgctgcgcggccccggacctgggctactcctgctcgccgtccagtgtctcgggactgctgtgccctcaacaggagcctctaagtccaaaaggcaggcccaacagatggtgcagccacagagccctgtcgctgtgtcccaatctaagcctggctgctacgacaacggtaagcattatcaaataaatcagcagtgggagcgtacatatctcggaaatgccctagtctgcacctgctacggggggtcaaggggatttaactgcgagagtaagccagaagctgaggagacctgctttgacaagtataccggtaacacatatcgtgttggtgatacgtatgagaggcctaaggattcaatgatttgggattgcacgtgtataggtgccggccgaggcagaatcagctgcacaatcgcaaaccgctgtcacgagggaggccagagttacaagataggggacacttggaggagaccacatgaaactggcggctatatgctggagtgcgtgtgtctcgggaatggcaaaggcgaatggacctgtaagcccatagctgagaagtgcttcgaccacgctgcaggcactagttacgttgtaggagagacctgggagaagccataccagggctggatgatggtggattgcacctgtctgggggaggggagcggcagaataacttgtacatcacgtaaccgctgcaacgatcaggacacacgcacctcctacaggatcggggatacatggtctaaaaaagataatagaggcaatttattgcaatgcatctgtacgggaaacggtcgtggcgagtggaagtgcgagaggcataccagcgtgcagactactagtagtgggtctgggccgttcacagacgttagggccgcagtgtaccagccacaaccacacccccagcctccgccttacgggcattgtgttacagactcaggagttgtatacagtgtcgggatgcagtggcttaagacccagggaaacaaacagatgctctgtacttgccttggcaacggggtctcctgccaggaaacagctgtcacgcagacatacggaggtaacagtaatggagagccctgcgtactcccttttacatataatgggaggactttctacagctgtactacagagggccggcaggacgggcacttatggtgttctacaaccagcaactacgaacaggaccaaaaatacagcttttgtacggaccacaccgtcctggtgcagactcgaggagggaactccaacggggcactctgtcatttcccattcttatacaataaccacaattatactgactgtacatctgaaggaaggcgtgacaacatgaagtggtgcgggacgacgcagaattatgacgctgatcagaagtttggcttttgccccatggccgcccatgaggaaatttgcacaaccaacgagggagttatgtaccggattggcgatcaatgggacaagcaacatgacatgggccatatgatgagatgcacttgtgtgggaaacgggcggggtgaatggacctgcattgcctatagtcagcttcgggatcagtgcatcgtggacgacatcacctacaacgtcaatgacacctttcataagcggcacgaagaggggcatatgctgaactgcacatgttttgggcaaggcaggggacgttggaagtgcgaccccgttgaccaatgccaggatagcgaaacaggcacattttatcaaatcggagactcctgggagaaatatgtgcacggcgtgcggtaccaatgttattgctatgggagagggatcggcgaatggcactgtcagccattgcaaacctatccctctagtagcggccctgttgaagtcttcatcaccgagacccctagtcagcctaattcgcacccaatccagtggaacgcccctcagccttcccatatttcgaaatacattctgcgatggcggcctaaaaatagcgtcgggcggtggaaggaagccacaattcccggccatttgaattcctacacaattaaaggactaaagcccggggttgtgtatgaagggcagctgatttccatccagcagtacggacatcaagaagtgactaggtttgacttcaccacaacctcaacctctacacccgtgacgagtaatacagtgactggcgagacgactcccttttcccccctggtggcaacaagtgagagcgtgacagaaattaccgcttcctcatttgtggtttcttgggtctcagcttcagacaccgttagtggcttccgcgtcgaatatgaattgtctgaggaaggggacgagccccagtacctggatctgcctagcaccgctacctctgttaacattccagacctgcttccaggacggaagtatattgtgaacgtctatcagatctctgaagacggcgagcagagtttgatccttagcacaagccagacaactgcccccgacgcgccccctgacactacagtggaccaggtggacgataccagcatagtggtgcggtggtccagacctcaagcccccatcaccggatatcgtatagtctattctccatctgtagagggatcttctactgagcttaatcttcctgaaacggcgaactccgtgaccttaagcgatctacaacccggcgtacaatataatattacaatatacgcagtggaggagaatcaggaatccactccagtagttattcagcaagagactaccggcacccctcggagtgatactgtaccgagtcctagagacctccagtttgtcgaagtgaccgacgtgaaggtgaccattatgtggacacctccagagtccgcagtgaccggctatagagtagacgtgattccggtcaacctgcctggtgagcacggccagcgtcttcccatctcccgtaataccttcgccgaagtcaccggacttagccctggtgtcacatactactttaaggtctttgctgtgagccacggacgagagtctaaaccactgaccgcccaacagaccacgaagcttgacgcccctacaaacctgcagttcgtaaacgagaccgattcaacagtgctcgtgagatggaccccccctagggcccagataacagggtacagattgacagtcggtttgacgcggcgcgggcagcctcggcaatataacgttggccctagcgtgtcaaaatatccactgcggaacctgcagcctgcatccgaatacaccgtgagcttggttgctatcaaagggaaccaggagtctcccaaggcaaccggggtgttcacaacactccagcccggatcttctatccctccctataacactgaggtgaccgaaacaaccatagtgatcacatggacaccagcgccacgtattggatttaagctgggggtgcggcccagccaaggcggtgaggcacctcgcgaggttacttccgattccggtagcattgtcgtcagcggactcacccccggcgtggagtacgtgtacacaatccaggtgctgcgggatggccaggaacgggatgcaccgattgtgaacaaggtggtcacaccactgtcccctccaaccaacctgcatcttgaggcaaatcccgataccggggtgcttacagtgtcatgggagcggtccacgacacccgacattaccggctacagaatcaccacaactccaaccaatggacaacagggaaattccctcgaggaggtggtgcacgccgaccagtcatcatgtacttttgacaacctgtctcccggccttgaatataacgtgagtgtgtacacggtgaaggatgataaggagtctgttcccatttccgacacaattattcccgccgtgcccccgcctacagacttgcgattcaccaacattggccctgataccatgcgagtgacatgggcgccgcctccctcgatcgatttaactaacttcctcgtccgctacagtcccgttaaaaatgaagaagatgtggcagagctgtcgatttcaccatccgacaacgctgtggtgctgacaaatctgttgcctgggacagagtatgtcgtgtcggtgtcgtcggtctacgaacagcacgagagtactcctctgcgaggaaggcagaaaaccggcctggatagccccaccggtatcgatttttccgatatcactgccaattcatttactgttcattggatcgcgccaagagcaactatcactggttatcggattcgccatcatccggagcacttttcgggaaggccgagagaggatcgagtgcctcacagccgaaatagtattacactgactaacctcacaccaggcacagaatacgttgtcagtatcgtggctctcaatgggcgtgaagagtccccactgttgatcgggcagcagagtaccgtcagtgatgtgcctagagacttggaagtcgtggccgctactccgacctccctcctcatttcctgggacgcgcccgcggtgacagtgagatactacagaatcacatatggagaaaccggtggaaacagtcccgtgcaggaatttaccgtgcccggttccaagagtaccgcaacgatatctgggctgaagccaggagtggactatactatcactgtatacgccgtgacaggacgtggcgattcccccgcttccagtaaaccgatctccatcaattatcgcactgagattgacaaaccgtcccagatgcaggtgaccgacgtgcaggacaattccattagtgtaaagtggctgcctagctcatcccccgtgaccgggtacagagtaaccacgactccaaagaacgggccaggaccaacgaagacaaagaccgctggcccagatcagactgagatgaccatagagggcctgcagcccacagtggaatatgttgtctcagtgtatgctcagaaccctagcggtgaaagccagcccctcgtccagactgcggtgacaaacattgatcggcccaaaggactggcattcaccgatgttgacgtggactctattaagatcgcctgggagtccccacaggggcaagtaagccgttaccgggtcacgtattcgtctcctgaggatgggattcatgaactgtttcctgcccccgacggggaagaagacacagctgagcttcagggtctcagacctgggtcagaatacaccgtaagtgtggtggctctgcacgacgatatggagtctcagcctctgatcgggactcagtcaactgccatccccgcacctactgacctgaagtttactcaggtgaccccgacgtctttgtccgcacagtggactccccccaacgtgcagctaacggggtaccgcgtccgtgtgacacctaaggaaaaaacaggacctatgaaagagataaacctcgcccctgacagctcctctgtcgttgtctccggtcttatggttgcgacgaagtacgaagtgtcagtatatgctctcaaagacaccctgacttccaggccagctcaaggggtggtgaccactctcgaaaatgtgagcccaccgagaagggcaagggtgacagatgccactgagactacaatcactatctcctggcggaccaagactgaaactattacggggttccaggtggacgcagtcccagccaatgggcagactccaatacaacgaaccattaagccagacgttagaagttatacaatcaccggcttgcagcctgggactgactacaaaatttacctgtataccttgaatgacaatgccaggtctagccctgtcgtgattgacgctagcaccgcgattgacgccccctccaacctgcgctttctggcgaccacccccaattcgctgcttgtgtcttggcaaccccctcgggcccggatcaccggatatataatcaaatacgaaaagcccggctccccaccccgagaggtggtgccccgccccaggccgggcgtgactgaagcaaccattacaggtcttgaaccaggaacagaatacacaatctatgtgatcgccttaaagaacaaccaaaaatcggagccgctgatcggccggaaaaagacagatgaactccctcagctcgtcacgcttccacacccgaatctgcacgggcccgaaatcctggacgtgccttccactgttcagaaaactccctttgtgacccacccggggtacgatactggaaacggcatccagctgccagggacctctggccagcagcctagcgtgggacagcagatgatcttcgaggaacatggcttccggcggaccacgcctcctaccacagccacccctatccggcatcggccacgcccgtatccgccaaacgtgggacaggaggcgcttagccagactaccatctcctgggctccgttccaagatacaagcgaatatataatctcttgtcaccccgttgggacagacgaggaacctctccagttccgagtgcctggtacaagtacaagcgccacactgacgggactcacacggggtgctacatacaacgtcattgtcgaggcactgaaggatcaacagaggcacaaagtccgggaggaggtggtcaccgtggggaattctgtcaacgaagggctgaaccagcctacagacgactcctgctttgacccatataccgtaagccattatgccgttggcgacgagtgggagaggatgagcgagagtggctttaagttgttatgccaatgcttagggttcggctcagggcacttccgatgtgattcctcacggtggtgccacgacaatggcgtcaactacaagattggggaaaagtgggaccgccagggagagaatgggcagatgatgtcctgtacttgcctgggtaacggcaagggggagttcaaatgtgatccacacgaggctacatgctatgacgacgggaagacataccacgtgggagagcagtggcagaaggagtatttgggggccatatgctcttgcacttgctttgggggccagagaggttggagatgcgataactgtaggcgacctgggggagaaccttcacccgagggtactaccgggcagtcttacaaccagtactcacagcgctaccatcagcgaacaaacaccaatgttaattgcccaattgaatgcttcatgcccctggacgtccaggccgatcgcgaggactctcgggaatag

SEQ ID NO: 15229 - DNA, 6555 bp, Artificial Sequence
  Description of Artificial Sequence: Synthetic coding sequence
atgcttcgtggaccaggccccggcttactcctgctggctgtgcagtgccttggtacggcagtgccatccactggcgctagcaaatcaaaacgtcaagcccaacaaatggtccaaccgcaatcccctgtcgccgtgagtcagtcaaaaccaggctgttatgataacggtaagcattatcaaatcaaccagcagtgggagcggacgtaccttgggaacgctctcgtctgtacttgttacggagggtcgcgcggctttaactgtgagtctaaaccagaggccgaagagacttgtttcgacaaatacacaggaaacacctatcgtgtgggcgacacgtacgaacgacccaaagattctatgatttgggattgtacatgcattggggcgggaaggggtcgcatttcatgcacgatagctaaccgatgccacgagggagggcagtcatacaagatcggagacacttggcgacgccctcacgaaacaggcggctacatgcttgagtgcgtgtgccttggcaacggcaaaggagagtggacctgcaaaccaatcgctgagaaatgtttcgatcatgccgcgggcacatcgtacgtggtgggagaaacttgggaaaaaccataccaggggtggatgatggtcgattgtacctgcctgggggaaggcagcgggagaatcacctgtactagcagaaaccggtgcaatgaccaagacaccaggacctcctatagaatcggagatacatggtccaagaaagacaaccgggggaatctcctacagtgcatttgtactggtaacgggcgaggggaatggaagtgcgagaggcatacgtctgtccagaccacaagcagcgggtccggacccttcaccgacgtccgcgccgccgtttatcaaccgcagccccatcctcagccacctccatatggtcactgtgttaccgactctggcgtggtgtacagtgttggtatgcagtggctcaagacccagggaaataaacagatgctatgcacgtgcctgggcaacggggtctcctgtcaggagactgcggtgacacagacctacggtggaaattcgaatggggagccctgcgttctgccctttacttataacggaaggaccttttactcttgtacaaccgaaggccgccaggacggacacctttggtgttcgacaacttcaaactacgaacaggatcagaaatacagtttctgcacagaccatacagttcttgtgcagaccagaggcgggaacagcaacggtgccctctgtcactttccttttctttataacaaccacaattatactgactgtacatcagaggggaggcgggataatatgaaatggtgtggcacaacccagaactatgatgctgaccagaagtttggtttctgtccaatggcagctcacgaggagatttgcacaactaatgaaggggtgatgtatcggattggggatcagtgggataagcaacacgatatgggacatatgatgcgatgcacatgcgttgggaatgggcgaggcgagtggacttgtattgcctatagtcagctgagagatcagtgcattgtggatgacatcacgtataacgtcaatgacacattccataaaaggcacgaggaaggccacatgctcaattgtacatgcttcgggcagggccgtggaaggtggaagtgcgatccagtcgaccaatgtcaagattctgagacaggcacattctatcagataggagactcttgggaaaagtacgtccacggcgtcaggtatcagtgttactgttatgggagggggattggggaatggcactgtcagcctcttcagacctacccgtccagttcgggtccagtggaagtattcattaccgagacgccaagccagccaaactcccatccaattcagtggaatgcaccacaacctagccacataagcaagtacatcctcagatggcgaccgaagaacagcgtagggcgttggaaggaagctacaatcccaggtcacctgaactcatatactatcaagggtctgaagcccggagttgtttatgaagggcagttaatttccatccagcagtacggacaccaagaggtgaccagattcgattttaccaccacatcaacttccaccccagttacgagtaacactgtaactggcgagactaccccatttagtccactcgtagctacctcagaatctgtgaccgagatcaccgcaagctctttcgtggtcagctgggtcagcgccagcgatactgtgtctggctttcgggttgagtatgagttgtccgaggaaggcgacgaaccccagtacctcgacctcccttctacggcgacaagcgtaaacattcctgaccttttgcctggcaggaagtacatcgtgaacgtgtaccagattagcgaggacggcgagcagagcctgatcctgagcacttcgcagaccaccgcccctgatgcgcctccagatacaacagtggaccaggttgacgacacctccattgtggtgaggtggagccggccacaggcccctattaccggctataggatcgtgtattctccatctgtggaagggtcaagtaccgagttaaatctcccggagacagccaacagcgtgaccttgagcgacctgcagcctggagtgcagtacaatatcactatttatgccgttgaagaaaaccaggaatctactcctgtcgtgatacagcaggagactaccggtacaccccgcagtgatacagtgccgagcccgcgagatctgcaattcgttgaggtaacagacgtgaaagtgacaattatgtggactccaccagagagcgctgtcactggttatcgtgtcgacgttattcctgtaaatcttcccggcgagcatgggcaacgcctgcccatctccagaaacactttcgccgaggtgaccggtctcagccctggcgtgacctactatttcaaggtattcgcagttagccatgggcgcgaatccaagcctcttactgctcagcagactaccaagcttgatgccccaaccaacctccagtttgtgaacgagaccgactcgacagtcctagtaaggtggaccccgcctcgtgcccagatcacgggttacagacttacggtggggctgacacggcgcggtcagcctcggcaatacaacgtgggtccttcagttagcaagtatcccctgcggaacttgcagccagcctctgaatataccgtgtcgctggtggccataaaggggaaccaagagtccccgaaagcaactggagtgttcacaactctccaacccggctccagcattccaccatacaacacagaagtgaccgagacgaccatcgtaatcacatggactccagctcctcggatcggcttcaagctgggagtgcgtccctctcagggcggggaagccccccgcgaggtcacgagtgactccggcagcattgttgtttcgggcctaacacctggcgttgagtatgtttataccatccaggtgctgagggacggccaggaaagagacgcccccatcgtgaataaggtcgtcacgccgttgagtccaccgaccaacctccacctcgaggctaatccagatacaggggttcttactgtcagctgggagcgatcaacaaccccagacatcacgggttaccgtatcaccacgactcctacaaatggccagcagggaaactccctggaggaggttgtgcacgccgaccagtctagttgcacctttgataacttgagtcctggtttagagtataatgtatccgtgtatacagtgaaagacgacaaggagtcggtgcctataagtgatactatcatacccgcggtgccacctccaactgacctgcggttcactaatattggacctgataccatgagagtcacatgggcaccgcccccctccatagacctcactaactttttggtccgctattctccagtcaaaaacgaggaggacgtcgcggaactgagcatatcaccttcagacaacgccgtggtcctcactaatctactgccaggaacggagtacgtcgtgagcgtgagtagcgtgtatgagcagcatgagagcactccattgcggggcaggcaaaaaacaggcctggactcccccacaggcatcgacttctcggacattaccgcaaattcctttacggtgcactggatcgctccaagagctactatcacgggataccgcatacgccatcatcctgagcacttctcaggaaggcccagggaggaccgcgtgccacatagcagaaactccataactctgacaaatctgactcctggaacggagtacgtggtctcaatagttgccctgaatggcagagaggagtctcctctgctgatcggacaacaaagtaccgtctcagatgtgcccagggacctagaagtggtagcggcaacacccacaagcctgttaatatcctgggacgcacccgccgtcactgtgagatattaccgtataacatatggcgaaactggcggaaatagccccgtgcaggaatttacagtgcccggcagtaaaagtactgcgaccatctctggactcaaacccggcgtcgattacaccatcactgtgtatgcagttaccggccggggcgattcacctgctagttctaaaccaatctcaatcaattaccgaacggaaattgacaaaccttctcagatgcaggtcacagatgtgcaggacaacagcatatccgtgaagtggctgccttcatcaagcccagtcacagggtacagggtaaccaccacaccgaagaatggtcccgggcctacaaaaacaaaaacggccggcccggaccagaccgaaatgaccattgaaggacttcaacctactgtagagtatgtagtgtctgtttacgcacagaatccaagcggtgaatctcagccccttgtgcagaccgccgtgaccaacattgaccgacccaagggactggcctttactgacgtcgatgtagatagtatcaagatcgcctgggagtctcctcaagggcaggtatcccgatatcgagtgacctactcctctccagaggacggtatccatgagctcttccccgccccagacggcgaagaggataccgctgaattacaggggctccgtcctgggagcgagtacaccgttagtgtagtcgctctgcacgacgatatggaaagccagcctctgattggaacgcaaagcacagccatacccgctccaacagacttgaagttcacccaggtgactcccacttccctgtcagctcagtggaccccaccaaatgtgcagctgacagggtatagggttcgcgtgacccccaaagaaaaaaccggtccaatgaaagaaatcaaccttgcgcccgactccagctccgtcgtcgtgagtgggctgatggtggcaaccaagtacgaggtgtcagtgtatgccttgaaggacaccctgactagtcgccctgctcagggagtggttaccactctggagaatgtcagcccgccaagaagagcgcgggtcaccgacgcgacagaaacaacaattaccatctcctggagaacaaagacagagaccataacaggctttcaggtcgacgcagtcccagcgaacggtcagacccccatccagcgcaccataaaacctgacgttcggagttacactataaccggcctacagccagggacagactataaaatctatctctatactctgaacgataatgcgcgctcttcccctgtggtgatagatgcaagcacagcaatcgatgcgcccagtaatctacgcttcctcgccaccaccccgaactcgctactcgtatcctggcaacctcctcgtgcgcgcatcacaggttacataatcaaatacgaaaagcccggttcacctcctagagaggtggtacctcggccccggccaggggttaccgaggccaccattaccggcctggagcctggaacagaatatacaatatacgtgatcgcactgaaaaataatcagaaatcagaaccattaattggcaggaaaaagaccgtgaacgaaggtcttaaccagccaaccgatgacagttgcttcgatccgtacacagtgagccattatgccgtgggagacgagtgggagcgaatgtctgagagtggattcaaactgctgtgtcagtgcctaggcttcggctctggacactttcgctgcgacagctctcgctggtgtcacgacaatggtgtcaactacaaaattggggagaagtgggatcgtcagggtgagaatggtcagatgatgtcctgtacttgcctgggcaacggaaaaggtgagtttaaatgtgacccccacgaggcaacatgctatgatgatggtaagacatatcatgtgggcgagcagtggcagaaagagtatctgggtgctatatgtagttgtacctgcttcggaggacagcgcgggtggcggtgcgataattgtagaaggcctggtggcgaaccatcaccggaagggactactggtcagtcgtataatcagtactcgcaaagatatcaccaacgaacgaatacaaacgtcaattgtccgatcgaatgcttcatgccccttgatgtgcaggccgatagggaggattcacgcgagtag

SEQ ID NO: 15230 - DNA, 6636 bp, Artificial Sequence
  Description of Artificial Sequence: Synthetic coding sequence
atgcttcgcggacccggaccaggactgttgctcttggcggtgcagtgcctgggcaccgcggtgccttctacgggcgcaagcaagtccaagcgtcaggctcaacagatggttcaaccacagtcacccgttgccgtaagtcagtcgaagccagggtgttacgacaatggaaaacactatcagataaaccaacagtgggagcgcacttaccttggtaatgccctcgtatgtacctgttatggtggcagcaggggattcaactgtgaatccaagcccgaggccgaggaaacgtgcttcgataagtacaccgggaatacatatagagtgggggacacatatgagcgaccaaaagacagcatgatctgggattgtacctgcataggggccggaagagggaggatcagttgcacaattgccaataggtgccacgaaggaggtcagagctataagattggagatacatggcggcggccccatgaaaccggaggctatatgttggagtgcgtgtgtcttggtaacggcaagggagagtggacttgtaagccgatcgccgaaaagtgtttcgatcatgctgctggcacgagctacgtcgtcggagaaacatgggagaagccctaccaaggatggatgatggttgactgcacgtgcttaggcgaaggaagtgggaggatcacatgtaccagtagaaacaggtgcaatgaccaagatacccgcacctcctaccggattggggatacatggtccaagaaggacaataggggcaatttgttgcagtgtatatgcacggggaacgggaggggcgaatggaaatgcgaaaggcacacgtctgtgcagacgacgagctccggttccggaccgtttaccgatgtgcgtgctgccgtgtatcaaccacagcctcacccgcagccgcccccctatggccactgtgtgaccgatagtggtgtggtgtactcggtaggtatgcagtggttgaagacacagggcaacaaacagatgctctgcacctgtcttgggaacggggtgtcttgccaggagactgccgtcacacagacttacggagggaacagcaacggtgagccatgcgtgctcccatttacttacaacggcaggacattttactcttgtactaccgagggtcggcaggacggccatctctggtgcagcaccacatctaactatgaacaagatcagaagtattccttctgtactgatcatacagtactggtacagaccagaggcggcaatagcaatggcgctctctgccatttccctttcctgtacaacaaccacaattacaccgattgcacatcggaaggacgaagagacaacatgaaatggtgtggcacaacccagaattacgatgcggaccagaaatttggtttttgccccatggccgcccatgaagagatatgcaccacaaacgaaggcgtgatgtaccgcatcggggaccagtgggataaacagcacgacatgggacatatgatgaggtgcacttgcgtgggtaacggacgtggcgagtggacgtgcatcgcatattctcagcttagagaccagtgcatcgtcgatgatattacttacaatgtaaacgatacctttcataaacggcacgaagagggacacatgctaaattgcacttgttttggacagggtcgtggccgatggaagtgtgatcctgtcgaccagtgccaagacagcgaaactgggacgttttatcaaatcggcgattcctgggagaaatacgttcacggggttcgttaccaatgttattgttacggacgaggaataggtgaatggcactgccagcctttacagacgtatcccagctcaagcggcccagtggaggtcttcattaccgagacacctagccagccgaactctcaccctatccaatggaatgcaccacagccatcccacatatcaaagtacatcctgagatggcgaccaaagaactctgtcggacggtggaaagaggccaccatcccagggcatctgaatagctacactatcaaaggccttaaacccggagttgtttacgagggtcaactgattagtattcagcagtacggtcaccaggaggtaaccaggttcgactttaccaccactagcacctctacgccagtgacttcaaacactgtcactggagagaccacaccttttagtcctcttgtcgctacttccgaatccgtaacagagatcacagctagctcgttcgttgtgagctgggtaagcgcatccgacaccgtcagcggctttcgagtggaatacgagctaagtgaagagggggacgagcctcagtacttagacctgccttccactgccacgtccgtgaatattcctgacttgttgcccggtaggaagtacatcgtaaacgtatatcagatttccgaggatggcgaacagtccttaatcctctccactagccagaccaccgcccccgacgcacccccagacacaacagtggaccaggtcgacgatacctcgatcgtggtccggtggtcccggccgcaggcacccatcaccggctatagaattgtttattctcccagcgttgagggctcatcaacggaactgaatctgccagaaaccgccaatagtgtgaccctgtccgatctccagccaggggtgcagtacaacattactatttacgccgttgaagagaaccaggagagcactcccgttgtcatccagcaagagaccacgggaacccctaggagcgacaccgtccccagtccacgggacctgcagttcgtcgaggtcacagacgtcaaggtcaccattatgtggacaccaccagagtcagccgtgactggctaccgagttgacgtcattccagtcaatttgccaggtgagcacggccagcgcctgccaatttccaggaacactttcgccgaagtcactgggctaagcccaggcgttacatattattttaaagtatttgccgtgagtcacgggagagagtccaagcctctgaccgcccaacaaaccactaagctggatgcgcctactaatctgcagttcgtcaatgaaaccgactcgaccgtgctggtgcgatggaccccccccagggcacagatcacggggtacagactgaccgtcgggctcacccgcagaggccagcccaggcaatacaatgtcgggccttccgtgtccaagtaccctttaagaaacttgcagcccgccagcgagtacactgtgtcactggtggccatcaagggcaaccaggaatcaccaaaggcaacgggagtcttcacaaccttgcagccaggttccagcattcccccctataatacggaagtgaccgagaccaccattgtgattacatggacacctgccccacgcatcggtttcaaactcggagtgagaccttcacagggtggggaggcacctagggaggtgacatcagacagtggcagcattgtggtgtccggactgacacccggggtcgaatacgtctacaccatccaggtgctgcgcgatgggcaggagagagatgcacccattgtcaataaggttgtaactccgctgagcccacccaccaacttgcatcttgaagctaatccagacacaggggtgctcacagtgagttgggagagaagtactacacctgacataaccggatatagaattacaaccactccgacaaacggtcaacagggtaatagcctcgaggaggttgtgcacgctgatcagtcaagctgcacgttcgacaacctgagtcccgggctggagtataacgtctccgtgtatacagtcaaggatgataaagagagtgtgcccatatccgataccatcataccagctgtcccaccaccgaccgacttgaggttcactaacatcgggcccgacaccatgagagtgacttgggcgccccctcccagtattgaccttactaattttctagtgcgctactcgcccgtaaagaacgaagaggatgttgctgagctgagcataagtcccagcgacaacgcagttgtcctgacgaatctgctgcccggtaccgagtatgttgtgagtgtgtcatctgtctacgagcaacacgaaagcacacccctcagaggacgccaaaaaacaggcctggatagccctaccggcatcgatttctccgatattaccgctaattcgtttaccgtgcactggattgcaccccgggccaccataacagggtatagaattcgtcatcatccggagcacttttctggacggcctagggaggaccgcgttccccattcccgcaattccataactcttaccaacctgacacccggtactgaatatgttgtctcaattgtggcactcaatggccgagaagaaagtccgttacttatcggccaacagtccacagtctcggacgttcctcgtgacctagaggtggtggccgcaacacccacatctctcctaatttcctgggacgcccccgcagtcaccgtccggtattaccgcatcacctacggggaaaccggtggcaattcacctgtgcaagaatttaccgtacccggaagtaagagcaccgctacaatatccgggctaaaaccaggggtcgactatacaatcaccgtctatgctgtaaccggaagaggtgattccccggcctcctccaagccgatctctatcaattataggactgagattgacaagccttctcagatgcaggtgacagacgtgcaggataatagtatctccgtcaagtggttaccatctagttcaccagttaccggatatcgagtgaccacaactcccaaaaacggtccaggacctacaaaaacaaagacagccggtccggaccagactgaaatgactattgaaggattgcaacctactgtggagtacgtggtgtctgtatacgcccagaacccgtctggagagagccagccgctcgtgcagactgctgttacaaacatcgataggccgaagggtttggcattcaccgacgtcgacgttgacagcatcaaaatagcttgggaatcacctcaaggccaagtttcccgttacagggttacctactcatctccagaggacggaatccacgagctgtttcccgcgcccgacggagaggaagacaccgctgagctgcagggcctccgccccgggtccgaatatacggtgtctgtggtggcactccacgacgatatggaatcacaacctctgatcggcacccagagcaccgccatcccagctcctaccgatctcaaattcactcaggttactccaacttccctttccgcccagtggaccccaccaaatgtccagctcaccggctatagggtgagggtgaccccgaaagagaagacagggccaatgaaggagatcaatctcgctcctgacagttcatccgtggttgtaagcggcttgatggtcgcaactaagtacgaagtttccgtctacgcactgaaagatacattaacatcgcgccctgcccagggagttgtgacaactcttgagaacgtttctccgccgcggagagcaagagtgacagacgctaccgaaactacaatcacgattagctggaggaccaagacagaaacgataacaggattccaggttgacgctgtgcccgcgaacggtcagacccccatccagcgtacaattaaaccggatgtgagatcttacaccatcacaggtttgcagccaggtacggattacaaaatttatctgtacacattgaatgacaatgcccgttctagccctgtggtgattgatgctagcacagccatcgatgcaccttccaatttgcggtttctcgctactaccccaaatagcctgctggtgtcatggcagcccccgagagctcggattacaggatacattattaagtacgaaaagcctggtagcccacccagggaagtggtaccccgcccccgacctggcgtcaccgaggctactattaccgggctggagcctgggacagagtataccatatacgtgatcgctcttaagaacaaccaaaaatcggagccgctcatcggcagaaaaaagaccggccaggaggccctctcacagacaactatctcctgggctcccttccaggacacatcagagtacatcatctcttgccaccccgtcggcacagacgaggagcctctccaatttcgcgttcctggaacttccaccagtgctacactgacaggcctgacacgtggcgcgacctataacgttattgtcgaagccctcaaggaccagcagcgacacaaggtgcgggaggaagttgtgacagtgggtaactcgggatggtgtcacgataacggcgttaactataaaatcggcgaaaaatgggataggcaaggtgaaaatgggcagatgatgagttgcacgtgtctggggaatgggaagggagaattcaaatgcgacccacatgaagcaacatgttacgacgacggcaagacttaccacgtgggtgaacagtggcaaaaggagtacttgggagccatctgcagttgtacttgcttcggtggtcagaggggctggcgctgcgacaattgtaggagaccagggggggaaccctctccagaggggactacaggacagagctataatcagtacagtcagcgctaccatcagcgcaccaacacaaatgtcaactgtcctatagagtgttttatgcccctggacgtgcaggccgatagggaggactcgcgagagtag

SEQ ID NO: 15231 - DNA, 7434 bp, Artificial Sequence
  Description of Artificial Sequence: Synthetic coding sequence
atgttgcggggcccaggaccaggtcttcttcttctggccgtgcagtgtcttggcactgcagtgccttcgacgggtgccagtaagtccaagaggcaggcccagcagatggttcaacctcaaagccccgtggcagtgagccaaagtaaacctggctgctatgataacgggaagcactatcaaatcaaccaacagtgggagcgcacatatctgggtaacgccctggtgtgtacctgctacggcggttctcggggatttaactgtgaatctaaacctgaggctgaggagacatgcttcgataaatacactggcaacacgtacagagtgggcgacacatatgagcgccctaaggacagcatgatctgggattgtacatgcattggagctggcagaggcaggatttcttgtacaattgctaatcggtgccatgagggcggccagtcctataaaattggcgacacgtggcgtcgcccccacgagacaggaggctacatgctcgaatgtgtgtgcttgggcaatgggaaaggcgagtggacatgcaaaccaatcgcggagaagtgctttgatcacgctgctggcacgtcctacgttgtcggggagacatgggaaaaaccttatcaaggctggatgatggtggactgtacttgcctcggtgaaggaagcggcaggattacgtgtacgagccggaacaggtgcaacgatcaggatacgagaacatcatatcgaattggggatacatggagcaaaaaagataatagggggaacttactgcagtgcatatgtactggcaatggccggggggaatggaagtgcgagagacataccagtgtccagactacctcttcggggagcggtcctttcaccgatgtgagagcagccgtctatcagccccagcctcacccccagccacccccatacggccattgcgtgactgacagtggagtcgtgtacagtgtgggaatgcaatggctgaagacgcaaggcaacaaacagatgttgtgcacatgcctggggaatggtgtgtcctgtcaggagaccgccgtcactcagacatacgggggcaattcaaacggcgaaccatgcgtgctgccatttacatataacggacgaacgttttactcctgcactactgagggtcgtcaggatggccacctgtggtgttccactactagcaactacgagcaggaccagaagtacagcttctgcactgatcacacagtgttagtgcaaacacgcggcggtaatagcaacggggccttgtgccatttcccatttctgtataacaaccataattacacagactgtacctcagagggacgtcgcgataacatgaaatggtgtggaacgacacagaactatgatgccgatcagaaattcggcttctgtccaatggcagctcatgaggagatctgcactactaacgagggagtcatgtatagaattggagatcagtgggacaaacagcacgatatggggcacatgatgaggtgcacttgcgtcggaaacggccggggcgaatggacttgcatagcttacagccagctcagggatcagtgcatagtggatgacatcacatacaacgtaaatgacacatttcacaaacgccacgaagaaggccacatgctgaactgcacctgtttcggccagggccgggggaggtggaaatgcgatccagtggatcaatgccaggactccgagaccggcacattttatcagatcggcgatagctgggagaaatacgtccacggggttcgatatcagtgttactgttatggcaggggaataggtgagtggcattgtcaacccctgcagacctaccctagcagctcaggacctgtcgaggtctttattaccgaaacaccttcccaaccaaatagtcacccgatacagtggaatgccccacagcccagccacatctccaaatatatcctcaggtggaggccgaaaaatagtgtgggcaggtggaaggaggctactataccaggacacctcaacagctatactatcaaagggctgaaacctggtgtggtatatgagggacagttaatcagcatacaacaatatggacatcaggaagtgactcgcttcgatttcacaacgacgtcaacttccacccctgttacgtccaacacggtaacgggcgaaaccacgccgttctctccattggtggctaccagcgagtcagtaaccgaaatcaccgcctcatctttcgtggtgtcatgggttagtgcatcagataccgtaagcggctttagagtagaatatgagctctcagaagagggtgacgaaccgcagtacttagacctcccatccacagccaccagtgtgaatattccagatctgctgcctggtaggaagtacatcgtgaatgtctaccagattagtgaggatggtgaacagtctctgattcttagcacgagccaaacaaccgctcccgatgctccacccgatactaccgtggatcaggtggacgatacatcaatagtcgtaagatggtcacggccccaagctccaatcaccggatatcggattgtttatagtccatcagtggagggatcatctactgagctgaacctccctgaaactgctaacagcgtgactctctcagacctacagccgggcgtgcagtacaatatcactatttatgccgtagaagaaaatcaggaatccacccctgttgttattcaacaggagaccaccggcacccctagatctgatacggtccccagcccccgcgacctgcagttcgtggaagtaactgacgtcaaggtaaccattatgtggaccccccctgagtccgccgttaccggataccgggtagatgttatcccagtcaatctgcctggtgagcacggccagcgcttaccaatctcccgcaatacgtttgccgaggttacaggattgagcccaggggtgacctattattttaaagtttttgccgtgagccacggacgcgaatctaaaccgttaactgctcagcaaactaccaagctggatgctcccacgaacttacaatttgtgaacgagactgacagcacagtgctggtgcgatggacccctccacgagcacagatcaccggttacagattgacagtaggtctgacgcggagggggcagcctagacagtacaacgtgggacctagcgttagtaaatatccactgcgcaatctgcagcctgcttcggagtataccgtttctcttgtggctattaagggtaatcaggagagccctaaggccaccggcgtctttaccacattacagccaggaagctcaatccccccttacaatacagaagtgaccgagactacgatcgtaatcacatggacgccggcgccaagaatcggctttaaactgggtgttcgtccatcacaggggggggaggcaccgcgagaggtgactagcgattcggggagtatcgtggtctcagggctgacaccaggagtcgaatatgtttacacaattcaggtgctgagagacggacaggagcgagacgctcccatcgttaacaaggtggtgactcctttatctccaccaactaatctgcacctggaagcaaaccccgacaccggagtgctaactgtgagttgggaacgcagtactacgcccgacataactggctatcgtatcacaacaacccccacaaacggacagcaggggaacagtctcgaggaagtagtgcacgctgatcaaagctcatgcacgttcgataatctgagtcccgggctggaatataacgtctccgtctacactgtgaaggatgataaagaatctgtaccaatctctgatacaattatcccagaagtgccacagctgaccgatctctcctttgtggatattactgactcaagtattggcctccgttggaccccgttaaactcatcaaccattattggatatcggattaccgtagtcgccgctggtgaagggattcctatcttcgaagactttgtggactcctccgtcggctactatactgtgaccggcctggagcccggcatagactatgacatttcggttattactctcatcaacggcggagaatctgccccaacaaccctgacgcagcagaccgccgtccctcccccaacagatcttcggttcaccaatatcggccctgataccatgcgggtcacttgggccccccctccatcaatcgacctgacaaacttccttgtgaggtactcaccagtcaagaacgaggaagacgtagcggagctgtccatctctccctctgataacgctgttgttctcacaaacttgctgcccgggaccgaatacgtagtttccgttagttctgtctacgaacagcacgaaagtactccacttagagggcgacagaagaccggcttagactcaccaaccggcatagatttcagtgacattaccgctaactcatttacagtccactggatagctccaagggcaaccattacagggtaccgaatacgacatcatcctgaacacttcagtggtaggcctcgagaagatcgcgtgccgcactcccgaaattccatcactctgacaaatctcacccccggaacggagtatgtggtaagcattgtggctctcaatggcagagaggagtcccctctactcatcggtcagcagagcacggtatcggacgtgcctagagatctggaggtggtggccgcaacacccacttcattactcatcagctgggacgccccagcagtcacagtgcggtactatcggattacttacggtgaaacaggtggcaacagcccagttcaagaatttactgtccccggctccaagtctactgccacaatttctggcctgaaacctggcgtggactatacaatcactgtctatgccgtgaccggaaggggggattcaccggcctcatctaagcctatctccataaactatagaactgagatagataagcccagccagatgcaggtcacagatgtgcaggacaatagcatcagtgtgaaatggctcccgtcctctagccccgtgactggctaccgcgtcactacgacccccaaaaacgggcctgggcctacaaaaacaaagacagcggggccagatcagacagaaatgacgattgagggactccaacctaccgtggagtacgtcgtttcggtttatgcacagaatccaagcggggagtctcagcctctggtgcagacggcagtcacgaatatcgacagaccaaaaggactggcatttacagacgtagatgtggactcaatcaagattgcttgggaatctcctcagggccaggtgtcgaggtacagagtgacctacagctccccagaagacggtattcacgaactgtttcccgcgcctgacggtgaagaggacacagccgaactgcagggcctgagacccgggtccgagtacacggtgagtgttgtggctttgcacgatgacatggagtcacagcccctcatcggcacacaaagcacagcgatcccagctcccactgatttgaaatttacacaagtgactcccacatcgttgtctgcccaatggacaccacctaacgtccagttaacaggctaccgtgtgcgggtgaccccaaaggagaagaccgggcctatgaaggaaatcaacctggcacccgacagtagcagcgtcgttgtatccggactgatggtggccactaagtacgaagttagcgtctatgcccttaaagatacactgacttccagaccagcacagggagtggtgacaactttggagaacgttagtccacctaggcgggctcgcgtgactgatgcgacggaaaccacaatcactatctcttggcggacaaaaacagaaactattacagggttccaagtggatgccgtcccagcaaacggtcaaactcctatccagaggaccattaagccagatgttaggtcctataccataaccggtttacaacctggcaccgattacaagatctacttatataccctaaacgataacgcgaggtcaagccctgttgtaatcgatgcttccaccgcaattgacgcccccagcaacctcaggtttctcgccactacccccaacagcctcctcgtctcatggcagcctcctcgcgctagaatcacaggctatattataaagtatgagaaaccaggctctccaccgcgggaagtggtacctagaccacggccaggcgtgactgaagccaccataaccggccttgaacctggaacagaatacaccatctatgtgatagccttaaaaaataaccagaagtcagaaccacttatcggtcgcaaaaagacggatgagctgccacagttggtaactctcccccaccctaacctgcacgggccggaaatcctggatgtcccctcgaccgtacaaaagacacctttcgtcacgcacccaggttatgatactggaaatggaattcagctgcctgggacaagtgggcagcagccgtccgtcggacaacagatgatttttgaggagcacggctttcgtcgtacaaccccgcctacgactgccacgcctataagacaccgcccgagaccatatccccccaatgtgggcgaggagatccaaattggccacatcccacgggaggacgttgattatcacttgtatccgcatggtcccggcctgaatccaaacgctagcaccggacaggaggccctgtcccagacgacaatctcttgggccccgtttcaggacacttccgagtacatcatcagctgtcatccagtcgggactgatgaagaacctcttcagttccgcgtgcccggtacaagcacatccgccacacttacaggactgactcgtggcgctacatataacgtgattgtggaagccttaaaagaccagcagcgccataaggtccgtgaggaggtggttacagtcgggaattccgtcaatgagggccttaaccaacccacggacgactcttgcttcgatccgtatactgtgtcacactatgcggtgggcgatgagtgggagagaatgagtgaaagcggcttcaagcttttatgccagtgcctcgggttcggcagcggacatttccggtgcgacagcagcaggtggtgccatgataacggggtaaattacaaaattggggaaaagtgggatcgtcagggagagaacggccaaatgatgtcctgtacttgtctggggaacggaaaaggcgagtttaagtgtgatcctcatgaagcaacatgctatgacgatggcaaaacttaccatgtgggagaacagtggcaaaaggaatatcttggagccatctgttcatgcacctgctttggcgggcagagagggtggcgatgcgataattgccggagacccgggggcgaacccagcccagagggaactacaggacagtcctataaccagtactcccagagataccaccaaagaacaaatacaaatgtcaattgccccatcgagtgtttcatgcccctagatgttcaagcagatcgggaggattcgagggagtag

SEQ ID NO: 15232 - DNA, 6891 bp, Artificial Sequence
  Description of Artificial Sequence: Synthetic coding sequence
atgcttcgagggccgggaccaggcctgcttcttctggccgtgcaatgccttggaactgctgttccgagtacaggtgctagcaaaagtaagcgacaggctcagcagatggtccaaccgcaaagcccagtggccgtgagccagtccaagcctggttgttatgataatgggaaacactatcagattaaccagcagtgggagcgcacatacttaggaaacgcactggtctgtacttgttatggcggctcccgaggcttcaactgtgaatcaaaacccgaggccgaggaaacttgttttgacaagtataccggtaacacctatagggtgggagacacatatgagcgccctaaagatagcatgatttgggactgtacctgcataggtgccggacgagggcgcatctcctgcacaatagcaaatcgttgccacgagggcggccaatcctacaagatcggagacacttggcggcgcccacatgaaactggaggctacatgttggagtgcgtgtgcctgggaaacggcaaaggagagtggacatgcaagcccatcgcagaaaaatgctttgatcatgccgcaggcacttcatatgtcgtgggagaaacttgggagaaaccctatcagggttggatgatggtggactgtacgtgcctgggtgaagggagtgggagaatcacatgtacctcccggaatcggtgtaacgaccaggacactcgcacctcttacaggattggagacacctggtctaaaaaagacaaccgagggaatttgctccaatgtatatgcacaggcaacgggaggggtgagtggaaatgcgagagacacacttccgtccagacaaccagctcagggtctgggccttttacggatgtgagagctgccgtctaccaaccccagcctcacccccagccccccccctatgggcactgcgttaccgatagcggtgtagtttattcagtgggcatgcagtggctgaagactcagggaaataaacagatgctctgtacttgtctgggaaacggggtgtcttgtcaggaaactgcagtcacccaaacctacggagggaatagcaacggcgaaccctgtgtgctgccgttcacttacaatggccggactttttactcatgcaccacggagggccggcaggacgggcacctgtggtgctccacaaccagcaattacgagcaagatcagaagtacagcttctgtactgaccacaccgttctggttcagaccagaggcggtaactccaatggcgctttgtgccactttcctttcctctataacaatcataactacaccgattgtacttccgaaggacggcgcgacaatatgaagtggtgcggcaccacccagaattacgatgctgaccagaagtttggcttttgtcccatggcagctcacgaggagatttgtaccacaaatgagggcgtgatgtatcgcatcggggatcaatgggataagcaacatgacatgggtcacatgatgcgatgcacttgcgtcggcaacgggcgcggagaatggacatgtattgcctactcccagttgcgcgatcagtgtattgtggatgacatcacctacaacgttaacgacacctttcacaagaggcacgaagaaggacacatgctgaattgcacctgctttggccagggacgcggcagatggaaatgtgaccccgtggatcaatgtcaagatagcgagaccggaaccttttaccaaatcggcgacagctgggagaaatacgtgcatggggtgaggtaccaatgctattgttacggccgaggaataggggaatggcactgtcagcccttgcagacatacccctcctcttccggccccgtggaggtgtttattaccgagactcccagccaaccaaatagccacccgatccagtggaacgcccctcagccgtcccatattagtaagtatatactgagatggagacctaaaaatagcgttggccggtggaaggaagctactattcctggacatctgaattcatatactatcaaaggcttaaaaccgggagtcgtatatgaaggacagctgatctcgatacaacagtatggacaccaggaggttactcggttcgactttacaactacatctacttccacccccgtgacatcgaatacagtcactggggaaactacccccttctctcctttggtggcgactagcgagtcagttacagagattacagcctctagcttcgttgtcagttgggtctcggcctcagatacagtatctggatttagagtggaatacgaattgtccgaggagggggatgagcctcaatacttagacctcccatcaacagctacatccgtgaatattccggatctgttgcccggacggaagtacattgtcaatgtgtaccagatctccgaagatggtgagcagtcgctcattttgagcacatcccaaaccacagccccagatgctccaccggatacaacagtggaccaggtggacgatacaagcattgtggtgaggtggagtcgcccgcaagcgcctattacaggttatcgtatcgtgtattcacccagtgtggaaggctccagcaccgaattaaacctgccggagacggcgaactccgttactctctcagatctacagcctggtgtgcaatacaacatcacaatctatgcagttgaggaaaaccaggaatctacccccgtggttatccagcaggagactaccggcacccctcgctctgataccgttccgtcacctagagacctgcagttcgtagaggtgactgatgttaaagtgaccatcatgtggacacccccggaatctgcagttactggctaccgagtagatgtgatacctgtgaacctgccaggcgaacacggacagaggctccctattagtcggaacactttcgccgaggtgaccgggctgtcacccggtgtgacatactactttaaggtgtttgcagtgagccacggtagagaatccaagccactgaccgcgcagcagactaccaaactcgacgcaccaacaaatttgcagttcgtgaatgaaactgatagtaccgttctcgtgcggtggactccaccaagagctcagattactggatatcggctgacagtggggctgacgagacggggccagccgcggcaatacaatgtcggtccatctgtgagtaagtaccctctgagaaacctgcagccagcatcagaatatactgtaagtcttgtcgctatcaagggaaaccaagagtcgccgaaagcaaccggcgtttttaccactctgcagcctggctcttcaattccaccttataacactgaggttaccgagactaccatagtcattacatggaccccagcaccacgaattggttttaagctgggagtccgtcccagtcagggtggcgaggccccacgggaggtgaccagcgatagcggtagtatcgtcgtgtcagggctgaccccgggggtagagtatgtgtacaccatacaggtgctgagggatgggcaagagagagatgccccaatcgtgaataaagtagtgaccccgctcagcccacccaccaatctccatttggaggccaatcctgacacaggagtccttacagtgtcatgggagcggtcaactacgcctgacatcacaggatatagaatcacaactacccctactaacggccagcagggcaattctttagaggaagtggtccacgcagatcagtcctcctgtacattcgataacttgtcccctgggctggagtacaacgtttccgtgtatacggtaaaagatgacaaagaaagcgtgcctatttctgacacaatcatccctgccgtgcccccccctacagatttgagattcactaatattggcccagacaccatgagggttacatgggctccgcctccgagcatcgatcttacaaatttcctcgtgaggtatagtccagtaaagaacgaagaggatgtggctgagctctccatctcaccctctgacaacgcagttgtcttgactaaccttctgcccgggacggaatacgtcgtctccgtgtccagcgtgtacgaacagcacgaaagcactcccctccgaggaaggcagaagacggggctggatagccccaccggcatcgatttctccgacataaccgctaactcctttacagtccattggattgcccccagggctacgatcacaggctaccgaatccgccaccatcctgagcacttctccggacgtccgagagaggatcgcgtgccacattctaggaactccatcactcttacaaatttgactccaggcactgagtacgtggtgagcatagtcgcactgaacggccgggaggaatctcccctgcttattgggcagcagagcaccgtgtcagatgtcccacgcgatctggaagttgttgcagctacacccacatctctactaatctcttgggacgctcccgctgtgacagtcaggtattacagaatcacttacggcgaaaccggagggaattcccccgtgcaagaatttactgtgcccgggtctaaaagcactgctaccatttcgggattgaagcccggggtagattacaccatcactgtttatgctgtcaccggtagaggggatagtcctgcctccagcaaacctattagtattaactataggaccgaaatagacaagcctagtcaaatgcaggtgaccgatgtgcaggataattccatctccgtgaaatggcttcccagcagcagtccggtcaccggctatagggtgacgacaacaccaaagaacgggcccggccccacgaaaactaagacagcaggacccgatcagaccgagatgacaatcgaaggcctccagcctacggtcgagtacgtcgtgagcgtttatgcacagaaccccagcggggagtctcagccactggtccagacagccgtaacaactattccggctcccaccgatctgaaatttacccaagtcacacctacatcccttagcgcccagtggactcctccgaatgtgcagttaactggttatagggtgcgggttactcctaaggagaaaacggggcccatgaaggagatcaacttggcccccgacagtagtagcgttgtggtctctggactgatggtcgccaccaagtatgaggtttcagtgtacgccctcaaagatacattaaccagtcggcccgcccagggggtggtgacgactctagaaaatgtgagtcctccaaggcgagctcgggtgacggacgcaaccgaaaccactataacaatttcatggaggacaaagacagagaccattacaggcttccaggtagacgcagttccagccaacggtcaaacccccatccagcgaaccatcaagccggatgtaagatcttacacgatcaccggactccaaccaggaaccgactacaaaatttacctatatactctcaacgataatgccagatcctcacccgtagtgatagatgccagtaccgctatcgatgcacctagtaacctgagattccttgcaaccactccgaattcgctgctggtgtcctggcagccaccgcgcgcaagaattaccggctacattattaagtacgagaaacctggcagcccccctagggaagtcgtcccgcggcccagacctggtgtgactgaggccacaatcacgggactcgaaccaggaacggaatataccatctatgtgattgcattgaagaacaatcagaagagcgagccccttattggacggaaaaaaaccgatgaactgccccagttggtgaccctgccacaccccaacttacacggacctgagatcctcgacgtgcccagcactgtacagaagacacccttcgtaactcaccccggatatgacaccggcaacggaattcaattgcccggaactagtgggcagcagccttccgtcggtcagcagatgatcttcgaagagcacgggttccgtagaaccacccctcccactaccgcaacgccaatcagacatcgcccacgcccgtacccacctaacgttggggaggagatccagatcggacacatcccgagagaagacgtggactaccacctttaccctcacggtcccggactgaatccaaatgcctctacaggccaggaggctctctctcagaccaccatctcatgggccccgtttcaagacacgagtgagtacattattagctgtcaccctgttggaactgacgaagagccactgcagtttcgagtgcccggtacctctacctccgcaactttgacagggctcactaggggtgccacgtacaacgtgatcgttgaggcactgaaggatcagcagagacacaaggtgcgagaggaagtcgtgacagtgggcaatagcgtgaacgaaggtctcaatcagccaacggacgacagctgcttcgacccatatacggtgtcacactatgctgtcggtgacgagtgggagaggatgagtgagtccggatttaagctcctttgccagtgtttaggtttcggatctgggcattttcggtgcgattctagccgctggtgtcatgataacggcgtcaattacaagatcggagaaaagtgggatagacagggggagaacggacagatgatgtcatgcacttgcctgggtaacgggaagggagagttcaaatgtgatccgcacgaggcaacatgctacgacgacggcaagacttatcacgtgggcgaacagtggcagaaggaatatctgggcgcgatctgttcctgtacctgtttcggcggccagcggggctggaggtgtgacaattgccggaggcctggcggggaaccttccccagaaggtactaccggtcaatcatataatcaatattcacaaaggtaccaccagcgtaccaacacaaatgttaactgtcctatcgagtgctttatgccgctcgacgtccaggccgatcgcgaggattctcgggagtag

SEQ ID NO: 15233 - DNA, 6096 bp, Artificial Sequence
  Description of Artificial Sequence: Synthetic coding sequence
atgcttagaggaccgggacccggactactgctgctcgccgtccagtgtctcggaacggccgttccaagtacaggagcctccaagtcaaagcgtcaggctcaacagatggtgcagccccagtcccctgtggccgtgtcacagtccaaaccaggctgctacgataatggcaaacattaccaaattaaccagcagtgggaaaggacctatctggggaacgccctagtgtgcacatgctatggcggcagccgtggattcaactgcgaaagcaagccagaggccgaggagacctgctttgacaagtacacaggaaatacttacagggtcggtgatacctacgagagaccgaaggatagcatgatctgggattgcacttgtattggcgccggcaggggacggatttcttgcaccattgccaacaggtgccacgagggtggccagtcctacaagattggagacacatggcggaggccccatgagacagggggctacatgttagagtgcgtgtgtctgggcaatggaaagggcgaatggacctgtaagccgattgcggagaagtgctttgatcatgccgccggcactagctacgtagttggtgagacctgggagaagccttatcagggctggatgatggttgactgcacctgtctgggggaaggttcaggtagaatcacctgtacttctagaaatagatgcaacgaccaggacacccgaaccagctaccggattggagatacttggtccaaaaaggacaatagaggcaatctcctacagtgtatctgcactgggaatggcaggggcgagtggaagtgcgaacgtcatacatccgtgcagactacgtccagcggcagcggtccattcaccgatgttagggccgcagtctatcagccgcaaccacaccctcaaccaccgccgtatggtcattgtgtgacagactcaggggttgtgtattccgtaggcatgcagtggctaaaaacccaggggaacaaacagatgttgtgcacctgtctgggaaacggggtgtcctgtcaggaaacggccgtgacacagacctacggtggcaactccaacggtgaaccatgtgtccttcctttcacctataacggacggacgttctatagctgcacaactgaagggcgccaggatggccacctttggtgttctaccacatcaaattacgagcaagaccaaaagtatagcttctgcacggaccacactgtgttggtgcaaacacggggcggcaattctaatggggccctctgtcatttccccttcttgtataacaatcataactatacagactgtacatcggaaggtcggagggacaacatgaagtggtgtggcactacacagaattatgatgccgatcagaagttcggcttctgccctatggcagcccatgaggaaatctgcactactaacgagggcgtcatgtatcgtatcggagaccagtgggataagcagcacgatatgggccatatgatgagatgcacctgtgtggggaatggcaggggcgagtggacctgtatcgcctactcacagttgagggaccagtgcattgttgacgatattacatacaatgtcaacgatactttccataagcggcacgaagaagggcacatgttaaactgcacttgtttcggacaaggaaggggcagatggaaatgtgatccagtcgaccagtgccaggatagcgagacagggaccttttatcagataggggattcctgggagaagtatgtgcacggggtgagatatcagtgttattgctatggtcggggcataggtgagtggcactgccagcccctgcaaacctatccctcaagttccggaccagtggaagtattcatcaccgagacaccttcgcaacctaacagtcatccaattcagtggaacgcaccccaaccgagccatatctctaaatatatcctgagatggcgacccaagaattctgtcggtaggtggaaggaagcaactatccctggtcacctcaattcctataccataaaggggcttaagcctggggtggtctatgaagggcaactgatctccattcagcagtacgggcatcaggaggtcacccgattcgactttaccacgacatccacctccacacccgtgacgtcaaacaccgttacaggggaaaccacgccatttagccctttggtggcaacatctgagtccgtcaccgaaatcaccgcgagttcctttgtggtgtcttgggtatcggcctccgacaccgtctctggcttccgagtggaatatgagctgtcagaggagggagatgaaccacagtatctcgatctgccctccacagctacctcagtgaatatcccggatttactgcctggcaggaagtacattgtgaatgtgtaccagatcagcgaggacggtgaacaatcgctgatcctgagtacatcccagaccaccgctccggacgcccctccagatacaacagttgaccaggtagacgataccagcatcgtagttagatggagccggcctcaggctcccatcactgggtacagaattgtctatagcccatcggtcgaaggcagctctactgagctaaacctgcccgaaactgcaaattccgtgaccctgtccgacctgcaaccgggcgtacagtacaacatcactatatatgccgtagaggaaaatcaggaaagtacacccgtcgtgatacagcaagaaacaaccggcactcccagatccgacacagtacctagtccacgtgatttacaattcgtggaggtgacagatgtgaaggtaactataatgtggaccccacccgagtcggccgtgacaggatatcgcgtggacgtaatacccgtgaatctccctggggaacatggacagcgactgcctatctcaaggaacaccttcgcagaagtgacaggtctgtcaccaggggtaacgtattactttaaagtgttcgccgtgagtcacggtcgcgagtcgaagccactgacggcccagcaaaccaccaaactagatgcacccacaaatctgcagtttgtgaacgagaccgacagcaccgtacttgttcggtggactccaccaagggcccagattaccggatatcgactaactgttggtcttacacgccggggacagccacgccagtataacgtgggaccttcagtttccaagtatcctttgcgcaacctgcaacccgctagcgaatatactgtgtccctggtggcgattaagggtaatcaggagagcccgaaggctactggggtgtttaccactctccagccggggtcctccatccccccttacaatactgaggtgactgagacaacaatcgtgatcacctggactcctgccccacgcataggcttcaagcttggagtgagaccatctcagggaggcgaggctcccagggaggttacttctgattcaggaagcatcgtcgttagcggactgacacccggagtggagtacgtgtacacaatccaggttttgagagatggacaggagagagacgctccaattgtgaataaggtggtgactcccctcagcccacccacaaacctacacctggaggccaaccccgacacaggtgtgttgaccgtgagttgggaacgaagcaccacaccagacatcacggggtatagaataacaaccactcctaccaacgggcagcaaggtaacagcttggaggaggtggttcacgctgaccagtcttcatgtacattcgataacctttctcctgggttggagtataatgttagtgtgtacacagtgaaagatgataaagagtccgtaccaatttcggatactattatccctgcagtgcctcctccaaccgacttgcgcttcacaaatatcggcccagacactatgagggttacgtgggctcctcctccttcaatcgatctgaccaattttctggtgaggtactccccagttaagaatgaggaggacgtggcggagctctcgatcagcccctctgacaacgctgtggtgctcactaacctgctgcctggaaccgaatacgtagtgagcgtaagctcagtctatgaacagcatgaatccacgccactgaggggaagacagaaaaccgggttagattcacccactggaatagactttagtgacataaccgcaaactcttttaccgtgcattggatagcgccccgggctaccataactggttatagaataagacaccacccggagcacttctccggtcgtcctcgcgaggatcgagtgccacactccaggaactcaatcacgttgacaaatctgactccaggtaccgaatatgtggtttccatagttgcccttaatgggcgggaagaatcccccctgctgatcggacagcagtcgaccgtgagcgatgtgcctcgggacttggaggtggtggccgctaccccaaccagccttctaatctcgtgggacgcacctgcagtgaccgtgaggtattacagaatcacctacggagaaacaggcgggaacagtccggtacaagaattcaccgtgcccggaagtaaaagtactgcaacaatttcaggattgaagcctggagttgactacaccatcacagtgtatgccgtgacaggccggggagatagcccggccagtagtaagccaattagcataaattataggaccgagatcgataaaccttcccagatgcaagtgacggatgttcaggacaactctataagtgtgaagtggttaccatccagctccccagtgaccggctatagggttaccaccactcctaagaacggtcctgggccaacgaagactaagacagcgggaccagatcaaactgagatgactattgaaggcctacagccgacagtggaatacgtggttagtgtctacgcccaaaacccatccggagagtctcaacctcttgttcagacagcagtgacaaacattgaccgccccaagggtctggccttcaccgacgtggatgtggactccatcaagattgcatgggagtctccgcagggacaagtgtcccgttacagggttacctactcaagcccagaggatgggattcatgagctcttccctgctccagatggcgaagaagacacagcagagctgcaagggttgcggccaggtagtgaatatactgtgagcgtcgtggcactacatgacgatatggagtcacagccactgataggcacccagagcacagccatacctgcaccaaccgatcttaagtttactcaggtaacaccaacgagcctctccgcccagtggacccctcctaatgtacagctaactggatacagagttcgcgtgaccccaaaggaaaagactggtccgatgaaggagatcaacttggcccccgattcgtcatctgtcgttgtgagcgggcttatggtggcaacaaagtacgaggttagtgtctatgcccttaaagacaccctgacatctcgccccgcgcagggcgtggtcactaccctggagaacgtctccccaccgcggcgcgcgagggttaccgatgcaaccgagacaacaattaccataagttggcggacaaagacagaaaccattacagggttccaggtggatgcagtacctgctaatgggcagacccctatccaacggactatcaagccagatgttagatcctatactataactggtcttcagcctggcacagattacaaaatctatctttatacattgaatgataacgctcgctcaagtcccgtcgtcatcgatgcgtctacagctattgacgctcccagcaacctaaggtttctcgccactactccaaactccctcctggtttcctggcagccccctcgcgctaggatcaccggatacataataaaatacgaaaagcccggctcccccccccgggaggtggtgcccaggccaagaccaggtgtaacagaggctacgatcacaggccttgaacctgggactgaatataccatttatgttattgctctgaagaataaccagaagtctgagcctctgattggacggaagaaaactggccaggaggcactgtcacagactacaatctcttgggctcctttccaagatacatccgaatatatcattagttgtcatcccgtgggtacggacgaagagcctctccaatcaactaaggcctag

SEQ ID NO: 15234 - DNA, 6531 bp, Artificial Sequence
  Description of Artificial Sequence: Synthetic coding sequence
atgctgcgaggccccgggcctggcctcctgctgcttgccgtgcagtgtctgggcacagcagtgcctagtacaggggcttccaagtccaagcgccaagcgcagcagatggtccagccccagagccctgtcgcagtgtctcaaagcaagcctggttgctacgacaacggtaaacattatcagataaatcaacaatgggagcgcacatatctcggcaacgcactggtgtgtacctgctatggtggctctagggggtttaattgcgagagtaagcctgaggctgaggagacctgctttgacaagtataccgggaacacctatcgtgttggcgacacttatgagcggcctaaggatagtatgatctgggactgcacatgcatcggcgctggaaggggcaggatatcttgcaccatcgccaaccggtgccatgaaggagggcagtcctataagattggggatacctggcgccggccccacgagacaggcggctacatgctcgagtgtgtgtgcctcggcaacggcaaaggtgagtggacctgtaaaccaatagccgaaaaatgcttcgaccacgccgcagggacttcatatgtagtgggcgaaacgtgggagaagccataccaggggtggatgatggtggactgcacttgcctgggcgaagggtcaggacggatcacatgtacgtcacgcaatagatgtaatgaccaggacacccgcacaagctatcgcataggcgacacttggtccaaaaaggacaatcgcggtaaccttctgcagtgcatctgtacagggaacggacgtggcgaatggaagtgtgagaggcatacctccgtgcagactacgagctccggctcagggccgtttactgatgtccgcgcggcagtataccaacctcagccacacccccaaccacccccttatgggcactgcgtgacagatagcggcgttgtctattctgtggggatgcagtggctcaaaacgcagggaaataaacaaatgttgtgcacatgccttggcaatggagtatcctgccaggaaaccgcagtcacacagacttacggcggaaactccaacggcgaaccctgtgtgttgccattcacgtataacggaagaaccttttactcctgtaccactgagggtcgtcaggatggccacctttggtgcagtaccacttcgaactacgagcaggaccagaagtatagtttctgtaccgatcacacggtcctcgtgcaaacgcgcggcggtaactcaaacggggctctctgtcatttcccatttttatacaataaccataactacaccgattgtacatctgaaggtagacgggataacatgaagtggtgtggcacaacccagaattatgacgcagaccagaagtttggcttctgtccgatggcagcacatgaagagatctgcacaaccaacgagggggtgatgtaccgaataggtgatcagtgggataagcagcacgatatgggtcacatgatgaggtgcacctgtgtgggtaatggccgaggagagtggacctgtatagcttactcccagttacgagaccaatgcatagtggacgatataacctacaatgtgaacgacaccttccacaagcgtcatgaagagggccacatgctgaattgtacctgtttcgggcagggtcggggcagatggaagtgcgacccagtcgatcaatgccaggatagtgagactggcactttctaccagataggcgactcttgggagaaatacgtgcacggggttaggtatcaatgctactgctacggaagggggataggagaatggcactgccaaccactgcaaacatacccatcgagtagcggcccagtcgaggtgtttattacagagaccccgtctcagcctaactctcatcccatccagtggaatgctcctcaaccctcacacatctcgaagtatatcctgagatggaggcctaaaaactctgtgggccgatggaaagaggcaactattcctggccatctgaactcgtatactattaagggcctgaagccgggagtcgtgtacgaagggcaactgatttccatccagcaatatgggcaccaggaggtgactaggttcgactttaccactaccagcacatccacaccagtgactagtaacacagtgaccggcgagaccactccattttcacccctcgtggcaacctctgaatctgtgactgagatcaccgctagtagctttgtggtctcctgggtctcagctagtgacaccgtttctggtttccgagtcgaatacgaactgtccgaggagggcgacgaaccacagtacctggatctcccatctaccgcaacttccgttaatatacccgacttgctgcctggtcgtaaatatattgtgaatgtgtatcaaatttcggaagatggcgagcaatccctgatacttagcacatcacagaccacagcacccgatgcccctcctgatacgaccgtggatcaggtcgatgacacaagcattgtggtgagatggtcacgtccgcaggctccaattaccggatatcgtatcgtctattcgccgtcggtggaaggctcatcaacagagctcaacctgcctgagactgcaaactccgtgacactgtctgacctccagccgggtgtacagtacaacatcactatatatgcggtggaggagaatcaggagagtactccagtggtcatacagcaggagacaaccggaacgccgcggagtgatactgtgccaagccctagggatctgcagtttgtggaagtgacagatgtgaaagtcactataatgtggacgccacccgaaagcgctgttactggctaccgagtggatgtaatcccagtgaacctcccaggagagcacggacaaagactgcctatctcacgcaataccttcgccgaggttaccggactctcaccaggtgtgacatactattttaaagtcttcgccgtgtcccatggtcgagaaagtaaacccctgacggctcaacagacaaccaaactagacgctccaacaaaccttcagtttgttaatgagactgactccacggtgttggtccgatggacaccaccgcgcgctcagatcactgggtaccggcttacagttggcttaacaaggagaggacagcccaggcagtataatgttggtccatccgtttctaagtacccacttaggaatctgcagcccgcctccgaatataccgtttccctcgtggctattaagggaaaccaagaatcacctaaagctaccggtgtgttcactaccctgcagccaggcagttcaatcccaccttacaataccgaagttaccgagacaaccatagtcataacatggacaccggccccgcgcatcggcttcaagctgggggttaggccatcacaagggggcgaagctccaagggaggtgacctccgattccggttcaatagtcgtatccggcctaacaccaggagtcgaatacgtgtacacaatacaggtcttgcgagatggacaggaaagagacgcacctattgtgaataaagtggtcactccactgtccccccctaccaatttgcacctagaagccaaccctgataccggtgtacttacggtcagctgggagcggtcaactactccagacataactgggtacaggattacaaccacccccactaatggtcagcaaggcaattctctcgaggaggtggttcatgcagatcagtctagttgtacttttgacaatctaagtcctggccttgagtataacgtttccgtctacactgtcaaagacgataaggagagcgtgcctatcagcgacaccatcatccccgcggtgcctccgcctactgatctcaggtttactaatattggtcctgacactatgcgggtcacttgggcccctccacccagcattgatctgacaaactttctcgtcagatattctccagtcaagaatgaggaagacgtggcagagttgtctatctctccaagcgacaatgcagtggtcctaactaatctgctgccagggactgaatacgtggtttcggtctcctccgtttatgaacagcacgagtccaccccccttaggggacgacagaaaaccggattggatagtcctactgggatagacttttccgacataaccgcaaacagtttcacagttcattggattgccccaagggccactatcacaggctacaggattaggcatcatcctgaacacttctcagggagacctagagaagaccgagtccctcactcccgtaactcgattacactcacaaatctgacccccggtaccgaatacgttgtttctattgtagccctaaacggtcgagaggagtctccccttctaatcggacagcaatccaccgtctcagacgttcccagagatctggaggtcgtcgccgcaacaccgacatctcttttaatatcatgggacgcccctgcggtaaccgtacgctactataggatcacatacggcgagacgggaggtaacagccctgtgcaggagttcacagtccctggctccaagtctaccgctacgatctcgggactcaaacccggagtagactatacaatcaccgtttacgcggtgacagggcgtggagacagcccggccagtagtaaacccatctccatcaactataggaccgagatcgataagccaagccaaatgcaagtgacagatgtgcaagataactccatctcagtgaagtggttaccatcttcaagccccgtgaccggataccgggttaccaccactcctaaaaacggaccgggtcctaccaagactaaaacggcaggcccggatcagactgaaatgaccatcgagggcctccaaccaactgtcgagtacgtcgtttcagtgtatgcgcagaaccccagtggtgaatcgcaacctcttgtgcaaactgcagttacaacgattccagccccaactgacctgaagtttacacaggtgactccaacatcactgtcagcccagtggaccccaccaaacgtgcagctcaccggatatagagtacgggtaacccccaaggaaaaaacaggccccatgaaagagattaacctggcacccgatagctcatctgtggtggtcagcgggctcatggtggccaccaagtacgaagttagtgtgtacgccctcaaagacaccttgacctctcgtccagcccagggggtggttacaactttagagaatgtcagcccacctcgcagggctagagtcacagacgctaccgaaacaactatcactatatcctggcggaccaaaacggagaccatcaccggcttccaagtggacgctgtcccagccaacgggcagactcccatccagagaactatcaaacccgatgtccgatcctataccattaccggcctgcagccgggcacggattataaaatctacttgtatactctgaacgacaacgcccggtcttctcctgtggtcatcgacgcctctactgcaattgacgcaccctccaatctgcgttttctagccacgactccgaacagcctgttggtttcttggcagccacccagagcccgcataaccgggtatatcattaagtacgaaaagccaggttctcctcctcgggaggtggtgccaagacctagacccggtgttacagaggctacaatcacaggcctggagcccggtaccgagtacacaatttatgtgattgccctgaagaataaccagaaatctgaacctctgatcgggaggaagaagactggtcaggaagccttgtcacagacaaccatttcctgggccccctttcaggatacaagcgagtatatcatctcctgtcatcctgtaggaacggacgaggagcccctccagtttagggtgccagggactagtacgagcgccaccctgacgggactaaccaggggcgcaacgtacaacgtgatcgtggaggctttgaaagaccagcagcgccacaaggtgcgggaggaagtggtgaccgtgggaaacagcgtgaatgaaggcctgaatcaacctactgacgactcttgcttcgacccatatacggttagtcattacgccgtgggagacgaatgggagaggatgtccgaatccggatttaagctcctgtgtcaatgcctggggttcggaagcggccatttccggtgcgattcctctagatggtgtcacgataacggggtgaattataaaatcggggagaagtgggatagacagggggagaatggccagatgatgtcctgcacttgcttaggcaacggcaagggcgaatttaaatgcgatccacacgaggcgacatgttacgacgatgggaaaacctaccatgtaggcgagcaatggcagaaggagtacctgggggccatctgctcttgtacctgttttggaggtcaaagaggctggagatgtgataattgtagacgacccggaggtgaaccttcgcccgaaggcaccactggccagagctacaatcagtatagccagaggtaccaccagagaacaaataccaatgtaaactgtccaatcgagtgtttcatgcctctggacgtgcaggccgatagagaggattccagggagtag

SEQ ID NO: 15235 - DNA, 7161 bp, Artificial Sequence
  Description of Artificial Sequence: Synthetic coding sequence
atgctgcgcggtcccggccccgggctcttactcttagccgtacagtgcctcgggacagccgtgccctccaccggcgcctctaaatcaaagagacaagctcagcagatggtgcaacctcaatctccagtggccgtgagccagtctaagcccgggtgttatgataacgggaaacattatcagatcaaccaacagtgggagaggacgtatcttggaaacgctctggtatgcacatgctatgggggctcccgtggtttcaattgtgagtcaaaaccagaggccgaagagacctgctttgacaagtacacaggcaacacgtatagggtcggcgatacatatgagaggcccaaagacagtatgatatgggactgtacctgtattggagccggcagaggcagaatctcctgcactatagcaaacagatgtcacgaaggagggcagtcctacaaaatcggcgatacctggcggcgcccccatgaaaccggggggtatatgctggaatgtgtgtgtctcggtaacggcaagggggaatggacctgtaagccgatcgcagaaaaatgcttcgaccatgcagcaggcacgtcatacgtggtcggcgagacatgggaaaaaccatatcagggctggatgatggtggattgtacctgcctgggggaggggagcggccgaattacatgcaccagccgaaatcgatgtaatgaccaggatactcgaaccagttacagaattggcgacacctggagcaagaaagacaacagaggtaatctcttacagtgtatatgcacggggaatggccggggggaatggaaatgcgaaaggcacacctccgttcagacaacctcctctggtagcgggccctttacagatgtccgggctgccgtgtatcagccccagccacatccacagcctcctccctatgggcactgtgtgactgatagcggagtggtatattcagtcggtatgcagtggctgaaaacgcagggcaataaacagatgctatgcacctgcctgggcaacggcgtgagctgccaggagactgctgtgacccaaacatatggcggaaattccaacggggaaccctgtgtgttgcccttcacatacaacggccgaacattctattcatgtaccacagagggtaggcaggatggccacctctggtgcagtaccacatcaaactacgagcaggaccagaagtattctttctgcacagatcacaccgtactggttcagacaagaggtggcaacagcaacggggcattgtgccatttccctttcctgtataataaccataattacaccgactgcacgtcagaaggacgcagggataatatgaagtggtgtggaacaactcagaactacgatgccgaccagaagtttggcttctgccccatggccgcccacgaggaaatttgcaccacgaacgaaggcgtaatgtacaggatcggggaccagtgggataaacagcatgacatgggccacatgatgaggtgcacgtgtgtgggaaacggcagaggagaatggacctgtatagcctattctcagcttcgggaccagtgtattgtcgacgacattacgtacaatgtgaacgatacgttccataaaagacatgaggagggccacatgctgaattgtacctgcttcggccagggtaggggcaggtggaaatgtgatcccgtggatcaatgtcaggattctgagacaggcaccttctaccaaataggggatagctgggagaaatacgtccacggggttaggtatcagtgttactgctacggccggggcattggagagtggcactgccaacccctacagacatatccttcctcctctggccctgtggaagtatttatcacagaaacacccagccaaccaaattcacatccaatacagtggaatgcaccccagcctagtcatatctctaagtatatccttcgatggaggccaaagaatagtgtcggtcgatggaaggaggctacaatcccaggccacttaaactcatataccattaaggggcttaagcccggcgtcgtttacgagggccagttaatctccatccagcagtacgggcaccaggaagtgacccggtttgactttacaactacttctacgagcacgcccgtcacgtccaacacggtaactggagagaccacaccattcagtcccctggtggcaaccagcgaaagcgtgaccgagatcaccgcatcctccttcgtcgtgtcatgggtgagtgccagcgataccgtctctggatttcgcgtggagtatgagttgagtgaagagggggatgagccccagtacttggatctgccctccactgccacgagcgtgaacattccagacctgttgcccgggcgtaagtacattgtaaacgtctaccagatttcagaggatggtgaacagagtctcattcttagcaccagccaaaccactgcgccagacgcaccccctgatacaacagtcgatcaggtcgatgataccagcatcgtagtgcggtggagccggcctcaggcacctattacaggataccggattgtctacagcccatccgtggaggggagttcaaccgaacttaacctgccggagacagcaaattctgtgaccctgtctgacttacagcctggggtgcagtacaacatcacgatctatgctgtggaggagaaccaggaatcaactccagttgtgatacagcaggagacaactggtaccccacggtctgataccgtgcccagcccccgagatctacagttcgtcgaagtcacagacgtcaaagttaccattatgtggacacccccagaatccgccgtcactgggtatagggtggatgtgatacccgttaacctcccaggagagcatgggcagagactgcccatttctaggaacacatttgctgaagtcaccggtctgtctcccggggtcacgtactactttaaagtattcgccgtgtctcacgggagggaaagcaaacctctgaccgcacagcagaccaccaagctcgacgctcctactaatctccaattcgtgaatgagactgactccaccgtgctggtcagatggacgcctcctcgtgcacaaatcacagggtataggcttactgtgggacttacacggagggggcaaccacgccaatacaatgttggaccctcagtttcgaagtatcccctccgcaaccttcaacctgccagtgagtacactgtgagcctggttgccatcaaggggaaccaggaatcccctaaagcaacaggtgtgttcaccactctacagcccggaagctcaatacctccctacaacactgaggttacagagaccaccatcgtgattacctggacgcccgcccccagaatagggtttaagttgggggtcagaccttcacagggcggcgaggcacctcgcgaagtgactagcgatagcggctctattgtggtgtcaggcctcacacctggggttgagtatgtctacaccatacaggtgctgcgagatggccaggaacgggacgcaccaatagtgaataaagttgtgacaccgctgtcgccaccgaccaatctacacctggaggccaatcctgacactggtgtgcttacggtgagttgggagcgctctactaccccggatataacaggctaccggattacaacgactcccaccaatggtcaacaggggaattccctggaggaagtggtccatgcagatcagtcttcatgcacattcgataacctgtctccgggcctggaatacaatgtgtcagtttacacagtcaaggacgataaagagtctgtgccgatctctgacacaatcattcctgccgtgcctcccccaactgacctccgctttacgaacataggcccagacactatgagagtgacctgggctccaccacctagcatcgacctgactaattttcttgttcggtacagcccggttaagaacgaagaggatgtggctgaactctctatttccccatcagataacgcggtggtgctgacgaacctgctccccggcactgaatatgtcgtctctgtgtcgagcgtgtatgagcagcacgaatctacacctctgagaggcagacagaaaactggccttgattctccaacaggaatcgacttcagcgatatcactgctaactctttcacggtccattggatcgcaccacgtgccaccatcactggatacaggatcaggcaccacccagaacactttagtggaagacccagggaagatagagttcctcactcgagaaacagtatcaccttgacaaatctgactcccggtaccgagtatgtggtatcgatcgtcgctctgaacggaagagaggagtctccccttctgattggccagcagtctactgtgtccgatgtaccccgcgatttggaagtcgtggcggccactcctacaagtcttcttattagttgggacgccccagctgtgactgtaagatattacagaattacttatggcgagacagggggtaacagtccggtgcaagaatttactgtcccgggaagtaagtctaccgctacaatatccggactcaagcccggggtggactacaccataaccgtgtacgctgtaaccggtaggggggattctccggcctcctccaaacccatcagcattaactaccggacagagatcgacaagcctagccagatgcaggtgacagatgtgcaggacaacagcatttctgtgaaatggctgccttcctcatccccagtgacagggtaccgggtgaccacaacacccaaaaacggcccgggacctactaagactaaaacggctggtcctgatcaaacagaaatgaccattgaaggtttacagcctaccgtggaatacgtggtgtctgtgtatgcccaaaacccctcgggcgagtcccagccgttagtgcagactgccgttaccaatattgatcgacccaaaggactggcttttactgatgtggacgtggacagtatcaagatcgcctgggaatcaccccagggacaagtttcccgctaccgcgtgacttacagttcaccagaagacgggatacatgaactgtttccagcgccggacggcgaagaagacacggccgagttacagggcctccgaccgggctctgaatacacagtctcggtcgtggcactgcacgacgatatggaatcccaacctctaatcggaactcagtcaactgctatcccagccccgaccgacctaaagtttacccaggtgacaccgacctcactgtcagcacagtggacgccccctaatgtgcagttgaccgggtaccgagtcagagtcaccccaaaggaaaagacaggacctatgaaagagatcaatctggccccggactcttcaagcgtagtggtgtctggtctgatggtggccacgaagtatgaagttagcgtctatgccttgaaagatacactcacctctagaccagctcagggtgtggtgactaccctggagaatgtgagccctcctcggcgcgcccgagttaccgacgctacggaaaccactatcacgatctcttggcgaaccaagacggagaccatcacaggctttcaggtcgatgcagttcccgcaaatggccagactcccattcagcggacaataaaacccgacgtcaggagttacacaattacaggacttcagcctgggaccgactacaagatatatctgtatacactgaacgataatgcccggagtagtcccgtcgtgattgacgcttcaaccgccatcgatgccccgagtaatcttcggtttctggccacaaccccgaactcactgctggtgtcctggcagcccccacgagcccgcatcacaggatacattatcaagtacgaaaagcctgggagcccgccaagggaagtcgttccaaggccccgaccaggagtcaccgaagctaccatcactggtttggagccaggaacggagtacacaatatacgtgatagccctcaagaataaccagaaatccgagcccctgataggcaggaaaaaaaccgacgagctgcctcaactcgtcacgttacctcaccctaacctccacggccccgaaatccttgacgttccatctaccgttcagaagaccccttttgttacccaccccggatatgacacaggaaatggtattcagctcccgggcactagtggccagcagccttctgttggacagcaaatgatctttgaggaacacggcttcagacgtaccacaccccctacaacagctacaccaatccgacaccgcccccgaccatacccccccaacgtgggcgaggagatccagattggccatatcccacgggaagacgttgattatcacctgtatccgcatggtcccggccttaaccctaacgccagtacagggcaggaggccctgagccaaacaacgatctcctgggctccttttcaggacacctctgagtacattattagctgccatcctgttggcaccgatgaggagcctctgcagttccgggttcctggcacttccacgagcgccacattaaccggcctcaccaggggtgccacttataatgtgatcgtcgaagctctcaaggatcaacagcggcacaaagttcgcgaagaggtagtgaccgtcggcaacagcgtgaatgagggcttgaaccagcctaccgatgactcatgcttcgacccttacaccgtgagtcactatgccgtgggggatgaatgggagcggatgagcgagtccggttttaaattgctgtgccagtgcctgggattcggctcgggacatttcagatgcgactcctcaaggtggtgccacgataatggagtgaactataagatcggagaaaagtgggaccgacaaggagagaacggccagatgatgtcttgcacctgcctgggcaacggtaagggagagttcaagtgtgatccgcatgaagccacgtgctatgacgatggaaaaacctaccacgtgggcgagcagtggcagaaagaatatctcggtgccatatgttcttgtacatgtttcggtggccagcgcggatggaggtgcgataactgtcggcgtccaggtggggagcctagccctgaaggaaccaccggccaaagttacaatcagtattcacaaaggtaccatcagcggacaaacacaaacgtcaactgccctatcgaatgttttatgccactcgatgtccaggctgatcgcgaagacagccgagaatag

SEQ ID NO: 15236 - DNA, 6723 bp, Artificial Sequence
  Description of Artificial Sequence: Synthetic coding sequence
atgcttagagggcccgggcccgggctcttgctactggcagtccagtgcctgggcactgccgtaccaagcactggagccagtaagtctaaacgccaggcccaacagatggtccagcctcaatccccagtcgccgtttctcagagcaagcctggatgttacgacaatggtaaacattaccagattaaccaacagtgggagaggacatacctgggtaacgccttggtgtgtacatgctacggtggcagcagaggctttaactgcgagagcaaaccggaagccgaggagacttgctttgacaagtataccggaaatacttacagggtcggtgatacctacgagcggccaaaggactctatgatttgggattgcacctgcatcggagccggacgaggacgaattagctgtaccattgctaatcgctgccatgagggcggtcagagttataagattggagacacctggcgccggccacatgaaacaggcggatacatgctggagtgcgtctgtctgggcaacggaaaaggggaatggacttgcaagcctattgcggagaagtgcttcgaccacgccgccggaacatcttacgtggtgggcgagacatgggagaagccctatcaggggtggatgatggtggactgcacatgtctaggggaaggaagtggaaggattacttgcacctcccgtaaccgctgcaacgatcaggacacgaggacgagctaccggattggagacacttggagcaaaaaagataatcgggggaatttgctccagtgtatatgtactggcaatggtaggggcgaatggaaatgcgaacgacacacatccgtgcagaccacctcatcgggaagtgggccctttacagatgtccgtgccgctgtgtatcaaccgcagccacatccgcagccaccgccgtacggccactgtgttactgactccggagttgtgtattctgtgggtatgcagtggcttaaaactcagggaaacaagcagatgctctgcacttgtctgggtaacggcgtctcatgtcaggagaccgccgtcacacagacttatgggggaaacagcaatggcgaaccctgtgtgctccctttcacctacaatggtcgtaccttttactcttgtaccacggaggggaggcaggatggacacctgtggtgcagtacgactagcaattatgagcaagaccagaagtactctttttgcaccgaccacaccgtgttggtgcagacaagggggggcaatagtaacggggccctttgccatttcccgttcctttacaacaaccataattatacggattgtacgtccgagggtcggcgagacaatatgaagtggtgcggtaccacccagaattacgacgcggatcaaaaattcggcttttgtccaatggccgcccatgaggagatttgcacaacaaacgagggtgtgatgtacagaattggagatcagtgggataagcagcacgacatgggccacatgatgaggtgcacgtgtgttgggaacggccgaggagaatggacctgcatcgcttacagtcagttgagggaccagtgcatcgtagacgacatcacatacaatgtcaacgatacgttccataaacgccacgaagaaggacacatgctgaattgcacctgcttcggtcagggaaggggacgatggaagtgtgaccctgtcgatcagtgtcaagactccgagaccgggacgttctaccagataggggacagctgggagaaatacgtccatggtgtgagatatcagtgttattgttatggtagaggaattggtgaatggcactgtcagcccctccagacctacccgagcagttccggcccagttgaagtgttcatcacagaaacaccatctcaaccaaacagccaccccatccagtggaatgccccccagcccagtcacatatctaagtacatactccgctggcgaccaaaaaactcggttgggcgctggaaagaagcaactatccccggccacctgaatagctatacgattaagggcctcaagccaggggtggtgtacgagggccagcttatttcaatccagcaatatggccaccaggaggtgaccaggttcgatttcaccacaacatctacatcgacgccagtaacgtcgaacacagtgaccggagaaaccacccctttcagcccactggtggctacctctgaaagcgtaaccgagatcacagccagctccttcgtggtgtcctgggtcagcgcgtctgacactgtttcaggatttcgcgtggagtacgaactgtccgaggagggagacgaacctcagtatttggatctccccagcaccgcgaccagcgtgaatattcccgacttattaccaggccgaaaatatatcgtgaacgtctatcagatttccgaggacggcgaacagagcctgatcctgagtacttcacagacaacagcccctgacgcgcccccagatacaacagtggaccaggttgatgatacctcaattgtggtgaggtggtctcgcccacaggcaccaattaccggctaccgcattgtgtactcaccgtcagtagaggggagctctactgagctcaatctgcccgagacagccaatagtgttaccctgtccgatctgcagccaggggttcaatacaatatcacaatatatgcggttgaagagaatcaagagtccaccccggtcgtgatccagcaggaaactacaggtacgcctcgcagcgacacagttccttctccacgggatctgcagttcgtggaggtcaccgacgtgaaggtgactatcatgtggacccctcccgagagtgccgttaccgggtatcgcgtcgatgtgatacctgtgaacctccctggcgagcacggccagcgtctgccaatatcgaggaataccttcgccgaggtaactggattaagcccaggagtgacctattacttcaaggtcttcgctgtgtcacatggccgggaatcaaagcccttaaccgcgcagcagaccacaaaactggacgcacctactaatctgcagttcgtgaacgaaaccgactctaccgtgctcgtcaggtggacacctccacgagcacagataacaggctaccggctaacagtcggtctgacacgccgcggtcaaccccggcaatacaacgtcgggccaagtgtgagcaagtacccacttaggaaccttcagcccgctagcgagtacacggtcagcctggttgctatcaaaggaaaccaggagagccctaaagcgaccggagtgtttactacactgcagcctggaagctctatcccaccctataacactgaggtaaccgaaacaaccattgtcatcacttggaccccggcccctcgaatcggctttaagctcggtgtgcgaccgagtcaggggggagaggcgccccgcgaagtgacgtcagacagcggctctattgttgtgtcagggttgacaccgggggtggagtacgtgtataccattcaggtcttaagagacggccaagagcgcgacgccccaatcgtgaacaaggtagtcactcctctgagtccccccaccaacctccacctcgaagcaaaccccgacaccggcgtcctcaccgtctcctgggagcgatcaacaacccctgatataactggatacagaattacaactaccccaacaaacggccagcagggaaacagcctggaagaggtggtacatgctgaccagtccagttgtacatttgataatctttcccctgggttggaatacaacgttagcgtctacaccgtgaaagacgacaaggaatccgtgcctatcagcgacactatcattcccgctgtgcccccccccacagatcttcgattcaccaacattgggcctgataccatgagagtcacttgggccccacccccctcaatcgatctcacaaattttcttgtgcgctactctccagttaaaaacgaagaggatgtggctgagctgtcaatctctccctcggataatgctgtcgtgctcaccaatttgctgcccggcaccgagtacgtagtctcagtaagtagtgtatatgaacagcacgagagtacacccctcagaggtcgacagaagaccggccttgacagtcccaccggaatcgattttagcgacatcactgccaactcatttaccgtgcattggatcgcccccagggctacaattacaggatacagaatcaggcaccaccctgaacattttagcggccgaccccgcgaagatcgtgtcccacattctcgtaacagcatcacactcacaaaccttacaccgggtacagagtatgtcgtctctatcgtggcgctgaacggtagagaggagagtccactcctgattggtcagcagtctaccgtttcagatgtccccagggatctcgaggtcgtagcagcaacaccaacaagcttgctgatctcctgggacgcccccgccgtgaccgtccgttactacaggataacgtacggggagaccggggggaatagccctgttcaggagtttactgttcctggatcaaagagcacagccacaatttctggtctgaaacctggagtggattataccattaccgtgtatgctgtgaccggccgcggcgacagtcctgcttctagcaagccaataagtatcaattatcgaaccgaaatagacaagccgtcccagatgcaggtgacagacgttcaggacaatagcatctccgttaagtggctccctagcagcagccctgtgaccgggtatcgcgtgacgacaaccccaaagaatgggcccggacccacgaagactaaaacggctggccccgaccagaccgagatgaccatagagggcctgcagccaaccgttgagtatgttgtgagcgtttacgcccagaatccctctggagagtctcagcccctagtccagaccgcggtcacaaccattccagctccaaccgacctgaagttcacccaggtgactccaacttccttgtccgctcagtggactccgcctaatgttcagttaacaggatatcgagtacgcgtgactccaaaagaaaaaaccggcccaatgaaggagataaatttagctccagacagttccagcgttgtagtatctggtctaatggttgcaactaaatatgaggtcagcgtatacgccttgaaagatacgctcacatcgagacctgcccagggtgtggtgacaacccttgaaaacgtgtccccccctaggcgagcccgtgtcaccgatgctaccgagacaacaatcactatcagctggcggaccaagacagagacaatcacaggattccaggtggacgcagtgcccgcaaacgggcagactcctatccaaaggactatcaaacccgatgtaagatcatacaccatcacagggctccagcctggcacagattacaaaatttatctatatactcttaacgacaatgccagatcatcgcctgtggtcatcgatgcgtcaaccgccatcgacgccccctccaatcttcgattcttagcgaccacccctaatagcctcctggtctcatggcagcctccacgcgctaggataactggatacatcatcaagtacgagaagcccggctctccaccacgggaagtggtgccacgcccgcgacccggcgttacagaagccacaattactggactagaaccaggcacagagtatactatttatgtaatcgcgctcaaaaacaatcagaagtccgagcctctgatcgggaggaaaaagacagtgcaaaaaacccctttcgtgactcaccccgggtatgacaccggtaacgggattcagctgcctgggacaagcggtcagcagccctctgtgggccagcaaatgatctttgaggaacatgggtttagacggactacacccccaaccaccgctacccccattcgtcacagaccccgtccttatcctcccaacgtagggcaggaagcgctgtcccaaaccacaatcagctgggcgcccttccaagatacatctgagtacataatctcatgccacccagtgggcacagacgaggagcccctgcagttcagagtccccggtacttcaacttctgccacactcactggactcacgaggggggctacgtacaatgtgattgtggaagctttaaaagatcagcagcgacacaaagtgcgagaggaggtggtgactgttgggaacagtgttaacgaaggcctcaaccagcctactgatgactcctgctttgacccctacacagtcagtcattatgccgtgggcgatgagtgggagcggatgtctgaaagcggctttaagttgttgtgccagtgcctcggtttcggttcagggcactttcggtgtgactctagtcgctggtgccacgacaacggcgtgaactacaagattggagagaagtgggatcgccagggggaaaacgggcaaatgatgtcctgtacatgcctcgggaatggaaagggcgaatttaaatgcgacccccatgaagcgacgtgctatgatgatggcaaaacgtatcatgtcggtgagcaatggcaaaaggagtacctgggagcaatctgttcttgcacttgcttcggagggcagcgtggatggagatgcgacaattgcagaagaccaggaggggagccatcccctgaaggcaccaccggacagagctacaaccagtattcgcaaagatatcatcagaggactaacactaacgtgaattgccctatagagtgctttatgcccctggacgtgcaagctgatcgcgaagactcccgggaatag

SEQ ID NO: 15237 - DNA, 1974 bp, Artificial Sequence
  Description of Artificial Sequence: Synthetic coding sequence
atgctgcgcggccctggccctgggcttctgctgctggctgtgcagtgtctggggacggccgtaccctcaacaggagcttccaagtcgaaaaggcaggcccagcagatggtgcagccacagtccccggtggctgtgtcccagtcaaagccaggctgttatgacaacggaaaacactatcagattaatcagcagtgggaacgaacttatctgggcaacgcacttgtatgcacctgttacggcgggtcacgcggcttcaactgtgaatcaaaaccggaagccgaagaaacatgcttcgacaagtataccgggaacacctacagggtgggagatacatacgagcgaccgaaggactctatgatctgggattgtacatgcattggggccggccgtgggcggatttcctgcaccatcgcaaaccggtgccatgagggtggtcagtcctataaaatcggggatacatggagacggccacatgagacaggcggctacatgttagagtgtgtgtgcctaggaaatgggaagggagagtggacctgtaagccgatcgctgaaaaatgcttcgaccatgcggccgggacctcatatgtggttggcgagacctgggagaagccttaccagggctggatgatggtcgactgtacatgcttgggcgaggggtcggggagaatcacctgtacaagccgcaaccgctgtaatgaccaggatacccggacatcttatcggattggagatacgtggtccaagaaagacaatagaggtaatctccttcagtgcatctgtacaggcaacgggcggggagagtggaaatgcgaacgtcatacgtcggtgcagactacttcatccggcagtggccccttcactgacgttagagctgccgtttaccagccgcagccgcacccacagcctcctccctatgggcactgcgttacagacagtggcgtagtgtactctgtcggtatgcaatggctgaagactcagggcaacaaacaaatgctgtgtacttgcttgggaaatggagtgagctgccaggagacagctgtcacacaaacgtacgggggcaactcgaatggggaaccttgtgttcttccattcacctacaacgggcgcaccttttacagctgcacaacagaagggcggcaggacggacacttatggtgtagtaccacttctaactacgagcaagaccagaaatactcattttgcacagaccataccgttctggtccagacccggggcggaaattccaatggggcattatgtcattttccattcctctataacaatcataactacaccgattgcacaagtgaggggcgccgcgacaacatgaagtggtgcggcaccacacagaactatgacgctgatcaaaaattcggattctgcccaatggctgctcacgaagagatctgtactaccaacgaaggggtaatgtaccgcataggggatcagtgggacaagcaacatgacatgggtcatatgatgcgctgtacctgtgtaggtaacggaagaggcgagtggacctgcattgcctactctcaactgagggatcagtgtatcgtggacgacatcacctacaacgttaatgatacctttcataagaggcatgaggaaggtcacatgctcaattgcacttgttttggtcaggggcgcgggaggtggaaatgcgacccagtggatcagtgtcaggatagcgagactgggaccttttatcagatcggagactcttgggagaaatatgtacatggagtgcgataccaatgttattgctatggccgcggaatcggtgagtggcactgccagccactgcagacctacccatcaagcagtgggcccgtggaagtgtttattaccgagacccctagtcagccgaatagtcatcccatacaatggaatgccccccagccatcccatatctcaaagtacatactgcggtggcgaccagtctccatcccccccagaaatctgggatattag

SEQ ID NO: 15238 - DNA, 6804 bp, Artificial Sequence
  Description of Artificial Sequence: Synthetic coding sequence
atgctgcgaggaccaggacctggccttcttcttcttgctgtacagtgtctgggcaccgctgtgcctagtacaggtgcatcgaaatcaaaacggcaggcccagcaaatggtccaacctcagtctcctgtggctgtcagtcagagtaaacctggatgctatgataatggtaaacactaccaaatcaaccagcagtgggagagaacctatctgggcaacgcgctggtgtgtacctgttacggcgggagtaggggctttaactgcgagtctaagccagaagccgaggagacgtgctttgataagtacactggcaatacctacagggtgggtgatacttacgaacggcccaaagatagtatgatttgggattgcacctgcattggtgctggccggggccggattagttgtactatcgcaaacaggtgccacgaaggtgggcaatcctacaagataggagatacatggcggcgtccccatgaaaccggcgggtatatgctcgagtgcgtctgcctcggaaatggaaagggggagtggacgtgcaagcccatagccgagaaatgctttgaccacgccgctggaaccagctacgtggtgggggaaacatgggaaaagccttatcagggttggatgatggtggattgtacctgtttaggcgagggcagcggaagaatcacatgtacctcgcggaatcgctgtaacgatcaggacaccaggactagttaccggattggagatacttggagtaaaaaagacaaccgcgggaatcttctacagtgtatctgcaccgggaacggtcgcggggagtggaagtgcgagcgtcataccagcgtacagacgacatcttcagggtcagggccattcacagatgtccgcgctgccgtctatcaaccacagccccatccccaacctccgccctatggccattgcgtgacagactccggagtggtctattcagtgggcatgcagtggctgaagactcagggcaacaaacagatgttgtgtacctgcttagggaatggtgtttcctgtcaggagaccgccgtcactcagacatacggtggcaatagcaacggcgagccatgtgtgttaccttttacttataacggccgcaccttctactcatgcactaccgaggggcgtcaggatggtcatctttggtgcagcacgactagtaactatgagcaggaccagaagtattcgttctgcactgaccacacagtgctggtccaaacccgcggcggcaacagcaatggggcactttgtcactttccttttctgtataacaaccacaactacaccgactgcacatcagaaggacgcagggacaacatgaagtggtgtggaactactcagaattacgacgccgatcagaagttcggcttttgtccaatggccgcccatgaggagatctgtaccaccaacgagggggtgatgtacaggatcggcgaccagtgggacaagcagcacgacatgggccatatgatgaggtgtacatgcgtgggaaatggccgcggcgaatggacctgcattgcgtattcccaactgagggatcagtgtatagttgacgacatcacctacaacgtaaacgacactttccacaaacgtcacgaagagggacacatgttaaactgtacgtgtttcggccagggtaggggccgttggaagtgcgaccctgtggaccagtgccaggattctgagactggaacattctaccagattggagacagctgggaaaagtacgtgcacggggtcaggtaccaatgttattgttatggtagaggtataggagaatggcattgccagccactgcagacatatccatccagttctgggcctgtggaagtttttattaccgagactccgagccagcccaattctcaccctatccagtggaatgcaccacagccaagtcatatctccaagtacatcctgcggtggcgtcccaagaattctgtgggccggtggaaggaggccaccattccaggtcacctgaactcttataccataaaaggcctgaaaccaggagtggtctatgagggccagcttataagcatccagcagtatggccatcaggaggtcacacggtttgattttactactacatcaacaagcacaccagtgacgtcaaatactgtcacaggcgagacgacccccttcagcccactagttgccacatctgaaagtgtgacagaaatcactgcgtcctccttcgttgtgagctgggtgtcagctagcgatacggtgtccggatttcgagtcgagtacgaactgtcagaagagggagacgagccgcaatacctggatcttccttccacagctaccagtgtcaacatcccagatttactaccaggaaggaaatatattgtgaacgtgtaccagatctcagaagacggagaacaatccctgattctgagtacctcccaaaccaccgctcctgatgcccctcctgacaccacagtcgatcaggtcgatgacacatcaatcgtcgtgcgctggtccaggccacaggctcctattaccggttaccgcattgtctacagtccaagtgtagaaggtagctccaccgaattaaatctgcctgaaactgcaaactcggtcacactttcagaccttcagccaggagtgcagtataacataactatttatgcggtggaggaaaatcaggaaagcaccccagtggttatccagcaggaaaccactggcacgcctcgctccgacactgtgccatcaccaagagatctgcaatttgtcgaggtaacggacgtcaaggtgaccattatgtggacccctcccgagtctgctgtgacaggatatcgagttgacgtgatacctgttaacctccccggggagcatggccagaggctgcccattagtcgcaatactttcgcggaagtgactggattgtctcccggggtcacctattatttcaaagtgttcgctgtgtctcacgggagagaatccaagcccctcaccgcacaacagaccaccaaattggatgccccaacaaacttacaattcgtaaacgagaccgattctaccgtcctggtgcgctggacgccaccccgggcacagatcactggctacagattgactgttggactgacacgcaggggccagcccaggcagtacaacgtcggtccttcggtgtcaaagtacccgctacggaatcttcagcctgccagcgaatataccgtgagtctggtggctatcaaggggaatcaggagtctccaaaggccactggagtgtttacgacacttcagcctggttcttcaatccctccctacaacactgaagtgacagagacaactatcgtgatcacctggacccccgcccccagaatcggcttcaaactgggtgtcagaccgtcacaggggggagaggctccacgcgaggttaccagcgacagcgggtctatcgttgtgtccgggctcacaccaggtgtggagtatgtgtatactatccaagttctccgggatgggcaagaaagagacgccccaattgtgaacaaggtggtgactcccctgagcccaccgaccaatcttcatttggaagccaaccccgatacaggcgtactcacagtttcttgggagcgatcgaccactcccgacatcacgggttatcggatcaccaccacccctacaaacggccaacagggcaactcactggaggaggtggtccatgccgaccaatctagctgtacctttgacaacctctcacccggactggagtacaatgtgagcgtctacaccgtgaaggatgataaagagtcggtaccaatcagtgataccatcatccctgaggtcccccagctgacagatttaagcttcgtggacataacagattcgtcaatcggtctccggtggacccccctgaactcaagcacgataattggctaccgcatcactgtcgtggcagctggggaagggattcccatttttgaagactttgttgatagtagtgtaggatactatactgtaaccggcctggagccaggaattgactatgatatctcagtgatcacccttatcaacggcggagagtccgctcctacaactttaactcagcaaaccgccgttcctccgccaacagacctgcgattcacaaatatcggaccagacaccatgagggtaacctgggcacctcctcctagcatcgatctgaccaatttcctggttaggtactccccggtgaagaacgaggaagatgtggccgagctctccatctcgcctagcgacaacgctgtcgtcctgactaatctgctaccagggacggagtacgtggtgagcgtgtcctcagtttatgagcagcatgaatcaacccctcttcggggacggcagaagactggccttgacagcccaacaggaatagacttttctgacataacggcgaattccttcacagtgcattggatcgctccacgagccactattacagggtatcgcatcaggcatcatccagagcatttttcgggtcgcccaagagaagatcgggtcccccactcccgaaacagcatcaccctgactaatctcactccagggaccgagtacgtggtgtcaatcgtggcactgaacggccgggaggaaagccccctactcatcgggcagcagtccaccgtttcagatgtgcccagggacctggaggtagtcgctgccaccccaacaagcctactgatcagttgggatgctcccgctgtgactgtgagatactaccgtattacctacggcgagaccggcggaaacagccctgttcaagagtttaccgtgcctggaagcaaatcgacagccacgatatccggactcaaaccaggggtcgattataccatcacagtgtacgcagtgaccggcagaggagactctccagcatcaagtaagcccatatcaattaactatcgtaccgaaatcgataaaccctctcagatgcaggtgaccgatgtgcaggacaattctatttctgtcaagtggctgccgagcagctcacccgtgaccggttatagagtgacaacaacaccaaagaacggcccaggaccgactaagaccaagacagcgggccctgaccaaacggaaatgaccatcgaaggattgcaacctacagtagagtacgttgtttctgtgtatgcccagaacccatcgggggagagtcagccgttggtccaaacagctgttactaccattcccgcaccaacggatctgaagttcactcaagtgactcccacctctttgtccgcccagtggactccccccaatgtgcagctcactggataccgggtaagagttacccccaaggaaaaaacaggcccaatgaaggagatcaacctcgcaccagattctagctccgtcgtggtgtcaggccttatggtggccacgaaatacgaggtaagcgtgtacgctcttaaggacacactcacttcccgtcccgcccaaggggtggtgacaacgctcgaaaacgtgagcccaccgagacgcgctagagtcactgacgcaacggagacaaccatcacaatttcctggagaaccaaaaccgagactatcaccggcttccaggtggatgccgtcccagctaatggtcagacccccattcagcggacaattaagcccgatgttagatcctacaccatcactggacttcagcctggtactgattataaaatctacttgtacacactcaacgataatgcccgttcgagtcccgtggtcattgacgcaagcaccgctattgacgctcctagcaatctccgatttctcgccactaccccaaactcattgctggtcagttggcagcccccacgcgccagaatcacaggttacataattaaatacgaaaaaccaggatcccctcctcgagaggtggttcccaggcctagacctggcgttactgaagcgactatcactggtttagaaccaggaaccgagtataccatctatgtgatcgcactaaaaaataaccagaagtccgaaccacttatcgggcgaaagaagactggtcaggaggcgcttagccagacaacaatctcttgggctcccttccaggacacctcggaatatattatctcctgccaccccgtcggcaccgacgaggaacctctgcagtttcgggtgcccggcaccagtacctcggcgacattaacaggacttacaaggggtgccacatataacgtcatcgtggaggctttgaaggaccagcagcgccataaggttagggaggaagtggtcacggtcggtaattcagttaacgaaggcctcaaccagcctacagatgacagctgtttcgatccttacaccgtatcgcactatgctgtgggtgacgaatgggagcgcatgagcgaatctggttttaagttactgtgccagtgcttgggctttggtagcgggcactttaggtgcgattcatctaggtggtgccacgacaacggtgtgaactataaaatcggagagaagtgggaccgccagggcgaaaacgggcaaatgatgtcttgcacgtgccttggtaacggaaagggagaattcaaatgcgacccccacgaagctacatgctacgatgacgggaaaacttaccacgtcggagagcaatggcagaaggagtaccttggagctatctgcagttgcacatgctttggcgggcagaggggatggcggtgtgacaactgcaggaggccaggtggtgagccgtctccagagggcaccacaggacagtcgtacaaccaatattcgcagcgttatcaccaacggactaacactaatgtcaattgtcccatcgagtgcttcatgccccttgacgtgcaagcggatcgagaagactctagagaatag

SEQ ID NO: 15239 - DNA, 6798 bp, Artificial Sequence
  Description of Artificial Sequence: Synthetic coding sequence
atgcttagggggccggggccgggcctgctcctgctcgctgtgcaatgcctgggaacagcggtgccatccaccggagcaagtaagagcaagaggcaagcacagcaaatggtccagccacagtcacctgttgcagtctcccagtccaaacctggttgttacgacaatgggaagcactatcaaatcaatcagcagtgggaacgcacatacctcggaaatgccctggtgtgtacttgctatggcggctcccgcggctttaattgtgagagtaaaccagaggcagaggagacctgctttgacaagtacaccggcaatacctacagggttggggacacatatgagaggccaaaagactcaatgatctgggactgcacctgtatcggcgctggccggggaaggattagctgtactattgccaaccgctgccacgaaggcggccagagctataaaattggggacacctggaggcgtccacacgagaccgggggttatatgctggaatgtgtttgtttgggtaacggaaaaggtgagtggacatgtaagcctatcgccgaaaagtgtttcgatcatgctgccggcaccagttacgtggtcggcgagacttgggaaaagccctatcaggggtggatgatggtggattgtacttgcctcggggaaggatccggtcgtatcacttgtaccagccgaaacaggtgtaatgatcaagatacccgaacatcttatcggatcggagacacatggtctaagaaagataatagagggaacctcctacagtgtatctgtaccggcaacggtagaggggagtggaaatgcgaaaggcatacatctgtgcagacaacctcctcaggttccggacccttcactgacgtgagggccgctgtctaccagccccagcctcacccacagccgccaccctacgggcactgcgtgaccgactctggcgtcgtgtattcagtaggaatgcaatggctgaaaacccaggggaacaagcagatgctctgcacgtgtctgggaaacggcgtcagctgtcaagaaacggcagtgacacagacatatggcggcaattcgaacggggaaccttgcgtcctccccttcacttacaacggtaggacgttctattcatgcaccactgagggccgccaggacggccacttatggtgctctacgaccagtaattatgagcaggatcagaaatatagcttttgtacagatcacactgtgctggtacagacgcggggcggaaactcaaatggcgcactgtgtcacttccccttcctgtataacaatcataattacacagattgtacaagtgaaggtaggcgggataatatgaaatggtgcggaacgacgcagaattatgatgccgaccagaagttcggtttctgccccatggcagcccatgaggagatttgtactaccaatgaaggcgtcatgtacagaataggcgatcagtgggataaacagcatgacatgggtcacatgatgagatgcacgtgcgtgggcaacggccggggggagtggacctgtattgcttatagtcagctgcgggatcagtgtatcgtggacgacatcacatataacgtgaacgatacctttcataagcgccatgaggaagggcacatgctaaattgtacctgtttcggccagggacgcgggcggtggaagtgtgaccccgttgatcagtgccaggacagcgagaccggaacattctaccagatcggcgatagttgggagaagtatgtccacggagtccgataccagtgttactgctatgggcggggaatcggagaatggcactgtcaacccttgcagacttacccatcatcatccggtcccgtggaagtgttcataaccgaaaccccctcacagccaaactctcatcctatccagtggaatgccccccagccgagtcacatttccaagtatatcttgcggtggagaccaaagaacagtgtgggcagatggaaggaagctaccatccccgggcacctgaattcttatactatcaagggcttaaagcccggtgtggtctatgaggggcagttgatatccatccagcagtacggacaccaggaagtcactcggtttgattttaccaccaccagcacaagtaccccagtaacaagtaatactgtgactggcgagaccaccccgttctctcccttagtggcgactagtgagtctgttacagagataacagcctcctcctttgtcgtcagctgggtgtccgcatccgacacggtgagtggattccgcgtggagtacgaactaagcgaagagggagatgaaccacaatacctggacttaccatcaaccgcaacgagcgtcaatatacccgacctgctgccaggccgcaaatacattgtaaacgtttaccagatatctgaggacggagagcagagcctaatattatcgacatcccaaacaaccgcccccgacgctcccccagacacaaccgtggatcaagtcgacgataccagtattgtggtgcgttggtccagaccccaggctcccattaccggttatagaattgtatacagcccgtccgtggaaggctcctctactgaactcaatctacctgaaacagcaaacagtgtgactctgtctgatcttcagcccggcgtccaatataatattaccatttacgccgtcgaagaaaatcaggaatcaacgcccgtggtgatccagcaggagactacaggtaccccacgatcagatacagtcccgagccctagagacctacagttcgtcgaggtaactgacgtgaaagtcaccattatgtggactccacctgaatcagctgttacaggctatagggtggatgttatccctgtcaacttgcctggagaacacgggcaaagactgcccatcagccgcaatacctttgcagaagttaccggactcagccccggggtcacttactactttaaagttttcgccgtaagtcacggacgtgaaagcaaaccgctaacagctcagcaaaccactaagctcgatgcaccaactaatctgcagttcgtcaatgaaaccgactccactgtcctcgtgcgatggacccctccacgggcccagatcaccggctaccgactgacggtcgggctgacgaggcgggggcagccaaggcagtataacgtcggtccatccgtgtctaaatatcccctccggaacttgcagcccgcatctgagtatactgtgagccttgtggctatcaaggggaaccaggaaagccccaaagctaccggggtgtttactaccctgcagcctggctctagcatacctccttacaacaccgaagtgaccgagacaacgattgttatcacatggacgcccgcacctcgaatcggtttcaagctaggagttcggccaagtcaaggaggcgaagctcccagagaggtcacttccgattcggggtcaatcgtggtcagtggactgacccccggggtcgagtacgtctacaccatccaagtactccgggacggacaagaacgcgatgcccccatcgtaaacaaagttgtgacaccattgtccccgccaactaatttacacttggaagccaatcccgacactggggtgctgacagtatcatgggaaaggtccaccacacccgacatcacaggataccggatcacaacaactccaaccaatggccaacagggaaattctctcgaagaagtggtgcatgcagaccaatccagctgcaccttcgacaacttaagccccggccttgaatacaacgtgagcgtgtataccgtcaaagatgacaaggagtcggtgcctataagcgatacaatcatcccagccgtccctcctccaaccgatctgcgtttcactaatatcgggccagacaccatgcgagtcacttgggctccccccccatctattgatctcaccaactttctcgtgagatacagccccgtgaagaacgaggaggatgtggccgagcttagtataagtcccagtgacaacgccgtggtcttaactaacctcctcccgggaactgagtacgtggttagtgtttcgagtgtgtacgaacaacatgagagcacgcccctacgaggccgccaaaaaaccggcctcgactctcccacaggcatagatttcagcgacattacagcaaactcttttacagtgcattggatcgcccctagggccaccatcacgggatataggattcggcaccacccagagcactttagcgggcgaccacgggaggatcgcgtcccacactcccggaacagcattacactgacaaatctgacaccagggacggagtacgtcgtgtcaattgtggccctgaacgggcgcgaggagtcacccctgctcattgggcagcagagcaccgtctcagatgtaccacgcgatctggaggtcgtcgccgctactccaacctcgctgcttatcagctgggatgccccagctgttaccgtccgatactaccgcatcacttatggagagactggtggcaacagtcccgttcaggaatttactgtcccaggctccaagtcaacggccacaatttcgggcctcaagcctggtgtagactacaccatcaccgtgtatgccgtcactggacgcggcgactcccccgcaagctccaaacctattagcattaattatcgaactgaaatagataaaccctcacagatgcaggtgaccgatgtgcaggataactccatcagcgtgaaatggcttcccagctcttctcccgtcacgggctacagggttacaacaacacctaagaacggtcctggacctaccaaaactaagacagccggacccgaccaaactgaaatgactatcgaagggctgcaacctaccgtggagtatgtggtgagtgtgtacgctcagaacccgagtggagaatctcaaccactcgtgcagactgcagtgactacaatcccagcgccaactgacttgaaatttactcaggttacccccacttcgctgtccgctcagtggactccacccaatgtgcagctcacagggtatagagtgagagtcacgcccaaagaaaaaacggggcccatgaaagagatcaatttggctcctgactccagttctgtggttgtatctggattgatggtggctactaaatatgaggtctccgtctacgctctcaaggacacactcacttcaaggcctgcgcagggcgtagtgactaccctagagaacgtgagcccccctcggcgagcccgcgtcactgacgccacagagactacaattacaatttcctggcggacaaagacagagaccatcacagggttccaggtggatgccgttccagccaacggtcagacaccaattcagaggacgattaagccagacgtgcggtcctacacaatcactgggcttcagccagggacagactataaaatctatctgtataccctcaacgataacgctaggtcctcgcccgtcgtcattgacgccagcaccgctattgatgctccaagcaaccttcggtttctggcgacaacacccaactccctcttggtcagctggcagcctcctcgggcgcgaataaccggatatatcattaaatatgagaaacctgggtcacctcctcgggaagtggtgccccggccccgtccgggggtaaccgaagctacaatcaccggcctggaaccagggactgagtatacaatttatgtaattgcgttgaaaaataatcagaaaagtgaaccactgataggtcgcaaaaaaacagacgagctgcctcaactggtgaccttgccacaccccaacctgcacggcccagaaatcctcgacgtgccaagcacggtccagaagacccctttcgttactcaccccggctacgacaccggcaacgggatacagctccccggtacatccggtcagcagccatctgtcggacaacagatgatttttgaagaacacggctttcggcgaacaacaccacccaccactgccacaccaatcagacacagacctcgcccttaccctcctaacgtgggccaggaagcgctgtcgcagaccacaatctcctgggcaccttttcaggatactagcgagtatatcataagttgccaccccgttggcaccgatgaagaacccttgcaatttcgggtgcccggcactagcacgagcgccactctcacgggtttgacgagaggagctacgtataacgtcatagtcgaagctctcaaagaccagcagagacacaaggtgcgagaagaagtagtaacggttggaaattccgtcaatgagggacttaaccagccaactgacgatagctgttttgatccctacacagtctcccactacgccgtgggagatgagtgggagagaatgtcggagagcggattcaagctcctctgccaatgcttgggtttcggctccgggcacttccggtgtgacagctcccgctggtgccatgacaacggtgtgaattataagatcggggagaagtgggatcggcagggagagaacggtcagatgatgtcttgtacatgccttggcaatgggaaaggagagttcaagtgcgatcctcatgaggcaacgtgttacgatgatggcaaaacctaccacgtcggcgagcagtggcagaaagaatacctgggagcaatctgtagttgcacctgctttggcgggcagagagggtggagatgcgacaactgtagacgtcctggaggagagccatctccagaggggactactgggcaaagttacaaccaatactcccagaggtaccatcagcgcaccaacaccaacgtgaattgccccatagagtgctttatgccgcttgacgtccaggcagacagggaggacagtagagaatag

SEQ ID NO: 15240 - DNA, 6993 bp, Artificial Sequence
  Description of Artificial Sequence: Synthetic coding sequence
atgctgagaggtcccggtcccggtctgctcctgctggcagtccaatgtcttggtacagcagtgccgagcaccggagccagcaaatccaaacgccaggcccagcagatggtgcagcctcagagtcccgtagccgttagtcagagcaagcccggctgctatgacaacgggaagcactatcagatcaatcaacagtgggaaaggacatacctgggaaacgcgctggtttgtacttgttatggcggctctcgggggttcaattgcgaatcaaaacctgaagccgaagaaacctgcttcgataagtataccggaaatacatatcgtgttggagatacatatgaacgccccaaagattccatgatttgggattgcacctgtatcggcgccggacgcgggcgcattagctgtaccatagcaaataggtgccatgaaggcggccaatcttataaaataggcgacacctggcggaggccccatgaaacgggaggatatatgctcgagtgcgtgtgcctggggaacggcaaaggggaatggacatgtaagccaatcgctgaaaagtgttttgatcatgctgctggaacaagttacgtggtgggagaaacatgggaaaagccataccagggttggatgatggtggactgtacttgtctaggcgaggggtccggaaggattacatgtaccagtagaaaccgatgcaatgaccaggacacccgcacctcataccgaattggtgacacgtggagcaaaaaagataatcgtggtaacctgctacaatgtatatgcaccgggaacggcagaggagagtggaaatgtgagagacacactagtgtacagaccacttcctctggtagcggacctttcactgatgtaagggcggctgtataccagccccagccgcacccccagccccctccatacgggcactgtgttactgactctggtgtggtgtactccgtaggcatgcagtggcttaaaacccagggtaataaacagatgctgtgtacatgcctgggcaatggcgtttcttgccaggagactgctgtcactcagacctacggtggcaactcaaacggagagccttgcgttctcccttttacgtacaacggaagaacattctactcatgcactactgaagggcggcaggatggccacttatggtgtagcactacatccaattatgagcaagaccaaaagtactctttctgcactgaccacacagtcttggtgcagacgagggggggaaattctaatggggcactctgccattttccctttctctacaacaaccataattacaccgactgcacatctgagggccgcagggataacatgaaatggtgtggtacgacccagaattacgatgctgaccagaaatttggcttttgccccatggcggcacacgaggagatctgtaccaccaacgagggcgtcatgtacagaattggggatcagtgggacaagcaacacgacatgggacacatgatgcggtgcacttgcgtgggcaatggtcgcggcgagtggacttgcatcgcatatagtcagctgagagaccaatgcatcgtggacgacatcacatataacgtgaatgatacatttcataaacgacacgaggaaggacacatgctgaattgtacatgcttcggccagggccgcggccggtggaaatgtgaccccgttgatcagtgtcaagactctgagacggggaccttctaccaaatcggcgatagctgggaaaagtatgtccacggcgtaagataccagtgctattgctacgggcggggtatcggtgaatggcactgtcagcccctgcagacttacccgtcgtccagtggtcctgtggaagtgttcattacggaaacgccctctcagccgaacagtcatcccattcagtggaacgcgccccaaccttcacatatctctaaatatatcctgcggtggaggcccaaaaactccgtgggtcgctggaaggaggcgacaattccgggtcacttaaattcttataccattaaaggcctcaagcccggcgttgtgtacgagggccagcttatctctattcagcagtacggccaccaggaagtaaccagatttgatttcaccacaacctccaccagcactcccgtgacgtccaatactgtgaccggtgagactaccccattctctcctcttgtggcaacttccgagtccgttacagaaatcacagcatcctcgtttgtggttagctgggtctccgccagcgatactgtctcaggattccgcgtggaatacgaattgagtgaggaaggtgacgaaccgcagtatttagacctcccctctactgctaccagcgtgaatattccggaccttttgcccggacggaaatacattgttaacgtttaccagatcagtgaggatggggagcagagcctcatcctgagcacaagccaaacaacagcacccgatgcccctcccgacaccaccgtggaccaggtagacgacacatctatcgtggtgaggtggagtcggcctcaggctcctatcaccggataccgaatagtctatagtcctagcgttgaaggctcttccaccgagctgaatctccccgagactgccaattccgttacactgtcagacctgcagcccggcgtacagtataatataactatttatgctgtcgaggagaaccaggaaagcactcctgttgtgattcagcaggagaccactgggacacctcggtcagacaccgtcccttcgcctcgagacctgcagtttgttgaagtcaccgacgttaaagtaaccatcatgtggactccaccagagtcagccgttactggataccgggttgacgtcattccggttaatctgccgggcgagcatggtcagagactgcctatatccagaaatacatttgctgaggtgacaggcctctcccccggcgttacctattacttcaaggttttcgccgtgtcacatggaagagaaagcaaacctctcaccgcacagcagacgacgaaattggacgctcccaccaacctgcagttcgtcaatgaaacagattcaacggtactggttaggtggacgcctccacgggcacagattacaggctaccgtctcacggtcggattaaccagaagaggccagcctagacaatataacgtagggccaagcgtttccaagtatccactgagaaatttgcagcccgcatcagagtacaccgtctctcttgtggccatcaaaggcaaccaggaatctccaaaggcgactggtgtgttcacaactctccaacctggctccagcattccgccatataatactgaagtgaccgagacaacaattgtgatcacctggacacccgcacccaggatcgggttcaaactgggcgtccgccccagtcagggcggagaggctccccgagaggtgactagtgatagtgggagtatcgtggtttctggcctgacacccggcgtggagtacgtgtacacaatccaggtactgagggacggccaggagcgagacgctcccatcgtaaataaggtggtgaccccattgtccccaccaaccaatctgcatctcgaggccaatccagacacaggggttctcacagtgtcctgggagcggtccacaacgccagacatcaccggttaccggattaccactacccccactaacggtcaacagggtaatagtctagaggaggtggtgcacgccgatcagagtagctgtacctttgacaatctgagtccagggttagagtataatgtgtccgtgtatacggtgaaggatgacaaggagagcgtcccaatctccgacaccattataccggcagtgccacccccaactgacttacgattcactaatatcgggccggatacgatgagagtgacctgggctccccctccgagtattgacctcactaactttttggtaagatattctccagtcaaaaatgaggaggatgttgcagagttgtctatttcacctagcgataatgctgtcgtgctgacaaacttactgcccgggacagagtacgtggtgagcgtgtccagcgtatatgaacagcatgaatcaactccactgcggggcagacagaagacagggctggattcccctactggcatagatttttccgatatcactgccaatagcttcaccgttcactggattgccccacgcgcgactattacaggctatcgtataaggcaccatcctgaacacttcagcggaagaccaagagaggatcgggtaccccattcaaggaacagcatcacgcttactaacctcacaccaggaaccgagtacgtcgtcagtatcgtagctttaaatgggcgggaggagtcccccttgctgatcggccagcagtccacagtgtccgatgtaccacgtgatctcgaagtggtggctgcaacacctacgagcttgctgatctcatgggacgctcctgcagtcactgtacgatactaccgaatcacatacggagagacaggtggaaactcacccgttcaggagtttacagtccccggtagtaagtcaaccgctacaatttccggcctgaagccaggggtagactatactattaccgtctatgcagtaaccggcaggggggattccccagctagctcaaagccaatatctatcaactaccgtaccgagatcgacaaacccagccagatgcaggttactgatgtgcaggacaatagcatttctgtgaagtggttgcccagctcttcaccagttacaggttaccgcgtcacaaccaccccgaaaaatggtcccggtcccactaagaccaagactgcaggaccagaccagaccgaaatgactatcgagggtctgcagcccaccgtggaatacgttgttagcgtgtacgcccagaacccctcaggcgaaagtcaacccctggttcagacagctgttacaaatatcgatagacccaaaggtcttgcctttaccgacgtggatgtggactctataaagatcgcctgggagagcccacagggccaggtgagccgctaccgggtcacgtattcatcacctgaggatggcatccacgaactcttccccgccccagatggagaagaggacacggcagaattgcagggcttgagaccgggctccgaatacacggtatccgtcgttgccctgcacgacgacatggaatcacagcccctgatagggactcagagcacagcaatacctgcgcctactgatctgaaattcacccaggtgacccccacttccctgtccgctcagtggacccccccgaatgttcagctcactgggtacagagtgcgggtcactccaaaagagaagacaggccccatgaaggagatcaaccttgcgcctgactcctcatcagtcgtagtctctgggctaatggtggccacgaaatatgaggtcagtgtgtacgcactgaaggacaccctcacatctaggcctgctcagggagtcgtaacaactctggagaacgtttcacctccccggagggcacgggtcaccgacgccaccgagaccaccatcaccattagctggagaactaagacggaaactattacgggtttccaggtggatgcagtgcctgctaatgggcagacgccgatccagaggacaattaaaccagatgtacgatcctacactatcactgggctgcagcctggcaccgattacaagatatacctctacacccttaatgacaacgcccggagttctccagtggtaatcgatgcctctaccgctatagatgctccttctaacctgagattcctcgctactacccccaacagtctcctcgtttcctggcaacccccccgagcccgcattacgggctacattattaaatacgagaaacctggctcaccccccagagaagtggtccctcgtcccaggcctggggtgacggaggctactatcactggactggagcccgggactgagtataccatatatgtgattgcactgaaaaacaaccagaaatccgagccacttatcgggaggaagaagacagtccagaaaacccccttcgtaacccatcccgggtatgacaccgggaacggaatccaactgcccggcacatcagggcagcagccaagtgtcgggcaacagatgatcttcgaggagcatggattccgccggactaccccaccaaccacggccacccccattaggcacagaccccgcccttacccccctaacgtcggtcaggaagctctgtcgcagactactattagctgggccccctttcaggatacatctgaatatattatctcttgccatccggtggggaccgatgaggagccactgcagtttagggtacccgggaccagcacgagcgcaaccttgaccggccttactagaggggctacttacaacgtcattgtggaggcccttaaagaccaacagcgccataaagtccgagaggaagtcgttacagtcggcaactctgtgaatgaaggcctgaaccagcctacagacgacagttgcttcgacccttacaccgtttcacattacgccgtgggcgatgaatgggaaaggatgtcagaatcaggattcaaactgctgtgccagtgtctgggctttgggagcggacacttccgctgcgactcgtcccggtggtgccacgacaacggtgtcaactacaagatcggtgagaagtgggatcgacaaggagagaacggtcaaatgatgagctgcacctgtcttggaaatgggaaaggagaattcaaatgtgacccccatgaagcgacttgttatgatgatggtaagacctaccacgtgggagaacagtggcagaaggaatacctaggagcaatatgcagctgtacctgctttggtggccagagaggctggcggtgcgataactgcagacgcccagggggtgagccttctccagaagggaccacgggacagtcatataaccaatacagccaaagatatcatcagcgcacaaataccaatgtgaattgcccaattgaatgctttatgcccctggatgtacaggccgatagggaggattctagagagtag

SEQ ID NO: 15241 - DNA, 3312 bp, Artificial Sequence
  Description of Artificial Sequence: Synthetic coding sequence
cttagatggacacccttgaactccagcacaatcatcggctataggatcactgtcgtcgccgctggagaaggaatcccaatctttgaggactttgtggatagcagcgtggggtactacactgtgacggggctggaaccgggaatcgactatgacattagcgtaataactctgatcaacggaggggagtcggcccctactacactgactcaacaaacggctgtcccgcctcccaccgatctgagattcacaaacatcggccccgacactatgcgagttacgtgggctccgccgccaagcatcgaccttacgaacttcctagtcaggtactcccctgtaaagaacgaggaagacgtggcggagctcagcatctcgccttctgacaacgcagtagttttgactaatctgttgcccggcaccgaatatgtggttagcgtgtctagcgtgtacgaacaacatgagtctacgcctctgcggggacggcagaagaccgggctagactctccgaccggtatagacttctccgatattacagcaaacagcttcacagtacactggatcgcccccagagctacaattaccgggtacagaatccggcatcaccctgagcatttctcagggcgcccaagggaggaccgagtcccccattccagaaattccattactttgacaaacttaactccaggaacagaatatgtcgtgtctatagtcgcactgaatgggagggaggagtccccactgctcatcgggcagcagtcgaccgtcagcgacgtgccaagggatttggaggtggtcgccgcgactcctacgtccctgctgatctcttgggacgcgcccgcagtgacagttaggtactatcggattacctatggcgaaacaggaggcaactccccggtccaggagttcacagtgcccggttccaaatctactgctacaatcagcgggctaaagcccggcgtagattacactatcaccgtatacgccgtgactgggcgcggagattcaccagccagctcaaaacccataagtataaactaccgtactgaaatcgataaaccctctcagatgcaggtgaccgacgttcaggacaacagcattagcgttaaatggctcccatcttccagccccgtcaccgggtaccgagtcaccactacccccaagaacgggcctggcccgactaagacaaagactgctggccctgaccaaactgagatgactattgagggcctacaaccaactgtggaatacgtcgtctccgtgtacgcacagaatccctcaggggaatcccagccgctcgtccagaccgcagtgactaccattccagctcctactgacctgaagttcactcaggtcacacccacatccttatccgcccagtggactcccccgaatgtccagctgaccggataccgggtacgcgtgactcctaaggagaaaacagggccgatgaaggagatcaatttagcacctgactcatcctccgtcgtggtgtctggactgatggtcgcaaccaaatacgaagtgagtgtttatgcacttaaagacacattaaccagtcgccctgctcaaggcgtggtgaccacattagagaatgtgtcacctccccggagagcccgagtgaccgatgccactgaaacaactatcacaatttcatggaggaccaagaccgagacaatcaccggcttccaggtggatgctgtccccgctaacggccagacgcctatccagcgaaccataaaaccggacgtcaggtcctatactattacaggtctacagcctgggactgactacaagatctatctctatacattgaacgataacgctagaagctccccggtggtgatcgacgcctctactgcaattgacgccccaagtaatctcagatttctggccaccacgccaaattcactgctggtgtcttggcagccccctcgggccaggataacgggttatatcataaagtacgaaaagccaggtagcccgcctcgggaggtagtgccccgcccgcggccaggcgttacggaggccaccataactggcctggagccaggcaccgaatatactatatacgtaatagctctgaagaacaatcagaaatctgaacctttaataggtcgaaagaagaccgacgagcttcctcaacttgtgaccctgccgcatcccaaccttcacggtccagaaatactggacgttccctccaccgtccagaagactccgttcgtcacccaccccggatacgacactgggaatggaatccagttgcctgggacgtctgggcagcaaccctctgtaggccagcagatgattttcgaagagcacggttttcgtcggactacaccaccaactacggcgactcctatcagacacaggccgcgcccatatccgcctaacgttggagaagagattcaaatcgggcatatacctcgggaggatgttgactaccatctctatccccacggcccgggactgaatcccaacgcctcaaccggccaagaagctctcagccagaccactatcagttgggcccctttccaagataccagcgagtacatcatatcctgccatccagtgggaacggatgaggaaccactacagtttcgcgtccctggtacctcaactagtgccaccctgacggggttaacaagaggagcaacttataacgtgattgtggaggcccttaaggatcagcagcgtcacaaggtgagagaggaggtggtcacggtcggcaactcggtcaatgagggactaaaccagcccactgatgacagctgcttcgatccctataccgtctcacactacgcagtgggggatgagtgggagagaatgagtgaatctggattcaaacttctttgtcagtgtcttggttttggatcaggccactttagatgtgatagctcccgctggtgccacgataatggagtgaactataaaattggtgagaaatgggataggcaaggcgaaaacggacagatgatgagctgcacctgtctggggaacggaaagggagagttcaaatgtgatccgcacgaggcgacttgctacgacgacggaaagacttatcacgtgggcgaacaatggcaaaaagagtatctaggtgcaatttgctcttgcacatgtttcgggggccagcgcggctggcgttgtgacaattgtagacgacccggcggagagccttctcctgaggggacgaccggccaaagctacaatcagtactcccagagatatcaccagaggacgaatactaatgtgaattgtccgatagaatgcttcatgcccctggatgttcaggctgatagggaagatagtagagaatag

SEQ ID NO: 15242 - DNA, 312 bp, Artificial Sequence
  Description of Artificial Sequence: Synthetic coding sequence
atgcccgtgagcgtttcaagcggccgcacttttcccaagagagggcagacctgcgttgtgcactacaccgggatgctcgaggatggaaagaaatttgactcatcgcgggacagaaacaaacctttcaaattcatgctgggcaagcaggaggtgatacgagggtgggaagagggtgtggctcagatgtccgtgggacagcgcgcaaaattgaccatttctcccgattacgcctacggcgccaccggccatccggggattatccccccacacgccacactcgtgttcgacgtggaattactgaaattggagtag

SEQ ID NO: 15243 - DNA, 327 bp, Artificial Sequence
  Description of Artificial Sequence: Synthetic coding sequence
atgggggtccaggttgaaactatatcgccaggggacggaaggacctttccaaagagaggccagacatgcgtagttcactatactggcatgctcgaggacggcaagaagttcgatagctctagagatagaaacaagccctttaaattcatgctcggcaagcaggaggttatcagaggctgggaggagggtgtggcccagatgtccgtgggacagcgagcgaagctcaccattagccccgactatgcttacggtgccacaggccatcccgggatcatccctccacacgccaccttagtcttcgatgtcgagctgttgaagcttgagtag

SEQ ID NO: 15244 - DNA, 312 bp, Artificial Sequence
  Description of Artificial Sequence: Synthetic coding sequence
atgccagtgtctgtgtcatctggtcgtacttttccgaagcgcggccagacgtgcgtagtccactacacggggatgctcgaggatggtaaaaaatttgactcttctcgggatagaaataaacctttcaagttcatgctcggcaaacaggaggtgatccgggggtgggaagaaggcgtggctcaaatgagcgtcgggcagcgcgccaagctgacaatttctccagattatgcatatggcgctactgggcacccaggaattatccctcctcacgccacactcgtattcgacgttgaactgctgaaactggagtag

SEQ ID NO: 15245 - DNA, 327 bp, Artificial Sequence
  Description of Artificial Sequence: Synthetic coding sequence
atgggggttcaagtggagaccattagcccgggggacgggaggaccttccctaaacgagggcagacgtgtgtggttcattacaccggaatgcttgaggacggaaaaaaatttgactcttcacgtgatcgcaacaagcctttcaagttcatgctgggaaagcaggaggtgatcagaggttgggaagaaggggtggctcagatgtctgttgggcagcgagctaagctgaccatttcacctgactacgcatacggagcgacaggacatcctgggataatcccgccgcatgctacactcgttttcgacgtagagttgctgaagctggaatag

SEQ ID NO: 15246 - DNA, 279 bp, Artificial Sequence
  Description of Artificial Sequence: Synthetic coding sequence
atgggcgttcaggtggaaacaatttctcccggggacggtatgttagaagacggtaagaaattcgactcttcacgcgatcggaataagccattcaagttcatgctcggcaagcaggaagtcattaggggctgggaagaaggggtggcacagatgtccgttggccaacgggctaaactgactataagccccgactacgcttacggcgctactggtcacccaggaattatccccccacacgcaaccctggtcttcgacgttgagctgctgaaactggaatag

SEQ ID NO: 15247 - DNA, 1143 bp, Artificial Sequence
  Description of Artificial Sequence: Synthetic coding sequence
atgggtattcagggcttggccaagctgatcgccgacgtcgctccctccgctattagggagaacgatataaagagctacttcggtaggaaggtggccattgatgcaagtatgtccatctatcaatttctgatcgctgttaggcagggtggggatgtcttacagaatgaggagggcgaaaccaccagtcacttgatggggatgttttaccgcaccattcgaatgatggagaacgggatcaagcctgtgtacgtgtttgacggcaaaccgccgcagcttaaatctggcgaacttgctaagcgctcagaacgcagagccgaggctgagaaacagctacaacaggcgcaggccgccggtgcggagcaagaagtggaaaagttcacaaagcgactggtgaaagtgactaagcagcacaacgacgagtgtaagcacctgctttcactcatgggaatcccttaccttgatgctcctagcgaggccgaggcctcgtgtgcagcactcgtgaaagccggcaaagtatacgcggcagctaccgaggacatggattgtcttactttcggatcacccgtgctgatgcgacacctaaccgcatccgaggcaaagaagctcccaatacaggagttccatctgtcacggatcctgcaagagctgggcctgaaccaggaacagttcgtggatctgtgcatcctgctggggagcgattactgcgagtccattcgcgggattggacctaagagggcagtggacctaatacaaaagcataagagtatcgaggagatagtcaggcgcctggacccaaataaatatcctgtgccagagaattggctgcataaagaggcacaccaattatttctcgaaccagaagtcctggatcccgagagtgtagaattgaaatggagtgaaccaaatgaagaagagctgattaaattcatgtgcggggagaaacagttctctgaggagaggataagatctggagtcaaaaggctcagcaaaagccgccagggctccacacaaggacgcctggatgatttctttaaggttacaggctctctctcatctgctaagagaaaggagccggaacctaaggggagtaccaaaaagaaagccaagaccggtgcggcgggcaaattcaaacgcgggaagtag

SEQ ID NO: 15248 - DNA, 498 bp, Artificial Sequence
  Description of Artificial Sequence: Synthetic coding sequence
atggggatccaggggctggccaagctgatcgcggatgtcgccccctctgcgattcgggaaaatgatatcaaaagctactttggacgcaaagttgccatagacgccagcatgtctatatatcaattcctgattgctgtgcgccaaggcggagatgttcttcagaacgaggaaggagagacaacctcacacttgatgggaatgttctatagaactatacgcatgatggagaatggaattaagccggtgtacgtgttcgacggtaaacctccgcaactgaagtccggagaactagcgaagagatcagagcggcgagccgaggctgagaaacagttgcaacaggcacaggctgcaggagccgaacaggaagtggagaaattcacaaagcgactagtaaaagtgaccaagcagcacaacgatgaatgcaaacacctgctgtccctgatgggtataccctacctggacgctccaagcgaagcagaggcttcgtgtgccgcttag

SEQ ID NO: 15249 - DNA, 4017 bp, Artificial Sequence
  Description of Artificial Sequence: Synthetic coding sequence
atggtgagctattgggataccggggttctgctttgtgccctactgagctgtctgttgctaactggatcatcaagtggaagcaagctcaaagacccggagttatcacttaaaggcacacagcacattatgcaggctggccagactcttcatcttcagtgccgaggagaggcggcacacaagtggtctctaccagaaatggtttctaaagagagcgagagactctcaatcaccaagtccgcttgcggtcgcaatggaaaacaattctgctcaaccctaaccctcaacacagcgcaagctaatcatacaggcttctattcatgtaagtatctcgccgtgcctactagcaaaaagaaggaaacggagagcgctatttacatctttatctctgacaccggccgcccttttgtggaaatgtactcagaaatccctgagatcattcacatgactgagggtcgcgaacttgtgatcccctgccgcgtaacctccccgaacatcactgtgaccttgaagaagttccctctcgacaccttgattcctgacggcaaacggattatatgggattcccgaaaaggatttattatatctaatgccacatataaggagatagggctcttaacctgcgaggctaccgtcaacggccatctgtataaaacaaattatttgacccatagacaaacgaatacaattattgacgtgcagattagtacccctcgccccgtgaaactgttgcgcggacacactctagttctgaactgtaccgcaactacacctttgaacacccgcgtgcaaatgacttggagttatcctgacgagaaaaataagcgggccagcgtacggcggaggattgaccaatctaacagccatgcaaatattttctacagcgtgctcaccatcgataaaatgcaaaacaaggataagggtctatacacctgtcgggtccgatcagggccatccttcaagagcgttaatactagcgtgcacatatacgacaaggctttcataacagtgaaacaccggaaacagcaggtactggaaaccgtcgctggcaagcgctcatatcggctgtccatgaaggtcaaggccttcccctccccagaggtcgtgtggctaaaggacggtctacctgccacagagaaaagcgcacggtacctgacccgcggatactctttgattattaaggatgtaaccgaagaagatgccggcaattacacgattctcctgtccataaaacagtcgaatgtatttaaaaacctgaccgcaacattgattgtcaacgtgaagccccaaatctacgaaaaggctgtctccagttttcccgaccccgctctgtatcctctcggctcacgccagatcttaacctgtaccgcctatggcattccccaacctaccatcaagtggttttggcatccttgtaaccataatcattccgaagccagatgtgacttttgtagtaataatgaggagagtttcatcctagacgccgattccaatatgggtaatcggatcgaatccatcacgcaacggatggctattatcgagggcaagaataagatggcatctaccttagtagtggcagattctcggatatcagggatatacatttgcattgcatctaataaggtgggcaccgtgggaaggaacatcagtttctatatcacggatgtccccaacggttttcacgtcaacctcgaaaaaatgcctactgagggagaagacctgaaactgagctgcactgttaacaaattcttgtatcgcgatgttacttggattctgctccgcacagtgaacaacaggactatgcattactccatttccaaacagaagatggcaatcaccaaggaacactccataaccttaaacctcacaatcatgaatgtctcgctccaggatagtggtacgtatgcatgtagagctagaaacgtctataccggggaggagatactgcagaaaaaagaaattaccatccgggatcaggaggcaccttatctcctgcggaacctctctgatcatacagtggccattagtagcagcaccacgctggattgtcatgccaatggggtcccagaacctcaaatcacatggttcaagaataaccacaaaattcagcaggagccagggattatactcggtccaggaagctcaacactgttcatcgagcgcgttaccgaggaagatgagggcgtctatcactgcaaggctaccaaccaaaagggctccgtcgagtccagcgcatacctgaccgtgcaaggcacctccgataaaagcaatctggaattaatcactttgacctgtacatgcgtcgccgccactctgttctggctgctgttgacactgtttattcggaagatgaaaaggagtagtagcgagattaagaccgactatctatcgataataatggaccccgatgaggtgcccctcgatgaacagtgtgaaaggctcccatacgacgcatctaagtgggaatttgctagagagcgactgaagctcggaaagagtctcgggaggggggcattcgggaaggttgtacaggcgagtgcttttgggattaagaagagccctacctgcagaaccgttgccgtgaaaatgttgaaagaaggcgccactgcttcggaatataaagcccttatgaccgagctgaagatccttacacatattggccatcatttaaacgtggttaacctactcggcgcttgcactaagcaggggggccctctcatggtcattgtggagtactgtaagtatgggaacctgagcaattatctcaaatcaaagagggacctcttcttcctgaataaagatgcagccttgcatatggagcccaaaaaggaaaagatggagcccgggctggaacaggggaaaaaaccccggcttgattctgttactagtagcgaatcatttgcttctagcgggtttcaggaggataaatcacttagtgacgtcgaggaggaagaagacagcgatggcttttataaggaaccaattacaatggaggaccttatctcctatagctttcaggtcgctcggggcatggaatttctaagcagccgcaaatgtatccaccgtgaccttgccgctcggaacatccttctttcagagaacaatgtggtgaagatctgtgatttcggtctcgctagggatatatacaaaaaccctgactatgtcagaaagggagatacacgcttgccactgaagtggatggctccagagtccatatttgataaaatatacagtaccaaatccgatgtctggtcatatggcgtcctgttatgggagattttctccttgggtggatctccatacccaggagtccaaatggacgaagacttttgctctcggttaagggagggcatgcggatgagagcacccgagtatagcaccccagagatctaccaaattatgctagactgttggcacagggacccgaaggaacgcccaagatttgctgaattggtggagaaactcggagatctactgcaggcaaacgtccagcaagacggcaaggactacattcctataaatgccattctgactggtaactctgggttcacttattctaccccagccttctcagaggactttttcaaagagagtatcagcgcaccgaagttcaacagtggaagtagtgatgatgtgcggtacgtgaacgcgtttaaattcatgtcgctggagcgcataaaaacatttgaagaactgcttcccaacgcgacttctatgttcgatgattatcagggagattcctctacactccttgcctctcccatgctgaaacggtttacttggaccgatagtaagcccaaggcctctctgaagatcgacctgcgcgttacttctaagtctaaggagtcaggcctgagtgacgtctcacggcccagtttctgccactcctcctgcgggcacgtcagcgaggggaaacggcgattcacctacgatcacgccgaactcgaaaggaagatcgcttgctgcagtccgccacccgattacaacagtgtggttctgtacagtactccccctatatag

SEQ ID NO: 15250 - DNA, 531 bp, Artificial Sequence
  Description of Artificial Sequence: Synthetic coding sequence
atggtaagctactgggacacaggagtactcttatgcgctctgctgagctgtctgctgctcacaggctcgagctctggcagtaagctcaaagacccggagctgtctttgaagggcacacaacatatcatgcaggccggccaaacgctacacctgcaatgtcggggcgaggcggcccataaatggagcctgcctgaaatggtgtctaaagaatctgaacggttgagcatcaccaaatccgcctgtggccggaacgggaagcagttctgttctactctgaccttgaatactgcacaggctaatcataccggcttttatagctgtaaatatctggctgtccccacaagtaagaagaaggagactgaatctgccatctatatctttatcagtgacactggcagacctttcgtggaaatgtactcggagattcctgaaatcattcatatgaccgagggaagagaattggtaatcccttgtcgcgtaacctcccctaatatcaccgtgaccttgaagaaaaaaaacaaaagggcttag

SEQ ID NO: 15251 - DNA, 1626 bp, Artificial Sequence
  Description of Artificial Sequence: Synthetic coding sequence
atggtaagctactgggacaccggcgtcctgctctgcgcattactcagctgtctgttgttgaccggctcctcgtccggatctaaactgaaggatcctgagttgtcactgaaagggacccagcatattatgcaagctggacagacccttcacctgcagtgccggggcgaggccgctcacaaatggtccctgccggaaatggtgtcaaaagaaagcgagcgactgagtatcacaaagtcagcctgcggccgaaatggcaaacagttttgttctaccctcacattgaacaccgctcaggcaaatcacactggattctactcttgcaaatacctggctgtacctacttccaaaaagaaggaaacagagtctgccatctatatttttatctcagataccggccgccccttcgttgaaatgtacagcgaaattccagagatcattcacatgacagagggcagggagctcgtcataccttgtcgagtgacgtcccctaacatcacagtgacactcaagaaatttccactggacactctcatcccagacgggaagcggattatttgggactctcgtaaaggattcatcataagcaacgcaacctataaggagattgggcttctgacatgcgaagccaccgttaatggtcacctctataagacaaactatttgacccatcgccaaaccaacactattattgacgtgcagatttcgacccctagacccgtgaagctgctgcggggtcacacccttgtgctaaattgcaccgccaccacgccgttgaacacaagagtgcagatgacatggtcatacccagacgaaaagaataagagagcctctgtgcggagacggattgatcagtcgaattcccacgctaatattttttatagcgtgctgaccatagataagatgcagaacaaggacaagggcctatacacgtgccgagtaaggtcaggtccaagctttaaaagcgtcaacacgtccgtgcacatctatgacaaagctttcattacagttaagcaccggaaacaacaggtgctggaaactgtggccggcaaacgcagctacagacttagcatgaaggttaaggccttcccttctcccgaggtggtctggctcaaagacgggctgcccgctaccgaaaaaagtgcaagatacctaacccgcggttactctttgattattaaggacgtgaccgaggaggatgctggaaactacaccattctccttagcattaagcagagtaatgtgtttaagaacctgaccgccacactgatagtgaatgttaaaccgcagatttatgagaaagcggtgagttccttccctgacccggcactctaccccctgggcagtcgccagattttaacttgcaccgcctatggaatcccacagccaaccattaagtggttctggcatccatgtaaccacaaccatagtgaagctcgctgcgatttctgcagtaataatgaagagagttttattttagacgcagattcaaacatgggcaatcgtattgaatcaatcacccagcgcatggccattatagagggcaaaaataagttacctccagctaattcttctttcatgttgccaccgacaagcttctcttcaaactattttcatttcttgccttag

SEQ ID NO: 15252 - DNA, 1671 bp, Artificial Sequence
  Description of Artificial Sequence: Synthetic coding sequence
atgaagcgctcatcctctgagataaagaccgattatctctcaattattatggatcccgatgaggtacccctcgacgagcaatgcgagcgcctgccctatgacgccagtaaatgggaatttgcccgtgagagactgaagctcggaaagtcactcggaagaggcgcgtttgggaaggtagtccaggccagcgcctttgggattaagaagtcacctacctgtcggaccgtcgccgtgaaaatgctcaaggagggggccactgcttcagagtacaaggctctgatgaccgagctcaagattctgacgcatataggtcatcatctcaatgttgtgaatctgctgggcgcctgtaccaaacaaggcggccccctgatggtgatcgtggagtattgtaaatatggaaacctgtccaactatctcaaatctaaaagagacttgttcttcctgaacaaggatgccgccctccacatggaacccaaaaaggaaaagatggagccggggctggagcagggcaagaagccccgtctggattccgtcacttcaagtgaatcttttgccagcagcggattccaggaagacaaaagcctgagcgatgtggaagaagaggaagattccgacggcttctataaggagcccatcactatggaagaccttatttcttatagctttcaggtggcaagaggcatggagttcctgagcagcaggaaatgcatccacagagatttagcagcccggaacattcttctgtctgaaaacaacgttgttaagatatgcgacttcggactggcccgggacatctacaaaaaccccgattatgtccggaagggcgacacccggctcccacttaagtggatggcgcccgaatcaatcttcgacaagatttacagcacgaagtccgacgtgtggtcttatggagtccttctatgggagatattttctttaggcgggtctccctatcctggtgtccagatggatgaggatttttgctcccggctcagggagggaatgcgcatgcgtgcgccagagtacagcacccccgagatctatcagataatgttggactgttggcatcgggaccccaaagagagaccacgatttgctgagctagtggaaaagctgggtgacttgctgcaggcaaacgtccagcaagatggcaaagattatatccctattaacgcaatcctcacagggaacagtgggtttacctatagcactcccgcattttctgaagacttctttaaggagagtatctcagcgcctaagttcaacagtggaagctccgatgacgttagatatgtaaacgcattcaaatttatgagtcttgagagaattaagacctttgaggaattgctccccaatgctaccagcatgttcgatgattatcaaggtgacagcagcactttgttagcctcccccatgttgaaacgatttacctggaccgactccaaaccaaaagctagtctgaaaatcgatctccgggttaccagtaaaagcaaggagagcggactgagcgacgtttctagaccctccttttgtcattctagttgcggtcacgtgtccgaggggaagagaagattcacctacgatcacgcggagctagagcgcaagattgcatgctgcagcccaccgcctgattataactccgtggtattgtatagtacaccccctatctag

SEQ ID NO: 15253 - DNA, 45 bp, Artificial Sequence
  Description of Artificial Sequence: Synthetic coding sequence
gagctaagcaactttgagtgcttgcacccctgttctcaggagtag

SEQ ID NO: 15254 - DNA, 2202 bp, Artificial Sequence
  Description of Artificial Sequence: Synthetic coding sequence
atggtgtcatactgggacacgggggtactgctttgtgcccttttaagctgcctgttgctcacaggaagcagttcgggctccaagcttaaggacccagaattatctttgaagggaacacagcatattatgcaggcaggacagaccttgcatcttcagtgtagaggcgaggcggcccataagtggtctttgccagagatggtctctaaagaatcagagcgtctgtccattaccaagtctgcttgcggtcggaacgggaaacaattttgctcaaccctgaccttaaacaccgcccaggcaaaccatactgggttttactcatgcaaatacttggctgtccctactagtaaaaaaaaggagactgagagtgccatttacatcttcataagtgacacgggaaggccctttgttgagatgtactctgaaattcccgagatcattcatatgactgaagggcgcgagctggtgataccttgtagagttacaagcccaaatattaccgtcaccctcaagaaattccctctagatacgctgattcctgatgggaaacgcattatttgggatagtaggaagggctttatcatttctaacgccacttacaaggaaatcgggctgctaacttgcgaggccacagtgaacggccatctgtacaagacgaattatcttactcacagacagacaaacactatcattgacgtgcagatcagcaccccacggcctgttaaactgttaaggggacatacactggtgctgaattgcactgctactactccccttaacacacgagtgcagatgacttggagttacccagatgaaaagaacaagagagcctccgtccgtcgcaggatagatcagtcaaatagccacgccaatatcttttactcggtgctgaccattgataagatgcagaacaaagacaagggcctctacacatgccgcgtccgctccggtccgtcctttaagtcagtgaacactagtgtgcacatctacgataaggccttcattacagtaaagcacagaaaacaacaggtgctggagaccgtggctggcaaaagatcttaccggctgtcaatgaaggttaaggctttcccatcccccgaggttgtctggcttaaagacggcctgccagccactgagaaatctgctaggtacctcactcgggggtacagcctcattattaaggatgtgaccgaggaggatgctggtaattatacgattctcctatcgattaagcagtcaaatgtgtttaagaatctgaccgcaaccttaatcgtgaacgtgaagccccaaatttatgaaaaagccgtttcttcttttccagacccagctctctatccgcttggttcgcggcaaatactgacctgcacagcctacggtattccacaaccaaccatcaaatggttctggcatccctgcaaccataaccactctgaggcgcgctgtgatttttgctcaaacaacgaggagagttttattctggacgccgactcaaatatgggcaacaggattgaatcaatcacccagcgcatggctattatcgagggcaagaataagatggcaagtacgttagttgttgccgactctcgcatcagcggtatttatatttgtattgcgagtaacaaagtcgggaccgtcggcagaaatatctccttctatattaccgatgtacccaatgggttccatgtgaacttggagaagatgccaactgaaggggaggacctgaaactcagctgcaccgttaacaagtttttgtacagagacgtgacgtggatacttcttcgcactgtcaataaccgaacaatgcattacagcatttcaaagcagaagatggccataaccaaggaacattccatcaccttaaaccttacaatcatgaacgtatcgttgcaagattcggggacctatgcctgccgcgctagaaacgtgtacactggtgaggagatactgcagaagaaggaaatcaccattagggatcaggaggcgccctacctgctgcgaaacctcagtgaccacaccgtggcaatttctagctccacaactttggactgccatgctaatggcgtccccgagccacagatcacctggttcaaaaataaccataagattcaacaagagcccgaactgtatacaagtacttcaccctcaagcagttctagctcccccctctcctccagcagttcaagcagctcctcctcatcatcttag

SEQ ID NO: 15255 - DNA, 1086 bp, Artificial Sequence
  Description of Artificial Sequence: Synthetic coding sequence
atgaactcagacctacttgttgatagcgatggcttctataaagagccaataacaatggaagatctcatatcttattcttttcaggtagcaaggggaatggagttcttgagttctcggaaatgcatccatcgggatttggctgctaggaatatcctgttgtctgaaaacaatgttgtgaagatatgtgacttcgggctggctagggatatctacaagaaccccgactatgtacggaagggggacacaagactccccctgaagtggatggcccccgagagcatctttgacaaaatttatagcacaaagtctgacgtatggagctacggagtgctcctttgggagatcttcagccttggggggagcccgtatcctggcgtgcagatggatgaggacttttgctccagattgagagaaggtatgcgtatgcgggcccccgagtattcgacacctgagatttatcagatcatgctggactgctggcatagggacccaaaggagcggccccgttttgccgagctagtagagaagctcggcgatcttctgcaggcgaatgtgcagcaggacggcaaagattacattcctatcaacgcaatactgaccggcaattccgggtttacgtattccactccagccttctctgaagacttttttaaggagagcataagcgcccccaaattcaattcaggctcaagcgatgatgtccgatacgtgaatgccttcaaattcatgagcttagagcgaatcaagacctttgaagagctactcccaaacgcaaccagcatgtttgacgattatcagggtgactcctccactctgttagcaagtccgatgctgaagcgctttacctggactgacagtaagccaaaagccagtctcaagattgacctccgagtgacttccaaatccaaggagtctggcctttctgatgtcagtcgtcccagcttctgtcatagtagttgcggccacgtctcagagggaaaacgccgcttcacttacgaccacgcggaattagaaaggaaaatcgcttgctgttccccaccacctgattataattccgtggttctctactccacccctccaatttag

SEQ ID NO: 15256 - DNA, 75 bp, Artificial Sequence
  Description of Artificial Sequence: Synthetic coding sequence
ctgccgccagcgaactcttccttcatgctgcccccaacttctttctcgtcgaattatttccatttccttccctag

SEQ ID NO: 15257 - DNA, 1062 bp, Artificial Sequence
  Description of Artificial Sequence: Synthetic coding sequence
atggagctgaccgagcttctgctagtggtcatgctgctgttgacagcccgactgacgctgagctctccagctccacctgcctgtgacctccgggtactgtctaagctgctccgagattctcacgttttacactctagactgagccagtgcccagaggtacaccccctacctactcccgtcctcctgccagccgtcgacttcagtctaggcgaatggaagactcagatggaagagacaaaagcacaagatattctgggcgccgtgactttgctgctagagggcgtcatggctgctagaggccagttaggacctacatgcctttcaagcctccttggccagctgtcagggcaggtcagattgctcttgggcgcactgcaatcactactcggaacccagctgccgcctcaggggcggaccaccgcccataaagaccccaacgctatattcttgagcttccaacatctcttgcggggaaaggtcaggtttctgatgttggtaggagggtcaaccctctgtgttagacgggcaccacctaccacggccgtcccctccagaacctccctggtcctgaccctaaatgaactccctaataggactagtggattgctggagaccaatttcacggccagtgcgcggacaacggggagcggactgttgaagtggcaacagggatttcgggctaagattcctggactgctgaaccagacctccaggtccctcgaccaaatacctgggtatctgaatcggattcacgaactcctcaatggaacacgcgggctattccctggaccctctcgacgcacattgggagctcccgacatctcttcaggtacctccgacacagggtccctcccacccaaccttcagcctgggtattcaccctccccgactcaccctcccacagggcagtatacactttttcctttgcctcccaccttgccaacccctgtcgtccagctacaccccctcttgcctgatccatctgcgcccacaccaacacccacatctcccctccttaacactagttacacacattcacaaaatcttagccaagaaggatag

SEQ ID NO: 15258 - DNA, 537 bp, Artificial Sequence
  Description of Artificial Sequence: Synthetic coding sequence
atgacggtgctggcaccagcatggagcccgaccacctatttactcctgttgctcttgttgtctagcggcctctcggggacgcaggactgttccttccagcacagtccaatcagctctgattttgctgtgaaaattcgagaactttcagactatctcctccaagattacccggtaacagtggcttctaacctccaggacgaggaactttgcggcgggctgtggcggctcgttttggcccagcgctggatggagcggctgaagacagttgctggcagcaaaatgcagggacttctggaacgggtcaatacagagattcactttgttacaaaatgcgcatttcagccgccaccctcctgtctgcggttcgtgcagactaacatttcacgtctgctgcaggagacaagcgagcaactggtcgctctaaagccctggattacaagacagaacttttcacgctgtctcgagctgcaatgccaacccgtggagactgtgttccacagggtctcgcaagatggcttagacctgttaacatcatag

SEQ ID NO: 15259 - DNA, 708 bp, Artificial Sequence
  Description of Artificial Sequence: Synthetic coding sequence
atgacagtgctggcccccgcctggagcccgacaacctaccttcttctgcttttgctccttagtagtggactgagtggcacacaggattgctcattccaacacagccccatttcctccgacttcgcagtgaagatccgggagctgagtgactatttactgcaggattatcccgtgacagttgcctccaatcttcaggatgaggagctgtgcggcggattatggagactcgtgctggcacagcgctggatggaacggctaaagactgtggcaggaagcaaaatgcaggggctgctggagcgagtgaacacagagatacactttgtcaccaagtgtgcattccagccccctcccagctgcctccgcttcgtgcagaccaacatctcacggttgctgcaggagaccagtgagcaactggtggcccttaagccgtggatcacacggcagaattttagccggtgtctggagttgcagtgccaacccgacagctctacattaccccctccttggagcccgcgcccccttgaagccacggcacccaccgccccgcagcctccgctgctgctgctactgctgctgccagtgggtcttctactgctggccgctgcatggtgtcttcactggcaaaggacaagacgtcgcactccaagacctggagagcaggtgccgccagtgccatcaccccaggacctgctgctggtagagcattag

SEQ ID NO: 15260 - DNA, 4092 bp, Artificial Sequence
  Description of Artificial Sequence: Synthetic coding sequence
atgcaaagaggtgcggccttatgcttaaggctgtggctgtgcttggggctgcttgatggattggtctcaggctactccatgactccgcccaccctgaacataactgaagaatcacatgtcatcgacacaggtgattcccttagcatttcctgtagagggcagcaccctctggaatgggcttggccaggcgctcaggaggcccccgcgacaggcgacaaggatagcgaggatacaggcgtagtgcgcgactgcgaagggacagacgctcgaccgtactgcaaggttctgctgctacacgaggtccatgccaacgatacggggagctacgtgtgttattataagtatattaaagcccggatcgagggcacaacagccgcctctagttatgttttcgtgagggactttgaacagccatttatcaacaagccagacacacttttggttaaccggaaggacgcgatgtgggttccctgcctcgtgagcatacccggcctgaacgtcaccctcaggagccaaagcagtgtgctttggcccgatgggcaagaagttgtgtgggacgaccgtcgagggatgctcgtctctacccccctcctgcacgacgccttgtatctacagtgtgagactacctggggagaccaagacttcctctctaaccctttcctggtgcacattaccggcaacgagctgtatgacattcagctcctgccccggaagagcctggagctccttgtcggagaaaaactggtgttaaattgcacagtgtgggctgagtttaatagcggggtgacatttgactgggattacccaggaaagcaggcagagaggggaaagtgggtgcccgagaggcgttcacagcaaacccatacagagctcagcagcatcctaactattcacaatgttagtcagcacgatttgggaagctatgtctgcaaggcgaataatgggattcagcgatttcgcgagagtaccgaggttatagtgcatgaaaatcctttcatttcagtcgaatggctaaaaggtcccatcctcgaagcgactgccggcgacgagctagttaagctcccagtaaaacttgctgcatatccacctcccgagtttcaatggtacaaagatgggaaggcgctttccgggaggcacagcccccatgccctagtgctgaaagaggtgacggaggcgtctactgggacctacactctggcactatggaattcagctgcagggctcagacgcaatatatcgttggaacttgtagtgaacgtgcctccacagatacatgaaaaagaggcctctagtccaagcatctactctcgccattccagacaggctcttacctgcacggcctacggggtgccactccctctgtccatccagtggcattggcgcccatggactccttgcaaaatgttcgctcaaagatctctgagaaggcgccagcagcaggacctcatgccccagtgtagagattggagggcagtgacgacacaggatgctgtgaacccaattgaatcactggatacatggaccgagtttgtcgagggcaaaaacaaaacagtgagtaagcttgtgattcagaacgccaatgtgtccgccatgtacaagtgcgtggttagtaacaaggtgggacaagacgagcggctgatctatttttatgtgaccactattccggacggtttcaccatagagagtaaaccctccgaagagctgttggagggccaaccagtgttgctaagttgccaggctgacagttacaagtacgagcatctgagatggtaccgcctgaatctgtccaccctccacgacgcccacggtaatccactgctcctggactgtaaaaacgttcaccttttcgctacacccttagccgctagcctcgaggaagtggcccccggcgcccgacacgctaccttgagtctcagcatcccccgtgtggctccagagcacgaggggcattacgtttgcgaggtgcaggatcgccggagccatgataagcattgccacaagaaatatctgagtgtgcaggccctggaggcccccagacttacccagaatctgacggacctgctggtgaacgtgtccgactccctcgagatgcagtgtttggtggccggagcacacgcccccagtatcgtatggtacaaggatgagaggctcctggaagagaagtctggtgttgatttagccgactctaatcagaaactcagcattcaaagagtcagggaggaggacgccggccgctacttgtgttccgtttgtaacgcaaaaggatgtgtgaacagctcagctagtgtggcggtggaaggcagtgaggacaaggggtccatggaaatcgttattctcgtcggcactggggtcatagcggttttcttctgggttctgctcctattaatcttctgcaacatgcggagaccagcccacgccgacattaagactggctatctcagcattatcatggaccctggcgaagtgcccctcgaggaacagtgtgagtatctgtcctacgatgcctcacaatgggagttccctcgagagcgactccatctcggcagagtgctcgggtacggagcctttggtaaggtcgtggaggcatcggccttcggcatccataaaggttcttcatgcgacaccgtcgcagtcaagatgcttaaagagggggccactgcttcagagcatcgggcccttatgtcagagctaaaaattttaatccacattggtaatcacctcaacgtggtaaatttgttgggggcgtgtacaaaaccccagggacctcttatggtaatcgtggagttttgtaagtatggaaatctcagtaattttctgagggcgaaacgggacgcattttctccgtgcgcggagaaatcccctgaacagagaggccggtttagggccatggtggaactcgcccgcctggatagacgtcgccctgggagcagcgaccgcgtgttattcgcccgatttagcaagactgaggggggggcccgacgggcaagcccagaccaggaagccgaagacctatggctgagccccctgacgatggaggacctcgtctgctatagcttccaggtggcccggggaatggaattcctggcctctcggaagtgcattcatagagatctggccgcgcgtaatatactcctgagcgagtcagatgtggtgaagatttgcgactttggattggcacgagacatctataaagatcccgattacgtgcggaaaggtagtgctcgcctgccactgaagtggatggcccccgaaagtatctttgacaaggtgtacaccacccagagtgacgtgtggtcatttggcgtgctgctgtgggagatattcagcttaggagcctcgccatatcctggggttcagattaatgaggaattctgtcagcgtctgcgggacggcacacgaatgagagcccctgagttagccacccctgcaattagacggatcatgctgaattgctggtcaggtgatccgaaggcccggccagccttctcagaactggtggagatccttggagatctcctccagggtagaggcctccaggaagaagaagaggtgtgcatggctccccgctcctctcagtcatcagaggagggatccttttcacaggtcagcacaatggctttgcatatcgcgcaggctgacgcggaagactcacccccatccctccaacggcacagtctagctgcacggtactacaattgggtgtcattcccaggttgccttgctagaggcgccgaaacccgaggttcgagcagaatgaaaactttcgaggaattcccaatgactcccacaacatacaagggtagtgtggacaaccaaacagattccggtatggtactcgcttccgaagagttcgagcagattgaaagccgacatcggcaagagagcggattttcttgtaaagggccaggccagaacgtggccgtgacacgcgcccacccggattcccagggccggaggcgtagaccggaacgcggcgccaggggcggtcaggttttctacaactcggaatacggcgagctcagcgagccgtcagaggaggaccactgttcgccgtctgccagggtgactttttttaccgataattcctattag

SEQ ID NO: 15261 - DNA, 2283 bp, Artificial Sequence
  Description of Artificial Sequence: Synthetic coding sequence
atgctggttagcacccccctgctgcatgatgccctgtatctgcagtgcgagacaacttggggtgaccaggatttcctgtccaacccttttctggtgcatataaccggaaatgaactgtacgacattcagctgctgccgagaaagagtctcgagctactagtgggcgaaaagctggttctaaactgtacggtatgggcagagtttaactcgggggtcaccttcgactgggattatcccggcaaacaggctgaaagagggaaatgggttcctgagagacgtagccagcagactcataccgagctgagtagtattctgacaatacataacgtgagccagcatgatctgggttcctacgtctgcaaggccaataacggaattcagagattccgcgagagcacggaggtgattgtgcatgaaaatccttttatctccgtcgagtggcttaaaggacctattctggaagccaccgccggcgacgagcttgtgaaactgcccgtgaaactcgccgcatatcctccacccgagtttcagtggtacaaagatggaaaagccctttcaggtaggcattcaccacacgctctggttctgaaggaagtcacagaagcctcaaccggcacctatacacttgccctgtggaattccgcagccggcctccgccgcaatattagcctcgagctggtggtcaatgttcctccacagatccatgagaaagaggcctcaagcccatctatttactcccgacactcccggcaagctctgacttgcactgcctacggtgttcctttgcctctgagcatacaatggcactggaggccatggaccccctgtaagatgttcgcccaacgatctctgaggcgcagacagcagcaggacctgatgccgcagtgccgcgattggagggctgtcaccacacaggatgccgtcaatcccattgaatctttggacacctggaccgaatttgtggagggaaagaataagaccgttagtaagctagtaatccagaatgcgaacgtttcagcaatgtataagtgcgtggtttcaaataaggtcggccaggatgagaggctgatttacttctacgtcaccacaattcctgatggatttacaatcgagtcaaagccgagcgaggagctactcgagggccaaccagtcttgttgtcctgccaggccgattcttacaagtatgaacacctgcgctggtacagattgaatctgtctaccttgcacgatgctcacggcaacccactcctgctggactgtaagaatgtacacctcttcgctacccccctcgccgccagtctggaggaggttgcgcctggcgcaaggcacgccaccctgtccttaagtattcctcgggtggccccagagcacgaagggcactatgtttgtgaagtgcaggatcgccgtagtcatgataagcattgccataaaaaatacttgtcagttcaagccttggaagcgcctaggttgacccagaacctgacagacctgctcgtcaacgtttccgactctctggagatgcagtgtctggttgccggcgcccacgctccctcaatcgtttggtacaaagacgaacgcctgctggaggagaaatccggggtggacctggcagattcaaaccagaaactgagcattcagcgcgtcagagaagaagacgctggaagatatctctgcagcgtgtgcaacgctaagggttgcgtgaatagtagcgcctcggtggccgtggaaggatccgaggacaagggatcgatggaaattgtcattctggttgggacaggagttatcgccgtttttttctgggttttgctcttgctgatcttctgtaatatgagacggccagcccatgcggatatcaagaccggctacctgagcatcattatggaccctggcgaggtgccattagaggagcaatgtgagtaccttagctacgatgctagtcaatgggaatttcctagagagcgcttgcatcttggtagagtgctaggctacggagccttcggtaaggttgttgaagcgagtgctttcggcatccacaaaggaagctcctgcgacaccgtggccgttaaaatgctcaaaggagtcggctccgcagggggaaggggaagccttgccggcgaggaacaacaactcggggtgggcaggtgggatggcaattcagggcgtgaaacggaagctgggtcacagagtcacccccggttttacagagaggctgctgggtttcgagcagaaggaccacccgagccacctagcgtggggccagctggttgccccggggggccttag

SEQ ID NO: 15262 - DNA, 3897 bp, Artificial Sequence
  Description of Artificial Sequence: Synthetic coding sequence
atgcagagaggggccgcactctgcttgaggctgtggctatgcttgggccttctcgatggcctggtcagtggctactctatgaccccacctactctaaacattaccgaggagtcacatgtaatcgacacgggggattcactgagcatctcgtgcagaggacaacatcctctggagtgggcctggcccggagcccaagaagcaccagctaccggggataaagatagtgaggatacaggggtagttagggactgcgaaggcacggatgcacggccctactgtaaagtcctattgcttcatgaggtgcacgcaaacgacactggttcctatgtctgctactataagtacatcaaggccagaattgagggcaccacagccgctagttcttatgtgtttgtgcgcgactttgagcaacccttcatcaataagcccgacactctccttgttaatcgcaaagacgcgatgtgggtgccttgcttggtcagtattcccgggttgaacgtgacgcttagatcacagagctctgttctgtggcctgacgggcaggaagtcgtgtgggacgatagaagaggaatgctcgtttctacacctctgctgcacgacgctctgtacctgcaatgtgaaaccacgtggggtgatcaagacttcttgtcgaacccatttctggtgcacattaccggaaatgagctctacgacattcagctactccctaggaaaagcctggaattgctagtcggagaaaaattggtgttgaactgtaccgtgtgggctgaatttaattctggagtgacatttgattgggattacccagggaagcaggcagaaagaggaaagtgggtgccagagagacgaagtcaacagacacataccgagctctcttccattctaaccattcacaatgttagccagcacgacttgggttcctacgtgtgtaaggcaaataacgggatccagcgctttcgggaaagtaccgaggtcattgttcatgaaaacccattcataagcgtcgaatggttaaagggcccaattctggaggcaaccgctggagacgagctcgtgaaactacctgtcaagttggcggcctatccacctcctgaatttcagtggtacaaagacggcaaggccctgagcggcagacactcaccccacgccctcgtcctcaaggaggtgacagaggccagcacggggacctataccctggccctatggaactccgctgctggcctacgtagaaatatttcgctcgagctcgtcgtcaacgtgcctccacaaatccacgagaaagaagcatcaagcccaagtatctatagcagacattcacgacaggctctcacgtgtacagcctacggggtcccattgcctctgtccatccagtggcactggaggccttggaccccatgcaagatgttcgcacagcggagcctgagacgccggcagcaacaggaccttatgcctcagtgtcgcgactggcgagccgtcactactcaggacgcggttaatccaatcgaaagcctcgacacctggaccgagttcgtggaagggaagaacaaaacagtgagcaagctggtaatccagaacgccaatgtgtcggcaatgtacaaatgtgttgtgtccaataaggtgggacaagatgaaagactgatctacttttacgtgactaccatccctgacggatttaccatcgagtcaaagccaagcgaggagctcctggaaggtcaaccagtgctcctttcctgtcaggctgactcctacaagtatgagcacctcagatggtacaggttaaatctgagcacgttgcatgacgcgcatggcaacccccttcttctggattgcaaaaatgtccatctattcgcaaccccattggccgcttcgctggaggaagtagccccaggcgccagacatgccactctaagcctatccattcccagagttgcccccgaacatgagggtcactatgtgtgcgaggtgcaggatcggcgctcgcacgacaagcattgccacaagaagtatctctccgtacaggcattggaggcaccccggctgacacagaatctgaccgatctcctggtaaacgtatctgacagccttgagatgcagtgtctcgtggcaggggctcacgcgccgtccatcgtatggtacaaagacgaaagattacttgaggagaaaagcggtgtggatctggctgattctaatcagaagctctctatacagcgggttcgggaagaggatgccgggaggtacctctgtagcgtgtgtaacgctaagggttgcgtgaacagtagcgcgtcagtggcagtggagggctcagaggacaagggaagtatggaaatcgttattctggtggggacgggggtgatagcagtttttttttgggtcttgctgctgcttatcttctgcaacatgcgacggccggcccacgcagatataaagacaggctatctgtcaattatcatggatcccggtgaagtgcccctggaggaacagtgtgaatatctgtcctacgatgcttctcagtgggagtttccacgagagcggctgcacttggggcgagttctaggatacggagcgttcggaaaggtggtggaggctagcgcgtttggcatacacaaagggagtagttgcgacaccgtcgccgttaaaatgttgaaggagggagcgactgcttccgagcacagggcgttgatgtcggaattaaagatactgatccatatcggcaatcatctcaatgtcgtgaatctcctgggggcttgtaccaaaccccaaggtcccctgatggttattgttgaattttgtaagtacggcaatctgagcaactttctgagagctaagagggacgctttctcgccttgcgccgagaaatcaccagagcagcgaggccgcttcagagcgatggtggagttagcccggctagatcggcgcaggccaggatcgtctgacagagtgctgttcgcccgtttctcaaagaccgagggcggcgctcggcgagccagtcccgaccaggaagccgaagacttgtggttgtctccccttactatggaggacttggtatgctactcctttcaagtggccaggggaatggagttcttggcatcaaggaagtgcatccatcgtgatttggcagcaagaaatatcctcctgtccgaaagtgacgtcgtgaaaatctgtgacttcggcctggctagagacatatataaggatccagattacgtgcgcaagggcagcgcaaggctacctctgaagtggatggcgcccgagagcatctttgacaaggtctatacaacgcagagcgacgtgtggagcttcggggtcctgttatgggagatattttcccttggtgcttctccatatcctggcgttcagatcaatgaggagttttgtcagcgcttaagagacggtactagaatgagggcacccgaactcgctacccccgccatacgccgtattatgcttaattgttggagcggggacccaaaggcccgacccgctttctccgaactcgtggagatcctcggggatttacttcagggaagaggactgcaggaggaagaagaggtctgcatggcccctaggtcctcccagagctctgaggaaggttccttttctcaggtaagtaccatggcactccatattgcacaggctgacgccgaggactcaccacctagtctgcagaggcacagtttagcggcgaggtattataactgggtctcattccctggctgcctcgctcgcggagccgaaaccaggggttctagcaggatgaagacatttgaggagtttccaatgaccccaacgacatataaaggtagcgtcgataaccagacggacagcggtatggtgctcgcaagcgaggagttcgaacagattgagtctcggcataggcaagaatctggattcaggtag

SEQ ID NO: 15263 - DNA, 3921 bp, Artificial Sequence
  Description of Artificial Sequence: Synthetic coding sequence
atgcaaagaggggccgcactgtgtctgcggctctggctgtgtttaggccttctggatggactggtcagtggctattcgatgacgccccctacacttaatattacagaggaatcccatgtgattgacacaggggactcactgtcgattagctgtaggggccaacatcctttggagtgggcttggccaggtgcacaggaagcgccggctacaggcgataaggacagtgaagacacaggggttgtccgggattgtgagggaacagatgcccgtccttactgcaaagtgctgcttttacatgaagtgcatgccaacgatactggctcttacgtttgttactataagtatatcaaagctcgcatcgaggggaccactgcggcttctagctatgtgttcgtgcgagactttgagcagccattcattaataagcctgatacacttttggtgaatcgcaaagatgcaatgtgggtcccctgcttggtttctatacccggactcaacgtgacactccgtagccagtcaagcgtgttgtggcccgatggacaggaggtcgtgtgggatgacagacgaggcatgcttgttagcacccctctgttacatgacgccttgtatcttcagtgcgaaaccacctggggagatcaggattttctctccaatccattccttgtgcacatcaccgggaacgaactctatgacatccaactgcttcctcggaaatctctggaacttctagtgggcgaaaagctagtcctgaactgtaccgtttgggctgaatttaattctggggtgacatttgattgggattatcccggaaaacaggctgagcgtgggaagtgggtgcccgaaagaaggagccaacagacacacacggaactctcttcaattcttaccatccacaatgtgtctcagcacgacttaggctcctacgtatgtaaggccaacaacggaatacagcggttccgggaaagtactgaggtcattgtccacgagaatcctttcatatccgtggaatggctgaaaggacccatcctcgaggccacagcgggagatgaattagttaagctgccagtgaaattggccgcctatcctcctcctgaattccagtggtacaaagacggaaaagccctgtccgggcggcatagcccacacgccttagtcttaaaagaagtgaccgaggcatccacagggacctacactctcgccctgtggaattccgctgcagggcttcggagaaacattagtctggagctcgtggtgaacgtgccgccccagatacatgaaaaggaggcttctagtccctccatatacagccgccattcgcgacaggctttgacatgtaccgcctacggggtccccctgccactgtctatccagtggcactggcgcccgtggacaccctgtaagatgtttgcccaacgtagcctgcggcgacgccaacagcaagatctgatgcctcaatgtcgggattggagggcagtgacaacccaagatgctgtcaatcctattgaatcactcgatacgtggaccgaattcgtggaagggaagaataagactgtctcaaaattggtgatccaaaacgccaatgtgagcgccatgtataagtgtgtcgtctctaacaaggtgggccaggatgagcgcctgatctatttctatgtcaccacaatacccgacggctttaccatcgagtcaaagccgtcagaggaattgttagagggacaacctgtcttattaagttgtcaggctgatagctacaaatacgagcatctgcgatggtaccggttgaatctgtctactcttcatgatgctcatggcaaccctctgttactggactgtaaaaatgtacacttatttgcaacacccttagcagccagccttgaagaagtggcccctggcgcaaggcatgccacgctgagcttatccattcccagggtcgcacccgagcatgagggtcactatgtgtgcgaagtgcaagaccgacgctctcatgataaacactgccataagaagtacctctccgtgcaagctcttgaagcacctaggttgacgcagaacttgactgatctgctcgtgaacgtttcagacagcctagagatgcagtgcctggttgctggggcccacgctccaagcattgtttggtataaagacgaacggttgttagaggaaaaatccggcgtcgatctggctgacagtaaccagaagctgagcattcagcgggttagagaggaagatgccggaaggtatctctgctcggtatgtaatgccaaaggctgcgtaaacagcagtgcctctgtagcggtggaggggagcgaagacaaaggtagcatggaaattgttatccttgtcggtacgggggtgatagcagttttcttctgggttttactactcctcatattttgtaacatgcgcagacctgcccacgccgacattaagacaggatatctctcaatcatcatggaccccggcgaggtacctctcgaagagcagtgtgaatacctctcttacgatgcctcccagtgggagttccctcgggaaagattacacttaggccgggtcctcgggtatggggccttcggcaaagtcgtggaggcctcggccttcgggatccataagggcagcagctgcgacacagtggccgtgaagatgctgaaggagggagccacagcatcagagcatagagcacttatgtctgagttaaagattctcatccatattggaaaccacctcaacgtggtgaatctcctaggggcctgtactaagccccagggcccgcttatggttatcgttgagttttgtaagtacggaaatctttccaatttcttgcgggccaagagagacgcgttttccccctgtgccgagaagagtccagaacaacggggccggtttcgcgcaatggtagagttagctaggctcgatagaaggagacccgggtcaagcgaccgggttctcttcgctcgtttcagtaagactgaaggcggcgcccgacgcgcttctccggatcaagaggctgaagacctatggctgtcccccctcactatggaggacctcgtctgctatagcttccaggtggctagaggaatggaatttcttgcttcacggaagtgtattcatcgcgatctggctgccagaaatattctgctgtctgagtctgacgtcgtgaagatctgcgactttggcttagcccgtgacatctataaggaccctgactacgtacggaaaggcagtgcccgcttgcccctcaaatggatggctccagaatcaatctttgataaggtgtacactacgcaatctgatgtctggagtttcggtgtccttctctgggagattttttccctgggagcctccccttaccccggggtgcagatcaatgaagagttctgccagagacttcgagacgggacaagaatgcgggctccagaactggccacacccgcaattcggcgaattatgttgaactgttggtccggagaccctaaggcgcggccggccttctccgaacttgttgagattctcggggacctgctccagggcaggggtctgcaagaagaggaggaggtttgcatggcacctcgttcttctcagtccagcgaggagggttcattttcacaagttagcactatggcacttcatatcgcacaggccgatgccgaggattctccaccttctctgcagaggcattctttggcggcccgctattataactgggtcagttttccagggtgcctggcaagaggcgcggaaaccaggggtagcagtcgcatgaagacttttgaagaatttcccatgacacctaccacctacaaaggctctgtggataaccagactgacagcgggatggtcttagcctctgaagaattcgaacaaattgagagcagacaccggcaggagtccggcttcagggggacacggcgtaccaggggagcctag

SEQ ID NO: 15264 - DNA, 1740 bp, Artificial Sequence
  Description of Artificial Sequence: Synthetic coding sequence
atgaatgccatcgtagccctgtgtcatttctgcgaacttcacggcccccgcacactgttttgcacggaagtgttacacgctcctctccctcagggcgatggtaacgaagacagtcccggccagggagagcaggctgaggaagaggaagggggaatacagatgaattctcgtatgagggcacactctcctgctgagggcgcctccgtggagtcatcttcccccggacccaagaaaagcgacatgtgtgaaggctgccggtccctggctgcggggcaccccggctacatttctcacgataaggagacttctattaagtacgtgtcgcatcagcaccccagccatcctcagttgttctcgattgtcagacaagcatgtgtacgctctctgagttgtgaggtatgccctggtcgcgaaggaccaatattctttggcgatgagcagcatggcttcgtgttctcgcacacttttttcattaaagactcgcttgctaggggctttcagcggtggtattccatcataaccattatgatggaccgcatctatcttattaattcctggccgtttctcctgggcaaagtgaggggaatcatcgacgagctccaagggaaggccctaaaggtgttcgaggccgaacagtttggttgcccacagagagcccagcggatgaacactgcttttactccctttcttcaccagaggaatggaaacgctgcgcggtcactgacctcactcacctctgacgataatctatgggcttgtctacacaccagtttcgcgtggctcttgaaagcctgtgggagccgactgaccgagaagctactcgagggcgcccctacggaggatactctggttcagatggagaaactggccgacctggaagaggagtcagagtcatgggataactctgaggctgaggaggaagagaaagctcctgtcctgcctgagtccaccgagggcagagagctgacccaggggcctgcagaaagttctagtctttccgggtgtggcagctggcagcccagaaaactgcccgtctttaagagtctgcggcatatgaggcaagtgcttggggctccctcattcaggatgttagcctggcacgtgctgatgggaaaccaagtgatttggaaaagtagggatgttgatttggtgcaatctgccttcgaagtgctgaggaccatgctgccagtgggctgtgttaggatcataccatattcctctcagtacgaggaggcatatcgttgcaacttcctgggtttgtcaccacacgtgcagatcccccctcacgtactgagctctgaatttgctgtcatcgtggaagtgcatgctgccgctagatcgaccctgcatccagttggctgcgaagacgatcaaagtttgtctaagtacgaattcgtcgtgacgtcaggctcccccgtggctgctgatagggtgggccctaccattcttaacaagatagaggcagctctgaccaaccagaatttgtccgttgacgttgttgatcagtgtttagtctgcttgaaggaggagtggatgaacaaagtaaaagtgttgttcaagttcacgaaagtggactccaggccaaaagaggatactcagaagttgctctccattttgggcgcttcagaggaggacaacgtgaagctcttgaaattctggatgacaggactctctaaaacatataaaagtcacctgatgagcaccgtcaggtctcccaccgcctcagaatcaagaaactag

SEQ ID NO: 15265 - DNA, 594 bp, Artificial Sequence
  Description of Artificial Sequence: Synthetic coding sequence
atgaacgctattgtagccttatgccatttttgtgaactgcacggccccaggactttattttgcaccgaagtgctccacgctccactgccacagggcgacggcaacgaagatagtcctgggcaaggcgaacaggctgaagaggaagagggagggatccagatgaattccagaatgcgcgcgcactcacctgctgagggcgcaagcgttgagtcgagttctcccggccccaaaaagagtgatatgtgcgagggttgccggtccctggccgctggacaccccgggtacatctctcatgacaaggagacatccataaagtatgtgtctcatcaacatccctcccatccccagttgttctctattgttcgccaggcgtgtgtcagatcgttatcatgcgaagtctccttggtggccacagagcctgtgtcagtgggggctcatatgttgcccggcgcactggggggcctcggagcatcgatcgcgcagggtggacgacattggtccagtttgcgagcggacccccaaatctcaaccgctcagggaacaggccgcctgccatgccccgaactgcgagaagagagttgttggacttgttag

SEQ ID NO: 15266 - DNA, 1029 bp, Artificial Sequence
  Description of Artificial Sequence: Synthetic coding sequence
atgaatgccattgtagctctgtgtcacttttgtgaactacacggacccaggacactcttctgcactgaagtattacacgctccactgccccagggcgacggaaatgaggatagccctggtcaaggggagcaggctgaagaagaggagggtggtatccaaatgaattcacgtatgagggcgcactctcctgcagaaggtgcaagcgtagagtcctctagtcccgggccaaaaaagtccgacatgtgcgagggctgccggagtctagccgcaggccatccgggctacatctcccatgataaagaaacatcgatcaaatacgtgtctcaccaacacccttctcacccgcagctattcagtattgtcaggcaggcatgcgttcggtccctgtcatgtgaagtgtgccccggcagagaaggccccatcttctttggggacgaacaacacggcttcgtgttttctcatacctttttcatcaaggattcactggcacgtggtttccagcgctggtacagtatcattaccattatgatggaccggatttacctcataaattcttggcctttcctgctgggcaaagtacgcggcatcattgatgagctgcagggaaaagcgctgaaagtcttcgaagctgagcagttcggatgccctcaacgtgctcagcgaatgaatactgccttcactcccttcctccaccaaagaaatggtaatgccgctcgcagcctcacttctctgacatccgatgacaacctgtgggcatgtctgcacacgtcttttgcctggttgcttaaggcttgcgggagccgcctgacggagaaactgctggagggcgctcctactgaggacacactcgtccagatggagaagctcgctggcgaagccggggttttactgcctggcccctggccgggttggccatggggaggaacctcttgcctcctgtcctggcaggaatctctgagggagggcaatgccgccttaaaccaacccagaacatctctccgcgaggctcatccacccatctcagtatag

SEQ ID NO: 15267 - DNA, 594 bp, Artificial Sequence
  Description of Artificial Sequence: Synthetic coding sequence
atgaatgccattgtagccctgtgccacttttgtgaacttcacggcccacgaaccctgttttgcacagaggtcctgcatgccccccttccccaaggggatggaaatgaggactctcccggccagggggaacaagcagaagaggaggaaggcgggatacagatgaactcacgcatgcgcgctcattctccagcagagggagcatcggtggagagcagctctcctggcccaaaaaagagtgacatgtgcgaaggctgtcgatccttggctgctggccatcccggatacatcagtcacgacaaggagacttctatcaaatacgtgtcacatcaacacccatcccacccccagcttttttctattgtacgccaggcatgtgtgagaagcctctcctgtgaagtctctctcgttgccacagaaccggtgtccgtcggtgcccacatgttacccggagcccttggcggcctgggagccagtatagcccaagggggccggcattggtcaagtctgcgagctgatccccaaatatcaaccgcccaggggacagggcggctgccatgcccggagctacgagaggaaagttgctggacctgctag

SEQ ID NO: 15268 - DNA, 462 bp, Artificial Sequence
  Description of Artificial Sequence: Synthetic coding sequence
atgaattcccgcatgcgtgctcactcccctgccgagggtgcctcggtcgaatcgtcaagtccaggacctaagaagtctgatatgtgtgagggatgtaggtcactggctgctggacatccaggctacatctctcacgacaaagaaaccagtatcaagtacgtgagccaccagcacccctcgcatccccagttattcagcatcgtcagacaggcttgcgtgaggtctctgagctgcgaggtgtgtcctgggcgcgaagggcctattttttttggtgatgagcagcacggatttgtgttttcccacacgttttttataaaggattccctggcgcgcggatttcagaggtggtactccattattacaataatgatggatcgcatctatttaattaactcatggccctttttgctgggaaaggttagaggcatcatcgacgagctccagggtaaagctctaaagtag

SEQ ID NO: 15269 - DNA, 1419 bp, Artificial Sequence
  Description of Artificial Sequence: Synthetic coding sequence
atgctcggcacggtgaaaatggagggacacgaaacaagtgactggaatagctattatgccgacactcaagaggcctatagcagtgtgccagtctccaatatgaacagtgggctggggagtatgaactccatgaacacatacatgaccatgaataccatgacgacatcaggcaatatgacccctgcctcatttaacatgagctacgccaatcccggccttggcgccggactctctcctggagctgtagccgggatgcccgggggatctgccggcgcaatgaacagtatgaccgcagctggcgtgaccgccatgggtaccgccctgtcgccttccgggatgggcgcaatgggggcgcagcaggctgcttccatgaatggactgggaccatatgcggctgctatgaacccgtgtatgtctcccatggcttatgcaccatctaacctgggtaggtccagagccggaggaggtggcgatgcgaaaactttcaaaaggtcatacccacatgctaaacccccatatagctatatctcgctgattaccatggccattcaacaagctccctcaaaaatgctcactctgtcagagatctatcagtggatcatggacctgtttccctactaccggcagaaccagcagcggtggcaaaacagtatcagacactctctgagcttcaacgactgtttcgtgaaggttgctagaagccctgacaagcctgggaaggggagctactggactctgcaccccgacagcgggaacatgttcgagaatggatgctatctcagaaggcagaagaggtttaagtgtgaaaaacagccaggtgccggcggcggtggtggctctggcagcgggggttccggtgcaaagggcggacccgagagcaggaaggaccctagcggtgcatctaatccaagcgccgactctcccctgcaccgcggggtgcacgggaagaccggccagcttgagggggccccagcccccgggccagcagcctccccacagacgctcgatcactctggtgcaaccgcgaccggaggggcctccgagctgaagacacccgcttcctcaacggcccctccaatctcctccgggccaggagccctggcctcagtccctgcttcacatccggcccatggccttgcccctcacgagagccaattgcacctgaagggggacccacattactcattcaaccatccattttccatcaataatttgatgtctagcagcgaacagcagcataagctcgatttcaaggcttacgagcaggccctccagtattccccttatgggagcacgttaccagcttctctccccctgggctcagcaagtgtcaccaccaggtccccaatagaacctagcgccttggagccagcctactaccagggcgtgtatagtcggcctgtattaaatacgtcttag

SEQ ID NO: 15270 - DNA, 1320 bp, Artificial Sequence
  Description of Artificial Sequence: Synthetic coding sequence
atgaactcaggactgggcagtatgaattccatgaatacttacatgactatgaacacaatgaccacctcagggaatatgacacctgcgtcctttaacatgagttacgccaatcctgggctcggcgccggtctcagtcccggggctgttgctggtatgcctggcggcagtgccggagcaatgaattcgatgactgctgccggtgtgactgccatggggacagcattgtccccgtccggcatgggcgctatgggcgcgcagcaggccgccagcatgaacgggctcgggccctatgcagcagcaatgaatccatgtatgagtccaatggcctacgccccttctaatctgggaagaagccgcgcaggcggcggtggggatgccaaaacttttaagcggagttacccacatgccaaacccccctactcatacatttcccttatcaccatggccatccagcaagccccatcaaaaatgctgaccctgtctgaaatttaccaatggatcatggatcttttcccatattaccgccagaaccaacagaggtggcagaattcaattagacactccctaagctttaacgactgcttcgtgaaagtcgcccggagccccgataaacccggcaaggggtcgtattggactctccacccggatagcggaaatatgtttgaaaacggctgctaccttcgcagacagaagcggttcaagtgcgagaagcaacccggggctggaggcgggggcggcagtggaagcggtggttcgggtgccaaggggggtcccgaatcccggaaggatccctcaggcgcctctaatccgtcggcggactcacctctgcaccgtggggtgcatggaaagaccggccagctggagggcgcaccagcccctggtcctgcggcttccccccaaaccctcgaccatagcggtgccactgcaacaggcggagcgagtgagttaaaaactccagcttcaagcacggcccctcccatctcttcaggacctggcgccctcgcttccgtgcctgcctcccaccccgcccatggcctcgcacctcacgaaagtcagctccatctgaagggcgatccccactactcctttaatcacccgttctcgattaataatctgatgagcagcagtgagcagcagcataagctagactttaaggcttacgagcaagccctgcaatacagtccctatggctccaccctgcccgcatccttaccactggggtccgccagtgtgacaactcgctcacctatcgagccgtccgctctggaacccgcgtattatcagggtgtctacagcagaccagtgctgaatacttcgtag

SEQ ID NO: 15271 - DNA, 1506 bp, Artificial Sequence
  Description of Artificial Sequence: Synthetic coding sequence
atgcaggcccgatactctgtgtccgaccctaacgccctgggcgttgtgccttacttgagcgaacagaattactatcgggcggcagggtcttatggtgggatggccagtcctatgggcgtgtactctggccaccctgaacaatattccgctgggatggggcgctcttatgctccatatcatcaccatcagcctgcagccccaaaggatctagtgaagcccccttactcctacatcgccctcataaccatggcaatccagaatgccccggagaagaaaattacactgaacggcatctaccagtttattatggaccgtttcccattttatcgtgaaaacaagcagggctggcagaactccatccggcacaacttgagcctgaatgagtgtttcgtaaaggtgcctagagatgataaaaagccaggtaaaggctcttactggacacttgatccagacagttacaatatgtttgagaacggaagctttttgcggcgaagaagaaggttcaagaagaaagatgtctccaaggagaaagaggagcgcgcgcatttgaaggagccaccccctgccgcatcaaagggcgcacccgccaccccacatttggctgacgctccaaaggaagcggagaagaaagtcgtgatcaaatcagaggctgccagtcccgccctgcctgttatcactaaagtggaaacactctccccagagtcagccctccaagggtcccctaggagcgccgcttccacaccagcgggaagcccagacggctccctgccagagcatcacgctgcagcacctaatggcctgcctgggtttagtgttgaaaacattatgaccctgcggaccagtcctccggggggcgagctaagccctggagccggcagggcgggtctggttgtgcccccgctagcactaccttacgcagcggccccaccagcagcttacggccagccttgcgcccagggcctggaagctggtgccgcaggaggctatcaatgtagcatgagggccatgagtctctacacaggcgcggaaaggcctgctcacatgtgtgtgcctccagcactcgatgaggcgttgtctgaccacccttccgggccaacttccccactcagtgcactcaatcttgccgctggccaggaaggtgctctcgccgccaccggacaccaccatcagcaccacggccaccaccacccccaagctcccccacccccacctgctccacaacctcagcctacaccgcagcccggtgcagccgctgcacaggccgctagttggtatctcaaccactccggggacctgaaccacttgcccggacacacgttcgctgcccaacaacaaacctttcctaatgtgcgcgaaatgtttaattcccacagactaggcatcgagaactctactctcggcgaaagccaggtaagcggtaatgcgagctgccagctcccgtatcgcagtacccctcctttatacagacacgctgcaccatacagttatgactgtaccaagtattag

SEQ ID NO: 15272 - DNA, 1968 bp, Artificial Sequence
  Description of Artificial Sequence: Synthetic coding sequence
atggcggaggctcctcaggtggttgaaattgatcctgattttgagccgctcccaaggcctcgatcatgtacttggcccctcccgcgccctgagttctctcaaagcaatagcgcaacatcaagccctgcccccagtggctctgccgctgccaatcctgacgcagctgctggcctccccagcgcctctgccgcggcagtgagcgcagactttatgtcaaacctgagtctactggaagagtcagaggactttccccaggcccccgggtccgtagccgctgccgtcgcagcagcggctgctgccgctgccaccggtggcttgtgcggggatttccagggaccggaagcaggctgtctgcaccccgcccccccccagcccccaccgcccggtcctctgtctcagcatcctccagtgcctcccgccgcagccggacctctggcgggacagcctcgaaaatcctccagttcgcggcgcaacgcatgggggaatctgtcgtacgcagacctgataaccaaggccattgagagtagtgcagagaagcggctgacacttagtcagatctatgaatggatggttaagagtgtgccttatttcaaagacaagggcgactctaactcttcggcagggtggaagaatagcataaggcacaatctctctttacactccaaattcatcagggtgcagaacgagggtacaggcaagagtagctggtggatgcttaatcccgagggcggtaagtccggaaagtccccccgcaggagggccgctagtatggataacaactcgaagtttgcgaaatctcgcagccgtgctgccaaaaagaaagcctctcttcagtctggccaagagggagctggcgacagtccgggttcccagttcagcaagtggccagccagccccggctctcattcgaatgatgatttcgacaactggagcacttttagaccccgcacctcgtccaacgccagcactatctcagggagactgagccctattatgaccgaacaggatgatctgggcgaaggagatgtgcatagcatggtttacccaccctctgctgccaagatggcatctacccttccatctctctcagagatctccaacccggaaaacatggagaacctattggataatttgaacctactgagcagtccgaccagcctcacagtgtcaacccagtcctcccctggcaccatgatgcaacaaaccccttgctactccttcgcaccccctaacacctctcttaacagcccgagccccaattaccaaaagtacacctacggacagagcagcatgtccccattgccacagatgccaattcagactcttcaggacaacaagtcttcgtatggtgggatgagccagtataactgtgctcccggacttctgaaagaactcctgacttctgacagcccaccgcataacgatatcatgacgcccgtagaccctggtgtagcccagcccaacagccgcgtcctgggccaaaatgtcatgatgggtcctaattccgtaatgtctacatatggtagtcaagcatcacataacaagatgatgaaccccagctcacacactcatccgggccacgctcaacagacttctgctgtgaatgggagaccactgccgcacacagtctccaccatgccacacacttccggcatgaatcgactgacacaggtcaagaccccggttcaggtaccactcccacaccctatgcagatgtccgccctgggaggatatagctctgtctcttcctgcaacggctacgggcgcatgggcttactgcaccaggaaaaattgccttcggatctagatggaatgtttatcgagcgcttggattgtgatatggaatcaatcattagaaacgaccttatggacggggatacccttgattttaatttcgacaatgtgctgcccaaccagagcttccctcacagtgtcaaaacaacaacacattcatgggtgtcagggtag

SEQ ID NO: 15273 - DNA, 2022 bp, Artificial Sequence
  Description of Artificial Sequence: Synthetic coding sequence
atggcagaggcgccagcatctcccgcccctcttagtcctctggaggtggagctggatcccgagttcgagccccagagccggccccgatcctgtacttggccactccagagaccagagctgcaagccagcccagcgaaaccctccggagaaacggccgctgattcaatgattcccgaagaagaggacgatgaagatgacgaggatggaggaggccgggccggctcagccatggccatcggtggaggcggcgggtccgggaccctggggtccggattactgttggaggatagcgctagagtactggcacccggcggacaagaccccggcagtggcccggcgaccgctgccgggggcctctccgggggcacccaggccctgctacaaccacagcaacccttacctcctccccagccaggagccgcgggggggtctggccagccgaggaagtgcagtagccgaaggaacgcatgggggaatctttcttacgccgaccttatcactagggcaatagagtcaagtcctgacaagcggttaaccctatcccagatatatgagtggatggtccgctgcgtgccttattttaaagataaaggcgattctaattccagcgctggatggaagaacagcatccggcacaatttgtcattacactcccggtttatgcgtgtgcagaacgaagggactggaaagagctcctggtggatcatcaacccggacggtggaaaatctggcaaggccccccgacgccgggccgtttccatggacaacagcaataagtacacaaagtctcgaggcagagccgccaaaaagaaggccgccttgcaaacggctccagaatctgccgatgatagcccctctcaactctccaagtggcccggctctccgacctcccgctcctccgatgagcttgacgcatggacagacttccggtcaaggacaaattccaatgcgtcaaccgtgtccggtcgtctttccccaataatggcgagcacagaactcgacgaggtgcaagacgacgatgcgccattaagccccatgctgtacagttccagcgcaagtttatccccttcagttagtaaaccgtgtacggtggagctgccgcgcttaacggatatggctggcactatgaatctgaatgatggcctcaccgaaaacttaatggatgacctattagacaatatcaccctgcctccgagccaacctagccctactggcgggctcatgcagcggtcaagcagctttccttacactaccaagggttctggtctgggctcacccacttcatccttcaactctaccgtgtttgggcccagcagcctgaacagcttgcgccagagccctatgcaaaccatccaggagaacaaaccagccactttcagttccatgtctcattatggtaatcagacactgcaggatttgctgaccagtgattccctctcacacagcgacgtgatgatgactcagtccgaccctctcatgtcccaggcatctaccgccgtcagcgcccagaattcccgcaggaatgtgatgctgcgcaatgatccgatgatgtccttcgccgcccagccaaaccagggcagcctcgttaaccagaaccttttacaccaccagcaccagacacagggggccttaggaggctctcgagcactcagtaactccgtatccaatatgggactctcagaatcttcgtctctgggctccgcgaagcaccaacagcagagccccgtgtcgcagagtatgcagacacttagcgattccttaagtgggagttcactgtactccacatctgcaaaccttccagtcatgggccatgagaaattcccctcagacctcgacctggatatgttcaacggttctctggaatgtgatatggaatccataataaggagtgaactcatggacgccgacggcttagatttcaattttgacagtctgatctctacacaaaatgtggtggggctcaacgtcggaaacttcactggcgctaaacaggcctcatcacagtcctgggtgccaggctag

SEQ ID NO: 15274 - DNA, 2022 bp, Artificial Sequence
  Description of Artificial Sequence: Synthetic coding sequence
atggctgaagcccccgccagtcctgctcccctctctcccctggaggtagaactggaccctgagttcgaacctcagagtagaccacgatcgtgcacctggccactgcaacggccagagctgcaggccagtcctgccaagccatcaggggaaaccgcagcggactctatgatccccgaggaagaagacgatgaagacgacgaggacggcggaggcagggccgggtcagccatggcgattgggggtggaggcggcagtggtactcttggcagcggcctccttttggaggatagtgctagagtgctggccccagggggccaggatcccggatctggacctgctactgctgccggcggcctctcgggtgggacacaggccctgctacagcctcagcagcctctacccccaccgcagccaggtgcagcaggcgggtcgggacagccacgcaaatgctctagcagacggaatgcttggggcaacctgagctacgcggacctcataaccagggccatcgaatcctctcccgataagaggctaacgctgagccaaatttacgagtggatggtgaggtgtgtgccatacttcaaggataagggagacagcaactcttcggctggctggaaaaatagtattcgacacaatctctcactacactcaagattcatgcgcgtgcagaacgaggggacggggaagagctcctggtggatcattaaccccgatggaggaaaaagcgggaaagcccccagacgaagggcagtgagtatggacaatagcaacaagtacacaaagagccgagggagagcagccaagaaaaaggccgctcttcagacagcacccgaatctgctgacgacagtccttcacagttgtccaaatggcccggcagccccacatctcgctccagcgacgaactggacgcttggacagactttcggtcacgtacgaactccaatgcatctacagtaagtggaagactgagcccgatcatggcctcaaccgaattggatgaagtacaagatgatgatgctccccttagtccaatgctgtatagttcatctgcctcactttcaccgagtgtctccaaaccatgcaccgtggaactcccacgcttgactgacatggctggtacgatgaatctgaatgacgggctcaccgaaaatttgatggacgaccttttggacaacatcacgctcccaccttcacaaccatcccctacgggcggacttatgcaaaggtcctcatccttcccctacacaacaaaagggtccggtctcggctcacccacatcttctttcaactccactgtgttcggtccctcttcattgaatagcctgagacagagccctatgcagacaatccaggaaaacaagccagccaccttctcttcgatgagccattatggaaaccaaaccttgcaggatctcttgacctcagatagtttgagtcacagcgatgtcatgatgactcagtcagaccccctgatgtctcaggcttcaacggcagttagtgcccagaacagtcgtaggaacgtcatgctgagaaatgacccaatgatgtcattcgctgctcagcctaaccaggggtcattagtgaaccagaatttactccaccaccaacaccagacacaaggtgccctcggtggaagtcgcgctctttcaaactccgttagcaatatgggactttctgagagcagcagcctcgggtcagctaaacatcagcagcaatctcctgtctcccaatcaatgcagacgttgtctgacagcctatcgggttccagcctgtattctacctccgccaatttgccagtgatgggccatgagaaattcccttctgatctggacttagatatgtttaacggctctctcgaatgcgacatggagtctatcatcaggagcgaacttatggacgcagacgggcttgattttaactttgatagtcttatctctacgcagaatgtcgtagggctgaacgtgggaaatttcaccggcgcgaagcaggctagtagccagtcttgggtgcctggctag

SEQ ID NO: 15275 - DNA, 1302 bp, Artificial Sequence
  Description of Artificial Sequence: Synthetic coding sequence
atgcgggtgcagaatgaaggcacgggcaaatccagctggtggatcataaatcctgatggcggaaaaagcgggaaggcccctaggagaagagcagtttcaatggataattcaaataagtatactaagtctagaggcagagccgctaaaaaaaaagccgccctgcagacagctcccgaatcggcagacgacagcccaagccagctatcgaaatggccgggtagcccgacatctcgatcgagtgatgaactggacgcttggaccgacttccgttcaagaaccaactcaaatgcgagcaccgtgagtggacgcctgagtcccatcatggcctcaacggaactcgacgaagtgcaagatgatgatgccccgctgagcccgatgttatactccagtagcgcgtctctttcgccgtccgtcagcaagccctgtactgttgaattacctagattgacagacatggccggaacaatgaatctaaacgatggactgacggaaaatctcatggacgatctcctggacaatatcactctacccccatctcagccttctcctacagggggcctgatgcagagaagctccagttttccctacacaactaaaggttccgggcttggatctcctacgtccagttttaatagcaccgtatttggcccatcctccttgaacagcctgcgccagtctcccatgcagaccatacaagaaaataaacctgccactttttcctctatgagtcattatggcaatcagactctgcaagacctgctgacgagtgactccttatcccattcagacgtcatgatgacacagtcagacccactaatgagccaggcctcaaccgccgtgtccgcacagaactcgcgacggaatgttatgttacggaacgaccccatgatgtccttcgcggcacagcccaatcagggatctctcgtcaatcagaacctcctgcaccatcagcatcagacacagggcgccctgggcggttccagagccctgagtaacagcgtgtctaatatgggcttatcggagtcctcttcactcgggagtgccaaacaccaacagcaatctccggtgagccagtcaatgcagaccctgtccgactccttgagcggctccagcctctacagcaccagcgctaacctacctgtaatggggcacgagaagtttccaagtgacctggatcttgacatgagcatgggcgcatggaatgtcacatggtcaccactctcagtcgtcaatagttggatgcttatgggttggatcttaacactcataccctcctcccctcaccgcatgctcttagtttag

SEQ ID NO: 15276 - DNA, 1362 bp, Artificial Sequence
  Description of Artificial Sequence: Synthetic coding sequence
atgagagtgcagaatgaaggcaccgggaagagcagctggtggatcatcaatcctgacgggggaaagagcgggaaggccccccggcgaagggccgtgagcatggataactcgaacaagtacacaaaatcacgcggaagggccgccaagaagaaggccgccttgcagacggccccggagtcagccgatgactctccatcccaacttagtaagtggccaggttctcctacttctagaagctccgacgaactcgatgcttggacagactttcggagccggactaattcgaacgcttcgactgtcagcggccggctgagccctattatggctagtacagagctggacgaagtccaggatgacgacgccccactgagccctatgctctactcatctagcgcttctctgtctccctctgttagtaagccttgtacagtcgaattgccaagactgacggatatggccggcacgatgaaccttaacgacggccttactgaaaatctgatggatgatttgttagacaacattacgttacccccgagtcagccctctcccacgggaggcctgatgcagcgtagttcttcatttccctacacaaccaagggcagtggcctgggaagcccaacatcttcctttaatagcacggtcttcggcccatctagcctgaactccctgaggcagagcccaatgcagacaatccaggaaaacaaacccgccaccttctcttcaatgtcccattacggcaatcagaccctccaggacctgctgacttccgactcgctcagtcatagcgacgtaatgatgacgcagagcgacccgctcatgtctcaagcgtcaactgccgtgtctgctcaaaatagcaggcgcaacgttatgctgcgaaacgatcctatgatgtctttcgcagcgcagcctaatcaaggcagccttgtcaatcagaacctgctccaccaccagcatcagacccaaggagccctgggcgggtctcgcgcactgtctaattccgtgtccaatatgggtctgagcgagagctcctccttgggtagcgccaagcaccaacagcagtcaccggtgtctcagagcatgcaaacattgagcgatagcctctccgggtcctcactttacagcacatcggcgaacttgccagtcatgggacatgagaaatttccctctgatttagacctagacatgtttaacggttctctcgagtgtgacatggagtctataattagatctgagctgatggatgctgatggcttggattttaactttgattccctgatatccacccagaacgtggtaggccttaatgtggggaattttaccggcgccaagcaggcgtccagccagtcctgggttccaggctag

SEQ ID NO: 15277 - DNA, 444 bp, Artificial Sequence
  Description of Artificial Sequence: Synthetic coding sequence
atgtccttccgatttggacaacacctgatcaaaccatcagtggtgtttctgaagaccgagctctcattcgcactggtgaataggaaaccggtggtgcccggacacgtcctagtatgtccactccggcccgtcgagagattccatgatctcaggccagatgaggtcgcggacctctttcagaccacacagagagtcggaacagttgtggagaagcatttccacggcaccagtctgaccttcagcatgcaggatggccctgaggctggtcagacagtgaagcacgtgcatgtccatgtcctgcctcggaaggccggcgattttcataggaacgatagcatttacgaagagttgcaaaaacatgacaaagaagattttcccgccagttggcgctccgaggaggaaatggcagccgaggcggccgcactccgcgtttatttccagtag

SEQ ID NO: 15278 - DNA, 444 bp, Artificial Sequence
  Description of Artificial Sequence: Synthetic coding sequence
atgtcctttcgattcggtcaacatttaatcaagccatcagttgttttcttaaagactgagctgtcatttgctctggtaaacaggaagccagtagtccccggacacgtgctggtgtgtcccctgaggcccgtggagagatttcacgatttacggcctgacgaagtagccgacctgttccaaacaacacagagggttggaacagttgtcgaaaagcactttcatggaaccagtctgacattttcaatgcaggacggacccgaagctggacagacagtcaaacacgtccacgttcatgtgctgccccgtaaggctggggacttccacagaaacgacagtatttatgaagagctgcaaaagcatgataaggaggacttccctgctagttggcgcagcgaagaagaaatggcagcagaagctgctgccctccgggtctactttcaatag

SEQ ID NO: 15279 - DNA, 444 bp, Artificial Sequence
  Description of Artificial Sequence: Synthetic coding sequence
atgagcttccgcttcggtcaacaccttataaagccgagtgtcgtctttctcaagaccgagctgtccttcgcattagtcaaccgaaaacccgtcgtccctggacacgtgttagtgtgcccacttcgcccagtggaacgctttcacgatctgaggcctgacgaagttgcggatctgtttcagaccacgcagcgggtgggcacagtggttgagaaacacttccacggtacttcactgacattttcaatgcaggacggtcctgaggccggacagacggtcaaacatgtgcatgttcacgtgctgccacgcaaggccggtgattttcaccggaatgactcaatatatgaagaactgcagaagcatgacaaagaggatttccccgcttcctggaggagcgaagaggagatggccgccgaggccgccgcgcttagagtatattttcagtag

SEQ ID NO: 15280 - DNA, 240 bp, Artificial Sequence
  Description of Artificial Sequence: Synthetic coding sequence
atgagcttccgcttcggccagcacctgataaaaccatcagtggttttcctgaaaacagagctatctttcgcgctggtgaaccggaaaccagtggtgcccggacatgtgctggtctgtcctctgcgtccggttgagagatttcacgaccttaggcccgacgaggtggcagacttgttccagaccactcagcgagtcggtaccgtggtggagaaacacttccacggcacgtcactcacgtag

SEQ ID NO: 15281 - DNA, 444 bp, Artificial Sequence
  Description of Artificial Sequence: Synthetic coding sequence
atgtcgtttcgctttggccagcatctgattaagccatcagtggtatttctgaagacagaactttcatttgccttggtcaaccgcaaacccgtggtacctggccacgttctggtgtgtccactcagaccagttgagcgattccacgatctgaggcccgacgaggtcgcggatctctttcagaccactcaaagggttgggacagtcgtggagaagcatttccacggcacctccctcactttcagcatgcaggatggacctgaggcaggacagacagtgaagcatgtgcacgtccacgttctaccgaggaaggccggcgattttcatcggaatgacagcatttatgaggaactgcagaagcatgataaggaagacttccctgcgagctggcgcagtgaagaagagatggccgccgaagccgccgccttgcgcgtatattttcagtag

SEQ ID NO: 15282 - DNA, 1725 bp, Artificial Sequence
  Description of Artificial Sequence: Synthetic coding sequence
atgcgggacccaggcgccgcagcacccctgagtagcctcggcctgtgcgcacttgtgctggctttattaggcgcccttagcgccggagccggcgcacagccttaccatggggagaaagggatatccgttccagaccatgggttttgtcagcccatcagcatacctctgtgcaccgatatagcatacaatcaaacaatcctgcccaatctgctggggcatacaaaccaggaggacgctggattggaggtccaccagttttacccactggtgaaggttcagtgcagtcctgagctgagatttttcctgtgttctatgtacgccccagtgtgtactgtcttggaccaagctatccctccatgtagatccctgtgtgagcgtgctagacagggctgtgaagcattgatgaacaaatttgggttccagtggccagaacgacttcgctgtgagaattttccagtacacggggccggtgagatttgtgtgggccagaacaccagtgatggctcagggggacccggcggcggccctacagcctatccaacagccccctatctacctgatttaccctttactgctctgcctcctggcgcttccgatggacgtggccgaccagcttttcctttctcctgccctcgccaactgaaagtgcccccttatctgggttaccgttttcttggcgagcgggactgcggagcaccatgcgaacccgggcgtgctaacggactcatgtacttcaaggaagaggaacgtaggttcgcgaggctgtgggtgggtgtatggtctgtactgtgctgcgcctcgaccttgttcaccgttctaacttacctggttgacatgcgaagatttagttaccccgaaaggcctataatattcctctctggatgttattttatggtggcagttgcccatgtggccgggtttttgcttgaggaccgagcggtgtgtgtggagcgttttagcgatgatggatatcgaactgtggcccagggtactaaaaaagagggatgcacaatccttttcatggttctctactttttcgggatggcatcctctatatggtgggtcatcctgtccctcacctggttcctggcagctggtatgaagtgggggcacgaagctattgaggccaattctcagtactttcatttggcagcctgggccgtgcccgctgttaagacaatcacgattctggctatgggacaagtggatggagacctgctctccggcgtctgttatgtgggcttatcctctgtggatgcactacgggggttcgtgctagcaccactgtttgtctaccttttcattggcactagctttttgctagcaggcttcgtgtcactgttccgcattcgaactattatgaagcatgatggcaccaagaccgaaaaactggaaaaactcatggtgaggatcggcgtgttcagcgtactgtacactgtacccgccacaatcgtgttagcctgctacttttacgaacaggcttttagggaacactgggaacggacctggttgctgcagacttgcaaatcatacgcagttccatgcccccccgggcactttccccctatgtccccagatttcaccgtgttcatgattaaatatctcatgactatgatcgtgggcatcaccaccgggttttggatttggtctggtaagaccttgcagagttggaggaggttctatcaccggctgagccacagtagtaagggagaaaccgccgtatag

SEQ ID NO: 15283 - DNA, 654 bp, Artificial Sequence
  Description of Artificial Sequence: Synthetic coding sequence
atgtcttttcgaggcggcggccgaggtggttttaaccgcgggggaggaggcggtgggttcaatcgtggcggttctagtaatcactttcgaggcgggggaggggggggcggggggggaaattttcggggtggggggagagggggcttcggccggggcggcggtagggggggatttaacaagggccaggaccaaggaccccctgaaagggtggtactgctgggcgagttcctgcacccatgtgaagacgatatcgtgtgcaagtgtacaacagatgaaaataaggtgccttattttaatgctccagtgtatctggaaaataaagaacagatcggcaaggtggacgaaattttcggacagctgcgggacttttatttttccgtgaagctgtccgaaaatatgaaggctagtagctttaaaaaattacagaagttttatatcgacccttacaaattgctcccactgcaaagattcctacctcgcccccctggagaaaaggggcccccacgcggcggtggcagaggaggtagagggggcgggagagggggaggaggccggggcggcggacgtggtggaggctttcggggcggtcggggcgggggcggaggaggctttcggggggggcgtgggggtggcttcagggggcgagggcactag

SEQ ID NO: 15284 - DNA, 1533 bp, Artificial Sequence
  Description of Artificial Sequence: Synthetic coding sequence
atgtatcgagcacttaggctgctggcccgctctcgccccttggtgcgggcccctgccgcagccctggcatccgctccagggctaggcggcgccgctgtcccaagtttctggccaccaaacgcagctcgaatggccagtcaaaactctttccggatcgagtacgacactttcggagaactgaaagttcctaacgataagtactatggggcccagacagtcaggtctacaatgaattttaaaattgggggtgttaccgagagaatgccgacccccgttattaaggcctttggcatcctcaagagagctgctgccgaggtgaatcaggattacgggctcgatcccaaaattgctaacgcaattatgaaggctgccgatgaagtcgcagaaggcaaacttaatgaccactttcccttggtggtctggcaaacaggctcaggcacacaaactaacatgaacgtgaacgaagtaatcagcaaccgggccatagagatgttaggcggcgaacttgggtcgaagattccagtccaccccaacgaccacgtgaataaatcccagtccagtaacgatacgttccctacagctatgcatatagcggccgcgattgaggtgcatgaggtgttgctccctggcctacaaaaactccacgatgccctggacgctaaaagcaaagagttcgcacagatcattaagatcggcagaacacatacgcaggacgccgtgcctctaacactcgggcaggagttctcgggttacgttcagcaggtgaagtacgccatgacaagaattaaggctgccatgcctaggatttacgaactggccgccggggggacagccgtgggaactggacttaatactagaataggcttcgccgaaaaagttgcagctaaggtggccgcgctgactggcctccccttcgtgacagccccaaataaattcgaagcactggccgcgcacgacgccctcgtcgaactctcaggggccatgaatacgactgcctgctctttgatgaagatcgccaacgacataagattcttggggtccggacctcgttctggcttaggggagctgatcctgccggagaatgaacctggtagctcgataatgccaggaaaggtcaatcctacgcagtgcgaggccatgacaatggttgccgctcaggtgatgggaaaccatgtggccgtcactgtggggggaagcaatggtcattttgagttgaatgtctttaaacctatgatgataaagaacgtgttacattctgcccggcttctgggagacgcatcggtgtcttttaccgaaaattgtgttgtaggcatccaggcaaacaccgaaaggataaacaaactgatgaacgagagcctcatgctggtaaccgcactgaacccccatataggctacgacaaggctgccaaaatcgcaaaaactgctcacaaaaacggaagcacacttaaagaaactgccattgagctcggatatctgacagccgagcagttcgacgagtgggtcaagcctaaggacatgctggggccaaagtag

SEQ ID NO: 15285 - DNA, 537 bp, Artificial Sequence
  Description of Artificial Sequence: Synthetic coding sequence
atgtctccctctggcagattgtgtttactgacgattgttggcttgattttacccacaagggggcaaaccctaaaggataccacaagctcttcttccgcagatagcaccatcatggatattcaggtgcccacccgcgcccccgacgctgtgtacacagagctgcagcccacatctccgacccccacttggcctgcagacgagacaccccagccacagacccagactcagcaactggagggaactgatggccctctggtgaccgaccccgagactcataagtctaccaaggccgcgcatcccaccgatgatactacaaccctatctgaacgccccagcccctctaccgacgtccaaactgatccccaaacactgaaaccctcgggcttccacgaagacgacccatttttctatgacgaacacacattgagaaaacgaggccttttggtggccgccgtgcttttcataaccggaataattatacttacgtcaggcaagtgccgtcaactgagccgcctttgcaggaatagatgtagatag

SEQ ID NO: 15286 - DNA, 324 bp, Artificial Sequence
  Description of Artificial Sequence: Synthetic coding sequence
atgcaaactctctcaaacattccgtgcttttgccttcacgggtctttgctcccatctaccgacctggctactctctcagcgcaccccactgacgacaccacaaccttatctgagcgtccatctcctagtacagacgtccagactgacccacagaccctgaaaccatcgggttttcacgaggatgacccattcttttatgatgaacataccctgcggaagcggggccttcttgtggccgccgtgctattcatcaccggaatcattattcttacttctgggaaatgccgccaactcagtcgcctctgcagaaataggtgccgttag

SEQ ID NO: 15287 - DNA, 291 bp, Artificial Sequence
  Description of Artificial Sequence: Synthetic coding sequence
atgtctcccagtggacggctttgtctactgaccatcgtgggattgattttaccaacaagaggtcaaactctgaaggatacgacatcttcctcatctgctgacagcacgattatggatatccaagtcccaacacgggcgcctgacgccgtgtacacggagctgcaacccacaagccctacacctacttggcccgcagacggcgcttatatcacagcctacggtgtgactcacttcctgatgaatatgctggccgtgagtagctttttttgtttgcatacggcgcctcagtag

SEQ ID NO: 15288 - DNA, 537 bp, Artificial Sequence
  Description of Artificial Sequence: Synthetic coding sequence
atgtccccgagtgggcgtctctgtctgctgaccattgtcggcctaattctccctacaagggggcaaaccctgaaagacacaacctcatcctcctctgcagattccactatcatggacattcaggtgcctacccgagcgcctgatgcggtgtatacggagctgcagcccaccagccccaccccaacatggccagcagacgagacacctcagcctcagacgcagacgcagcagctggagggaaccgatggacctctggtcaccgatcccgagactcataagagcaccaaggcggctcacccaactgacgacaccaccactctctccgagcgtccctcccctagcaccgacgtgcagaccgaccctcagactttaaagccatcgggattccatgaggatgacccatttttctatgacgaacataccctgaggaagagaggccttctggtcgctgccgttctgttcatcactggcataataatccttacgtcagggaagtgcagacagctatcaaggctttgccgcaaccggtgcaggtag

SEQ ID NO: 15289 - DNA, 537 bp, Artificial Sequence
  Description of Artificial Sequence: Synthetic coding sequence
atgagtcctagcgggcgcctctgtctgctaacaattgtcggcctgatcctgccaactcgaggtcagactttaaaagatactacgagcagctcctcggctgactcaaccataatggacattcaggtccctactagagccccagatgcggtgtatacagagctacagccaactagcccaacccctacatggccagccgacgagacacctcagccacaaactcagacacagcaacttgaggggaccgacggcccactggttacggatcccgaaactcacaagagcaccaaagcagcccatcccaccgacgataccaccacgttaagcgagcgcccatcaccctccacggatgtccagaccgacccccagacccttaagccgtccggcttccacgaggacgatccttttttctacgacgaacatacgcttcggaagagaggcctgttggtggccgcagtgctgtttatcacgggcatcataattctgactagtggtaagtgtcggcagctctcccgcctgtgtcgcaatcggtgcaggtag

SEQ ID NO: 15290 - DNA, 537 bp, Artificial Sequence
  Description of Artificial Sequence: Synthetic coding sequence
atgagtccatcgggaaggctgtgcctgttgaccatcgtcggtttgattctgccaacccgcggacagacgctgaaggacactacgtcgtcctcaagtgccgactcaaccattatggacatacaggtgcctacccgagctccggacgcagtgtacaccgagctgcagccaacgtctccgacacccacttggcctgccgacgaaaccccccagccccagacacagacccagcagttggaagggacggacggtccgctcgtaacagaccccgagacccataaatccactaaagcagcccacccaaccgatgatactaccacactgtctgagagaccttctccaagcacagacgttcaaaccgatccccagacgctcaaaccttccggcttccacgaggacgatccttttttttacgatgagcatacactcaggaagcgaggccttttggtggctgctgtgctatttatcactggcatcattatattgactagtggtaagtgtcgtcaactgtcccggctgtgtcgcaatcggtgcaggtag

SEQ ID NO: 15291 - DNA, 585 bp, Artificial Sequence
  Description of Artificial Sequence: Synthetic coding sequence
atgagcccatccggtcggctgtgcctgctaacgattgtgggcttgatactccccactcgcgggcagacgttgaaagacacaactagcagcagctctgctgatagcactataatggacattcaggtacctactcgggctcccgacgcagtgtacaccgaattacagcccacatcccccactcctacatggcctgcagacgagactcctcagcctcagactcagacccagcaattggaaggaacggacgggccattagtgacagacccggaaacacacaagagcaccaaggctgcccacccaacagacgacacaacgacgctgtcggagcgcccctcaccttccaccgatgtgcagaccgatccacagaccctgaaacctagtggctttcacgaggacgaccctttcttttatgacgaacataccctcaggaaaagggggctcctggtagccgcagttctgtttattactgggatcatcattctgacctcagagaattggggctgggtggggaggacacctcgccccgggggtggcctgatgaccgaggggtgggtactaaaaggcccttgggctatattgttttag

SEQ ID NO: 15292 - DNA, 1518 bp, Artificial Sequence
  Description of Artificial Sequence: Synthetic coding sequence
atgagtaacatatgccaacgcctctgggagtaccttgaaccctatctaccatgtttgtcgaccgaggccgacaaatccaccgttatcgaaaatcccggtgcgctgtgctcccctcagagccagcggcacggccactactttgttgccttatttgactaccaggcccgtacagccgaggatctcagtttccgagcgggcgataaactgcaggtgctggacacactgcacgaaggctggtggtttgccaggcacctcgaaaaacgccgtgacggctcgtcccagcagctgcaaggatacataccctctaattacgttgccgaggaccgctcccttcaagctgagccttggtttttcggggcaatcgggaggtctgatgccgaaaaacagttgctttactctgaaaacaagaccggcagttttctgatccgggagagcgaatcccagaagggtgaatttagtctgtctgtgttggacggggcagtagtgaagcattatagaataaagcgcctcgatgagggggggttttttctcactcggcgacggatttttagcactctcaacgagttcgtgtcccattacaccaagactagtgatggcctgtgtgtgaagctcggtaaaccatgtctcaagattcaagtaccagctcctttcgacctctcctacaagacagttgatcagtgggagatagatcgtaatagcatccagttgcttaagcgactaggaagtgggcagttcggcgaggtctgggagggcttgtggaacaacactacccctgtcgcagtgaagacactcaaacctggcagcatggaccctaacgattttttgagggaagcacagatcatgaagaatctccgacatcccaaactgattcagctgtatgccgtctgcacgctggaggatccaatctacatcattaccgagctcatgcgccacggttctctgcaggagtatctgcagaatgatacaggaagtaagattcacctcacccagcaggtggacatggccgcccaagttgcaagtgggatggcctaccttgagtccaggaattacattcatagagacctggccgctcgaaatgtgctggtaggcgagcacaatatttataaagtggcagactttggactggctcgggtgttcaaagtagacaacgaggatatctacgaatcccgccacgaaatcaagctacccgtaaagtggacggccccagaagctatcaggagcaacaagttttcaattaaaagcgacgtgtggtcgtttggaatactgctatatgagataattacatacggaaaaatgccctattctggtatgactggggctcaggtcattcaaatgttggcccagaactatcgcctcccccagccctcaaactgtccacagcaattttataacatcatgctggagtgctggaacgccgaacccaaggagaggcccactttcgaaacactgcgatggaagctggaggattacttcgagactgatagcagttatagcgatgcgaacaatttcatccgctag

SEQ ID NO: 15293 - DNA, 1092 bp, Artificial Sequence
  Description of Artificial Sequence: Synthetic coding sequence
atggattccactagcctgctgccaaacccatggattcgggtccttgatggagcagtggtgaagcactataggatcaagcgtctggatgaaggcggattcttcctgacaagacggaggatattcagcacactgaatgagttcgtgagccattatactaagacatctgacggcctgtgcgtgaaactgggaaagccttgtctgaagatccaggtgccagcccctttcgatctgagctataaaaccgtcgatcagtgggagatcgatcggaactctatccagctgttaaagcgattggggtcaggacaattcggtgaggtatgggagggactgtggaataataccactccggtggctgtgaagacactgaagcctggcagtatggatccaaacgactttctgcgtgaggctcagatcatgaagaacctgaggcacccgaaactgatccagctgtatgccgtgtgcaccctggaggaccccatatatataatcactgaattaatgcgccatggctccctgcaagaatatctgcagaatgacactggctccaaaatacacctgacacagcaggtggatatggccgctcaagttgcatctggaatggcttatcttgagagtaggaactacatccatagggacctagctgcccggaacgtattggtgggcgaacataatatttacaaggtcgccgactttgggcttgcacgagtcttcaaagtcgataatgaagacatctacgaatctaggcacgagataaaactgccagtgaagtggactgcaccggaagccattagatcaaacaagttctccatcaagagcgacgtgtggagcttcggaatcctgctgtacgaaattattacctatggaaagatgccttattccggtatgaccggcgcccaggttatccaaatgttagcacagaattaccgcctgccacaaccatccaattgtcctcaacagttctataacatcatgcttgagtgttggaatgccgaaccgaaggagaggccgacttttgaaacgctgagatggaagctggaggactatttcgaaacagactctagttactctgatgctaataatttcattcggtag

SEQ ID NO: 15294 - DNA, 1128 bp, Artificial Sequence
  Description of Artificial Sequence: Synthetic coding sequence
atgaggtctgtcgcccctagtggccccaaaatggggaatatcacagctgacaactcctccatgtcctgcactatcgatcacacaatacatcaaacattggccccagtggtttatgtgactgtgctggttgttggcttccccgcaaattgcctgagcctctactttggctacctgcaaatcaaggccagaaatgaacttggggtatatttgtgtaatttgactgtggccgaccttttctacatctgctcattacccttctggctgcaatatgtgctgcagcacgacaactggtctcatggtgacctttcgtgccaggtgtgcggcatccttctgtatgaaaatatctatatcagcgtggggtttttgtgctgtatctcggtggacagatacttagcagtggcccacccatttcgctttcaccagtttcgcacactgaaagccgctgttggagtaagcgtagtgatttgggcaaaagagctgctgacgtccatttatttcctgatgcatgaagaagtgattgaagatgagaaccagcacagggtctgctttgaacactaccctatccaggcctggcagcgggccatcaactattatcggttcctcgttggatttctgttccccatttgtctgctgttggcctcttatcaaggaattcttagagccgtgcgccgaagtcatggaacccaaaagagtaggaaagaccaaatccagagactggttctcagcaccgtagtcatcttccttgcctgcttcctaccataccatgtgctgctgctggtacggagcgtgtgggaggcaagttgcgacttcgccaagggcgttttcaatgcctaccatttcagcctccttctcactagctttaattgtgttgcagacccagtgctgtactgttttgtgagtgaaacaacccaccgggacctggctaggctgaggggggcctgtttagcctttctcacttgttcacggacaggccgggcccgggaggcctacccactgggtgcgccagaggcctccggaaagtctggagcccagggcgaggaacccgaactcttaacaaaactccaccccgcgttccagacgccaaacagccccggcagtggtggatttcccaccggccgcctcgcctag

SEQ ID NO: 15295 - DNA, 1017 bp, Artificial Sequence
  Description of Artificial Sequence: Synthetic coding sequence
atgggcaacatcacggcggacaattcctctatgtcctgcactattgaccataccatccatcagacactggcgcctgtcgtttatgttactgttcttgtcgtggggtttcccgccaattgcctgtccctgtactttggatatcttcaaatcaaggcgcgtaatgagctcggcgtgtacctctgtaatttgaccgtcgcggatctcttttacatttgtagcctgccattctggctccagtatgtgctgcagcacgataattggtcccacggcgatttatcctgccaggtatgcggaatcctattatacgaaaacatatacatttctgtaggctttctgtgctgcatttccgtagacaggtatctggcagtggcccatccctttcgcttccaccagtttcgcacgttgaaggccgccgtcggcgtgtcagtcgtcatctgggccaaggagctactcacctcaatctactttctcatgcatgaggaggtgattgaggacgaaaatcagcaccgcgtttgttttgagcactacccaatccaggcgtggcagcgcgccatcaactactaccgcttcctggtgggcttcttattccctatctgcctattactggccagctatcagggtatacttcgcgctgtgcggcggagccacggcacacagaaatctagaaaggaccagatccagaggctggttctatcaaccgttgtcatattcttggcttgcttcctgccatatcatgtgctcctgttggtgaggagcgtgtgggaagctagttgcgactttgcaaagggggtgttcaacgcctatcatttttccttgctcctcaccagcttcaattgtgtggccgatccagtcctgtactgcttcgtctctgagactacacatcgggatctggctaggctgcgaggcgcgtgcctagccttcctgacttgttcacgaaccggccgggccagagaagcttacccactcggtgctcctgaggcctccggcaaaagtggggctcagggagaagagccatag

SEQ ID NO: 15296 - DNA, 1098 bp, Artificial Sequence
  Description of Artificial Sequence: Synthetic coding sequence
atgggaaatatcacagctgacaactcatctatgagttgcaccatcgaccataccattcatcagacacttgcccctgtagtgtacgtgacagtattggttgtcggctttccagccaattgcttgtctctctacttcggctacctgcagattaaggcacgcaatgagcttggagtatacctgtgcaacctcaccgtcgctgacctattttatatatgctctttgcccttttggttgcagtatgttctgcagcacgacaattggagccacggtgatctgagttgccaagtgtgcggaatactgctgtatgagaatatatacatctcggttggatttctctgctgcatctcagtcgacagatatctcgcagtggcccatccctttcggttccaccagtttagaaccctgaaagctgcagttggagtctctgtggttatctgggccaaggaactactgacgtccatttactttctgatgcacgaggaagtgatagaggacgaaaatcaacatagagtctgtttcgaacactacccaatacaagcttggcagcgagccatcaactactaccggttcctggtgggatttttgttccctatctgtttgctcctcgcctcataccagggcatcctgagagctgtgcggaggagtcacgggacccaaaaaagtagaaaagatcagattcaacgcctggttttgtccacagtggtgatttttctcgcttgcttcttgccttaccacgtgctcttgctggtccgctctgtgtgggaggctagctgtgattttgctaaaggggtcttcaacgcttatcacttctcactccttcttacatcatttaattgcgtcgcagatcccgtgctatactgttttgtgtccgagaccactcacagagatctggcgagactgcggggagcatgcttagcgttcttaacttgtagcaggaccggcagagccagggaggcctacccacttggagctccagaggcctctgggaaatctggcgcccagggcgaagagccagaacttttgaccaagctgcatccagcctttcagacaccgaacagtccagggtccgggggatttcctacaggtcggttggcgtag

SEQ ID NO: 15297 - DNA, 1098 bp, Artificial Sequence
  Description of Artificial Sequence: Synthetic coding sequence
atggggaacataactgccgataactcgagtatgtcatgtaccatcgatcataccatacatcagacactcgctcctgtagtctacgtaactgttttggtagtcggcttccccgccaactgtctgagcctgtattttggttacctgcagataaaagctaggaatgagctgggggtgtacctctgtaatctcacggtggcagaccttttctacatttgtagcctgccattctggctccagtatgtattacagcatgataattggagccacggcgatctgtcgtgccaagtttgcggaatccttctctacgagaatatctatatctcggtgggattcctgtgctgcatatcagtggaccgatatttggccgttgcacaccctttccgatttcatcaatttagaaccctgaaagccgctgtcggagtgtctgtcgtcatctgggccaaggaactcctcactagtatctacttcctcatgcacgaggaagtgatcgaggacgaaaatcagcaccgggtgtgcttcgaacattatcccatccaggcctggcagagggcaattaactactataggttccttgtcggatttctcttccccatctgcctgttattagcttcgtaccagggcatactgagggccgtgaggaggtcccacggcacacagaagtcccgcaaagaccaaatccagcgcctggtgcttagtacagtcgtgatctttctggcttgcttcctgccttaccacgtactgctcctcgttcggtcagtgtgggaggctagctgcgacttcgccaagggagtgtttaacgcatatcatttttctctgttgttgacaagctttaattgcgtcgcagatcccgttttgtattgttttgtctccgagacaacgcacagagacctggctcgcctcaggggagcttgtctggcttttctcacctgttctcggaccggcagggccagggaggcttacccactcggggctccagaggctagtgggaagtctggggcacaaggcgaggaaccagagctgctaacaaagctccaccctgcatttcagacaccaaactctcccggatccggcggattcccgaccggcagactggcttag

SEQ ID NO: 15298 - DNA, 2100 bp, Artificial Sequence
  Description of Artificial Sequence: Synthetic coding sequence
atgactttgaggcggaagtgcaatgaggacgatgaggttttttttggcccattcggacataaggagcgctgcattgcagccagcttggaactcaacaatccggtaccagagcaaccacccctgccgactagcgaatcaccttttgcctggtctcccttagcaggagaaaagtttgtggaagtgtacaaggaggcccatctgctggctctgcatatagaatcatccagcagaaatcaggccgcgcaggctgctaagcccgaggatcccagaagtcagggcgtggaacgtttcattcaggaaagtaagctgaagatcaatctttttgagaaagaaaaagaaatgaaaaaatcccccacctccttgaaacgcgagacctattatctgtctgacagcccgctcctgggccccccagtgggggagcctagactgctggcatcttcgccagccctgccatcaagcggtgcccaggcccgcctcacacgggcacctggacctcctcactcagcccatgcactcccaagggaatcttgcactgcccatgccgcatcacaggcagcgactcaacgtaaacccgggaccaagctgctcctccctcgcgcggcttctgtgcgcggccggtcaattccgggtgctgcggaaaaacccaaaaaagagatcccagcctctccatccaggactaaaattcccgctgaaaaggaatcccatcgggatgttctgcccgacaaaccggcccccggggctgtgaacgtccccgcggctggctcacatctgggacaaggcaaaagagctattcccgtgcctaacaagctgggcctcaaaaagacactgctcaaagcccccggatccacatccaacctcgctagaaaaagctctagcggccccgtatggtctggagccagctccgcttgtacttctcctgccgtcggtaaggctaagagcagcgagttcgcctccatcccggccaattcctcccgtcccttaagtaatatatccaagtccggccgcatgggtcccgctatgctccgccctgctcttcccgccggtcctgtgggagcctcgtcatggcaagctaagcgggtagacgtgagtgagctggccgcagagcagctcaccgcgccaccaagcgcgtcccccacacaacctcagacacctgagggcgggggccaatggcttaattccagctgcgcctggtcagagtcctcgcagctcaacaagacaagatcaatccggcgccgtgattcatgtctaaactctaagaccaaagttatgccgacaccaactaatcagttcaagataccaaagttttcaatcggagactcccccgactcttccactcctaaactgtcaagagcccagcggccacaaagctgcaccagcgtagggagagtcaccgtacactctaccccagtgcgccgatccagcggaccggcgcctcaaagcctactttctgcttggcgggtgtctgctctgccaacgcctgcgagcaggcgttgctcgggtctgccacccatgactcctaaaacaatgccccgggctgtgggctctcctctgtgcgtgccagcgaggcgccgctcctcggaaccacgaaaaaattcagccatgagaactgagccaacccgggagagtaaccgcaagaccgatagccgcctcgtagacgtgagtcccgaccgcgggagccctccatctagggttccacaggcactgaacttctctccagaagagagcgattccacattcagcaagagtaccgctactgaggtggcgagggaagaagctaaaccaggaggcgatgccgccccgtcggaagctctcctagtggacattaagctggagccattagcagtgacacccgatgcagctagtcagccactgattgacttgccattaattgatttttgtgatacccctgaagcgcatgttgccgtggggtccgagtcacgacccctcatcgacctcatgacaaatactcccgatatgaacaaaaatgttgccaagcccagcccagtcgtgggccagttgattgacctcagctctcctcttatccagttatcacctgaggccgacaaagagaacgtggactcgcctctgctgaagttctag

SEQ ID NO: 15299 - DNA, 2220 bp, Artificial Sequence
  Description of Artificial Sequence: Synthetic coding sequence
atggaagggggtgggggcagagacgagccctcggcttgtcgcgcaggagatgttaatatggatgatccaaagaaggaggacatactcctactggccgatgaaaaattcgacttcgatctatctctctctagtagtagcgcaaacgaggatgacgaagttttcttcggcccattcggacataaggaacgttgtatcgctgccagcctggagctgaacaatcctgtacccgagcagcccccgcttccaactagcgaatcccctttcgcctggtcacctctggcaggggagaaattcgtggaagtctacaaagaagcacacctgttggcgctgcacattgagtcatcaagtagaaatcaggcagcccaggcagctaagccggaagacccacggtcccagggcgtggagcggttcatacaagaatccaaactgaaaattaacctgttcgagaaggaaaaggagatgaagaagtctcccacatcattaaaacgggagacttattacctctccgactcaccgttgctgggaccacccgtaggggagccccgactgcttgcctcatcgcccgctctccctagctctggcgctcaggccaggctgacacgggcgcctggacccccgcactctgctcacgctttgccacgagagagttgtacagcccacgccgctagccaggcagcaacgcagcgcaaaccaggcacgaaattgctgctgccgagagcagcctcagtccggggccgctccattccgggcgccgccgaaaaaccaaagaaagagatacctgcttcccccagtcggacaaaaatccctgccgaaaaagaatcacacagagacgtcctcccggacaaacccgctccaggtgccgtgaatgttcctgcagctggctcgcacctgggacaggggaagcgggccattcccgttcccaataagttgggccttaaaaagacgttgctgaaggctcccggctcaacctcgaacctggcaagaaaaagcagttcgggtccagtctggtccggcgcttctagtgcctgcacaagcccagccgtaggaaaggcaaagagctccgaattcgcctcaattccagctaactcttctcgcccactttctaacatcagcaagagtggacgaatggggccagccatgttgaggccagccctgcctgcaggtcccgtgggcgcaagtagctggcaggcgaaacgcgtcgacgtgtctgaactggccgcagaacagttgactgcacctccttctgcctcccctactcagccacagacgcctgaaggaggcggacaatggttgaacagtagctgtgcttggagtgaaagctcgcagctcaataagaccaggagtattagaaggagagactcttgccttaatagcaaaactaaggtgatgcctacaccaactaatcaatttaagattcccaaattcagcatcggagactcgcctgattcatcgaccccgaagctctcacgcgcccagcggcctcagagttgcacgtctgtcggccgcgtgacggtccactccacgcctgtccgccgcagttctggacctgcgcctcaatccttgctatccgcatggcgagtgagcgcactacctacaccagcaagtcgacgctgtagtggcctccccccgatgactcccaaaacaatgccacgggccgtcggaagccctctctgtgtgcctgcccgccgtcgctcttcagagcccagaaaaaatagtgccatgaggactgagccgacccgggaaagcaatcgtaagactgacagcaggcttgtggacgttagccccgaccgtgggtcgcctcccagccgcgtgcctcaagctctgaatttctcccccgaagaatctgactcaaccttcagtaaatctacagccactgaggtcgcccgagaggaggccaaaccagggggagacgctgccccatccgaagcgctccttgtcgacataaaactggaacccctggctgtgacccccgatgcagccagtcagcccttaattgatctgcccctcattgatttctgtgacactccggaagcacacgttgctgtgggttccgagtctaggcccctcatcgatctgatgacgaataccccggatatgaacaaaaacgtcgccaagccatcacctgtggtggggcagcttattgatttgtcttcccctctgatccagctttctccagaggctgataaggaaaatgtggacagtcccctcctcaagttttag

SEQ ID NO: 15300 - DNA, 1149 bp, Artificial Sequence
  Description of Artificial Sequence: Synthetic coding sequence
atgggggattggtctgccttaggtaaacttcttgataaagtccaggcatatagtactgccggtggtaaagtatggttgtcagtgcttttcatctttaggattcttctcctgggtacagctgtggagagcgcctggggcgacgagcagtctgcctttagatgtaatacccaacagcctgggtgcgaaaatgtgtgttacgataaaagttttccgataagccacgtgcgattttgggtccttcaaatcatattcgtttccgtgcccactctcttgtacttggcccatgtcttctatgtcatgagaaaggaagagaaacttaacaaaaaagaggaggaactcaaggtcgctcagaccgacggcgtaaatgtcgacatgcatctgaagcagatcgaaatcaaaaagtttaaatatggcatcgaagagcatgggaaagtgaagatgagaggcgggttattgcgaacgtacatcattagcatcctgtttaaatccatttttgaagtcgctttcctcctgatacagtggtacatctacggcttcagcctgtctgcggtttatacatgcaaaagggatccttgtccacatcaggtcgattgctttctgtctcgccccaccgaaaaaacgatctttattatttttatgttggtggtcagcctcgtctcactagcactcaacatcattgagttgttctatgtgttttttaaaggagtcaaggatagggtgaaaggaaagagcgatccctatcatgcgacgagtggagctctgtctcccgccaaggattgtgggagccagaagtatgcttatttcaacgggtgttcaagcccaacagcgcccttgtctcccatgagcccgccgggttataagctggtgaccggggataggaacaactcaagctgtcgcaactacaataagcaggcgagtgaacagaactgggccaactattcagccgaacaaaatcgcatgggacaggctggatccaccatatccaattcacacgcacagccattcgactttccagatgacaatcagaatagtaaaaaactcgccgccggtcacgaactgcagccgcttgcgattgtggatcagcgaccctcctcccgcgctagctcaagagctagtagccggccgcgcccagacgacctggagatttag

SEQ ID NO: 15301 - DNA, 1101 bp, Artificial Sequence
  Description of Artificial Sequence: Synthetic coding sequence
atgggtgattggagtgctttggggaagttgctggataaggtgcaggcttactcaacagcaggaggaaaggtttggctttctgcttggggggacgaacagtcagccttcaggtgtaacacacagcagccgggatgtgagaacgtgtgttacgataagtcctttccgatctcccatgtgaggttctgggttctccagataatttttgtgagcgtcccaacattgctgtacctcgcccacgtgttctacgttatgcggaaggaggaaaaactaaacaagaaagaggaagagctcaaagtcgctcagacagatggcgtgaatgttgatatgcacctgaagcagatagaaataaaaaagtttaagtacggcatcgaggagcacggcaaggtgaagatgcggggtggcctcttgcggacatacatcatatccatactgttcaaatcaatttttgaagtcgccttcctgctgattcagtggtatatttatggattttccttaagcgccgtgtacacatgtaaacgggatccctgcccccatcaggtggactgcttcttatctcgcccgacagaaaagaccatttttatcatcttcatgctcgtggtgagccttgtcagtcttgccttaaatatcattgagcttttttacgtgttctttaaaggcgtgaaggacagggtgaaggggaagtccgatccataccacgctacaagcggggcattgtcaccagcaaaagattgtggttctcagaagtacgcttatttcaacggctgctccagtcctacggcaccgcttagtcctatgtcacccccgggctacaagctggtgaccggggacaggaataattcctcatgcaggaattacaacaagcaggcgtccgagcagaattgggccaactactccgctgagcagaacagaatgggacaggccgggtccaccattagcaactctcatgcccagccatttgacttccccgatgataaccagaacagcaagaaattagccgcaggccacgaattgcaacccctcgcaatcgtggaccaaagacctagcagcagagccagttctcgtgcttcgtcgaggccacggcctgacgacctggaaatctag

SEQ ID NO: 15302 - DNA, 2673 bp, Artificial Sequence
  Description of Artificial Sequence: Synthetic coding sequence
atggactccaacacagcgccgctgggcccttcctgcccgcagccacctcccgcgcctcagccccaagcccggtctagacttaacgctacagcgagcctggaacaggaacgtagtgagaggcccagggcaccagggccccaggctggacctggtcccggggtacgagatgccgcggcacctgctgagccgcaggcccaacacacgaggtctcgggagagagctgatggaacggggccgacaaagggcgatatggagattccctttgaagaggtgctggagagggctaaagctggggacccgaaagctcagaccgaggtgggaaaacattaccttcaactggccggtgataccgatgaggagctgaacagctgcacggcggtcgattggctggtgctggccgccaaacagggaagacgggaagccgtgaagctcctcagacgctgcttggccgatcggagaggaataacctccgaaaatgagcgggaggtgcgtcagctatccagcgagactgacctggagagggcggttagaaaggccgcccttgtgatgtactggaagttaaacccaaagaaaaagaagcaggtggcagttgccgaactgctagaaaacgttggccaggtcaacgagcacgacggaggcgcacagcctggacctgtgccaaaaagcctccagaagcaaaggcgcatgctcgaacgattggtgtcatccgagtcaaagaactatatcgccctggatgattttgtggagatcactaagaagtatgcaaaaggcgtaatccccagctctctgttcttacaggacgacgaagacgacgacgaactcgccgggaaatcacctgaagacttgccactccggctcaaggttgtgaagtaccctcttcatgccatcatggagattaaagaatacctgatagatatggccagcagggccggtatgcactggctgtctacaatcatacctacacaccacattaacgccttaatctttttttttatcgtttctaacttgacaatagactttttcgctttctttattcccctggtcattttttatctgtcttttatctccatggtgatctgcaccctgaaggtatttcaggattctaaagcttgggaaaattttcgcaccctgaccgacctcctgcttcgattcgaaccaaacctggacgtcgagcaggcagaggttaattttggatggaatcacctcgagccctacgcccacttcctgttaagcgtgttcttcgttatcttctcttttcccatcgcttctaaagactgtataccatgctcagaactagccgtgatcaccggattctttaccgtaaccagctacctttccctgtcaacccatgccgaaccatataccagaagagcacttgccactgaggtgactgccggccttctgtccctgctgccgtccatgcccctcaattggccctacctcaaggttttgggccagactttcatcacagtgccagtgggacacctggtagtgcttaacgtgagtgtcccctgtttgctatatgtctacttattgtatttgttcttccggatggcacagttgagaaactttaaggggacttattgctatctggtgccttatctggtatgctttatgtggtgcgagctaagcgtggtgatcctactggagtctaccggtctgggccttctacgagctagtattgggtatttcctgtttctttttgccctcccaatactggttgctggcctcgctctggtgggcgtgctccagttcgcccgatggtttacctctttggagcttactaagatcgctgtgacagtggccgtgtgcagcgtccctcttctgctgcgctggtggacaaaagcctctttcagtgtggttggtatggtcaagagtctgactcggtctagcatggtcaaactgatcttagtgtggttgaccgcaatagtacttttttgctggttttatgtgtatcgcagtgagggaatgaaagtgtataactccaccctaacatggcaacagtacggagcactatgcggccccagagcctggaaagagacgaatatggccagaactcagatcctatgctcacatctggaaggtcatagggttacgtggacagggcgttttaagtatgtcagggtgaccgatatcgacaatagcgctgagtccgccatcaacatgttgccattttttattggagactggatgcggtgtttgtacggggaagcttaccccgcctgctctcccgggaacaccagtaccgctgaagaagagctgtgccggctgaagttactcgccaagcacccgtgccatataaagaaatttgatcggtacaagtttgagatcacagtcggcatgccgttctccagtggagctgatggatctaggagccgcgaagaggacgacgttacaaaggacattgtgctgagagctagtagcgagttcaagtccgtattactgagcctgcggcagggcagtctgatcgaattctcaacaatcttagaggggcgactgggatcaaagtggcctgtcttcgaactgaaagctatttcctgcctgaactgcatggcccagctctctcccacacgcagacacgtgaaaatcgagcacgattggcgatctacggtgcatggcgcagtgaaatttgcttttgactttttcttctttccattcctgtctgcagcttag

SEQ ID NO: 15303 - DNA, 654 bp, Artificial Sequence
  Description of Artificial Sequence: Synthetic coding sequence
atgagcttcagaggtggtggaaggggcggctttaatcgcggcgggggtggcggaggctttaatcggggcggctccagcaaccacttccgcggcggagggggtggtgggggcggcggcaattttaggggaggcgggaggggtggattcgggcggggcggcggccgcggaggatttaacaagggccaggatcagggccccccagagagggtcgtcttactgggagagttcctccatccctgtgaagatgatattgtgtgtaaatgcactactgatgagaacaaagtcccctactttaatgcccctgtgtatctggagaataaggagcaaattgggaaggtagatgaaatcttcggtcagttgcgggatttttacttctccgtcaagctgagtgagaatatgaaagccagttccttcaaaaagctgcagaaattttatattgacccttataagctcctgcccctgcaaaggttcttgccgcgcccccctggggagaagggccctcccaggggaggcggtagaggagggaggggaggaggaagggggggcggaggaagaggaggaggccggggcggcggattccggggggggagggggggaggtggaggggggttccggggggggcgtggcggtggatttaggggccggggacattag

SEQ ID NO: 15304 - DNA, 1590 bp, Artificial Sequence
  Description of Artificial Sequence: Synthetic coding sequence
atgggatgcgttttctgcaaaaagcttgagccggtggccaccgcaaaagaggatgccggtttggaaggcgactttcggagctacggggccgccgatcattacggccccgaccccactaaggcccgtccagcctcgagctttgctcatattcctaattacagtaacttcagttcccaggcaataaacccagggtttctagactccggaactatcagaggcgtctcaggaattggggtaacactatttatcgccctgtatgattacgaagccaggaccgaggacgatctgacttttactaaaggtgagaaattccatattttgaacaatacagaaggagattggtgggaggccagaagcctcagttctggcaagacagggtgcattccctctaattacgtggcacccgtcgattctattcaggctgaagagtggtactttggcaaaattgggagaaaagatgcagaacgccagctgttgagtccgggcaatcctcagggcgccttcttgatcagggaatctgagacgactaaaggtgcgtattcgctgtccatccgagactgggaccagaccaggggagatcacgtcaaacattataagattcgtaagctggacatggggggttactacattaccacccgcgtccaattcaatagcgtccaggaactagtccagcattatatggaggtcaatgacggtctgtgtaatctgttaatcgctccttgcacaatcatgaagccccagacacttgggctggccaaggacgcttgggaaattagccgcagctccataacccttgaacggcgcctcggcacaggctgctttggggacgtatggctggggacctggaacggaagcacaaaggtggcggtgaagacactcaaaccaggaaccatgtccccaaaagctttcttagaggaagctcaggtcatgaagcttctgagacacgataaattagtgcagctgtatgccgtggtgtcggaggagcccatttacattgtgaccgaattcatgtgtcatggcagcctgctagatttcctcaaaaaccctgagggacaagatctccgcctgccacagcttgtggacatggcggcccaggtggccgagggcatggcttacatggagcggatgaattacattcaccgggatctgcgcgcagccaacattttggtgggagaacgcctcgcttgcaagattgccgatttcggattggccaggttgattaaggacgatgagtacaatccctgccagggttccaagttccctatcaaatggaccgcacctgaggcggcgcttttcggacgcttcaccatcaagagcgatgtttggtcctttggtatattgttaaccgagttgatcaccaagggaagaataccttaccccgggatgaataaacgggaagtgttagagcaggtcgagcaggggtaccacatgccttgcccccctggatgccctgcctcgctgtatgaggcgatggaacaaacttggagactcgatccagaagagcggcctaccttcgaatatctgcagtcgttcctcgaggattacttcacttcagcagagccccagtatcagccaggcgaccagacctag

SEQ ID NO: 15305 - DNA, 1590 bp, Artificial Sequence
  Description of Artificial Sequence: Synthetic coding sequence
atgggctgtgttttctgcaaaaaactggagcccgtggccactgctaaggaggacgccggtctggaaggtgacttcaggtcctacggggccgcggaccactacggtcccgacccaaccaaggccagaccagcgtcttccttcgcccacattcccaattactcaaacttcagttcacaggccatcaaccccggctttcttgacagcggcaccataaggggggtgagtggcatcggtgtgaccctgttcatagccttgtatgactacgaggctaggaccgaggacgatttgaccttcaccaaaggtgaaaagttccatatcttgaacaacacagagggcgattggtgggaagccaggtctctgagtagcggaaagacgggctgcattcccagcaactacgtggcgcccgtggactccattcaagccgaggaatggtactttggaaaaattggccgaaaagacgcggagcgacagttactgagtccggggaacccgcagggtgcctttctgattcgcgaaagcgaaacaacgaaaggagcctactcactgtcaattagagattgggatcaaacgcgcggcgatcatgtcaaacattacaagatcaggaaattggacatgggcggctattatattacaactcgggtgcaattcaacagcgtgcaggagctcgtgcagcactacatggaggtgaacgacggactgtgtaacctgctgatcgcaccatgcacaattatgaagccacagacactgggcctggccaaggacgcctgggagattagtagatcaagcatcacgctcgaacgtaggttggggacagggtgctttggagacgtctggctgggcacatggaacggatcaacaaaggttgctgtgaagaccctgaaaccgggaacgatgagccccaaagccttcttggaggaggcccaagttatgaagcttctccgtcacgacaaacttgtgcagttgtatgctgtggtgagtgaagagcccatctatattgtgaccgaatttatgtgccacgggtccttgttggacttcctaaagaaccctgaaggacaagatctgagactgccacagctcgtggacatggccgctcaggtcgcagagggtatggcctacatggaacggatgaattacatccacagggacctgagggccgccaacatcttagtgggcgaaagactggcctgtaagatcgctgatttcggtctggcaagactgatcaaggatgatgagtataacccatgccagggatcaaaattcccaattaaatggactgcacccgaggctgcactttttgggcggtttacaataaaatccgatgtctggagtttcggtatcctgctgaccgagctcattacaaaagggcgcattccctaccccggtatgaacaagcgtgaggttctggaacaggtggagcagggataccatatgccctgccctcctggttgtccagcctcactgtacgaggccatggaacagacatggcgcctggatcctgaggagcgccctacgttcgagtatctacagagtttccttgaagactacttcacctcagccgagcctcagtatcagccgggagatcagacctag

SEQ ID NO: 15306 - DNA, 1590 bp, Artificial Sequence
  Description of Artificial Sequence: Synthetic coding sequence
atgggatgcgtgttttgtaaaaagctagagccagtagctacggccaaagaagacgcaggattggaaggagattttaggagctatggtgctgccgatcattacgggccagaccctactaaggccaggcctgcaagctcattcgcacatataccaaattattcaaacttctccagtcaggctatcaatcctgggttcctggatagcggcactataagaggagtgtctggaatcggcgtcacactgttcatcgctttgtatgattacgaggccagaaccgaggatgatctgacattcacaaagggagagaagttccacattctgaataataccgaaggtgattggtgggaggcgcgctctttgtccagtgggaagactgggtgcatccccagtaattatgtcgcacccgtggattctatacaggccgaggagtggtattttggcaagatcggaagaaaggacgccgaacggcagttgctgtccccgggtaatccacagggtgccttcctgatacgggagagcgaaactacgaaaggagcgtacagtctatcaatccgcgattgggatcagacacgcggcgaccatgtcaaacattacaagatcagaaagctggatatgggcggttactacattaccaccagggtacaattcaactctgtgcaggaattggtgcagcactacatggaagtcaatgatggcctgtgcaatctgctcatcgctccatgtacgataatgaaacctcagacattggggctggccaaggacgcttgggagatctctcgctcatctataaccctggaaaggaggcttgggacagggtgctttggagacgtttggctcggcacatggaacggcagcacaaaagttgctgtgaagactttgaaaccaggaacgatgagtccaaaagccttcctcgaggaggctcaggtgatgaaacttctacgacacgataaacttgttcaattgtacgccgtcgtgagcgaggagcccatctatattgttactgaatttatgtgtcatggcagcctcctagattttctaaaaaaccctgaggggcaggacttgaggcttccacagctggtggatatggcagctcaagtggccgaagggatggcatatatggaacgaatgaattacatacatcgcgatctgagagcagctaacatacttgttggcgaaaggctggcttgtaaaattgccgatttcggcctggcacgactaatcaaggatgatgagtacaatccttgtcaaggaagtaaattccccataaagtggaccgcccctgaagccgcgctgttcgggcgattcaccatcaaaagtgacgtgtggtctttcggtattttgctgactgagctgattacaaagggtcggattccttatccaggaatgaacaaacgggaagtcctggaacaggtagaacagggctaccacatgccctgtcctcctgggtgccctgcctccttgtacgaggctatggaacagacttggcggttagatccggaagaaagacctaccttcgaataccttcagagctttctggaggattactttacgtcggccgagccccagtatcagcccggcgatcagacttag

SEQ ID NO: 15307 - DNA, 1590 bp, Artificial Sequence
  Description of Artificial Sequence: Synthetic coding sequence
atggggtgtgtgttctgcaagaagctggaacccgtagccactgcgaaagaggatgccgggctggagggagatttccgcagttacggggccgctgatcactatggccccgaccccacaaaagcgcgcccggcatcctctttcgcccacattcccaactacagtaattttagctcccaagctatcaacccagggttcttagattcaggaaccatcagaggagtcagtggaatcggagtaactttgttcattgccctgtacgattacgaagcaagaaccgaggatgaccttactttcaccaagggggagaagtttcatatcctcaacaacactgagggcgattggtgggaagccaggagtctgagctctggaaagacaggctgtatcccctctaattacgtggccccagtcgattcaatccaagccgaggaatggtacttcggtaaaatagggagaaaggacgctgaaaggcagttactgtcccctgggaatccacagggtgcctttctgatacgcgaatcagagacaacaaagggagcttattcccttagcatccgggactgggatcagactagaggtgaccatgtcaaacactataaaattcggaagctggatatggggggatactatattacgactcgcgttcagtttaactcagtgcaggaattagttcagcactatatggaagtcaatgatggactgtgtaacctcctgatcgccccatgtacaataatgaaacctcagacgctcggattggccaaggatgcttgggagatcagcaggtcaagcatcacattagagcgcaggctcgggacaggttgtttcggggacgtgtggctcgggacttggaatggaagcaccaaggtggccgttaagactctcaaaccagggaccatgtcacctaaagccttcttagaggaggcccaagtgatgaagctgctgcgccacgataaactggtgcagctctacgccgtagtgtccgaagagccaatctacatcgtcactgagttcatgtgccacggcagccttctcgattttctgaagaatcccgaagggcaggatctgcgactgccccagttggtggatatggccgcgcaggttgccgagggcatggcatatatggagcggatgaactatatccaccgcgaccttcgggcagcaaatatcttggtaggggaacggctggcctgtaaaattgctgacttcggtttggcccgtctcatcaaggatgatgagtataatccatgccagggctcaaagtttcccatcaagtggacggcccccgaagccgccctgtttgggcgctttactattaagagcgacgtgtggtcctttgggattctcctcaccgaactcatcacaaagggtaggattccatatccaggcatgaacaagcgcgaagtgctggagcaagtggagcagggctatcacatgccctgtcccccaggctgtccggccagtctgtatgaggcaatggaacagacctggcgacttgacccagaggaaaggcctacattcgaatatttacagagttttctggaggattactttacctcagccgaacctcagtatcagccgggtgatcaaacctag

SEQ ID NO: 15308 - DNA, 942 bp, Artificial Sequence
  Description of Artificial Sequence: Synthetic coding sequence
atgggctgtgtgttctgcaaaaagctagagcctgtggccaccgctaaggaagatgcaggtctcgagggcgattttcgtagttacggcgccgccgatcattacgggcccgaccctaccaaagctcggcctgcgagttcttttgcgcacatccctaactacagtaatttctcatctcaagcgatcaaccctgggtttctcgactcaggcaccataaggggagtgtcaggcatcggggtgactctgttcatcgccctgtatgattatgaagccagaaccgaggacgacctgacatttactaaaggagagaaattccacattctgaataatacagaaggggactggtgggaagctcggtccctctcctctggtaagacggggtgtattccaagtaactacgtggcacctgtggactcaatccaggccgaggaatggtattttggcaagataggccggaaggacgcggagcgccagctcctcagccctggcaatcctcagggggcatttctgatccgagaatcagagaccaccaagggcgcatactcgctgtcaatccgggattgggaccagacaagaggcgatcacgtgaaacactacaagattcggaaattggacatgggtggatattatattacgaccagggtgcagttcaacagcgttcaggaacttgtccagcactacatggaggtgaacgatgggctgtgcaacctcctaatagctccctgcacgatcatgaaaccgcaaacgctgggattggcaaaagatgcctgggaaatttcacgctcatccatcaccttggagcgcaggcttggcacaggttgctttggcgatgtgtggctgggaacgtggaatggctcaacaaaggtggcagtcaaaaccctgaaacccggtactatgagccctaaagcctttttggaagaagcccaagtgatgaagctgttatag

SEQ ID NO: 15309 - DNA, 1392 bp, Artificial Sequence
  Description of Artificial Sequence: Synthetic coding sequence
atgggctgtgtgttctgtaagaagctagagcctgtggctacggctaaagaagatgcaggcctggagggcgatttcaggagttatggggctgccgaccattacggacccgacccaacgaaagctcgacccgcctcctcctttgcccatattcctaactactctaatttctcttctcaagccattaatccaggcttcttggacagtggaacaattcgcggtgttagcggaattggtgttaccctctttatagccctttacgactatgaagccagaacagaagatgacctcacattcacaaagggcgagaaattccacatcttgaacaataccgaaggcgcctacagcctgtccatccgtgattgggaccagacaaggggcgaccacgtaaaacactataagatccggaaactggatatgggcggttactatataacaaccagggtgcagttcaattcagtgcaagaactggttcagcactacatggaagtgaacgatggcctgtgcaacctactgatcgccccttgcaccattatgaagccccagacacttggactggctaaggacgcctgggaaatctcacggagctctatcactctggagagaagattggggacaggctgctttggcgacgtgtggttaggcacgtggaatggttctacaaaagtggccgtcaaaaccctgaagcccgggaccatgtcaccgaaggcttttctcgaggaagctcaggtcatgaagttactgagacacgacaagctggtgcaattgtacgccgtggtgtcagaagaaccaatttatatcgtgacagagtttatgtgccatggttcactgctagatttcttaaaaaacccagaggggcaggatcttcggctcccccagctggtcgatatggccgcccaagtagcggaaggcatggcttatatggaacggatgaactacatccacagagatcttagggctgcgaatatactggtgggagaacgtctcgcatgtaaaatcgctgatttcgggctcgcccgattaataaaggatgacgaatataatccttgccaaggctcaaagttccccatcaagtggacggcgcccgaggcagccttgttcggcagattcaccattaagtcagatgtgtggtcgtttgggattttgctgaccgagcttattactaaaggccggatcccgtaccccggaatgaacaagcgcgaagtgttggaacaagtggagcagggttaccacatgccctgtcctcccgggtgcccagcaagtctgtacgaagctatggaacaaacatggcggcttgaccctgaagaacggcctacatttgagtacttgcaaagctttcttgaggactatttcacctctgcagagccccaataccaaccaggggaccagacatag

SEQ ID NO: 15310 - DNA, 1005 bp, Artificial Sequence
  Description of Artificial Sequence: Synthetic coding sequence
atggagtttcccggactgggaagcttaggcacttccgaacctctgccccaatttgtggacccagcactggtgagctctacgccagaaagcggggtttttttcccctctgggcccgaggggttggacgctgctgccagctcgactgctccttcaacagcaaccgccgccgccgcagccctggcttattaccgcgatgccgaggcctaccgacactcacccgtttttcaggtgtacccacttttaaactgcatggagggtatccctgggggctccccttatgccggttgggcctacggtaaaactggcctctatcccgcctccacagtctgtcctacacgtgaggactcacccccgcaagccgtagaagacctggatggcaagggcagtacctcctttctggaaacgctcaagaccgaacgtctaagtccagatttgttgactctgggccctgcccttccaagtagcctccctgtaccaaattccgcctatggcgggcccgacttctcatcgacctttttcagcccaaccgggagccccctcaacagcgccgcctacagctccccgaagctgagggggacactgcccttgcctccatgtgaggcccgcgagtgcgtgaactgcggcgccacagccacccccctttggaggcgtgatcgaaccggacactatctgtgtaatgcttgtggcctgtatcacaaaatgaatgggcaaaacagacctcttatccgtcctaagaaacgcctcatagtgtcaaagcgcgctggaactcagtgtacaaactgtcagactacaacaactaccctgtggcggagaaatgcctctggtgaccctgtatgcaatgcatgcggactctactacaaattgcatcaacattactgtggggggagtgcccagctgatgcgcgcacagtccatggcatctagggggggggtcgtgtccttttccagttgctcccagaactcaggacagcccaaaagccttggaccccgacacccactggcctag

SEQ ID NO: 15311 - DNA, 1242 bp, Artificial Sequence
  Description of Artificial Sequence: Synthetic coding sequence
atggagtttccgggcctgggttcactgggcacaagcgaaccacttcctcagttcgtggaccctgccctggtgtcatcaacgcctgaaagtggagtcttcttcccctccgggcccgaaggtctcgatgccgccgcaagtagcactgcacctagcactgccacagctgctgctgccgctctggcttactaccgcgatgccgaagcttacaggcatagccctgtcttccaggtctaccccctcttaaattgcatggaggggatacctggaggaagtccatacgcaggatgggcctatggtaaaacaggcctctacccagcaagcacggtgtgcccaacccgcgaggatagtccaccccaagctgtcgaggatcttgacggtaaggggtcaacatcattcctggagactctgaaaacggagagactctcacctgacctactgacactggggcccgccctgccaagcagtcttcctgtgccgaattccgcttatggaggacccgatttctcctcaacattttttagtccgaccgggtcacctctcaatagtgccgcatacagcagcccaaaactgcggggtactcttcctttgcctccctgtgaagcacgcgaatgtgtcaactgcggggctacagctacacccctttggcgccgcgatagaaccggccactacctgtgcaatgcttgtgggctgtatcacaaaatgaatggacagaaccgtcctctcattagaccaaaaaagcgcctcatcgtgtcgaagcgagccggcacacagtgcactaattgccagacgaccaccactacactctggaggaggaatgcctctggggaccctgtctgtaatgcctgcggtctgtattataagctgcatcaggtgaacaggcctttgaccatgcggaaggacggaatccagactcgcaatcgcaaggcttccgggaaaggcaagaagaaaaggggcagttctttaggcggtacgggcgctgctgagggaccggccgggggattcatggtagtggccgggggctcagggtctggcaattgcggtgaggtggcctccggactgacactaggtcctcctggaaccgcacacctgtaccagggcttgggtcctgtagtgttgtctgggcccgtctctcatctgatgccattccctggacctctgctggggagcccgaccgggagcttccctacaggaccaatgccgcccaccacttcgacaaccgtagtggctcctctttcttcatag

SEQ ID NO: 15312 - DNA, 369 bp, Artificial Sequence
  Description of Artificial Sequence: Synthetic coding sequence
tgacagaacagacctctgattaggccaaaaaagagacttatagtttcaaagcgtgccggcacgcaatgtaccaattgccaaactactactaccaccctttggaggcgtaacgcttctggtgaccctgtgtgcaacgcctgtgggctttattataaactccaccaggtgaacagaccacttactatgcggaaggacggcatccaaacccggaatcgcaaagcatccggcaaaggcaaaaagaaacgtggcagctctttgggagggacaggcgccgctgagggccctgcccttctctggtggctgaggagcgcacacgaggggacagaacacgggctgcaacggcgcggaggagtgctgctgttactgtag

SEQ ID NO: 15313 - DNA, 1332 bp, Artificial Sequence
  Description of Artificial Sequence: Synthetic coding sequence
atggaggtgacagccgatcagccccgatgggtctcgcaccatcaccccgcagtgttgaacggccagcatccagatacacaccaccccgggttgagtcatagttacatggatgcggcccagtaccccctgccagaggaagtggacgttctctttaatatcgatggccaggggaatcatgtcccaccctattacgggaactccgttagggctactgtacaacggtatcccccaacacaccatgggagtcaggtatgcagacccccattattgcacggctctcttccttggctcgacggcggcaaagcgttgggatctcaccataccgcctctccctggaacctctctcccttttctaaaacgtctatacaccatgggtcacctgggcctctgtcagtgtacccacccgcttccagcagctcactgagtggaggacatgctagtccacacttattcacgttcccgcctactcctccaaaagatgtcagtcctgatcctagccttagcacacctggttcagcgggctctgccaggcaggacgaaaaagagtgtttaaagtaccaggtacccctccccgactcaatgaagctggaaagttcccatagccggggcagtatgaccgctctcggtggagccagttcttcaactcaccatcccattaccacataccccccatacgtcccagaatactctagcggactatttccaccttccagtctcttggggggtagtcccacaggattcggctgtaagagcaggcccaaagctcgctctagtactggaagagagtgtgtgaactgcggcgctactagtacgcctctgtggcgccgtgacgggaccggccactacctgtgcaacgcttgcggactctaccacaaaatgaatggacagaataggcccctgattaaacccaagcggcggttgtcagcagcccgccgggctggcacatcatgcgccaactgtcagaccactaccactacgctctggcggcggaacgccaatggagacccagtgtgcaatgcatgcggtctctattacaaactgcataacatcaatcgcccactcaccatgaaaaaggaggggattcagacgcggaacagaaagatgtcttccaagagcaaaaaatgcaagaaggttcatgatagtctggaagattttcccaagaatagctccttcaaccccgccgccctgagccgccatatgtcgtcactgtcccacatctcccctttctcgcattctagtcacatgctaacaacccctactcccatgcatcccccatctagtctgtccttcggaccccatcaccccagcagcatggtaactgcaatgggctag

SEQ ID NO: 15314 - DNA, 1335 bp, Artificial Sequence
  Description of Artificial Sequence: Synthetic coding sequence
atggaagtgaccgccgatcaacctagatgggttagccaccaccacccagcagtactgaacggccaacatccagatacacaccatcccggactgagtcattcttatatggatgccgcccagtaccccctgcctgaagaggtcgatgtgctcttcaacattgacggccaaggaaaccatgttccaccttattacggtaactcagtgcgcgcaacagtgcaacgctacccccctacccatcacgggtcccaagtatgccggccgcccctcctgcatgggtcattgccatggctcgatggggggaaggctctgggatcccatcacactgcttccccctggaacctgtcccccttttccaagacctccatacatcatggaagcccaggccctttgtctgtctatcctccagcttcttcttcctccctaagtgggggacacgcttcccctcatctgtttactttccccccaactccccccaaagatgtctctcctgacccttcccttagtacgcccggttctgcgggatctgcacgccaggatgaaaaggaatgcctcaaatatcaggtcccactgccagacagcatgaagttggaaagtagccatagtcgagggtccatgaccgcacttggaggagcctcttcttccactcaccaccctattactacttacccaccctacgttcccgaatatagctccggcctgtttcccccttcctctctgttgggtggaagcccaaccggttttggctgtaagtcacgccccaaggcgcgaagtagcactgaaggaagagagtgtgtgaactgcggagcgacaagcacccccctctggcgacgggacggcacaggtcattacttgtgcaacgcttgtggcttatatcataagatgaatggccagaatcgacccctgatcaagcccaaacgcaggctttctgcggccagacgcgccggaacatcttgtgctaattgccagaccaccacgacaaccctgtggagacgaaatgctaatggagaccctgtctgtaacgcgtgcggactgtactacaaactccacaatataaataggcccttgaccatgaagaaggaggggatccaaacacgtaaccgaaagatgtcctcaaagtccaagaagtgtaaaaaggtgcacgatagccttgaggatttccccaagaacagcagctttaatccagctgcgctgagtaggcatatgtcctcacttagccatatatccccattcagtcactctagtcacatgctgacaacaccaactcctatgcatcctccgagcagcctgtcgtttggtcctcaccatccctcaagtatggttacagccatgggctag

SEQ ID NO: 15315 - DNA, 393 bp, Artificial Sequence
  Description of Artificial Sequence: Synthetic coding sequence
atggaagttactgccgatcagcctcggtgggtatcacaccatcatcctgcggtgttaaatggccagcaccccgatacacatcatcccggcctctcacatagttacatggacgcagctcagtatccgttaccagaggaggtcgacgttctttttaacattgatggccaggggaatcacgttcccccgtactatgggaactctgtgagagctaccgtgcagcgataccctccaacccatcatggatcccaggtctgtcgccctcctctgttgcatggcagcctgccctggcttgatggtggaaaagccctcggttcacaccacactgcttccccctggaacctacgcccctgtcttcagtgcctgtgggccctcctgcaggcctctcaatgttag

SEQ ID NO: 15316 - DNA, 798 bp, Artificial Sequence
  Description of Artificial Sequence: Synthetic coding sequence
atgcgccgagctgagttagccgggttgaagaccatggcctgggtgcccgcagagtcagctgtggaggaattgatgcccagactactacctgtggagccttgcgacttgaccgagggatttgatccaagcgtgccaccgcggacaccccaagagtatctacgcagggtgcaaatcgaggcggcccagtgcccagatgtggtggtggcccaaatagatcctaaaaagctcaagcggaagcaaagcgtcaacatctccctctctggctgccaaccagctccagaaggctactcaccaacactgcagtggcagcaacaacaggtggcccagttttcaactgtgagacagaatgtcaacaaacatcgctcccactggaaatctcagcagcttgatagcaacgtgaccatgcctaaatcagaagacgaggagggatggaagaagttttgtctgggagaaaagctgtgtgctgacggagctgtgggccctgccacgaatgaaagcccagggattgattacgtccaggccacagtgacctccgtcctagaatacctgagtaattggttcggcgagagagattttactcccgaactcggaagatggctatacgctctactcgcatgccttgagaaacctttgctgcccgaagctcactcgcttattagacagctggcacggcgttgtagcgaagtgaggttattggtggattccaaggatgacgaacgtgttcccgcactgaacctgctgatctgcttagtctctaggtatttcgaccaaagggaccttgctgatgaaccatcctag

SEQ ID NO: 15317 - DNA, 843 bp, Artificial Sequence
  Description of Artificial Sequence: Synthetic coding sequence
atgagacgcgccgagcttgcagggcttaagaccatggcatgggtcccagcggagtctgctgtggaggagctcatgccgcggctcctgcccgtggagccctgcgacttaacagagggtttcgacccgtccgtcccacctcgtaccccacaggaatacctccgcagagtgcagatcgaggcagcacaatgtcccgatgtggtcgtcgcacagatcgaccccaaaaagctcaagagaaaacagagcgtgaatattagcctgagtggatgtcagcctgcacccgaaggttattccccaacacttcaatggcagcagcagcaagtggcacaatttagcactgtgcggcagaacgtcaacaagcaccgctcacattggaagtcacagcagttagactcaaatgtgactatgccgaagagcgaggacgaagaagggtggaagaaattctgccttggcgaaaagctctgcgcagatggcgcagtcgggcccgcaacgaatgaatcccccggcattgactacgttcagatcggatttcctcctcttctctctatcgtgtccagaatgaatcaggctaccgtcacatctgtgctcgagtacctctcaaactggtttggcgaacgggattttactcctgagctgggcagatggctttatgctctgctggcatgtctagagaagccgcttctgcccgaggctcattctcttattcgccagttggctagaaggtgctctgaggtaaggctgttggtggattccaaagatgatgaaagagtgccggctctgaatctcctgatctgccttgtctcccgctatttcgatcagagagatctggccgatgagcctagttag

SEQ ID NO: 15318 - DNA, 753 bp, Artificial Sequence
  Description of Artificial Sequence: Synthetic coding sequence
atgaggagagccgagctcgccggcctgaagactatggcatgggtcccagccgagtcagctgtggaagagctcatgcctaggctactgccggtggagccctgtgatttaactgaggggtttgacccttctgtgccaccacgcaccccacaggagtacctgcgccgggtccagatagaggctgcacagtgtcccgacgtagtggtggcccagatcgacccaaagaagctcaaacgcaaacagtctgttaatatcagtttatccggctgtcagcctgcccccgagggctattcccctacgctgcagtggcagcagcaacaggttgctcagttttccaccgttcggcagaacgtgaataaacatcgaagccactggaaatcccagcagctggattcaaatgtcacaatgccgaaaagcgaagatgaagaagggtggaagaagttttgcttaggcgagaagttgtgcgccgatggggcggtcgggcctgctaccaacgagagtcctggtattgactacgtccagatcggattccccccgctgctttctattgtgagccgcatgaatcaggcgacagtaacctcagttctggagtatctgagtaactggtttggagagcgagactttacccccgagttagggaggtggctctacgccctgttagcctgcctggaaaaacctttactccccgaagcccacagcctgatcagacagctggcgcgtcggtgtagtgaagtgaggctcctcgtcgtgttctag

SEQ ID NO: 15319 - DNA, 768 bp, Artificial Sequence
  Description of Artificial Sequence: Synthetic coding sequence
atggatgtcatggacggatgccagttttctccctccgaatacttctatgatggatcctgcattccgagccccgaaggggagtttggcgacgagtttgtgccccgggtggctgctttcggggcccataaagccgaactgcagggctccgacgaagacgagcacgttagggctcccacgggacaccatcaggccggccactgcctaatgtgggcttgtaaggcctgtaaacgaaaaagtacaacgatggatagacggaaggccgccaccatgcgggagagacgcaggcttaagaaggtgaatcaagcattcgaaaccctcaaacggtgcacaactacaaacccaaaccagaggctcccaaaggttgaaattttgaggaatgctattcgctacattgagagtttgcaggaactgctgcgggagcaggtggaaaactattatagcctcccagggcagtcctgtagcgagccaacatctcccacatctaattgctccgatggtatgcccgagtgcaactcacccgtatggtccagaaaaagctctacgtttgacagtatctactgccctgatgtgtctaatgtgtacgcaaccgataagaacagcctgtcatctctcgactgtttatctaacattgttgacaggataaccagttccgaacagcctggactccccctccaagacctagcctcgctgtcccctgtggcttctacggactctcaacccgcaactccgggtgcttcatcatctcgtctgatctaccacgtcctgtag

SEQ ID NO: 15320 - DNA, 1725 bp, Artificial Sequence
  Description of Artificial Sequence: Synthetic coding sequence
ctgtcacccagtcttgggttcccagcccagatgaaccatcagaaggggccctctccaagtttcggggtacaaccatgcggcccacatgattcagcacgtggggggatgatcccacatccccagagccggggaccattccccacatgtcagctcaaatctgagcttgacatgctggtaggcaaatgtagggaggagcctctagagggggatatgtcgtcccctaatagcacaggcatacaggaccctttattgggaatgttggatggcagggaggacctggagcgcgaggaaaaacgggaacctgaaagcgtctacgaaacagattgtcggtgggacggctgcagtcaggaatttgactctcaggagcaactggtgcaccacatcaactccgagcatatccacggggaaaggaaggagtttgtgtgtcactggggaggttgctcgagggagctgcgaccctttaaagcccagtacatgcttgttgtgcatatgcggagacacactggggagaagcctcacaagtgcacttttgaaggatgccgcaaatcttactcacgcctggaaaacctaaaaacccacctgcgctcccacacaggggagaaaccctatatgtgtgagcacgagggctgtagtaaggccttctctaatgcttcggatcgtgcaaagcatcagaatagaacccattccaatgaaaaaccctatgtgtgtaagctgccaggctgtacaaagcgctataccgacccttccagtctcagaaagcacgtgaagactgtccacggcccagacgcgcacgtgacaaagcgtcataggggcgacggacccctcccacgggcgccgtccataagcaccgttgaaccgaaaagagagagagagggaggcccgatccgggaagaatcccgtttaactgtgcctgagggggccatgccacctcaccctcagcctttgttctcccattacccccagccttcaccgcctcaatacctacagagcggaccatacacccagccacccccagactatctcccttccgagccaagaccctgtctggacttcgattctcccacccactccacaggacaactcaaagctcagctggtatgcaactatgtccagtctcagcaggagctgctgtgggagggaggtgggagagaggacgctcccgcccaggaaccttcgtaccagtcgcctaaattcctcgggggctctcaggtcagcccctctcgggctaaggcccctgtgaacacttacggccccggttttgggcccaacctgcctaaccataaatccggctcctatccgacccctagtccctgccacgagaattttgtggttggcgctaatcgcgcctcacaccgagccgctgcccctcctagactgttgccccccctgcccacatgctacgggccactgaaagtgggcggaaccaatcccagttgtggtcacccagaggtggggcgactgggcggagggccagctctgtatcctccgccagaaggtcaggtgtgtaaccctctcgacagcctagatcttgataatacacagctggacttcgtggctatcctcgatgaaccccagggccttagtccacctccttcccacgaccagcgcggaagctcagggcataccccacctccctccgggccacctaacatggccgtgggtaatatgagcgttctgctgaggtccctccctggcgaaaccgagtttctgaattcctcagcctag

SEQ ID NO: 15321 - DNA, 390 bp, Artificial Sequence
  Description of Artificial Sequence: Synthetic coding sequence
atgttcaacagcatgactccaccacctatatctagttatggggaaccctgttgccttcgccccctgccttcccagggtgctccaagtgtgggaacagaaggcctttcaggtccgcccttctgtcaccaagccaacctgatgtctggtccgcacagctacggcccagcgagagaaaccaattcttgtaccgagggaccgttattctcctctccacggagtgcagttaaactgaccaaaaaaagagccctctccatatcacctctgagcgatgcgtctctggacttgcagaccgtcatacgcacatccccatcctctctggtcgccttcatcaactcccgatgcacctcccctgggggaagttacgggcacctgtccattggaacgatgtag

SEQ ID NO: 15322 - DNA, 3198 bp, Artificial Sequence
  Description of Artificial Sequence: Synthetic coding sequence
atgtttaattcgatgacgccacctcctattagctcctacggcgaaccgtgttgtttaagaccactgccctctcaaggagccccctccgtgggcaccgaagtcaagctgacaaagaaacgggctctttcaatcagtcccctctctgacgcatccttggaccttcagaccgtaatcaggacttctccttcgagcctggtggcttttatcaattccaggtgcacctctccaggaggctcttatggccacttaagcatcgggactatgagcccatcactaggcttcccggcccagatgaatcaccagaaaggacccagtccctcattcggcgtgcagccatgtgggcctcacgattcggcacgcggcggaatgattccccaccctcagagcaggggaccgtttcctacttgccagctgaagtccgaattggacatgctagtaggtaagtgtcgcgaggagccactggagggcgacatgagttcaccaaatagcactgggattcaggatccactgctgggaatgttggatggccgcgaagacctcgagcgcgaagagaaaagagagcctgagagcgtgtacgagacggactgtcgctgggacgggtgctcacaggaattcgactcgcaagagcagctggtccaccacatcaatagtgagcatatccacggagagagaaaggaatttgtctgccattggggaggctgctcaagggagttgagaccattcaaggcgcagtatatgttggtggtccatatgcgtaggcacacaggagagaagccgcacaagtgcaccttcgagggatgtcggaaaagctacagcaggttggaaaatcttaaaacgcaccttcgttctcacacgggtgagaagccctacatgtgtgaacatgagggatgctcaaaggctttctcgaacgccagtgacagagctaagcaccagaaccgcactcattccaacgagaagccttatgtgtgcaaactgcctggatgtaccaaacgttatactgacccctccagcctgcgaaaacacgtgaaaaccgtccacgggccagatgctcatgttacaaagcgacacagaggcgatggccccctgcctcgagccccttccatctctaccgtggaaccgaaacgcgaaagagaaggcggacccatacgcgaggagagcagattgacagtgcccgagggagctatgaagccccagcctagccctggagctcagtctagctgctctagcgaccattctccagccggctctgcagcgaacactgattcaggcgtagagatgactggcaacgcaggagggtctaccgaggatttgagctctctggacgagggcccctgtatcgccgggaccgggctgtcaaccctgaggcgcctagaaaacctgcgattggatcaactccatcagcttcgacccatcgggacccgcggcctcaaattacctagtttgagtcacacagggacgaccgtctccagacgcgtcgggccacctgtgtctcttgagagaaggagctcctcgagcagtagtattagcagtgcctataccgtgtctcggcgtagctctctcgcttccccctttccccctggcagccctccggagaatggagcatctagcctgcccggcctgatgcccgcacagcattatctgctcagagcacgttatgccagcgcccgaggtggcgggaccagtccaaccgccgccagcagcttggatcgaatcggaggccttcccatgccgccctggaggagtcgggcggaatatcccggttacaaccctaacgccggcgttacgaggagggcaagcgaccctgcccaagcggcggaccgcccagcgccagctagagttcaaagattcaaatcgttggggtgtgtccacacaccaccaacggtggcgggcggtgggcagaactttgacccatatctgcctacttccgtctactctcctcagccaccatccataaccgaaaacgctgcaatggatgcaagaggcctgcaagaagaaccggaggtgggtacaagtatggtgggatctgggctaaacccctacatggattttccaccgaccgacaccctgggatatggcggtccggaaggagccgcggctgaaccctatggtgcgcggggtccgggctcccttccactaggacctggacctccaacgaactacggccctaatccatgcccacagcaggcttcctatcctgatcccacccaggagacttggggggaattccccagtcactctggcctgtatcctgggcctaaggcgttggggggaacatattctcaatgtcctcggttagagcactatggacaggtccaggtgaagcccgagcagggatgcccggttggaagtgattccaccggcctagccccctgcctgaatgcccatcctagtgagggaccaccccacccgcagccactattttcacactatccccagccctcgccaccccagtatctgcaatcagggccctatactcaacccccgccagactatctgccaagcgaaccaagaccgtgcttggatttcgactccccaacccactccacgggccaactgaaggcccagctggtttgtaactacgtgcagtcacaacaggagctcctttgggaaggcggcggtcgagaggacgcccctgctcaggagccatcctatcaatccccaaaatttcttggaggttctcaagtgtccccttcaagagccaaggccccagtgaacacctacggtccgggatttggacctaatctgcccaaccacaagagcggatcttatcccaccccttctccctgccatgaaaactttgttgtgggtgcaaaccgcgcctcacatcgtgctgctgcaccccctcgcctgttacctcctctgcctacatgctacggtcctttgaaggttggcggaaccaatcccagttgcggccacccggaagtgggccgtctgggaggcggacctgctctgtatccaccgcctgaggggcaggtgtgtaaccccctggatagcttggacctggacaatacgcagttagattttgtggccatcctggacgagccacaggggctgagccccccacctagccacgaccagcggggttctagcggccataccccccctcctagcggccctcccaatatggccgtcgggaacatgtctgtgctactccgcagtctcccaggggagacggaattcctcaattcttcggcctag

SEQ ID NO: 15323 - DNA, 528 bp, Artificial Sequence
  Description of Artificial Sequence: Synthetic coding sequence
atgtcgcccagtctgggcttcccggctcagatgaaccaccagaagggccccagcccctccttcggtgtccagccctgcggtccccatgactctgctaggggcggtatgattccccatcctcagtccaggggcccatttcccacatgtcagctgaaatctgagctggacatgctggtgggtaagtgcagagaggagccgctagagggtgacatgtcctcacctaactccacgggcattcaggatccgctcctggggatgctggatggtagagaggacttagaacgggaagaaaaacgagaaccggagtccgtctatgagacggactgtcgatgggatgggtgttctcaggaatttgacagtcaggagcagttggttcaccacataaattccgagcacatccatggggagcggaaagagtttgtttgccactgggggggctgctccagggagttgcgtccgtttaaggctcagtatatgttggtggtgcacatgaggcggcataccggagagaagccacacaaatgctag

SEQ ID NO: 15324 - DNA, 2937 bp, Artificial Sequence
  Description of Artificial Sequence: Synthetic coding sequence
atgagtccctctttaggatttccggcccagatgaaccaccagaaagggcctagccccagcttcggggtccaaccctgtgggccacatgattccgcgcggggtggcatgatcccacatcctcaatcacgggggcctttccctacttgtcaactgaaaagcgaattggatatgcttgtcggtaaatgccgcgaagagcccctggagggcgatatgagttcccctaactccactggtattcaggacccgcttctcggcatgctcgacggcagggaagacttggaaagggaagaaaagcgcgagcccgaatcggtgtatgagaccgactgtcggtgggatggatgctctcaagagtttgattctcaggagcagctggtacatcacataaattctgaacatatccatggcgagcggaaagagttcgtctgccattggggaggctgcagccgggagctcaggccctttaaagcgcaatacatgctcgttgtgcacatgaggcgccacacgggcgaaaaacctcacaagtgcactttcgaaggctgcagaaagtcttattcgcgcctggagaaccttaaaacccatcttagatcccacaccggggaaaagccctatatgtgcgagcatgagggttgtagtaaagctttcagtaacgctagcgatcgcgctaagcaccaaaaccgaactcattcgaacgagaagccctacgtgtgtaaactccccggatgtactaaaaggtacaccgacccttcctctctgcgcaagcacgttaagaccgtacacgggcccgacgcccacgtgactaagaggcaccgaggcgatggccctcttccccgtgctcccagtatatctacagtggagcctaaaagagaacgagagggcggccccatcagggaggagagtcggctcaccgtgccggaaggcgccatgaagccacagccgtcacccggagcacagtctagctgcagcagtgaccattcccctgcagggtctgcggctaacacagatagcggtgtagagatgacaggaaacgccggtggctccaccgaagatctaagtagtctggatgaagggccttgcatcgcgggcaccggactgtcgactttgagacgactagagaacctcagactggatcagctgcatcagctgagaccgatcgggactagggggctcaaactacctagcctttctcacacgggtacaaccgtcagtcgcagggtgggccctccggttagcctggaaaggcgatccagctctagtagtagcattagttccgcctacactgtttcacggcgctcttccctcgctagcccatttccacccggcagccctccagagaatggagccagctcccttccaggcctgatgcccgcccaacactacctcctccgggccagatatgctagtgcaagaggaggaggcacctcgccaaccgctgcgtcatctcttgatcgcattggcggtctgccaatgcctccctggaggtcaagagcagagtatccgggttacaatcctaacgccggcgttacacggagggccagcgatcccgctcaagcagcagacaggcccgccccggccagggttcaaagatttaagtccttgggctgcgtccacaccccaccgacagtagctggcgggggccaaaacttcgatccgtacctgccaacctctgtatattccccgcagcccccgtctatcacagagaatgctgctatggatgcaagaggacttcaagaggaaccggaggtgggcacatcaatggttggctccggcctgaatccttatatggactttccacctaccgataccctggggtacggaggtccagaaggcgccgcggcagagccttatggggctcgggggcctggctctctcccgttaggtcctggcccaccaactaattacggccctaatccctgcccccagcaggcttcataccccgatccgactcaagagacgtggggggagttcccctctcacagcggcctgtaccctggcccaaaggccttgggcgggacctattcacagtgtccaaggctggagcattatggacaggtccaagtaaagccagagcaaggttgtcccgtggggagcgacagcactggcctggctccgtgcttgaatgcgcaccctagcgaaggtcctccacacccacagccgctgttcagccactacccccagcccagtcctcctcagtatctccagtccggaccatacacccaacctcctcccgactatctcccctctgagcccagaccctgtttggactttgacagtccaacacacagtactggacaattaaaggctcagctggtttgcaactatgtccagtcacaacaagaactcctgtgggaaggaggtgggagagaagacgctcccgcccaggagcctagctaccaatcccccaagttcctcggagggtcccaagtttcaccctcccgggccaaggctccagtgaacacatacggtcctggcttcggtccgaatctccccaatcataaatcgggttcataccctacacccagtccttgtcacgaaaattttgtcgttggcgcaaatagagcctcacaccgcgccgccgccccgcctagactgttacctcctcttccgacctgttatggccctctcaaggttgggggcacaaatccatcctgcgggcatcctgaagtggggcgcctgggaggcggtccagcactctatccccctccagaaggtcaggtgtgcaatccactagacagcctggacttggacaatacacagctcgatttcgtggctatcctcgatgagcctcagggactttccccccctccatcacacgaccagcgggggtcttccggccataccccgcccccatcaggccctccgaacatggcagtcggaaacatgagtgtgctgttaagatccctacccggtgaaacggaattcctgaatagttccgcgtag

SEQ ID NO: 15325 - DNA, 135 bp, Artificial Sequence
  Description of Artificial Sequence: Synthetic coding sequence
atgtccggaccgcattcgtacggaccagcccgcgaaaccaattcctgtacagagggtcccctgttttccagtccacgcagcgccgtcaaactgaccaagaaaagggctctctcgatatccccactgagcgactag

SEQ ID NO: 15326 - DNA, 3198 bp, Artificial Sequence
  Description of Artificial Sequence: Synthetic coding sequence
atgtttaacagtatgacaccccctcccataagctcctatggcgagccttgctgccttcggcccctgccgtcccagggggcccccagcgtcggtaccgaagtgaagctgaccaagaagcgtgctctgagtatctccccactgtccgatgcatccctggatctccagactgtcatcagaaccagcccttccagccttgtcgcatttattaatagcagatgtacctctcctggcggaagttacggtcacctgtcaattggtacgatgagcccgagcctcgggttccccgcgcagatgaaccaccagaagggacccagcccttctttcggggtacagccctgtggtccacatgattccgcccgcgggggaatgatccctcacccacagagcagaggcccatttcccacctgccaactcaagagcgagctggacatgctggtaggcaaatgccgggaggagcccctggaaggcgacatgagttccccgaactccaccgggatacaagaccctctgctcggaatgctggacggtcgcgaggacctagaacgggaggagaagcgggaaccagagtctgtgtacgagaccgattgtcgatgggacggctgctcccaggaattcgactctcaggaacaacttgtgcaccacatcaattccgaacacatccacggagagaggaaggaattcgtgtgccactggggtggctgttcgcgcgagttaagaccgtttaaagcccagtatatgctcgtggtgcatatgaggcgccacaccggagagaaacctcacaaatgcaccttcgaaggctgcaggaaatcatattctagactcgagaacctgaaaacacacctcagaagccatactggcgaaaaaccatacatgtgtgaacacgagggctgcagtaaagcctttagtaatgccagcgacagggctaagcatcaaaataggacacattccaatgaaaagccgtatgtgtgcaagctgccagggtgcaccaagagatatactgacccgtctagcctgaggaagcacgtaaagactgtgcatggtccggatgcgcacgtgactaagagacacaggggggatggccccctacccagagctcccagcatcagcactgtggaacccaagagggaacgagaaggcggaccaatccgggaagagagtaggctaaccgtgccagaaggcgctatgaaaccacagccatctcctggcgctcagagttcatgcagctccgaccactcacccgcggggtctgcggccaatacggacagcggcgtggaaatgacaggcaatgccgggggttctacagaggacttgagcagcttggatgaggggccctgtatcgcgggaacgggtttgagtactctccgaaggctcgagaacctgagactggaccagttgcatcaactgaggcctattggaacccgtggcctcaaactgcccagcctgtcacacacaggcacgacagtctcccgacgcgtcgggcctcctgtgtccctcgagagacgatcaagctcatcctcatccatcagcagtgcttacactgtcagccgaaggtcgtctctggcgagccccttccccccaggttcgccgcctgagaatggcgcgtccagcctgccagggctcatgcccgcccagcattatctcctgagagctcggtatgcgtccgctcggggtgggggaacgtcgcctactgccgcaagcagcctggaccgcataggcggcctcccaatgcccccttggagatcaagagccgaataccctggctacaaccctaacgccggcgttactcgaagggccagtgaccccgcacaggccgcagacaggcccgcccccgccagagtccagcggttcaaaagtttaggttgcgtgcacaccccacctacagttgctggagggggacagaacttcgacccatacctgccgaccagtgtgtactctccccagcccccctctataaccgaaaacgctgcaatggatgccagaggccttcaggaggagcccgaggttgggactagtatggtcggaagcggcctgaatccttatatggattttccccccacggacaccttgggctacgggggaccagaaggagctgccgcagagccctatggcgccagaggccctggatcgttgcctctgggtcctgggccgcctacaaattacgggcccaatccgtgccctcaacaggccagttaccccgaccctacacaggagacttggggtgagttccctagccattcgggtctgtacccaggacccaaggcccttggagggacatactcacagtgcccacggttggagcactacggccaagtgcaggtgaagcccgagcagggttgtccggtgggcagcgacagtaccgggctggcaccctgcctaaatgctcatccttcagaagggccaccccaccctcagcctctcttctctcactatccccagccatcccctccccaatacctgcagagtggcccctatactcaaccccctccagattacctgccgagcgaaccacgcccttgtctggatttcgactcgccgacacatagcactgggcagctgaaggcacagctggtctgcaactatgtgcagagccagcaggagctgctatgggaggggggcggccgcgaggacgccccggcccaggaaccctcttaccagtctcctaagtttctgggcgggagccaggtgtcaccaagccgcgctaaggcacctgttaacacctatggtcctggcttcggccccaacctgcctaatcacaagagcggatcctacccaactccctcaccgtgccacgaaaacttcgtggtaggggccaaccgagcttcccatcgtgcagctgcgccccccaggctactgcccccgctgcctacgtgctatggaccactcaaggtcggagggactaaccccagttgtggtcacccagaagttgggagacttggcggcgggcccgccttgtatccaccacctgagggacaggtctgcaacccactggacagtttggacctcgataatacccagttggactttgtagcaatccttgatgaaccccagggattaagcccaccacctagccacgaccagaggggaagctctggccatacccctcccccaagtggtccccctaatatggctgtcgggaacatgtctgtgctactccggtctcttcccggagagaccgaattcttgaatagttcagcttag

SEQ ID NO: 15327 - DNA, 1548 bp, Artificial Sequence
  Description of Artificial Sequence: Synthetic coding sequence
atggccgagcaggttgccctctccagaacccaggtgtgcggtatccttcgggaagaactgtttcagggcgatgcctttcaccagagcgacactcacatcttcattatcatgggagcttcgggagatctagccaagaagaagatctatcctacaatttggtggctcttcagggacggattgttgcccgagaatacattcatcgtcggatacgccagaagtcgtctcaccgtggcggatattcgcaaacagagtgagcctttttttaaggccacacctgaggaaaagttgaagctggaggatttctttgcgcgcaattcctacgtggccggccagtacgacgacgcagcctcctaccagcgactcaatagccacatgaacgcactacaccttggcagccaggccaaccgcctattctacttagcactgccacccacagtgtacgaggcagtcactaaaaatattcacgagagctgcatgtcccagattggttggaaccgaattatcgtggagaaacccttcggtagggatctacaaagttcagaccgcctgtctaaccacatatcaagcctgttcagagaggatcagatatatcgcatcgatcactatcttggaaaagagatggtacagaacctgatggttcttcgattcgctaatcggattttcggtcccatttggaaccgggataacatcgcatgcgtgattttgaccttcaaagagccctttggtaccgaggggagagggggttactttgatgagttcggcattattcgagatgtgatgcaaaatcacttgctgcagatgttgtgtttggtggccatggaaaaaccggcttcgactaatagcgatgatgtgagggatgagaaggttaaggtgctgaaatgtattagcgaggtacaagcgaacaacgtagttctgggtcagtatgtgggaaacccagatggcgaaggggaagccacaaagggttacttggatgaccccacagtgccccgtggcagtacaacagctacgttcgctgccgtcgtgctctatgtggaaaacgagcgatgggatggagtcccattcattctcaggtgtggcaaggcccttaatgagaggaaggcggaagtccggctgcaattccacgacgtggccggcgacatcttccaccagcaatgtaaacggaatgagttagtgatccgggtgcagcccaacgaggccgtgtacactaagatgatgacgaagaagcccgggatgttcttcaatcccgaagagtccgagctggatctcacgtatggcaaccggtacaagaatgtgaagctgccagacgcctatgagcggttgattctcgacgtgttctgcggatcacagatgcacttcgtgagatccgatgaactgagagaggcttggcggattttcactcctctcttacatcagatcgagctggagaaacccaaacctatcccctatatctatggtagtaggggccctacggaggccgatgaacttatgaagagagtggggttccagtatgaaggcacatataagtgggtgaacccccataagttgtag

SEQ ID NO: 15328 - DNA, 1686 bp, Artificial Sequence
  Description of Artificial Sequence: Synthetic coding sequence
atggccgagcaggtagccctaagccgcacacaagtctgcgggatcttacgggaggaactgtttcagggggacgcttttcaccagagcgatacccatattttcatcataatgggcgcttccggcgaccttgcaaaaaaaaagatctatccaacaatatggtggctcttccgcgacggcctgttacccgagaatacattcattgtcggatatgcacggtcgcgcctgacggtggcggacattaggaagcagagcgagccgttcttcaaagccaccccagaagaaaaactcaagctggaggatttcttcgcccggaacagttacgtggcagggcagtacgatgacgctgcctcctaccagcgcctgaactctcacatgaatgccctgcacctcggatcacaggccaatagattgttctacctggcactgccacccactgtgtatgaagcagtaaccaagaacatccacgaaagctgtatgtcccagatcggctggaaccgaataatagtcgagaagccttttggtagggatctccaaagttccgataggttaagtaaccatatcagttctctgtttagagaggaccagatctatcggatcgaccactacttagggaaggaaatggtccagaacctaatggtgctcaggttcgctaacaggatcttcggaccaatctggaaccgggacaacatcgcctgcgtgattcttacatttaaggagccgttcggcactgagggccgagggggatatttcgatgagtttggaataattaggggacccgggcgtcagggcggatcggggagcgaatcatgttctctgtctttgggatccctggtctggggcccgcatgctctggagccaggagagcaggggggagaactgcgtcgcgccctggcctcctctgtgcctcgcgacgttatgcaaaatcacctcttacaaatgctctgcttagtcgctatggagaagcctgcttctactaactctgacgatgtcagggacgagaaagttaaggtacttaaatgcatctctgaggtgcaagccaacaacgtcgttctgggtcaatatgttggcaacccggacggagaaggcgaagctactaaagggtatctggacgatcctaccgtacctcgtgggagcacgactgccacatttgctgccgtggtgctgtacgtggagaatgagcgctgggatggcgtcccatttattctgcgctgcggtaaagcactgaacgaacgtaaagcggaggtcagactgcagttccatgacgtggccggagatattttccatcaacagtgtaaacggaatgagctagtcattcgggtgcaacccaacgaggccgtgtatactaaaatgatgaccaagaaacccggcatgttcttcaaccctgaagagagcgagctggacctgacatacggaaaccggtacaaaaatgtgaaactgcccgatgcatacgagagactgatccttgatgttttctgtgggtcgcaaatgcacttcgtgaggagcgatgagctgagggaggcctggaggatttttacccctctgttacatcagattgagctggaaaaacctaagccgattccttatatctacggtagcagaggacccaccgaggccgatgagctgatgaagcgcgtgggtttccagtatgaagggacttacaaatgggtgaatcctcataagttgtag

SEQ ID NO: 15329 - DNA, 1638 bp, Artificial Sequence
  Description of Artificial Sequence: Synthetic coding sequence
atggggcgcaggggcagcgcccctggaaatggtagaaccctacggggctgtgaacggggaggccgacggcgaaggtccgcagattccgtgatggccgagcaggttgccctgtcacgcacccaggtgtgcggcattctacgagaggagttgtttcaaggagatgcctttcatcagtctgatacccacatctttattattatgggggcttctggcgacctcgcaaaaaagaaaatctacccaactatatggtggctgtttagagatgggctgctgcccgagaatacttttatagttggctacgcgagaagcaggctgaccgttgctgacattagaaagcagagcgagcccttcttcaaggcgacccccgaggaaaaactaaagttggaggacttttttgcccgcaattcttacgtggcaggacaatatgacgatgccgctagttatcagaggctgaattcccatatgaacgctctgcacctggggtctcaggccaatcgcttgttttacctggcactcccgccaaccgtctatgaggcagtgactaagaatatccacgaaagttgcatgagccagattggctggaatcggatcatagtcgaaaagcccttcggtcgggacctccagtcgtcagacaggctgtctaaccatatttcttctctattcagagaagaccagatctatcgcattgaccactacttaggaaaagagatggtccaaaatctgatggtgctgcgctttgctaataggatctttggtcctatatggaaccgggataacatagcctgtgtgattctgacgttcaaggaacccttcgggactgaggggcgtggcggctactttgacgagttcgggattattagggatgtcatgcagaaccacctgcttcagatgctgtgtctggtggcgatggagaaacccgccagtactaactcagacgacgtgagagatgaaaaagtaaaagtgctcaagtgtataagcgaagtgcaagcgaacaatgttgtgcttggtcaatatgtggggaatcccgatggggagggagaggctactaagggatacttggacgacccgacggtgcccagaggatcaaccactgcaactttcgctgctgtggttttgtacgttgaaaacgagcggtgggatggtgtcccgttcatcctcaggtgtggcaaggccctcaacgagaggaaagctgaggtgaggctacagttccatgacgtagcaggagatatcttccatcagcagtgcaaaaggaacgagttggtcatccgcgtgcagccaaatgaggcggtgtataccaagatgatgaccaaaaaaccaggcatgttctttaatcctgaggagtcagagctcgatcttacttatgggaatcggtacaagaatgtgaagctccctgacgcatatgagcggttgatattggatgttttctgtggcagccagatgcacttcgtccgaagtgatgagctgcgggaggcatggcggatttttactccactgcttcaccaaatcgagttggaaaagcccaagcccatcccctacatttacggcagcaggggccccacagaagccgatgagttgatgaagagggttggattccagtacgagggcacatataagtgggttaaccctcacaaactgtag

SEQ ID NO: 15330 - DNA, 1548 bp, Artificial Sequence
  Description of Artificial Sequence: Synthetic coding sequence
atggctgagcaggttgcactgagtcgaactcaggtatgtgggatcctgagagaggaactgtttcagggagacgcttttcaccagtccgatactcacattttcattatcatgggtgccagtggcgatctggccaagaaaaaaatttaccccaccatatggtggcttttccgggacggactgctcccggaaaatacctttattgtcgggtacgcaagaagtagacttaccgtggctgacatccgcaagcagtccgaaccgttctttaaagctaccccagaagagaaactcaaactcgaggatttcttcgcaaggaacagctacgtggccggacaatatgatgacgccgcatcatatcagcgacttaactcccacatgaacgctctccatctcggttcacaagcgaatcgattgttttatttagcgttaccgcccacggtctatgaggcagtcactaaaaacatacacgagagctgcatgtcccagattgggtggaataggattattgtggagaagccctttggacgggatctgcagagctccgacaggctgtctaaccacatttcctcactgttccgtgaagatcaaatctacagaattgatcattatttgggaaaggagatggtgcaaaatctgatggtgctccgatttgccaaccggatcttcggaccaatatggaacagagacaacattgcttgcgtgatcttgacctttaaggaacccttcgggaccgaaggcagggggggctatttcgacgaattcggaatcattcgcgacgttatgcagaatcacctccttcagatgctttgcctggtggctatggaaaagcccgccagcaccaatagtgatgacgtgcgagatgagaaagtgaaggtcttgaaatgcatctctgaggtgcaggccaacaatgtggtgctgggccagtatgtcggaaatcccgatggcgagggagaagctacgaagggatatctggatgatcctaccgttccacgcgggtccaccactgcaacctttgccgccgtggtgctgtacgtggaaaacgagcgttgggatggcgttcccttcattctgcgctgtggcaaagctctaaacgagaggaaagcagaggtccgactgcagttccatgacgtggctggagatatcttccaccagcagtgtaagcgaaacgagttggttatccgagtacagccaaacgaagcggtgtacacaaaaatgatgacaaaaaagcccggcatgttctttaaccctgaagagagcgagctggacctgacttacggaaacagatataaaaacgtaaagctccctgacgcctacgagaggttgatccttgatgttttctgcggcagtcagatgcactttgtccgcagcgacgaactgcgtgaggcatggaggattttcacacccctcctacaccagatcgaactggagaagccgaagcctatcccctacatctacggctctaggggacctaccgaagcagatgagctgatgaaacgggtgggcttccagtatgaggggacttacaagtgggttaacccccataagctttag

SEQ ID NO: 15331 - DNA, 771 bp, Artificial Sequence
  Description of Artificial Sequence: Synthetic coding sequence
atggctgaacaggtcgctctatcgagaactcaagtgtgcggaatcctgcgagaggagctttttcagggagatgctttccatcaatccgacacccacatttttattattatgggagcatccggtgacctggctaaaaaaaagatttatcctacaatctggtggctgtttagagacgggttgttacccgaaaacaccttcatcgtcggttatgcgaggtctcgcctgacggttgcggatatacgcaaacaaagtgagccttttttcaaagcaactccggaggagaagctaaagttagaggatttcttcgccagaaattcctacgtcgccggccagtatgatgatgcagccagctatcagagactcaattcccacatgaatgctctccaccttggaagtcaagcaaatcggctcttctacctggcgctgccgcctactgtttatgaagcagtgactaaaaatatccacgagagttgcatgagccaaatagggtggaaccgaattatagtcgaaaagccctttggaagagacctgcagtctagcgacagactgtcaaatcatattagctccctctttagggaggatcagatttaccgtattgaccactacctgggaaaagagatggtgcaaaatcttatggtgcttagatttgcgaacaggattttcggacctatctggaatcgggataacatcgcctgtgttatacttactttcaaggagccctttggtactgaaggccgtggcggttacttcgacgagttcggcatcatctag

SEQ ID NO: 15332 - DNA, 681 bp, Artificial Sequence
  Description of Artificial Sequence: Synthetic coding sequence
  Description of Combined DNA/RNA Molecule: Synthetic coding sequence
atggcccgcttgctgcaggcatcttgtcttctgtctttactcctcgcagggtttgtgagccagagtcgcggtcaagagaaatcgaaaatggactgccatggcgggatatctggcaccatttatgagtatggagcgctgacgattgacggagaggaatacatacctttcaaacaatacgcagggaaatacgtgctctttgtcaacgtggcatcctacugaggtctcaccgggcagtacattgagctcaacgccctacaagaggagcttgctcctttcggattggtgatactgggctttccatgtaatcaattcggcaagcaggagccgggggaaaacagcgagatcctacccacgctgaagtacgttcgccctggcgggggcttcgtgcccaacttccaactgtttgagaagggggatgtgaatggagaaaaggagcaaaagttctacacatttctgaagaattcttgcccaccgacatcagaattactgggaacttcagatcggctgttttgggaaccaatgaaagtacacgacattagatggaactttgagaagttcctagtgggccctgacggcattcccatcatgcgatggcatcaccgcacaacggtgtccaatgtcaagatggacatcctgagctacatgcggcgccaggctgccttaggcgtgaaacgaaagtag

SEQ ID NO: 15333 - DNA, 219 bp, Artificial Sequence
  Description of Artificial Sequence: Synthetic coding sequence
atggctagactgctgcaagcctcatgtttgctcagcttgctcctggctggattcgtcagtcaaagccgcggccaggaaaagtctaaaatggattgccacggtggcatttctggtacaatctacgaatatggcgcactcacaattgatggggaggaatatatacctttcaagcagtatgccggtaagtatgtgctgttcgtgaacgtggcatcatactag

SEQ ID NO: 15334 - DNA, 633 bp, Artificial Sequence
  Description of Artificial Sequence: Synthetic coding sequence
atgcctccctatactgttgtgtactttccagtccggggcaggtgtgctgccctgaggatgctattagccgaccaaggccaatcttggaaggaggaggtcgtcactgtggagacttggcaggagggaagcctgaaggcttcctgcctgtacggccagcttccaaagtttcaggacggtgacctgaccctgtaccaatctaacactatcctccggcatctcggtagaacacttggactgtacggtaaggatcagcaggaggccgccctggtagatatggtgaatgacggtgttgaggacctccggtgtaaatatatatccttaatctatacaaactatgaagccggtaaggacgattatgtgaaggccctccctgggcagttgaaaccattcgaaactttgctctcccagaaccagggaggtaagactttcatagtgggcgaccagatttcttttgctgactataatctactcgatttgcttctcatccacgaggtgctggctccaggctgtctcgatgcttttcctctgctcagtgcttacgttggccggctcagtgccaggccaaagctgaaggcattccttgcgtctcccgaatacgttaacttacctattaatggaaatggaaagcagtag

SEQ ID NO: 15335 - DNA, 2184 bp, Artificial Sequence
  Description of Artificial Sequence: Synthetic coding sequence
atggccttccagaaagcggtcaagggaaccattcttgtgggcgggggggctctcgctaccgtgcttggcctgagccaattcgcccactacagaaggaagcaaatgaacttagcctacgtcaaggccgctgattgtatcagtgagccggtgaatcgcgaaccacccagtagggaggcacaactactgaccctacagaacacatcagaatttgacatactagttataggcggaggcgcaacagggagcggatgcgccctcgacgctgtgacccgcggattaaaaaccgctcttgtcgaaagggacgatttctccagtggtacttccagtcggtcaaccaaactgatccacgggggtgtccggtatctccaaaaggctatcatgaagctggacattgaacagtataggatggtgaaggaggcccttcacgaaagagcgaacctgttggagattgccccccacctttctgctcccctgcctattatgttgcctgtttacaaatggtggcagctcccatactactgggtggggattaaattgtacgatctggtcgcgggctctaactgcctgaagtcaagttatgttctctcgaaaagcagggcccttgagcatttcccaatgctgcagaaagacaaactggtgggcgccatcgtgtattatgacggacaacacaatgacgcacgaatgaacctcgctattgccttgacggccgcaaggtacggagcagccactgcaaattacatggaggttgtcagtttactcaagaagaccgatccacagacagggaaagtaagagtctcaggtgccagatgcaaggacgtcttgactggacaggaattcgacgtgcgcgctaagtgcgtaattaacgccactggaccgttcaccgatagcgtcaggaagatggacgacaaggacgccgctgcgatctgtcagcctagcgccggcgtacatatagtaatgcccggctattactcccctgagtcaatgggacttctcgatccagcaacctcagatgggcgggtcatcttttttctcccctggcagaaaatgaccattgctggcacgacagatacccccactgatgtgacccatcacccgattccatccgaggaagatatcaatttcatactgaatgaggtgcgcaattatttgtcttgcgatgtcgaagtgcggcggggggatgtacttgctgcttggtcaggtatacggcctctggtcacggatccaaagtctgcagatacccagtccatcagccgtaaccacgtcgttgatattagcgaaagtggtttgatcactatcgcgggggggaagtggaccacgtacaggagcatggcagaggacaccataaatgccgcagtgaagacacataatctgaaggccgggccatcgaggacggtcggcctgttcctccagggcggcaaagactggtctccgacactgtatattcgcttagtgcaagactatggccttgagtcggaggttgctcagcatctggcggccacatatggtgacaaggcatttgaagtggccaagatggctagtgtgaccggcaaaagatggccgatagttggtgtgcggctcgtgtcggaatttccttatatagaagccgaagttaagtacggaatcaaggaatacgcctgcaccgctgtggatatgattagtcggcgtaccaggttagccttcctcaacgtgcaggcagcagaggaggcccttccccggatagtagagctgatgggcagagaactaaactgggacgattataaaaaacaggagcagttggaaaccgcccggaaattcctctactatgagatgggctataagagccggtccgaacagctgacagataggagtgagataagcctgctgccaagcgatatagaccggtacaaaaaacggttccacaaattcgacgctgatcagaaagggtttattaccatcgttgacgttcagcgcgtcctggaaagtattaacgttcagatggacgagaacacgcttcatgaaatcctcaacgaggttgatctgaacaagaacgggcaggtggagctgaatgagtttcttcagctgatgtccgccatccagaaggggagggtttccggaagccgtctggccattctgatgaaaacagccgaagaaaacctggatcggagggtgcccattcccgtggatagatcctgcggtgggctatag

SEQ ID NO: 15336 - DNA, 1503 bp, Artificial Sequence
  Description of Artificial Sequence: Synthetic coding sequence
atgaacttggccatagctctcaccgcagccagatacggagcagctacagccaattacatggaggttgtctctctgctgaaaaaaactgacccgcaaacagggaaagttagggtgtctggggcccggtgtaaggacgtgttaaccggtcaggagttcgatgtgagggccaagtgcgtgatcaatgccactggaccatttactgactccgtacgtaaaatggatgacaaggacgctgctgccatatgtcagcctagtgccggagtccacatcgtaatgcccggctactactctcccgagtccatgggcctgctggacccagctacttccgacggcagagtgattttcttcctgccctggcagaaaatgactattgctgggacgaccgatacaccgactgatgtgacccaccacccaatcccatcagaggaggatattaatttcatcttgaatgaagtgcggaattatttgtcatgcgacgtagaagtgcgaagaggggatgttctggctgcatggagcggcattcgcccgctggttaccgaccccaagtcagccgacacacagagcatctctcgtaaccatgtggttgacatttccgaatcaggactgatcaccattgccggtgggaagtggacgacatatcgctctatggccgaggataccattaacgcagctgtgaagactcataatctcaaggccgggcctagtcggacggtcggacttttcctccaaggcggcaaggactggagccccactctatacatccgtctcgtgcaggattatggcctggagtccgaagttgctcaacatctcgccgccacctacggggacaaagccttcgaggttgctaaaatggcctctgttaccggcaaaaggtggcccatcgtgggcgtgagactggtgagcgagtttccttacattgaggcggaggtgaaatacggcattaaagaatacgcctgcacagccgtggatatgatttcccggagaaccagactcgccttcctgaacgtgcaagccgccgaagaggcgttgccccggatcgtggagttaatgggaagggaacttaattgggatgactacaagaagcaggaacagctagagactgctcgcaagtttttgtattacgaaatggggtacaagagccgatccgagcagcttaccgaccgctccgaaattagcctgcttccctctgacatcgacagatacaagaaacgattccacaaattcgacgcggatcagaaggggtttataactattgtcgacgtacagcgcgtattagagtctataaacgtgcaaatggatgagaatacgcttcatgaaattctgaatgaggtggacctgaacaagaatggccaagtcgagctgaatgagttcttgcagctcatgagcgcaatccaaaagggacgagtcagcggaagcagattggctatcctcatgaaaaccgccgaagaaaatctcgaccgccgggtccctatcccggtcgacagatcgtgcggcggtctttag

SEQ ID NO: 15337 - DNA, 2184 bp, Artificial Sequence
  Description of Artificial Sequence: Synthetic coding sequence
atggcttttcaaaaggctgtgaagggaactatcctcgtggggggtggagccctggctacggtactgggactttctcagttcgcccactatagaagaaagcagatgaatctggcttacgttaaggccgcagattgtatcagtgagcctgtgaacagagaacccccgtcacgggaggcacaactactgaccctccagaataccagtgagtttgatattctagtcattggaggtggtgcgactgggtcaggctgtgccctggacgctgtgactagagggctcaagacagcactggtggagcgagatgacttttcttccgggaccagcagtagatccactaagctgatccacggaggagtacgctacctgcagaaagccatcatgaagctcgacattgagcagtataggatggtcaaggaggcgctgcatgaacgcgccaacctgctcgaaattgctccacacttgagcgctccactccctatcatgctccccgtgtacaagtggtggcaattgccttattactgggtggggatcaagctttacgacctagtggctggatccaattgcctcaagagttcatacgtacttagcaagagcagagcgttagagcatttccccatgttacagaaggataaactggtcggggccatcgtgtactatgatgggcagcataatgacgctcgaatgaatctggcgatagcactgaccgcagcaaggtatggcgcagccaccgcgaactatatggaagtggtctcactgctgaagaaaacggacccgcaaactggcaaggtcagagtgtcaggagcgcgctgcaaggacgtcctgactggccaggaattcgacgtgcgggccaagtgcgtcatcaatgccactgggcccttcacagactctgtgagaaaaatggacgataaggacgctgccgctatttgtcagccctcggcaggggtccacatcgttatgcccgggtactatagccccgaatcaatgggactgttggatccggcgacctcagatggcagagttatctttttcctgccgtggcagaagatgacaattgcaggtactacagacacccctacagacgtcacgcatcatccaataccctctgaagaggacatcaatttcatactgaatgaggtgcgcaactatttgtcctgtgacgtggaggttagaagaggagatgtactggctgcctggagcgggattcgcccgctggtcaccgacccaaagtcagctgatacacagagtattagcagaaatcacgtggtggacatcagtgagagcgggctgatcaccatagcgggcggaaaatggaccacataccgctcaatggctgaggataccatcaacgccgctgtcaaaacccacaatctcaaggccggcccctctaggacagttggactgtttctgcaaggtggcaaggactggtctcctactctgtatattagactggtgcaggactacgggctggagtctgaggtggcgcaacacctggccgcaacatatggagacaaggctttcgaagtggccaaaatggctagcgtgacgggcaaaaggtggcctatagtcggtgtgcgccttgtttcagaattcccctatattgaagccgaggttaaatacgggattaaggagtacgcttgcacagcggtcgacatgataagccgtcggaccaggctggcctttttaaatgttcaagccgccgaggaggcactgccacgaatcgtggaactgatgggccgggaattgaactgggacgattacaaaaagcaagagcaactggagacggctagaaaattcttatactacgagatgggttataagtctaggagcgaacagctcacagatcgatctgagattagcctgctgccttcagacatcgataggtataagaagagatttcataagtttgatgcggaccagaagggtttcatcaccatcgtcgatgtgcaacgagttctggagtccataaacgtgcagatggacgaaaatacactgcacgagatcctcaacgaagttgacctgaataaaaacggacaggttgaactcaatgagttcctgcagctgatgagcgctatccagaaaggacgtgtatccggctccagactcgcgatcctaatgaaaactgccgaggaaaatctcgatcggagagtgcctatccctgtggacagatcttgcgggggcctctag

SEQ ID NO: 15338 - DNA, 2184 bp, Artificial Sequence
  Description of Artificial Sequence: Synthetic coding sequence
atggctttccaaaaagccgtcaagggaactatcctcgtgggcggtggcgcactggcgacagtgcttggcctgtcacagtttgcacattacaggcggaagcagatgaacctggcgtatgttaaggccgcagattgcatcagcgagcccgtgaaccgggagccacctagcagagaggcacagttactcacattgcagaatacatccgagtttgatatccttgtgatcggaggaggagccaccggcagcggctgtgcgctcgatgctgtgactaggggactgaaaacagctctcgtggagagggatgacttctcatcaggaacttcatctagatctactaaacttatacacggtggtgtcagatatcttcaaaaagctattatgaaactggatattgagcagtataggatggtgaaagaggctctgcatgaacgggctaacttactggaaattgccccacacctctcagcaccactgcccattatgctgcctgtgtacaaatggtggcagctgccctactattgggtaggaattaagttgtacgatctggtagctgggagcaactgtttgaagtcctcttatgtgctgagtaaatcacgcgccctggaacacttcccaatgctgcagaaggacaaattggtaggagctatcgtgtactacgacggacagcacaacgatgcccggatgaaccttgctattgctttaacagcggccaggtacggcgctgcgaccgccaactatatggaggtcgtgtctctgctgaaaaagaccgaccctcaaaccggcaaggttagggtgtctggagccagatgcaaggatgtgctgaccggtcaagaatttgatgttcgggccaagtgtgttatcaacgcaaccggcccgttcacagacagtgtgcggaaaatggacgataaggatgccgccgccatatgtcagccctcggccggggttcatatagtgatgcccggctattactccccagaaagtatgggcctgcttgaccctgccaccagcgacggcagggtgatcttttttctgccttggcagaagatgacaattgctgggactaccgatacacccacagatgtcacccaccatcccattccctctgaggaagacataaattttatactcaatgaggtacggaattacctgtcatgcgatgttgaagttcggaggggagatgtgctagctgcatggtcagggatcagacctttagtaaccgatcccaaaagcgcagacacccaatctatcagccggaatcatgtcgtcgatatcagcgaatccgggctcatcacgattgccggtggaaaatggacaacataccggagcatggccgaggacactattaatgccgctgtgaagacccacaacctgaaagccggaccttctcgtacagtggggttatttctgcagggcggtaaagactggtcacctactctctatatacggctcgtacaggactatggcctcgagtccgaggttgctcagcatctggctgccacctacggggacaaggctttcgaagtagctaagatggcctctgtgacaggtaagagatggccaatagtgggcgtgagattagtcagcgaattcccctacatagaagccgaggtgaagtacggcatcaaggagtacgcctgcaccgcggtggatatgatctcccgccgtacccggctggcttttttgaacgttcaggccgccgaggaagccctgccacggatcgtggagctcatgggccgggaactcaactgggatgattataaaaaacaggaacagctggagacagcacggaagttcctatactatgagatgggatacaagtcgcgctccgaacagttaaccgataggtcggaaattagtcttctgccctccgatatagacagatataaaaaaagatttcacaagttcgacgctgaccagaaggggtttataaccatagtggacgttcaacgtgtgctggaatccataaatgttcagatggacgagaacaccctgcatgagattctgaatgaggtcgacttgaacaagaacgggcaggtggagcttaatgagttcctccaactcatgtccgcgattcagaaaggcagggtgagtggctctcggttggccatcctaatgaaaaccgcggaagagaatctcgatcgcagggtccccatccctgttgatagaagttgcggggggctttag

SEQ ID NO: 15339 - DNA, 330 bp, Artificial Sequence
  Description of Artificial Sequence: Synthetic coding sequence
atggcctttcaaaaagcagttaagggcactatccttgtcggcggcggcgcgcttgccaccgtactcggactatcccaatttgcacattatcgacggaagcagatgaaccttgcatacgttaaagccgccgattgcatcagcgaaccggtcaaccgggagccccccagtcgggaagcgcagttgctgaccctgcagaatacctcggaattcgacatcctggtcataggcgggggtgcaacgggaagtgggtgcgctcttgatgcggtaacgcggggtctcaaaacagcactggttgagcgcgacgatttttctagcggtaccagctcttag

SEQ ID NO: 15340 - DNA, 2184 bp, Artificial Sequence
  Description of Artificial Sequence: Synthetic coding sequence
atggctttccaaaaagccgtgaagggaaccattttggtgggtgggggggcccttgctactgtactcggactgagccaattcgcacactaccggcgcaagcaaatgaacctggcttatgtcaaggccgctgactgtatcagtgagcccgtaaatcgggaaccaccatcgcgggaggcacaacttctcacactgcagaatacctccgaattcgatatactggtgatcggcggcggtgctacaggctcgggatgtgccctggacgccgttaccaggggcttaaagacagcgctcgtggagagggacgatttttcctctggaacctcgtccagatcgaccaaactgattcacggaggagtgcgatacttacagaaagcaatcatgaagctggatattgaacagtaccggatggtcaaagaggctctccacgagcgcgctaacctgcttgagatagcccctcacttgagtgctcctctgcccattatgctgccggtttacaagtggtggcagctaccctactattgggtcggtatcaaactgtatgatctcgtggccgggagcaactgtctgaagtcctcctacgtgctgtcaaaatcccgggccttggaacatttccctatgcttcagaaggataagttggtgggggcaatagtttactacgatggacagcacaacgacgctcgcatgaatctggcgatcgcccttacggccgcgcgatacggggccgccaccgccaactacatggaggtggtctcactcctgaaaaagactgatccccagaccggcaaggtcagggtctcaggtgcccgctgtaaagacgtgctaacaggccaagagttcgatgtccgtgcaaaatgtgtcatcaacgccactggccctttcaccgacagcgtgaggaagatggacgataaggatgccgcagcaatttgtcagcccagtgctggagttcatattgtgatgcctggctattacagccctgaaagcatgggcctgttagaccccgcaacaagtgatggacgggtcatttttttcctcccatggcagaaaatgaccatagccgggacgactgatacacccactgacgtgacccaccatccaatcccatctgaggaggatattaatttcattctcaatgaggttcggaactacttaagctgtgatgtggaggtccgtcgcggcgacgtcctggcagcctggtcgggaattcggccactggtaacagatccaaaaagcgccgacacacagtccataagccgcaaccacgtcgttgacattagtgaatccggtctcataaccatcgcggggggaaagtggactacctatagatctatggctgaggatactatcaacgcggctgtcaagacacacaacttaaaggctggcccctccaggactgtgggcctctttctccaaggcggaaaggactggtccccgaccctctatattaggctggttcaggactatggtcttgaaagcgaagtggcgcagcatttagccgctacctacggagacaaagccttcgaggtggctaagatggcctctgtcaccggaaaacgatggcccattgttggcgtgcgtctggtgtcagaattcccttacatagaggctgaagtcaagtatggcatcaaggaatacgcctgcactgccgtggacatgattagcagacgcacacggctcgccttcctgaatgtgcaggctgctgaggaggcacttcccaggatagttgaattaatggggcgagagcttaactgggacgattacaagaaacaggagcagctggagactgcccgcaaatttctgtattatgaaatgggttataaaagcaggtcggagcagctgacagatcgatccgagatctcactcttgccgtccgatatagataggtacaagaaaaggtttcacaaatttgatgcggaccagaaaggcttcatcactattgtggatgtccagagagtgttggagagtattaacgtccagatggatgagaatacattacatgaaattttgaacgaggtcgacttaaacaagaatggacaagttgagctcaacgaattcctgcagcttatgtctgccattcaaaaaggcagagtatcaggctctcgattggccattcttatgaagactgcagaagaaaatttggaccggcgcgttccaatcccagtcgaccgaagttgtggaggattatag

SEQ ID NO: 15341 - DNA, 1140 bp, Artificial Sequence
  Description of Artificial Sequence: Synthetic coding sequence
atggcatttcaaaaggccgtcaaggggaccatcctggtcggagggggagcattggccacagttcttggtctcagtcagtttgcacactaccggcgaaaacaaatgaatcttgcctatgtgaaggccgccgattgcatcagcgaaccagtgaaccgtgaacccccctcccgggaagcccagctcttgactttacaaaacacatctgagtttgatatcctggtaataggcggcggggccactggctcgggctgtgcgctcgatgctgttaccagaggccttaaaacggccctagttgagagagacgacttttccagcggcacatctagcaggagcacaaaactgattcacgggggagttagatatttacagaaggcaatcatgaagctagacatcgagcaataccggatggtgaaggaggctctgcacgagagagccaatcttctagaaattgcacctcatctttccgcacccctgccaattatgctgccagtctacaagtggtggcagcttccctactactgggtggggattaagctgtatgacttagtggctggttcaaactgtcttaagtcaagttacgtgctgagcaagagtagggcccttgagcactttcccatgctgcagaaggataagttagtgggagcaatagtctactacgatggacagcacaatgatgcacggatgaatttggccatcgctctgaccgctgccagatacggtgccgccaccgcgaactacatggaggtggtttccctcttgaaaaagaccgaccctcagactggtaaagtcagagtgtctggggccagatgtaaagatgtattgactggtcaggagtttgacgtcagggcaaaatgcgtgattaacgccaccgggccttttaccgactctgtccgtaagatggacgacaaggacgccgccgcgatctgtcagccatctgccggggtccatatcgtgatgcccggttattattcacctgaaagcatgggcctactggatccagccacctccgacggtcgcgttatctttttccttccctggcagaagatgaccatagctggtacaacggatacccctaccgatgttactcatcatcccatcccatctgaagaggatattaactttatcttgaatgaggtctag

SEQ ID NO: 15342 - DNA, 1263 bp, Artificial Sequence
  Description of Artificial Sequence: Synthetic coding sequence
atgtccggtaggccccgcacgacgtcttttgccgagagctgcaagccagtgcagcagcctagcgcttttggctccatgaaggtgtccagggataaagacggctcaaaagtgacaacagtcgttgccactcccggtcagggccctgaccgcccacaggaagtttcttacacagatactaaagtcattggcaatggctcctttggggtcgtctaccaagctaaactgtgtgattccggggagctggtggctatcaaaaaagtgttgcaggataagaggtttaagaacagagagctgcaaatcatgcggaaattagaccattgcaatatcgtgcgtctgcgttacttcttctactctagcggtgagaagaaggacgaggtgtacctgaatttggtactcgactacgtacctgaaaccgtgtaccgagtggcccggcactatagccgggccaaacagaccctacctgtaatatacgttaagctgtacatgtatcagctgttccgtagtttagcatacattcattcttttgggatttgccatcgcgatattaagccccaaaatctactgctcgaccccgataccgctgtgctcaagctgtgcgattttggctccgctaaacagctggtgcgtggcgagcccaacgtctcatatatatgcagtaggtactatcgggccccagaactcatcttcggcgccaccgactatactagctccattgacgtgtggagtgccgggtgcgttctggccgagctattgctggggcagcctatcttcccgggagactctggggtcgaccaactggtggagatcattaaagtgctgggtacgccaaccagggagcagatcagagagatgaaccctaactatacggaattcaaatttccccaaatcaaggcccacccatggactaaagtgtttcggccaagaactccccctgaggccattgctttgtgcagtcgactgctagaatacaccccaaccgccaggcttacccccctggaggcctgcgcacattcattctttgacgagttgagggaccccaacgtcaagttgccgaacggacgcgatacccccgccctttttaacttcacgacgcaggagctgtcctcgaatccccccctggcgactatcctgatcccaccccacgcacgtattcaagctgccgcctctacacctaccaatgcaacggccgccagcgatgcaaacaccggagaccgaggacagaccaacaacgcagcttcagcaagtgcaagcaactctacctag

SEQ ID NO: 15343 - DNA, 1302 bp, Artificial Sequence
  Description of Artificial Sequence: Synthetic coding sequence
atgtccggtcgaccccgaacaacgagcttcgccgagtcatgcaagccagtccagcagccttctgcattcgggtcaatgaaggtctccagagataaagacggaagcaaagttaccaccgtcgtggccaccccaggacagggtcccgataggcctcaggaggtcagctacacagacaccaaggtgatcggcaacggttcctttggggtggtgtaccaggcgaagctgtgtgatagcggcgagctagttgccattaagaaagtcctgcaggataagcgcttcaagaaccgggagttgcaaattatgcggaagctggatcactgtaatatcgttagactcagatattttttctacagtagcggtgagaaaaaagacgaggtttatctgaatctggtgttggattacgtgcctgagaccgtgtatcgtgtggcacgccactactctagagccaaacagacgttaccggttatttatgttaaactttacatgtaccagcttttcagaagcctggcctacattcactcgtttggaatatgccaccgcgacatcaagccccagaacttattgttggatcccgacaccgccgtattaaagttgtgtgatttcggaagcgcgaaacagcttgtgcgcggggaaccaaatgtaagttacatctgctctaggtactatcgggcaccggaactaatatttggagcaactgactacacctcctccatcgatgtatggagcgctggctgcgtgctcgccgagttgttgctgggacagcctatcttccccggagattctggtgtcgatcaactggtcgagataatcaaagtattggggacgccaacacgagaacagatccgcgagatgaatccaaattacactgagttcaaattcccgcagataaaggcccacccttggaccaaagattcatctggcacaggccattttacttccggcgtgagggttttcagacctaggacacctcctgaggccattgccctgtgtagcaggttattggagtacacacccacagccagactgacacccctcgaggcgtgcgcccattccttctttgacgagctcagagatccaaacgtgaagctccccaatgggagagatacgccggccctgtttaattttacaacacaggagttatcatccaatccgcctctcgccaccatactgataccacctcacgcaagaattcaggcagctgcatccaccccaactaacgcaacagccgcaagtgatgccaatacaggcgataggggccagacaaataatgcagccagcgcatctgctagcaatagcacttag

SEQ ID NO: 15344 - DNA, 315 bp, Artificial Sequence
  Description of Artificial Sequence: Synthetic coding sequence
atgaatcccaattatactgagttcaaatttccacagatcaaagcacatccttggaccaaggtcttcaggccacgtacccccccagaggctatcgccctatgctccagattgctggaatatactcctaccgccaggctcactccactcgaggcctgcgcccactccttcttcgacgaactgcgggacccaaacgtcaagctgcccaatggcagggacacccctgcgttgtttaactttactacacaggatgcaaatactggagacagggggcagacgaacaatgccgcctcagcttccgcgagcaatagtacctag

SEQ ID NO: 15345 - DNA, 837 bp, Artificial Sequence
  Description of Artificial Sequence: Synthetic coding sequence
atggaagaaaacatggaagagggacaaacacaaaaggggtgcttcgagtgttgtattaaatgcctcggagggatcccatacgcgagtctgattgctaccatccttttatacgccggggtagccttattctgcgggtgcggacacgaggccttgtccggaacggtaaatatcctccagacatatttcgaaatggcccggaccgccggtgacacactcgacgtgtttactatgatagacatatttaagtacgttatatatggcatagccgcagctttcttcgtgtacggcattctgctgatggtggagggattctttaccacaggtgccattaaggatttgtacggagacttcaagatcaccacctgcgggcggtgcgtctccgcttggtttattatgctgacctacttatttatgcttgcctggctcggagttacagctttcacgtccttgccagtttatatgtatttcaacctctggaccatatgcaggaacactactctggttgagggcgccaatctgtgtctggatctcagacaattcggcattgtgactataggagaagagaagaagatctgtaccgtgagtgaaaactttctaagaatgtgtgagtccaccgaacttaacatgacgtttcacctgttcattgtagcgctcgctggagctggtgctgccgtgatcgccatggttcactacctgatggtgctttctgcaaattgggcctacgttaaggatgcctgtcgaatgcagaagtatgaagacattaaaagtaaggaggaacaagagcttcacgatattcactccaccagatccaaagagcggctgaatgcctacacttag

SEQ ID NO: 15346 - DNA, 837 bp, Artificial Sequence
  Description of Artificial Sequence: Synthetic coding sequence
atggaggaaaacatggaagagggacagacccagaagggatgttttgagtgttgcattaagtgtttgggcggcatcccatatgcctccctgatcgccaccatactcttgtacgccggcgtggccctattctgcggatgtgggcatgaggcgttatcgggtaccgtgaatatcctgcagacctacttcgagatggcgcgtaccgctggagacacgttggacgttttcactatgattgacatcttcaagtacgtgatctatgggatcgcagccgctttttttgtttatggcattttactcatggtcgagggattttttactaccggtgccatcaaggacctttatggtgactttaagatcacaacatgcgggcgctgcgtcagtgcttggttcatcatgctgacctacctctttatgctggcctggttaggcgttacagcattcacctccctgcccgtatacatgtacttcaatttgtggacaatttgccggaataccactttagttgaaggcgctaatttgtgtctggatctgaggcaatttggaatagtgacaataggggaagagaagaagatttgcacggtctccgagaactttctgaggatgtgtgaaagtaccgaactgaacatgacttttcacctttttattgtggcacttgccggcgcgggagcagctgtgattgctatggtccactatctgatggtgttgtccgctaactgggcctacgtcaaggacgcctgccgcatgcagaaatatgaagacatcaagtccaaggaagagcaagagctgcatgatattcattcgacgcgctccaaggagcgactgaacgcctacacttag

SEQ ID NO: 15347 - DNA, 33 bp, Artificial Sequence
  Description of Artificial Sequence: Synthetic coding sequence
atggaagagaacatggaggagggccagacatag

SEQ ID NO: 15348 - DNA, 804 bp, Artificial Sequence
  Description of Artificial Sequence: Synthetic coding sequence
atggggtgcttcgagtgctgtattaagtgccttgggggtatcccctacgcttctttgatcgctacaatccttctgtacgctggggtggcgctcttctgcggctgtggacatgaagccctgtccggaaccgtcaatattctccagacctacttcgaaatggctcgcactgccggcgacacactggacgtctttaccatgatcgacatcttcaaatacgtaatctacgggattgctgctgcctttttcgtgtatggaatcctgctaatggtggagggatttttcacaacaggtgccatcaaggacttgtatggtgatttcaagattacaacttgcggaaggtgtgtatccgcttggtttatcatgctgacatatctgtttatgctcgcctggctgggtgtgactgccttcacaagccttcctgtgtacatgtacttcaatctctggacgatctgccgaaacacaactcttgttgagggtgccaatttgtgtcttgatcttaggcaattcgggattgttacaattggcgaagaaaaaaagatctgtaccgtgagtgaaaacttcttgagaatgtgcgaaagcactgagcttaacatgacatttcacctgttcatcgtggcactggccggggcaggggcggctgtgattgccatggtgcattatctcatggtcctgtccgcaaattgggcatacgtgaaggacgcttgtcgcatgcagaagtacgaggatataaagtcaaaagaagagcaggagctccacgacatccattctacaaggtccaaagagcgtctcaacgcctacacatag

SEQ ID NO: 15349 - DNA, 390 bp, Artificial Sequence
  Description of Artificial Sequence: Synthetic coding sequence
atggaagaaaacatggaagagggacagacacaaaagggatgcttcgaatgctgcataaaatgtctgggagggataccttacgcgtcattgattgcaacaattttactctatgcgggtgttgccctcttttgcggatgtggacatgaagccctctccgggaccgtcaatatccttcaaacatactttgaaatggcccggacagccggcgacactttggatgttttcactatgatcgatatattcaagtacgttatatatggcattgccgccgcatttttcgtttacggaatcctcctcatggtagagggcttcttcactacaggtgccataaaagatctgtacggcgatttcaagataacgacctgtgggcgctgcgtgtccgcttggtag

SEQ ID NO: 15350 - DNA, 816 bp, Artificial Sequence
  Description of Artificial Sequence: Synthetic coding sequence
atgactgatcttgagggctgctttgaatgttgtataaagtgtctcggcggcatcccttatgccagcctgatcgcaactattctgttatacgccggggtggcgttattttgcgggtgtggccatgaggccctgagcgggaccgtgaacatcctacaaacctattttgaaatggcccgtactgctggtgatactttggatgtgttcaccatgatcgatatcttcaagtatgttatctacgggatagccgcggcattttttgtctacgggattctcctcatggttgagggatttttcaccacaggggccatcaaagatctgtacggcgatttcaagattaccacatgcgggcgttgcgtgtcagcctggtttatcatgctgacatacctgttcatgctggcctggcttggcgtgaccgcatttacctccctgccagtgtacatgtactttaacctttggacaatctgtcggaatacaacactggtcgagggcgccaacctctgcctggacctcaggcagttcgggattgtgaccatcggagaagaaaagaagatctgcaccgtcagcgagaactttctgcgcatgtgcgaaagcacggaactgaatatgacctttcacctgtttattgtggccttggcaggcgctggggctgccgtgatcgcgatggtccattacctaatggtgttgtccgcgaattgggcctacgtgaaagacgcgtgtcgtatgcagaagtacgaggacatcaaatcaaaagaagaacaggagctccatgacattcactcaacgagaagtaaagaaaggctgaacgcttacacctag

SEQ ID NO: 15351 - DNA, 1206 bp, Artificial Sequence
  Description of Artificial Sequence: Synthetic coding sequence
atgatgggacttggaaatggtaggcgaagcatgaagagtcctccactcgttctggcggctctagtggcgtgtatcatcgtcctggggttcaactactggattgcaagctcacgaagcgttgatttacaaacgcgtatcatggagttagaggggcgggtgaggagggcagcagctgagcgaggagccgtcgaactgaaaaaaaatgaatttcaaggggaacttgagaaacagcgcgagcagctggataagatccagtccagccataacttccagctagagtcagttaataagctgtaccaggacgagaaagcggtcctcgttaataatataacaacaggcgaaaggctgatcagagtgctgcaggaccaactgaagactcttcagagaaattacggacgattgcaacaggatgtcctccagtttcaaaagaatcagaccaaccttgaacggaagttcagctacgatctcagccagtgtatcaaccagatgaaggaggtaaaggagcagtgcgaggagaggatcgaagaggtgacgaagaaaggtaatgaagctgtagcttccagagacctgtccgagaacaacgaccagaggcaacaactgcaagcgctctcggagccgcagccccggttgcaagctgcagggctgccgcacaccgaggttccccaagggaagggaaacgtgttgggaaacagtaagagccagactccagctccctcctcagaagtcgtgttggacagcaagcggcaagtggaaaaagaggaaacaaatgagatccaggtggtgaacgaggaaccgcagcgcgaccgcctgccccaggagcctgggagggagcaggtggtggaggaccggccagtggggggacgagggttcggaggtgctggtgagctcgggcagacaccccaggtgcaggcagccctgagtgtgagccaggaaaatcctgaaatggagggccctgagagagaccagttagtcatccctgatggtcaagaggaggagcaggaggctgcgggggaagggcggaatcagcagaaattaagaggggaggacgactacaatatggacgagaacgaagccgagagtgagaccgacaagcaggccgcacttgccggtaatgaccgcaatatcgatgttttcaacgtcgaagaccagaaaagggacacaatcaatctgctagaccagcgggagaagcgcaatcacaccctgtag

SEQ ID NO: 15352 - DNA, 1206 bp, Artificial Sequence
  Description of Artificial Sequence: Synthetic coding sequence
atgatgggactgggtaacggtagaaggagtatgaaaagccctccgcttgtgctggctgcgttagtcgcctgcattattgttctcggcttcaactactggattgcttcttccagatctgttgacctccagacgagaattatggagttagaggggcgggttcgcagggctgccgcagagaggggtgccgttgaactaaagaaaaatgagttccagggtgaactggaaaagcagagagagcagctcgacaagattcaatctagccataattttcagcttgaaagtgttaacaagctgtaccaggatgagaaggcagttctggtgaacaacatcacaactggggaacggttaattcgtgtgctgcaggaccagctgaagaccctacagcgcaactatggcagactgcagcaggacgtgttgcagttccagaagaatcagaccaatcttgagagaaaattttcatacgacctctcacagtgtataaatcaaatgaaggaggttaaagaacagtgcgaggagcggatcgaggaggtaactaaaaaggggaatgaggccgtagcatctcgtgatctgtccgagaacaatgaccaacgccagcagctgcaggcactgtctgaaccccagccgcgcctccaggccgccgggcttcctcacactgaagtcccccagggaaaagggaacgtgctggggaactctaaatcccagacaccggccccatcttccgaagtcgtgctagatagtaaacgccaggtagagaaagaagaaactaatgagattcaggtagtgaatgaagaaccacaacgtgacaggttaccacaagagcccggccgcgagcaagtggtggaggataggcccgtcggtggacgtggtttcggtggcgctggagagctcgggcaaaccccacaggttcaggctgcactgtctgtctctcaggaaaatcctgagatggagggtccggaaagagaccagctcgtgatcccggacgggcaggaagaagagcaggaagccgctggcgaagggagaaatcagcagaaactgagaggcgaggacgattacaacatggacgagaatgaagccgagtccgaaactgataaacaggccgctctggcaggcaacgaccgcaacatcgatgtgttcaatgttgaagaccagaagcgtgatacgatcaacctcttagatcagcgagagaagagaaatcacaccctgtag

SEQ ID NO: 15353 - DNA, 243 bp, Artificial Sequence
  Description of Artificial Sequence: Synthetic coding sequence
atgatgggactgggtaacggcagacggtcaatgaaatccccccctcttgtgttagccgctcttgtggcctgcatcattgttctaggcttcaactattggatcgctagcagtcgctccgttgacctgcagacccgaattatggaactcgagggccgcgtcagaagggcggcagccgagagaggagctgtcgaactgaagaagaatgagttccagggcgaactggaaaagcagcgggaacagtag

SEQ ID NO: 15354 - DNA, 366 bp, Artificial Sequence
  Description of Artificial Sequence: Synthetic coding sequence
atgatggggctggggaatggtcgcaggtccatgaagtccccccccctcgtgctcgctgccctagtagcctgtatcatcgttttaggcttcaattattggatcgccagctctcgcagcgtggacctgcagactagaatcatggagctcgagggacgagtccgacgagcagcggccgagcggggggccgtggagttgaaaaaaaacgagtttcagggggagttagagaagcagagggagcagctggacaagatccagtcttctcacaacttccagttggagagtgtcaacaagctgtaccaggacgagaaagcagtgctggttaataatatcaccacgggagaacgcctgataagggtcttacagtag

SEQ ID NO: 15355 - DNA, 279 bp, Artificial Sequence
  Description of Artificial Sequence: Synthetic coding sequence
atgaagccaatacaaaagttgttggctggcctcattctgttgacatggtgcgtcgagggatgtagcagccagcattggagttacgggctcaggccgggaggcaagcgagacgccgagaatttgattgactctttccaggagatcgtcaaggaggttggtcaattagccgaaactcagcgttttgaatgtacaactcaccaacccaggtctcccttaagggatctcaagggggcacttgagtccctgattgaggaggagactggtcagaagaagatctag

SEQ ID NO: 15356 - DNA, 279 bp, Artificial Sequence
  Description of Artificial Sequence: Synthetic coding sequence
atgaagcctattcagaaactgctggccggcctgattcttctgacttggtgcgtcgagggctgcagtagccagcattggtcctacggccttcgccctggcggcaaacgcgacgcagaaaacttaatcgattccttccaggaaattgtgaaagaagtgggacaattagccgaaacacagagatttgaatgtacaacccaccagcccaggagtcccctcagggacctaaaaggcgcgctggagtcactaatcgaagaggagacgggacagaagaaaatttag

SEQ ID NO: 15357 - DNA, 774 bp, Artificial Sequence
  Description of Artificial Sequence: Synthetic coding sequence
atgcccgcctccatgtttagtatagataacatccttgccgcgaggccacgttgtaaggattccgtactcccagtcgcccattctgcggctgcaccagttgtttttccagctctccacggggattcactgtatggagcaagcggcggtgcatcatccgattatggcgctttttacccaaggccagtcgcccccgggggtgctgggctgcctgcagctgtgtcgggttcacggctgggctacaacaattatttctatggccagcttcacgtccaggcagcacctgttggaccggcttgctgtggtgcagtgccacctcttggagctcaacaatgctcatgtgttccgaccccaccaggctacgagggccctggaagcgtgttggtgtcacccgtcccccaccagatgctcccttatatgaatgtggggactctatcaagaaccgagctccaattactgaatcagttacattgtagacgaaagaggcgccaccgaacaatttttaccgacgagcagctagaggctctggaaaatctcttccaggaaacgaagtatccagacgtcgggacacgagagcagttagctagaaaggttcacctgagggaagaaaaagtggaagtctggttcaagaaccgtcgcgccaaatggagaagacaaaaaaggagctcgtccgaggagtcagagaacgctgagaaatggaataagactagttcaagcaaggcctctcccgaaaaaagagaggaagaaggaaagtctgacctagactcagatagctag

SEQ ID NO: 15358 - DNA, 654 bp, Artificial Sequence
  Description of Artificial Sequence: Synthetic coding sequence
atggcataccctggttatggagggggttttgggaatttttcaatacaggtgcccggcatgcagatgggacagcccgtccccgagactgggcctgctatcctcttggacgggtacagcggaccagcttattcagacacatattcatcagccggggacagtgtgtatacatatttctctgccgtggctggtcaggatggagaggtggacgcagaagagcttcagcgctgccttacgcagtctggcattaacggcacatacagtccgtttagtttagagacctgtcgtattatgatcgcaatgctggacagagaccatactgggaaaatgggatttaatgccttcaaggagctttgggctgcgctcaatgcctggaaggaaaatttcatgacagtagaccaagacggctccggtaccgtggaacaccatgagctgcggcaggcaattggccttatgggataccggctttcaccacagacgttgaccactatagtgaagagatatagtaaaaacggcaggattttttttgacgattacgtagcctgttgcgtcaaactgagagccttgaccgactttttccggaagagagatcacctgcagcaaggatccgctaactttatttacgacgatttcctccagggtaccatggctatttag

SEQ ID NO: 15359 - DNA, 438 bp, Artificial Sequence
  Description of Artificial Sequence: Synthetic coding sequence
atggctacctgggccctgcttctgctggccgccatgttgttgggcaatcctggactggttttcagccgcctttcccctgaatattatgatctggcacgagcccacctgagagatgaggagaagtcgtgtccctgtctggcacaggagggtccacaaggggatctactcacaaagacccaggagctcggcagagactaccgaacatgcctcaccatcgtccagaagctcaagaaaatggtcgacaagcccacgcagcgatcagtgtcgaacgcggcgactcgggtatgccggaccggccgctccaggtggagagacgtgtgtagaaacttcatgagacggtaccagtcccgagtaacacagggtcttgttgccggcgagaccgcccagcagatctgtgaagatttgcgactctgcatcccgtctactggccctctttag

SEQ ID NO: 15360 - DNA, 393 bp, Artificial Sequence
  Description of Artificial Sequence: Synthetic coding sequence
atggaaggcctagtattcagccgcttgagtccagagtattacgatctcgcgcgagcccatctccgtgacgaagagaaatcttgtccatgtctggcacaggagggaccacagggagaccttttaaccaaaactcaggaactgggacgggattatcgaacatgcctgaccattgtgcagaagctaaagaagatggtcgataagcccacgcagcggtccgtttccaatgcagcgacccgggtgtgtcggacaggcagatctcggtggagggacgtatgcaggaacttcatgcggaggtaccagagtagagttacccagggactcgtggctggggagaccgcccagcagatttgtgaggatctgcgactgtgtatcccgtcaactggcccattatag

SEQ ID NO: 15361 - DNA, 555 bp, Artificial Sequence
  Description of Artificial Sequence: Synthetic coding sequence
atgagtagaaccgcctatacagtgggcgctctactgctcctactgggaaccctgctgccagcagccgaggggaagaagaaaggcagccaaggagcaattccacctcccgataaggctcagcacaacgattccgaacagacccaatccccccagcaacccggatctagaaatcgagggcgaggtcagggacggggcacggcaatgcctggcgaggaggtgctggagagctcccaggaggcactccatgttacggagaggaagtacctgaaacgggactggtgcaaaactcagcctctcaaacagaccatccacgaggagggatgcaatagtcgcaccatcatcaaccggttctgttatggacagtgcaactcattttacattccgcgacatatccgaaaagaggaagggtcctttcagtcatgtagcttttgcaaaccgaagaaattcacgactatgatggttacgctgaattgtcccgagctgcagccccctaccaaaaagaagagagttactagagtaaaacagtgccgatgcatttctatcgacttggactag

SEQ ID NO: 15362 - DNA, 432 bp, Artificial Sequence
  Description of Artificial Sequence: Synthetic coding sequence
atgtcccgcaccgcctatactgttggcgcactgctgctgctgctcggtacgctactgcccgctgcagagggaaagaagaagggatcacaaggggctataccgcctccagacaaagccttgcatgtcaccgaacgcaagtacttaaagagagactggtgtaaaacacagccgctcaaacaaaccatccatgaagagggctgcaattcacgtactatcataaatagattctgctatggtcagtgtaacagcttctacatacctaggcatatccggaaggaagagggcagttttcagtcctgttcgttctgcaaacctaaaaagtttacaactatgatggtaacactcaattgcccggaactgcagccacctacaaagaagaagcgtgtcacaagagtaaagcagtgtagatgtatttctatcgatttagactag

SEQ ID NO: 15363 - DNA, 432 bp, Artificial Sequence
  Description of Artificial Sequence: Synthetic coding sequence
atgagtcgtactgcttataccgtcggcgcccttttgctcctgctggggactttgctgccagccgccgagggcaaaaagaagggcagccaaggtgccatccctcctcctgacaaggctcttcatgtcacagagcgaaagtacctgaaacgagactggtgtaaaacccagccactgaagcagactattcacgaggaaggctgcaatagccgaaccatcatcaatcggttctgctatggccagtgcaactcattttatattccgcggcacattagaaaggaggaaggttcttttcagtcatgcagtttctgcaagcctaaaaaatttactaccatgatggtgactctcaattgccccgagctgcagccgcccaccaaaaaaaagcgcgtgacacgagtgaagcaatgtcgctgtatttccatcgacctggactag

SEQ ID NO: 15364 - DNA, 396 bp, Artificial Sequence
  Description of Artificial Sequence: Synthetic coding sequence
atgacccttgaggaattcagcgccggggagcagaagacagaatcggatcccgataacgtcgtcttatgtctactggcggccgacgaggatgacgatagggatgtagcacttcagattcactttacgcttatccaggcattttgttgcgaaaatgacatcaacattctcagagtgtcaaacccaggtcgcctggcggaactgcttctcttagagaccgacgcaggcccagcggcgagcgagggcgctgaacagcctcctgatctgcactgtgtgctggttactaacccacattctagccagtggaaggacccagccctctcgcagctcatatgtttctgccgtgaatcaagatatatggaccagtgggtgccggtgattaacctgcccgaacggtag

SEQ ID NO: 15365 - DNA, 498 bp, Artificial Sequence
  Description of Artificial Sequence: Synthetic coding sequence
atgaccctggaggagttctctgcaggtgagcaaaagaccgaacgaatggacaaggtcggtgatgctctggaggaggttctttcaaaagcccttagccagcggacaataaccgtcggcgtgtacgaggctgccaagctccttaatgtagatcccgataatgttgtgctttgtttacttgccgcagacgaggatgacgacagggatgttgcactgcagatccactttacacttattcaggcgttttgctgtgaaaacgatataaatatactgagagtgagcaatcccggacgtctggcagaactccttctcctcgaaacggacgctggccctgcagcctcggagggagcagagcagccacccgatttacactgtgtattggtaacaaaccctcacagcagccagtggaaggacccagctctgtctcaactcatttgcttttgccgtgaatcgagatatatggaccagtgggtgccagtgatcaatctccccgaaagatag

SEQ ID NO: 15366 - DNA, 3693 bp, Artificial Sequence
  Description of Artificial Sequence: Synthetic coding sequence
atgtcagctctttgctggggccggggggccgccggcttgaaaagggctttgcggccatgcggccgccctggactacctgggaaagagggcacagccggcggagtttgcggccctaggcggtcttctagtgctagtcctcaggaacaggatcaggatcgcaggaaagactgggggcacgtggaactgctggaagttctgcaggcacgtgttagacaactgcaggcggagagcgtgtcagaggtcgtcgtgaacagggtagatgtcgcgcgattgcccgaatgtggtagcggagacggaagcttacagcctcccaggaaggtccagatgggagccaaagacgctacccccgtcccctgcgggaggtgggccaaaattctggaaaaggacaagcggacccagcaaatgcgcatgcaacgtctaaaggccaagctccaaatgcccttccagtcaggcgagttcaaggcgttgactcgccggctgcaggtcgagccacgtctcctgagcaagcagatggcaggatgcctggaggattgcaccagacaggctccagaatcaccgtgggaggaacagctggctcggctccttcaggaggcccccgggaagctcagcctagacgtggagcaggccccatcaggtcagcatagtcaggcgcaactttctggacaacagcagcgcctcctcgctttttttaagtgctgcttactcaccgatcagctgcctctagcccaccacctcttggtggtgcatcatggccagagacaaaagagaaagctgctgaccttggacatgtataacgctgtgatgcttggttgggcccggcaaggcgctttcaaggaactggtgtacgtgctgtttatggttaaggatgcaggattgactccggacctgttgtcatacgctgccgctctacagtgcatgggccggcaagaccaagatgccgggactattgagcgatgcttagaacaaatgagccaggaaggcctgaagttgcaagccctgtttaccgcagtgctgttgtcagaggaggaccgtgctaccgttcttaaagcagttcacaaggtgaaacctactttcagtctgccgccccagttgccgccgccagttaacacatcgaaacttctgcgtgacgtgtacgctaaggacgggcgggttagctaccccaaattgcaccttcctctgaaaaccttgcagtgtctcttcgagaagcaactacacatggaattggcaagcagggtgtgtgtggtcagcgtagagaagcctacactcccttcgaaagaggtgaaacatgcgcggaaaacactcaaaactctccgagatcagtgggagaaggccttatgcagggctctgagagagaccaaaaaccgactcgagcgcgaggtttacgagggaagattctcactgtatccgtttctgtgtctgctggacgaacgcgaagttgttagaatgctgcttcaggtgctccaggcactgccagctcagggcgagagctttacaactctagccagggagctctcagcccggactttcagtaggcatgtcgtgcagagacaacgcgtctccggtcaagtgcaggcactgcagaaccattatcggaagtacctgtgtcttctcgcctctgatgccgaagtgcctgaaccctgtctgcctcggcagtattgggaagaacttggcgcccccgaagcacttcgagagcagccttggccgctccccgtgcagatggaactgggaaaattgctcgcggagatgctggtgcaggccacgcaaatgccttgttctctggacaaacctcaccggagttctcgcctggttccggtgctgtaccatgtttattctttccgaaatgtccagcagattggcatcctcaaaccacacccggcctacgttcaactactggagaaggccgcagagccaactctgacattcgaggccgtagatgtgcctatgttgtgccctcctctcccctggacttctcctcatagcggcgcctttctgttgtctccaaccaaactgatgagaaccgttgagggcgcaacgcagcaccaggagttactggaaacatgccctcctacagcactgcatggagcccttgacgcgcttacgcagctgggcaattgtgcctggagggtgaatggcagggtattggatctggtactccagctattccaggccaaggggtgtccacaactcggggtgcccgccccaccttcagaggccccccaacctcctgaggcccacttgccgcattctgctgccccagccagaaaggccgagcttagacgggagctggcccattgccagaaagtggcgagagaaatgcattcactgcgcgctgaggcgctatatcgcctgtctctcgcccaacacctgcgggatagagtgttctggctgccccacaatatggactttcgaggtaggacctatccctgccccccacattttaatcatcttggatccgatgttgcgcgggcattgttggaattcgcccaaggccgaccccttggcccccacggtctggattggctcaagattcacttggtcaatctgacggggctgaagaagcgggagcccctcaggaagcggctggctttcgctgaagaggttatggacgatatactagactctgcagaccagccccttaccggcagaaaatggtggatgggcgctgaggagccttggcaaacactggcttgttgtatggaagtcgccaatgcggtgcgggcctccgatcccgctgcatacgtgagtcatcttcccgtgcatcaggatggtagctgtaacggactgcaacactacgctgcactgggaagagacagcgtcggtgcagcatccgtgaatctggagccatctgatgtgccccaggatgtgtacagtggggtcgcggctcaggtggaagttttcaggagacaggacgctcaaagaggcatgcgtgtggctcaagtgctggaaggatttattacccgcaaagtcgtgaaacagacggtgatgacagtggtctatggcgtcactcgctatggagggcgcctgcaaattgagaagagattacgtgaactttctgactttccccaggaattcgtgtgggaagcctcgcactaccttgtaaggcaggtgttcaagtcgctgcaggagatgttcagcggcacgcgcgcgattcaacattggctgactgaatctgctcggctgatcagtcacatggggagcgtagttgagtgggtcaccccactcggggtcccagtcatccaaccttaccgccttgatagtaaagtgaagcaaatagggggtggcatccagagcattacctacacacataatggggatataagtcggaagcctaatacacggaaacagaagaacggattccctccaaacttcatccacagcttggattctagccacatgatgctcacagctctgcattgctacagaaaggggctgacgtttgtttccgtgcatgattgctattggacacatgccgctgatgtgtcagtgatgaatcaagtttgccgagagcagttcgttcgcttacactctgaaccaatcctgcaggacctcagcaggttcttggtgaagcgattttgcagtgagccccagaaaattctggaggcctcccagctgaaggaaacattgcaggcagtccccaagccaggcgcctttgacctggagcaggttaaacggtcaacatactttttctcctag

SEQ ID NO: 15367 - DNA, 480 bp, Artificial Sequence
  Description of Artificial Sequence: Synthetic coding sequence
atgacactggaggaggtgaggggacaggataccgttcccgagagcactgcaagaatgcagggcgcaggcaaggcattgcacgaactccttttgtccgctcagcggcaggggtgcctgacggcaggggtgtacgagagcgcaaaggtgttgaatgtcgatccagacaatgttacgttttgtgtcctggctgcaggagaagaggacgaaggagacattgctctgcaaattcattttacgttgattcaggccttttgttgcgagaatgatatagacattgttcgcgtaggggatgtgcagagactggcagctatcgtgggagccggcgaagaagccggggcacccggcgacctgcattgcattctgatcagtaatcccaatgaggatgcctggaaagacccagccttagaaaaacttagcctgttctgcgaggaatcgcgatcagtgaatgactgggttcctagcattacactgcccgagtag

SEQ ID NO: 15368 - DNA, 426 bp, Artificial Sequence
  Description of Artificial Sequence: Synthetic coding sequence
atgcagggggctggaaaagcccttcatgaactcctcctgagcgcccagcgccagggctgtcttacggctggagtgtacgaaagtgcgaaagtgctgaatgtggatccggacaacgtgacattctgcgttctcgctgcaggcgaggaagacgagggggacatcgcactccagatacacttcactcttatccaagctttctgctgtgaaaatgacatcgacatcgtcagagtcggcgacgtgcagcggctggccgccatcgttggggcaggcgaagaagcaggcgccccgggcgatctgcattgtattctcatatccaacccaaatgaggatgcttggaaggatcctgctttagagaaactctctctgttctgtgaagaaagccgatcagtgaatgactgggttccttcaatcactctccccgagtag

SEQ ID NO: 15369 - DNA, 2085 bp, Artificial Sequence
  Description of Artificial Sequence: Synthetic coding sequence
atgcagcccgcaatccaggtatggttcggtgaggaccttccgctgagcccacggtcaccactgacgccaagacatggacctggactggccaatgtgtgccaatacgatgaatggattgcagttcgacacgaagccaccctcttgcctatgcaggaggacctgtcaatttggttgagcggcctcctgggcattaaggtcaaggctgagaagttgcttgaagagctcgacaatggagtgctgttgtgccagcttatcgatgtgctgcagaacatggtcaaaacatgcaatagcgaggagtctgggaacttccccatgcgaaaggtaccatgcaaaaaagatgccgcttcggggagttttttcgcccgcgacaacaccgccaatttcctccattggtgtagggacataggcgtcgacgagacgtatttattcgagtcagagggtctcgttctgcacaaggaccccaggcaggtgtatctatgtttgctcgaaatcggccgtatcgtgtctaggtatggcgtagagccgcccgtgctggtcaaactggagaaggagattgagttggaagagacactgctcaataccagtgggcctgaagactccattagcattccaaaatcatgctgtagacatgaagaactgcacgaagccgtgaagcatatcgccgaggaccccccatgtagttgctctcatcggttttctattgagtacttatctgaagggcgctaccggttaggggacaagatcctgtttattcgtatgcttcacgggaagcacgtgatggtacgagtgggaggtggatgggacacgcttcagggatttctattgaagtatgacccatgcaggattctgcaatttgcaactctcgaacagaagattcttgcgttccaaaaaggagtatcaaacgagtcggtgcctgattccccagctcgaacacctcaaccaccagagatgaacccactgtctgcggtgaatatgttccagaagcaaaattcaaaaccatcagtccccgtctctatcccaaaaagcaaagaaaagcagggcagacctccaggagcacttgtgcccgcatcaagcctgaagggtggaaacctgggctctatgtccgtgcggagtaagctgccgaattcacccgcagcctcctcacatcctaaactgaagtctagcaagggtattacaaaaaagccccaagcacctagcaataatgcttcttccagtcttgcttcacttaatcccgtgggcaaaaacacctccagccctgcactgcctcggactgcgccttgtatatcagagtctccaaggaagtgtatcagcagccctaacacccctaaagccaaagtcataccagcccagaacagcgccgacctgcccgagtccactcttctgcccaataagtgttctgggaaaacccagcctaagtacctcaagcataatcatatttcttcgcgtgataacgctgtgagccatttggccgcacactcgaactcctcaagcaagtgtcctaagttgcctaaggccaacatacccgtcaggccaaagcctagctttcaaagcagcgcaaagatgactaaaacatcaagtaaaacaattgccactggcctgggaacccaatcacaacccagtgatggggctccccaggcgaagcccgtgcccgcccagaaactgaaaagtgctctgaatcttaaccagcccgtgtccgtgtcttccgtgtccccggtgaaggcaactcagaagtcaaaagataagaatatcgtgtccgccacaaaaaagcagccccaaaataagtcggccttccagaaaactggtccgtcctcattgaaatcacctggacgcacccccctgtctattgtgagcctcccgcagtctagcacgaagacacaaaccgccccgaaaagcgcccagacggtggctaagagccaacactctacgaagggacctcccaggagtggcaagacccccgcctccatcaggaagccgcccagctctgtgaaggatgctgattctggggacaagaagccaactgctaaaaagaaggaggatgatgaccattacttcgtcatgaccggctcaaagaaacctagaaagtag

SEQ ID NO: 15370 - DNA, 2085 bp, Artificial Sequence
  Description of Artificial Sequence: Synthetic coding sequence
atgcaacccgccattcaggtatggtttggagaagacctgccgctatccccccggtcacctctgaccccccgccacggcccggggctggcaaatgtatgccagtacgatgagtggattgcagtcaggcacgaggcaactctcttgcccatgcaggaggacctgtctatttggctgagcggccttctcggcatcaaggtgaaggctgagaagctactggaagagctggacaatggggtgctgctgtgtcagcttattgatgtgctgcaaaatatggtgaagacttgcaattcagaagaaagcggcaactttccaatgaggaaagtgccctgcaagaaagatgcagccagcggatcctttttcgccagggacaatactgctaattttctccactggtgcagagatatcggcgttgacgagacctacttatttgaatccgaaggtctggttctacacaaggatcccagacaagtctatttgtgcttgctcgagatcggcagaatcgtgtctagatacggagtggagcctcccgtcctggttaagcttgagaaggaaattgaactcgaggagacacttctgaatacttcaggaccagaagattcaattagcattcccaagtcatgttgtcgccatgaggaacttcacgaagccgtgaagcacatcgccgaagatccaccgtgtagttgttcccatcgcttcagtatcgagtatttatctgagggccggtatcggctgggggacaagatactgtttatcaggatgctacacggcaaacacgtgatggtccgtgtgggcggcggttgggacacgctgcagggctttttgctcaagtacgatccttgccgcatactgcagtttgcgacgcttgaacagaagatcttggccttccagaaaggtgtctccaacgagtctgttccggactcccccgcaaggactccacagccccctgaaatgaatcctctgagtgcggtcaacatgttccagaaacagaattccaagccgtccgtccctgtgtctatccccaagtccaaggaaaagcagggcaggcccccaggtgctttagtgccagctagcagtctgaaagggggaaacctgggttccatgagcgtccgctcgaaactcccaaactcacccgctgcctcctcacaccccaagctcaaaagtagtaaaggcattaccaaaaaaccccaggcaccgagcaataatgcaagctctagtctcgcctctttaaatcctgtggggaagaacacatcctctcctgccttaccccgcacagcgccctgcatcagcgaatccccaaggaaatgcatcagcagtccgaacacccctaaggcaaaagttatcccagcccaaaatagcgccgatcttccagagtccaccttgctgcctaataagtgttccggaaaaactcagcccaagtacctcaagcacaaccatatatcttctcgagataacgctgttagccacctggccgcgcattctaactccagcagcaagtgccctaagttgcccaaggccaatatcccggtgcggccgaaaccgtccttccaatcctcagcgaagatgacaaagacctcttccaagacaatagcaaccgggctaggaactcagagccagccttcagacggcgcaccacaggctaagcctgtgccagcacagaagttgaaatctgcactgaaccttaaccagcctgttagcgtaagcagtgtgtcacctgttaaggccacgcagaaatcgaaggataaaaacattgtgtctgccactaagaaacaaccccagaataagtctgcctttcagaagactggaccttcatccctaaaaagcccgggacgaacccctctgtcgattgttagtctgccacagtctagcactaaaacgcagactgcgccgaagagcgcgcagaccgtcgctaagtctcagcacagcaccaagggcccccctcgaagcggaaaaacccccgctagcataagaaagccaccatcttccgtaaaggacgccgattctggcgataagaaacctacagctaagaagaaggaggacgacgaccactactttgtgatgacaggttctaagaaacctaggaagtag

SEQ ID NO: 15371 - DNA, 2085 bp, Artificial Sequence
  Description of Artificial Sequence: Synthetic coding sequence
atgcagccagccatccaggtttggtttggagaggacctgcctttgagcccacggagtcctctgacaccccggcatggtccaggcctggcaaatgtgtgccagtatgatgaatggattgccgtcaggcacgaagccaccctgctgcctatgcaggaagatctgagcatctggctgtctgggttgctcggcattaaagtgaaagccgaaaaactgctggaggagctcgacaacggggttctgctgtgtcagctcatcgacgtcctccagaatatggtgaagacctgtaatagcgaagagagtgggaacttcccgatgcggaaagttccttgtaaaaaagacgccgcttcggggagcttcttcgcgcgagacaatactgctaacttcctgcattggtgccgcgatataggcgtcgacgagacatatctatttgagtcggaaggtctggtcctgcataaagaccctagacaggtctatctgtgtttgctggaaatcggacggatcgtatctcggtatggggtggaaccacccgtcctggtaaagcttgagaaagagatagaactggaggagactctcctgaacacatctggacctgaggatagcatctccatcccaaagagctgctgccggcatgaggaactgcatgaagccgtcaagcacatcgcagaggatcctccctgctcctgctcccatcggtttagcatcgaatacctgagcgaggggaggtaccgcctgggcgataagattttatttattcgaatgcttcacggcaaacacgtcatggtgagagtgggaggtgggtgggacacgctgcagggcttcctgttgaaatacgacccctgtaggattctccagttcgcaaccttggagcagaagatcctggcctttcaaaaaggggtgtctaatgagtcggtccctgattcccctgcacgaacccctcagccccccgaaatgaatccactgtctgccgtgaacatgttccaaaagcagaactcgaagccctcagtgccggtctcaatccctaagtctaaagagaagcaaggacggccacccggcgccttggtgccagcatcgagtttgaaaggaggaaatctaggttctatgtctgtcaggagcaagctgccaaacagtcccgctgctagtagccaccccaagctcaagagttccaagggaatcacaaagaagccccaggcacccagcaataacgcatcctcatccctagcaagccttaaccccgtaggaaagaacaccagttcccctgccctcccacgtaccgcaccctgcatctctgaatcccctcgcaaatgcatttcctcacccaacacacctaaagccaaagtgattcccgcacagaactcagccgatttgcccgaaagtacactgcttcctaacaaatgtagtggtaagacccaacccaaataccttaaacacaaccacataagttcccgcgataatgcggtgagccatttagctgcccactctaacagctcttcgaagtgcccaaagctccccaaagccaatattccagtcaggcccaaaccttctttccagtctagtgcgaaaatgaccaaaacttcttctaaaacaatcgcgaccggcctgggaacccagagccagcctagcgatggggcaccacaagcaaaaccagtccctgcacaaaagctgaaatctgcgcttaatctgaatcagccggtgagcgttagtagcgtgagccccgtaaaggccacacagaagtctaaggataaaaatatcgtcagtgcgactaaaaagcagccccagaacaaatctgccttccagaaaaccggaccatcttccctgaagagcccgggacgaactccgctgtctattgtgtcccttccacaatcttctacaaagacgcagacggcccctaagtccgcacagacagttgctaagagccagcactcgacaaagggcccccccagaagcggcaagactccggccagtatcagaaagcccccttcttccgtgaaggacgctgacagcggtgataagaagccaaccgcgaagaaaaaggaggatgacgaccattactttgttatgacagggtctaaaaaaccaagaaagtag

SEQ ID NO: 15372 - DNA, 150 bp, Artificial Sequence
  Description of Artificial Sequence: Synthetic coding sequence
atgcagccagccatccaggtctggttcggagaggatctcccactgagccctcgcagccccttgactcctaggcacgggcctgggctcgcgaacgtctgtcagtacgatgagtggatcgccgttagacatgaggctaccctcctaccctag

SEQ ID NO: 15373 - DNA, 1611 bp, Artificial Sequence
  Description of Artificial Sequence: Synthetic coding sequence
atgaatgcaagcctggaaagcttgtattccgcctgctctatgcagtccgacaccgtgccattgctgcagaatggtcagcacgcccggtctcagccacgcgcatcaggtcctcctcgcagtatccagccacaggtcagtccacgccagcgggtgcagaggtctcagccggtccacattctggctgtgcgtcgcctgcaggaggaagatcagcaattccgcacatccagcttacctgcgatcccgaaccctttcccagagctgtgtggacctggctcccccccagttctcacccctgggtctcttccccccagccaggctgccgcgaagcaggatgtgaaggtgttttccgaggacggaacaagcaaagttgtagagatcctggccgatatgacggcccgagacctgtgccaactgctggtttacaagtcacactgcgttgatgacaactcatggacactggtggagcaccacccacacctggggctcgagaggtgcttagaggaccatgaactggttgtgcaggtggagagcaccatggcctccgagtctaagtttttattccggaagaactatgccaagtatgagttttttaagaaccccatgaacttcttccctgagcagatggtaacttggtgccagcaatcaaacggcagtcaaactcagctccttcagaatttcttgaactctagttcttgtccagagatacagggtttcctgcacgttaaggaactcggaaagaagtcttggaagaagttgtatgtttgtctccgcaggtctggtctgtattgtagtaccaaagggactagtaaagagcctaggcacctgcagctcctggccgacctggaggacagcaatatcttctcgctgatcgcaggtcggaaacaatataacgccccaacagaccacggtttatgtatcaagcctaacaaagtcaggaacgaaaccaaggagctgcgactgctgtgcgcagaggacgaacagactcgcacttgctggatgactgcctttaggctcctgaagtacggaatgttgctttaccaaaattatcgaataccccaacagcggaaagctctgcttagccccttcagtacacccgtgcggtctgtatctgaaaactcattggtcgccatggacttcagcggacagaccggccgggtaatcgagaatcctgctgaagcccaatcagcggccctcgaagaaggacatgcctggagaaagagatccacccgcatgaacatccttgggtcccagtcccccttgcaccccagcaccttgagcaccgtcattcatcgaacacaacattggtttcacggcagaatcagtagagaggagagccacaggatcattaaacaacagggcctggtggacggcctctttctgctgcgtgactcccagagcaacccgaaggcctttgtgctgaccctctgtcatcaccagaaaatcaagaacttccagattcttccatgcgaagacgacgggcagaccttcttttctcttgatgacgggaacaccaaattctccgatttaattcaattggtggatttctaccagctgaacaaaggagtgctgccttgcaaacttaaacatcactgcatccgcgtggctctttag

SEQ ID NO: 15374 - DNA, 1647 bp, Artificial Sequence
  Description of Artificial Sequence: Synthetic coding sequence
atggcgttggcaggatgtccggactcattcctgcaccacccatattaccaggacaaggtagagcagactcctcggagtcagcaggatcccgcaggtccaggacttcctgcgcagtctgacagattggcaaatcaccaggaagacgatgtcgacctggaagctctcgtgaacgacatgaacgccagtctggaaagtctctacagtgcatgcagtatgcaatccgacaccgttcccctcttgcagaatggtcagcacgccagatcacaaccaagagcaagcggacctccaagatccattcagccccaggtgagcccccgccagagggtgcagaggtcccaacctgtgcatatcctggcagtgagacggctgcaggaggaagaccagcagtttaggacctcgagcctgcctgccattccaaatccttttccggagttgtgcgggcctgggagtccccctgtcctgacgcccggcagcttgccccccagccaagccgccgctaaacaggacgtgaaagtgtttagcgaagatgggacgtccaaagtcgtcgagattctcgcagacatgactgctagggacctctgtcagctgctggtgtacaaatctcactgtgtggacgataattcttggacacttgtggaacatcacccacatttaggattagaaaggtgcctagaagatcacgagctggttgtccaggtagagagtaccatggccagtgaaagtaaatttctgtttcgcaagaactatgcaaaatatgagttcttcaagaaccccatgaacttttttccagagcaaatggtgacctggtgccagcagtctaacggcagtcaaactcaattgcttcaggagcccaggcatctgcaactgctggcagacctggaggactcaaacatcttctccctgatcgccgggaggaagcagtataacgcccctactgatcacggcctctgtatcaagcccaacaaagtcaggaatgagactaaggagctacgcctgctctgcgccgaagacgaacagacgcgcacctgctggatgacagcatttagattactgaagtacggtatgctgctctaccagaattaccgaataccacagcagcgtaaggcactgctcagcccctttagtactcctgtcaggagtgtgtctgagaacagtctcgtggctatggacttcagcgggcagaccggacgcgttatcgagaacccagctgaggctcaaagtgccgcactagaggaggggcacgcatggaggaagcgctccacccgaatgaacatactggggtcacagtctcctttacacccttcgacactcagtacagtgattcatagaacccagcattggttccacggcagaataagtagagaagagtcccatcggatcatcaaacagcagggactcgtggacgggctctttttactgcgggattctcagagcaacccaaaggctttcgtgttaaccctctgccatcatcagaagatcaaaaacttccagatactgccctgtgaggatgatggacagactttctttagtctcgacgatgggaacactaagttttccgacttgattcagctcgtcgatttttatcagctaaacaagggggtgttgccatgcaagctgaagcaccactgtatcagggtcgcactctag

SEQ ID NO: 15375 - DNA, 381 bp, Artificial Sequence
  Description of Artificial Sequence: Synthetic coding sequence
atgaatattctgggatcacagtctcccttgcatccctctaccctttcgaccgtgatccatcggacacagcactggtttcacggacggatctcgcgtgaggagagccacaggataatcaagcagcaaggactggtggacggcctcttcctgcttcgggatagccagtctaaccctaaagcttttgtgttaacattgtgccaccaccagaagattaagaatttccaaatcctcccctgtgaggacgacggccagacttttttctctttagacgacggtaataccaaattttctgatcttatccaacttgttgatttttaccagcttaataaaggagttcttccttgtaagctcaaacatcactgtattagggtggctttatag

SEQ ID NO: 15376 - DNA, 1611 bp, Artificial Sequence
  Description of Artificial Sequence: Synthetic coding sequence
atgaatgcctcattagagtcactctatagtgcctgtagtatgcaatcagatactgtgcctctactgcagaacggtcaacacgctaggtctcagccaagggcaagtgggccaccaagaagcattcagccccaggttagcccacggcaacgcgtccagcggtcccagccggtccatatcctagccgtgagacgcctacaggaggaagatcagcagtttagaaccagcagtctgcctgcgattccaaaccccttcccagaactatgcgggccaggatcccctcctgttctcactccagggagtcttccccctagccaagccgccgctaaacaagatgtcaaggtgttttcggaggatgggacaagcaaggtagtggagatcctagccgatatgaccgcaagggacttatgtcagttactcgtatataaatcgcactgtgtggatgacaattcctggactctggtagaacaccatcctcacctgggactggaaagatgcctggaggaccacgagctcgtggttcaggtcgaaagcacaatggcttctgagtccaaatttctctttagaaaaaactatgccaagtatgaattttttaagaatcctatgaattttttcccagagcagatggtaacctggtgtcagcaaagcaacggatcacagacccaacttctgcaaaacttcctgaattcatcttcgtgccctgagatccagggcttcctgcatgttaaggaactcggcaagaagtcatggaaaaaactctatgtctgtctcaggcggtccggattgtattgttctaccaagggtacctctaaggagccacggcacttgcaactgctggctgatttagaggatagcaacatcttttcgctgatagcaggcagaaagcagtataacgcacccaccgaccatggcctctgcataaaacctaataaagtgagaaatgagaccaaagaactccgcctcctatgcgccgaagacgaacagacaaggacttgctggatgactgcttttaggctgctcaagtatggcatgctgctttaccagaactataggatccctcagcagcgcaaagctttactgtcccctttcagcactccggtccgttccgtgtccgagaacagtttggttgcaatggatttttctggccaaactgggcgggtcatcgagaacccagctgaagcacagagtgccgcccttgaagaggggcacgcatggcgcaagaggtccactcggatgaacatcctgggttcacaatccccactacacccatcgactctgtcaaccgttattcacaggacccagcactggtttcatgggcgtatttctcgcgaggaaagccaccgtatcataaagcagcaggggcttgtggatggcctttttctgcttcgggacagtcaaagcaaccctaaagcattcgtgcttacattgtgtcatcaccagaaaattaaaaattttcaaatccttccctgtgaggacgatggccaaacctttttcagcctcgacgacggaaacacaaagttcagtgacctgatccagctcgtggatttttaccagctgaataaaggcgttctgccgtgtaagctgaagcatcactgtattcgggtggcgctgtag

SEQ ID NO: 15377 - DNA, 1785 bp, Artificial Sequence
  Description of Artificial Sequence: Synthetic coding sequence
atggctctggccggatgtccggatagcttccttcaccacccctactatcaggataaggtcgaacagactccacgatcgcagcaagaccctgctggccctgggttacctgctcagagcgaccggctggcaaaccatcaggaagatgatgtagatctggaggctttagtaaatgacatgaatgcctctcttgagtctctttactctgcttgttcgatgcaatccgacactgtgcccctgctgcaaaacggtcagcatgctaggtctcagcctcgggcatccggaccaccgcgaagcatccagccccaggtgagcccgcgccagcgagtacaacgaagccagccggtccacatactggccgtgagaaggctgcaagaggaggaccagcagttcagaacatcttccctccccgcaattcccaatccctttccagagctctgtggacccgggtctcctcctgtgctgacccctgggtccctccctcctagccaggccgccgctaaacaggatgtaaaggtgtttagcgaagacggaacgtccaaggtggtggaaatcctggctgacatgacagcaagagatctgtgccagttgcttgtgtacaagagccactgcgttgacgacaatagctggacactcgtggagcatcacccccacctggggctggaacgctgccttgaggaccatgagcttgtggttcaggtagaaagcactatggctagcgagtctaaatttctatttaggaaaaattacgccaagtacgagttttttaagaatcctatgaatttctttccggaacaaatggtgacatggtgccaacaaagcaatggctcccagacacagcttcttcagaactttctgaatagttcctcgtgtcctgagattcagggctttctacatgtgaaggaactgggcaagaaatcttggaagaagctgtatgtatgcctgcggaggtccggcctgtattgctcaacaaagggcacctctaaggagccgcgccatctgcagctcctggcagatctggaagacagcaatattttttccctaatcgcgggtaggaagcagtataatgctccgacggaccatgggctctgtatcaagccaaataaagtgcgcaatgagacaaaggaactcagactcctctgcgctgaggacgagcagacgcggacctgttggatgactgcctttcgtctcctgaagtacggcatgctgctgtatcagaattataggatccctcagcagcgaaaagcgttgctgagtccattctcaacacccgtcaggagcgtcagtgaaaactcactggtagcaatggactttagcggacagaccggaagagtcatagagaacccagcggaggcacagagcgccgcactggaagaaggacacgcttggcgcaagcgcagcacacggatgaatattctaggctcacagtctccgcttcaccccagcaccctcagtacagtgatccataggacccagcactggttccacgggagaatcagcagagaagaaagtcacagaattattaagcagcagggcctagtggatggattatttcttctccgagattcgcagtccaatccaaaggcctttgttttgaccctgtgccatcaccagaagatcaagaacttccagatcctcccctgcgaggatgacggccagacattcttcagcctggatgatggcaacaccaagtttagtgacctcatccagttggtggacttctaccagttgaataagggggtcctgccatgcaagctgaagcatcattgcattagggtggccctgtag

SEQ ID NO: 15378 - DNA, 1785 bp, Artificial Sequence
  Description of Artificial Sequence: Synthetic coding sequence
atggccctagccggttgtcccgactcttttctgcaccatccatattatcaggacaaggttgaacaaacccctaggtcccaacaggacccagccggtccaggcctccccgcgcaatctgatcggctggctaatcatcaggaggatgatgtagatttggaagctctggtgaacgacatgaacgcctctctggaaagcctatactctgcctgtagtatgcagtccgataccgtacccctcctccagaacggccagcacgcaagaagccagcctcgagcgtccgggcccccccgctctatccagccacaggtgtccccgcgccagcgcgtgcagcgctctcaaccagtacacatcctcgcagtgaggcgcttgcaagaggaggatcagcaatttcgtacctcaagtctgcccgccattccgaacccttttccagagttgtgcggtcctgggagtcctcctgtgctgacccccggatccttgccgccgagccaggccgcagctaagcaggatgtaaaggtattcagcgaggacggaacttccaaagtggtggagatccttgcggatatgaccgcaagggatctgtgtcagctgctggtgtataagagccattgcgtagatgataacagctggactttggtagaacaccacccccatctcggcctggaacgatgcctggaggatcacgaactggtggtccaagtagaaagcacgatggcctcggagtctaaattcctcttccgaaagaactatgccaaatatgaattcttcaagaaccctatgaacttctttccagagcagatggtcacatggtgtcaacagtcaaatgggtcccaaactcagttgctgcagaactttctcaattcgtctagttgtcctgaaatacaggggttcctgcacgtaaaagaactgggcaaaaaatcctggaaaaaactttatgtctgtctgaggcgcagcggcctgtactgcagtaccaagggaacttccaaagaacccagacatctgcagctgttggctgatttagaggacagcaacatttttagtcttattgctggcaggaaacagtacaatgcaccgactgatcatggactgtgcatcaagcctaataaagtgcgcaacgagacaaaggagctcaggctactttgcgctgaggacgaacaaaccaggacttgctggatgacagctttccgcttgctgaaatacggcatgctcttgtaccaaaattatcgcattccccagcagagaaaagctctgttgagtccctttagcacccctgtgcgctctgtgtcagagaactcgcttgtcgctatggacttttcggggcagactggacgcgtcatcgagaatccagctgaggcccagagcgccgcgctggaggagggacacgcatggaggaagcgctccacacggatgaatatactgggatctcagtcaccattgcacccctctacccttagtacagttatccatcgtacgcaacattggttccatgggcggatttcacgagaagagtcacacaggattattaaacagcaaggtctcgtcgatggcctctttctgttacgcgacagccaaagtaatcccaaggctttcgtgttgaccctgtgccaccaccaaaaaatcaaaaacttccagattctgccctgtgaagatgacgggcagactttcttctctctagatgatggcaacacaaaattcagtgatctcatccagttggtcgacttctatcagctgaataagggagtcctgccctgtaagctgaaacatcactgtattagagtggccttatag

SEQ ID NO: 15379 - DNA, 1611 bp, Artificial Sequence
  Description of Artificial Sequence: Synthetic coding sequence
atgaacgccagccttgagtctctctattccgcgtgctctatgcagagcgatactgtgccactgctccagaacggacagcatgcccgatcccaaccacgcgcaagtgggcccccacgctcgatccaaccacaggtgagccccagacagcgtgtgcagcggagtcagcccgtccacatcctggccgtcaggcgcttgcaggaagaggatcagcagtttaggacctcctccctgcctgccatcccaaatccatttcctgaactttgtggccccggaagtcctcctgtgctcactccgggctcactacccccctctcaggctgccgctaaacaggatgtcaaagtgtttagcgaggatggtactagcaaagtggtggagattctggcggacatgaccgcgcgggacctgtgtcagctcctcgtatacaagtctcattgcgtagacgacaattcatggactctggttgaacaccatccccatctggggctcgagagatgcttggaagaccacgaattggtcgtgcaagtcgaaagtacaatggcttccgaatccaaattcctgttccggaagaactacgctaagtacgagttctttaagaatccaatgaactttttcccagaacagatggtaacatggtgccagcagtcgaacgggagtcagactcaacttcttcaaaattttctcaactctagtagctgcccagaaatccagggctttctacacgtgaaagagcttggcaagaagtcatggaaaaagctgtacgtctgcctcagaagaagtggcctctattgcagcaccaaaggcacctctaaggagccccgccatcttcagcttttagcggatctggaggactctaacatatttagtctgatcgctggaaggaagcagtataacgcccctaccgatcatggcctctgcatcaagcccaacaaggtgaggaacgaaacaaaagaacttagactcctgtgtgctgaggacgagcagacccgaacgtgctggatgacagcatttcggctgttaaagtatggcatgctcttgtaccaaaactataggatccctcaacaaagaaaggccctcctgagccctttctcaacgccagtcagaagcgtgagcgagaactccttagtagctatggacttcagcggacagacaggacgcgtgattgagaatccagccgaggcccagtccgcagctctggaagaggggcacgcctggcggaagcgatctacccgtatgaacattcttggatcccagtcccccctgcatccttccacactgagcaccgtgattcatagaactcagcattggttccacggacgcatctcaagggaagaaagtcatcgcatcataaagcaacaaggactggtcgatggactgttcctactccgggactctcagagcaatcccaaggcgtttgtgctcacactatgtcaccaccagaagattaagaattttcagatattgccatgcgaggacgatggacaaacatttttcagcttggacgacggcaacacaaagttctcagatctgatccagttagtcgatttttaccaactgaacaaaggagttctgccatgcaagctgaagcatcattgcatccgcgtggccctctag

SEQ ID NO: 15380 - DNA, 1611 bp, Artificial Sequence
  Description of Artificial Sequence: Synthetic coding sequence
atgaacgcttctctggagtcgctgtactcagcttgctctatgcagagcgatactgtgcccctgctccagaatggccaacacgccagatcccaaccacgtgcctccggtccgcctagatccatccagccccaggttagtcctagacagagggtgcaacggagccagccggtgcacattctggctgtacggcgcctccaggaggaggaccaacagttccgaaccagtagtcttcccgcaatccccaatcctttccctgaactgtgtggccctggcagccccccagtgctgacccctgggagccttccaccatcccaggctgcagccaagcaggacgtcaaagtgttctctgaagacgggaccagtaaggtcgtggaaattctggcagacatgaccgccagggacctttgccaattgcttgtgtataagtcgcattgtgtggacgataatagttggacactcgtggaacaccatccacatcttggcttggaaaggtgtctggaggatcacgaattggtggtccaggtagagagcacaatggcaagcgagtctaaattcttattccgcaagaattacgctaagtacgaatttttcaagaaccctatgaatttctttcctgagcagatggtcacctggtgtcagcagtctaacggatcccaaactcagcttctgcagaattttcttaatagcagcagttgtcctgaaatccagggctttttgcatgtcaaggaactgggcaagaagtcctggaagaagttatatgtatgcctgcggcgatctgggctgtactgttccaccaagggaacgtccaaggaacccagacacctgcagttgctggccgacctcgaggattctaatatatttagccttatagcagggcgcaaacaatataacgcacccactgatcacgggctctgcattaagccgaacaaggtgcgcaacgaaacaaaggaactcagattgctatgtgcggaagacgaacagacgcgcacatgctggatgacggccttcaggctgctaaaatatggaatgttgctgtatcagaactacaggatcccacagcaacgcaaagctctcctgtctccattctccacccccgtgagatctgtcagtgagaactcgctcgtggcgatggactttagcggacagactggaagggttatcgaaaacccagcagaagcccagagtgctgccctcgaggagggacacgcttggcgtaaacgctccactaggatgaatatactgggatcacagagcccactgcacccatctacgctgtctacagtgattcacagaacacaacattggttccacggtagaatatcacgggaggagtcacacagaatcatcaagcagcagggactcgtggacggacttttcctcttgagggatagccagagtaatcccaaagctttcgtgctaacgctctgtcatcatcagaaaattaaaaactttcagattctgccctgcgaggatgatggccagacgttcttttctttggacgacggtaatacaaagttctccgatctcattcagctcgttgatttctaccagttgaacaaaggtgtgttaccctgcaagctgaaacatcattgtatcagagtagccctgtag

SEQ ID NO: 15381 - DNA, 1767 bp, Artificial Sequence
  Description of Artificial Sequence: Synthetic coding sequence
atgcaggctgcaggacccttgtttcgctctaaggataaggtggaacagacacctaggtctcagcaggaccccgccggccctggactcccagctcagtctgataggctcgcaaaccatcaggaggatgacgttgaccttgaagcacttgttaacgatatgaatgccagccttgaatccttgtacagcgcctgctcaatgcagtctgacacagttccccttctgcagaatggacagcatgccaggtcacaacctcgggccagtggcccccccaggtctattcaacctcaagtgtcccctaggcaaagagttcagcgctcccagcctgtgcatatcctcgccgtgaggaggctccaagaagaagaccagcagtttagaacgtcttctcttcctgcaattccaaaccccttcccagaactgtgcggcccgggcagtccaccagtcttaacccccggctctctgcccccctcacaagctgctgccaagcaagatgtaaaggtgttctccgaggacggtactagtaaagttgtggaaattctcgccgacatgactgccagagacctgtgccagctcctcgtctacaaatcccattgcgtggacgataatagctggaccctggtagaacaccacccgcacctaggactggagcggtgcctcgaggaccatgagctggtcgtccaggtggagtctaccatggcttccgaatctaaatttctcttcagaaagaactatgccaagtatgagttctttaagaatccaatgaatttcttccctgagcaaatggtgacctggtgccaacaatctaatggttcccagacacagctcctacaaaacttcctgaactcttcttcatgtcctgagatccaaggatttctccatgtgaaagaactcggtaagaaatcctggaagaaactgtacgtgtgcctgcggaggagcgggttgtattgttctaccaaggggacttccaaagagcctcgacacctgcaactcctggcggacctcgaggattctaatattttctcactgatcgcaggccgaaaacaatataacgctcccactgaccatggcctgtgtattaagcccaacaaggtaagaaacgagactaaggagcttagattgctctgcgctgaggatgaacagacccgaacgtgctggatgacagcctttcggctgctgaaatatggcatgctcctgtaccagaattatcgaattcctcagcagagaaaagccctcctcagccccttctcaacacctgtgcggtctgtcagtgagaatagtctggtggcaatggactttagtgggcagaccgggcgcgtgatcgaaaatcccgctgaggctcagtccgctgccctcgaggaaggccatgcatggcgcaaacgctctaccaggatgaacatcctgggatcgcaaagcccccttcacccttctacattgtccactgtgatacaccgcactcagcactggttccatggcaggatctcacgggaagaatctcacaggattataaagcagcaaggattggttgatggattgttcctactccgggattcacagtcaaaccccaaagcttttgtcttgacactctgtcaccatcagaagattaaaaatttccagatacttccatgtgaagacgacggccagacctttttttctctggacgatggcaacactaaatttagtgaccttattcagctggttgatttctatcagctaaataagggcgtgctgccttgcaaactgaaacaccactgcatccgagtggctttgtag

SEQ ID NO: 15382 - DNA, 1611 bp, Artificial Sequence
  Description of Artificial Sequence: Synthetic coding sequence
atgaatgcaagtttagagtccttgtacagtgcttgttctatgcagagcgacacagttccgttgctgcagaatggacagcatgctcggtcccaaccacgtgcctctgggcctcctcggagcatccaacctcaggtcagcccccgccaaagagtgcagcgatcacagccagtccatatcctggccgtacggagactgcaagaggaggaccaacagttcaggacctcctctctgccagccatccccaatccctttcctgaactgtgtggaccgggatcccctcctgtgctcacaccgggatccttgcccccaagccaagccgccgccaagcaggacgtaaaggtcttttctgaagacggaacaagcaaagtggtagaaatcctcgccgatatgaccgcccgagacctgtgtcagctattggtctataaaagccactgtgtggatgataatagctggaccctggtagaacaccacccacacttgggcctggagcggtgcctggaagatcacgaacttgtcgtgcaggttgagtccacaatggcaagcgagtctaaatttctcttcagaaaaaattacgccaaatacgagtttttcaaaaacccaatgaacttctttcccgagcagatggtgacctggtgccagcagagtaatggcagtcagacacagcttcttcagaacttcctgaatagcagctcatgcccggaaatacagggctttctccacgtcaaagagcttgggaaaaaatcatggaaaaaactctacgtgtgtctgcggagaagtggactatactgttcaacgaaaggaacttccaaagaaccgcggcacctccagctgcttgccgaccttgaggacagtaatatcttttcgctgattgccggaagaaaacagtacaacgccccaaccgatcatggactgtgcataaagcccaataaagttcgaaacgagaccaaagagctgagactcctgtgcgctgaggacgagcaaacccgcacatgttggatgactgccttccggctccttaagtatggcatgctcctgtaccagaattataggatcccacagcagagaaaagccctgctcagtccattctcgacccccgttcggagcgtgagtgagaattctttagtcgccatggacttctcagggcaaaccggccgggtcattgaaaatcctgcagaagcccagtcggcagccctggaagaggggcatgcctggagaaagcgctcaacgcgcatgaacatcctcgggagccagtcccccctgcatccgtcaactctgtccactgtgatacaccggacacagcactggttccatggccgaatcagcagggaagagagtcataggattatcaagcagcagggcctcgtggatggcctgtttctgttgcgggattcccagtcgaatcctaaggcttttgtgctgactctgtgtcaccaccagaaaatcaaaaatttccagatactaccttgcgaggatgacggtcagacatttttctccttagatgatgggaacaccaagtttagcgatctgatacagcttgttgatttctatcagctcaataagggggtcctcccttgcaaactgaaacatcactgtatccgggtggccctatag

SEQ ID NO: 15383 - DNA, 1611 bp, Artificial Sequence
  Description of Artificial Sequence: Synthetic coding sequence
atgaatgcgtcactggagtccttatacagtgcatgctccatgcaaagtgatacagtaccattgctgcagaatgggcagcatgctcgctctcagccacgcgcatccggccctcctcgcagcatccagcctcaggtctctccccgccagcgcgtgcagcgtagccaacccgtccacattctcgccgtgcggagacttcaggaggaggaccaacagttccgaacctctagccttccggccatcccaaaccctttccccgagctgtgtggcccagggtcaccccccgtgctcactccagggtcactgccgccctcacaggctgcagctaagcaggatgtgaaggtcttttctgaggatggcacatcaaaagtggtcgagatcctggccgacatgactgcgcgtgacctttgtcagttgctcgtctataaatcacactgcgtagatgacaactcctggaccctggtggaacatcacccccatctgggacttgagcgctgccttgaggatcacgaacttgtggtgcaggtggagtctactatggccagcgagtccaagttcctgttccggaaaaactatgccaaatacgaattctttaagaaccccatgaacttctttccagagcagatggtgacgtggtgtcagcagtccaacggctcacagacccagctgctccagaattttctgaatagctcctcctgtcccgagatccaaggcttcttacacgtaaaggagcttgggaaaaagtcctggaagaagctttacgtgtgcttaaggcggagtggcctctactgctctacaaaaggcacttccaaagaaccaaggcacctccagttgttggccgacctcgaggacagcaacatattctccctgatcgccggtagaaaacagtataacgcccctacagaccatgggctgtgcattaagcctaacaaagtgcgaaatgagaccaaagagcttaggctgctgtgcgctgaagatgaacagacccggacatgttggatgactgcctttcgtctcttaaagtacggtatgcttctgtatcagaattaccggattcctcagcagagaaaagccttgctcagcccattcagtacccctgtgaggagcgtgagcgaaaactcactagttgcgatggacttttctggacagaccgggcgcgtcattgagaacccggccgaggcccagtcagcagctctcgaggagggacacgcttggaggaagagatctacacggatgaacattcttggctctcagtcgccactgcaccccagcactctcagcacagttatacatcggacccagcactggttccacggccggatcagtagagaggagtcgcacagaattatcaaacaacaggggctcgtggacggactctttttgctgcgagatagccaatccaatccaaaggcttttgtcctcactctgtgccaccaccagaagattaaaaattttcagattctcccatgcgaggacgatggacagacatttttcagcctcgatgacggcaatactaaattctccgatctcatccagctggtggacttctatcaactcaacaaaggagtccttccctgtaagctcaaacaccactgtattcgggtggctttatag

SEQ ID NO: 15384 - DNA, 345 bp, Artificial Sequence
  Description of Artificial Sequence: Synthetic coding sequence
atgcaggcggctggcccccttttcaggtctaaagacaaggtggagcagacccctcggagccagcaggaccccgctggccctggactccccgcccaatcagacaggctagctaatcaccaagaagatgatgtggatcttgaagcactcgtgaacgacatgaatgcttcattagaatccttatactcagcgtgcagtatgcagtccgacacagtgccactacttcagaatggacagcacgccaggtcacagcctcgggcaagcggaccacctaggtcgatccagccgcaagtcagtcctaggcaacgggtccagcggtcccaacccgtacacatcttggcggtatag

SEQ ID NO: 15385 - DNA, 1767 bp, Artificial Sequence
  Description of Artificial Sequence: Synthetic coding sequence
atgcaggcggccgggcccttgttccgatctaaggacaaggtagagcagactccacgctctcagcaggatccagccggcccaggactccctgctcagtctgacaggctagccaatcaccaggaagacgacgtcgacctggaagccctggtcaatgacatgaatgcctcccttgaatccctatattccgcttgttccatgcagagtgataccgtgcccttattgcagaatggacagcatgcaagaagccagcctcgcgctagtggcccccctcgctccatacagccacaggtaagtcctcgtcagcgtgtgcagagatcccagccagtccacatcctggccgtccgtcgactgcaggaagaggaccagcagttccgcacttcctccttgcctgccattccaaacccattccccgaactctgtggcccaggtagtccgccagtcttaactccggggtccttgcctccatcccaggctgccgccaagcaggatgtgaaggtattctctgaagatgggacatctaaagtagtagagatcctcgctgatatgacagcccgagacttgtgccaactgttggtgtacaaaagccattgtgtggacgacaatagttggaccctcgtggaacaccaccctcacctgggcttggagagatgtttggaggatcacgagctcgtcgtgcaagttgagtcaactatggcgagtgagagcaaatttctattccgaaaaaattatgccaaatacgagtttttcaagaacccaatgaatttttttcccgagcagatggtgacctggtgccagcagtccaacggctcccagacccagctcttgcagaacttcctcaactcctcttcctgtccagaaattcagggctttttacacgttaaagagttagggaaaaagagttggaaaaagctgtacgtgtgcctgcgccgctcaggattgtattgcagcacaaaggggaccagtaaagaaccacgccatttacagctacttgcagacctggaggactccaacatctttagcctgattgccggaaggaaacagtataatgcacctacagaccacggattgtgcataaaacctaataaggtgcgaaacgagactaaagagctgcgcctcctctgtgccgaagatgagcagactagaacctgttggatgaccgcatttcgtctactcaagtacggaatgttgctctaccagaattaccgcatcccccagcaacggaaagccctcctcagtcctttttccacccccgtcaggtcagtgagcgagaactcgctggtggcaatggacttctccggccaaacgggaagggtcatcgagaacccagctgaagcccagtctgccgcattggaggagggccatgcttggcgcaagcgctctaccagaatgaacatcttgggaagccagtcacccctccaccctagtactctgagtactgtgatccatcggacacagcattggttccatggtaggatttcccgcgaggagagccatcgaattattaaacagcaaggattggttgatggattattcttgcttagggacagccagtctaaccctaaggcctttgtgctcactctgtgtcaccaccagaagatcaaaaactttcagatcctgccttgtgaagacgacggacagaccttcttttctttggatgatgggaacacaaaattttctgacctaatacagctcgtcgacttctaccagttgaataaaggagttctaccctgtaaactcaaacaccactgcatccgagttgcactgtag

SEQ ID NO: 15386 - DNA, 531 bp, Artificial Sequence
  Description of Artificial Sequence: Synthetic coding sequence
atggaagcaatcgcaaagtacgatttcaaggcgacagctgatgatgagttaagttttaagcgcggcgacatcctcaaagtgctgaatgaagagtgcgaccagaattggtacaaggcagaactcaacgggaaagatggcttcataccgaaaaactacatagagatgaaaccccacccatttggtaacgacgtgcagcattttaaggtgctccgggatggcgcgggcaagtatttcctctgggtggtaaaatttaattccctgaatgagttagtggattaccaccgctcgactagcgtatctagaaaccagcaaatcttccttagggacattgagcaagttccccagcaacccacctatgtgcaggcactcttcgactttgacccccaggaagacggggaattgggcttccggcgcggtgactttatccacgtgatggataattcggatccaaactggtggaagggcgcttgccacggccaaacaggcatgttcccgagaaattacgtaacccccgtgaaccgcaacgtgtag

SEQ ID NO: 15387 - DNA, 654 bp, Artificial Sequence
  Description of Artificial Sequence: Synthetic coding sequence
atggaggccattgccaaatacgacttcaaggcgacagcggatgatgagttgagcttcaagcgaggtgacatcctaaaggtcctcaacgaggagtgcgatcagaactggtataaggctgagctcaacggtaaggatggctttatccctaaaaattacatcgagatgaagccccatccttggtttttcggcaagatccctagagccaaagccgaggaaatgctgtctaaacagaggcacgatggagcttttttgattcgagagtctgagtcagcacccggggattttagcttgagtgtgaagttcggaaatgatgtccagcatttcaaggtgctcagggacggcgccggaaaatactttctgtgggtggttaagtttaatagtctaaatgagctagtggactaccacaggtccacctccgtgagtcgtaaccagcagattttcttgagggatatagagcaagtaccccagcagcccacatatgtgcaggccctcttcgactttgacccacaggaagacggggaactgggctttagaaggggcgattttattcatgtgatggacaatagtgatcccaattggtggaagggggcttgtcacggacaaactggaatgtttcctcgaaactatgtcacccccgttaacaggaatgtttag

SEQ ID NO: 15388 - DNA, 654 bp, Artificial Sequence
  Description of Artificial Sequence: Synthetic coding sequence
atggaagctatcgctaagtatgatttcaaggccaccgctgacgacgaactgagttttaaaagaggggatatcctgaaagtgcttaatgaggaatgcgatcaaaattggtacaaggccgaacttaacggaaaggatggctttattcccaaaaattatatagagatgaagccgcatccctggttttttggaaagatcccaagagccaaggccgaggagatgctgtcaaaacaaaggcacgatggagcctttctgatccgggaatccgagtcagcacctggtgacttcagcctttctgtcaaattcggtaacgacgttcagcactttaaagtgctgagggatggcgccggaaaatactttctgtgggtcgtaaaatttaatagcttgaacgagcttgtagactaccatcggtccacatccgtcagtagaaatcagcaaatattccttcgcgacatcgagcaggtgccacagcagcctacatacgtccaggcactgtttgacttcgaccctcaggaggacggcgaactgggatttagacggggcgatttcatacacgttatggacaacagtgaccccaactggtggaagggggcctgtcatggccaaacagggatgttccctaggaactatgttacccccgtcaatcggaatgtttag

SEQ ID NO: 15389 - DNA, 654 bp, Artificial Sequence
  Description of Artificial Sequence: Synthetic coding sequence
atggaggccattgcaaaatacgatttcaaggccacagccgatgacgaactgtcttttaaacgcggggatatccttaaagtactgaatgaagaatgcgaccagaactggtacaaggcagaactcaacggcaaggacggttttatacctaagaactatatcgagatgaaaccgcatccttggttttttggtaaaataccccgcgccaaggccgaagagatgctgtccaagcagcgccacgacggggcttttctgatccgggagtcagaatcggctcctggagatttcagcctgtctgtgaagttcggcaacgatgttcagcatttcaaggtcctgagggacggtgcaggaaagtatttcctttgggtagtgaagttcaacagtctcaacgaactcgtcgattaccacaggtcaacttccgtttcgcggaaccaacagatttttctgcgggatatcgaacaggtgccgcagcagcccacctacgtgcaggcattatttgatttcgatccccaggaagatggcgaactgggctttagacgaggagacttcattcacgtgatggataattctgaccctaattggtggaaaggggcttgtcacggccagacagggatgtttcccagaaactacgtgactcctgtcaatcgcaatgtgtag

SEQ ID NO: 15390 - DNA, 222 bp, Artificial Sequence
  Description of Artificial Sequence: Synthetic coding sequence
atgcccgcccttcacatcgaggatctgccagagaaggagaaacttaagatggaagtagagcagctgaggaaagaggtgaagttacagcgtcaacaggtgtccaagtgtagcgaagagattaagaactacatcgaggaacggagtggggaggatcccctggtgaagggcatccccgaggataagaacccgtttaaagaaaagggctcatgtgttatcagctag

SEQ ID NO: 15391 - DNA, 432 bp, Artificial Sequence
  Description of Artificial Sequence: Synthetic coding sequence
atgagcggtcgtgggaagacaggcgggaaggcccgcgctaaggccaagagccgatcctcacgggctggcctccaatttcctgtggggagggtgcataggctcctgagaaaagggcactatgctgaaagagtgggcgccggcgccccagtgtacttggcagccgtgctcgagtacctaacagccgagatcctcgagctggcaggcaatgctgccagagataacaagaaaactagaattataccaaggcacctgcaactggcgattcggaacgacgaagagctgaataagctgctgggcggtgtcaccattgcccaaggcggtgtgctgcccaacattcaggctgtgctgctgccgaagaagacttccgccacagtgggccccaaagctccgtctggaggaaagaaggccacgcaagcaagccaggagtattag

SEQ ID NO: 15392 - DNA, 432 bp, Artificial Sequence
  Description of Artificial Sequence: Synthetic coding sequence
atgtccgggaggggcaaaactggcggaaaggctagggcaaaagccaagtcccgcagctcaagagccggccttcaatttcctgtcggaagagtgcacagattgctaagaaaggggcactacgccgagcgagtgggagccggcgctcctgtgtatctagccgctgtgttggagtacctgacagctgagatcctcgaattggccggcaatgctgcccgagataacaaaaaaactcggattatcccgcgacatcttcagttggccatacgcaacgacgaggagctcaacaagcttttaggaggggtgacaatcgcacaggggggggtcttgcccaatatccaggcagtcttactacccaagaaaacatctgctacagtaggaccaaaggctccctccgggggaaaaaaggccacacaggcatcacaggagtactag

SEQ ID NO: 15393 - DNA, 276 bp, Artificial Sequence
  Description of Artificial Sequence: Synthetic coding sequence
atgtgcccttgtccattacacagagggcgcggacctcccgccgtgtgtgcatgctcagctggtaggctgggactgcgctcttccgccgcccagcttactgctgcccggctgaaggcactgggggacgagctgcaccaaagaactatgtggagacgtagagcccgctcacgcagagcgcccgccccgggagctctgcccacatactggccatggctgtgtgcggccgctcaggttgctgcgcttgcagcttggttgttagggaggaggaacctatag

SEQ ID NO: 15394 - DNA, 618 bp, Artificial Sequence
  Description of Artificial Sequence: Synthetic coding sequence
atgaccgaaaggagggtgcctttctctctgttaaggggcccaagctgggatccattcagagattggtaccctcactcccggctcttcgatcaggctttcgggctgcctcgcctgccagaggaatggtctcagtggctcggcggctcttcatggcccggatacgtgcgacctctgcctccagccgcaattgagtctcctgctgtagcggcacctgcttatagtagggcccttagccgacaactctcatcaggtgtgtcagaaatcagacataccgccgatcgctggagagtgtctctcgacgttaatcatttcgcacccgatgagctaaccgttaaaactaaagacggtgtcgtggaaattacaggtaaacatgaagaacgccaggatgagcacgggtatatcagccgttgcttcacacgaaagtatactctccctcctggggtcgaccctacacaggtgtctagctccctgtcacccgagggtacactaacagttgaagcgcctatgcctaagctagctactcagtctaatgagattaccatcccggtgacatttgagtcacgggctcagctaggcggacctgaagccgccaagtccgacgaaacagctgcaaagtag

SEQ ID NO: 15395 - DNA, 513 bp, Artificial Sequence
  Description of Artificial Sequence: Synthetic coding sequence
atgacagaacgtcgcgtgcctttcagtttgcttcgtgggcctagttggcctggttacgtgcgacccctgccacctgctgccatcgagtcacccgcagtggccgccccagcttattcccgcgccctctctagacagttaagcagcggcgtgtccgagataaggcacacggcagatcgatggagagtctctcttgacgtgaaccacttcgcaccagatgagctcactgtgaagacaaaggatggtgtggtggagataacgggcaaacacgaggaaagacaggacgagcacggatatatcagtaggtgttttacccggaagtataccttaccccccggtgtagaccctacacaagtgtcttcatcgctgtcacccgaagggacgcttacggtggaggccccaatgccaaaactggcgacgcagtcaaacgaaataaccatacccgttacatttgagagccgggcacagctgggtggccctgaagcagccaagtcagacgaaactgcagctaagtag

SEQ ID NO: 15396 - DNA, 1926 bp, Artificial Sequence
  Description of Artificial Sequence: Synthetic coding sequence
atggcaacggctaaaggcattgcaattggcattgatctgggaaccacgtattcttgtgtgggcgtgttccagcatggcaaggtggaaattatcgccaatgatcagggcaaccggaccaccccctcttatgtggctttcacagacactgaaagactcataggagacgcagccaaaaatcaggtagccatgaatccgcaaaacacggtatttgacgcgaagaggctgattggccggaagttcaacgacccggtggtgcaggctgacatgaaactctggccctttcaggtcattaacgagggaggaaagccaaaggtgctggtcagctataaaggcgagaataaggccttttaccccgaagaaatatcatcgatggtcttaaccaagctcaaggaaacagccgaagctttcctgggacatccagttacaaacgccgtgattacggtccctgcgtactttaacgattcgcagagacaggctaccaaagacgctggagtcatagcaggattgaatgtgcttcgtatcatcaatgagccaacagccgcagccattgcctacgggttagacaagggtggccaaggagaacgtcacgtactgatcttcgacttgggcggggggacttttgacgtgtcaatcctaacaatagatgacggtatcttcgaggtgaaagcgaccgctggcgatacccacctcgggggtgaggacttcgacaaccgcctcgtgagccatttcgtcgaagagttcaagagaaaacataaaaaagatatcagccagaataagcgagcagtgcgacggctgcgtaccgcctgcgagcgggccaaacgaactctatccagcagcacgcaagcaaacttggagatcgattccctgtacgagggcatcgatttttacacctccatcactagagcacgtttcgaagagttgtgcgctgacctattcagaggaaccctggagcctgtcgagaaggccctgcgtgatgccaagatggataaggccaagatacacgacatcgttcttgttggcggctcaactagaatacccaaggttcagaggctcctgcaggactactttaatggacgggatctgaacaagagcattaatccagacgaagccgtcgcttatggcgcagccgttcaggccgcaattctaatgggggacaaatcagagaaagttcaagacttgctgctgctggatgttgctccactttctctgggactggagaccgctgggggagtcatgaccgcattaatcaagagaaacagtactatacccactaagcagacgcagatctttacaacgtactccgataaccagcccggcgtgctgattcaagtgtatgagggtgagagagccatgaccaaagacaacaatcttcttgggcgctttgacctgactggcataccccccgcacctcggggcgtacctcaaattgaagtaacatttgatatagacgcaaacggtattttgaatgtgactgccatggacaaatccaccggaaaggtcaacaagatcacaatcaccaatgataagggcaggctgagcaaagaggaaatcgagcggatggtgctcgacgccgagaaatacaaggccgaggacgaggtacagcgagaaaagatcgctgccaagaatgcactggagtcttacgcttttaacatgaaaagcgtggtatctgacgaaggactcaagggcaaaatttctgagagtgataaaaataagattctagacaagtgcaacgaactgttaagttggctcgaagtgaaccagctcgcggaaaaagatgagtttgaccacaagcgcaaagagctgaaacaaatgtgtaaccccataattaccaagctctaccaaggcgggtgtacagggcccgcgtgcggaaccggttacgttcctgggagaccggctacgggccctacgattgaggaggtcgactag

SEQ ID NO: 15397 - DNA, 1599 bp, Artificial Sequence
  Description of Artificial Sequence: Synthetic coding sequence
atggctaccgccaagggaattgccatcggcattgacttgggcaccacttacagctgtgtgggggtgtttcagcatgggaaagttgagatcattgccaatgaccaagggaaccgaaccaccccatcctacgtcgcctttaccgataccgagcggttgatcggggacgctgctaagaaccaggtggccatgaacccccagaacacagtgtttgacgccaaaagacttatcgggaggaaattcaacgaccccgtggtgcaggccgacatgaagctttggccatttcaagtgatcaacgagggggggaaacccaaggtgctggtctcttataagggcgaaaacaaagccttttacccagaggagatcagttcgatggtcttaactaaactcaaggaaaccgccgaggcctttctgggacatccggtgacaaacgcggtgattacagttcccgcctacttcaatgacagccagcggcaggcgacaaaagatgcaggagttatagcaggcctgaatgtgctgcgcattataaacgaacctacagctgctgccattgcctacggcctggacaaaggggggcagggcgagcggcatgtgctcatttttgacctgggcggaggcacctttgacgtgtctatactgacaatcgatgacggaatttttgaagtgaaggccaccgccggggatacccacttgggcggtgaagattttgataacagacttgtcagtcacttcgtagaagagtttaaacgaaagcacaaaaaggatattagccaaaacaagagagcagttcggagactgagaaccgcttgcgagcgggccaagagaaccctctccagtagtacacaggctaaccttgagatcgatagtttatatgaaggcattgacttctacacaagcatcaccagagcccgtttcgaggagctgtgtgcagacttatttaggggaaccctggaacctgtcgaaaaggccctgagagacgctaaaatggacaaggcaaagatccacgatatcgttttagtgggcgggtctacacgcatcccgaaggtgcaaagactcttgcaagattattttaatgggcgggacctaaataagagtatcaatcctgatgaggctgtggcatacggagctgccgtgcaggccgcaatcttgatgggggacaagtcagagaaagtacaggatctcttgctcctcgacgttgctccattgtccttgggattagaaacagccgggggagtaatgacagcgctgatcaaacggaattccacaattcccaccaaacaaacccaaatctttacgacatactccgacaaccagccgggcgtgctcatacaggtctatgagggtgagcgtgccatgaccaaagataacaatctgctgggcaggtttgacctaaccggtatcccccccgcgccaagaggtgttccacagatagaagtcacgtttgatattgatgccaacggtattctgaatgtgacagcgatggataaatctaccgggaaagtgaacaaaattacaatcacaaacgacaaagggagactgtccaaggaagagattgaaaggatggtgctcgacgctgagaagtacaaagccgaagacgtttag

SEQ ID NO: 15398 - DNA, 1926 bp, Artificial Sequence
  Description of Artificial Sequence: Synthetic coding sequence
atggcaaccgcaaaaggtatcgctattggcatcgacctaggcaccacctactcatgtgttggagtgttccagcacggaaaagttgagatcatcgccaatgaccaggggaatcgcactactcctagctatgtggccttcaccgacacggaaagactcattggagacgccgcgaaaaaccaagtagcgatgaacccccagaacacagtcttcgacgcaaagagactcattggacgaaaattcaatgatcccgtcgtgcaggccgacatgaagctgtggccattccaagtgattaatgaaggggggaaacccaaagtcttggtgagctacaaaggagagaacaaagctttttacccggaagaaatttcttctatggtgctaaccaagcttaaggagactgctgaagcgttcctaggccacccagttactaatgccgtgattacagtgcctgcttattttaacgacagccagcggcaggccactaaagatgcaggagtcatagctggactgaatgtcctgagaatcattaacgagcctactgccgccgctattgcttacggcctcgacaaggggggccagggagaaagacacgtactgattttcgatttgggagggggtacctttgatgtgagtattctgactatcgacgatggaattttcgaagtcaaggccaccgccggagacacccacctgggaggggaagactttgacaaccgcctcgtctcccacttcgtggaggaattcaagcggaagcacaaaaaggatatctcccagaacaaacgagccgtccgtcggctccgcaccgcctgcgagcgggctaagaggacactgtccagctctacacaagctaacctagaaatcgacagtttgtatgagggcattgacttctacacttctattacaagagccagatttgaagaattgtgtgccgacttgttccggggaaccctggaacctgtcgagaaggctctgagggacgcaaaaatggacaaggcgaagatccatgatatcgtcctggttggggggtcaacacggattccaaaagtgcagaggctgttacaggactactttaatggccgcgatctgaataaatcaatcaatcctgatgaggcagtcgcttatggggccgcagtgcaggccgcaattctcatgggtgataaatctgaaaaagtgcaagatctcctcctgttagatgttgctcccctctctctggggctggaaacagccggcggtgtcatgaccgctttaattaagagaaacagcacgattccaactaaacagacccagattttcaccacatattcagataaccagcccggagtgttgatccaggtttatgagggggaacgcgccatgacgaaggacaacaaccttctgggacggtttgatctgaccgggattccccccgctccgagaggggtgccccagattgaggtgacattcgatattgacgccaacggcatcctcaacgtgactgctatggacaagagcaccggcaaggtcaacaagattactattacgaatgacaaggggcggttaagtaaagaggaaattgagaggatggtgctcgatgccgagaagtataaggcagaagatgaagtgcagagggagaagattgcggccaagaacgcactggagagctatgcattcaacatgaagtccgtggtatcagatgagggcctgaaaggtaagatttcagagtccgacaaaaataagatactcgacaagtgtaacgagctcctcagctggctggaggtgaatcagctcgcagaaaaagacgaattcgatcacaaacggaaagagttaaaacagatgtgtaatcccataattacgaaattgtaccaaggcggctgtacaggacccgcctgtggcactggatatgttcccggacgaccggcaacagggcctaccattgaagaagtagactag

SEQ ID NO: 15399 - DNA, 699 bp, Artificial Sequence
  Description of Artificial Sequence: Synthetic coding sequence
gctaaggggattgcaatcggcattgacctggggacgacatacagctgtgttggggtgttccagcatggaaaagttgaaattattgccaacgaccaagggaatagaactactccatcctacgtcgctttcactgacacagagaggctgattggcgacgccggggtgatcgctggattgaacgtcctgaggatcatcaatgagcccactgccgctgcaatcgcatacggactggacaagggaggccaaggcgaaagacacgtgctaatattcgacctgggaggcggcacatttgacgtctcaatcctcacgattgacgacggtattttcgaagttaaggctacagcaggggatactcaccttggcggcgaggacttcgataaccgtctggtcagtcatttcgtggaggaatttaaaagaaagcataagaaggacatcagccagaataaaagagccgttcggcggctacgcaccgcgtgcgagcgcgccaagcggactttaagcagctctacccaggccaatttggaaatagactcactgtatgaagggatcgacttttacacatccattacgcgggcccggttcgaggaactctgcgctgacctgtttcgcggaacattggagccggtggagaaaggggcacctcctgctagcccccggtgctccggctgcttccgcactacctcaatggatgttatctag

SEQ ID NO: 15400 - DNA, 1074 bp, Artificial Sequence
  Description of Artificial Sequence: Synthetic coding sequence
atgaaagagaacaaggagaattcctccccaagtgtcacttctgctaacctggaccacaccaagccatgctggtattgggataaaaaagatctcgcgcacactccctctcaactggagggccttgaccctgcgaccgaggcacggtaccgacgggagggcgctcgctttattttcgatgtgggcacaagacttggactccactatgacaccttggcaacagggataatctactttcacagattttatatgtttcactccttcaaacagttccctagatatgtcactggggcatgttgcctgttcctggctggaaaggttgaagagaccccaaaaaagtgcaaagacattattaagacggcaaggtcgctcctgaatgatgtccagtttggacaattcggagatgatcccaaggaggaggtgatggtcttagaacgtatccttttacagacaattaaattcgatctgcaagtagagcacccatatcagttcctcttgaaatatgctaagcagttgaaaggcgacaaaaacaagattcagaagctcgtgcagatggcctggactttcgtgaatgacagaacatctctctgcactaccctctctctccagtgggaaccagaaatcatcgcggtcgccgtgatgtacctggctgggagactctgtaagttcgaaatacaagagtggacgtctaagcctatgtaccggagatggtgggaacagtttgtgcaagatgtgcccgttgacgtgctcgaggatatttgccaccaaattctggacctctactcacagggtaaacagcaaatgccacatcatacccctcatcagctgcagcagcctcctagccttcaacctacgccccaggtgcctcaggtacagcaatctcagccctctcagtcatcagagcctagtcaaccccagcagaaggacccaccgctgattctgttgcaaggttgggcttgccggcagccggcaacccacctactcccaagccctttggaggattctctgctgtgccccaggccatttccccatccagcatgtctccagctaggaggatggggaggacagccaggatag

SEQ ID NO: 15401 - DNA, 2565 bp, Artificial Sequence
  Description of Artificial Sequence: Synthetic coding sequence
atgccgccctgctccggaggggacggctccacccccccgggcccctctttacgcgatcgggactgtcccgcgcagtccgcagagtaccccagggaccggctggacccaagaccaggtagcccctcagaagcctcctctcctccttttctgcggagtagagcccccgtgaactggtaccaggagaaggctcaggtgtttctctggcacttaatggtcagcggcagtaccacattgctgtgcttgtggaaacagccatttcacgtgtccgcattccccgtaacggcgagcctggcgtttcgccagtcacaaggagcaggtcagcacctctataaagatctgcagccatttatattgctgcggctcctcatgccagaagagacacagactcaggaccaacccatggaagaggaagaggtagagactttcgcgttccaagctgaaatcgcgcagctgatgagtctcataataaacacattctacagcaataaggagatcttcttaagggaattaattagcaacagtagtgacgccctcgacaagatacggtacgagagtctgacagacccgagtaagctagattcagggaaggaactgcatataaacttgatccctaacaaacaagatcgcactttgacaatcgttgacacagggattggcatgacgaaggctgacctgatcaataatctcggcactatcgccaagtcaggcaccaaggctttcatggaagccctccaagcaggcgctgacatctctatgatcggccagttcggcgtcggtttttactcagcttaccttgtggctgagaaggttaccgtcataactaagcataacgatgacgagcagtacgcatgggagagttcagcgggcggaagtttcacagtgcggacagatacgggagaaccaatgggccgtggaaccaaggtgatattgcacctgaaggaagatcaaaccgagtacctagaagagcgcaggatcaaagaaatcgtaaaaaagcactcccagttcatcgggtacccaatcacattgttcgtggagaaagagcgagataaggaggtgagtgatgacgaagctgaggaaaaggaagataaggaagaggaaaaagagaaggaagagaaggagagcgaggacaagccagagatcgaggacgtgggtagcgacgaagaagaggaaaagaaagatggtgacaagaaaaaaaagaagaagatcaaggagaagtacatcgatcaggaagaattaaataaaactaagcctatatggacgcggaatcctgatgacatcactaatgaggaatacggagagttctataaaagtctgacaaacgactgggaggatcatctggctgtcaaacacttttcggtcgagggtcaattggagtttagagctctgcttttcgtgcctcgcagggcgccatttgatctcttcgaaaacagaaagaagaagaataacattaagctgtatgtaagacgcgtgtttattatggacaactgtgaggaacttataccagagtatcttaacttcattaggggggttgtggattctgaggatcttcccctcaacatcagtagggagatgctgcaacagtccaagattctgaaagttatccgcaaaaacctggtgaagaagtgccttgagctgttcactgaactggccgaagataaagagaactataagaagttctatgagcaattcagcaagaacatcaaattgggtatccatgaggactcccaaaataggaaaaagttgagcgagttgctcagatactacaccagcgccagtggagacgagatggtttctctgaaggactactgtactcgaatgaaggagaatcagaagcatatctactacatcacgggtgaaactaaggatcaggtcgccaattccgccttcgtagaacggctgaggaagcatggccttgaggtcatctatatgattgaacccatcgatgaatactgcgtgcagcagctgaaagaattcgagggcaagaccctggtttcagtgaccaaagagggactggagcttcccgaagacgaggaagaaaagaaaaagcaggaagagaagaaaacaaaattcgaaaacctgtgcaaaattatgaaggatatcctggaaaaaaaggttgagaaggtggttgtgtcgaatagactcgttaccagcccctgctgcattgtgacctccacctacggctggacagccaatatggagaggattatgaaggctcaggctctgcgtgacaattcgacaatgggatacatggctgctaaaaaacacttagagattaaccctgaccacagtataatcgaaaccttgcgccagaaggccgaagctgataagaacgataaatctgtgaaggatttggtaatactgctttacgagacagctctcttatcaagcggattctctctggaagacccacagacacacgctaatcgcatttaccgaatgattaagcttggattgggcatagatgaggatgaccccactgccgacgataccagtgcggcggtcacggaagagatgcccccccttgaaggcgacgacgacacctccaggatggaggaagttgattag

SEQ ID NO: 15402 - DNA, 1242 bp, Artificial Sequence
  Description of Artificial Sequence: Synthetic coding sequence
atggggcgggggactaaagtgatcctgcacctgaaagaagaccaaactgaatacctggaggagaggcgcatcaaagagatcgtgaaaaagcattcgcagttcattggataccctataaccttgttcgtggagaaagaacgcgacaaggaggtctcagacgatgaggctgaggaaaaggaagacaaggaggaggaaaaagagaaggaggagaaggagagcgaggataagcctgaaattgaagacgtgggatctgatgaggaggaagaaaagaaagacggagataaaaagaaaaagaaaaagatcaaagagaaatacattgaccaggaggaattgaataagaccaaaccgatatggacacgaaaccctgacgacatcacaaatgaggagtatggggagttttataagtcgcttacgaacgactgggaggatcacttggccgtcaagcacttcagcgtagaaggccagctagagtttagggccctcttattcgttcctaggcgagctccgttcgatcttttcgaaaatagaaagaaaaagaataatatcaaactatacgtccgtcgcgttttcattatggataattgcgaagaacttattcctgagtacctaaattttattcggggcgtagtagatagtgaagaccttcctctgaacatctctcgagagatgctccagcagagcaagatcctgaaagtgatcagaaaaaatcttgtgaagaaatgcctagagttgtttactgaactggccgaggacaaggagaactataagaaattttatgagcagttcagtaaaaacataaaactcgggatacatgaggacagccagaatcgaaagaaactttcagaactgcttaggtattatacaagtgcatccggcgacgaaatggtctctctgaaggactactgcactcggatgaaggagaatcagaagcatatctactatattacaggggagactaaggatcaggtcgccaacagcgcatttgtggaacggctgagaaagcacggtcttgaggttatctatatgattgagcccattgacgaatactgtgtccagcagcttaaggaattcgagggcaagacattagtatccgtaacaaaggagggcttagaactccccgaggatgaggaagaaaaaaagaagcaggaagagaagaaaactaagttcgagaatctttgcaaaatcatgaaagatattctggagaagaaagttgaaaaagtttgtgagtattctatcagttag

SEQ ID NO: 15403 - DNA, 2412 bp, Artificial Sequence
  Description of Artificial Sequence: Synthetic coding sequence
atgagggctctgtgggtgctgggtctgtgttgtgtgctgctcacctttgggtctgtaagagctgatgacgaggtggacgttgacggcacagtagaagaagatcttggtaaaagtagagaagggtcaaggaccgacgacgaagttgtgcaacgggaggaagaggcgattcagttagatggcctgaacgccagccagattcgtgagttgagagagaagagtgagaagtttgccttccaggccgaagttaatcgcatgatgaaactcattatcaacagtctgtacaagaataaagagattttcctgagagaactgatctccaatgcctccgatgcgctcgataagatccgattgatctccctgacagacgagaatgccctctctgggaacgaagaactgactgtcaaaatcaaatgtgacaaggagaagaacttgctgcatgtgaccgacacgggagtcgggatgacccgcgaggagctggtgaagaatctcgggactatcgccaagtcaggcacttctgagtttcttaataagatgacagaggctcaagaagacgggcagtccaccagcgaactgatcgggcagttcggagtgggattttactcagcgttccttgtcgccgacaaagtaattgttacttcaaaacacaacaacgatacccagcacatttgggaaagcgactctaacgaattcagtgtgatcgcggacccacgagggaacaccttaggcagagggaccaccataacacttgtgctgaaggaggaggcttccgactacttggagctggatacaatcaaaaatctggtaaaaaagtattcacagtttatcaattttcccatctatgtgtggtcctccaaaaccgaaaccgtcgaagaacccatggaggaagaggaggctgccaaagaggagaaagaagaaagcgatgacgaagctgccgtagaagaagaagaggaggagaaaaagcctaagacgaagaaggtcgagaagacagtgtgggactgggagctgatgaatgatatcaaacctatctggcaaaggccttccaaagaggtggaggaagacgagtataaggcattctacaaaagtttcagcaaggagagtgatgatcctatggcctatatccactttactgcagaaggcgaagttacatttaaaagcatcttgttcgttcccacttctgcaccccgggggctttttgatgaatacgggagcaagaagtctgactacatcaaactgtatgtgagaagggtttttattacggacgattttcatgatatgatgcctaagtacctgaacttcgtaaagggggtggtggatagcgacgacctgccactcaatgtttcccgggagaccttgcagcagcataaacttctgaaggtgatccggaagaagctggtcagaaaaaccctagacatgatcaagaaaatagcagatgacaagtacaatgacaccttttggaaagaatttggtacaaacatcaaactcggcgtcatcgaggaccatagcaatcggacaagactcgccaagttgcttagattccagagctcgcaccaccccaccgatatcaccagcttggatcagtatgtcgaacggatgaaggaaaagcaggataaaatttatttcatggccggttcgtctagaaaggaagccgaaagcagccccttcgttgagagattgctgaagaaggggtacgaggtgatatatttaaccgagcccgtggatgagtactgtatccaggccctccctgaattcgatggcaaacgctttcagaacgtggcgaaggagggcgtgaagtttgacgagtctgagaagactaaagagtccagggaggcagttgaaaaggagttcgagcccctgctcaactggatgaaagacaaggctttgaaagacaagatcgaaaaggcagtggtctcacaaagactgaccgagtctccatgcgcattagttgcgtcacaatatgggtggtccgggaatatggagagaattatgaaggcccaggcataccagaccggtaaggatataagtactaattactacgcaagccagaagaaaactttcgagatcaatccgcgacaccctcttattagagacatgctgcggagaataaaggaagacgaggatgacaaaacggttctagatctagccgtggtccttttcgagacagcaacgctaagatctggttacctcttacccgacactaaggcctacggcgacaggatagaaaggatgcttcgactctctctgaacattgaccctgatgcaaaggtagaagaagagccagaagaagagcccgaggaaacagccgaggatacaacagaggatacagagcaggatgaagatgaagaaatggatgtcgggacggacgaagaagaagaaacagccaaggagagcactgccgagaaagacgaactgtag

SEQ ID NO: 15404 - DNA, 1662 bp, Artificial Sequence
  Description of Artificial Sequence: Synthetic coding sequence
atgagagcgctttgggtgctgggcttgtgctgtgtgttgctgacttttggaagtgttcgcgcagatgatgaagtggatgtggacggcacagtggaagaagacttaggaaagtctcgagagggctcccggacagatgatgaggctgccaaagaagaaaaagaggaaagcgatgacgaagcggcagtggaggaagaagaagaagagaaaaagccgaagactaaaaaagttgagaaaaccgtgtgggactgggagctgatgaacgatattaagccaatatggcagaggccaagcaaagaggtggaagaggacgagtataaggcattctataagtcgttttcgaaggaatcagacgaccctatggcctacatacacttcaccgcggaaggcgaggtgacttttaagtcaattctgtttgtaccaacaagcgctcccagaggcctcttcgacgagtacggcagcaaaaaaagcgattacatcaaactgtacgtgaggagagtgttcattacggacgatttccatgatatgatgcccaagtacctgaactttgtgaagggagtggtggattctgacgatcttccactgaacgtttctcgtgagactctccaacagcacaaactgttgaaggttatccgcaaaaagcttgttaggaagactcttgatatgataaagaaaattgccgacgacaaatacaacgacacattttggaaggagttcggcaccaacatcaagttaggtgtcattgaagaccactccaaccgtaccaggctggcaaagcttctgcggttccagagttcccatcatcctaccgacataacatctcttgaccagtacgtggagcggatgaaagagaagcaggataagatctacttcatggcgggcagctcccgaaaggaggcggaatcctctccttttgtagaaagattattaaaaaagggttatgaggtgatatacctgactgagccagtggatgaatactgcattcaggcccttccagaattcgatggaaaacgctttcagaacgtggcaaaggagggagtaaagtttgacgagtctgagaagaccaaggagagccgggaggcggtggaaaaagagtttgagccactactgaactggatgaaagacaaggctttgaaggacaaaatcgaaaaggctgtggttagccagaggctgacagagtccccatgcgcgctggtggccagccaatacgggtggagcgggaatatggagcggatcatgaaggctcaggcttaccagaccggaaaagacatttcaaccaactactatgcgtcacaaaagaaaacctttgaaattaatccccgccatccccttattcgtgacatgctcaggcggataaaagaggacgaggacgacaaaaccgttctagacctcgcagtcgttctcttcgaaacagccacactgagatcaggctatctattaccagacactaaggcttatggcgatcggatcgaacgcatgttgcggctgtcccttaatatcgaccccgatgctaaggtagaagaggagcccgaagaagaaccggaggagaccgcagaggacacaacggaagacactgaacaagacgaagatgaagagatggatgtgggcaccgacgaggaggaggaaaccgctaaggagtcaaccgccgaaaaggatgaactgtag

SEQ ID NO: 15405 - DNA, 948 bp, Artificial Sequence
  Description of Artificial Sequence: Synthetic coding sequence
atgagagcgttatgggtgttaggcctctgctgtgtcctgctgacatttggctccgtgcgagctgacgacgaggtggacgttgatggtacggtggaggaggatctgggcaagtcaagggaggggagccggacagatgacgaagtcgtacagagggaggaggaagccattcagcttgatggcctgaacgcttcccagattagagagttgagagaaaaatcggagaagttcgcctttcaggcagaggtgaatcggatgatgaagctgataataaattccctatacaaaaacaaagagattttcctgagagagctgatctcaaatgcttcggacgcgcttgataaaatcagactcataagcctcacagatgaaaacgctttgagtggaaatgaagaactgaccgtcaagataaaatgcgataaggagaagaacttgcttcatgtgacagatacaggcgtcggtatgaccagggaggaactggttaaaaacctcgggaccatagctaagtcaggcacttcagaatttctcaataaaatgaccgaagcacaggaggatgggcaatctacaagtgagcttatcggccagtttggggttgggttttactctgccttcttagtcgccgacaaggtaatcgtgactagtaagcacaataatgacacccagcacatctgggagagcgatagcaacgaattcagcgtcatagcagaccccagggggaataccctgggccgcggaacgaccataacactggtgttaaaggaagaagcatcggactatttagaactggacaccatcaaaaaccttgtgaagaagtactctcagttcattaattttcccatctacgtgtggtcctccaaaaccgagactgtcgaagagcccatggaagaagaagaggccgcaaaggaagagaaggaggagtcggatgacgaggccgcagcgcgacgccgctag

SEQ ID NO: 15406 - DNA, 483 bp, Artificial Sequence
  Description of Artificial Sequence: Synthetic coding sequence
atgtcagaggttcggccactgtctagggatatcctgatggagaccctgctgtacgagcagctgcttgagccccctaccatggaggtcttagggatgactgattccgaggaagatctcgacccaatggaggactttgactcactggagtgcatggagggctctgacgccctggctcttcgacttgcctgcattggggacgagatggatgtctccctgcgcgcccccaggctcgcccagctgagcgaggtggctatgcacagtctgggcttggcatttatatacgaccagactgaagacatccgggatgtcctcagaagctttatggatggcttcacgaccttgaaagagaatatcatgaggttttggagatcccccaaccccgggtcgtgggtgtcgtgtgaacaagttctgctggctctccttctgttactggccctgcttctgccactgttatccggaggtctgcacctgctgttgaaatag

SEQ ID NO: 15407 - DNA, 564 bp, Artificial Sequence
  Description of Artificial Sequence: Synthetic coding sequence
atggaacgacctcagcctgacagcatgccccaggacctgtcagaagctctaaaagaggctactaaggaagtgcacacacaggcggagaacgcggagtttatgaggaatttccagaaaggccaggttacacgcgatggattcaaactagtcatggctagtctctaccacatctatgttgcgttggaggaagagatcgagagaaataaagagtccccagttttcgctcccgtttatttcccagaggagcttcaccgtaaggccgcattggaacaagatctcgctttctggtacgggccaagatggcaggaagtgataccgtacaccccggccatgcaacgttatgtgaagaggttacacgaggtgggcaggaccgaacccgaactgttagtggctcacgcctacacgagataccttggggacttatccggcgggcaggttctcaaaaagatcgcgcagaaggcattggacctcccttcaagtggcgagggtctcgctttcttcacattccctaacatcgcatcagccactaaattcaaacaattgtatcggtcaagaatgaattag

SEQ ID NO: 15408 - DNA, 1581 bp, Artificial Sequence
  Description of Artificial Sequence: Synthetic coding sequence
ctcggaggcagatcaagctgcgaggaccccggctgtcctagagatgaagaacgggctccccggatggggtgtatgaaatctaagttcctgcaggtaggcggcaacactttttcaaagaccgaaacctctgccagtccacactgtccagtttacgtcccggacccgaccagcacaataaaaccggggcccaactcccataattctaacactccgggcattagagaggccgggtctgaggacattattgtggtggccctgtacgactacgaagcaatccaccacgaagacctgtcctttcagaagggcgatcaaatggtggttctggaggagtccggcgagtggtggaaggccagatccctggctacccgcaaggaaggctatatacctagcaattacgtggctcgtgtcgatagcctagagaccgaggagtggttctttaaaggcatcagccggaaggatgccgagagacaattactggccccaggaaacatgctgggttctttcatgatccgcgattctgaaaccactaagggctcctactcgctctcagtgagggattacgatcctagacagggggacactgtcaaacactataagattaggacactagacaatggaggcttctatatcagtccaaggagtaccttcagtacactgcaggaactggtggatcattacaaaaagggtaatgacggtctgtgccaaaagctttccgtcccttgtatgtcgagcaagccccagaaaccctgggagaaagacgcatgggagattcctcgagagtcactaaaactcgagaaaaagctcggagctgggcagtttggcgaagtgtggatggcgacatacaacaagcacacaaaagtggccgtcaagaccatgaagcccggttcaatgagcgtagaagcttttctggcagaagcgaacgtgatgaagaccctgcagcatgataagctggtgaaactgcacgccgtcgtgaccaaggaaccgatttacataatcacagaattcatggccaagggttctctcctagacttcttgaagtcagatgagggatctaagcagcccctacccaagttgatcgactttagcgcacagattgccgaggggatggcatttattgagcagagaaactacatccatagagacctcagagctgccaatatactcgtgtctgcgagccttgtatgcaagatcgcagactttggattggcacgagtgattgaagataatgagtacaccgcgcgagaaggagcaaaattccccatcaagtggacagctcccgaagccattaatttcggctcctttacaattaagagcgacgtttggtcatttgggatactcctgatggagatcgttacatacggccgcattccttaccccggcatgagcaaccccgaagtgataagggcactggagagggggtatagaatgcctcggcccgagaactgcccagaagaactctacaatatcatgatgaggtgctggaagaatagaccggaggaacgcccaactttcgagtatattcagtccgtgttggatgatttctatacggccacggagtctcagtaccaacagcagccctag

SEQ ID NO: 15409 - DNA, 1578 bp, Artificial Sequence
  Description of Artificial Sequence: Synthetic coding sequence
ctcggcggacgatcttcctgcgaagatccaggatgccccagggacgaagaaagagctcctcgaatgggctgcatgaaatcaaagttcctacaggttggggggaatactttcagcaaaaccgaaacctccgcctccccacattgccccgtgtatgtacctgaccctacttcgaccataaaacctgggcctaacagtcacaactcaaacacacctggaataagggaaggaagcgaggatattattgtggtcgccttgtatgattatgaggccatccatcatgaagacctcagtttccaaaaaggggaccagatggtggttctcgaagaatccggagagtggtggaaggcccggtctctcgctactcgtaaggagggctacatcccttctaattacgtagcccgggtggatagcctggagacagaagagtggttcttcaagggcataagcagaaaggacgccgagagacagctcctcgcaccaggcaatatgctgggcagtttcatgattagagactccgagaccaccaaagggtcctactctctgtcagtaagagactatgacccacgccagggagatactgttaaacactacaaaatccgcaccctggataatggcggcttttatattagccccaggtccacgttctccacgctacaggaactggtagaccattacaagaagggcaacgacggactgtgtcagaagctgagcgtcccctgcatgagcagcaaacctcagaagccctgggagaaggacgcctgggagattcctagagagtctcttaaattggaaaaaaaactgggtgctggacagttcggggaagtttggatggccacttataacaaacacactaaagtggctgtgaagaccatgaagcctgggagtatgagtgttgaagcctttttggccgaggccaacgtcatgaagacactacagcacgataagctggtgaaactccatgcggtggtgacgaaagaacccatctacatcattacagagttcatggccaaggggagtctcctggactttctgaaaagcgacgagggcagtaagcagcctctgccaaaattgattgatttcagcgctcagattgcagagggaatggctttcatcgagcagaggaattacattcatcgcgacctgcgcgccgctaatatcttagttagcgccagcctggtgtgcaagatcgccgattttggcttggccagggtgatcgaggacaacgaatacaccgccagagagggcgccaagttccccattaagtggaccgcacccgaggctataaacttcgggtcctttactataaagtcagacgtctggagtttcggcatactgctgatggaaatagtcacatatggaagaattccttatcccggcatgtctaatccagaagttatccgggccttggaacgtggctacagaatgcctagacccgagaattgccctgaggagctatacaatatcatgatgaggtgctggaaaaaccgcccagaggagaggccgactttcgagtacatccagagcgtgctggacgacttctataccgccacggaaagtcagtaccagcagcagccttag

SEQ ID NO: 15410 - DNA, 1515 bp, Artificial Sequence
  Description of Artificial Sequence: Synthetic coding sequence
atggggtgcatgaagagcaaattcctgcaggtgggcggcaacaccttttctaagactgaaaccagcgcttctccccactgccctgtatacgttcctgatcccacaagcacaatcaagccaggccccaatagccacaatagtaacacccccgggatccgggagggcagcgaagacataatcgtcgttgctttatacgactacgaggccatccaccatgaggatttgagctttcaaaaaggcgaccagatggttgtcctagaggagagcggggagtggtggaaagctcggagccttgccacacggaaggaagggtacataccttctaactatgtggcacgggtagactctctggagacggaagagtggtttttcaaaggcatcagccggaaggacgccgaacgccagctcttggccccaggcaatatgctgggctctttcatgataagagattccgaaacgactaagggctcttattctctttcagtgagagattatgacccaagacagggtgataccgtgaagcattataaaatcagaaccctggataatggtgggttttacatttcccctcgcagcaccttctctaccctccaggagctggtcgaccactacaaaaaaggtaacgacgggctctgccaaaagctgagtgttccatgtatgtcctccaagcctcagaagccgtgggagaaagatgcatgggagataccccgcgaatcgctgaaactcgaaaaaaagctgggcgcaggccagttcggggaagtgtggatggctacctataacaagcataccaaggtcgctgtcaaaacaatgaaaccagggtcgatgtctgtggaagcatttcttgcggaggccaacgtcatgaaaacactgcaacacgacaaacttgtcaaactgcatgccgtggtgaccaaagagccaatctatatcattactgagtttatggccaaaggatcccttctggactttctaaaaagcgacgaaggaagcaagcagcccttgcccaagctcattgattttagtgcccagatcgcggaaggtatggcctttatagaacagagaaattatatacatcgcgatctgcgagctgcgaacatcctagtttctgcctccctggtctgtaaaattgcggactttggcctggcacgtgtcatcgaggataacgagtacactgcacgagagggagccaagttccccatcaagtggacggctccagaggccattaactttggatcatttaccattaaaagcgacgtatggtcctttggcatactcttaatggagattgtaacctacggccgcattccataccccggtatgtccaaccccgaggtcatcagggctctggagaggggctacaggatgcctcgtccagaaaattgccctgaggagctgtacaatatcatgatgcgctgttggaaaaacaggcctgaggagaggccgaccttcgagtacatccaaagcgtcctcgatgacttctacacggctaccgaaagccaatatcagcagcagccatag

SEQ ID NO: 15411 - DNA, 1518 bp, Artificial Sequence
  Description of Artificial Sequence: Synthetic coding sequence
atgggctgcatgaagtctaagttcctgcaggtcggcggcaatactttcagcaagaccgagacctctgcttctcctcactgcccagtgtacgtgccagatcctacgtcaacaatcaaacccggtccaaattctcacaactccaacaccccaggtattcgcgaagctggctctgaagacattattgtggtggcactgtacgattatgaagctatccaccacgaggacctgtcctttcaaaaaggggaccagatggtagtgttggaggagtctggcgagtggtggaaggcgcgaagcctggctacaaggaaggagggctacataccatccaattacgtggcgagagtggactccctggaaaccgaggaatggttttttaaaggcatttccaggaaggacgccgagcggcagctccttgcccccggaaatatgctgggcagcttcatgatccgtgactcagaaactaccaaggggtcttattcactcagcgtacgggattatgaccctcggcaaggcgataccgtaaagcattacaaaatccgaacactcgacaatggcggtttctatatctctcctcgaagcaccttttcaacactgcaggagcttgtggaccactacaagaaggggaacgatggcttatgccagaagctgagcgtcccgtgcatgtcttccaaaccccagaaaccatgggaaaaggatgcctgggagatccccagagaatccctgaagcttgagaaaaaactcggcgccggccagtttggggaagtgtggatggcaacttataataagcatacaaaggtcgcggtcaagacaatgaagcccggatctatgtcagtagaggcgtttctggccgaggctaatgtcatgaagacactccagcacgataagctcgtgaagctccacgctgtcgtaacaaaggagcccatatacattatcactgagtttatggccaagggtagtctgctggacttcctgaaaagtgacgaagggtcaaaacaacctcttcccaagctcattgacttttctgcacaaattgccgagggcatggcttttattgagcaacggaattacattcatcgcgacctccgcgccgctaacatcctggtaagtgcaagcctcgtctgcaaaatagcggactttgggcttgccagggtcatcgaggataatgagtacaccgcccgcgaaggtgcaaagtttcctataaaatggacagcccctgaagcgattaacttcggctcttttactattaagagcgacgtgtggagtttcggcatcctcctaatggagattgttacatatggaagaatcccatatccagggatgagtaaccccgaggtgatcagggccttagagcgaggatatagaatgcccaggcctgagaactgccccgaagagctctacaatattatgatgcgctgttggaagaacagaccagaggagcgcccaacatttgagtacatccagtccgtgctcgacgatttctatacagcaactgagagccaatatcagcagcagccatag

SEQ ID NO: 15412 - DNA, 1521 bp, Artificial Sequence
  Description of Artificial Sequence: Synthetic coding sequence
atgatgggatgtatgaagtctaagtttctccaggtcggggggaatacgtttagcaaaacagagacctctgcatcgccacactgtcccgtgtatgtccccgatcccacttctactattaagcctggccctaattcgcacaatagtaatacacctgggataagggaggccggaagcgaagacattattgttgtcgcattatacgactacgaggcaattcatcacgaagatcttagctttcagaaaggcgatcagatggtggtcctcgaggaatcaggagaatggtggaaagcacgctcgctggctaccagaaaagaagggtacatcccgtccaactacgttgccagagttgattccctggagactgaagaatggtttttcaaaggtatctctcggaaagatgccgagagacagctgcttgcccctggaaacatgctggggtctttcatgattcgagactctgaaacaactaagggaagctactccctgtctgtgcgagactacgatccacggcagggggacacggtgaagcactataaaatcagaactctggataatggtggcttctacatctctcctagatctacattcagcaccctccaggagctggttgatcactacaagaagggtaatgacggattgtgccagaaactgtcagtcccctgtatgtcatccaaacctcaaaagccatgggagaaggatgcatgggagatacccagggaatccctgaagttagaaaagaagctaggtgctggtcaatttggcgaggtgtggatggctacttacaacaagcacaccaaagtcgcagttaagactatgaagccgggcagtatgagtgtggaggccttccttgccgaggccaacgtgatgaaaaccctgcagcatgataagttggtaaaactgcatgctgtggtgacaaaagaacctatctacatcatcactgaattcatggccaagggctcactgctcgattttctgaagtccgatgaaggatctaaacagccactccctaagctaatcgacttctccgcccaaatcgctgaaggtatggccttcatcgagcaacggaactatatacatagggatctgcgcgctgctaacattctagtgtcggcatccttggtgtgtaagatcgccgattttggacttgctagggtcattgaagacaatgaatatactgcgagggagggagccaaattcccaatcaagtggaccgcgcccgaggcgattaattttggctcctttacgattaagtcggacgtttggtccttcgggatactgctgatggagattgtaacctatggtaggattccttacccaggcatgagcaaccctgaggtcatccgagccctggagaggggatatcgcatgcctaggcctgagaattgccctgaggagctttataatatcatgatgcgttgctggaaaaacagacccgaagaacggccaacattcgaatatatacagagcgtacttgatgacttctacaccgccacagaaagtcaatatcagcagcagccatag

SEQ ID NO: 15413 - DNA, 1518 bp, Artificial Sequence
  Description of Artificial Sequence: Synthetic coding sequence
atgggctgtatgaaaagtaaatttctgcaagtgggaggtaacacttttagcaagacggaaacatctgccagcccccactgccctgtgtatgtacctgatcccacttctactatcaagccgggccccaatagccataatagcaatactcctggcattcgagaagccggaagcgaagatataattgtcgttgctctgtatgattacgaagccatacaccatgaagacctgtcttttcagaaaggagatcaaatggtcgttctcgaggagtcaggtgaatggtggaaggcccgctccctagccacgagaaaggagggctacattccaagcaactatgttgcacgtgttgatagtcttgaaactgaggaatggttcttcaagggcatttccagaaaagatgccgaaagacaactgctagcgccggggaatatgctcgggtccttcatgattcgggactctgagaccacgaaaggctcctattcactgagtgtccgcgactacgatccacgacaaggagacacagtcaagcactacaagatccgaaccctggacaatggtgggttttatatctctcccagatcaacattctcaaccctgcaggagctggtcgaccactataagaaaggcaatgacggactgtgtcaaaaacttagcgtcccctgtatgagcagtaaaccccagaagccttgggagaaggatgcctgggaaattccacgcgaatctctgaagctggaaaagaagcttggcgcagggcaattcggggaggtctggatggcaacttataacaagcatacgaaagtggccgttaaaacaatgaagcccgggtccatgtcggtggaagcctttctggctgaagccaatgtgatgaagacccttcagcacgataaattagttaaactgcatgctgtggtcacgaaagagcccatctatattattaccgaatttatggcaaaagggtctctgctggattttctcaagtccgacgagggttctaagcagccgctcccgaagttgattgacttctctgctcagattgcagagggaatggcgtttattgagcagagaaactacattcaccgggatttgagggccgcaaatatcctcgtgtcagcctccctcgtctgtaagatcgctgacttcggcctggcacgggtgatcgaggacaacgaatacaccgccagagaaggagccaagttcccaatcaaatggacagcacccgaggcgattaactttggcagttttaccattaagagcgacgtttggagtttcggtatccttctgatggagattgtgacttacgggcgaattccatatcctgggatgtctaaccccgaggtgattagggctctggagcgagggtatcggatgcctagacccgagaactgccccgaggaactttacaacattatgatgaggtgttggaaaaaccgacccgaagaacgcccaacattcgaatacatccagagtgtgctggacgacttctacacagccacagaatctcagtaccagcaacaaccctag

SEQ ID NO: 15414 - DNA, 1632 bp, Artificial Sequence
  Description of Artificial Sequence: Synthetic coding sequence
atgttactgcggtccaagccagctctaccaccgcctctgatgcttctgctgcttggacctctggggccactgagtcctggagccctgccaaggcctgcacaggcccaggatgtggtggacctcgacttctttactcaggagcctttgcacctagttagcccaagttttctcagtgtgaccatcgacgccaatctggctactgatcctcgctttttgattctgctgggctcccctaaactccggactctagctcgcggactcagcccagcctacctgcgttttggcgggacaaaaactgactttctcattttcgatccaaagaaggagagtaccttcgaagaacggtcttattggcagagtcaggtgaaccaggacatttgcaagtatggctccattcctccagacgtggaagaaaagctgcgcctcgaatggccctatcaggaacagttactgttgcgggaacactaccagaagaagttcaaaaatagcacctacagtagatcttcagttgacgtgctgtatacgtttgccaactgctccgggctggatttgatctttggcctaaatgccttactaagaactgccgacctccaatggaattcatcaaacgcacaactgctgcttgattattgctccagtaaagggtataatatttcatgggagctgggcaacgagcctaacagttttctgaagaaggctgatatcttcattaacggcagtcagcttggcgaggatttcatccaactgcataagctgctccgaaagagcactttcaaaaatgcaaaactctatggccctgacgtcggccagcctcggaggaaaacagccaaaatgcttaaatccttcctaaaggcgggcggcgaagtgattgattccgttacctggcaccactactatctcaatggacgcacagctacaaaagaagatttcctgaaccccgacgtgctagatattttcatttcatcagtccagaaagtattccaggtagttgagtccaccaggcctggcaagaaagtgtggcttggtgagacctccagtgcctatggcggtggcgcaccattgctctccgacacctttgcagccggtttcatgtggctggacaaactgggcttaagtgcgcgtatgggaatcgaggtcgtaatgcggcaagtattcttcggcgctggaaactatcacctggttgacgagaacttcgacccgcttcctgattattggctatccctgctgtttaaaaagttggttggaacaaaggtacttatggcatcagttcagggctcgaaaaggcgcaagcttagggtgtatctccactgtaccaacacagacaacccaagatacaaagaaggggacctcaccctgtacgctatcaacctgcacaatgtgacaaagtacttgcggctgccttatcctttttctaacaagcaggtggacaaatatctgcttcggcccctcggcccacacggcctgctatccaagtctgttcagcttaatggccttaccctgaagatggtcgacgaccagactctcccccctctcatggagaagccccttcgcccgggcagctcactaggccttcctgcatttagctatagctttttcgtgatcaggaacgccaaggtggccgcctgtatttag

SEQ ID NO: 15415 - DNA, 1632 bp, Artificial Sequence
  Description of Artificial Sequence: Synthetic coding sequence
atgctgctgagatctaagcccgccctgcctccccccttgatgttgctgttactgggacccctgggaccccttagcccaggcgccctgcctaggcccgcccaggcacaagatgttgttgatctcgattttttcacgcaggagccactccatctggtctctccttccttcctctctgtcacaatcgacgccaacctggcaactgatcccagattccttattctgttggggagtcctaagctgagaactctcgcacggggcttatccccggcgtacctacgcttcggtggtacaaaaacagactttttaatcttcgaccctaagaaggaaagtacttttgaggaaaggagctattggcaaagccaggtgaatcaggatatttgtaaatatggtagtatcccgcctgacgtggaagagaaactcagactggaatggccgtaccaggaacagctgctgctgagagagcactaccaaaagaaatttaaaaattctacatactctcgctcttccgtcgacgtcctctatacgtttgcgaattgtagcggcctggatttaatcttcggcctgaacgcactgttgagaaccgctgacctgcagtggaactcaagtaacgcacagctgctcctggactattgctcttctaagggttacaatatctcctgggagctcggcaacgaaccgaacagcttcttgaaaaaagctgatattttcattaacggaagtcaactaggggaagacttcatccagttgcataagctacttcggaaatccaccttcaaaaatgccaaattgtatggtcccgacgtgggacaacctcgccgtaagacagccaagatgctaaagtcctttctgaaggccggcggagaggtgatagatagcgttacatggcatcactactacctaaacggaagaaccgccaccaaagaggatttcctcaatcccgatgttctggatatttttataagctcagtccagaaggtgtttcaagtagtggaaagcaccaggcccggtaagaaagtttggctgggagagacctctagtgcgtatggaggaggcgcccccttgctgtctgataccttcgcggctggatttatgtggttggacaaattggggctctccgctcgcatgggaattgaggttgttatgcgccaagtgtttttcggagcaggcaactatcacctggtcgatgagaattttgatcccctgcctgactattggctctccctcttgtttaagaaattggttggaacaaaagtcctgatggcttctgtgcagggaagtaaaagacgcaaactccgtgtgtatctgcattgcacgaataccgataacccgagatataaggagggggatctgaccctctacgcgatcaacctgcataacgtaaccaaatatctcagactgccctacccattctcgaacaagcaggttgataaatacctgttgcgccctcttggaccacacggcttactgtccaagtctgtacagttgaacggtctgaccctgaagatggtggatgaccagaccctccctccactgatggaaaagcctctgcggccgggctcgtcacttggtcttcctgccttctcttattctttttttgtcatcagaaatgcaaaagttgcagcgtgtatctag

SEQ ID NO: 15416 - DNA, 294 bp, Artificial Sequence
  Description of Artificial Sequence: Synthetic coding sequence
atgttgctgctgctgggacctcttggccccttgtcaccaggcgccttaccaaggcccgctcaggctcaagacgtggtcgacctagacttttttacccaggagcctctgcatttagtcagtccttcgtttctgtcagtgacccgcccgggcaagaaggtgtggctaggagagacttcttcggcttatggaggtggcgctcccctcctgagtgacacctttgcagctgggttcatgtggctggacaagttgggcctgtctgcccgcatggggattgaagtcgtcatgaggcaatag

SEQ ID NO: 15417 - DNA, 1410 bp, Artificial Sequence
  Description of Artificial Sequence: Synthetic coding sequence
atgcttttgcggtctaaaccagcactgccccctcccctcatgttgctactgcttgggcccttgggacctctatcccccggcgccctacctagacctgcccaggcccaggacgtcgtggatctggacttttttactcaagaacccttgcacttggtaagcccttcattcctttccgtaacaatagacgctaacctcgctacagatccacgttttcttatcctcttgggtagtccaaagctgcggacgctggcccgtgggttatctccagcataccttcgtttcggaggcaccaagacagacttcctaatctttgaccctaagaaggaatctacattcgaggaaaggagctattggcagagccaggtgaaccaggacatctgcaaatacgggtcaattccacccgacgtcgaagagaagttgaggctggaatggccttaccaggagcagctgctcctgagggaacattaccaaaagaagttcaagaactccacgtatagtaggagctcagtggacgtgttgtataccttcgccaattgctccggacttgacctcatcttcggtctgaatgctcttctgcgtactgccgatctccagtggaacagctctaatgcacagctgctgctggattattgctcatctaaggggtataacatttcttgggagctgggaaacgagccgaattcatttctaaagaaggctgatatttttatcaacggatctcagttgggtgaggacttcattcaactgcataagctgcttcgcaagagtacattcaagaatgcaaagctctacggacccgatgtgggacaaccccgaaggaagacagccaagatgctcaagtccttcctcaaggcagggggggaggtaatcgatagcgtcacatggcatcattattacctgaatgggcggaccgctacaaaggaagacttcttgaatcctgacgttctggacatctttatcagtagcgtgcagaaggtgttccaggactactggcttagcctgctgtttaagaagttagtggggaccaaggtcctgatggctagtgtgcagggctctaagagaagaaaactccgagtctatctgcattgtacaaacaccgataatccaaggtataaagaaggagatttaaccctttatgcgatcaacctgcataatgtaaccaagtacctgaggctcccataccctttcagtaataaacaagtagataaatatttattaagacccctgggccctcatggattgttaagcaagagcgttcagctgaatggcctgactctcaaaatggtcgacgaccagacacttccacctctgatggagaaacccctgagacctgggtcaagccttggtctgcctgctttcagttacagcttcttcgtgatccgcaatgcgaaggtggcagcctgcatatag

SEQ ID NO: 15418 - DNA, 1458 bp, Artificial Sequence
  Description of Artificial Sequence: Synthetic coding sequence
atgctgcttcgcagcaaaccagcactacccccccctctgatgttactcctcttgggcccacttggcccactctctcccggcgctctgcctcggccagcccaagctcaagacgtcgttgatttggactttttcacgcaggaaccactgcacctcgtgagtccctcatttctgagcgtgacaattgatgcgaacctcgcgacagaccctagattcctgatccttttaggtagtcctaagctaagaacattggcccgaggactgagcccggcatacttgagattcggcggcaccaagactgactttctgatctttgatccaaagaaggagtccacatttgaggagaggtcctactggcaatcgcaggttaaccaagatatttgcaagtatggctcaatccctcctgatgtcgaggagaaactacgcttggagtggccataccaggagcagctactcctgcgggaacattaccagaaaaaatttaaaaattctacatatagcaaacccaactcatttctaaaaaaagccgatatctttataaacgggagccagttgggcgaggactttattcagcttcataaacttctgcgaaagagtaccttcaagaatgctaaactttatgggcccgacgtcgggcagcccaggagaaaaaccgctaagatgctgaaatcattcctgaaagccggcggcgaagtcatagacagtgtgacatggcaccactactacctgaacggcagaacagccacaaaggaggactttttaaatcctgacgtgctagacattttcataagttccgtccagaaagtttttcaggtcgtagaaagcaccagacccgggaagaaagtgtggcttggagaaaccagtagcgcttacggaggcggggcccccctgttaagtgacacatttgccgcaggctttatgtggcttgacaagcttggcctgtccgccagaatgggcatcgaggtggtgatgaggcaggtcttctttggggctgggaattatcatttagtggacgagaactttgatcctctgcccgattactggctttctttgctgttcaagaagctggtcggaaccaaagtgttaatggcaagcgtgcaggggagtaagagacgaaaactcagagtctatctgcattgcaccaataccgacaatccacggtataaagaaggcgatctgaccctatacgctatcaatcttcataatgttaccaagtacctcagattaccctatccctttagtaacaagcaggtagacaagtacttgctgcgccctctgggtccccacggcctgctgagtaagagcgtgcaactaaatggccttaccttaaaaatggtcgatgaccagactctccctccactgatggagaaacctctgcgacctggctcctctctagggctgccagcttttagctactcgttttttgtgattagaaacgctaaagttgcagcatgcatttag

SEQ ID NO: 15419 - DNA, 1062 bp, Artificial Sequence
  Description of Artificial Sequence: Synthetic coding sequence
atggagaaaactctcgaaacagtaccgctggaaaggaaaaaacgggagaaagagcagtttaggaagctattcatcggcggcttgtctttcgagacgaccgaggagtcgcttcgaaattactatgagcagtggggcaaactgaccgactgcgtggtaatgcgagatcctgcttctaagcggtctagaggcttcggtttcgtgaccttttccagcatggcagaggtggacgcagccatggctgccaggccccacagtatcgacggaagggtagtggagcctaagcgtgctgtggccagagaagagagcggcaaaccaggcgcccatgttaccgtcaaaaagttgtttgtgggcggaattaaggaagacactgaagaacaccacctccgcgattacttcgaggagtacggaaaaattgatactattgagattatcactgaccgccagtccggcaaaaagcgcgggttcggctttgtgacgtttgatgaccatgacccggttgacaagatcgtgttgcagaaataccacacgatcaatggccacaatgcagaagttcggaaggctctgtcccgtcaggaaatgcaagaggtccagtcttcccgcagtggaaggggcgggaatttcggtttcggggattcgcgaggcggcgggggaaacttcggacccggccctggctcaaattttcggggcggatccgatggttatggctccgggaggggcttcggggatggctacaatgggtacggcggcggcccaggtggcggtaatttcggcggcagtcccggatatggcgggggacgaggaggatatgggggaggaggccccgggtatgggaatcaggggggcggctacggaggaggctacgacaattacggtggcgggaattacggttcagggaactacaatgatttcggaaactataaccagcagccaagcaactacggccccatgaaaagcgggaactttggaggcagcagaaatatggggggcccatatggcggcggtaattatgggcctggtggaagcggcgggagcggaggatatggagggcgctccagatattag

SEQ ID NO: 15420 - DNA, 1026 bp, Artificial Sequence
  Description of Artificial Sequence: Synthetic coding sequence
atggagagagaaaaagagcagtttaggaagctgttcattggaggtctatcttttgagaccaccgaagagtctctgagaaactattatgaacagtggggcaaactaactgactgtgtggtgatgcgggaccctgcaagtaaacggtcgagaggttttggcttcgtaacattttccagcatggcagaggtagacgccgccatggccgcccgcccgcattccatcgatggacgtgtggtggaaccaaaaagggcagtcgcccgagaggaatcggggaagccaggggcccacgtcaccgtcaagaaactcttcgtcggcgggatcaaggaggacacagaggagcaccacctgagagattacttcgaagagtatgggaagatcgataccatcgagatcataaccgatcgtcagagcggcaaaaagcgtggatttgggttcgtgacgtttgatgatcacgaccctgtggataagatcgttctccaaaaataccacactataaatgggcataacgcagaagtacggaaagctttaagccgtcaggaaatgcaggaggttcagtcgagccgatctggaaggggaggcaacttcggctttggtgactccagggggggcggcggcaacttcggacctggccccggcagcaacttccgcggggggtctgatggatacggaagcggacgcggttttggcgacggctataatggctacggaggaggcccaggtggaggaaatttcggagggtcccccggatatggaggcggcaggggcggctatggtgggggggggcctggatacgggaatcaggggggcgggtatggggggggctacgataactacggcggcggaaattacggctccggcaactacaatgactttgggaactacaaccagcagcctagtaactacggacccatgaaatctggaaacttcggtggaagcagaaatatgggcggcccttacggcgggggcaactatggcccgggggggtccggggggagtggtgggtatggagggcgcagccgctattag

SEQ ID NO: 15421 - DNA, 1062 bp, Artificial Sequence
  Description of Artificial Sequence: Synthetic coding sequence
atggaaaaaactttggagacagtgcctctagagcggaaaaagagggagaaggagcagttcaggaagctctttataggaggactatctttcgaaaccaccgaagaaagtctaagaaattattacgagcagtggggtaaacttacagactgcgtggtgatgagggatccagcatccaaacgttcccggggctttggcttcgtcaccttctcttcgatggcggaagtcgacgccgctatggccgccagaccccacagcatcgacggccgagtggtggagcctaagcgtgccgtggccagagaagagagcgggaaacccggcgctcacgtcacagtcaaaaaactgttcgtgggtggcatcaaggaagacacggaagagcaccatcttagagattacttcgaggagtacggcaagatagataccatcgagatcattacagatcggcaatccggaaagaaacgcggatttggctttgttaccttcgatgaccacgatccagtagataaaatcgttctgcaaaagtaccacactatcaatggccacaacgctgaagtgcggaaagccctcagtaggcaagagatgcaggaagtgcaatccagcaggtcaggccggggaggcaatttcggatttggcgacagtcggggtggaggcggtaactttggacctggcccaggaagcaacttccgcgggggctctgacgggtatggctctgggaggggatttggggacggctacaatggttacgggggagggcccggcggcggtaacttcggcggctccccaggttacggtggagggcgcggagggtatggcggtggtggtccaggttatggcaaccagggcgggggctatggaggggggtacgacaattacggcggcggcaattacgggtctgggaactataatgacttcggcaactacaatcagcagccatcaaattatggcccaatgaagtcagggaatttcggtgggtcgcgcaatatgggtgggccatatgggggcggtaactacggtccgggagggtctggggggtctggaggctacggtggccgatctagatattag

SEQ ID NO: 15422 - DNA, 750 bp, Artificial Sequence
  Description of Artificial Sequence: Synthetic coding sequence
atggaacgcgaaaaagaacaatttaggaagctgttcatcggagggctgagtttcgaaactacagaagaatctctccgcaattactacgaacaatgggggaagttgacagattgtgttgtgatgcgagatcccgccagcaagagatcccggggttttggctttgtgacatttagcagcatggccgaagtagacgctgcaatggcggcccgtcctcatagtatagacggccgcgtcgtcgaacctaaaagagccgttgccagagaggagagtgggaaacccggcgcacacgtgaccgtaaagaaactattcgtcggagggatcaaagaggataccgaggagcaccacctgcgggactattttgaggagtatgggaaaattgacactatcgagataattacagacaggcaaagtggcaagaagaggggattcggttttgtcacgtttgacgatcacgatcccgtcgataagatcgtgcttcagaaataccacacaatcaatggtcataacgcagaagttcgtaaggctctttcaagacaggagatgcaggaagacttagaggtcgcaatcctagaagttgcgcctgtgatggaggaagaggaagaggacatggtggttgaagatcttgacatggccacaagggtcggcgcaacggaggtggtcatgaccacaatggaagaagaaataatggaggtggaaattacaatgattctggagatcatcacgtctaacctcctgactacagttcagtag

SEQ ID NO: 15423 - DNA, 846 bp, Artificial Sequence
  Description of Artificial Sequence: Synthetic coding sequence
atgtctgaagagcagtttggcggcgacggtgcagcaggaaacggaggaggacgccgagccggcgagcaagaaggcgctatggttgcggctacccagggggccgcggcacgggaagctgagccaggcccgggcgcagagcccagattggaagctccgaagggtgctgagtctgagggcgctaaaattgatgcatctaagaacgaggaggacgagggtaaaatgttcattggtggcctgtcttgggacacgacaaagaaggacttgaaggattacttcagcaaattcggggaggtggtggattgcactctgaagttggaccccattaccggccgttctagggggttcggtttcgtgctgttcaaagaatccgagtcagtcgataaagttatggaccagaaggagcacaaattgaatggtaaggttattgacccaaagcgagcaaaggctatgaaaacaaaggagcctgtaaagaagatttttgtgggcggtctgtcccccgacactcccgaggagaagatcagagagtatttcgggggctttggcgaagtggagtctatcgaattacccatggacaataagactaataagcgaagggggttctgcttcatcaccttcaaggaggaggagcctgtgaaaaaaattatggaaaagaagtatcacaatgtgggcctttccaaatgcgaaattaaggtcgccatgtccaaggaacagtatcagcagcaacagcagtgggggagtaggggtggctttgcaggacgagcccgcggtcggggcggggaccagcaaagcggttacggaaaagtgagtcgcaggggtggccaccaaaacagttataagccatactag

SEQ ID NO: 15424 - DNA, 1068 bp, Artificial Sequence
  Description of Artificial Sequence: Synthetic coding sequence
atgtctgaagagcaattcggcggagatggagccgcagccgccgccaccgccgccgtcggcggcagtgctggtgaacaggaaggagcaatggtcgccgctacgcaaggggcagccgcagctgccggtagcggcgccggaactggagggggtacagcatctggaggtaccgagggcggcagtgctgagagcgaaggcgccaagatcgacgcctccaagaatgaagaggatgaagggcactctaatagttctccacgccattctgaggctgctaccgcccagagggaggaatggaaaatgttcattggcggtctctcctgggacaccacgaaaaaagatttaaaggactacttctctaagtttggtgaggttgtggattgtactctgaaactcgatcccataaccggacgcagccggggatttggttttgtgttgttcaaagagagcgagagtgtggataaggtcatggaccagaaagaacacaaactgaacggtaaagtcatcgacccgaagcgagcgaaagcgatgaaaaccaaggaacccgtcaagaagattttcgtagggggactttctcctgatacccctgaggagaagattagagaatattttggtggcttcggggaggttgagtcaattgagctccctatggataataagacgaacaagaggagaggattttgttttatcacatttaaggaagaagagcctgttaagaaaatcatggagaagaagtatcacaacgtgggtctgtccaaatgtgaaatcaaggttgcaatgtctaaagagcaatatcaacagcagcagcagtggggctcccgcggtggctttgcaggtagagcgcggggtcgagggggtggcccatcacagaactggaatcagggctatagcaattactggaatcagggttatggtaactacggatacaacagtcaggggtacggtgggtacggcggctacgattacaccggatacaataactactatggctacggcgactatagtaaccagcaatctggctacggcaaagttagtagaagggggggacatcaaaactcttataagccatactag

SEQ ID NO: 15425 - DNA, 1011 bp, Artificial Sequence
  Description of Artificial Sequence: Synthetic coding sequence
atgtccgaggagcaatttggcggggacggagccgctgctgctgccaccgccgctgtcggcggtagcgctggcgagcaggagggagctatggtggctgccacccagggcgctgctgccgcagccggttctggcgcaggaaccggtggcggaaccgcctcagggggcacagaagggggatctgcagaaagtgagggcgcaaagattgacgctagtaagaacgaagaagacgaaggcaaaatgtttatcggcgggttgtcatgggacactaccaagaaggacttgaaagattattttagcaagtttggtgaggtcgtagactgtactcttaaactggatcccattacagggaggtctagaggcttcgggttcgtgctgttcaaggagtccgagtctgtcgataaagtaatggaccagaaggagcacaagctgaacggcaaagtgatagaccccaaacgcgctaaagccatgaagacgaaggagccagtgaaaaaaattttcgtcggtggcttgagccccgacactcctgaggaaaagattagagaatactttggcggctttggagaggtggagtccatcgagcttcctatggataacaagaccaacaagcgcaggggattttgtttcattacttttaaagaagaggagccggtgaaaaagatcatggagaagaagtatcacaatgttggtctttcaaaatgtgagatcaaggtcgcaatgtctaaagaacagtaccagcagcaacaacaatggggatcacgcggcgggtttgcgggcagagcgagggggaggggtggcggaccctctcagaactggaatcaaggttacagcaattactggaatcaggggtacgggaattatggctataacagccagggctacggaggatatgggggttatgattacaccggctacaataactattacggatacggagattactccaaccaacagtcggggtatgggaaagtcagtaggcgcggcggccaccagaactcatataagccctactag

SEQ ID NO: 15426 - DNA, 921 bp, Artificial Sequence
  Description of Artificial Sequence: Synthetic coding sequence
atgtcagaagaacagtttggcggtgacggggccgctgcggccgccaccgcggcagtgggcggctctgctggcgaacaggagggagcaatggtggcagccacacagggggcggccgcagctgcaggcagtggtgcaggaactggcgggggtacagcaagcggcggtacagagggcggcagcgctgagtccgagggggctaaaattgatgctagcaaaaatgaggaagatgagggccacagcaatagcagccctcggcatagcgaagcggcaactgcccagagggaggagtggaagatgttcattggggggctgtcctgggacacaaccaaaaaagacctcaaagactacttttcgaaattcggtgaagtggtggactgtacacttaaactcgaccctatcaccggacggtcccgcgggttcggattcgttctgttcaaagaatctgagagtgtggataaggtgatggaccagaaagaacacaagttaaacgggaaggttatagacccgaagagagcaaaggccatgaaaaccaaagagcctgtgaagaaaattttcgtcggggggttgagcccagacacacccgaggaaaaaattagggagtacttcggaggattcggcgaagttgagagcattgaactgcccatggacaataagacaaacaaacgcagggggttttgcttcattactttcaaagaggaagagcctgtgaaaaagatcatggaaaagaagtaccataatgtcggcctttccaagtgcgaaattaaggtggcaatgagtaaagagcagtaccaacaacaacagcagtggggctccagagggggattcgccggaagagcccgaggtaggggcggggatcagcaaagcgggtacgggaaggtaagccggagaggtggacaccagaactcctataaaccatattag

SEQ ID NO: 15427 - DNA, 468 bp, Artificial Sequence
  Description of Artificial Sequence: Synthetic coding sequence
atgtcggaggagcagttcggtggcgacggagccgctgcagcggcaaccgccgctgtcgggggcagtgcaggagagcaggagggagctatggtcgccgcgacacaaggagccgcagctgctgctggcagcggggctggcacaggaggcgggacggccagtggtggcacagagggaggcagcgcagaatccgaaggggccaaaatcgatgccagtaaaaatgaagaggacgagggaaagatgttcatcggcggcctgtcttgggatacaacaaaaaaagatttgaaggactacttctccaagtttggtgaggtcgtggattgcacactgaagctcgaccccattaccggtcgcagcagggggtttgggttcgtgcttttcaaggagagcgaaagcgtggataaggtaatggatcagaaggagcataaattaaacggcaaggtaatcgaccccaaaagggctaaggcctag

SEQ ID NO: 15428 - DNA, 666 bp, Artificial Sequence
  Description of Artificial Sequence: Synthetic coding sequence
atgtcggaagagcagttcgggggggatggcgctgctgccgctgccactgcagcagttggcggttccgccggggaacaggagggggcaatggtggccgcaacacaaggggccgccgccgcagctggatccggcgccgggactgggggcggtacagcttcaggcggcacggaaggaggtagtgccgaaagcgaaggtgctaaaattgatgccagcaaaaatgaagaagacgaaggccatagcaattccagtccccggcactcagaagctgccactgctcagagggaggaatggaagatgttcataggcggcctcagctgggatactaccaagaaagatctgaaagattatttttctaagttcggtgaggtcgtcgattgcacactgaaactagatcccataacggggcgcagcagaggcttcgggtttgtgttgttcaaagagtccgagagcgtcgataaggtcatggaccagaaagaacacaaactaaacgggaaggttatcgacccaaaacgcgctaaagcaatgaagacaaaggaacccgtaaaaaagatattcgtcggaggactctcccccgatacaccggaagaaaaaatacgggagtactttggaggcttcggagaagtagaatccatagaactgcccatggacaacaaaaccaataagtag

SEQ ID NO: 15429 - DNA, 633 bp, Artificial Sequence
  Description of Artificial Sequence: Synthetic coding sequence
taaaaaatgtttattggaggcctctcatgggacactacgaagaaggacctgaaagattatttcagcaaattcggcgaggtggtggattgcacacttaaactcgatccaattaccgggcggagtagagggttcggcttcgtcttatttaaggagagcgaatctgtcgacaaagtgatggatcagaaggaacataaattgaacgggaaagttatcgaccctaaacgggcaaaggccatgaaaacaaaggagccggttaaaaaaatcttcgttgggggtctgtctcctgataccccagaggaaaagatcagagaatattttggtggctttggagaggtagagagtatcgagctgcccatggacaacaaaaccaataaacgacgggggttctgcttcattacatttaaagaggaagagccagtgaaaaaaatcatggaaaagaaataccataacgtcggccttagtaagtgcgagatcaaagttgcaatgagcaaagagcagtatcagcagcaacagcagtgggggtcccggggcggtttcgcagggagagctagaggccggggaggggatcagcagtccggatatgggaaggtaagccgccgtggaggtcatcaaaacagctacaagccttactag

SEQ ID NO: 15430 - DNA, 606 bp, Artificial Sequence
  Description of Artificial Sequence: Synthetic coding sequence
atggaccagaaggaacataaactcaatggaaaggtcattgaccccaagcgcgcgaaggccatgaagactaaggagccagtcaagaagattttcgtgggcggcctgtcgcctgacactccagaggagaagataagggagtactttgggggctttggagaggtggaaagcattgagctgccaatggataacaagacaaataagcgacggggcttttgtttcattacatttaaagaggaggaacccgtcaaaaaaataatggagaaaaagtaccataacgttgggctgtcaaaatgcgagatcaaggtcgcgatgagtaaggaacagtaccaacaacagcaacagtgggggagccgaggcgggtttgcagggagggcacgtggcagaggtggaggcccttcccagaattggaatcagggctacagtaactactggaatcaaggatacggaaattatgggtacaattcccaggggtacggaggctatgggggctatgactacacaggttataacaactattacggctatggggactatagcaatcagcagtccgggtatggtaaagtgtctcgccgtggggggcaccagaactcctataagccctactag

SEQ ID NO: 15431 - DNA, 912 bp, Artificial Sequence
  Description of Artificial Sequence: Synthetic coding sequence
atgagcgaagagcaattcggtggcgatggtgccgccgccgccgccaccgcagctgcaagcggaggcacagagggcggtagcgctgagagtgaaggtgccaaaattgacgcctccaaaaatgaggaggatgaaggtaagatgttcattggcggcctcagttgggacaccactaagaaagatcttaaagactacttcagcaagttcggggaggtggttgattgcacactcaaattagacccaattacgggtcggtctcgggggtttggcttcgtgctcttcaaggagagcgaaagcgtcgacaaggtgatggaccagaaggagcacaaactcaatggaaaggtgattgatccaaagcgagctaaggccatgaagacaaaggagcctgtgaagaaaatcttcgtgggaggacttagtccagacactcccgaagaaaagattcgcgaatattttggtgggttcggagaggttgagagtattgagctccccatggataacaaaacaaataagaggagaggattttgctttatcaccttcaaagaggaggagcctgtgaagaagattatggagaaaaagtaccacaacgtcggactaagcaaatgcgaaattaaggtggccatgtctaaagagcaataccagcagcagcaacagtggggttcccgcgggggtttcgccggtcgcgcacgcgggcgcggaggggggccctcacagaattggaaccagggatatagcaactactggaaccaggggtacgggaattacggctataactcacagggatatggtggctatggtgggtatgactacacggggtacaacaactattatgggtatggcgattatagcaatcaacagtccggctatggaaaagtttcccggcgaggcggccaccagaattcctataaaccatactag

SEQ ID NO: 15432 - DNA, 1974 bp, Artificial Sequence
  Description of Artificial Sequence: Synthetic coding sequence
atgcctcgttacactgtccacgtcaggggggagtggctggccgttccttgtcaggacgcccagctaaccgtgggctggctggggagagaagcagtacgcaggtacatcaaaaataagcccgacaacggaggatttacaagcgtggacgacgcccattttctggttcgccgttgcaagggactcgggctgctcgataacgaggacaggttggaagtggccttggagaataatgagtttgtggaggtagtgatcgagggggacgctatgtcaccggactttatccctagccagcccgaaggcgtctacctctactctaagtatcgtgagcccgagaagtacatcgaactagatggagatcgcctgacgaccgaagacctggttaacctcgggaagggcagatataagatcaagctcaccccaactgctgagaaacgggtgcagaaatccagagaggtaatcgattccattattaaggaaaagacggtggtttatggaataaccaccgggtttggcaagtttgcgaggacagtgattcccatcaacaaattgcaagagctgcaggtgaatctagtcagatctcatagtagtggcgtgggcaagcccttgagtcccgaaagatgcagaatgcttctggcgctgcgcattaatgtactggcaaagggatattctggcattagcttggagaccctgaaacaggtgatagaaatgttcaatgcttcctgtctgccatacgtgcctgaaaaaggtacagtgggggccagtggtgatttagctcctctatcacatctcgcattgggactcgtgggcgagggcaagatgtggagtcccaaaagcggctgggctgacgccaagtatgtcctggaagcgcacggccttaaacctgttattctaaagcccaaagaaggcttagcgctcattaatggaactcagatgatcacttctctgggctgcgaggctgtagagagagctagtgccatcgcaagacaggccgacatagtcgccgctctgacactggaagtgctcaaaggtacaacaaaagcatttgacactgatatacatgccttgagaccacaccgcggccagattgaggttgcattccgcttcaggtctctcctggacagtgaccaccatccctcagaaatcgccgagtcacaccgcttctgcgatcgtgtgcaagatgcctacacacttcgatgctgtcctcaggtccatggggtcgtgaatgacactatcgccttcgtgaaaaacatcataactacagaattaaacagtgcaaccgacaaccccatggtgttcgccaacagaggggagacagtctcaggtggcaactttcacggagagtacccggccaaagccctggactatcttgcaatcggaattcatgaactggccgctatctcagaacgccggatcgaacggctatgtaacccttccctctctgaactgccagccttcctggtggctgagggcgggttgaattcaggcttcatgatagcacactgcacggctgctgcgctcgtgtccgagaacaaggctttgtgccacccctccagcgtggactccttgtctacttcagcagcaacagaggaccacgtaagcatgggagggtgggcggccagaaaagcactgagagtcattgaacacgtcgagcaggttttagctatcgagctgcttgcagcctgtcaaggcattgagtttctgcgaccactgaagactacaacgcctttggaaaaggtctatgatcttgtcagatccgtagtgcgcccctggatcaaggaccggttcatggctcccgatattgaagccgcccatagactgctcctcgagcagaaggtgtgggaagtggcagccccttacattgagaaatataggatggagcatattccagagagcaggcccctgagccccaccgcattctctcttcagtttctgcataaaaagagcacaaagatccctgaaagcgaagatctgtag

SEQ ID NO: 15433 - DNA, 1776 bp, Artificial Sequence
  Description of Artificial Sequence: Synthetic coding sequence
atgccaaggtacacggtacacgtgcgcggggaatggttagctgtgccatgccaggacgcccagcttaccgtgggatggctggggagagaagccgtgcggagatatatcaaaaacaaacctgataacgggggattcactagcgtcgacgacgcccattttctagtcagaagatgtaaaggtctcggtttgcttgataacgaagatagactcgaggtggcactcgagaacaacgagtttgtagaggtagtaatagaaggcgatgccatgagtccagatttcataccctcccagccagagggcgtatacttatactctaagtacagagagccggaaaaatatatcgaactcgatggggatcgacttacaaccgaggacttagtgaatctggggaagggtcgttacaaaatcaagctgactcctaccgcggagaagcgagtccagaaatcacgggaagtcattgacagcataattaaagaaaagaccgtggtgtacggcatcacaactggctttggaaaatttgcaaggacggtgattcctattaataagctccaggaattgcaagtcaaccttgtgaggagtcacagttccggggttggcaaacccttatcccctgagagatgtcgcatgctgttagcgttgaggataaacgtgctcgccaagggctattccgggatctcattggagactctaaagcaggtgattgagatgttcaatgcgtcttgcctgccctatgtacccgagaaggggactgtgggtgcatccggcgaccttgccccactgagtcatttagctctcgggctggtcggggagggaaaaatgtggagtcccaagtccgggtgggccgatgcaaagtatgtcctcgaggctcacgggcttaagcctgtgatcctgaagcccaaggagggccttgccctgattaacggtacccagatgataacctcccttggctgtgaggctgtcgaacgcgcgtctgccatagctcggcaggcagacattgtggccgctttaactttggaggtgcttaaggggacgaccaaggcctttgatacagatattcacgcacttcgtccacatagagggcaaattgaggtggcctttcgttttaggtcactgctggattctgaccaccacccaagcgaaatcgctgagagtcatcgcttttgtgaccgtgtccaggatgcatacactctccgctgttgtcctcaggtgcacggcgttgttaatgatacaattgcctttgtgaaaaatataatcactacagaacttaattctgctacagataatcctatggtgttcgctaatcgtggcgagaccgtttccggagggaacttccacggggaataccctgcaaaggctttagattacctggccattggcatccacgaattggcagcaattagtgagcgacggatcgaaagactctgtaacccaagcctgtctgagttacctgcgttccttgtggcagagggcgggttgaactctggtttcatgatcgcacattgtacagccgctgctctggtgtctgagaacaaagcattgtgtcaccctagtagcgtggatagtctatcgactagcgccgcgaccgaggatcacgtctcgatgggtggctgggcagcacggaaagcactgagggtgatcgaacacgtggaacaagtgttggctattgagctcttggcagcctgtcagggcatcgagtttctgaggcccctgaaaaccacaactccgctcgagaaagtctacgacctggtgagaagcgtagtgagattcgggaaatag

SEQ ID NO: 15434 - DNA, 1350 bp, Artificial Sequence
  Description of Artificial Sequence: Synthetic coding sequence
atgctcttagcactaaggataaatgtgttggctaagggctactcagggattagcctcgaaacactgaagcaggtcatagagatgttcaacgcgtcctgcctaccatatgtaccagaaaagggaactgtgggtgcctccggtgatctcgcccctctgagtcacctggcccttggcttagtgggggaaggcaagatgtggagcccaaagtccgggtgggcagatgcgaagtacgtgctggaggcccacggattgaagcccgtgatacttaagccgaaggaagggctagcactcattaacggtacacagatgatcacctccctcgggtgtgaggccgttgagcgggcctccgcaatcgcccggcaagctgacattgttgctgctctgacgctggaagtgctgaaagggacaaccaaggcattcgatacagacatccacgctctccgcccacacagaggtcagattgaggttgcttttaggtttcgcagcttactggatagtgaccaccatccaagtgaaattgccgaaagccaccgattctgtgacagagtacaggatgcgtacacccttaggtgttgcccacaggtccatggggtggttaatgacaccatcgcattcgtgaagaatattattacaaccgaactgaactccgccacagataatcctatggtcttcgccaacagaggcgaaaccgtatccggagggaactttcacggggaataccctgccaaggcactcgactacctcgcaattgggattcatgaactggcggccatatccgaaaggagaatcgaacggctgtgcaacccaagtctctctgagctgcctgcctttctggtcgccgagggagggcttaacagcgggttcatgatcgctcattgtactgctgccgcattggtctctgagaataaggctctgtgtcacccttcatctgtagattcactttcaacctcggctgctactgaagaccatgtgtcgatgggtgggtgggcagcccgtaaggcactgagggtcatcgaacacgtggaacaggtcctggcaatcgagctcctggccgcttgtcagggtatcgagttcctgcgacctctcaaaaccactacaccattggagaaagtgtatgacctggtgcgctctgtggtgagaccatggattaaggaccgcttcatggctcccgatatcgaggctgcacatcgactgcttctggaacagaaggtgtgggaagtggcggccccttatattgaaaaatatcgcatggagcacattcccgagagcaggccgctgagtcctacagccttcagcctgcaatttctccataagaagagtaccaagattcccgaaagcgaagacctttag

SEQ ID NO: 15435 - DNA, 1260 bp, Artificial Sequence
  Description of Artificial Sequence: Synthetic coding sequence
atggctggcttcggagcgatggaaaagttcctcgtggaatacaagtctgccgtagaaaagaagttagccgagtacaaatgcaacactaacacagcaatagagcttaagctcgttagattccccgaagacctcgagaatgatatacgcacgttttttcccgaatacacgcatcaactcttcggggacgatgaaacggcatttggttacaagggattaaagattttgctgtactatatcgccggttccttgtcaacgatgttcagagtggagtatgccagcaaagtggatgagaatttcgactgcgtggaggccgacgacgtggaaggtaaaataaggcagatcattcccccaggcttctgtaccaataccaacgattttctgagcttgctcgaaaaggaggtcgattttaaaccattcgggacgctcttacacacgtattccgttctgtcacccacgggcggtgagaactttacctttcagatatacaaggcagacatgacatgccggggcttccgtgagtaccacgagaggctgcagactttcctgatgtggttcatagagactgcatcttttattgacgtggacgatgagcgatggcattacttcttggtgtttgaaaaatataataaagatggcgcgaccctcttcgccaccgttggatacatgaccgtctacaactattacgtttatcctgacaaaacacgaccaagggtttctcagatgctcatcctgacacccttccaagggcagggacacggagcccagctactggagactgttcatcgctactacaccgagttcccaactgtgctggacattaccgcagaggacccatccaaatcgtacgtgaagttacgagacttcgtgttggtcaagctttgccaggatctgccttgcttcagtagggagaagctgatgcagggctttaacgaggatatggctattgaggctcaacagaaattcaagattaataagcagcatgcccgacgggtgtacgaaatcttgcggctgctggttacagacatgtcagatgcagagcagtaccggtcctatagattagatataaagcgccgcttaattagcccatataagaagaagcagagggaccttgcaaaaatgaggaagtgcctcaggcccgaggaactgacaaatcagatgaaccaaatcgagattagtatgcagcacgagcagctggaggagtcttttcaggaactcgtggaggattaccgacgggtcatcgagaggctggcgcaagagtag

SEQ ID NO: 15436 - DNA, 1005 bp, Artificial Sequence
  Description of Artificial Sequence: Synthetic coding sequence
atgtttagagtcgaatacgcctcgaaagtggacgagaattttgattgtgtagaagcagacgatgtcgagggtaagatcaggcagatcattcctccaggcttctgtactaataccaatgactttctcagcttgttagagaaggaggttgattttaaacctttcggtacacttctgcacacatatagtgttctgagtcccactggaggcgagaatttcacctttcagatttataaagccgatatgacttgccgcggttttcgcgagtatcatgagcgcttgcagacttttctgatgtggtttatcgagaccgcttcctttattgatgtagacgatgagcgctggcattattttcttgtgtttgagaagtacaataaagacggggcgaccctttttgctaccgtgggatacatgactgtgtacaactactacgtgtatcccgacaaaactaggcctcgagtgagccaaatgcttatcttaactccttttcagggacaggggcacggcgctcagctgctagagaccgttcacagatactataccgagttccctaccgtgttggacataacggctgaggatccttccaagtcctatgttaagctgcgagatttcgtgctcgtgaagctctgccaggatcttccttgtttttctagggagaagcttatgcaagggttcaacgaggacatggcgatcgaggctcaacaaaagtttaagattaacaaacaacatgctcgccgagtgtatgaaattctgagattacttgtgacagacatgagtgatgccgagcagtaccgcagctatcgactggatattaagcgcaggctaatctccccgtacaaaaagaagcaaagagatttagctaagatgcgcaagtgcttgagaccagaggaactcacgaatcagatgaaccagatcgagatttccatgcagcatgagcagctggaggaaagcttccaagagctagtcgaggactaccgaagggtgatcgaacgccttgcacaggagtag

SEQ ID NO: 15437 - DNA, 870 bp, Artificial Sequence
  Description of Artificial Sequence: Synthetic coding sequence
atgaccgttagcttccacaaatatggtgaatacttcccagggaccggtgatctgcgcgacatcggtgctggtaaaggcaaatattacgcagtgaactatccactccgagacggaattgacgacgagtcctacgaagctatttttaagcccgttatgtcaaaggtaatggaaatgttccaaccctctgccgtggtgttacagtgtggctcagatagcttaagtggtgaccgcctgggctgtttcaaccttaccattaagggacatgcaaaatgtgtggaattcgtgaagtcttttaatctcccgatgctcatgctgggggggggtgggtatactataaggaatgtagcgcgctgttggacatacgaaaccgccgtggccttggataccgagattcccaatgagttgccatacaacgactacttcgaatattttggacctgattttaagctgcacatttccccctccaacatgaccaaccaaaacaccaatgaatacctcgagaagattaaacagcgtttgttcgaaaacctccgtatgctgccccatgcccccggggtgcagatgcaggccattcccgaagacgccatcccagaggagagcggggacgaggacgaggacgatccagataaacgaatcagtatttgcagtagcgacaagagaatcgcttgcgaagaagaattcagcgattctgaggaagagggggaagggggccggaagaacagcagcaacttcaaaaaggccaaacgtgtgaaaacggaggacgagaaagagaaggaccccgaggagaaaaaggaggtaaccgaagaagagaagactaaggaagagaagccagaggctaagggcgttaaggaggaggttaagctcgcttag

SEQ ID NO: 15438 - DNA, 1449 bp, Artificial Sequence
  Description of Artificial Sequence: Synthetic coding sequence
atggctcagactcagggaactcgccgtaaggtgtgctactactatgacggagatgtcggaaactactattacggacaggggcacccaatgaagcctcacagaatccgtatgactcataatctcctgctcaattatggcctgtataggaagatggagatatatagaccccacaaagccaatgctgaagagatgaccaagtaccattcagatgactatattaagttcctcaggtctatcaggccggacaacatgtctgagtacagcaagcagatgcagaggttcaacgtcggcgaagactgccccgtgtttgacgggttatttgaattctgccagctgtcgactggtggcagtgtggctagtgcagtaaagctaaataaacagcagacggatatcgccgtcaactgggcgggcggcctgcatcacgctaagaaaagtgaagcttccgggttttgctacgttaatgacatcgttctggcaattttagagctgctcaagtaccatcagcgcgtactctacatcgatatcgacatccaccatggcgatggagtcgaggaagctttctacaccaccgaccgagtcatgacagtgtcctttcacaagtatggtgaatactttcctggcaccggggatttgcgggacattggagccggaaaggggaagtactatgccgttaattaccccctgagggacgggatagacgacgagagctacgaggccatttttaagccagtcatgagtaaggttatggagatgtttcaacctagcgcagtagtgttgcaatgcggaagtgattctctctcaggcgacaggttggggtgcttcaatctaacaataaagggccatgcaaaatgtgttgaatttgttaaatcgtttaatttgccaatgttgatgctgggaggcggggggtacactattaggaacgtggcacgctgctggacatatgagacagcggtggctctggacactgaaattccaaacgaactgccgtacaacgactattttgagtacttcggacctgacttcaagttgcatattagcccaagcaatatgactaatcagaacacaaatgagtatctcgagaagatcaagcagcggctgtttgagaatctccgaatgcttccacacgcccccggagtgcaaatgcaggccattccagaagatgccatacccgaggagtcaggggatgaggacgaagacgacccagacaagaggatttcaatctgttcctctgacaaaaggatcgcatgtgaagaagaattttctgacagtgaggaggaaggcgagggaggccgtaagaactcttctaatttcaagaaggccaaaagggtgaagacagaggatgagaaagaaaaggatccggaagagaaaaaggaagtgaccgaggaagagaaaaccaaggaagaaaagccagaagctaaaggagttaaagaggaggtgaagctggcttag

SEQ ID NO: 15439 - DNA, 636 bp, Artificial Sequence
  Description of Artificial Sequence: Synthetic coding sequence
atggctcaaacacaaggcacacggcgaaaggtgtgttattactacgacggggatgttggtaattattactacggccaaggccatcctatgaaacctcatagaatccgaatgacacataacctcttgctgaactatgggctgtatcgcaagatggaaatctatcggccgcacaaggctaacgcagaggagatgacgaaataccatagcgatgattatatcaagttcttaagatccattcgaccagataacatgtctgagtatagcaagcaaatgcagcgcagttcagccgtgaagctaaacaagcagcagactgatatcgccgtgaattgggctggtggtctccaccatgcaaaaaaatctgaggcgagtggtttttgctacgtgaatgacattgttctggctatactggaactgttaaaatatcatcaacgcgtgctgtacattgatatcgacatccatcatggcgacggtgtggaagaggctttctacaccactgaccgggtgatgacggtctcattccacaaatatggcgagtacttccctggcacgggagacctgagagacattggtgctggaaaggggaaatattatgccgttaattaccccctccgtgatggaattgacgatgagagttag

SEQ ID NO: 15440 - DNA, 1044 bp, Artificial Sequence
  Description of Artificial Sequence: Synthetic coding sequence
atgcttcatactacccagctttatcagcacgtgcccgagacaagatggccgattgtttactccccccgctataatattacttttatgggactcgagaaattacacccatttgacgcaggtaagtgggggaaggtaatcaacttcttaaaggaagagaagctgctgagcgacagtatgttggtggaggctcgcgaggctagcgaggaggacctgctggttgttcacacccgcaggtatcttaacgagttgaaatggtcgttcgcagtagctactatcacagagattccgccggtcatattcctgcccaattttttggtccagcgcaaagtgctccgccccctgaggacgcagactgggggaacaattatggccgggaagctggccgtggaaaggggttgggcaatcaatgtgggcggcgggttccaccattgttcttcagaccgcggcggaggtttctgcgcttatgcagacataactcttgccatcaaattcttgttcgaacgagtggaaggaatttctcgggcaacgataatcgacctggacgctcatcaagggaacggacacgagagggatttcatggacgacaaacgagtgtacattatggatgtgtacaatcgccacatctacccgggcgatcgctttgctaaacaggctattcggagaaaagtggagctcgagtggggcaccgaggatgacgagtacctggataaggtcgaaaggaacattaagaagtctttacaagagcacctacccgacgttgtcgtctataacgcagggactgacattctcgaaggagatagactggggggtttgtctatttcccctgctggcatagtcaagagagatgagctggtgtttaggatggttcggggaaggcgtgtgcctatactgatggtgacatctgggggatatcagaaacgcacagctagaatcatcgctgactccattctcaacctcttcggattaggcctgattggccctgaatctccatccgtctccgcacagaatagcgataccccgctgctgcccccggccgtgccgtag

SEQ ID NO: 15441 - DNA, 711 bp, Artificial Sequence
  Description of Artificial Sequence: Synthetic coding sequence
atgggtctggagaagttacacccgtttgacgccggcaaatggggcaaagtcatcaactttttgaaagaagagaagctgttgagcgacagtatgcttgtagaggccagagaagcctccgaagaagatctgctagtcgttcatacacgacgctacctgaatgaactgaagtggtcctttgctgtggcaaccatcactgagatccctcccgtgatattcttgcctaattttttggtccagcgcaaggtgctcaggcccctgcggacacagacaggcgggaccattatgggagtggcaagtaccaccgctccggctaccgtggcgggcgcctccgtccccatgcggacctccagaagtcctagtagcttctgtctctctgtgtggcgcgcttctcctggccttccctctctcattctcatgcctattcgagccatgggtatgagtgagacgagctggactactagtgtctgtacatcctggatgagcactacggccacatctacccagggcaccgccttaccatctagaccgtccggggggcggtggagttggtcaggcgcacaacggatgatgagcacttggatcagatggcgagggaccagcagaaacccctctagatcaacctgtcccacatggtggtatactatgcaggctcccacaagttctcgcggaaccgcgctgggtggctgcccatccgcgcagcgcgcctcctag

SEQ ID NO: 15442 - DNA, 960 bp, Artificial Sequence
  Description of Artificial Sequence: Synthetic coding sequence
atggggctggaaaagctacaccctttcgacgccggcaaatggggaaaggttataaattttctcaaagaagaaaaactattgagcgattctatgcttgtagaggccagggaggctagcgaggaggacctgctggtggtacataccaggagatatcttaatgagctgaaatggtcttttgcagtggcaaccatcaccgagatacctcctgttatctttctgcctaactttctcgttcagcggaaggtgctgaggccactgcggacacagacaggcgggacgattatggcaggtaagctggccgtggagcgcggctgggcgatcaacgtcggcggtggcttccatcactgctcgagcgacagaggaggaggattttgcgcctacgccgatataactctcgccatcaagttcctcttcgaacgcgtagaaggcattagcagggctaccataatcgatctagacgcccatcaggggaatgggcacgaaagggacttcatggacgacaagcgcgtgtatatcatggatgtatacaatagacacatctaccctggcgataggtttgcaaagcaagctatacgacggaaagttgagctcgagtggggaacggaggatgatgaatacctggataaagtcgagcgcaatattaagaaatccctccaggagcacctgcctgatgtggtggtgtacaacgccggcacagatatcttagagggagaccggttaggcggattatccattagtcccgctggaattgtgaagcgtgacgagctggtatttcgaatggttaggggcaggcgggtgcccatcctcatggttacctctgggggctatcagaaaaggaccgcaagaattatcgcggatagcatactgaatctcttcggactggggctaattggcccggaatccccctcagtgagcgcacaaaatagcgacacccccttactgcctccagccgtgccatag

SEQ ID NO: 15443 - DNA, 468 bp, Artificial Sequence
  Description of Artificial Sequence: Synthetic coding sequence
atggatgacaaacgggtttatattatggatgtgtacaacaggcatatttatcccggggataggtttgcaaagcaggccattaggaggaaggtcgaattggagtgggggacagaagacgatgaatatctggacaaagtcgagagaaacattaagaagtctctgcaggagcatctcccagacgtagtggtgtacaacgccgggactgacatcctggagggagataggctggggggattgtcaatctcccctgcgggtatcgtaaagcgcgatgaactggtcttcagaatggtacgcggccgccgcgtgcctatactaatggtcacctctgggggataccagaagaggacagcacgaatcatcgccgattctatactgaacctcttcggactgggcctgatcgggcccgagtctcctagcgtgagtgcccagaattcagatacaccccttctgcctcctgctgtaccctag

SEQ ID NO: 15444 - DNA, 891 bp, Artificial Sequence
  Description of Artificial Sequence: Synthetic coding sequence
atgggtcttgaaaagcttcatcctttcgacgctggcaaatggggtaaggttatcaatttcctgaaggaggaaaaattactgtccgattctatgctagtggaggccagagaggcttctgaagaagacctgctcgtcgtgcacacgcgacggtacctgaacgaactcaagcggaaggtgttgaggcctcttaggactcagaccgggggtacaatcatggcagggaagttggccgtggagcggggatgggcaattaatgttggcgggggcttccatcattgctcgtccgaccggggtggggggttttgcgcctacgctgatattaccctcgccattaaattcctctttgagagagttgaagggatctccagagccacaataattgacctagatgcacatcaggggaatggccacgagagagattttatggacgacaagcgggtgtatatcatggacgtgtataatcgacatatatatcctggggaccgctttgccaaacaggccatcaggcgcaaagtggaattggaatggggaacagaggacgacgagtacctggacaaggtggagcggaacataaagaagagcctccaggaacatttacccgacgtagttgtctacaacgccggcaccgatatactggaaggagatcgcttaggaggtctgtctatcagtcctgcgggaatcgtaaagagggacgagctcgtctttagaatggtccggggcaggagggtgcccatcctcatggtgacatcgggcggatatcagaagagaaccgcacgcattatcgctgattccattctgaacctattcggacttgggcttatcgggccagagtcaccctctgtgagtgcccagaatagcgacaccccccttttgccccctgccgtgccgtag

SEQ ID NO: 15445 - DNA, 1377 bp, Artificial Sequence
  Description of Artificial Sequence: Synthetic coding sequence
atgaagcctcaccggatacgaatgacccataatctcctgctaaattacggcttatatagaaagatggaaatttataggccacacaaggcaacagctgaagagatgactaagtaccactccgatgagtatatcaagtttcttaggtctatccgcccagacaacatgagtgagtattccaagcagatgcagagattcaacgtgggtgaggactgtcccgtattcgatggactgtttgagttctgccagctgagcaccggagggtctgtggccggtgccgtcaaacttaaccgtcaacagactgacatggccgtcaactgggccggagggctccaccacgcgaagaagagtgaagcatccggtttctgctatgtgaatgacatagtcctcgcaatactggagcttctgaaatatcatcaacgcgttctctacatagacatcgatatccaccatggtgacggagtggaggaggcgttctatacaactgaccgggtgatgacggtgtcctttcacaaatacggtgagtactttcctggaaccggcgatttgagggatatcggagcaggaaaaggaaagtactatgccgttaattttcccatgcgcgacggcatcgacgatgaatcctatggccagatcttcaaacctattattagcaaagtgatggagatgtatcagccaagtgccgtggtgctacagtgcggagcagacagcttgtccggggacagactgggctgcttcaacctgacggttaagggccacgctaaatgtgtggaggtggtcaagacgttcaacctcccactgctcatgttgggaggcggtggatacaccataagaaacgtggctcggtgctggacttatgagacagcagtcgctttggactgtgagattccaaatgagctgccttacaatgactactttgagtactttgggccagattttaagttacatatcagtccatccaatatgaccaaccaaaatactcccgagtacatggagaagatcaagcagaggctgttcgagaacctcaggatgttgccgcacgcgccaggtgtacaaatgcaggcaatacctgaggatgctgtgcacgaagactccggtgacgaagacggggaggatcctgacaagcgcatttccattcgggcttcagataagcgtatcgcgtgcgacgaagaattcagcgacagcgaagacgagggcgaaggcggacggaggaatgtggctgatcataaaaaaggcgccaagaaggctaggatcgaagaggacaaaaaggagaccgaagacaagaaaactgacgtcaaggaagaggacaagagcaaggataacagtggggagaagactgataccaagggcactaagtccgaacagctgagcaatccctag

SEQ ID NO: 15446 - DNA, 1749 bp, Artificial Sequence
  Description of Artificial Sequence: Synthetic coding sequence
atgcggagcccaccatgcgggctgctgcggtggttcggcggcccacttctggcatcgtggtgtaggtgccatctgcgattcagagcctttggcacatcagccggatggtacagagcctttcctgctcccccacctttgctgccccccgcctgtccgtcaccccgcgactacagaccccatgtgagcctctcgcccttcttaagccggccttcaaggggtggttcgtctagctcctcctcgagtcggaggcgtagtccagtcgcagccgttgctggtgagcctatggcatacagccagggcgggggtaagaaaaaagtttgttactattatgatggggacatcggaaattattactatgggcagggacatcccatgaagccccatcgaatccgcatgacccacaacctgttactgaattatggcctttatcggaaaatggagatttacaggccacataaggcaacagcggaagaaatgacaaagtaccattctgatgagtacatcaagttcctgcggagcataaggcctgataacatgtccgagtacagtaagcagatgcaacgctttaacgttggcgaggattgtcccgtgtttgacggactcttcgagttctgccaactcagtactggcgggtctgtcgccggcgcagttaaattgaatcggcaacaaacagacatggctgtgaactgggccggcgggcttcaccacgcgaaaaaaagtgaggcctccggattctgttatgtcaacgacattgtcctggctattctggaactcctgaaataccatcagagggtgttgtatattgatattgatattcaccatggagatggcgtggaggaggctttctacactaccgaccgggtgatgacagtgtcctttcataagtatggagagtacttccctggaactggggacttgcgagatatcggagcgggcaagggaaaatattatgccgtgaatttccccatgagagatggtattgacgacgagtcttacggacaaatttttaagcccatcattagcaaagtcatggagatgtaccaacctagcgccgttgtcttacagtgcggcgcagattcattgtccggcgacagactggggtgctttaaccttacagtgaagggccatgcgaagtgcgtggaggttgtcaaaacctttaatttacctctcctgatgctggggggaggtggctacaccattagaaacgtcgccagatgctggacctacgagactgccgtggcccttgactgcgagatacccaatgagctcccatataatgattactttgaatacttcggccccgacttcaagctacacatatctccttcaaacatgacaaatcagaacaccccagaatatatggagaagatcaagcagagactatttgagaatctcaggatgctgcctcacgctcccggcgtgcaaatgcaggcaatccctgaggatgctgtacacgaagacagtggagacgaggacggcgaggatccagataagagaatctctataagagcaagtgataaaaggatcgcctgcgacgaggaattctctgactctgaggatgaaggggaaggggggaggaggaacgtagcagatcacaagaaaggggctaagaaggcccgaatcgaagaggataaaaaagaaacagaagataaaaaaaccgacgtgaaggaggaggataaaagtaaggataacagcggcgagaagacagatacgaaaggaaccaagagcgaacaactgtccaacccttag

SEQ ID NO: 15447 - DNA, 1467 bp, Artificial Sequence
  Description of Artificial Sequence: Synthetic coding sequence
atggcctacagccaaggcggaggcaaaaaaaaggtgtgttactactacgatggcgacattggaaactactattatggccagggccaccccatgaaaccccataggatccgaatgacacataatctcctgcttaactatggtctgtatcgaaaaatggagatttatcgcccacacaaggcgaccgcagaagagatgaccaaataccatagcgatgagtacattaagtttttacgatctatcagacctgataatatgtctgaatatagtaagcagatgcaaagatttaacgtcggcgaagattgccctgtgttcgatggattattcgagttctgccagctgtccaccggaggctcggtggcaggcgccgtcaaactcaatagacaacaaaccgacatggccgtgaattgggctggcggtttacatcatgccaaaaagtcagaggcctctggcttctgttatgtgaatgatatcgttctggctatcctggaactgctgaagtatcaccagagggtgctgtatatcgacatcgatatccaccacggcgacggcgtggaggaggcattttacactaccgatagagttatgacggtaagctttcacaagtacggtgaatactttcctggcaccggtgacctgagggacatcggggcgggtaaaggtaaatattacgctgtcaactttccaatgcgagatggcattgacgatgagtcctatggacaaatatttaaacccattatttcaaaggtgatggagatgtaccaacccagcgcagttgttctccagtgtggggccgactcactgtccggggacaggcttggctgctttaatctgaccgtgaagggccatgccaaatgcgttgaagtggtgaaaactttcaacttaccgctcttgatgttaggggggggagggtatactatacgcaacgttgccagatgttggacttacgagacagctgttgcccttgattgtgaaatcccaaatgagttgccctacaatgactactttgagtacttcggcccagatttcaagctccacatctcacccagcaatatgacaaatcagaacaccccagagtacatggagaaaataaagcagcgtttgttcgagaacttgcgaatgctaccacacgcccccggggtacagatgcaggccattccggaagatgcagtgcatgaggactcaggtgacgaggatggggaagacccggataagaggattagcatccgggcgtctgacaagagaatcgcttgcgatgaagagttctcagactcagaagatgaaggggagggtggtcggcggaatgttgcagatcacaaaaagggagctaagaaagccaggattgaggaagataagaaggaaactgaggataaaaaaacggacgttaaggaggaggataagtctaaagataactctggcgaaaagacagatacaaagggcactaagagcgaacagctgtcaaatccgtag

SEQ ID NO: 15448 - DNA, 1377 bp, Artificial Sequence
  Description of Artificial Sequence: Synthetic coding sequence
atgaagccacaccggattcgcatgactcacaaccttctgctgaattacggactttaccgcaagatggaaatttatagaccccacaaggctaccgccgaagaaatgactaagtaccactcagacgaatacataaaattcttgcggtctattcggcctgataatatgtcagaatacagtaagcagatgcaacggtttaacgtaggggaagactgccccgtgttcgacgggctattcgaattttgtcaactctccacgggagggagcgtggctggcgcggttaaactcaatcggcagcaaaccgacatggcagtgaactgggcagggggtctacaccacgctaaaaagtcggaagccagcgggttctgctacgtgaatgatatagtacttgcaattctggaattgctgaagtatcaccagcgggttttgtatatagatatcgacatccaccatggggacggagtggaagaggcgttttacaccacggatcgtgtgatgacggttagctttcacaaatacggagaatactttccgggaaccggcgacttgagggatattggtgcaggcaaaggcaaatactacgcagtgaatttcccaatgcgcgacggaattgacgatgagagctatggccagatattcaaacctataatatccaaagttatggaaatgtatcagcctagcgcagttgttcttcaatgcggagccgactcactgagtggtgataggctgggatgcttcaatttgactgtcaagggccatgcgaaatgcgtggaagtcgtgaagactttcaatctgccgcttcttatgctgggcgggggaggctacaccatccgaaatgtcgccagatgttggacatatgagactgctgtggcgcttgattgcgaaatcccaaatgagctgccctacaacgattattttgagtattttgggcccgattttaagctccatatcagcccttcaaatatgactaatcaaaacacccctgagtacatggaaaagatcaaacagcggctgttcgagaatttgcggatgctcccgcatgcccccggcgtgcagatgcaggccatccctgaggacgccgtgcacgaggacagtggtgacgaagatggtgaggatcctgacaagcggatctcgattcgcgcatctgacaaacgcatagcctgcgatgaggagtttagcgactccgaagacgaaggggaaggtgggcgaagaaatgtggccgaccacaaaaagggcgccaaaaaagcgcgaatcgaggaagataagaaggaaactgaagacaaaaagactgacgtgaaagaagaagataaaagtaaagacaactccggggagaagactgacaccaaggggacaaagagcgagcagctctccaacccctag

SEQ ID NO: 15449 - DNA, 1287 bp, Artificial Sequence
  Description of Artificial Sequence: Synthetic coding sequence
atggctaaaacagtggcctatttctatgaccccgacgtgggcaattttcattatggcgcaggacaccctatgaagccccacagactggcactgacacactcactggtcctgcactatggcctctataaaaagatgatcgtctttaagccgtaccaggccagtcagcatgacatgtgccggttccactccgaggactacattgatttcctccagcgagtctcacctacaaacatgcaggggttcacgaagtcacttaatgcattcaatgtgggcgacgattgccctgtgttccccggactctttgaattctgctcaaggtatacgggcgcttccttgcagggcgccacccagctgaacaataagatctgcgacattgctattaattgggctggtggcctgcaccacgctaagaaattcgaggcaagcggattctgctatgtaaacgatatcgtgatcggaattctggaactactaaagtaccaccctagagtcctgtacatagacatagatattcaccacggggacggcgttcaggaagccttttacctcacggatcgcgtgatgacagtgtcttttcataaatacggaaactactttttcccaggcaccggggacatgtatgaagtgggggctgagtccgggcggtattactgcctaaacgtccctctgcgggacgggattgatgatcagagctacaagcacttgttccaaccagtaattaaccaggtagtcgacttctaccagcccacctgtattgttctgcaatgcggggctgatagcctgggctgtgatcgtcttgggtgttttaacctttccattagagggcacggcgagtgcgtggagtacgttaaatcgttcaatatcccattgcttgtgcttggcggaggtggctatactgtaaggaatgtggcccgatgttggacatacgagactagcttgctcgtcgaggaagctatcagtgaggaactgccttacagtgaatattttgaatattttgctcctgactttacgctgcatcctgacgtgtcaacacgcatcgaaaaccagaattcccgacaatacttggatcagatccggcagaccatcttcgaaaatttgaaaatgcttaaccatgcaccgtccgtgcagattcacgatgtgcccgctgatctgctgacctacgatagaactgatgaagccgacgcagaagaacgcgggcccgaggaaaattattccaggccggaggctccaaacgagttctacgacggggaccatgacaatgacaaagaaagcgatgtcgagatttag

SEQ ID NO: 15450 - DNA, 3255 bp, Artificial Sequence
  Description of Artificial Sequence: Synthetic coding sequence
atgtccagccaatcacacccagatggcttgtctgggcgtgatcagcccgttgagctgctcaacccagcgagagtgaaccacatgccttcgaccgtagacgtggccacagccctcccactgcaagtggcgcccagcgctgtgcctatggacctccgcctggatcaccaattttcactgccagtggccgaaccagctctgagagaacagcaactgcagcaggaacttttggcattgaagcaaaagcagcagatccagcgacagattctgatcgccgagtttcagaggcaacatgagcagctgtcccgccagcacgaagcacaactgcacgagcacataaagcagcagcaggagatgctcgcaatgaaacaccagcaggaactacttgagcatcaaaggaagctcgagagacatcggcaggagcaggagctcgaaaagcagcacagagagcagaaactgcagcagttgaaaaacaaggagaagggaaaagagagcgcagtggcctcgacagaggtgaaaatgaaactccaagagttcgtgcttaataaaaaaaaagcactggcccaccggaaccttaatcattgcattagctccgatcctaggtattggtatgggaaaacccaacattccagtctggatcaatcttcacccccacagagcggcgtcagtaccagctataatcaccccgtcttgggcatgtacgatgccaaggatgatttccccctccgaaagacagccagcgaaccaaatcttaagctgcggtcaaggttgaagcagaaggtcgcagaacgccgatccagccccttgttgaggagaaaggacggtccagtggtgaccgctctgaaaaaaaggccactggacgtcacagacagtgcatgtagctccgcccctggctcgggaccttcttcccctaacaactccagtggctcagtcagcgccgaaaatgggatcgcgccagccgtgccgtccatccctgctgaaaccagtctggcccaccggcttgtggccagggagggctcggctgcgccactgcctctgtatacctcacccagccttcctaacatcacattgggcttgcctgcaactgggccttcggccggcaccgctgggcagcaagacgctgagcgcctgacgttgccagccctccagcagcggctttcactttttcccggaacccacctcacaccgtacctcagcacttccccactagagagggacggtggagcggcacactcacctctgctccagcacatggttctcttggagcaacctcccgctcaggccccactggtaacaggtctgggcgccttacctctccacgcacagtcactcgtcggggccgaccgagtgtccccatccattcacaaacttagacagcatcgaccccttggccggacacagagcgccccactgccccaaaacgcccaggcccttcagcacttggttatccaacagcaacaccaacagtttctcgaaaagcacaagcagcagttccagcagcaacagctacaaatgaacaaaatcatccctaaacctagtgaacccgccaggcagcccgagtctcaccctgaagagacagaggaggaactgcgtgagcatcaagcactgttggacgagccgtacctcgaccgcctccccggccagaaggaggcccatgcccaggccggcgtgcaggtgaagcaggagcctatagagagcgatgaggaagaggctgagccacctcgcgaggtggaacctggacagagacaaccaagtgagcaggagctgttattcaggcagcaagccctgctgctcgagcaacagcgcatccatcaactccggaattaccaagccagtatggaggcagctggaatcccggtgagtttcggcggccacagaccgctctctagagctcagtctagtcccgcttccgccactttcccagtgagcgtacaggaaccacctacaaagccacgctttaccactggattggtgtatgacaccttgatgctgaaacatcaatgcacttgcggcagttcttcttcccatcccgaacacgcaggtcggattcagtctatttggagcaggctgcaggagaccggacttagagggaaatgcgaatgtatcagagggcgtaaagccaccctggaagagctgcaaacagtccatagcgaggcacatacgctcttatacggcacaaacccactgaaccggcagaagctggactcaaagaagctcttagggtccctcgcatctgtattcgtcaggctaccctgcggcggagtcggagtggactctgacacaatctggaatgaagtgcacagtgcaggtgcggcgcgtcttgctgtgggatgtgtcgtcgagttagtgttcaaagtggccacaggggagctgaaaaatggatttgcagtggtacggccccctggacatcacgccgaggagagcactcccatgggattctgctactttaattctgtagccgttgctgcgaagctactgcagcagcgcctctcagtgtccaagatactaatagtagactgggacgtgcaccatggcaacggcacgcagcaggcattctactcggacccgtccgtgctgtacatgagtctgcaccgctatgacgacgggaacttctttccaggatccggtgcccctgacgaagtaggcacgggcccaggggttgggttcaatgtgaatatggcgttcacagggggcttggatcccccaatgggagacgcagagtacctcgcggctttccgcaccgtagttatgcccattgcatcagagttcgctcctgacgtagtgctcgtttcctcgggctttgacgcggtggaagggcaccctactccacttgggggttataatctgtcagccagatgttttggataccttactaaacagctcatgggacttgctggtggcagaatcgtgctagccctcgagggagggcacgacttgacggccatctgcgatgcatccgaagcatgcgtaagcgcactcctgggtaacgagctcgatcctctccctgagaaggtgttacagcagcgacccaatgctaacgccgtgcgcagcatggagaaggttatggaaattcattcaaaatactggcgatgcctgcagaggactacatccaccgcaggccgttctctcattgaagcgcagacatgtgagaacgaagaagccgaaacagtgaccgccatggcttctctgagcgttggggtgaagccagccgaaaagagacccgacgaggagcccatggaggaggagccacccttatag

SEQ ID NO: 15451 - DNA, 1941 bp, Artificial Sequence
  Description of Artificial Sequence: Synthetic coding sequence
atgctcgctatgaaacatcagcaggaactgctggagcatcaaaggaagctggaacgccaccggcaggagcaggagctcgagaaacagcatagagagcagaaactgcaacagctcaagaataaggaaaagggcaaggaaagtgcagtggcttccacagaggtcaagatgaaacttcaagaattcgtcttgaacaaaaaaaaagctttggctcatcgcaacttaaatcactgtatctcttcagatcccagatactggtatggtaaaacccaacacagcagtcttgatcagtcaagcccaccccagtctggcgtgagcacgtcctataaccaccctgtgctcggtatgtacgacgctaaggacgacttcccattgcgcaaaacggcttccgagcccaacctgaaactgagatctcgtctcaagcagaaagtagcagaaaggcgtagttctcccctgctgagacggaaagacggacctgtggtcactgcgttaaagaagcgcccacttgatgtgacagactccgcttgttcatccgcccctggtagtggacctagctcccctaataattcatctggttctgtatccgccgagaacggtatagcacctgcagtcccttccatccccgctgagacctccctcgcccacaggctggtggcaagagagggctcagccgccccactccccctctatacctcccctagcttacccaacatcactctaggcctgcccgctactggaccatcagccggaacagcagggcagcaggacgccgagagattaactcttccagccttacagcaacggctctcgctgtttcctggaactcatctcaccccctatcttagcaccagccctctggaacgcgacgggggagctgcccattctcctctgttgcagcatatggtgcttttagaacagcctcctgcacaggctcccctcgtcaccggcctcggcgccctgccactgcacgctcagtccctcgtcggcgccgaccgggttagcccttccatccacaagctacggcaacataggcctttaggccggacccagagtgcccccctgccccagaatgcccaggccttacaacatttagtcatccagcagcagcaccagcaatttctggaaaagcacaagcagcagtttcaacagcagcagctacagatgaacaagatcattccaaaaccatcggagcccgcgagacagccagagtcacatcctgaggagacggaagaggaactgagagagcaccaagcactgctggacgaaccctatcttgatcggctgcccgggcagaaagaggcccatgcccaagccggagtacaggtgaagcaagagcccatcgagagcgatgaagaggaagccgagccacctagggaagtggagcctggccagaggcaacctagcgaacaagaactgctcttccgtcagcaggccctcctgctggagcagcaacgcatacaccagctgaggaattaccaagcgagtatggaggctgcaggtatcccagtctcctttggcgggcatcggccactgagccgcgcacagtcgagcccagcgtcggcgacctttccagtaagcgtgcaggaaccccctacgaagccccggttcaccacaggcctcgtctatgacacgctgatgctgaaacaccaatgtacctgtggttcatcttcatctcaccccgagcatgccgggcggatccagagcatttggtctagactccaggaaacgggcctccgcggtaagtgcgagtgtattcgcggccggaaggcaacccttgaagaactccagacagttcacagcgaggcccacactcttctctatggaaccaatcccctaaacaggcagaaacttgactctaaaaagcttctggggtccctcgcctcggtgtttgtgcgcttaccttgcggcggggtgggtgtgtctgtgccattaatgtgtaaatag

SEQ ID NO: 15452 - DNA, 2919 bp, Artificial Sequence
  Description of Artificial Sequence: Synthetic coding sequence
atgctagcaatgaagcatcaacaggagctgttagaacaccaacgcaaactagaaaggcataggcaggagcaagagcttgaaaagcaacaccgcgaacaaaagctgcaacagcttaagaacaaggaaaagggtaaagagtcggccgtggcctctacagaggtgaagatgaaactacaagaatttgtcctgaacaaaaaaaaggccctcgcacaccgaaacctgaatcattgtatttcctccgatccacgttactggtacggtaagactcagcattctagtctcgatcagagctcccctccccagtccggcgtttctactagttataaccacccggtgttgggaatgtacgacgccaaggatgatttccctttgcggaaaactgccagtgagcctaatttgaaactcaggtcgcgcttgaagcagaaagtggcagagagaaggagctctccactgttaaggcgaaaggatgggcctgtggtgaccgcactgaagaaacgacccttggacgtcacagacagtgcttgcagttctgcaccgggaagcggaccgtcctcccctaacaatagttcgggtagcgtgagcgccgagaacggtatagcacctgctgtgccctctattccagccgaaacatccctcgctcatcggctggtagccagggagggtagcgccgcccccctgcctctatacacttcgcccagcctccctaacatcaccctgggactgccggccacgggccccagcgccggcactgccgggcagcaggacgctgaaaggctgacattgcccgcactgcagcaaagactgtctctgttccccggaacacacctcaccccttacctgagcacatcaccactcgagcgggacggaggagccgcccacagtcctttgcttcagcacatggtcctgttggaacagcctcctgcacaggcgccacttgtgacagactggtatttgtccggattaggagctctgccattgcacgcccaatctttggttggcgctgacagagtctccccttccatccacaagctgcggcaacatagaccccttggccggacccagtcagccccccttcctcagaacgctcaggccctgcagcacctggtgatccagcagcaacaccagcaattcctggagaaacataaacaacagttccagcagcagcagctgcagatgaataagattattccaaagccctctgagcccgcaagacagccagaaagccaccccgaggagactgaggaggaactgcgggaacatcaggcattactggacgagccatatcttgacagattgcccggccaaaaggaggcccacgcgcaggccggggtgcaagtcaagcaggaacccattgaaagcgacgaggaggaggcagagccaccacgcgaggtcgaaccgggccaacgccaacccagtgagcaagagctgctgttccgacagcaggctctgttgctggaacaacagcgcattcaccagctccgcaactatcaggctagcatggaggcagcgggaatccccgtgtcctttggtgggcacaggccactatcccgtgcccagtcttcccccgccagcgctacgttccctgtcagcgtacaagaaccaccgacaaagccccgattcaccactggattagtctatgacaccctgatgctcaagcaccaatgtacttgcggatcttcatcaagccacccagaacatgctggccgaattcagtccatttggagcagattacaagagactggccttagaggcaagtgcgaatgcatacggggtcgcaaggcgacactagaggagcttcagacagtacattccgaggcccataccctgctctacggaaccaacccgctaaacagacaaaaactggactcgaagaaactgctgggatcgctggcatccgtctttgtgagattgccatgtgggggtgtcggtgtggactcagatacaatctggaacgaggtgcactcagccggcgcagctagactggccgtgggttgtgtcgtcgagctggtctttaaggtagctacaggagagctgaaaaatggattcgctgtggtgcgtccacctggacaccatgccgaagagagtacccccatgggtttctgttattttaacagcgtcgccgtagccgctaagttgctacaacaacggctgtcagtgtctaagattctcatcgtggattgggatgtacatcatggcaatgggacacagcaggccttttattcggacccgtcggtgctttatatgtctctgcacaggtatgacgatgggaatttttttccagggagcggcgctcccgatgaagtggggaccggtccaggcgtgggctttaacgttaacatggcatttactggtggtctggaccctcctatgggcgacgccgaatatctggcagcctttcgcaccgtggtgatgccaatcgccagcgaatttgcccctgacgtggtgctagtctcttcggggtttgatgctgtggagggtcaccctacaccactcgggggctacaatctgtcagcccgttgcttcggctatctcaccaagcagctcatgggtttggccggtggccgaatcgtcctggccctggagggcggacacgaccttacagccatctgcgacgcatcagaagcttgcgtctctgccctcctgggcaatgagttagacccactgcccgaaaaagtgctccagcagagacctaatgccaatgccgtgcgttctatggaaaaagtgatggaaatccacagcaagtattggaggtgtttacagaggaccacatcaaccgctggccgatccctgatagaggctcagacttgcgagaacgaagaagccgagacagtcactgccatggcctcactctctgtaggtgtgaagccggctgagaaaaggcctgacgaagagcctatggaggaggagcctcccttatag

SEQ ID NO: 15453 - DNA, 2214 bp, Artificial Sequence
  Description of Artificial Sequence: Synthetic coding sequence
atggacgtcgcaacagcgctgcctctccaggtggctccttccgccgtcccaatggacctccggctcgaccaccagttcagcctgcctgtggccgagcccgcactgcgagagcagcaactgcagcaggaactcctcgccctgaaacagaagcagcagatccagcggcagattctcatcgcggagttccagcgacagcacgagcaactgtctcgacagcacgaggcgcagctccatgaacacattaaacaacaacaggagatgttagcaatgaagcatcagcaggagctgttggagcaccaacgaaagctggagcgccacaggcaggagcaagagctagagaagcagcatcgggaacagaagctgcaacagttgaagaataaggaaaagggcaaggagagcgcggtggcctcaacggaggttaagatgaagctccaggagtttgtccttaataaaaagaaagccctggcccaccgaaatttgaatcactgtatctcctccgaccccaggtactggtatggcaagacacaacatagcagcttggaccagagctcacctccacagagtggcgtgagcaccagctacaatcacccagtgctagggatgtacgatgcgaaagacgacttcccgcttagaaaaacagcttcagaacccaacctcaagctgcggagtaggctgaagcaaaaggttgccgaacgtagatcatcgcccctcctcagacgcaaagacggtccagtggtgactgctctgaagaaacgacctcttgacgtgaccgactccgcttgcagtagcgcccccgggagcggcccaagtagtcccaataattcgtctggcagtgtttctgcagagaatggaatcgcccctgctgtccctagtattcctgccgaaacaagcctggcgcataggctcgtcgcccgagagggcagtgcggcccccctgcctttatacacctctccttccttgcccaacatcaccctgggcctgccagctacgggaccaagcgcaggaactgctggccagcaggacgccgaacgcttgaccctgcctgccctgcagcagcgtctatccctgttcccaggcacacatttaaccccttacctgagtacctctccccttgaacgagacggaggagccgcccactcacctcttttgcagcacatggtcctcctcgaacagccacccgctcaggcgcctctcgtgaccgattggtacctgtcagggttgggcgcactgcctctccatgcccagagccttgttggagcagatcgcgtgtctccatccatccacaagcttaggcaacatcggcccctgggtaggacacaaagcgctccgctcccacaaaacgcacaggccctgcagcatctggttattcaacaacagcatcagcagttcctcgagaaacataaacagcagttccagcaacagcagttgcagatgaacaagatcatacctaagccaagcgagcccgcacgacagccagagagccaccccgaggagacagaggaggagctccgcgaacaccaggcactcctggacgaaccatatctcgaccggctcccgggtcagaaggaggcccacgctcaggcaggggtgcaagtgaaacaagagcctatcgagagcgatgaagaggaggccgagcccccacgggaagttgagccgggacagagacagccatccgagcaggagctcctgttccgccagcaagctctgctgcttgaacaacagcgcatacaccagctgagaaactaccaggcgagcatggaggctgccggcattccggtctccttcggtgggcacaggccccttagccgcgcccagtcctcccctgcctcagctacgttccccgtaagtgttcaggaaccgcccaccaaaccacgctttaccaccggacttgtctatgacacactgatgctgaaacaccagtgtacctgcggcagcagcagttcccatccagagcacgccggtaggatccagagtatttggagccgtctgcaggagacgggcctgcggggaaaatgcgagtgtatcaggggcaggaaagcgacccttgaagaactccagacagtacattctgaggcacacaccctgctgtacggcactaatccactaaatcgccaaaagctggactcaaaaaaattgttaggaagcttggctagtgtattcgtgcggctcccctgcggtggagttggggtcagcgtcccactgatgtgcaaatag

SEQ ID NO: 15454 - DNA, 2007 bp, Artificial Sequence
  Description of Artificial Sequence: Synthetic coding sequence
atggtcttgctggagcagcctcccgcccaggccccacttgtcactggtctgggcgctctgcctctgcatgcccagagtcttgtcggcgccgaccgggtctccccttcgattcataaactcagacagcacagacccctaggacgcacccaaagcgcaccactgccacaaaacgctcaggctctgcagcatttagtgatccagcagcagcatcagcaatttctggagaaacacaaacagcagtttcagcagcagcaactgcagatgaacaagatcatccccaaacctagtgagcccgcccgccaaccggagtcacatcctgaggaaacagaagaggagctcagagagcaccaggccttactagacgagccttacttagacaggctgcccgggcagaaagaggcccatgcccaggcgggcgtgcaggttaagcaggagccgatagaatctgatgaggaagaagcagagcctcctcgcgaggttgaacctggtcagcgccaaccatcagagcaggagctcttgttcagacaacaagcactgcttctggagcaacagagaattcaccaacttcgtaactatcaggcgtccatggaggctgccggtatccctgtgagcttcggggggcaccgtcccctgtccagagcacagtcgtcgcccgccagtgccactttccctgttagcgtccaggaacccccaactaagccccgctttactactggcttggtctatgatacattaatgctgaaacatcagtgcacgtgtgggagttcaagttcccaccccgagcacgctgggagaatacagtccatttggtcacggctgcaagagacgggactaagagggaaatgcgagtgtattcgcggcagaaaggcaaccctcgaagagcttcagaccgtgcactccgaagctcacacactcctctatggcacgaacccactcaacagacagaagttagacagcaagaaactgctcggatcactggctagcgtttttgtcaggctgccttgtgggggagtgggcgtcgatagcgacacaatttggaacgaggtacactccgcaggggcagcgcgattagccgtggggtgcgtggttgaactggtgtttaaggtcgccaccggcgagcttaaaaacggctttgcagtggtgcgacctcccggccaccacgctgaggaatcaactcccatgggattttgctacttcaattctgtggcagtggccgctaagttgctgcaacagcgcctttctgtgagcaagattctgattgtggactgggatgtgcaccacgggaacggcacacagcaggccttctactcagacccctctgtattgtacatgagcctgcatcgttatgatgatggaaactttttcccaggtagcggtgctcccgatgaagtaggcactggacccggtgttggctttaacgtcaacatggcctttacaggcggcctggaccctcccatgggcgatgccgaatatcttgcggctttccggactgtggtgatgccaatcgctagtgaattcgcaccagatgtggttttggtctcgtccggatttgacgcagtggagggacatcccacaccactaggcgggtacaacctctccgcgaggtgtttcgggtacttaactaaacagctcatgggactagctggcgggaggatcgtgttggccctggagggggggcacgatttgactgccatatgcgacgcctcagaagcttgtgtgagcgctttactgggcaacgagctggatccactgccagagaaagtgctccaacagcggccaaacgcaaacgccgtgcggtcgatggagaaggtgatggaaattcattccaaatattggcgctgcctccagaggaccaccagcaccgctggccgcagccttatcgaggcacaaacctgtgagaatgaggaagcggaaactgttaccgctatggcatctctctccgtaggtgtgaagcccgccgagaagcgcccagatgaggagccgatggaggaagaaccccccttgtag

SEQ ID NO: 15455 - DNA, 90 bp, Artificial Sequence
  Description of Artificial Sequence: Synthetic coding sequence
atgagttcacaaagccacccagacggactctctggccgagaccagcctgttgaactgctcaacccggctcgagtgaaccacatgccatag

SEQ ID NO: 15456 - DNA, 3648 bp, Artificial Sequence
  Description of Artificial Sequence: Synthetic coding sequence
atgacatccacagggcaagactccaccacaacccgccagcgccgcagtcggcagaacccccagtcaccgcctcaagattcatccgtgacatccaaacgcaatattaaaaagggagcggtgccaaggtcaatcccaaatctggctgaagttaaaaagaagggtaagatgaagaaacttggccaggctatggaggaggacctcatcgtaggtctgcagggcatggatctgaatctggaagcggaagctctcgccgggacaggactcgtacttgacgagcaactgaatgagtttcactgcctgtgggatgattcctttccagaaggcccagaacggctgcacgccatcaaggagcagctcatccaggaaggtctgcttgatcggtgcgtgagtttccaagctaggtttgccgagaaggaggagttgatgctggtgcactctctggaatatatcgatttgatggaaacaacccagtacatgaacgaaggcgaactgagagtactcgccgatacctacgacagtgtgtacttacatcctaatagctactcgtgtgcctgtctggcctcagggtctgtgctgagactcgtggatgccgtactgggagccgagatccgcaatggaatggctattattcgccccccaggacaccatgctcagcactcgttaatggacggctattgtatgttcaatcacgtagcagtcgctgcacgctatgcccagcagaaacaccgtatcagacgtgtgttaattgtggactgggatgttcatcatggccaaggaacacagtttacattcgatcaggatccgtctgtgctgtatttctcaatccatcgctacgaacagggaaggttctggcctcacttgaaagcatctaattggagcactaccgggttcgggcaaggtcaaggatatacgattaacgtgccctggaatcaggtgggtatgcgggatgccgattacatcgctgcttttctgcatgttctgttaccggtggctctggagttccagccgcagctggtgttagtagccgccggttttgatgccctgcaaggagatccaaagggggagatggctgccactccggctggttttgcgcaactgacccacctcctgatgggattggccggcgggaaattgatactctcactggagggagggtacaacctgagggcccttgcagagggcgttagtgcttctctacacacgctcctcggcgatccatgtcccatgttggagtcaccaggcgccccctgcagatccgctcaagccagtgtgtcatgtgcgctcgaagcattagagcctttttgggaggtgcttgtgaggtcaaccgagactgtggaacgggacaacatggaggaggacaacgttgaggaaagtgaggaggagggaccctgggagcctccagtcctccctattcttacttggccagtgttgcaatcaagaacagggttggtgtatgatcagaacatgatgaatcactgcaacctgtgggacagccatcacccggaggtaccccagcgtattttgcgcatcatgtgccggctggaagagctgggcctggcaggtcggtgcttgacactgacaccccggcccgcgacagaagctgagctgctcacctgtcactctgctgagtatgtaggacaccttcgagccacggaaaaaatgaagactcgcgaattgcacagagagtcctctaacttcgatagcatctatatctgccctagtacgttcgcgtgtgcccagctcgcgaccggagcagcctgtcggctcgtggaggcggtcctaagcggtgaggtgttaaacggagccgctgtcgttcgcccccctggtcaccatgctgagcaggacgcagcctgtggcttttgcttttttaactccgtggccgtagcagcacgccacgcccaaacaatatcagggcacgctctgagaattctcattgtagattgggatgtccatcatggcaatgggacccagcatatgtttgaagacgacccatccgtcctttacgtctcactgcaccggtacgaccacggtaccttcttccccatgggtgacgaaggggcttcgagtcagatagggagggcggccggcactggcttcaccgtgaacgtcgcctggaatggtccgcggatgggagacgccgattatctagcagcctggcaccgcctcgtactgccgattgcctacgaatttaatcctgagttggtcctggttagcgccggcttcgatgctgccaggggcgacccattaggcggctgtcaggtgtcccccgaggggtacgcccacctgacacacctccttatgggactggcctccggacggatcatccttatcctcgagggcggttataacctcacaagtatctccgagtctatggcggcctgcacccgtagtctgctgggagacccaccgccattgctcacactgcctaggcctcccctaagcggggcactggcctctattacggagacgattcaggtccaccggcgatattggagaagtcttagggtgatgaaggtagaggaccgggagggcccctctagcagcaagcttgttacaaagaaggcaccccagccagccaagcctcgcctggcggaacgcatgaccactcgagagaagaaggttttagaggccggtatgggcaaggtcacttccgcaagctttggggaggagtcaacccctgggcagactaattctgaaaccgccgtcgtggctctcacacaagatcaaccttccgaggccgctactggcggcgcgactttggcccagacgatcagcgaagctgccattggtggcgcgatgctggggcagaccacaagtgaagaggccgttggaggcgccacgccagatcagacgacctctgaggaaaccgtgggcggagcgattctggaccagactacatcagaggatgctgtcgggggtgcgacacttggacagaccacttccgaagaggctgtaggtggagcaacattggcccaaactacttcggaggcggccatggagggtgcaactctggaccagacgacctcggaggaggccccaggaggcaccgagttgattcagacaccactggcctcttccactgaccaccagactccgccaacaagccccgtacaaggcaccacaccccagatctccccatcgacgctgattgggagcctgcggacgttagagctgggttcagaatcacaaggtgcctctgagagtcaggcacccggagaggagaacctcctcggggaggccgccggtggacaggatatggccgactcaatgctgatgcagggaagcagaggcctcacggaccaggccatcttctatgctgtaacccccctgccctggtgtccgcatttggtggccgtttgccccataccagccgctgggctggacgttacccagccatgtggagactgtggcaccatccaagaaaattgggtgtgtttgtcatgctaccaggtgtattgtggtagatacatcaacgggcatatgctccaacatcatggcaactcaggccatcccttagtcttgagctatattgacctgagtgcatggtgctactattgccaggcttatgtacaccatcaggccctgctcgacgtgaagaatatagcccaccaaaataaattcggcgaagacatgccgcacccacactag

SEQ ID NO: 15457 - DNA, 633 bp, Artificial Sequence
  Description of Artificial Sequence: Synthetic coding sequence
atgacatcgaccggccaggattcaacaaccacaaggcagcggcggtctaggcagaatccccaaagccccccccaggactcaagcgttacatccaagcgcaacattaagaagggagcggtgcccaggagcattcctaatctggctgaagtaaaaaaaaaggggaaaatgaagaagttaggccaggccatggaagaggatcttatcgtggggctgcagggaatggatctgaacctggaggccgaggcattggctggcactggattggttttagatgaacagctgaatgaatttcattgtctttgggacgattcctttccggagggccctgaacgcctgcacgcaattaaggagcagctgatccaagaggggttgctggaccggtgcgttagttttcaggcccgtttcgccgagaaagaggaattaatgttggtacactccttagagtatatcgatctgatggagaccacgcagtacatgaatgagggcgaactgcgagtgctggcagacacatatgattcagtctatctgcaccccaactcctatagctgtgcctgtctcgcatcaggaagtgtgttacggctggtggatgccgtcctgggcgctgagattaggaatggcatggcaataatctag

SEQ ID NO: 15458 - DNA, 3648 bp, Artificial Sequence
  Description of Artificial Sequence: Synthetic coding sequence
atgacctccactggacaggatagcacaaccactaggcagagacgctcacggcagaatcctcagagcccacctcaggactctagcgttacatccaaacgtaatatcaagaagggtgcagtgccgagaagcatccccaacctagctgaagtgaaaaaaaaggggaagatgaaaaagctgggccaagcaatggaagaagacttgattgtgggactccaggggatggatctgaaccttgaagctgaggcactggctgggaccggtctcgtactcgatgagcagctgaacgagttccactgcctctgggatgatagctttccggagggccccgagcgtcttcatgccattaaggaacagctgatccaggaaggtcttctggatagatgtgtgtcttttcaagctaggttcgcagagaaggaggagctcatgttggtacacagtttggaatacattgacctaatggaaactactcaatacatgaatgaaggtgaactacgggtcttggcagacacctacgactctgtgtaccttcatcctaactcttattcttgcgcttgcctagcttcgggcagtgtgctgcgactggtcgacgctgtgctaggagctgagatcaggaacggcatggccatcattcgtcccccaggacatcatgcacagcactccctgatggatggctactgcatgttcaaccacgtggctgtggctgcccgctacgcccagcagaagcaccgtatcagaagagtccttatcgtggactgggacgttcaccacggtcagggaactcaatttacgtttgaccaggacccgtccgtactgtatttctcaatacatcggtacgaacagggtcgcttttggccacatttgaaagcaagcaattggagcacaaccggatttgggcaaggccaagggtatacgattaatgtcccctggaaccaggttggcatgcgcgacgctgactatatcgcagcgttcttacatgtactgctgcctgtagctcttgagtttcagccgcagctggtgctagttgccgctggatttgacgcattacagggcgaccctaaaggcgaaatggccgcaacccctgccgggtttgcccaacttacacatctcctgatgggcttggcagggggaaagcttattctgagcttagagggaggctacaacctgcgcgccctggccgagggagtgagcgcaagtctccatacactgctcggggatccatgcccaatgctggagtcacctggagcaccctgcaggtccgcacaggcctctgtgtcttgcgcactggaggcactggagcccttctgggaggtactggtccggagcactgagactgtcgagcgcgacaatatggaagaagataacgtggaggagagcgaagaggaagggccatgggagccgcccgtgctacctatcctgacatggcctgtcttgcaaagccggacagggttggtttatgaccagaacatgatgaatcattgtaacctctgggactctcatcatcccgaagtgcctcaacggatacttagaattatgtgcaggcttgaggaactgggcctcgccgggcgttgtctgacactgactccccgtccagcgacagaggcagagcttttaacctgtcactccgccgaatatgtgggacacctgagggccaccgagaagatgaaaacaagagaattgcatcgtgaatcttccaacttcgacagtatctatatctgcccctccactttcgcctgcgcccagctggccacgggggccgcgtgccggctggtggaggcggtgctgagtggcgaggttctcaacggagcggctgtggtgcgtccacctggacatcacgccgagcaggatgccgcctgtggtttctgttttttcaattcagttgcagtggccgcccgtcatgcccagaccatctccggacacgctctgcgcatactgatcgtagattgggatgtacatcacgggaacggcacccagcatatgttcgaggatgaccccagcgttttgtacgtgagtctgcacaggtatgatcacggaacgttctttcccatgggagatgaaggagcaagtagtcaaattgggagggccgcaggcactggttttacggtcaacgtggcttggaatggcccacgcatgggagacgccgattacttggccgcttggcatcgcctcgtccttcctattgcctacgagtttaatccagagctcgtgctggtttctgctgggtttgacgcggcccggggggacccactgggcggctgccaggtctcaccagaaggatatgctcatctaacgcacttactgatggggctggcctcgggaagaattatcctaatcctagagggcggttataaccttacgagtataagtgagtccatggcagcatgcacgcggtccctattaggtgaccctccacctttattaacacttccccggcctcctttgtccggagcccttgcttctatcacagagactatccaagtgcacaggagatactggcgcagcctgagggtaatgaaggtcgaagatcgcgaaggcccctcaagctccaaacttgtgactaaaaaagctccccaacctgccaagcctaggttagcggagagaatgactactagagaaaaaaaagtcctcgaggcagggatgggaaaggtgacatctgccagctttggtgaagagtcgaccccggggcagaccaacagcgaaaccgcggtcgtcgctctgacccaggatcagcctagcgaagcagccacagggggcgccactttggcacaaaccattagcgaggcagccattgggggagctatgctcgggcagaccacctctgaagaggctgttggtggtgcaacacccgatcaaacaacctcagaggaaacagtggggggagccattctggatcaaaccacttccgaagatgctgtcggaggcgcaactctgggccagaccacatctgaagaagcggtggggggcgccaccctcgcccaaactacgagcgaggccgctatggaaggagcaaccctcgatcagactacgtccgaagaagcacccggcggcacagagttgatacagacccctttggcctctagcacagaccatcagacccccccgacatctccagtgcaagggacaactccccagatcagcccatctacacttataggtagtttgagaaccttagaactgggctccgaatctcagggcgccagtgaaagccaggcgcccggagaggagaatctgttgggtgaggctgctggtggtcaggacatggcggacagcatgcttatgcaagggtctcgtggcctgaccgaccaggccattttctatgcagtcacccctctgccttggtgcccccacctcgtcgcggtatgtccaatccccgcggccggcctcgatgtcactcagccctgcggagattgcgggactattcaagagaactgggtgtgcctcagctgctatcaggtatattgtgggcgctatatcaacgggcacatgttgcagcaccacgggaactctggccacccgctagttctgtcctacattgatctctctgcgtggtgttactattgccaggcctatgtgcatcaccaggcactcctcgatgtgaagaatattgcccatcagaataaattcggtgaggatatgccacatccacactag

SEQ ID NO: 15459 - DNA, 633 bp, Artificial Sequence
  Description of Artificial Sequence: Synthetic coding sequence
atgacttccactgggcaagacagcacaaccacaaggcaacggagatctaggcagaatccccagagccctccacaggatagctccgttacgagcaaaaggaatattaagaaaggtgctgtgcctcgatctatacccaatctggccgaggttaaaaagaagggcaaaatgaagaaactgggacaagccatggaagaggatctgatagtgggactgcaagggatggatctgaatctggaagccgaggcccttgctggcacaggacttgtcctagatgaacagctaaatgagttccactgcctctgggatgactcgttccctgagggccctgagaggctgcatgctataaaggagcagttgattcaagagggactcctcgataggtgtgtgtcttttcaggcccgcttcgccgagaaggaggaacttatgctggtccattccttggagtatattgatctaatggagaccactcaatacatgaacgaaggggaactgcgggtactcgccgacacctatgactcagtatatctgcatcctaacagttacagttgtgcctgcctagccagcggaagtgtactgcgcctcgtggatgcagtcctgggagctgaaatccgaaatgggatggcaattatatag

SEQ ID NO: 15460 - DNA, 891 bp, Artificial Sequence
  Description of Artificial Sequence: Synthetic coding sequence
atgaagaaactggggcaggccatggaagaggatttgattgtcggtctccagggcatggacctcaacctcgaggccgaagccttggccgggaccggtttggtgttggacgaacagttgaatgagtttcactgtttgtgggacgatagttttcccgagggcccggagcgcctgcacgccatcaaggaacagctcatccaagaaggcctgctcgatcggtgtgttagctttcaggccaggttcgcagagaaggaggagctgatgcttgtacatagcctcgagtatatcgacctcatggagacgactcagtacatgaatgaaggggagctcagggtgctggctgacacatacgacagcgtttatctgcaccccaattcatactcgtgcgcttgcctcgcaagtggctcggttctccgtctggttgatgctgtgttgggggctgagatacggaatggaatggctattattcgccctccgggacaccatgcccagcactcgctgatggatggctattgtatgttcaatcatgtcgccgttgccgccaggtacgcacagcagaagcatagaattcgccgcgtgttgatcgtggactgggacgttcaccatggccaggggactcagtttacgtttgaccaagacccttctgtgttgtacttcagtatacataggtacgagcaaggccggttctggcctcacctcaaggcctcaaattggtcaacaaccgggtttgggcagggacagggatacaccatcaacgttccctggaatcaagtggggatgcgagatgccgactacattgctgcctttctccacgtcctgttacccgtggcactggaggtgctgggaatctggggtgtgctgggtggcggcgtcgctctgaaagtgcgactgtag

SEQ ID NO: 15461 - DNA, 429 bp, Artificial Sequence
  Description of Artificial Sequence: Synthetic coding sequence
atgacaagcactggacaggactccaccactactcgtcagaggaggtcaagacaaaatccacaatcccctcctcaggactcatcagtgacttcaaagcggaacatcaagaagggtgccgttccacggtcaatccccaatcttgctgaagtgaagaagaagggcaaaatgaagaaattgggccaggctatggaagaggatctcatcgttgggttacaaggcatggacctgaacttagaggccgaggccctggcgggcactggactggtgctggacgagcagcttaacgagttccactgcttgtgggacgatagcttccctgaggggcccgagcgactgcacgcaattaaggagcaattaattcaagagggcctgctggatcgttgcgtgagcttccaggcacgcttcgcagagaaggaggagctcatgtag

SEQ ID NO: 15462 - DNA, 810 bp, Artificial Sequence
  Description of Artificial Sequence: Synthetic coding sequence
atgacatctactgggcaggacagcaccacaacccgacaacggcggagtaggcagaatcctcagagcccaccccaggacagctccgtaactagtaaacggaacataaaaaaaggggctgtaccacgctccatccccaaccttgctgaggtgaaaaaaaaaggcaagatgaagaagttgggtcaggcgatggaggaagacctcatcgttggccttcaaggaatggatctgaatctcgaagctgaagctttagccggtactgggcttgtactcgacgaacaactcaatgaatttcactgcctgtgggacgactcctttcctgaggggccagagcgattacatgcaattaaagaacagcttatacaggaaggccttctggaccgatgtgtcagctttcaggccagattcgctgaaaaagaggagctaatgcttgtgcattctttagagtatatagatctgatggaaacaacccaatacatgaacgaaggtgagctcagagtgctggctgatacatatgatagtgtgtacctccatccaaattcttattcctgtgcgtgtctggcctccggcagcgtgctccgactcgttgatgcagttttgggggccgagatcagaaatggcatggccattatcagacctcccggacatcatgctcaacacagcttgatggacggctattgtatgttcaatcatgtggccgtagccgctcgatacgcccagcaaaaacacagaattaggcgtgtgctcatcgtggattgggacgtgcatcacggccaaggaacccagtttacgtttgaccaggatcctcggtag

SEQ ID NO: 15463 - DNA, 2454 bp, Artificial Sequence
  Description of Artificial Sequence: Synthetic coding sequence
atgacgtctacaggacaggactccaccacgacacggcagcgccgatctcgccagaatccccagagccctccacaggatagctcagttacgtctaagcggaatattaaaaagggggccgtcccaaggagcatccccaatctggctgaggttaaaaagaaggggaagatgaagaagctcggccaggccatggaggaagacctgatcgtagggctgcaaggaatggatctgaacctcgaggcagaggcccttgccgggactggactcgtgctggatgagcagttgaacgaattccactgtctgtgggatgattcgttccctgaaggtcctgagcgcctgcacgctatcaaggagcaactgatccaagagggtctccttgaccgctgtgtcagcttccaggcacggttcgcagagaaggaagagttgatgctcgtgcactccttggagtatattgacctgatggaaacaacccaatacatgaatgagggtgaactaagggtcctagctgatacatatgattctgtttacctccaccccaattcctatagctgcgcctgcctggccagtggctctgtgctgcgcctggtcgatgccgtgctcggtgccgaaatccgaaatggcatggcaatcatccgacctcccgggcatcacgctcagcactcattaatggatggatattgcatgtttaaccatgttgcagtagccgctcgctatgcccagcagaagcatcgaatcagacgcgtgcttatagtggattgggatgtgcaccacgggcaggggacgcagttcaccttcgaccaggacccaagcgtgttgtacttcagtattcataggtacgagcaaggacgcttctggccccacctgaaggcatccaattggtccacaactggattcggccaagggcagggctacactatcaatgttccttggaaccaggtggggatgagagatgctgattacatcgccgcctttcttcacgtgttactccccgtcgcactagagtttcagcctcagttagtcttggtcgccgctggtttcgatgcccttcagggcgatccaaaaggggagatggctgccacccccgccggcttcgcccagctcacccacctgttaatgggtttggccggaggcaaactcatcctgagcctggaggggggatacaacttgagggctctcgctgaaggggtgtctgcttctctccatacccttttaggcgatccttgccccatgctggaatcccccggagccccatgtcggtccgcgcaagctagcgtaagttgcgcactcgaagcattggaacctttctgggaggtgcttgtgcgtagcactgagaccgtggaaagggacaatatggaagaggataacgtggaggaaagcgaggaggaagggccctgggaacccccggtgctacctatcctcacatggccagtcttgcagagtcgtacaggcctcgtatatgaccagaatatgatgaaccactgcaacctctgggacagtcaccatccggaggttccacaaaggatccttcggatcatgtgtaggctggaggagttgggtcttgctggcaggtgtctgacgctgacgcctcggccagctaccgaagccgaactacttacttgtcattccgctgaatacgtaggccacctccgggcaacggagaaaatgaaaacccgcgaactccaccgagagtccagtaatttcgatagtatttatatctgtcccagcaccttcgcctgcgcccagctcgctactggcgcagcctgtcgactcgttgaggcagtgctcagcggcgaggtgctcaacggtgccgccgtagtgagaccgccgggtcaccatgcagaacaggacgcagcctgtggtttctgctttttcaattccgttgctgtagccgccagacacgcccagaccattagtggtcacgcccttcgtatcctaatagttgactgggacgtgcatcacgggaatggaacacagcatatgtttgaggatgatcctagtgtcctgtacgtgagtttacatcgttacgaccacggcacattctttccgatgggagacgagggcgcatcctcgcagatcggtagggctgccggaaccggatttacagtgaacgttgcatggaatggtcctaggatgggggatgccgattacctggccgcctggcatcgcctggtgctgcctatagcgtatgaattcaacccagaattggtgctggtgtcagcaggtttcgacgccgcacgtggcgatccattagggggttgccaggtgagccccgagggttacgcacatctgactttgccaattgcctgtctgcgcgggaccactactcctgcccagaaagagaggggagccgcccagtggccacaggagggagccgatatcatgagaatcacccttgctggcggtgaacttacaggaagacacgggaaagtggcatatgtcatcaagtataagctctag

SEQ ID NO: 15464 - DNA, 156 bp, Artificial Sequence
  Description of Artificial Sequence: Synthetic coding sequence
atgaccagtacaggacaggactcaactaccacacggcaacgacgatcaaggcagaacccacaaagccctccccaggatagctctgtgacctccaagaggaacatcaaaaaaggagcagtcccaagaagtatacctaacctggctgaagtcaagtag

SEQ ID NO: 15465 - DNA, 516 bp, Artificial Sequence
  Description of Artificial Sequence: Synthetic coding sequence
atgacctctaccggacaggacagcacaacaacccgtcagcgtagatcgaggcaaaatccccagtccccacctcaggattcctccgtcacaagtaagagaaatatcaagaaaggcgcagtgcccaggagtatccctaatttggcggaggtgaaaaaaaagggtaagatgaaaaaattgggccaagccatggaggaggacctaatcgtagggctgcagggtatggacctgaacctcgaggccgaggcactggccggaactggcctggtgctggacgaacaactgaatgagtttcattgtctctgggatgattcctttccggaaggaccagagcggctacacgcaattaaagaacagctcattcaggaaggactgctagacaggtgcgtgtcttttcaggcccgttttgcggaaaaggaagaactcatgctggtgcacagcctggaatacatcgacctcatggagacaacgcagtacatgaatgagggagaactgagagtcttggccgacacttactag

SEQ ID NO: 15466 - DNA, 486 bp, Artificial Sequence
  Description of Artificial Sequence: Synthetic coding sequence
atgacgtcaaccggccaggactcaaccaccacacgccagaggcgctctaggcagaatccgcagtctccaccccaagatagctcagtgacatccaagagaaacatcaagaagggcgctgtcccacgtagtattcctaacctggccgaagtgaagaaaaaagggaaaatgaaaaagctgggacaggcaatggaggaggatctcatcgttggcctccaaggaatggacctaaatcttgaagctgaggcattagcaggtactggccttgtcctggatgagcagttaaacgaattccactgcctgtgggacgatagcttcccagaagggcctgagagactccatgcaatcaaagaacagcttatacaggagggactgctcgaccgctgtgtctctttccaagcacgtttcgctgaaaaagaggaacttatgctggtgcactccctcgagtacatagatttaatggaaacaacacaatatatgaatgaatag

SEQ ID NO: 15467 - DNA, 504 bp, Artificial Sequence
  Description of Artificial Sequence: Synthetic coding sequence
atgacctccactgggcaagactctacaacgacccgccagcggcgctctcgacagaatcctcagtcacccccacaggacagtagcgtgacaagtaaaaggaacattaaaaagggtgcagtgccacggtccattcccaatctggctgaagttaagaagaaaggcaaaatgaaaaagcttggtcaagctatggaagaagatcttatcgtgggcttgcagggaatggatctcaatttagaagctgaggccctggccggtaccgggcttgtcctcgacgagcagctcaacgaatttcactgcctttgggatgatagcttcccagaagggccagagcgcctgcacgccatcaaggagcaactcattcaggaaggcctgctggataggtgcgtgtcatttcaggcgcgctttgctgaaaaggaagaactgatgctcgtgcactcactggagtatatagacctaatggagaccacacaatatatgaatgagggagagctgagggtcttgtag

SEQ ID NO: 15468 - DNA, 3690 bp, Artificial Sequence
  Description of Artificial Sequence: Synthetic coding sequence
atgagtggagctaacagaggaagaggacaagccagttcgacaatgacgtcaacaggacaggactctactaccacccgccaacgccgcagccgccagaatccccaatccccgccacaggatagtagcgtgacctctaaacgaaatattaaaaaaggggccgttcctcgctctattcctaatctggcggaggtcaagaaaaaaggcaagatgaagaagctgggccaagctatggaggaagacttgatcgtgggcctccagggcatggacttaaatcttgaagctgaagcacttgccggaacagggctggtgttggatgaacagctcaacgaattccactgcctatgggacgattcattccctgaaggtcccgagagactgcacgcaatcaaggagcagctgattcaggagggtctcctggatcggtgtgtaagtttccaggccagatttgccgagaaggaggagttgatgttggttcacagtttagaatatatcgacttgatggagacgacccaatacatgaacgagggcgaactgcgagtccttgccgatacttatgattctgtctatttgcacccaaatagctacagctgcgcgtgtctggccagcgggagcgtgctgagacttgtcgacgcagtgttgggtgcagaaatcagaaatggaatggccatcatccgccccccaggtcaccacgctcagcactctttaatggacggttactgcatgtttaatcatgtggccgtggcagctaggtacgctcaacagaaacacagaatcagacgcgtgttaattgtagactgggatgttcatcatggccaggggacccagtttacattcgaccaagaccccagcgtcctgtacttttccatccacaggtacgaacaagggcgcttttggcctcacctgaaagcaagtaattggtcgaccaccgggttcggacagggtcaagggtataccatcaatgtgccgtggaatcaggtgggcatgcgtgacgcagactacatcgccgccttcctacacgtgttgctcccggtggctttagagtttcagccccaactagtgctggtcgccgctgggttcgacgcgctgcaaggcgaccctaagggagagatggctgctactccagctgggtttgcccaactgactcatctcttaatggggttagccggcggcaaactgatcttatctctggaaggcggttacaatttacgtgccctggcagaaggcgtgagtgcaagtttgcacacactgttaggagacccatgtcccatgttagaaagtccaggcgcaccctgtagatctgctcaggcgtctgtcagttgcgctctggaggctctggagcccttctgggaagtgttggtgcgcagtacagagacggtcgagagagataacatggaggaggacaacgtcgaagagtcagaggaggaagggccctgggagcctccagtgctccctatcttgacttggcctgtgctgcagtcaaggacgggtctggtgtatgaccaaaatatgatgaatcactgcaacctgtgggactcccaccacccagaagtcccccagcggatactgaggattatgtgccgcctggaggaactcggcttagcaggcagatgccttacgctgaccccacgacccgcaaccgaggctgaacttttgacctgtcactccgccgaatacgtcggtcacctccgggccaccgaaaaaatgaagacgagggagctccaccgggaatcttccaatttcgattcaatatacatttgcccaagtacttttgcttgtgctcaactagccaccggggcagcatgtagattagtcgaggccgtgctttctggggaggtgctgaatggcgcagctgtggtgcgcccgccaggacaccatgccgagcaggacgccgcatgcggcttttgctttttcaattccgttgctgtggcagcccgccacgcccagaccatctccggccacgccctgcggatcttaattgtcgattgggatgtgcaccacggaaacgggactcagcatatgtttgaagacgacccctccgttctgtacgtcagtctacacagatatgatcatggcacgttcttccctatgggagacgaaggagccagcagccagataggaagagcagctgggacaggattcaccgttaatgtggcttggaatgggccccggatgggcgacgccgactatcttgcggcctggcacaggctggttctgcctattgcatatgagttcaaccctgaactcgtactggtttccgccgggtttgatgccgcccggggggaccctttgggtggatgccaagtgtcccccgagggatacgcccatctgacacatctcctgatgggcctggctagcggacgaattattcttatattggaggggggttataatctgacaagtatctccgagtccatggcggcatgtactcgcagcctactgggggatccaccacctctcctgaccctgcctagaccccctttgtccggtgcattggcttctatcacggagacaatccaggtccaccgccgttactggcgttctctacgggttatgaaagtagaggaccgtgaagggccatcgtcgtccaagctggtgacaaaaaaagctccacagcccgctaagccccgtctggcagaacgcatgactactagagagaagaaagtgctggaagcaggaatgggaaaggtgacatccgcgagtttcggcgaggaatcaacacctggacagacgaacagcgagacagcagtcgtggcactgactcaggatcaaccaagcgaggctgctacaggaggcgccacattagcccagaccatctccgaggccgctattggaggcgccatgcttggacagaccaccagcgaggaggcggttggtggcgcgaccccagatcagacaacatccgaagaaactgttgggggcgctatcttggatcagacgacctccgaagatgcggttggtggagctaccctcggacagaccactagcgaggaagctgtgggcggcgccaccctggcccaaacaacatctgaagccgcaatggaaggcgccacgttggaccagaccacatccgaggaggcccccggcggcacagagttaattcagactccgcttgcctcctctaccgaccatcagactccccccacttcccccgtccagggtacaactcctcagatctccccttctacccttataggatccttaagaacgttagaactgggatcagaatcccagggggccagcgaaagccaggctcccggcgaagaaaatctgctgggggaggccgccgggggccaggacatggccgactccatgctgatgcaagggagccggggtctcaccgatcaagctattttttatgccgtcaccccccttccttggtgtccccaccttgtggcagtctgccctattccagccgccgggctggatgtgacccagccctgcggtgattgtggtactatccaggagaactgggtgtgtttatcctgttaccaggtgtactgcggacggtacatcaacggccacatgctgcagcaccacggaaattctggacatcctctcgttttgagctacatcgatctctccgcttggtgttattattgtcaggcctatgtgcatcaccaagcgctgctggacgtgaaaaacatcgcccaccaaaacaaattcggggaagatatgccccatccccactag

SEQ ID NO: 15469 - DNA, 2976 bp, Artificial Sequence
  Description of Artificial Sequence: Synthetic coding sequence
atgcatagtcctggcgccgatggaacccaggtttcccccggcgcccactactgctccccaaccggtgccgggtgcccccgcccatgtgcggatacacctggaccccaacctcaacccatggatcttcgcgtgggccagagacccccagtagagccaccaccggaacccactttactagcgcttcagcgaccccagcgtctccaccatcatctctttctggctggtttgcagcagcagcgttcagtcgaaccaatgcggctatcgatggatacccccatgccagagctgcaggtcgggccccaagagcaggagttacgccagctcttacacaaggataagtctaagcgcagcgcagtggcaagctccgtggtaaagcagaagctggctgaagtgatactgaagaagcagcaggcggctcttgagcgaactgtccaccccaacagtcccggaatcccataccgcacccttgaacccctcgagacggaaggtgctacaaggtctatgctgagtagcttcctgccgcctgttccctccctccccagcgatcctccagaacactttcctctgaggaagaccgtgagtgaacctaatctcaaacttcggtataaaccaaaaaaatccttggaacgacggaagaatcctctactacgcaaggagtctgcccctccatccctccggcgcagaccggccgagaccctgggagattcatcacccagttcctcgtctactcccgccagcggatgcagtagtcctaacgatagcgaacacggtcccaatcccatcctaggttccgaagcgctgcttggccagaggttaagattacaggagacatccgttgcgccttttgcgcttcccaccgtcagtttgttaccagctattacattgggtctgccagccccagcacgcgcagatagcgacagaagaacccaccccactcttggtccacgaggccccattctgggtagccctcatacccctttatttcttccacacggacttgaacctgaggccgggggaacccttccttcacgactccagcccattctccttctggacccctcgggatctcacgctccccttctgacggtaccggggctgggtcctttacctttccatttcgcacagagcctcatgaccacagagagactttccggtagtgggctgcactggcctctaagccgtacaagaagcgaaccgcttcctccttccgccactgcacccccccccccggggccgatgcagccacggctggagcaactcaagactcatgttcaggtaattaagcggtccgctaaaccgtcagaaaagcctagattaaggcaaataccatccgccgaggacctggagactgatggcggcggacccggacaggtcgtggacgacgggcttgagcaccgggaactcggccacggacaacccgaagcccgggggcctgcacctttacagcagcatccgcaggtgcttttgtgggaacagcagcgcctggccggacgcctgcctcgagggtcaacaggggatacagttctcttgcctttagctcaaggcggtcaccggccactgtctcgagcgcagtctagccccgccgctccagcttccttaagcgcccctgagcctgcctcgcaagctagagtgctaagctctagcgaaacacctgctcgcacccttccttttactaccggactcatttacgattctgtgatgcttaaacatcagtgctcgtgcggagacaatagtcggcatcccgaacacgccggccgcatccagtccatttggtccagactccaggagcgtgggctacggtcccaatgcgagtgcctgagggggcgcaaagcttctctcgaggaactccagtcagtgcacagtgagcgccacgtgctcctgtacggcactaaccccctcagtaggctcaagctcgataacggcaaattggccggcttactggcccaaagaatgttcgtgatgctgccttgcgggggcgtaggggttgacacggataccatttggaacgagttgcactcttccaatgcagcaaggtgggccgcaggttcggttacagatctcgccttcaaggtggcctcccgcgaattgaagaacgggttcgccgtggtgaggcccccaggccaccatgccgaccattccacagcgatggggttttgcttctttaacagcgttgccatagcctgcaggcagttgcaacagcaaagtaaagctagtaaaatactaattgtggactgggatgtccatcatggaaatggtacgcagcagaccttttatcaggatccttcagtgctctatatttctctgcatcggcatgacgatggtaacttttttcctggtagtggggcagtggatgaggtcggtgcaggttctggtgagggctttaacgtaaacgtcgcgtgggccgggggtctcgatccacccatgggcgatccagagtatctcgcagcctttagaatcgtcgtgatgcctattgcgagggagttttctcctgatctggtcctggtgtctgccgggttcgacgcagccgaaggccatcctgcacccctgggcggataccatgtgtccgcaaaatgcttcggatacatgacacagcagttgatgaacctcgccggtggggcagtcgtgctcgcacttgaagggggccacgatctcacggctatctgtgacgcatccgaggcctgcgtcgcagctttgctcgggaatagggtggacccattgtctgaggagggatggaagcagaagcccaatctgaacgccatcagatcattggaggccgtgatccgcgttcactctaagtattggggctgcatgcagagactggcaagctgtcccgactcctgggtgccaagggtaccaggcgccgacaaagaagaggttgaggcggtgactgctttagcctctctgagtgtagggatcttggccgaagaccgaccatccgagcaacttgtcgaggaagaagaaccgatgaacctttag

SEQ ID NO: 15470 - DNA, 2865 bp, Artificial Sequence
  Description of Artificial Sequence: Synthetic coding sequence
atgcacagccccggagcggatgggacccaggtgagtccaggagcccactattgttcgcctaccggtgctggatgccccagaccatgcgctgatacccctgggccccagccacaaccaatggatctccgcgtcggacagcggccccccgtggaacccccaccagaacccactctcttggcccttcagcggcctcagaggctccaccaccacctcttccttgccggccttcaacagcagaggtctgtggagcctatgcgtctgtccatggatactcctatgccagaactccaggtcggtccccaggagcaggaactgcggcagttgttgcacaaggacaagtctaaaaggagcgctgtcgcaagttccgtggttaagcagaaactcgccgaggttatactcaagaagcagcaagctgctcttgagcggactgttcaccctaactcccctggaatcccctatcgaacgctcgagcccctcgagacagagggcgccactcgcagtatgctctcgtccttcctgccccctgtgcccagtttgccttcagaccctccagaacactttcctctcaggaagactgtgagcgagcccaacctgaaactgagatacaagcccaagaagtcactggagagaaggaagaatcctcttcttcgcaaagagtctgctcccccgtccctcaggcgacgaccggctgagaccctgggtgactcatctccctccagttcgtctaccccagccagcgggtgctcttcacctaacgattccgagcacggccctaatcctattctggggagcgaggcagactccgatcggaggacacatcccaccttaggccctcgaggacctatactgggatcgcctcatacacctctgttcctgccacatggcctggagccagaagctgggggcaccctaccctcacggcttcaacccatcttgcttctggaccccagcggaagccacgcccccctgctgactgtgccagggctcggtcccctaccttttcactttgcccaatcacttatgacgaccgagcgcctatctggatccggcctccactggccgctgtcaaggacacgaagtgagccgctgcccccctccgcaactgcccctcccccacctggaccaatgcagccacgcctggaacagctgaagacacacgtgcaagttattaaaaggtcagctaagccctcggagaagccacggctgcggcagattcccagtgctgaggacttggagaccgatgggggaggccccggccaggtggtggacgatggattggagcaccgggaactcggtcacgggcagccagaggcccgagggccagcccctctccaacagcatccacaggttctcttatgggagcagcagcgactggccggtcgacttccccggggtagcacaggagacacggtacttctcccattggcccagggcgggcatagaccgctttcccgagcccagtcctccccagctgctcctgcaagcctgtcagcaccagagccagctagtcaggcccgggtgctctcctcgagtgaaacccccgccaggacactgcccttcaccacaggcttaatatatgattcagtgatgcttaagcaccagtgctcctgtggcgataatagccgccaccccgagcacgcgggacggatacaaagcatttggtctcgactgcaggaaagagggctgcgttctcagtgtgagtgtctcaggggcagaaaagcgagccttgaagaacttcagtctgtgcacagcgagaggcatgtgcttctttatggaaccaatcccctcagtagattgaagctggacaatggcaagctggcaggcttattggcccagaggatgtttgtcatgcttccttgtggaggcgtcggtgtcgatactgatactatttggaacgaacttcacagtagcaatgccgctcgatgggcagccggctcagtaacggatctagcattcaaagttgccagcagggaactgaaaaatggttttgccgtggtgcggccacctggtcaccatgcggatcactccacagctatggggttttgcttttttaattctgtggccatcgcctgtaggcagctgcagcaacaaagtaaagcgagtaagatcctgatagtggattgggatgtacatcatggtaacgggacccagcagacattctaccaggacccttccgtgctatacatttcgctgcataggcacgatgatgggaacttcttcccaggctcaggcgccgtggacgaggtgggggccggctctggcgaaggttttaacgtgaacgttgcttgggccgggggcctcgatcctcctatgggagatcccgagtacctagccgctttcaggatcgtggtcatgcctatcgcaagggagttttcacctgatcttgtgctcgtgtcagcaggatttgacgccgccgaagggcaccctgcacccctgggagggtatcacgtcagtgccaagtgctttggatatatgacccaacaactgatgaatctcgctggcggagctgtggtgctcgctctggagggaggacacgatctgactgcaatctgtgatgcttcagaggcatgcgtggccgctttactcggaaaccgggtggacccgctcagcgaagaagggtggaagcaaaaacctaacctcaacgccatcaggagcctagaagccgtgattcgcgtccattccaagtactgggggtgtatgcagcgactcgcatcttgtcccgattcctgggtgccaagagttccaggagcagacaaagaggaagtcgaggccgtaacggcgctggcgtccctcagcgttggcatattggccgaggaccgcccgagtgaacagctggtggaggaagaggaacccatgaacttatag

SEQ ID NO: 15471 - DNA, 3045 bp, Artificial Sequence
  Description of Artificial Sequence: Synthetic coding sequence
atgtctgatctacgcaaaagagaactgggagctctgttcacaagcaggggtacgggcggggtggagtgggacggaacccaggtgtctccaggagcccactactgcagcccaaccggagcagggtgtccacgcccatgcgcagatacccctggtccacaaccacaacccatggatctgcgcgtaggtcagaggccaccagttgagccgccgcccgaacccactttgctggccctccagcggccccagagactgcaccaccacctgtttcttgccggcctgcagcagcagaggtccgtggaacccatgcgcctcagcatggacacccctatgcctgagcttcaagtggggcctcaggagcaggaacttcgccagttgttgcacaaggataaatccaagcgctctgccgtggcgtcgagtgttgtgaaacagaaactggcagaggttatcctcaagaagcagcaggccgcattggaaaggactgtgcaccccaatagcccgggcatcccttaccgcaccctagagcccctcgagacagaaggcgctacaagatctatgctctcctcttttctcccccccgtgcctagccttccctccgacccgcccgagcactttcctttacgcaagacagtctctgagcccaacctaaagctgcggtacaagcctaaaaagagcctggaacggcggaagaacccccttctgagaaaagaaagtgcacccccctccttacgcaggaggcctgcggagactttgggcgattcctccccctcgtcaagtagcactcctgccagcggctgctcaagtcctaacgattcggagcatggccccaacccaatcttgggtagcgaagcactactgggacagcggctacgcctgcaggaaacatctgtggcacctttcgctttaccaactgtgagcttgttacccgctatcactttgggtttacccgctccagctcgggccgattctgaccgcagaacccacccaactcttggcccccgcggccccatactgggaagtccacacacaccactgtttcttcctcacggcttggagcctgaggccgggggcacccttccgtcacggctgcagccaatcctcttgctggaccctagtgggtctcacgccccgctgctaacagttccagggttgggtcctcttcccttccattttgcacagagtctaatgacgacagagcgtttgtctggctccggcctccattggccacttagtcgaacccggtccgagccattgcctccctcagctaccgccccgcctcccccggggcctatgcagccacgactggagcaactcaaaactcatgtgcaggtaattaagcgctctgctaaaccatcagagaaacctagattgcgacagataccctccgccgaggacctcgagactgacggtgggggtcccggacaggtggtagacgatggcctcgagcaccgcgagcttggccacggccagcctgaggcacgcggtccagctccactgcaacagcacccccaggtgctattgtgggagcagcagaggctcgccggtcgtctgcctagagggtccaccggcgataccgtgctccttccattggcccaggggggccatcggcccctaagtcgggcccagtcttctccggctgcgcctgcatccttgagcgccccggagccagcgagccaggcccgagtgttgtctagttccgaaacgcccgcccgcaccttgccattcacaaccggcttaatttatgattccgtcatgttgaaacatcagtgctcctgtggtgataattcccggcacccagagcacgccggcagaattcaaagcatctggtccaggctgcaggagagaggtctgagatcacaatgcgaatgtctccgcggccggaaagcaagtcttgaggaattacagtccgtgcattctgaacggcacgtcctcctctacggcacaaatccactgtctcggctcaaactggacaatggcaaactagctggccttttggcacagaggatgtttgtgatgttgccatgtggcggggtgggcgttgacacagacacaatttggaatgagctgcattcctccaacgccgcccgctgggcggcgggctcggtgacggatcttgcattcaaagtcgccagcagggagctgaaaaacggattcgccgtcgtccgtcccccgggtcaccatgccgaccacagcacggctatgggcttctgtttcttcaattcggtggccatcgcctgtagacagctccaacaacagtccaaggcaagtaaaatactgatagtagattgggatgtgcatcatggtaatggaacacagcaaaccttctatcaggatcccagtgtgctttatatcagcctccataggcacgatgacggcaatttctttccagggtccggcgccgttgacgaggtgggggcaggcagcggagagggctttaacgtgaacgtggcgtgggcaggaggcctggaccctccaatgggtgatcctgagtatttagcagcgttcagaatcgtggtcatgcctatcgccagagagttttcccccgaccttgtcctggttagcgccggatttgacgccgctgaaggacatccagccccccttgggggatatcacgtatcagcaaagtgctttggctacatgacccagcagcttatgaacttggcaggcggcgcagtcgtccttgctctcgagggaggccatgaccttacagcaatctgtgatgcttcggaagcttgtgtcgccgctcttttaggcaatagggtggatccgctcagcgaggaaggttggaaacaaaaacccaatctaaacgctatcagaagtctagaggccgtgatacgggtgcacatgggggcactgacactgagtcagattccaggccatggttcctcacagcagcaagcaggcggggctttttcatggcctggccacccttgccgagcagccgtggtaatggtgaatactggggccgcatgcagcgcgtggccccctgtgcagacgccagggtgcctggagtgccagggcttgacaaagaaaaaatggcgccagtag

SEQ ID NO: 15472 - DNA, 402 bp, Artificial Sequence
  Description of Artificial Sequence: Synthetic coding sequence
atgcatagtcctggggcgggatgccccaggccgtgcgcagacacccctggcccacaaccacagccaatggacctgcgtgtaggccaacgacctccagtcgagcctccgcctgaaccaaccctcctggccttgcagcgcccacaaagacttcaccaccatctgttcctagccggccttcagcagcagaggtctgtggagccgatgagattatcaatggatacccctatgcccgagctccaagttggaccacaggagcaggagctcagacagcttctgcacaaagataagagcaagcggagcgcggtagcatcttcagttgtaaagcagaagcttgctgaggtgattctgaaaaagcagcaggccgccttagagcggacagtccacccaaactcacccggttag

SEQ ID NO: 15473 - DNA, 2859 bp, Artificial Sequence
  Description of Artificial Sequence: Synthetic coding sequence
atggatctgagagtgggacaacggcctcctgttgagccgcctcctgagcctacattgcttgccctgcagaggccccaaaggctgcatcaccacctctttttagccggactccagcagcaacgctcagttgagccgatgcggctttccatggatacccctatgccagaactccaggttgggccgcaagagcaagagctacggcaactgctgcacaaggacaagtctaagcggtcagcggtggcttcatctgttgttaaacagaaactggcagaggtgatcctgaagaaacagcaggccgccttggagcgaacagttcaccctaattcacctggtatcccgtaccgaaccctcgaaccgttggagactgagggtgccacccgaagcatgctgagctcatttcttccaccagtcccttctctgccctccgacccaccggagcattttcctctgcggaagacggtgagtgagccaaacctgaagcttcgctataaaccgaagaagtccttggagaggcgtaagaatccactgctccggaaggagagtgctcccccatcccttagacgccgtcccgccgagacactgggggacagtagcccctcaagctcttctacccccgctagtgggtgttccagtccaaatgacagtgagcatggccccaacccgatcctgggatccgaggcgcttctcggtcagcgactgagactgcaggagacctccgtggccccttttgcactgccaaccgttagtctgctccccgcaattacactgggccttccggcccctgcgcgcgccgatagtgatcggcgcacgcatcctacgttgggcccgcgcggtccaattcttggtagtccgcatactcctctgttcctgccccatggtcttgagcctgaggctgggggcacactgccaagccggctgcagcctattttgctgctggatccgagcgggtcccatgctccgttgctcaccgttccaggactcggccccctgccattccattttgcacagagtctcatgaccaccgaaagactctcagggagtggactgcactggcccctgtcaaggacacgcagcgagcccctgcccccctcagcgacggctcctcctccgccgggccccatgcagcctagattggaacagctcaaaactcacgttcaggtgatcaagaggtccgctaaacctagtgagaagccgagactgaggcagataccctcagccgaagatttggaaaccgatggaggtggacctgggcaggtggtggatgacggcctggaacatagagaactggggcacggccagcctgaagcccggggacctgccccactacagcagcatccacaagttctgctttgggaacaacaacggctggcagggagacttccccgcggttcaaccggcgataccgtgctgctcccactggcgcagggagggcacagaccactttccagggctcagagcagccccgccgcgccagccagtctttcagccccagagcctgcttcccaggctagagtgttgtcctcatctgaaacacccgcccgaacattaccatttaccaccggactgatatacgattctgtgatgcttaagcatcagtgctcttgcggggataatagcaggcatcctgaacacgcaggaaggatacagagcatttggtctcggctgcaagagagaggcctgcgaagccagtgtgagtgcctgagagggcgcaaggcaagccttgaagaactgcagagtgtccattctgagcgccacgttcttctgtatggaactaacccactctcaaggttaaagctagataacggaaagttggctggactgctggcgcaacgtatgttcgtgatgctgccctgcggaggcgtgggtgtggacacagatacaatctggaacgagctgcattcaagtaatgccgctagatgggccgccgggtccgttacagatctggcatttaaagtcgcctcccgcgagctgaaaaatggctttgctgtggtgcgacccccggggcaccatgcggaccattccactgccatggggttctgctttttcaactctgtggccatagcatgccggcagttgcagcaacagagtaaggcgtcaaagattctaatcgtggattgggatgtacaccacggcaacggaacccaacagacgttttaccaagatcctagcgtgctgtacattagcctgcacaggcacgatgacggcaacttcttccctggttccggtgccgtagacgaggtaggcgcgggctcaggcgagggattcaacgtgaacgtggcgtgggccggcgggttagatcccccaatgggcgatccagagtaccttgccgccttccgtatagtagtcatgccaatcgcccgggaattcagtccagatctggtgctggtttcagcaggattcgatgccgccgaagggcatcccgcccctttaggcggctaccacgtatccgccaaatgcttcggctatatgacccagcagcttatgaacttggcaggcggagccgtcgtgctggctcttgagggtgggcacgacttaaccgcaatttgcgatgcctccgaggcctgcgtggctgccctcctcggcaaccgcgtggacccactcagcgaggaaggctggaagcagaagcccaacctgaacgccatcaggtcacttgaggctgtcattcgggttcatagcaaatactgggggtgtatgcaacggctcgcttcttgcccggactcgtgggttcctagggtacccggtgctgacaaggaggaggtggaggcagtgacagccctggccagtctctcagtgggcatccttgctgaagacagaccctcggagcagctcgtggaagaagaggaacccatgaacctgtag

SEQ ID NO: 15474 - DNA, 2925 bp, Artificial Sequence
  Description of Artificial Sequence: Synthetic coding sequence
atgcacagcccaggagctggatgtccacgtccctgtgcagacacccccggcccacagccccagcccatggacctgcgggtgggacaacgcccacctgtggagcccccacctgagcccaccttactggccctgcaacggccacaaaggttacaccaccacttattccttgcgggactccaacaacaaagaagcgtggagccaatgcggctgagtatggacactcctatgcctgagttgcaagtgggtccgcaggagcaggagttacgacagcttctgcacaaggacaagagtaagagaagcgctgttgcttcctcagttgtcaaacagaaactggctgaagtcattcttaagaaacagcaggcagcacttgagcggaccgtccacccaaactcaccagggatcccttaccgaactctcgaaccattagaaacagagggcgccaccaggagcatgctctcgtccttcctgccccccgtcccctcgctgccgtcagaccccccggagcatttccccctccgcaaaaccgtatccgagccaaacctgaaattgcgttataaaccgaagaagagcctggaacgtcgtaagaatccccttctaagaaaagagtctgctcctccaagcctgaggcgccgccctgcggagacattaggagattcttctccaagttcatcctccactcctgcctctggatgtagtagccccaatgactccgaacacgggcccaatccgattttaggcagtgaggccctgttgggccaacgactcagattacaagaaacctcggttgcacctttcgctctgccgacggtgtcgctgctccccgcgatcacactcggcctcccggcccctgccagagccgattccgatcgacgtacccaccctaccttaggccctcgcgggcccattctgggctctcctcacacccccctctttcttccgcacgggctggaaccagaggcaggcggaactctgccctccagactacagcctattctgctgcttgacccctctgggtctcatgctccactgctcactgttcccggtcttggccctctaccttttcactttgctcagagcctgatgacaacggagcgcctatcgggtagcgggctccattggccgctatcaagaactcggagtgagcctttgccacctagtgcaaccgcccccccaccccccgggcccatgcaacctcgcttggaacagctgaagactcatgtgcaggtgatcaagagaagcgccaaaccgagtgaaaagcctaggctgcgacagataccttctgccgaggatcttgagactgacggcggaggccctggtcaggttgtcgatgatggccttgaacatagggagcttggacatgggcaacctgaggcgcgcggccctgcgccactgcagcagcatcctcaggtcctgctctgggagcagcagaggctggcaggccgccttcctcgtggatccactggggacacggtcttactcccactcgcgcagggagggcataggcccctgtcccgggctcagagctcacctgccgctcccgcctctctctctgcacccgaacctgccagccaggcacgcgtgctgtcctcttccgaaacccctgcccgcaccctcccatttactaccggtctcatatatgactccgtcatgctgaagcaccagtgcagttgtggagacaacagtcggcacccggagcacgccggcagaatccagagcatctggagcaggttacaggagcgcgggctgcgttcgcagtgtgaatgcctccgcggacgtaaggctagcctagaagagctccagagcgtgcatagtgagcgacatgtattgctgtacggcaccaatcctttaagcaggctcaagctggataatggcaaacttgccggtctactggcacagcgtatgttcgtgatgttgccctgtgggggtgtgggagtggacaccgacacaatctggaatgagctgcacagtagcaacgccgcacgctgggctgctggcagcgtgacggaccttgcatttaaagtggcaagtcgtgagctaaagaatggatttgctgtggttagaccccccggacatcacgccgaccatagtactgccatgggattttgtttcttcaattccgtggccatcgcttgccggcagttgcagcagcaaagcaaagccagcaagatcctaatcgtggactgggatgtccatcatggaaatgggacacagcagactttctaccaggaccctagcgtcctctatatttcccttcatagacatgatgatgggaacttttttcccggatccggggcagtggatgaggttggcgcaggtagcggagagggttttaatgtaaacgtggcctgggcggggggcttagatccccctatgggtgatccagaatatcttgctgctttcagaatcgttgtgatgccgatcgctcgggagttttcccccgacctcgtgcttgtaagcgccggtttcgatgcagccgagggacacccggcacccctcggcggctaccacgtcagcgccaaatgttttggctacatgactcaacaactgatgaatctcgccggcggcgcggttgtcttggccctggaaggtggccacgatctgaccgccatatgtgatgcatcagaggcttgcgtagccgccctcttgggaaacagagtcgatcctctctccgaagagggctggaagcaaaaacctaatctcaacgccattaggtcgttggaagcagtcatccgtgtgcactctaaatactggggttgtatgcagagattagcctcctgtcctgattcctgggtacccagggtgcccggagcagacaaagaggaagtagaagccgtgacagccctcgccagtctgagcgttggcatactcgccgaagaccgtccatctgagcagctggtggaggaggaagaaccaatgaatttatag

SEQ ID NO: 15475 - DNA, 819 bp, Artificial Sequence
  Description of Artificial Sequence: Synthetic coding sequence
atggaagaacctgaggagcctgcagattcaggacaaagtctggtgcccgtttacatttactctccggagtacgtctcaatgtgcgatagccttgccaaaatccccaagcgtgcatccatggtccactccctcatcgaagcatatgctctccataagcagatgcggattgtgaaacccaaggtcgcatctatggaggaaatggctacctttcatacagatgcctatctccagcacctgcagaaggtatcccaggagggggacgatgatcaccccgatagtatcgaatatgggcttggttatgactgcccagcaaccgaggggatttttgactatgccgccgcaattggaggcgctaccatcacagccgcccagtgcctgatagacggtatgtgcaaagttgcaatcaattggtctggcggttggcatcatgctaaaaaagatgaagctagcggattctgctatctcaacgacgctgtgctgggcatcctccgcctcaggagaaagtttgaaagaatactttacgtggatctcgacctgcatcatggcgacggtgtggaagatgcctttagcttcacatccaaggtgatgacggtctcgctccacaagttctctccgggcttctttccaggaaaatccgatgtgagcgatgtggggctggggaaaggacggtactactctgtgaacgttccaattcaggatggaatccaagatgaaaagtattatcagatctgcgagtcagtacgtacatcttgtccaaaatctagacccgtggaggccgctgccgccgcttgcctcccacaccttcacagcttagtctag

SEQ ID NO: 15476 - DNA, 1134 bp, Artificial Sequence
  Description of Artificial Sequence: Synthetic coding sequence
atggaggagccggaggagcctgcagactccggccagtcattggtgccggtctatatttactcccccgaatatgtgtctatgtgcgacagtctggccaagatccctaaaagagcctcaatggtgcactctctgattgaggcctacgctcttcacaaacagatgagaatcgtcaaacccaaagttgcttctatggaggagatggcgacatttcataccgacgcctacctgcaacatctccaaaaggtgtcccaggaaggggatgacgaccatcctgacagtattgaatacggcctgggatacgattgtcctgccaccgagggcatcttcgattacgccgcagcaatcggcggagctacaattactgcagcgcaatgccttattgatggaatgtgcaaggtggccatcaattggagcggtggttggcaccatgctaagaaggacgaggccagtggcttttgctatctgaacgacgccgtactgggaattctccgcctgaggcgaaagttcgaacgaatcctctatgtcgacctagacctgcatcacggcgacggagtggaggacgcgtttagctttaccagcaaggtcatgacagtttccctgcacaaattctctccaggttttttccctggtaccggagacgtgtcagatgtcggactcggcaagggccggtattactcagtcaacgtgccgatccaagacggaatacaggatgagaaatattatcagatttgcgaatcagtactcaaggaggtgtaccaagcattcaacccaaaggctgtcgtactacagctgggtgctgacacaatcgctggcgaccctatgtgtagctttaatatgacccccgttgggatcgggaaatgtctaaaatatattttgcagtggcagctagcgacattgatcctgggcggggggggatataatttggcgaataccgcccggtgttggacttatctgacaggggtcatcttaggcaagactctgtcgtcagagatacctgatcatgagtttttcactgcctacggtccagattacgttttagagatcaccccaagctgtagacctgatcgaaatgagccacatcgaatccagcagatcctgaactatatcaaaggaaacctcaaacacgtggtgtag

SEQ ID NO: 15477 - DNA, 861 bp, Artificial Sequence
  Description of Artificial Sequence: Synthetic coding sequence
atggaggagcctgaagagcccgccgactcaggtcagtctctggtacctgtgtacatttattccccagagtatgtcagcatgtgcgactctctggcgaaaattccaaagcgtgcctccatggtgcactcccttatcgaagcgtatgctctgcataagcagatgcgggacgaagcttcagggttctgctacctaaacgacgcagtactcggtatactccgactcaggcggaaatttgagcgcatactctatgttgatctggacctgcaccacggagacggagttgaagacgcattttcatttaccagcaaagtcatgaccgtgtccctgcacaaattttcccctggtttttttcctggcacgggggacgtatctgatgtgggccttgggaaaggcagatactactcagtcaatgtgccaattcaggatgggatacaagatgagaaatattatcagatctgtgaaagcgtcctgaaagaagtgtaccaggccttcaatcctaaagccgtggtcctgcagctcggtgccgatacaatcgctggcgacccgatgtgctccttcaacatgacacccgtagggatcgggaaatgcctgaagtatattctgcagtggcagttagctactctaatcctggggggtggcggctacaacctggctaataccgcccgttgttggacctatctgaccggcgtgattttgggtaagactctgtcgtccgaaatccccgatcacgaattttttacagcctacggtccagactatgtactggaaatcactccgtcctgccggcctgatcgcaatgaaccccacaggatccaacagattctgaactatatcaaaggtaatctgaaacatgtagtgtag

SEQ ID NO: 15478 - DNA, 549 bp, Artificial Sequence
  Description of Artificial Sequence: Synthetic coding sequence
atgacagtcagcttgcataagttctccccagggttcttccctgggacaggagacgtgagtgatgttggcctgggcaaaggacggtactattccgtcaatgtgccaattcaggatgggatccaggacgagaagtattatcagatctgtgagagtgtcctgaaagaagtttaccaggcattcaatcccaaagccgtggtgctgcagctgggcgctgatacgatcgcaggagaccccatgtgcagctttaatatgaccccagtgggcatcggcaaatgtctcaaatatattttacagtggcaactggccaccttgatccttggtggaggaggatacaacctggcaaacaccgcacgatgttggacctacctgaccggagtcatactgggaaagacactttcctccgagatcccggatcatgaattcttcaccgcctatggtccggattacgtcctggagatcacaccatcatgcagaccagatcgaaacgaaccccacaggatccagcaaatccttaactatattaagggtaacctaaaacatgtcgtttag

SEQ ID NO: 15479 - DNA, 441 bp, Artificial Sequence
  Description of Artificial Sequence: Synthetic coding sequence
atggaagagcccgaggagccggccgacagcggacaaagcctggtgcccgtgtatatttacagcccggaatacgtgtctatgtgcgacagcctggcaaaaatacccaagagggcatcaatggtgcatagcctgatcgaagcttacgcccttcacaagcagatgcgcatagtcaaaccaaaagtggcctcaatggaagagatggctaccttccacactgacgcctacctgcaacacttgcaaaaagtttctcaggaaggcgatgatgatcatcccgattcaatcgagtacggtctcggctacgattgccccgctactgaaggcatttttgattatgcggctgccattgggggcgccacaattacagctgcacagtgcctgatagatggaatgtgtaaggtggcaattaactggtcaggaggctggcatcacgccaagaagtag

SEQ ID NO: 15480 - DNA, 477 bp, Artificial Sequence
  Description of Artificial Sequence: Synthetic coding sequence
atggaagaaccggaggagccagccgatagtggacaaagcttagtgcccgtttatatttactcccctgagtatgtcagcatgtgcgacagtcttgcgaaaatcccaaaaagggcttcaatggtccactctctcatagaagcctacgcactgcacaagcagatgaggatcgtcaaacccaaagtggccagcatggaggaaatggccacattccatactgatgcttacctgcagcatttgcagaaagtcagtcaagaaggcgatgatgatcacccggatagtatagagtacgggcttggctacgactgccccgcgaccgaggggatcttcgattacgctgcagccatagggggggcgactatcacagctgctcagtgcttgattgacggtatgtgtaaagtcgcaataaactggagcggcggctggcaccacgccaagaaggagacctgtgtctacgtggccctctacaaggctttctag

SEQ ID NO: 15481 - DNA, 420 bp, Artificial Sequence
  Description of Artificial Sequence: Synthetic coding sequence
atggaagagcccgaggagcccgctgacagtgggcagtcactcgtaccagtgtatatatactcaccagagtacgtctctatgtgcgatagcttggctaagattccgaagcgagctagcatggtccactccctcatcgaagcctacgcactccacaagcagatgcgtgatgaagctagcggtttctgctatctgaatgatgccgtgctgggcatactgcggttgcgccgaaaattcgagaggatcctttacgtagacctggacctgcatcacggagacggtacaggggatgtttcagatgtcggactggggaagggacggtactattcagtaaacgtgcccattcaagacggtatccaggacgaaaagtattaccaaatctgtgagcgctacgaacctccagctcctaatccgggactctag

SEQ ID NO: 15482 - DNA, 771 bp, Artificial Sequence
  Description of Artificial Sequence: Synthetic coding sequence
atggaggagccagaggagccagctgatagcggccagtctcttgtacccgtttacatatacagccctgaatacgtttccatgtgtgactcactcgcaaagattcccaaacgagcctcgatggtacacagcctcatcgaggcctacgcacttcacaagcagatgagaattgtgaagcccaaagtagccagcatggaagaaatggctacatttcatactgatgcgtatttgcagcacctgcagaaggtatctcaagaaggggacgacgatcaccctgatagtatcgagtacggcctgggatacgactgtcccgccactgaaggcatattcgactatgcagctgccatagggggtgcgactattaccgcagcccagtgtctcatagatggcatgtgtaaagtggccatcaattggagtggcgggtggcaccacgcaaaaaaagacgaggcctcgggcttctgctatctgaacgatgctgtattagggatcctaaggctgagacgtaaatttgagagaattctctatgtggaccttgaccttcatcacggcgatggtgttgaggacgctttttccttcacatcaaaagtaatgaccgtctcactgcataaattctccccgggcttctttcctggtactggcgatgtgtcagacgtgggccttggtaaaggtcgttactactctgtaaatgtcccaatccaagatggtatccaggacgagaagtattaccagatttgtgagaggtatgagccgcctgctccaaacccaggactgtag

SEQ ID NO: 15483 - DNA, 831 bp, Artificial Sequence
  Description of Artificial Sequence: Synthetic coding sequence
atggcaggtccagctgctctgtcagcggctgccgccgcggcactggccgccgccctcttactgctgagacgagaagatccaggtcccggagcggggccgtcaatggccgagaccgaagctctttcaaagcttagggaagactttcgtatgcagaataagagcgtctttatcctgggcgcaagcggcgagacgggacgcgtcctgctgaaggagatcctcgaacaaggcctgtttagtaaagtcacactgatcggacgaagaaagctaacattcgatgaagaggcctacaagaatgtgaaccaagaggtagtagattttgagaagctggacgactacgccagcgcctttcagggacatgacgtcggattttgctgtctcggaaccacacgaggcaaagctggagcggagggctttgtgcgggtcgaccgagattacgtgttgaaatcagccgagttggctaaggccggaggatgtaagcactttaatctcctgtccagcaagggggcagacaaaagtagtaattttctgtaccttcaggttaaaggggaagtggaggccaaggtagaagagctgaagtttgatagatactctgtcttcaggcctggagtgctgctctgcgatcggcaagagtcccgccctggtgaatggcttgtcaggaaattctttggcagcctacccgactcttgggcaagtggccatagtgttcctgttgtgactgtggtgcgcgctatgctcaataatgttgtgagaccgcgcgacaaacagatggagctcctcgaaaacaaggcaattcacgacctcggcaaagctcatggatcattgaagccgtag

SEQ ID NO: 15484 - DNA, 729 bp, Artificial Sequence
  Description of Artificial Sequence: Synthetic coding sequence
atggccgaaaccgaggcactgtccaaactccgcgaggatttcaggatgcaaaacaaatcggtgtttatcctgggagccagcggagagacgggccgagttctgctaaaagaaatcctggaacaggggctgttttctaaagtcaccctgatcggccgccggaagttaacctttgatgaagaagcttacaaaaatgtgaaccaggaagtggtggattttgaaaaactcgacgactatgccagcgcctttcagggtcacgacgtcggcttctgttgtctgggcactaccagaggaaaggctggcgcggagggcttcgtccgcgtggaccgcgattatgtacttaagagcgccgagctggccaaggccggcggttgcaaacacttcaacctcctgtcttcaaaaggcgcggacaagtcatctaactttctgtatctgcaggtcaagggagaggtcgaagccaaggtagaggagcttaagttcgatcgctacagcgtctttcgaccaggggtcctgctctgtgatagacaagaaagtaggcctggtgagtggttggtccggaagttctttgggtctttgccagactcctgggcttcaggacacagtgtgcccgttgtgaccgttgtacgcgctatgctaaacaatgtcgtccggccaagggataagcagatggagctgctagagaataaggcaatacatgacctcggtaaggcccatggatcactgaagccctag

SEQ ID NO: 15485 - DNA, 729 bp, Artificial Sequence
  Description of Artificial Sequence: Synthetic coding sequence
atggcagagacagaggctctcagtaaattgcgggaagattttcgaatgcaaaataagagtgtgttcattctaggtgcttccggggaaacaggcagagttctgctcaaagaaatcctggagcagggactctttagtaaagttacgctcattgggcggcggaagctgacttttgacgaagaggcctacaagaatgtgaaccaggaggtcgtcgactttgaaaaactggacgactatgcatcagctttccagggccacgacgtcggattttgctgcctaggcacaacacggggaaaggcaggcgccgaggggtttgtgcgagttgatcgtgattacgttctgaaatcagccgaactggccaaagccgggggatgtaaacattttaatctccttagttcaaaaggtgccgataagtctagcaacttcctgtatctgcaggttaaaggggaggtggaagctaaggtggaagagctcaagtttgaccgatattctgtcttcagacccggcgtgctcctgtgcgacagacaagaaagcaggccgggcgagtggctggttaggaaattttttggctcattgcccgactcttgggcgagcggacattcagtgcctgtagttacagttgttagagctatgctaaacaatgtggtacggcccagggataaacaaatggagttgcttgagaacaaggccatccacgacctcggaaaggcacatgggtccctgaaaccatag

SEQ ID NO: 15486 - DNA, 729 bp, Artificial Sequence
  Description of Artificial Sequence: Synthetic coding sequence
atggcagaaactgaagctttatcaaagcttcgggaagatttccgcatgcagaacaagtcggtcttcatcctgggcgcatctggtgagacaggaagggttttgctgaaagagatcttagaacagggactgttttcaaaggtgactctgatcggcagaagaaagctgacatttgacgaggaagcctataagaatgtcaatcaggaggttgtcgactttgaaaagctggatgattatgcaagcgctttccaagggcacgacgtcggcttttgttgtctgggcaccactcgcggaaaggctggcgccgaaggctttgtgagagtcgatcgcgattacgttttgaaaagcgccgagctcgctaaagctggcggctgcaaacattttaacctgttatcttctaagggggcagacaaatcttcaaactttctgtatctgcaggtgaagggagaagtagaggccaaggtggaggaattaaaattcgatcggtattctgtttttcgcccgggggtgcttctctgcgaccgacaagagtcccggcccggcgaatggctagtcaggaaatttttcggaagcttgcccgattcctgggccagcggccacagtgtgcccgtagtgacagtcgtgagagctatgctgaataatgtagtgaggcctcgcgacaagcagatggagctgttggagaataaggccattcatgacttggggaaggctcatgggtccctcaagccatag

SEQ ID NO: 15487 - DNA, 402 bp, Artificial Sequence
  Description of Artificial Sequence: Synthetic coding sequence
atggcggagacagaagctctgtcaaaacttagagaggacttcagaatgcagaacaaaagtgtctttatcctgggagccagcggcgaaactggtagggtcctactcaaggagatcctcgagcagggcctcttttcgaaagtgaccctgatcgggcggagaaagctaaccttcgatgaggaagcttacaaaaacgtgaaccaggaggtagtggactttgagaagctggatgattacgcttccgcgtttcagggccacgatgttggattttgttgcttgggaacaacacggggcaaagctggagctgtgaggaaggcttatgcattatttcctttctgttggcctgtgattagccgtatcctttttcttctcacccttttcctttgtgcctgctgcaatgcctag

SEQ ID NO: 15488 - DNA, 402 bp, Artificial Sequence
  Description of Artificial Sequence: Synthetic coding sequence
atggctgagactgaagcgctgagcaagttgagagaggacttcagaatgcaaaataagtctgttttcatcctgggcgcctcaggagagaccggaagagtccttctgaaggagattttggagcagggcctgttctccaaagttactttaattgggcgccgcaaattaactttcgatgaggaggcctacaagaacgtaaaccaggaagtggtggattttgagaagcttgacgattatgcctccgcctttcagggccatgatgtgggattctgctgtctcggcaccactagaggaaaggcaggagcggtccggaaggcttacgcactcttccctttctgctggcccgtcatctccagaatactgttcctcctcacgctgtttttgtgcgcatgttgcaatgcgtag

SEQ ID NO: 15489 - DNA, 402 bp, Artificial Sequence
  Description of Artificial Sequence: Synthetic coding sequence
atggccgaaaccgaggcattaagcaaacttagagaagatttcagaatgcaaaataaaagcgtgttcatcttaggggccagcggagagacaggcagagtcctgcttaaggaaatcctagagcaaggccttttctccaaagtgaccctcattggacgcaggaaactcacctttgatgaggaggcatataaaaacgtcaaccaagaagtggttgatttcgaaaaactcgatgactatgctagcgcgtttcagggccacgatgtggggttctgttgtctgggtacaacaagaggcaaggcaggcgccgtcagaaaggcctatgcccttttcccgttctgttggcccgtgatttccagaattctgttcttacttacactgttcctttgtgcttgctgcaacgcctag

SEQ ID NO: 15490 - DNA, 1080 bp, Artificial Sequence
  Description of Artificial Sequence: Synthetic coding sequence
atggcagagcatggcgcgcactttacagccgcgtcagtggcagacgaccagccatctattttcgaagtggtcgcccaggactctctgatgaccgccgtccgcccagctctccagcatgtggtgaaagtgctggcagagagcaatcccacccattacggattcctgtggaggtggttcgacgagattttcaccctcctcgacctcctgctgcagcagcactatctgtcacgaacaagcgccagcttttctgagaacttttatggactcaagaggattgtgatgggtgacacacataaaagccagcgactggccagtgctggactacccaaacaacagttgtggaaaagcatcatgttcttagtgctcctgccgtacctcaaagtgaagcttgagaagctggtcagttcccttcgggaggaagacgagtacagtatccatccgccgagttctaggtggaagcggttttaccgagcttttctcgccgcctatccttttgtcaatatggcctgggagggttggtttctggtccagcagctgcgttatatccttgggaaggctcagcatcactctccgctcctacggctggctggcgtacagctcgggcgcctcactgtccaagacatccaggcccttgaacacaaaccggcaaaggcctcgatgatgcagcaacctgccaggtccgtgtccgaaaagatcaattccgccctcaagaaagctgtgggtggtgtggcactgagcctgagtactggcttatccgtaggtgttttttttctgcagtttttggattggtggtattcttcagagaaccaggaaacaatcaagtcccttacggctctacccacacctccaccacccgtccaccttgattacaatagtgactctcccctcctcccaaagatgaaaaccgtctgtcctctgtgtagaaaaaccagagtgaatgacaccgtgctggcaactagtggatatgtgttttgttataggtgcgtcttccactatgtgcgcagtcatcaagcttgtcccattacgggatatcctactgaggtccagcacctgattaaactgtatagccctgagaattag

SEQ ID NO: 15491 - DNA, 1374 bp, Artificial Sequence
  Description of Artificial Sequence: Synthetic coding sequence
atggtatctaaactgacaagtctacagcaggaactgctgtccgcactgctgtcttccggagttaccaaagaggtactggtccaggctctggaagaattgctcccaagcccaaatttcggagtgaaactggagacattgccattgagccccggaagcggagccgagccagatactaaacccgtctttcacaccttgactaatggacatgccaagggaaggctgagcggcgatgagggaagcgaagatggcgatgactatgacacccctcccattctgaaggagcttcaagccctgaataccgaggaggccgccgagcaacgcgctgaagttgatcgcatgttgtccgaggacccatggcgggccgcaaagatgatcaaaggatatatgcagcaacacaatattcctcagagagaggtggtggatgtcactggactcaatcaatctcatctgagccagcatcttaacaaaggaactccgatgaagacacaaaaacgagccgccctgtacacctggtatgtgaggaaacagagagaaattttgcggcagttctctcaacaaagccacggacctggacaaagtgacgatgcttgtagcgaacccacaaacaagaaaatgcgtcggaacagattcaagtgggggccagcctcccagcagatcctgtatcaagcctacgacagacaaaaaaatccctcaaaagaggaacgggaagccctcgtggaagaatgcaatagagccgaatgcctgcagcgcggcgtgagcccatctaaggcgcacggactcggatccaatctggtcactgaggtcagagtttataattggttcgcaaacagacgaaaggaggaagccttcaggcagaaactggccatggatgcttattcaagcaatcaaacccactcgctcaacccactgttgagtcacggaagtcctcaccaccagccctcttcctcacccccaaataaactttctggtgtgagatattcacaacagggcaacaatgaaattacgtcctctagcactatctcacatcatggaaactcggccatggtcacaagtcaaagcgtcctgcagcaagtatccccggcctctctcgatcccgggcacaaccttctaagccctgatggaaaaatgatcagcgtcagcggcggaggactccctccagtcagtactttaactaacatccactccttgtcacaccacaatccgcaacagagtcagaatctcatcatgacccctttgtcaggagtgatggccatcgcccagatgagctccacgagtctggtcatgccaacccaccacctgctgagagcccagcagcagggtccctgttttccgcaccatcacccactcggaagctgccacggaaaagcccaatag

SEQ ID NO: 15492 - DNA, 1338 bp, Artificial Sequence
  Description of Artificial Sequence: Synthetic coding sequence
atgctgagcgaggacccctggcgggctgccaagatgatcaagggatacatgcaacagcacaacattcctcaaagagaagtggtggacgtgacaggactcaatcagagccaccttagccaacacttaaacaaaggaacaccaatgaagacacagaagcgcgccgctctatatacctggtacgtcagaaaacaacgggagatcctgcgccaattcaatcagaccgtccagtccagtggtaatatgactgacaagagtagtcaggatcagctactcttcctgttcccggagttttcccagcagtcccacggaccgggccaatccgatgatgcatgttccgaacccacgaacaagaaaatgcgtcggaacaggtttaagtggggcccagcctcccagcagatactgtatcaggcatacgatagacagaaaaaccccagtaaagaggaacgggaggcgctagtggaagaatgtaatagggccgaatgcttgcagcggggagtgtcaccaagcaaggcccacgggctgggctccaatttggtgacagaagttagagtctacaactggttcgcgaacaggcgtaaggaagaagcattccggcagaagctggctatggacgcgtattcgagcaatcaaactcacagcctaaatccactcttaagtcacggatccccacaccatcagcccagtagttccccaccgaacaagcttagcggagtgagatactctcagcaggggaacaacgaaataactagtagcagtacgataagccatcatggaaattccgcaatggtcacttcgcagtctgtgttacagcaagtttcgcctgcatccctagatccgggccacaacctgctctcacccgacgggaaaatgataagcgtctccggaggcgggctgccccctgtctccacactaactaacatccactccttgagccatcataacccccaacagtcacagaatctgataatgacacccctctccggagtcatggctattgctcagtccctcaacacatcccaagctcagagcgtacccgtgattaatagtgtggccgggtcactcgcggccctccagccggtgcagttttcccaacaattacatagtcctcatcagcagcctctgatgcaacagagccctggcagccacatggcccagcagcctttcatggccgccgtcacccagctgcaaaactcacacatgtatgctcacaagcaggagccaccacaatattctcacaccagcagattccccagtgccatggtggtgactgacacatcttcaatttccaccctgacaaatatgtcctccagcaagcagtgccccctgcaggcatggtag

SEQ ID NO: 15493 - DNA, 1278 bp, Artificial Sequence
  Description of Artificial Sequence: Synthetic coding sequence
atggtctccaaacttacatcgctacagcaggagttactttcagcattgctgagcagtggggtaacaaaagaggtgttggtgcaggccttagaagagttattaccatccccaaatttcggggtaaaattagagactctccccttgtctcccgggtccggcgccgagcccgatacaaagccggtctttcataccctcacgaacggccatgccaaggggcggctgagtggcgacgagggaagcgaagatggagatgattatgatacacctcctattttgaaggaattgcaagcgctgaatacagaggaggccgccgaacaacgggcggaagttgatcgcatgttgagcgaggatccctggagagcagccaaaatgataaaaggatatatgcagcagcataacatccctcagagagaagtcgtagatgttactggtctgaaccagagccacctgagccagcatcttaataagggtacccctatgaagacacagaagagggctgccctgtacacatggtacgtcagaaagcagagggagattttgcgccaattcaatcagaccgtgcagagcagcggaaacatgactgacaagagttcccaagaccagctcctttttttgtttcccgaattctctcaacagtctcacggtcccgggcagagtgatgatgcatgcagtgaacccactaataaaaagatgcgtaggaacagattcaagtggggcccagcatctcagcagatcctgtatcaggcatatgatagacagaagaacccttcaaaagaagaacgtgaggccttggtcgaggagtgtaatcgcgccgagtgtctccaaagaggggtgagcccttcaaaggcccacggtcttgggtccaacctcgtcacagaggtaagagtgtacaactggttcgcaaaccgacgtaaggaggaggcctttcgccagaagctcgcaatggacgcatactcaagcaaccagacccattcgctgaatcctctgctgagccatggctctcctcaccatcagcctagcagttcgccgcctaataagttatctggagtgaggtactcgcagcagggcaataatgagattaccagtagctcgacaatttcccatcacggcaattccgcaatggtgaccagtcagagtgtcctgcagcaggtcagcccagccagcctcgatccaggccacaatcttctcagccctgacggaaagatggatctgtctttgaggcggaggtttgctccatcccagcatctcgatgagtacccgcaacccctgccaccgtag

SEQ ID NO: 15494 - DNA, 1596 bp, Artificial Sequence
  Description of Artificial Sequence: Synthetic coding sequence
atggtgtcgaaactcactagtttacaacaagagcttctcagcgcattactttcaagtggagtgacaaaggaggtgcttgtccaagccttggaagaactcctgccaagcccaaactttggggttaagctggaaacactgccgctgtccccaggtagcggtgcagagccggacacaaaaccggtgtttcacaccttgacgaatggccacgccaagggacgtttgtctggtgacgaaggaagcgaggacggagacgattatgataccccacctatactgaaggagctgcaggcccttaacaccgaagaggccgctgagcaacgcgcagaagtggatcggatgttgtccgaagacccttggcgcgccgctaagatgattaagggatacatgcaacagcataatatacctcaaagggaggttgtggacgtgacgggtctcaatcagagtcacctctcccagcacctgaacaagggcaccccgatgaagacacagaagagagcagctttgtacacgtggtacgtgcgcaagcaaagggaaatcctgcggcagttctcacagcagtcacacggtccaggccagtctgacgatgcttgcagcgaacccacaaataagaaaatgaggcgcaacaggttcaaatggggcccagcctcccagcaaatcctgtaccaggcttacgaccgccagaagaacccttcgaaggaggaacgcgaagcacttgtcgaggaatgcaaccgcgctgagtgtctacagaggggcgtgtctccatcaaaggctcatgggctggggagtaacctggttaccgaagtgcgcgtgtataattggttcgcaaataggcggaaagaagaggcgttccgtcagaagctggctatggacgcttatagttccaatcagacccacagcctgaatccgcttctcagccacggctcgccgcatcaccaaccgtcgtcttcgcccccaaataagctatctggagtgagatacagccagcagggcaacaatgagatcacatctagctccaccatctcacaccacggaaatagtgctatggtcacctcgcagtcggtcctgcagcaggtgtcacctgcgtccctcgatcctgggcataatcttctgagtcctgatggcaaaatgattagcgtttctggagggggattgccaccagtgtccacactgacaaacatccacagcttatcccatcacaacccacagcagtcccagaacctcattatgactccgcttagtggcgtcatggccattgcccagtccctgaatacctcccaggcccagagcgtgccggtgatcaactctgtcgctgggagcctggcggcactacagccagttcaattcagtcagcaactccactctccccatcagcagccgttgatgcaacaaagtcctggctcgcacatggcacagcagccctttatggccgccgtgacccaactccaaaattcgcatatgtatgctcataaacaggaacccccccagtattcacacacatcacgctttccatcagctatggtagttaccgatacatcgtctatcagtacattgactaacatgtcaagttctaaacagtgtcctctgcaggcgtggtag

SEQ ID NO: 15495 - DNA, 843 bp, Artificial Sequence
  Description of Artificial Sequence: Synthetic coding sequence
atgaaatttcgcgcgaagatcgtggatggggcgtgcctgaatcacttcactcgcatatctaacatgatcgccaagctggcaaagacgtgtacgctgcgtatatctccagataaactgaacttcattctgtgcgataagctggccaatggcggcgttagtatgtggtgtgagctagagcaggaaaatttcttcaatgaattccagatggagggcgtctcagcggagaacaacgagatctacttagagctcacctctgagaacctgtcaagagccttaaagactgcccagaatgcacgagctctaaagattaagctcactaacaagcattttccatgtcttaccgtgtccgtcgagctcctctcaatgtcctcatcctcccgcatcgtgacacatgacatacctattaaagtgattccacgcaagctctggaaggaccttcaggagccagttgtgccagaccccgatgtttctatatacctcccagtgttaaagactatgaagagtgtagttgaaaagatgaagaatatttctaaccatttagttatcgaagccaacctcgatggcgaactcaaccttaagatcgaaaccgaacttgtgtgcgtgaccacacactttaaggacctgggcaatccacccctcgcctccgaaagtacacacgaagaccggaacgtggagcacatggccgaggttcacatcgatatccgaaagctgctccagtttctcgcagggcagcaggttaatcccaccaaggccctgtgcaatatcgtgaacaataagatggtccacttcgaccttctgcacgaagatgtgtcccttcagtattttattcccgcattgtcctag

SEQ ID NO: 15496 - DNA, 780 bp, Artificial Sequence
  Description of Artificial Sequence: Synthetic coding sequence
atgatcgccaaactggccaagacatgtactttgcgaatatccccagataaactcaacttcatactgtgcgataaacttgccaatggaggcgtgagcatgtggtgtgaactggaacaggagaatttcttcaatgagttccaaatggaaggggtgagcgctgagaataatgagatttatctcgagcttacctcagaaaatctcagtcgggctttaaagaccgctcagaacgcgagggcgttgaagatcaagctgacgaacaaacattttccatgtttgaccgtgagcgtcgaactgctatcaatgagttcatccagtcgtatagtgacccatgacatccccataaaagtcattcccagaaaactttggaaagacctccaggaacctgtcgtgcctgacccggacgttagtatctacctgcctgtactcaaaacaatgaagagtgttgtggagaagatgaagaacataagtaatcacctggtgattgaggccaacctggacggagaattgaatcttaagattgaaacagagcttgtctgcgtgactactcacttcaaggaccttggtaatcctccactcgcatcagagtctacccatgaggatagaaatgtggagcacatggcagaggtccacattgacattcggaagcttctgcagttccttgctgggcaacaggtgaaccctactaaagcgctatgcaacatcgttaacaataaaatggtccatttcgacctacttcacgaagacgtatccctccagtatttcattcctgctctgagttag

SEQ ID NO: 15497 - DNA, 843 bp, Artificial Sequence
  Description of Artificial Sequence: Synthetic coding sequence
atgaaattccgcgccaaaatcgtggacggagcctgtctcaaccatttcacccgcataagcaatatgatcgcaaaactagctaagacctgtaccctccggatctcacccgacaaactgaactttattctgtgtgacaaactggcaaacgggggggtctcgatgtggtgtgagctggaacaggaaaactttttcaatgagttccaaatggagggggtgagcgctgaaaacaatgagatatatcttgagctgaccagtgaaaatttgtcacgggcattgaagaccgcccaaaacgctcgggcattgaagattaagctgacaaacaagcattttccttgccttaccgtcagtgtcgaactcttgtctatgtcgtcctcctctcgcatcgtcactcacgatatccctatcaaggtgattccccggaagctctggaaggacctccaagaaccggtcgtacctgaccccgacgtgtccatctacttacctgttcttaagactatgaagtcagtggtggagaaaatgaagaacatatccaaccaccttgtcatcgaagccaatttggacggcgagcttaacctgaagattgagacagagttagtctgtgtcacgacccatttcaaagacctgggaaaccctccacttgcctccgaatctactcatgaggatcgcaatgtggagcatatggcagaggttcacattgatatccggaaactcctccaatttctggccgggcaacaagtgaaccccactaaggcactgtgtaacatcgttaacaataagatggtgcacttcgatctcctccatgaagacgtcagtctccagtacttcatacccgcgctttcttag

SEQ ID NO: 15498 - DNA, 780 bp, Artificial Sequence
  Description of Artificial Sequence: Synthetic coding sequence
atgatcgcaaagttggccaaaacttgcacactccgcatctcacccgataagttgaatttcatcctgtgcgacaagctcgccaatggcggggtttccatgtggtgcgaacttgagcaggagaacttctttaatgaattccagatggagggcgttagtgcggagaataatgaaatctacctggagcttacttctgagaacctgtcacgcgccctcaagacagcgcaaaatgccagggcactcaagattaagctgacaaataaacacttcccatgcttgactgttagcgtggagctcttgtctatgagcagctcatccaggatcgtgacccacgacataccaatcaaggtaatcccgaggaaactgtggaaggacttgcaggaacccgtggtccccgatcctgacgtgagcatctacctgcctgttctaaagaccatgaagtctgtggtcgagaaaatgaagaacataagcaatcatctcgttattgaggcaaacctggacggggaactgaacctcaagatagaaactgaattggtctgtgttacaactcactttaaagacctgggtaatccgcccctggctagcgagtcgactcacgaagaccgcaacgtagaacatatggcagaagtccatatcgatataaggaaattactccagttccttgcggggcagcaggtaaatcccactaaggcactctgcaacatagtgaacaacaagatggtccacttcgacctgctacatgaagacgtgtctctgcagtactttatccccgcactgtcctag

SEQ ID NO: 15499 - DNA, 2130 bp, Artificial Sequence
  Description of Artificial Sequence: Synthetic coding sequence
atgtcattcccaaaagccccgctgaagcggtttaacgacccctctggctgcgccccaagtccaggcgcctatgacgtcaagacgctggaggtcttaaaggggcccgtaagcttccagaagtcccagcgcttcaagcagcaaaaagagtctaaacagaacctgaacgtggacaaagacaccactctgcccgccagtgcccgtaaggtgaagtccagcgagtccaagataagggtgcttctccaagagcgaggagcacaggaccgtagaattcaggacttggaaacagagctcgagaaaatggaggcccgcctgaatgctgccctacgggaaaagacttctctttctgctaacaatgctacacttgagaaacagttgattgagctcacaagaaccaacgagctgctaaagtccaaattcagcgaaaacggaaaccagaaaaatttacggatcctttctctggaacttatgaagttacggaacaaacgcgaaaccaaaatgagggggatgatggccaaacaagagggcatggagatgaaattacaagttactcagagatctctggaagagagccagggaaagattgcccagctcgaaggcaaactggtcagcattgagaaggagaaaatcgatgagaagtcagagacagagaagcttctggaatatattgaggaaataagttgtgccagcgaccaggtcgaaaagtataagcttgatatcgcccagctggaggagaatctgaaagaaaagaacgacgagatcctttcgctgaagcagtctctggaagaaaacatagtgatcctcagcaagcaggtggaggatctgaacgttaagtgccagctcctggagaaagagaaagaagatcacgtgaatagaaatcgagagcataatgagaatctaaatgccgaaatgcagaatctgaagcagaagttcatcctggaacagcaagaacgcgagaagctgcagcagaaggagttacagatcgacagcttactgcagcaagaaaaggaattgtcttcttccctgcaccaaaagctgtgttcctttcaggaggagatggtaaaggaaaagaatctatttgaggaggagctgaagcagaccctcgacgaactagacaaacttcagcagaaggaagagcaagctgaaagactagtaaagcagttagaagaagaagcaaaaagccgcgctgaagaattaaagcttctagaggagaagctcaaggggaaggaagccgagttagagaaatccagcgcagcacacacacaggccacgctcctactacaggagaagtatgatagtatggtgcagtcccttgaagacgtgacagctcagtttgaatcttataaggccctgacagcaagcgagatcgaggatctcaagcttgagaactcctcactgcaggagaaggccgctaaggcaggcaaaaatgcggaagacgtgcagcatcagatcctcgcaacagagtcatcaaatcaggagtacgttcgaatgttattggatttgcagactaaatctgccctaaaagagacggagataaaggaaatcactgtatccttcttacaaaagatcacagatcttcagaaccagctcaagcagcaggaggaggacttccgtaagcaactggaagacgaagagggccgaaaggctgaaaaggagaacactacggcagagctgacggaggagattaataagtggaggctgttgtacgaggagctctataacaaaaccaagccattccagctccaactagatgccttcgaggtggaaaagcaggccctgttgaatgaacatggcgcggcccaggaacagttgaacaagatacgggatagttacgcaaagctgttgggccaccagaacctcaagcagaagatcaaacacgtagttaaactcaaggatgagaatagccagctcaagtccgaggtgtcgaaattgagatgtcagctggctaagaagaaacagtctgagactaagctgcaggaagaactaaacaaagtcctgggtattaagcatttcgatccttctaaagccttccatcacgagagcaaagaaaacttcgccctgaagactcccctaaaagaaggcaacacgaattgctacagagcaccaatggaatgccaggagagctggaagtag

SEQ ID NO: 15500 - DNA, 2175 bp, Artificial Sequence
  Description of Artificial Sequence: Synthetic coding sequence
atgtcatttccaaaggcacccttgaagcgcttcaatgacccctccggctgtgcaccctcaccaggcgcatacgatgtcaagactctagaggtgttaaaaggaccggtttctttccagaagtcccagaggttcaagcaacagaaggagtcaaagcagaatttgaacgtggacaaagacactactctccccgcatcagctaggaaggtcaagagcagtgaatctaaggagtcccagaagaatgacaaagacttgaaaattttggaaaaggagatcagggttctactccaggaacggggcgcacaagataggcggatccaggatctggagacggagttggaaaagatggaagcccgcttgaatgccgccctgcgagagaaaactagtctatcagccaataatgctactcttgagaaacagctcatcgaactgacccgcactaacgaattactgaagtccaagttctctgaaaatgggaaccaaaagaacctcagaattctgtctttagaactgatgaaactacgcaacaagagggagacaaagatgaggggtatgatggccaagcaggaaggcatggaaatgaagctgcaagtcacccagcgtagcctcgaagagtcacagggcaagatagcgcagctagagggcaaactggtgtctattgaaaaggagaaaatcgatgaaaagtctgaaacagaaaaattgctggagtacattgaggaaatcagctgcgcttccgatcaggtcgagaagtacaagctcgatattgcccagctggaggagaacctgaaagagaagaacgacgagatactctccttgaagcaatccctcgaagaaaacatcgtcattttgagcaagcaagtggaagacctcaatgttaagtgtcagcttctcgaaaaggagaaggaagatcacgttaacagaaacagagaacacaatgagaacctgaacgctgaaatgcagaatttaaagcaaaagtttatccttgagcagcaagagcgggagaagctgcaacagaaagaactgcaaatcgacagcttgctgcagcaagaaaaagagctgagttcatccctccatcagaaactgtgttcgttccaggaagagatggtgaaagaaaaaaaccttttcgaagaggagttgaagcaaactctcgacgaattggataagctccagcagaaagaagaacaagccgagcgactggtcaagcagcttgaggaggaagcaaaatcaagggctgaggagctgaagctgttagaagagaagctcaaggggaaagaagcagagttagaaaagtcctctgccgcccacacccaggctacgctactgttgcaggaaaaatatgattctatggtccagtcactcgaggacgtgaccgctcaatttgaaagctataaagccttgacagccagcgagattgaggacctgaagctggagaactcttccctccaggagaaagccgccaaagccgggaagaatgcggaggatgtccagcatcagattttggccaccgaatcatccaatcaggaatacgtgaggatgctcctagacctgcagacgaaatctgcgctgaaagagaccgagataaaagagatcaccgtttcctttctccagaaaattaccgatcttcagaaccaactcaagcagcaagaggaagattttcggaaacagctagaggacgaggaaggaagaaaagcggaaaaagagaacacaactgcagagctcaccgaagagatcaataagtggagactcctgtatgaggaactttataataaaaccaagccatttcagctgcagttggatgccttcgaagtagagaagcaggccctgcttaatgagcatggggctgcgcaggaacagttgaacaagatcagggattcttatgcgaagttgctgggtcaccaaaatctaaagcagaaaatcaagcacgttgtcaaactgaaagatgagaattcccagttgaaaagtgaggtgtctaagcttcggtgccagttggcgaagaagaaacaatctgagacaaagctccaagaggagctgaataaggtgcttggcatcaagcacttcgatccgtctaaggcctttcaccatgagagcaaagagaacttcgccctgaagaccccactcaaggagggcaatactaattgctacagggcaccaatggagtgtcaggagtcgtggaagtag

SEQ ID NO: 15501 - DNA, 2178 bp, Artificial Sequence
  Description of Artificial Sequence: Synthetic coding sequence
atgtccttccccaaagccccattgaaaagatttaacgacccttctgggtgcgccccaagccccggggcatatgatgtgaaaaccttagaggtcctcaagggacctgtgtcctttcagaaaagccagcggtttaagcagcaaaaagaatcgaaacagaacctgaacgtggacaaggacaccacgttgcctgcctcagcccgcaaggtgaaatcgtcagagagtaagaaagaaagccagaagaatgacaaagatctgaagattctagaaaaagaaattcgagttctgttgcaagagcgtggagcccaagatagacggatccaggacctggaaacagagctggagaagatggaagcaaggctaaacgctgccctgcgagaaaagacatctctgagtgcaaacaatgccactttggagaagcagcttatcgagctcacccggaccaacgagctcctaaagagcaagttcagtgaaaatggcaatcagaaaaatcttcgaatcctaagtctcgagttgatgaagctcaggaataaacgggagaccaaaatgcgtgggatgatggccaagcaggagggcatggagatgaagctgcaggtgactcaacgctccctcgaagagtcacaaggtaagatagcacagctcgagggtaaactcgtgtcgatcgaaaaagagaaaatagacgagaagtccgaaactgagaaactcctggagtacatagaggagatctcctgcgcatcagaccaggtagaaaaatacaagctagacatcgctcagctggaggagaatctcaaggagaaaaatgatgagatactatcccttaagcaatcactggaagagaacatcgtgatactatctaaacaggtagaagatctgaacgtgaaatgccagctactggagaaagagaaagaggaccacgtgaatcgcaaccgagagcataacgaaaatctaaacgccgagatgcagaatctgaagcagaagttcatattggagcagcaagagcgagagaagctgcagcagaaggagctgcagatcgattctttactccagcaggagaaggaactgtcctctagcctccaccagaagttgtgttcattccaagaggagatggtgaaggagaagaatcttttcgaggaggaactcaagcagactctcgacgaactggacaaactgcagcagaaggaggagcaagctgaacggctcgtcaagcagctagaggaggaggctaagtcaagggctgaggagctcaagctgctggaggaaaagttgaaagggaaggaagctgagttggagaagagttctgcagcacatactcaggccaccttactcctgcaggagaagtacgactctatggtccagtccttggaggacgtgactgcccaattcgaaagctataaggccctgaccgcgtccgagattgaggacctcaaactggaaaatagttctctgcaggagaaggcagctaaggcaggaaagaatgcagaagatgtgcagcatcagatcctcgccaccgagagctcaaaccaggagtacgtacgtatgctgctagatctgcagacaaaatcggccctgaaggagaccgaaatcaaagagattacagtatcctttcttcagaaaattacagatctccaaaaccagcttaagcagcaagaagaggacttccgaaagcagctggaggatgaagaaggcaggaaagcggaaaaagagaacacaacagccgagctgacagaagagataaacaagtggcgcctgctctacgaggaactgtacaacaaaactaagccttttcaactacaacttgacgccttcgaggtagagaaacaagcccttctgaatgaacatggtgccgcccaggaacagcttaataaaattcgagactcctacgcgaagctgctgggccatcagaatttgaagcagaagatcaaacatgttgtgaagctcaaggacgaaaactctcagctaaagtccgaagtctccaagctcagatgccagctcgcaaagaagaagcaatcggaaactaaactgcaggaggagctcaacaaggtgctcggcatcaaacattttgacccatcaaaggccttccaccacgagagcaaagaaaattttgccctgaagactcccctgaaagaaggtaacacaaattgctatcgggctccaatggagtgccaggagagttggaaatag

SEQ ID NO: 15502 - DNA, 2106 bp, Artificial Sequence
  Description of Artificial Sequence: Synthetic coding sequence
atgtcctttcctaaggcaccactcaagcgctttaacgatcccagcggctgtgcgccgagtccgggggcatatgacgtcaagactctggaggttctgaaagggccagtgagctttcagaagtctcaaagatttaagcagcagaaggagtccaagcagaatctaaacgttgataaagataccacactgcctgcgtccgccagaaaagtgaagtcgtccgagagcaaaaaggagtcacaaaaaaatgataaggatctgaaaatattagagaaggaaatcagggtgttgctgcaggagagaggagcccaagaccgtcggatacaggatctggagactgagctcgagaaacaattgatagaactgacgagaacaaacgagcttcttaaatctaaattctctgagaacggcaaccagaaaaaccttagaattctgtctctggaactgatgaaactgcggaacaagagagagacaaagatgcgggggatgatggctaagcaggaaggaatggagatgaaactccaggtgacgcagagatcactggaagagtcacaggggaagatcgctcagctggagggcaaactggtctccatagaaaaggaaaaaatcgacgagaaaagcgagacagagaagttactggagtatattgaggagatttcctgtgcctctgaccaggtggagaaatacaagctcgacattgcccagctggaggagaacttaaaagagaaaaacgacgagattctctccttgaagcaatcactcgaggagaacattgtgattctctccaagcaggtggaggaccttaacgtcaagtgtcagttgctggaaaaagagaaggaggaccatgtcaaccggaacagggaacataatgagaacttgaatgccgagatgcaaaacctaaaacaaaagttcattctggaacagcaggaaagggaaaaactccagcagaaagaactacaaatcgattctttgcttcagcaggaaaaggaattgtcatcgtcattacatcagaaactgtgctcttttcaggaggaaatggtgaaggaaaaaaaccttttcgaggaggagctgaaacaaaccctggacgaacttgataagctccagcagaaagaggagcaggcggaaaggctcgtaaagcaactcgaggaagaggcaaagagccgtgccgaagagcttaagctgctggaagaaaagctgaaaggcaaggaagctgaacttgagaagtccagtgcagcgcacacgcaagccacacttctcctgcaggaaaaatacgattctatggtgcagagcctagaggacgtgaccgcacagttcgaatcctataaggctcttaccgcgtcagaaatcgaggacctgaaattggaaaattcatcattgcaggaaaaagccgcaaaagccgggaaaaacgcggaggacgtgcagcaccagatcttggctacagagtcctctaatcaagagtacgtacgcatgctgctcgacctgcagactaagtccgctttgaaggaaaccgagattaaggagattactgtttcctttttgcagaagatcacagacttacaaaaccagttgaaacagcaggaagaggactttcggaaacagcttgaggatgaggaagggagaaaagccgagaaagagaacaccacggcagagttaacagaagaaatcaataaatggcgcctgttgtatgaggagctgtataacaagacgaagccttttcagctgcagttggatgctttcgaggtcgagaagcaagctctgcttaacgagcacggtgcagcccaagaacagctcaacaagattagagacagctatgctaagctcttggggcatcagaacctgaagcagaaaattaagcacgttgtcaaactgaaggatgaaaattcccagctgaaatctgaagtcagcaaacttcgttgccaactcgcgaagaagaagcagtcagaaacgaagttgcaggaggaactaaacaaggttctggggattaagcattttgatccttccaaagcgttccaccatgagagcaaggaaaattttgcgctgaagactcccttaaaggaggggaatacgaattgctacagggctcctatggagtgccaggagtcatggaaatag

SEQ ID NO: 15503 - DNA, 1917 bp, Artificial Sequence
  Description of Artificial Sequence: Synthetic coding sequence
atgactctgcttatccgggtgttactccaggaacggggtgcccaagatagacggattcaggatctcgagactgaactggagaaaatggaggcgcgtctgaacgctgcccttagagagaaaactagcctcagcgccaataacgcgactttagagaaacaactcatagagctaactcgcaccaatgaactcttaaaaagtaagttttctgaaaacgggaatcaaaagaacctgcggatcctcagtttagagctcatgaaactaaggaataaacgcgaaaccaagatgcgcggtatgatggctaagcaagaaggcatggagatgaagcttcaggttacacaaaggtcgctggaggaaagccagggcaaaatagcgcagctggaaggcaagctggtgtctatagagaaggaaaagattgacgaaaagagcgagacagagaagctcttggagtacatcgaagaaatctcttgtgccagcgatcaggttgaaaaatacaaactcgacattgctcagttggaggaaaatctgaaggaaaaaaatgatgagatcttgtcactgaaacagtccttagaagagaacattgttatcctgagcaagcaggtggaggatcttaatgtcaagtgtcagctgctcgagaaggagaaggaggaccacgtcaatcggaaccgggagcacaatgagaacctaaacgcagaaatgcagaacctgaaacaaaaatttattctggagcagcaggaaagggaaaaattacaacagaaggagctgcagatcgattctcttctccagcaagaaaaggagctgtcatcttctctgcatcagaaattgtgctcattccaagaagaaatggtgaaggaaaagaatctcttcgaggaggagctaaagcagaccctggatgaactggataaattgcagcagaaagaagagcaggcggagagactcgttaaacagctcgaggaggaagccaaatctagagcggaggagctgaagctgctagaggaaaagcttaaagggaaagaagccgagttagaaaaatcaagcgccgctcacacccaggcaacattgcttctgcaagagaagtacgactccatggtgcagtccctcgaggatgtgacagcacaattcgaatcctacaaggctctaactgcatccgaaatcgaagatcttaaactggagaacagttcgcttcaggagaaagcggccaaagccggaaaaaatgcggaagatgtccaacatcagatcctggcaacagaatctagcaaccaagaatacgtgcgcatgctccttgatctccaaaccaagagcgccctcaaggagacggaaattaaggaaatcacagtgagcttcttgcagaaaattaccgacctgcaaaaccagctgaagcagcaggaggaggacttcaggaagcagctggaagatgaagaaggccggaaggctgagaaagaaaatactacagctgagctcacggaggagattaataagtggaggttgttatacgaagagctctataataaaacaaagccttttcagttgcagttggatgcctttgaggtggagaagcaggcgcttctgaatgagcatggagcagcccaggaacagctgaacaagattagggactcctatgcgaagttactcggccatcagaatctgaaacaaaaaatcaagcacgtggtgaaactgaaggatgaaaatagtcagctgaaatccgaagtatctaaactcaggtgtcagctggctaaaaagaagcagtcggagaccaagctccaagaagaactaaataaggtcctgggcattaaacatttcgatccttcgaaggctttccaccacgagagtaaagagaactttgcccttaagacaccactgaaagaaggcaataccaattgctatagggctccaatggagtgtcaagagtcttggaagtag

SEQ ID NO: 15504 - DNA, 996 bp, Artificial Sequence
  Description of Artificial Sequence: Synthetic coding sequence
atgtcatttcctaaggctccactcaaacgcttcaacgatccatctggatgtgctccaagcccaggcgcctacgacgtcaaaacgttggaggttcttaaagggcccgtatcatttcagaaaagccaaagattcaagcagcagaaagaatctaagcagaatctgaacgtggacaaagacacaacccttcccgctagcgcacggaaagtgaaatctagcgaatccaagattcgcgttctgctgcaggaacggggcgcgcaagatagacggatccaggatttagaaaccgagcttgagaaaatggaggcgcggcttaacgccgcacttagggaaaagacttccctttccgccaacaacgccacactagagaaacagttaattgagcttaccaggacgaacgagctcctcaaatctaagttctcagagaatggcaaccagaaaaacctccggattctatcactcgagttaatgaaactgagaaataaaagagagactaaaatgcgggggatgatggcaaagcaggagggtatggagatgaaactccaggtcactcagcggagccttgaggaatctcagggcaagatcgcccagttagaaggtaaattggtgtctatcgagaaggaaaagatcgacgagaaatcagagacggagaaactcttggagtacatcgaagaaatctcatgcgctagcgaccaagtggaaaaatacaaactggacattgcccagctggaagagaatcttaaggagaaaaatgatgagatcctgtctctgaaacagtctctcgaagagaacatagtcattctgagtaaacaagtagaagacctgaacgtcaaatgtcagctcctcgagaaggagaaggaggaccacgtcaataggaatagagaacacaacgaaaacctcaacgctgaaatgcaaaaccttaagcagaagttcatactggaacagcaggaacgtgagaagttacagcagaagaagaagcagatgcggaggaaaaagtag

SEQ ID NO: 15505 - DNA, 537 bp, Artificial Sequence
  Description of Artificial Sequence: Synthetic coding sequence
atgcatgtcaatggaaaggtggctctcgtgaccggggccgcacagggcatcggtagagcatttgccgaagcactcctgcttaagggggcaaaagttgctttagtggattggaaccttgaggccggcgtgcaatgcaaggctgcccttgacgagcaattcgagcctcagaagaccttattcattcagtgcgacgttgctgaccagcagcagctgagggacacatttaggaaggtcgttgatcactttggacgcctggatatactggtgaataatgccggcgtgaataatgagaagaattgggagaagacccttcaaattaatctggtctccgtgatcagcggtacatacctcggattggattatatgagtaaacagaacggaggagaagggggcatcatcatcaacatgtcttctctggccgggttaatgccagtggctcagcagcctgtgtactgcgcgtccaagcacggaattgttgggtttactcggtctgctgctcctaccatcgattgccagtggatcgataatacacattag

SEQ ID NO: 15506 - DNA, 801 bp, Artificial Sequence
  Description of Artificial Sequence: Synthetic coding sequence
atgcacgtgaacggcaaagtggcccttgtcactggagctgctcaaggcatcgggagggcattcgcagaggctcttcttttaaagggcgctaaggtcgccctggtggattggaatcttgaagcaggcgtccaatgcaaggcagcactggatgagcagtttgagccgcagaagacactgttcatccagtgcgacgttgctgaccaacagcaattgagagatacgttccggaaggtcgttgaccacttcgggcgcctcgatatactagtgaacaatgcgggtgtaaacaacgagaagaactgggaaaagacgttacagatcaacctggtgagtgtcatctcaggcacctacctgggccttgactacatgagcaaacagaacggaggcgagggcggcatcattattaatatgtcatccctcgcaggcctgatgcccgtggcccagcagccagtgtactgtgcaagcaaacacggaatcgtgggctttacccggtccgccgccctggctgcaaacctcatgaattccggcgtccggctcaatgcgatatgtccaggttttgtgaacacggctattctggagtctatagaaaaagaagagaacatgggacagtatatcgagtataaggaccacattaaggacatgataaagtattacgggatcctcgaccctcccctgattgccaatggcctgattacactcattgaggacgacgcactgaacggcgccataatgaagatcacaacctcgaaggggatccattttcaggactatgacaccacccccttccaggctaagacccagtag

SEQ ID NO: 15507 - DNA, 438 bp, Artificial Sequence
  Description of Artificial Sequence: Synthetic coding sequence
atgtcaaagcaaaatggtggcgaagggggcatcataataaatatgtcaagccttgctggtctcatgccagtagcgcagcagccagtgtactgcgcatcgaagcatggtatcgtgggctttacgcggagtgctgctttggccgccaacttaatgaacagtggggtgaggctgaacgccatctgcccgggattcgtgaataccgctattttggagtccatcgaaaaggaagagaacatgggacagtacatcgaatataaagatcatattaaggacatgattaaatactatggtattttggatccgccgctgattgctaacgggctcattaccttgatagaggatgatgcactaaatggggcaattatgaaaatcactacctcaaaagggattcacttccaggactacgacacaaccccgttccaggcaaagacccagtag

SEQ ID NO: 15508 - DNA, 438 bp, Artificial Sequence
  Description of Artificial Sequence: Synthetic coding sequence
atgagtaaacagaacgggggggaggggggaattatcattaatatgtcgagcctggccggtttaatgcccgtggctcaacagcccgtgtattgtgcctctaagcacggcatcgtcggatttacccgatctgccgctctcgcagccaatctgatgaacagcggagtgcgcctgaacgctatttgccctggttttgtgaatacagcgattttggagtctatcgaaaaggaggagaatatgggacagtacatcgagtataaagaccatattaaagatatgatcaaatattacggtatcctcgacccccccttaattgcaaacggcctgatcacgctaattgaggacgacgctctgaacggcgcgatcatgaaaatcacgactagcaagggcatccattttcaggattatgacactaccccctttcaggctaaaactcagtag

SEQ ID NO: 15509 - DNA, 432 bp, Artificial Sequence
  Description of Artificial Sequence: Synthetic coding sequence
atgcacgtaaacggaaaagtggcgcttgtgacaggagcggctcaggggattggaagggcctttgccgaggccctcctacttaaaggagctaaggtggcgctcgtcgactggaaccttgaggctggagttcaatgcaaggctgctttagacgagcagttcgaacctcagaagaccctcttcatccagtgtgacgtggcggatcagcaacaactccgcgatacgtttagaaaggtggtggaccatttcggtcgactggatatcctggttaacaatgccggagtgaacaacgaaaaaaactgggagaagacactgcagattaacctggtaagcgtcatctcgggtacctacctgggcttggactacatgtccaagcagaacgggggagagggcggaattatcatcaacatgagcagcttggcagcccatcactag

SEQ ID NO: 15510 - DNA, 2202 bp, Artificial Sequence
  Description of Artificial Sequence: Synthetic coding sequence
atgacctttcctgaggccgacatcctgctcaagagtggagagtgcgcagggcagacaatgctcgacacaatggaggcaccaggccattcaagacagcttctgctccaacttaataaccagcggactaagggcttcttgtgcgacgtcattatcgtggtccagaacgctctgtttcgagctcataaaaacgtgcttgccgcaagcagcgcttatctcaagtcactggtggttcacgacaatctcctcaacctggatcacgacatggtgagtccggccgtcttccgcttggttctggatttcatttacacaggacgcctggctgacggagcagaagctgctgctgcagccgcagtagctcctggagcggagccttccctcggagccgtgctggccgcagcgtcctacctgcagattccggaccttgtagccctctgcaagaagcgcctgaaaagacatggtaagtactgccacctgcgaggtggcgggggaggtggcggagggtacgctccttacggacgcccggggcggggcctgcgagcggctactccagtaatccaggcgtgctatccgtctccagtcggccccccaccccccccagcggccgagcccccctcaggacctgaagctgctgtcaacacccactgcgcagaactgtatgcctctggtcccggccctgctgcagctttatgtgctagcgagcgcaggtgctccccactgtgtggactggacctcagtaagaagtccccgcctggatctgcggccccagaaagacccttggcggagagagagctgcccccccgccctgactcgccgcctagcgctggccccgccgcatacaaagaacctcccctcgcactgccatctctgcctccgctcccgtttcagaaactggaggaagcagccccaccctccgacccatttcggggagggtcgggctcccctgggcctgagccacccggtagacccgacggcccttcactcctttatcggtggatgaagcatgaaccaggtctcggctcatacggggacgaacttggacgtgagagagggagtccctcggagcgatgcgaagagaggggaggcgacgcagctgtgagtccaggaggaccaccactggggctggccccgccaccgagataccccggatccctggacggtcctggagctgggggcgacggcgatgattacaagagctcatcagaagaaacaggctcatccgaggacccctccccccccggggggcacttagaaggctacccctgtccacatctggcttatggagagcccgaatctttcggggataatctctatgtctgtattccctgcggcaaggggtttccctctagcgaacagttaaatgcccatgtggaggcgcacgtggaggaagaagaggcactctacggcagggcggaggcagcagaagttgcggccggcgcagcaggactgggcccccccttcggagggggaggtgacaaggtggctggagcacccggcggcttgggggagctgctgagaccttacaggtgtgcctcttgcgacaagagctataaggatccggcaactttaaggcagcatgagaagactcattggctgactcggccctacccatgtactatttgtggaaagaaatttacccagcggggaacaatgaccagacatatgaggtcacaccttgggctgaaaccattcgcatgcgatgcgtgcggcatgcgctttaccaggcagtatagactgactgagcacatgcgcatccacagtggagagaaaccgtacgagtgtcaggtgtgcggaggaaagttcgcccagcaaagaaacttgatttcccacatgaaaatgcatgctgtaggaggggccgcaggggctgctggggctctggcaggactgggagggctgcctggagtgcccggaccagacgggaaaggcaagttggactttccagagggagtgttcgcagtcgctagacttactgctgaacagctctcacttaaacagcaagacaaggcagcggccgcggagcttctcgctcaaaccacccacttcctccacgaccccaaagtggccctagagtcactttaccctctggcaaaatttacagccgagctaggcctgtctcccgacaaggccgctgaagtcctgtcacagggggcccacctggcggccggtccggacggccgcaccatagataggttcagtcctacttag

SEQ ID NO: 15511 - DNA, 2145 bp, Artificial Sequence
  Description of Artificial Sequence: Synthetic coding sequence
atgctcgataccatggaggccccagggcattcacgccagttactgctccagctcaataatcaaaggacaaaagggttcctgtgcgacgtaattattgtagtgcagaacgcactgttccgtgcacataagaatgtcctagccgccagttctgcgtatctcaagtctctggtagtccatgacaacctccttaatctggatcacgatatggtatcaccagctgtattccgattagtgcttgactttatatacaccggaagacttgcggacggagccgaggctgccgctgccgcagcagtggctccaggggcagagccttcattgggcgccgtactggccgccgcctcctatctgcagattccagacctggtggccctgtgtaagaagcgtctcaagaggcatggcaaatattgccatcttcgaggtggaggaggtgggggtggagggtatgctccttatggtcgacccgggcgcgggctccgagccgccacccctgtaattcaagcatgttaccctagccccgtgggcccacctccccccccagctgccgagcctccctccggacccgaagctgctgtgaacacccactgcgcagagctgtacgcatccggaccagggcccgctgccgcattgtgtgcaagtgagcggcgatgctcgccgctgtgcggccttgatctgagcaaaaagagccctcccggtagtgcagctcccgaacgaccattggcagagcgagagctgccgccccgccccgattctccaccatctgccgggcctgccgcctataaggaaccaccgctagccttgccctctctgccgccccttcccttccagaaactggaggaggctgccccacctagcgaccccttcagaggcgggtcagggtccccagggcctgaaccccctggccgtccagatgggccttctctgttatatcgctggatgaagcacgaacccgggctcggttcctacggagatgagctgggaagggagcgtggttccccctccgagaggtgcgaggaacgaggcggggacgctgccgtgagtcctggcggaccaccgttgggcctggctcctcctccgcgttaccccgggagcctcgacggacccggggctggtggtgacggagatgactacaaatccagctctgaagagaccgggtcctccgaagatccatcccctcctgggggccatctggagggctacccatgtccacaccttgcctatggcgagcccgagagtttcggggacaacctttacgtgtgcatcccttgtgggaaggggttcccctccagtgagcaactgaatgcccatgtggaggctcatgtcgaagaagaggaagctctttatggccgggccgaggcagccgaggtcgcggccggcgcggcaggactggggcccccttttggaggcggcggagacaaagtcgcaggtgccccagggggcctgggggagctgctgcggccttatcgatgtgcctcttgtgacaagagttacaaagacccggctactctgaggcaacatgagaaaacccactggcttacaagaccttacccctgcactatctgcggaaaaaagtttacccagagaggtacaatgactcgacacatgcggtcacatcttggcctgaagccttttgcatgcgatgcgtgtggaatgcggttcacccggcagtataggctgactgagcatatgcggattcatagcggggaaaaaccctacgaatgccaggtctgcggtggtaagtttgctcaacagagaaatcttatctcccatatgaagatgcatgccgtgggcggtgcggcaggcgccgctggcgcgctcgccggcctcgggggcctgcctggggtaccaggccctgatggaaagggcaagctagattttccagaaggggtatttgccgtggcgcgcctgacagccgagcaactttctttgaagcaacaagataaggccgcagcggctgaactactcgctcagaccacccatttcttgcacgacccgaaagtggccttagagtctctgtacccgttggccaagtttactgccgaactcgggctgtcgccagacaaagcggccgaggtcctcagccaaggcgctcatctcgcagctggtcctgacggccggacaatcgatcggttctcaccaacttag

SEQ ID NO: 15512 - DNA, 2208 bp, Artificial Sequence
  Description of Artificial Sequence: Synthetic coding sequence
atggagggggctgggggtgcaaatgacaagaaaaaaatttccagcgagagaaggaaggagaaatccagggatgcagctcgtagtcgaagatctaaagagtccgaggtgttttacgaactggcacatcagctgcctttgccacacaacgtgtctagccatctggacaaggcctcagtaatgcggctgacgattagctatttacgcgttaggaaactgctagacgcaggtgatttagatattgaggatgacatgaaggcccagatgaactgcttctatctgaaggccctcgacggcttcgttatggttctcacagacgacggagacatgatttacatttccgacaacgtcaacaagtacatgggactgactcagtttgagctgacagggcattcagtcttcgattttacccacccatgcgaccacgaggagatgagagaaatgctgacacatcgaaacggcttagtgaaaaaaggtaaagagcagaatacacagagaagcttctttcttagaatgaaatgcactctgaccagtcgcggacgaacaatgaatatcaaatctgcaacttggaaggtgctccactgcaccggccacatacatgtgtacgacaccaactcgaatcagccacagtgcggttacaaaaagccgccaatgacctgtttagttctgatctgcgaaccaatccctcacccaagtaatatcgagatacctctggactcgaaaaccttcttatcaaggcactcactggacatgaaattctcatactgcgacgaacggatcacggaattgatgggatatgagcccgaggaacttttgggcaggagcatttatgaatactatcacgcgctcgactcggatcatctgaccaagacccatcacgatatgttcaccaaaggtcaggtgacaacagggcagtatcgaatgttagccaaacgcggcggttacgtctgggtagaaacacaggcgacagtgatttacaacaccaaaaactctcagcctcagtgtatagtgtgcgtgaactacgtggtgtccggcataattcagcacgatctgattttcagtctgcagcagacggagtgtgtccttaaaccagtggaatcttctgacatgaagatgactcagctctttactaaggtggaaagcgaagatacatcttcactgttcgacaaactgaaaaaagagcctgatgcactgactctcctggcaccggcagccggcgatacaatcatctccctcgactttggaagtaatgatacagagactgacgaccagcaattagaggaagtcccactttacaatgacgtgatgctaccttcccccaatgagaaacttcagaatatcaacttagctatgtcccccctacccactgccgagacgcctaagccactgcgatcctctgccgaccccgcattgaatcaggaagtcgctttaaagcttgagccaaaccccgaatctctggagctgagcttcacgatgcctcaaattcaagaccaaaccccaagcccttctgacggctccacccgacagagttcccctgagcctaatagtcccagtgaatactgtttctacgtcgactcagacatggtcaacgaatttaaattggagttggtggaaaagctttttgcagaggacaccgaggccaagaatccgttctcgacacaggataccgacctcgacctggagatgctggccccttacatccctatggatgatgactttcagttgcggtcgtttgatcagctgtctcctctagaatcttcaagtgccagtcccgaaagtgcatccccccaaagtactgtgaccgtgtttcagcaaactcagatacaggaacccactgctaatgccacgactactaccgcaactactgacgagctaaaaacagtaacaaaggaccgtatggaggacatcaaaatacttatcgctagccccagcccgacgcacatccacaaagaaacaacttcagccacttcctcgccttaccgggacactcaaagtcgaacagcctcaccaaatagagcaggaaagggcgtgatcgaacagacagagaagtcccatccccgcagtcctaacgttctctctgttgctctttcccagcgcacaacagttccggaggaagagctgaatcctaaaatcttagctctccagaatgcccaacgaaaacggaagatggagcacgacggtagcctgttccaggctgttggcatcatctag

SEQ ID NO: 15513 - DNA, 2481 bp, Artificial Sequence
  Description of Artificial Sequence: Synthetic coding sequence
atggaaggcgccggcggagcaaatgataagaagaaaattagttctgagcggaggaaagagaaatctcgcgatgccgcacgatcccgtagaagcaaggagagtgaagttttctacgagctcgcgcaccagctgcccctgcctcataatgtgtcatcccacttagacaaagcctccgtaatgaggctgacaatcagctacttgcgagtgcgaaaactgctggacgccggggacctggatattgaggacgatatgaaggcacagatgaattgcttctacttgaaagctttggatggatttgtaatggtgctgacagatgatggcgatatgatctatatctccgataacgtcaataaatatatgggtttgactcagtttgagctcaccggacactcagtttttgatttcacacacccttgtgaccacgaggaaatgagagaaatgttaactcataggaatggcttggtaaagaaaggcaaggaacagaacacccaacggtctttcttcttaagaatgaaatgcacattaacaagtcgaggacggacaatgaacatcaaatccgctacctggaaggtcctccattgcactgggcatatccacgtctacgatacaaactcaaatcaaccccagtgtggctataagaagccccccatgacctgtttggtcctgatttgtgaacctattccccatccttcaaatattgaaatccctctcgacagtaagactttcctctcgaggcactcgctggacatgaagttttcatattgcgatgagcggataaccgaactcatgggctacgagcccgaggagcttctgggaagatccatctatgaatactatcacgcccttgattccgaccacctgactaaaacccatcatgatatgttcaccaaggggcaagtcaccaccgggcagtacaggatgctggccaaaagggggggttatgtctgggtggaaacccaggctacagttatctacaatactaagaattcccaaccccaatgcattgtgtgcgtgaactacgtggtctcaggcattatccagcatgacctgatattttcattacaacaaactgaatgtgttctgaaaccagtggaatccagcgatatgaaaatgacccagctgttcacaaaagttgaatcagaggacacatcctcgttattcgacaaacttaagaaggagcctgacgccctgactctgttggcccctgccgccggcgatactatcatttctctggatttcggctccaatgacactgaaaccgatgatcaacaattggaggaggtgccgctgtacaacgacgtcatgctgcctagccctaacgaaaagcttcaaaacataaatcttgctatgtcccctctgcctacggccgagacacctaaacctcttcgaagcagtgcggaccctgcccttaaccaggaagtcgccctgaagctcgagcccaaccccgaaagcctggagttaagcttcaccatgccacagatccaagatcaaaccccaagtcccagcgatggctccactcggcagagttctcccgaaccgaactcaccatcagagtactgtttttacgttgattcggatatggttaacgagtttaaactggaactcgtcgagaagttgttcgcagaagatactgaggctaaaaatccattttccacacaggacaccgatctcgacctggagatgcttgctccatatattcccatggacgacgattttcagttgcgcagcttcgaccagctgtccccacttgaatcttcatccgctagtccagagtccgcgagcccccagtctacagtgaccgttttccagcaaacccagatccaggaacccactgccaacgcgaccactaccacagcaaccacggatgaactgaaaacagtgacgaaggatcgcatggaagacatcaagattctgatcgcatctccgtctcccacacatatacacaaagagacaacgtccgctacttcatctccgtacagggatacacagtcccggactgcctcaccaaaccgggcgggcaaaggtgtgattgagcagactgaaaagtctcacccgaggtctccaaacgtcctgtccgtggcacttagccagcggactaccgtgccggaggaagaacttaacccaaaaatcctggctttacagaatgctcagaggaagagaaaaatggagcacgacggctccctgtttcaagcggtcggcatcggcaccctcctgcagcagccggacgatcatgctgctaccaccagcctcagctggaagcgcgtaaagggatgcaaatcttccgagcagaacggcatggagcaaaaaacaatcatcctgatcccctctgatctcgcctgtcgactgttaggccagtctatggacgagtccggcctcccccagttgacaagttacgactgcgaagtgaacgctcccatacagggctcccgcaatctactccagggtgaggagctcctgagggccctcgatcaggtgaattag

SEQ ID NO: 15514 - DNA, 2304 bp, Artificial Sequence
  Description of Artificial Sequence: Synthetic coding sequence
atgcgcctcactattagttacctccgggtcagaaaactgttggatgctggcgacctggatattgaggacgacatgaaagcccagatgaattgcttctacctgaaggccctcgatgggttcgtgatggtcctgacggatgacggggatatgatctatataagtgacaacgtcaataagtacatgggcttgacccagtttgagttgaccggtcattccgtttttgattttacgcacccgtgtgaccacgaggaaatgcgggagatgttaactcatcggaacggtcttgtgaagaagggcaaagaacagaatacccagcggtccttttttttgcgcatgaagtgcactctgacgtcgcgaggaagaactatgaacattaaaagtgctacctggaaggtcctccactgtacaggacatattcatgtctatgatacaaactccaatcagccccaatgcggatataagaaaccccccatgacatgcctggtcctgatatgtgagccgatccctcacccaagtaatattgagataccattggacagtaaaacctttctgtcaagacattcactcgacatgaagttcagctattgtgatgaacggatcacagaattaatgggttatgagccagaggagttgctgggccgatctatctatgagtactaccacgctctcgatagcgaccacctcacaaaaacccaccatgacatgttcacaaaagggcaggtgactacaggccagtaccgtatgctagccaagagagggggttacgtctgggtggagactcaggctacagtaatctataatacgaaaaatagtcaaccgcagtgcatcgtatgcgtaaattatgtagtttctggcatcattcaacacgatctgatcttttccctgcaacagaccgagtgcgtcctgaaacctgtggagtcctccgacatgaagatgacccagctttttactaaagtggagagcgaggacacatcgagtctgttcgacaaactgaaaaaggaaccggacgcgttaacccttctggcgccagctgcaggagataccatcatctctttagactttggctcaaatgatacggagaccgatgaccagcagctagaggaagttccgttatataacgatgtgatgttgccttccccaaatgaaaaactccagaacatcaacctggctatgtcccctctcccgacagcagaaactcctaagccactgagatcatctgcagacccggctctgaaccaagaggtcgcgctcaagttagaacctaacccagaatccttagagctgtccttcacgatgccacaaatccaggatcagactcctagtccttctgatgggtccaccagacagtcatcacctgaacctaattccccatccgaatattgcttttacgtggattccgatatggtgaacgaattcaagcttgagctggttgagaaacttttcgccgaagatacagaggccaaaaaccccttttctacgcaggataccgaccttgacctcgagatgttagcgccatacattcccatggatgacgacttccagcttcggagcttcgaccagctatcaccgctggagtcatcctccgcaagtcctgagagtgcctctcctcaaagcaccgtcaccgtcttccagcaaacgcagattcaagagcccaccgcaaatgcgacaactaccaccgccaccactgatgagttaaagacagtcacgaaagaccggatggaagatatcaaaatattaatcgcctctccttcccctacacacattcacaaagagactaccagcgcaacctccagtccttatcgggatacgcaatctagaacagcgagtccaaatcgggccggcaaaggggtgatagaacagaccgaaaaatcgcatcctcgctcccctaacgtccttagcgtcgctctatcccagaggacaaccgtgccagaggaggagttaaatcccaaaatcctcgctttacagaatgcccagagaaagaggaaaatggagcacgacgggtccttattccaggctgttggtatcggcaccctgctgcagcagcctgatgaccacgctgccacaacatcccttagttggaagagagtaaaaggctgcaagagtagtgagcaaaatgggatggagcagaagaccatcatactgattccatccgatctcgcttgtcggctcctggggcaaagcatggatgagtctggtttgcctcagctaacttcctatgactgcgaggtcaacgcacccattcaggggtcacgtaacttactgcagggagaagaactcttacgcgccctcgaccaggttaactag

SEQ ID NO: 15515 - DNA, 2484 bp, Artificial Sequence
  Description of Artificial Sequence: Synthetic coding sequence
atggaaggagccggcggcgcaaacgataaaaagaatagaatctcgagtgagcgacggaaggagaagtccagggatgcagcccgtagccggaggagcaaggaatcagaggttttctatgagctggcccatcagcttcctctgcctcataacgtctcttcccacctggataaagcctccgtcatgcgcctgactatttcatacctcagggttaggaaacttctggatgcgggggatctcgatattgaggatgatatgaaggctcagatgaactgcttctaccttaaggccctggatggatttgtaatggtgttgacagacgatggagacatgatatacatatcagataacgtgaacaagtacatggggctcacgcaatttgagctgacaggccactccgttttcgacttcactcatccctgcgaccatgaggaaatgagggagatgttgactcatcgcaatggtcttgttaagaagggcaaagaacagaacactcagaggtcattctttctgcgaatgaagtgtactctgacctcgcgtggtcgcacaatgaatattaagagtgctacctggaaagtcctccactgcacagggcacattcatgtatatgacaccaactctaaccaaccccaatgcggctataagaagccccccatgacatgcctggttctcatatgcgaacctatcccacacccttctaatatagaaatccccttggatagcaaaaccttcctgagccgccactccctggacatgaagttctcgtattgtgacgaacgtattacagaacttatgggctatgagccagaggaactcctcggtaggtctatctacgaatattaccatgcactggacagcgaccatctgacgaaaacgcaccatgacatgtttaccaagggccaagtgacaacggggcagtacaggatgctggctaaacgggggggatacgtttgggtcgaaacccaggcaacggtgatttataacactaagaacagtcagccacagtgtattgtgtgcgtgaattacgtcgtgtcaggaatcatccagcacgatctgatattttcgctgcaacagaccgaatgcgtccttaaaccggtggagagctccgacatgaagatgacacagctgttcactaaagtcgagagtgaagacacctcttcactcttcgataagttgaagaaggagccagatgccctgacattactggcacccgccgcaggagacaccatcatctcgctggactttggttcaaatgatactgaaacagatgaccaacagttggaggaggtgcctttgtacaatgatgtcatgcttccgtctcctaacgagaagctgcagaacattaacctggccatgtcacctctgcccactgctgaaacacccaagcctttgcggagcagcgcggatcctgcgctcaaccaggaggttgctcttaagctggagccaaatccagaaagcctagagttgtcattcaccatgccacagatccaggaccagacaccttcgccgagcgatggaagcactagacaatccagccctgaaccaaactcacctagcgagtattgtttttatgtggatagcgacatggtcaacgagttcaagctggagctcgtggagaagttgtttgccgaagacactgaagctaaaaatcccttctcgactcaagatacggatctggacctggaaatgctcgcgccctatataccgatggacgatgactttcaactgagaagcttcgatcaactgtccccactggagtcatctagtgcctcaccagagtcagcctctccccagagcacagtgacagtttttcaacagacccagatccaggagcccactgcgaacgccaccactaccaccgcgactaccgatgaactaaagaccgtgacaaaagaccgcatggaggatattaaaattctgatcgcctctcccagccccacgcacatccacaaagaaacaacctcagcgacaagttctccataccgagacacacagagcagaactgcttcccctaaccgtgcagggaaaggtgttattgagcagacagagaagagccacccgcgaagcccaaatgtgttgagcgtagctctgtcgcagcgaacgaccgtccccgaagaggaactgaatcccaaaatcctcgccctacagaacgcacagaggaaaaggaagatggagcacgacggcagcctatttcaggccgtggggattggcactctgttacagcagccagacgatcatgcggcgaccaccagcctgtcctggaagcgcgtaaaggggtgcaagtcatccgagcagaacggcatggaacaaaagaccattatcttaatcccatctgatcttgcatgtaggctgttgggacagtcgatggatgaatcaggcctcccacagctgacctcctatgattgcgaagtcaatgcccccatacagggttcccgcaacctccttcagggcgaggagctgttgcgagctctggatcaggtcaattag

SEQ ID NO: 15516 - DNA, 2553 bp, Artificial Sequence
  Description of Artificial Sequence: Synthetic coding sequence
atgtccagtcagtgcaggtctctggagaacaagtttgtgttcttaaaggagggtctcggcaattctaagcctgaagagctggaggaaatacgtatcgagaacgggagaatctcatcagaacgccggaaggaaaaatcaagggatgctgctaggtccaggcgatccaaagaatcagaggttttttacgaactggcgcaccaactgcctctcccacacaacgtgtccagccatttggacaaggctagtgtaatgcgactgacgatttcataccttcgcgtgcgaaaacttttggacgcgggagacctggacattgaggacgatatgaaggcacagatgaattgcttttacctgaaggctctcgatgggttcgtcatggtcctcactgatgatggagatatgatttacatctcggataatgtgaacaaatatatgggcctcactcaatttgaactcaccggccattctgttttcgacttcactcatccatgtgaccacgaagaaatgcgggagatgttgactcaccgaaatggtcttgtgaaaaaggggaaggagcaaaacacacagcgaagcttttttctcagaatgaaatgcacgctgacgagtagaggcagaacgatgaacatcaaatcggccacctggaaggtactgcactgcacaggccacattcatgtttatgacacgaattctaatcaacctcagtgcggctataaaaaaccccctatgacttgcctggtgctaatctgtgaacctattccgcaccctagtaacattgagatccccctggatagcaaaacttttttgtcaaggcacagcctggacatgaagttcagctactgtgatgagcgcatcaccgagctcatggggtatgagcccgaagagctcctcggccgtagtatctacgagtattatcacgccctagattctgaccatttaacaaagacacaccacgacatgtttacaaaaggccaggtgacaaccggacagtatcggatgcttgctaagagaggtggctatgtttgggtggagactcaggccactgtgatatacaatactaaaaatagtcagccgcagtgcatcgtctgtgtgaactacgtggtatctggtattatacagcatgatctaatcttttccctgcagcaaactgagtgtgtcctgaagccagtggaatccagcgatatgaagatgacgcagctgtttacaaaagtagagagtgaggatacgagctcgctgtttgacaagctcaagaaagaacccgatgccctgacgttgctggcccctgcagccggagacaccattatcagcctggactttggatctaacgacacagagactgatgatcaacagttagaggaggtaccactgtacaatgatgttatgctgcccagccctaacgagaagctacagaacatcaatctggcgatgtcccccctgcctacagcagagacccctaagccactgcgtagcagcgccgatccagccctgaatcaggaagttgctttaaagcttgaaccaaaccctgaaagcctggaactctctttcactatgccccagattcaggatcagacaccatcaccgtctgatgggagcacccggcagagcagtccagaacccaactccccatccgaatactgtttctacgtggactctgatatggtaaatgaatttaagctcgaactcgtggaaaaacttttcgcagaagataccgaggccaagaatccttttagcacacaggacacagatctggatctggagatgttggctccgtatattccaatggacgatgactttcagctccgctcttttgaccagcttagccctttagaatcgtccagtgccagtccagagtcggcatctccccaatccactgtgaccgtgttccagcagacccagatacaagaaccaactgctaacgccaccacaaccactgccactacggatgaactgaaaacagtgacaaaagatcgtatggaagacattaagattctgatcgcgtcaccatcccctacgcacattcataaggagaccaccagtgccaccagcagtccctacagagacacccaatctcggaccgctagcccgaatagagctgggaaaggagtgatcgagcaaactgaaaagagtcatccccgatctcctaacgtgctctccgtggcgttgagccagcgcaccaccgtccccgaagaggagctgaatccgaagatcttggccctccagaatgcccagcggaagcgtaagatggaacatgatggctctctgttccaggccgtcggaatcggcaccttgctgcagcaacccgacgatcacgccgccaccacatccctatcttggaagagagtgaagggctgtaaaagttcagagcagaacggaatggagcagaaaacgatcatactgattccctctgatctcgcctgcagactgcttggacagagcatggacgagtcagggctcccccagctgacaagctacgattgtgaagtgaacgctcccattcagggctcccggaacctgttgcagggcgaggaacttctgagagcgctggaccaggtaaattag

SEQ ID NO: 15517 - DNA, 1734 bp, Artificial Sequence
  Description of Artificial Sequence: Synthetic coding sequence
atgaaattcagctactgcgatgaaagaattaccgagttaatggggtacgaacctgaagaacttcttggacgctcgatctacgaatattatcacgctctggattctgatcatctgaccaagacccatcacgacatgtttaccaaggggcaagtcactaccggccaataccgtatgctcgcaaaacggggagggtacgtttgggttgagacccaggccacggtcatatataacacaaagaacagccagcctcagtgtatcgtgtgcgtgaattacgtcgtgtccggcattattcagcatgatttaatcttctctttgcagcaaaccgaatgcgtgctgaaaccagtggaatctagcgatatgaagatgacccagttatttacaaaggtggaaagtgaagatactagttccttatttgataagctaaagaaggaaccggatgccttgacacttctcgctcccgcagccggggacactattatcagcctggattttggctctaacgacaccgaaactgatgaccagcagctagaggaggtgcctttgtataacgatgttatgttacccagtcctaatgagaagttgcaaaatattaatcttgccatgagcccccttccaactgcggagacaccaaagcccctccggtcaagcgccgatccagcactcaaccaggaggtcgctttaaagctcgagcctaatcctgagtccctggaactctccttcactatgcctcagattcaggaccaaacaccaagcccttcggacggatctacccgacagtcctctccagagcctaacagtccttccgaatattgtttttacgtagactcagacatggtgaacgaattcaagcttgagctggtggagaaattgtttgcagaggatactgaggctaaaaaccctttttccacccaagacacagacctggatctggagatgctggctccttacattccaatggacgacgactttcagcttcgttcattcgatcaactcagcccattggaaagtagtagcgccagtccagaaagcgcatcaccccagtccacagtcactgtgttccagcaaacacagatccaagaacctaccgccaatgccaccaccacaacggccactaccgatgagttgaagaccgtcaccaaagacaggatggaagacatcaagatcctcatagccagtccctctcccacgcacattcacaaagagaccacgtcagccacctccagtccctatcgcgacacacagtccagaactgccagtcccaatagagcaggaaagggtgtcattgagcagacggaaaaaagccatccacggagccctaacgtcctgagtgttgcactctcacagcgcaccactgtcccagaggaggagctcaatcccaagatccttgctctacaaaatgcccagcggaaaagaaaaatggagcatgatggcagcctgtttcaagccgtgggcataggaacgttgctgcagcaacctgacgaccacgcggctactaccagtctgtcttggaaacgagtgaaggggtgtaagagctcagagcaaaacggcatggagcaaaaaacaataatccttatcccctccgatctggcctgtaggctgcttgggcaatctatggacgaaagcgggctgccacaactgacaagctatgattgcgaagttaacgcccccattcagggctctcgcaacctgctccagggtgaggagctgctgcgcgcgctggaccaggtcaattag

SEQ ID NO: 15518 - DNA, 2304 bp, Artificial Sequence
  Description of Artificial Sequence: Synthetic coding sequence
atgcgactgacgatttcgtacctcagggtccgaaagctgctagatgccggcgatctggacattgaagatgacatgaaagcacagatgaattgcttctatttgaaggctctcgatggatttgtgatggtgctcactgacgatggagacatgatatatatctcggacaacgtgaataaatacatgggactgactcagttcgaattgactggacattctgtcttcgactttacacacccctgcgaccatgaagagatgagggaaatgctgacacacaggaacggcctggtaaagaagggcaaggaacagaacactcagcggtctttctttctccggatgaagtgtacgctgaccagcaggggtagaactatgaatatcaagtccgctacatggaaggtcctccactgcactggccacatccacgtatacgacacgaactccaaccaaccacagtgtgggtataagaagcccccaatgacatgtctcgtactaatctgtgaacctataccacacccatcaaacattgaaattccccttgactcaaagacctttctatctaggcactccctagacatgaagttttcctactgcgacgagagaatcacagagctgatgggctacgagccagaggagctgctaggtcgctctatatatgagtactaccacgcactggatagtgaccacttaacaaagacacatcacgatatgttcactaagggtcaagtgactaccggtcagtatagaatgctggcaaagaggggaggctacgtgtgggtggaaactcaggcaaccgtgatctataataccaagaactctcagccacagtgcatcgtatgcgtaaattatgtagtgtcaggtataatccagcacgacttgatcttctctctccagcaaacagagtgcgtgttgaagcccgtagagtcctctgatatgaagatgacgcaacttttcactaaggtggaatccgaggacaccagctctctgtttgacaagttgaagaaggaaccggacgcacttacccttttggcccccgctgcgggcgacacgattatttctctcgacttcgggagtaacgatacagagaccgacgaccagcaactcgaggaggtgccactgtataatgacgttatgcttccaagtcctaacgagaaactgcaaaacattaacttggccatgtctcccctgccaacagccgagaccccaaaaccactgcgcagcagcgccgatcccgctctgaaccaggaggtggccttaaagctggaaccgaaccctgagtccctggagctgtcttttaccatgccccagattcaggaccagaccccatcgccttctgacggctccacgagacagagcagccccgaaccaaatagtccgagtgaatattgcttctacgtggactcagacatggttaatgaatttaagctggaattagtagaaaaactgttcgccgaagacacagaggctaagaatccattctctacacaggacaccgacctggaccttgaaatgctggccccctacatccctatggacgacgatttccagctgaggtcgtttgaccagctatccccccttgagagttcaagcgcgtcaccggagagcgcgagtcctcagtctaccgtgaccgtcttccagcaaacccaaattcaggagccaactgcaaatgccactacaactactgctactaccgatgagctcaagactgtcactaaagaccggatggaggacatcaagatcttgattgcctccccaagccctacacacatacataaggagacaacctccgctacatcttcaccatatagagatactcagtcgagaaccgccagtccgaatcgcgccggaaaaggagtaattgaacagactgaaaagtctcaccctcgatctccaaacgtgcttagcgtggcgctttcgcagcgtaccacggtgcctgaagaggagctgaacccaaagattctagcactgcagaacgcacagcgcaagcgtaagatggagcacgatggctcactattccaagccgtggggatcgggacactcctgcagcagccagacgaccacgccgcaaccacctctctttcatggaagcgggtgaagggctgtaagagttctgaacagaatggcatggaacagaaaacaattatcttgatcccttctgacctggcctgtcgccttctgggccagtccatggatgagagcggccttccccaactcacatcgtatgattgcgaagtgaatgctccgattcaggggagcagaaaccttctccagggcgaggagctactacgcgccttggaccaggttaattag

SEQ ID NO: 15519 - DNA, 1296 bp, Artificial Sequence
  Description of Artificial Sequence: Synthetic coding sequence
atggaggatatccagaccaacgcagagctgaagagtacacaggaacagagtgtgccggccgaatcagcagctgtgttgaacgattattctcttacaaagtcacacgaaatggagaatgtggacagcggagagggaccggcaaacgaggacgaagatattggcgacgattcgatgaaagtgaaggatgagtacagcgaacgggacgagaatgtactcaagtccgaaccaatgggtaacgcggaagaacccgaaatcccctatagctattcaagggagtataacgaatatgaaaacattaaactcgagcgacatgtggtgtcctttgattcgtcgcgcccaactagtggaaaaatgaattgtgatgtgtgcggtctgtcttgcatctcatttaatgtgcttatggtacacaagcgctcacatacaggagaacggccctttcagtgcaatcaatgcggcgcctcttttactcaaaaaggcaacctgctgaggcacattaagctgcacacaggggaaaagccctttaaatgccacctgtgcaattatgcatgtcaaagaagagatgctttgaccgggcatcttcgaacacatagtggcgaaaaacggcactgttttgatgtgaattataacagttcttatatgtatgagaaggaatctgagttaatccagacccgaatgatggatcaggctataaataacgccatctcctatctgggcgcagaggcactaagacccctcgtccagacgccccccgcgccgacttctgagatggtgcctgtgatctctagcatgtatcccatcgccctcactagagcagaaatgtcaaatggtgcccctcaggagttggagaaaaagtctatccacctgccagaaaaaagcgtaccaagcgaaaggggtctgtccccgaacaattcagggcatgatagcaccgacacagatagcaaccatgaagaaagacagaaccacatctatcagcagaaccacatggtcctctctcgggctcgcaacgggatgcccctcttgaaggaagtgcccagaagttatgagttacttaaaccaccacccatctgccccagagacagcgtcaaggtcattaataaggagggggaagtgatggatgtttacaggtgtgaccattgtcgcgtgttattcctggattatgtcatgttcactattcacatgggttgccacgggtttagggaccccttcgaatgcaacatgtgtggctacagaagtcacgaccggtacgaattctcttcacacatcgcgagaggtgaacatagggcactcttgaagtag

SEQ ID NO: 15520 - DNA, 1245 bp, Artificial Sequence
  Description of Artificial Sequence: Synthetic coding sequence
atggaggatatacaaaccaacgctgagcttaaatccacccaagagcagagcgtcccagctgagagcgcagccgtgctgaacgattatagtttgaccaaatcacacgagatggagaacgtcgatagtggcgaaggaccagcaaacgaggacgaggatataggcgacgactctatgaaggtaaaggatgagtatagcgaacgcgacgagaacgtcctcaagtcagaaccaatgggtaatgctgaggaacctgaaatcccttactcttatagtcgggaatataatgaatacgaaaacatcaagttggagcggcacgtggtttcctttgatagtagtaggccaactagtggcaaaatgaactgtgacgtatgtgggttgtcgtgtattagttttaacgtgctgatggtgcataagaggagtcacacagcctctgctgaagctagacacattaaagccgaaatgggatcagagcgggccctggtcctggacaggttggcctctaacgttgcaaagcgtaaaagtagcatgcctcagaagtttattggtgagaagagacactgtttcgacgtgaattacaacagctcgtatatgtatgagaaggagagcgagctcatccagacccggatgatggaccaggccattaataacgccattagctatctaggggcagaagccctccgcccgctggtgcaaactcctcctgctcctaccagcgagatggtcccagtcatcagctccatgtacccgatcgcattaacccgggctgagatgagcaatggggcacctcaggagctcgagaaaaagtcaatccatctaccagagaagagcgtgccatctgaaagagggctgtccccaaataattccgggcacgacagcaccgataccgacagcaatcacgaagaacgtcagaaccacatatatcagcagaaccatatggtgctctctcgtgccaggaatgggatgccactcctcaaagaagtaccaagaagttatgagcttctgaagcctcccccaatctgccctcgcgattccgtgaaggttattaataaagaaggagaagtgatggatgtctaccggtgcgaccattgccgcgtcctcttccttgactacgtgatgtttacaattcatatggggtgtcacggcttccgggatcctttcgaatgtaatatgtgcgggtatcgtagtcatgataggtatgagttctcatcccatatagcccgcggcgaacacagggctttgttgaagtag

SEQ ID NO: 15521 - DNA, 1413 bp, Artificial Sequence
  Description of Artificial Sequence: Synthetic coding sequence
atggaagatattcagactaacgcggagctaaaatccacacaggaacagtccgttcccgctgaaagcgcggccgtcctgaacgactacagcctcactaaaagccatgaaatggaaaatgtggactccggagaggggcccgcaaacgaagatgaggacatcggggacgattccatgaaagtgaaggatgaatacagcgagcgggacgaaaatgtcctcaagtccgaacccatggggaatgccgaggagcccgaaattccatatagctactctcgcgaatataacgaatacgagaatatcaaattggaacggcacgttgttagcttcgacagctcccggcccacaagtggcaagatgaattgtgacgtttgcggcctcagttgtatttccttcaacgtgttgatggtccacaagcgttcgcataccggagaaagacccttccagtgtaatcagtgcggggcatcctttacgcagaaagggaatttgcttaggcacatcaaactccacactggggaaaagccctttaaatgtcacctgtgtaattacgcatgccaaaggcgggatgcactaacaggacatctcaggacccacagtgtggaaaagccttataagtgtgagttctgtgggaggtcttacaagcagcggtcgtcactagaagagcacaaagagagatgtcggactttcctccagagtactgaccccggtgacacaggggagaaacgacattgcttcgacgtcaattataatagctcatatatgtatgagaaagagagcgagctgatccagacaagaatgatggaccaggcaattaacaatgctatctcctacttgggtgcagaagctctccgtccgctcgtacagacaccgccagcccctacatccgaaatggtgcccgttattagcagtatgtatccaattgcgctcacaagggccgagatgtcaaatggtgcgccacaagaactggaaaagaaaagcattcacttacccgagaaatctgtgcctagcgaaaggggcctgtcccccaacaactccgggcacgacagcacagatacggactcgaatcacgaggagagacagaatcatatctaccagcagaatcatatggtcctgtcccgggctcgtaatggcatgcccctcctaaaagaggtcccgaggtcatacgagcttctcaaacccccccctatctgccctcgcgacagtgtcaaagttatcaacaaggagggcgaggtgatggatgtctacagatgcgatcattgccgtgtgttgtttctggactatgtgatgtttaccatccatatgggttgccatggcttccgagaccctttcgagtgcaacatgtgcgggtatcgctctcacgatcgttatgaattttctagtcatattgcgagaggcgagcacagggcactgcttaagtag

SEQ ID NO: 15522 - DNA, 1413 bp, Artificial Sequence
  Description of Artificial Sequence: Synthetic coding sequence
atggaagatatccagacaaacgccgaacttaaatcaacacaggagcaaagcgtgccagccgagtcagccgccgtgctgaacgactattccctgaccaagagtcatgaaatggagaatgtagactccggggaggggcccgctaatgaagacgaggacatcggggatgacagcatgaaggttaaagatgaatactccgagcgggatgaaaacgtcctgaagagtgagcccatggggaatgctgaagagccagaaatcccctatagttacagccgcgaatacaatgaatacgaaaatatcaagctggagagacacgtggttagctttgattcttccagacctacatccggtaagatgaattgtgacgtgtgcggcttgagttgtattagcttcaacgtgctcatggttcataagagaagccataccggcgagcgcccattccagtgcaaccagtgcggagcttcgttcacccagaagggcaatctcctgaggcacatcaaattacataccggcgagaaacctttcaagtgtcatttatgcaattatgcctgccagaggagggatgccctcacaggacacttgcgaacccactctgcctccgccgaagcccgacacattaaagctgagatggggagtgaacgcgccttagtacttgaccggctggcctcaaacgtagcaaagagaaagagcagcatgcctcaaaagtttatcggcgaaaagaggcattgctttgatgtgaattacaattccagctacatgtacgaaaaagaatctgagctgattcagacacggatgatggatcaggccattaacaatgctatctcttatctgggcgcggaggccctgaggcccttagtgcagacccctcccgcccccactagcgagatggtccctgttatctcttctatgtatcctatcgcgctaactcgggctgagatgtctaatggggcaccacaagaactggaaaagaagtcaattcacctcccggaaaaaagtgtgccatcagagaggggcctgtctcccaataatagcggccatgatagcactgacacggacagcaatcatgaggaacggcagaaccacatttaccaacaaaatcacatggttctgtccagagcacgaaatggcatgccactgctcaaggaagtaccgcgctcctacgagctcttgaagccccctccaatatgcccccgggattctgtaaaagttattaacaaagagggcgaagttatggacgtttatcgctgtgatcattgcagagttctcttccttgattatgtcatgtttaccatccatatgggatgccacggttttagggacccatttgagtgcaatatgtgcgggtataggagccatgaccgatacgagttctcatcacacatcgcaaggggcgagcatagggctctcctaaagtag

SEQ ID NO: 15523 - DNA, 1101 bp, Artificial Sequence
  Description of Artificial Sequence: Synthetic coding sequence
atggaggacatccaaacgaatgccgaactcaaatctactcaggaacaaagcgttcccgccgagtccgctgcagtacttaatgactattctttgactaaatcacatgagatggagaacgtggactcaggagaggggccggccaacgaagacgaggacattggcgtggagaagccctacaaatgtgagttttgcggtaggtcatataagcagagatcatctctcgaggagcacaaggaacggtgtcgaacctttctccagtccacggatccaggggatacggcctccgcagaggcccgtcatattaaggccgaaatgggttccgaaagggcgttagtattggacaggctggcttccaatgtcgccaagagaaagtcctccatgccccagaagtttatcggagagaagaggcactgcttcgatgtgaactataacagttcatacatgtatgaaaaggagtccgaactgatccagacaagaatgatggatcaagcaatcaataatgccattagctacctgggcgccgaagcactgcgcccgttggtgcaaactccacccgcacctacttccgagatggttcccgtgatatcctcaatgtatcctattgcattgacgagggcagaaatgagtaacggcgccccgcaggaactggaaaaaaagagcattcacctgccagagaagagtgtgcccagcgagcgagggctatctccgaacaacagcggccacgacagcacggacacagactctaaccacgaggaacggcagaatcacatatatcagcagaatcatatggtcctgtccagggccaggaacggaatgccgttacttaaggaggttcctagaagctacgaacttctgaaaccccctccaatttgcccgcgggattctgtcaaggtgattaacaaggaaggggaagtcatggatgtgtaccgctgcgaccactgtcgcgttctgtttctcgattatgtgatgttcactatccatatgggctgtcacgggtttcgggatccttttgagtgcaacatgtgtggataccgctcccacgaccgatatgaattctcaagccacatcgcgcggggggaacacagggccctgctgaagtag

SEQ ID NO: 15524 - DNA, 1128 bp, Artificial Sequence
  Description of Artificial Sequence: Synthetic coding sequence
atggaggacatccagacgaatgctgagctgaagtcaacacaggagcagtctgtgccagcagaatcagccgctgtactgaatgactacagtctgaccaagtctcatgaaatggagaatgtcgattccggcgaggggcccgcgaatgaggatgaagacattggggatgattccatgaaggtcaaagatgagtactcagaacgcgacgagaacgtcctgaagagcgagcctatgggtaacgccgaagaaccagagattccatatagctactcacgcgaatacaatgagtacgagaatataaaattggaaagacacgttgtgagctttgattcctccagacccacatcaggaaaaatgaactgcgatgtatgtggactgagttgcatcagttttaatgtgctgatggtgcataaaaggtctcataccggtgagaagagacactgcttcgacgtcaactataactccagctacatgtatgagaaagaaagcgagctcatccagacacggatgatggatcaggcaattaacaacgctatcagctacctgggtgccgaggccctgcgaccacttgtgcagacccctcccgcaccgacatcggaaatggtacctgtgatcagttcaatgtatccaatcgctctgacgcgtgctgaaatgtccaatggggctccccaggagttagagaagaaaagcattcacttacctgagaagtctgtcccctctgagaggggcctttcaccaaataacagcggccacgatagcaccgatacagactccaaccacgaggagcggcagaaccacatataccaacagaatcatatggttctcagccgggcaagaaacggtatgcccctgctgaaggaggtgccccgatcatacgaattgctgaagccaccccccatttgtcctcgagactccgtcaaagtcattaataaagagggcgaagtcatggacgtctaccgatgtgatcattgccgcgtgctgttcctcgattacgtgatgtttacaatccacatgggatgtcacggtttcagggatccttttgagtgtaatatgtgcgggtaccgctcccacgacaggtacgaattcagttcacacattgcccgaggggagcacagagccttgttgaaatag

SEQ ID NO: 15525 - DNA, 867 bp, Artificial Sequence
  Description of Artificial Sequence: Synthetic coding sequence
atggaagacattcagaccaatgctgaattaaagtctacgcaggaacagagcgttcctgccgaatccgctgcggttctgaatgactattctttaaccaaatcccatgagatggagaacgtggattccggggagggccctgccaacgaagatgaggatattgggggagagaagagacactgtttcgacgtgaattataattcatcttacatgtacgagaaggaaagcgagctcatacagacacggatgatggatcaggctatcaataacgcaataagttacttgggcgccgaagcgctgaggcctctcgtccagaccccaccagcaccgacgtccgaaatggtgcccgtcattagtagcatgtatcctatagccctcaccagggctgaaatgagcaacggcgcaccgcaggagcttgagaaaaagagcatccatctgcctgagaaatccgttccatcagagcggggtctgtcaccaaacaacagcggccatgactccaccgacactgactcaaatcatgaagagcgccagaaccatatctaccagcaaaaccatatggtgctgagccgggctagaaacgggatgcccctgctgaaggaggttcctcgctcatacgagctgttaaagcctcctcctatttgccctagggattccgtaaaagtcattaacaaagagggcgaggtgatggacgtctatcgatgcgatcattgcagagtgctattcctggattatgttatgttcactatccacatgggctgtcatggatttagggacccgttcgagtgcaacatgtgtgggtaccggagccatgaccggtatgagttttctagccatatcgccagaggcgagcatcgggcactgctcaagtag

SEQ ID NO: 15526 - DNA, 1269 bp, Artificial Sequence
  Description of Artificial Sequence: Synthetic coding sequence
atggaagatattcaaacaaacgcagaactgaagtctacccaagaacagtccgtgcctgctgaaagtgcggcagtgctaaacgactactctttaactaaatcacatgaaatggaaaacgtagatagcggggaggggccagccaacgaagacgaagatataggtggggaacgacctttccagtgcaatcagtgcggcgcgtccttcactcaaaaagggaacctcctgaggcatattaagctgcacaccggcgagaaaccctttaaatgtcatctgtgtaactatgcatgccagcggagggatgctctgaccgggcacctgcgcacacactctgttgaaaaaccttacaagtgcgagttctgtggccggtcctacaagcagcggagctccttggaggagcacaaagaaaggtgcaggactttcctgcaaagtacggatcccggcgatacagcatcagctgaggcgcgccacataaaggccgagatgggctcagagcgggcgctggtactggaccggttggcgagcaatgtggcaaaaagaaagagttcaatgccacagaaattcattggggagaaaagacactgtttcgatgtgaactacaattctagctatatgtacgaaaaggagagcgagttgatccagacgcgcatgatggatcaagccatcaacaacgccatatcctatctgggcgctgaggcgctgcgacctctggtgcagactcctccggccccgacttcagaaatggtacctgtgataagttctatgtaccctatcgcactgacccgcgcagagatgtctaatggtgccccccaggagctggagaaaaagagtatccatctgccagagaaaagtgtgccatccgagaggggcttatcaccaaataattctggacacgattccaccgacaccgactctaatcacgaagaaagacaaaatcacatctaccagcaaaaccacatggtgctttcacgagctagaaatgggatgcccctcttgaaagaagtgcccaggtcgtatgagttgctgaaacccccgcctatctgccctcgcgattccgtgaaggttataaataaggagggggaagtgatggatgtctaccgctgcgaccattgcagggtactctttcttgattacgttatgtttacaattcacatgggttgtcacgggttcagggaccccttcgaatgcaacatgtgcggctatcgcagtcacgataggtatgaatttagttcccacatcgccaggggcgagcacagagcacttctgaaatag

SEQ ID NO: 15527 - DNA, 984 bp, Artificial Sequence
  Description of Artificial Sequence: Synthetic coding sequence
atggaagacattcaaaccaacgccgaacttaagtcgacacaggaacagtccgtacccgctgagagcgccgctgtccttaatgattactcccttacaaagtcccatgagatggaaaacgtcgactcgggggaagggcctgccaatgaggacgaggacatcggggccagcgccgaagccaggcatatcaaagcagaaatgggatctgaaagagctttggtgttagacaggttggctagcaacgttgcaaaacgcaaatcctctatgccccagaaattcatcggggagaagcggcattgtttcgacgtgaattataatagcagctatatgtatgaaaaggaaagcgaactcatccagactcggatgatggaccaggcaattaataatgcgatttcctatttaggtgctgaggctctcaggcctctcgttcaaacacctccggcgcccacaagtgaaatggtgcccgtgatttcatccatgtatcctattgcacttacccgcgccgagatgtctaatggagcacctcaagagctggaaaaaaaatccatccatctccctgaaaagtctgtgcctagtgagcgcggactctcacctaataattccggccacgacagtacagacaccgattctaaccatgaagaaagacagaatcatatatatcaacagaaccatatggtgctcagccgggccaggaatgggatgccactgcttaaggaagtgcccagaagctatgagctgctcaagcccccaccaatctgccctcgcgactcagtcaaagtgatcaacaaagagggcgaggtgatggacgtttaccggtgtgaccactgtcgggtactgttcctggactatgtgatgttcactatccatatgggatgccatgggttcagagacccattcgaatgcaacatgtgcggatatcgtagccacgacaggtatgaattttccagtcacattgcccgaggggagcaccgggctctgctgaaatag

SEQ ID NO: 15528 - DNA, 1392 bp, Artificial Sequence
  Description of Artificial Sequence: Synthetic coding sequence
tgacaggagcaaagcgtacctgcagatgacagcatgaaggtgaaggacgagtatagtgaaagagatgaaaacgtcttaaagagcgaacccatgggcaatgccgaagaaccagagattccgtacagctattcaagagagtataatgagtatgagaatatcaagctggaacgacacgtagtctccttcgatagtagccgaccaacctctgggaagatgaattgtgacgtttgtggtctgtcctgtattagtttcaatgtcctgatggtgcataaacgaagccacaccggcgagcgtccattccaatgcaaccagtgcggagctagttttacacaaaaggggaacctcttgcgccacataaagcttcatacaggggagaagccattcaaatgccacctgtgtaactatgcctgtcagagaagggacgccttgacaggacatctgcggacccactccgtcgagaaaccctataaatgcgaattctgcgggaggtcttacaaacagagaagtagtctagaggagcacaaggaacgatgcagaacattcctgcaatcaacagaccccggggacacagcctcggctgaagcccggcatattaaggccgagatggggtctgaaagagcattagtgctggatcgcttagcatctaatgtggctaagcgtaagtcttctatgccccagaagttcattggagaaaagcgccattgtttcgacgtaaattacaattcctcatatatgtatgagaaggaatccgaactaattcaaaccaggatgatggaccaggctattaataacgctatctcatatctgggagcagaagcgctcagaccactagttcagacgcccccggccccaacatcagagatggtgccagttatttcctccatgtaccccattgccctgacgcgtgccgaaatgagtaacggagcccctcaggaactggagaagaagtccattcacctgcccgagaaatctgtgccctctgagagaggactcagcccaaataacagcggccatgacagcactgacacagactctaaccacgaagaacgccagaatcacatttaccaacagaatcatatggtgttaagcagggcccggaatggcatgccgctgctgaaggaagtcccacggagctatgagttgctcaagcctccccccatttgtccacgcgactcagtgaaggtaattaataaagagggcgaggtcatggatgtatatcggtgcgatcattgtcgggtgctcttcctggactacgtgatgtttactatccacatgggctgccacggtttccgggatcccttcgagtgtaatatgtgcggttatagatcacacgaccggtacgaattttcctcacatatcgcacgcggcgagcatagagctctgctcaagtag

SEQ ID NO: 15529 - DNA, 1275 bp, Artificial Sequence
  Description of Artificial Sequence: Synthetic coding sequence
tagcaggagcagtccgttcccgcagacgacagcatgaaggtgaaagacgaatacagtgaaagagatgaaaacgtgctaaaatcagaacctatgggtaatgcggaagaacccgagatcccatacagctactccagggagtataatgagtatgagaacattaaattggagaggcacgtggtgagcttcgacagtagccgtccaacaagcggaaagatgaattgtgacgtgtgcgggctgagctgcatcagtttcaacgtactgatggtgcataagagatcccataccggagagagaccgtttcagtgcaatcagtgcggcgcatccttcacccagaaaggaaatctactcaggcacatcaagctgcacacaggagagaagcctttcaagtgccacctctgtaactatgcctgccagagaagagatgcccttacgggacatctcaggacgcacagtgccagcgctgaagctagacacatcaaagccgagatgggctccgaacgtgccctggttctggaccgactcgcttccaatgtagccaagagaaagagttccatgccacagaagttcatcggggagaagcgtcactgtttcgatgtgaactataattctagttacatgtacgaaaaggaatctgagctcatccaaactcgaatgatggatcaggctattaacaacgccatttcttacctgggtgctgaggctttacgtcccctagttcaaacaccgcctgcccccaccagcgagatggtgccagtcatcagtagcatgtaccccatcgccctgacgagggcagaaatgagcaatggagctcctcaggaactggaaaaaaagtccatccatctgcctgagaaaagcgttcctagtgaaagagggctgagccctaacaattccgggcacgacagcaccgacacagattcaaatcacgaagagcggcagaaccacatctaccagcagaatcatatggtgctgtctagggccagaaacggaatgcctctgctaaaagaagttcctcgctcttacgagctgcttaagcctcccccaatttgtccaagggactccgtaaaagtgatcaataaggaaggagaagtgatggacgtgtataggtgcgaccattgtcgcgtgttgtttctggattacgtcatgttcaccatacacatgggctgtcacggcttccgcgacccatttgagtgcaacatgtgcgggtatcgaagtcacgatagatacgagttctctagccacatagctaggggcgagcatagagccctgctgaaatag

SEQ ID NO: 15530 - DNA, 1362 bp, Artificial Sequence
  Description of Artificial Sequence: Synthetic coding sequence
atggaagatatccagactaatgcggagttaaagagcacccaggagcaatctgttcccgcagaaagtgcagctgttctgaacgactattctctcaccaaaagtcacgaaatggaaaacgttgactctggcgaagggcctgcaaatgaggacgaagatatcggcgacgattcgatgaaggtaaaagacgagtactcggagcgcgacgaaaatgttcttaaatccgaaccgatggggaatgctgaagaacctgagattccgtacagttacagccgggagtacaatgaatatgagaatattaagctagagagacacgtggtctctttcgatagctcacgtcccactagtgggaagatgaactgcgatgtctgcggactgagttgcatttcttttaacgtgctgatggttcacaagcggtcccacaccgtcgagaaaccctacaagtgcgaattttgtggcagaagttacaagcagagatcatctttagaagagcataaagagagatgcaggacctttctccaaagtacagaccctggagatacagccagcgcagaggcccggcatatcaaggctgagatgggcagtgagcgggccctcgttctggacagacttgcctccaatgtggcaaaacggaagtcgtccatgcctcagaaatttatcggggagaaaaggcactgcttcgacgtcaactataattctagctacatgtatgaaaaagagtctgaacttattcagactaggatgatggatcaggccattaacaacgcaatttcttacctgggcgccgaagccttgagacccttggtccaaacacctcccgcaccaacgtccgagatggttccagtgatctcctccatgtaccccattgctttaacgagagctgagatgtccaatggcgccccacaggaactggaaaagaaaagtatccacctgccagaaaagagtgtccccagtgagagaggtctgagccctaataattccggccatgactccacggacactgactctaatcacgaggaaaggcaaaaccacatctaccaacagaatcatatggtgctgtccagagcacgtaacgggatgcctttgctgaaagaggtgcctcgttcctacgagctgcttaagccacctccaatttgcccccgggattctgttaaagtgatcaataaggaaggtgaagtgatggatgtctaccgatgcgaccactgtagggtgctttttttggattatgttatgtttaccattcacatgggttgccacggtttcagggaccccttcgagtgtaacatgtgcggctacaggagtcatgatcgctacgagttctcttcccacattgcccggggcgagcacagagctctcctcaagtag

SEQ ID NO: 15531 - DNA, 1530 bp, Artificial Sequence
  Description of Artificial Sequence: Synthetic coding sequence
atggaggatatacagactaacgctgaactgaagtccacacaggaacagtccgtccctgcggagtccgcagccgtgctgaatgattatagcctgacaaagagccacgaaatggaaaacgtcgattccggcgagggccccgcaaatgaggatgaggacatcggcgacgatagtatgaaagtgaaagatgagtatagcgagcgcgatgagaacgtgttgaagtccgaacctatggggaacgccgaggaaccagaaataccatactcatatagcagggagtacaatgaatacgagaatatcaagttagagaggcacgtagtctcatttgactcaagcagaccaacctccggcaaaatgaactgcgatgtctgcggcttgtcctgtatttcattcaatgttctgatggtccataagagatcacacaccggggaaagacctttccaatgtaaccaatgtggggcctcgttcacacagaaaggcaacctccttcgccacatcaaactgcacaccggggagaagccattcaaatgccacctatgcaactatgcctgtcagcggagggatgctctgacgggccatctacggacccacagcgtcgaaaaaccctataagtgcgagttctgtggtaggtcttacaagcagaggtccagcctggaagagcataaggagcggtgtcggactttcctccagtccacagacccaggtgacactgcatcggctgaggcgaggcacattaaagcagagatgggctctgagcgagccttagtactcgatagattagcctcgaacgtggcaaagcggaagtccagtatgccacagaagttcatcggagagaaacgccattgttttgacgtgaattacaatagctcatacatgtatgaaaaggagagcgagctgattcagacccggatgatggaccaggccatcaataatgcaatcagttaccttggtgctgaggcccttcgtcccctggtgcaaactcctcccgcacccacctccgaaatggtccccgtgatttcctccatgtatcccattgccctcacacgagcagagatgtcaaacggtgcgccccaagaactcgaaaagaaatcaatccacctgccagagaagtccgttcccagtgaacgtgggctttcgcccaacaactcgggccacgactctactgacacagacagcaaccatgaagagagacagaaccatatttatcagcagaaccatatggtgctgtccagagctaggaacgggatgcctttactaaaagaggtaccacgctcctatgagcttcttaagccacccccaatctgcccacgggacagcgtcaaggtgatcaataaggagggcgaggtgatggacgtataccgatgcgaccattgtagggtcctgtttctagattatgtgatgtttaccatccatatgggatgtcacggtttcagagatccattcgaatgtaacatgtgcggataccgctcccacgacagatatgagtttagcagtcacatagcccggggggaacaccgggcccttctgaagtag

SEQ ID NO: 15532 - DNA, 1428 bp, Artificial Sequence
  Description of Artificial Sequence: Synthetic coding sequence
atggaagatatccagaccaatgcagagctgaaatccacccaggaacagtctgtccctgctgatgattctatgaaagttaaagacgaatacagcgaacgcgacgagaacgtcctgaaaagcgaaccgatgggcaacgcagaggaaccagaaattccttacagctattctcgcgagtacaatgaatatgagaacattaaactcgagcgccacgtggtctccttcgattccagccggcccacaagcggaaaaatgaactgtgacgtctgtggcctttcatgcatttcctttaacgtcctcatggtgcacaaacggagccacaccggagaaagaccgttccaatgcaatcagtgcggcgcctccttcacacagaagggcaatttgcttcggcacataaagctccacaccggcgagaagccatttaagtgccacctttgcaactatgcctgtcaaagacgcgatgcattgaccggacatctgcggacacattctgtcgagaagccttataagtgtgagttttgtggccgctcatacaagcagcgcagctctctggaggaacacaaagagaggtgcaggacgttcctccagtcgactgaccctggcgacaccgcttctgcagaggctcgccacatcaaagccgaaatgggatctgaacgtgccctcgttcttgatagactggccagtaacgtcgcgaaacgcaaatccagcatgccccaaaagttcatcggagagaaacggcactgcttcgatgtgaactacaacagctcctacatgtatgagaaggaaagcgagttaatccagactcgcatgatggaccaggcgattaataatgcaatcagttacctgggggctgaggcgttgcgtccgctcgtacagacgcctccggcaccaacctctgaaatggttcccgtaatttcatcaatgtacccaatcgctctaacacgggccgagatgtccaatggagcccctcaggagctggaaaaaaagagtatacatctgccagaaaagagcgtcccctcagaaagagggctgagccccaacaacagcggccacgattccacagatactgacagcaatcacgaagaacgacagaatcatatttatcagcaaaatcatatggtcttgtctagagcaaggaatggtatgcccttactgaaggaagttcctcgcagctatgagcttctgaaacccccaccgatctgccctagggatagcgtgaaggtaattaacaaagaaggcgaagtgatggatgtctacagatgtgaccactgtcgcgtgttgtttctggactacgttatgttcaccatccatatgggctgccatggattccgggaccccttcgagtgtaacatgtgcggctaccgttcccacgacaggtacgagtttagttctcacatcgcccggggggaacacagggccctgctgaagtag

SEQ ID NO: 15533 - DNA, 450 bp, Artificial Sequence
  Description of Artificial Sequence: Synthetic coding sequence
atgaaagtcgcctccggttctacggccacggctgctgccggtccctcctgcgcgttgaaagcgggaaaaaccgcgtctggggctggcgaggtggtgagatgcctgagcgaacagagcgtcgcgatctctcggtgtgctggcggcgccggcgcgcgtctgcccgctctgctggacgagcaacaggtaaacgtccttttgtatgacatgaacgggtgttacagtcggctaaaagagctcgtccccaccctgcctcaaaaccggaaggtttcaaaagttgagatcctgcaacacgtcatcgactatatcagggaccttcagctggaattgaatagcgaatccgaggtggggacccctggcggacgtggcctcccagtccgggctccactaagcacactaaacggtgaaattagcgcgctgactgccgaagtccgtagtagatccgaccactag

SEQ ID NO: 15534 - DNA, 468 bp, Artificial Sequence
  Description of Artificial Sequence: Synthetic coding sequence
atgaaggtggcctccggatcaaccgccaccgctgctgccggtccttcctgtgctcttaaggcgggcaaaaccgcttcaggagcaggagaagtggtacgatgtctttccgaacaaagcgtagcaatctctaggtgtgccggaggggccggtgccagactccctgctttgcttgatgagcagcaggtgaacgtgctgctgtatgacatgaatggctgctacagcagactgaaagagttagtgccaactcttcctcagaataggaaagtgagtaaggtggaaatattacagcacgtcatcgattacatcagggatttgcaacttgagctcaacagcgagagcgaggtgggcacacctggaggacgggggctccctgtcagagcgcccctgtctaccctgaacggagagatcagcgccttgactgccgaggcggcgtgcgtccctgcagatgaccgaatcctatgccggtag

SEQ ID NO: 15535 - DNA, 738 bp, Artificial Sequence
  Description of Artificial Sequence: Synthetic coding sequence
atggcagcgggtatgtacctggagcattaccttgactccatcgaaaaccttcccttcgagctccaaagaaacttccagcttatgcgcgacttagaccagcgaactgaagatcttaaagcagaaatcgacaagctggccacagagtacatgtcctcagcaaggagtctctcatctgaggagaagttggccttgttgaagcagattcaggaagcctatgggaaatgtaaggagttcggggacgataaggtccagttggcaatgcagacgtatgagatggtggataagcatattagacgtctggatactgacctcgcccgatttgaggcggatttgaaagagaaacagattgagagtagtgactatgattctagctcttctaaggggcgcacccagaaggaaaaaaaagctgcgcgtgccagatctaaaggaaagaattccgacgaagaagcaccaaaaaccgcccagaaaaaacttaagttggttcgaactagtcctgagtacgggatgcctagcgtgaccttcggaagcgtgcatccctctgacgtccttgacatgcctgttgatccaaacgaacctacttactgcctttgccatcaggttagctatggggagatgattgggtgtgataaccctgattgtagcattgagtggtttcacttcgcttgtgtgggcctgactaccaaacctagaggcaagtggttttgtcctcgatgtagccaggaacgaaagaaaaagtag

SEQ ID NO: 15536 - DNA, 840 bp, Artificial Sequence
  Description of Artificial Sequence: Synthetic coding sequence
atgttgtcccccgcgaatggagagcagctgcatctggtcaactatgtcgaggactatttagattctatcgaatctttgcccttcgatctgcaacgcaatgtgtccctgatgcgcgagatcgatgccaagtatcaggagattcttaaggagctggatgagtgttatgaacgcttttcccgcgagacggacggagctcagaaacgccgcatgctacattgcgtgcagagggctttgatcaggagtcaggaactcggcgatgagaagatccaaatcgtttcgcagatggttgaactggtggaaaaccggactagacaggtggattcacatgtggaactttttgaagcacaacaggaattaggggacaccgcgggcaactccgggaaggccggggcggatagacctaagggggaggctgcagcccaggctgataaacctaattccaagagatcacggaggcagcggaacaacgaaaatcgcgaaaatgcttcctcaaaccatgaccacgacgacggcgcctcaggcacaccgaaggagaagaaagccaagaccagcaagaagaaaaaaaggtctaaggccaaagccgagcgggaagcctcccctgcagatttgcccattgaccccaacgagcctacctactgcctctgtaatcaggtgtcgtacggcgagatgataggatgcgataacgacgaatgtccaatcgagtggttccacttcagctgtgtgggcttgaatcataaaccgaagggaaaatggtactgccccaagtgcagaggcgaaaatgaaaagaccatggataaagctctggagaaatcaaagaaggagcgagcgtacaacagatag

SEQ ID NO: 15537 - DNA, 708 bp, Artificial Sequence
  Description of Artificial Sequence: Synthetic coding sequence
atggagatcctgaaggaactcgatgaatgctatgagcgcttcagcagggaaactgatggcgctcagaaaaggaggatgctccattgcgtgcagagagcactgataagatcccaggagctgggtgatgaaaaaatacagattgtgagccagatggtggagctggtggaaaaccggacccgccaagttgacagccatgtagagttatttgaagcccaacaggagttgggcgacacagctggtaattcggggaaggctggggcagataggcctaagggagaagccgccgcacaagccgacaagcctaattcaaaaaggtccaggcgccaacggaacaacgagaacagagaaaacgcatcatctaatcacgatcatgacgacggggcatcaggtactccgaaagaaaagaaagctaaaacctctaaaaaaaagaaacgaagcaaggccaaggctgagcgggaagcaagtcccgcggatctgcccatcgaccctaatgagccaacatactgtctgtgcaatcaggtctcctatggggagatgatcgggtgtgataacgatgagtgtcccattgaatggttccatttcagttgcgtgggactcaaccataaacctaagggtaagtggtactgcccaaaatgcagaggtgaaaatgaaaagaccatggacaaagcactcgagaaaagcaaaaaggagcgcgcttataacagatag

SEQ ID NO: 15538 - DNA, 1269 bp, Artificial Sequence
  Description of Artificial Sequence: Synthetic coding sequence
atgtcattcgtcgagtgtccttaccatagtccagccgaacgcctggtggctgaggctgatgaaggcgggccaagtgccatcacaggcatgggactgtgcttccgctgcctgctctttagcttttccggaaggtccggagtggaaggtggaagggtagacctgaatgtgtttgggagcctgggactccagccctggatcggcagtagcagatgttggggtggaccgtgtagttccgcattacgatgtggctggttttcctcctggcctccaccctccaaaagtgcgatacctataggcggtggctcacgtggagccggaagagtgagtcggtggcccccacctcactggttagaggcatggagagttagtcctctcccacttagccctctcagcccagctacatttggtcggggttttattgcagtcgccgtgatccctgggctgtgggcccgcggacgaggatgcagctcggataggcttcccagaccggctggacctgctcggcgacaattccaggcagcaagtttgctgactcggggatgggggcgagcttggccctggaaacagattcttaaggagcttgacgagtgctacgaaagattttccagagaaactgatggagcccagaagaggcgtatgctgcattgtgtccagagagcgctcattcggtcccaggagctcggggacgagaaaatccagattgtctcacagatggttgaactggttgaaaatcggacgcggcaggtggacagtcacgtcgagctgtttgaggctcagcaggagttgggcgacacagctgggaacagtgggaaggccggagccgaccggccaaaaggcgaggccgccgcacaggccgataagccaaatagcaagcggtcccgccgacaaaggaacaacgagaaccgcgaaaacgcgtcctcaaaccacgatcatgatgatggcgcctccgggacgccaaaagagaagaaggccaagaccagtaaaaaaaagaagcggtctaaggccaaggcagagagagaggcttcccctgccgatctgcctatcgaccctaatgagcccacctactgcctctgcaaccaggtgtcatacggtgaaatgattgggtgtgataacgacgagtgtcctatagaatggtttcacttctcttgcgtcggactcaatcacaaaccaaaaggcaagtggtactgcccgaagtgcagaggcgagaatgaaaaaacgatggacaaagcactcgaaaagtcaaagaaggaacgcgcttataatcggtag

SEQ ID NO: 15539 - DNA, 633 bp, Artificial Sequence
  Description of Artificial Sequence: Synthetic coding sequence
atgctacattgtgtacagagggcactcatcagatcccaggagctgggggacgaaaaaatccagattgtgtcccagatggtcgaactagtggagaatcgcaccaggcaggtcgatagtcatgtcgagttatttgaggcccagcaggaactcggagatacagcaggtaattcaggaaaggcaggggccgaccgcccaaaaggcgaagccgccgcacaagctgacaagcctaacagcaagcgcagcaggcgccagcgcaataacgagaatagggaaaatgcatctagcaatcatgatcacgacgacggagcaagcggcactccgaaagagaaaaaagctaagacgtctaaaaagaaaaaacgaagcaaagctaaagctgagcgggaggcatctccagctgatctgcccatagatccaaatgagccgacatattgcttgtgtaaccaagtcagttatggtgaaatgattggatgcgacaatgatgaatgcccaattgagtggttccacttttcgtgcgtcggactgaaccacaagcccaagggcaaatggtactgtcccaaatgtagaggggaaaatgaaaagactatggataaggcactggaaaaaagcaagaaggaaagagcctataatcggtag

SEQ ID NO: 15540 - DNA, 747 bp, Artificial Sequence
  Description of Artificial Sequence: Synthetic coding sequence
atggctgctggcatgtatctggagcactacctggacagcatagagaacctgccatttgaactccaacggaacttccagctgatgcgggatttggatcaaaggacagaggacctgaaagccgaaatcgacaaactcgccacagaatacatgtccagcgccagatcgctgtcctccgaagaaaaactcgccctgctgaaacaaatccaagaggcttacggcaaatgtaaggaattcggggacgataaggtgcagctggctatgcagacttacgagatggtcgataagcacatacgacggctggatacagatctggctcggttcgaagccgaccttaaggagaaacagattgagtcatctgactatgacagcagctcctcgaaaggaaagaagtctagaactcagaaagaaaaaaaagcagccagggcgaggtctaaaggtaagaactccgatgaggaggcccccaaaaccgcgcagaagaagctcaagcttgtccgcacctcgcctgaatatggcatgcccagcgtaacctttggctccgtgcaccccagcgatgtcctggacatgcctgtggacccaaacgagcccacctattgtctatgtcaccaagtctcctacggcgagatgatcggatgtgacaatcccgactgctcaattgagtggttccacttcgcatgcgtgggattgaccactaagccgcgggggaagtggttttgcccccgctgctcacaggagaggaaaaagaaatag

SEQ ID NO: 15541 - DNA, 750 bp, Artificial Sequence
  Description of Artificial Sequence: Synthetic coding sequence
atggccgcaggtatgtatctggagcactatctggatagtatagagaatttgccgtttgaacttcagcggaatttccagcttatgagagatcttgaccagaggacggaagatctgaaggcggagatcgacaaactcgcgacagaatatatgagttcggcacggtcgctgagctctgaggaaaagctcgccctcctgaagcagattcaggaagcatatggtaagtgcaaggagtttggtgacgataaagtgcaactggcgatgcagacctacgaaatggtagacaaacacatcagacggctggacacggacctggctagattcgaggcggatttgaaggaaaaacaaatagaaagcagcgactatgactctagcagttccaagggcaagaaaaaaggacggactcagaaggagaaaaaagctgctagggcccgaagtaaaggcaagaacagcgatgaggaggcgccaaaaacagcccaaaaaaagctaaaactcgtcagaacaagtccagagtacggtatgccatcggtgacttttggttcggtccatccttctgatgtcttggacatgcctgtcgatccaaatgaaccaacctactgcctatgccatcaggtgtcgtacggggaaatgatcgggtgcgataaccccgattgcagcattgagtggtttcacttcgcttgtgtagggctcaccactaagccgagagggaagtggttttgccctcgatgttctcaggaacggaagaaaaagtag

SEQ ID NO: 15542 - DNA, 741 bp, Artificial Sequence
  Description of Artificial Sequence: Synthetic coding sequence
atggctgcgggtatgtacctcgagcattacctggatagtattgagaacctgccattcgagcttcagcggaatttccaactaatgagagatctggatcagcggacagaggacctgaaggcagaaatcgacaaactcgcgactgaatatatgtcgtccgctcgaagcctgagtagtgaggagaaattagccctgctcaaacagatccaagaagcctatggcaagtgcaaggaatttggagacgacaaagtgcagctagcgatgcagacctatgaaatggtcgacaagcatatcaggagactcgataccgacctggctaggtttgaagctgatttgaaggaaaaacagattgagagttccgattacgacagctccagcagtaaagaaggccgcactcaaaaagaaaagaaagcagccagagctcggagcaaaggaaaaaattccgatgaagaggcccctaagacagcccagaagaagttaaagctggtcagaacctcccctgaatacggcatgccctctgttacttttgggtccgtgcatccctccgacgtgctagacatgcccgtggatcctaatgaacccacctactgtctgtgccatcaggtgtcgtatggagaaatgattggatgcgacaatccggactgtagcatcgagtggtttcactttgcctgcgtcgggctgacgactaagcctcgagggaaatggttctgtcccagatgctctcaagaaagaaaaaagaagtag

SEQ ID NO: 15543 - DNA, 540 bp, Artificial Sequence
  Description of Artificial Sequence: Synthetic coding sequence
atggccgccggtatgtatctggagcactacttggattctattgaaaacctgccattcgagctccagcgcaactttcagttaatgcgcgacctggatcaacggacagaagatttaaaggctgagatcgacaagctcgctacggagtacatgagtagcgctcggagtctttcctcagaggaaaagctcgccctgttgaagcaaattcaggaagcctatggcaagtgtaaagagttcggcgatgacaaagtgcagctcgcaatgcagacgtacgaaatggtcgacaagcatattagaaggctggataccgatctcgcccggttcgaagccgacctcaaagaaaagcagatcgagtcatcagattatgattcttccagttctaaggggaaaaagaaaggacgcacgcaaaaggaaaagaaggctgcaagggctcgttccaaggggaagaacagtgacgaggaggcccctaagacagcacagaaaaagctcaagttagtccggaccgtcccgttatccggctccatcctccctgtgtggggatag

SEQ ID NO: 15544 - DNA, 678 bp, Artificial Sequence
  Description of Artificial Sequence: Synthetic coding sequence
atggcagctggcatgtacctcgagcactatctggataaccttaaagccgagatcgacaagttggccaccgagtatatgagcagcgcaagatccctgagctcagaggaaaagctcgcgctgctaaagcagatccaggaagcgtatgggaagtgtaaagagtttggcgacgataaagtgcagctagccatgcagacctacgaaatggtagataaacatattagaaggttagacaccgatttagccaggtttgaggcagacctaaaggagaaacaaattgaaagcagcgattatgacagctcctccagtaaaggcaagaaaaagggaaggacccagaaagagaaaaaggcagccagagctcgatctaaggggaaaaactcggacgaggaggcacccaagacggcccaaaagaagctcaagctggtgagaacctctcccgaatacggaatgccttccgttaccttcggctccgttcacccgtccgacgttctggatatgcccgtggatcctaacgagccaacatactgtttgtgccatcaggtatcctacggggagatgatcgggtgtgacaaccccgattgctctattgagtggttccattttgcctgcgtggggctgaccaccaaaccccgcggcaagtggttttgtccacggtgcagtcaagagaggaagaaaaaatag

SEQ ID NO: 15545 - DNA, 3729 bp, Artificial Sequence
  Description of Artificial Sequence: Synthetic coding sequence
atggcctccccccccgaatcagatggattctccgatgttcgcaaggtgggctatctcagaaagcctaagagtatgcataaaagatttttcgtgttgagggcagctagcgaagcaggcgggcctgcccgcctggaatactacgaaaatgagaaaaagtggcgacataaatcttcagctcctaagcggtctatcccattggagtcctgctttaacatcaacaagagggcagactccaagaacaagcatctagtagcgctgtacactcgagacgagcacttcgctatagccgcggactccgaggcagaacaggattcttggtatcaagccctgctgcagctgcataaccgggccaagggtcaccacgatggcgccgccgctcttggagccggtggtggcgggggctcatgtagcggatccagtgggctgggggaggccggggaggacctgtcatacggagacgtgcctcccgggcctgctttcaaggaggtatggcaggtgatactgaaacctaagggactcgggcaaacaaagaacctgatcgggatctacagactgtgtctgacgtccaagaccatctcattcgtcaagctgaattctgaggcagctgctgtagtgcttcagttgatgaacatccgtagatgtggccattctgaaaactttttctttatcgaagtgggccggagcgcggtaaccggcccaggcgagttttggatgcaagtcgacgacagtgtggtggctcagaacatgcacgagactattcttgaagcaatgagggcaatgagcgacgagttcagacctagatccaaaagccagagctcatcaaattgcagcaacccgattagtgtgcccctgcgtcggcaccacttgaataacccaccaccaagccaagtaggcctcacccggcggtcccgtaccgagtcaattactgccacctcacctgcctcaatggtgggagggaagcccggctcctttcgtgtccgtgcatcgtcagatggcgaagggacgatgtcacggcctgccagcgtcgacggtagtcctgtgtccccatcaaccaaccggacccacgcccacaggcaccggggaagcgctaggctgcatcccccgcttaaccacagccgatctatcccgatgcccgcaagtaggtgtagcccttccgccaccagtcccgtaagcctatccagttcttccacgtccggtcatgggtccacatccgattgcctgtttccaaggaggtcgtccgccagcgtttccggcagccctagcgacggtggattcatatcatccgacgagtatggctcctcaccctgtgatttcaggagttccttccgtagcgttacaccagacagtcttggccacacgcctccagctagaggcgaggaagagcttagtaattacatctgcatgggggggaaaggaccttctaccctgactgccccgaatggacactacattctgtccagaggcggaaatgggcacaggtgtacccctgggacaggtctgggaactagccctgcactggctggcgacgaggccgcctccgccgccgacctggacaacagattcaggaagagaacacactctgccggtaccagccccacaatcacccaccaaaagacccctagccagagtagcgtagcaagcatagaggagtataccgagatgatgccggcctaccctcccggaggaggttccggcggacgcttgccgggacaccggcatagcgccttcgtgccgacaagatcatatcctgaggaagggcttgaaatgcacccactggaaagacgaggcggccatcaccgaccggattcctcaaccctgcacaccgatgacggctacatgcctatgtcacctggcgttgcgcctgttccaagtggtcggaaggggtctggggattacatgcctatgtcaccaaagagcgtttcagcaccacagcagatcatcaatccaatccgacgccatcctcaacgggtggatcccaacggatacatgatgatgagccctagtggggggtgtagccccgatataggaggcgggcccagcagttcatcctcatcttctaacgcagtcccctcaggtacttcctacggaaaactgtggacaaatggcgttggggggcaccactcccatgtcttaccacacccaaagcctcctgttgagagcagtggtgggaaactgctgccttgcactggggactatatgaacatgtccccagtaggagattcaaatacttcctccccttccgactgctactatgggcccgaggatccgcagcataagccagtattatcgtactattccctgccacgatcgttcaagcacacacagaggccaggggagcccgaagaaggggcacgtcaccaacatttgcggttgtctacttccagcggccggttgctttatgcagccactgctgatgacagctcatcctcaacgtcctccgacagcctgggcggcggctattgtggcgccaggttagagccctctttgcctcatccccatcaccaggtcctgcaaccacatttacctcgaaaagtagacacggccgcccagactaatagtagactggcacgacccacccggctcagtctcggggatcccaaggcttccactctgccgagggctagggaacaacagcaacagcaacagcctctgctgcatccgcctgagccaaaaagccctggagagtatgtcaacatcgaatttgggagcgaccagtcgggctacctctctggccccgtcgcctttcacagcagccctagtgtgaggtgcccctcacaactccaaccagccccccgggaagaggaaactggtacggaggagtacatgaaaatggacctgggccctggccggagagctgcctggcaagagagtacaggagtggaaatgggaaggctaggacctgcaccacccggggccgccagcatctgtagacccacacgcgccgttccttcctcacgcggcgactacatgactatgcaaatgagctgccctagacagtcttatgtcgacacaagccctgcagctccagtgtcctatgcagatatgcgaaccggcatagctgccgaggaggtaagcctgcccagagctactatggcagccgcatcctccagtagtgcggcatctgctagtccaaccggacctcagggagctgcggagctggcagcccactccagtttgcttggtgggccccagggacccggtggcatgtcagctttcaccagagtgaatctatctcccaacagaaatcagagtgctaaagtgattagagccgatccccaggggtgtagacggagacacagctctgagaccttttccagcactcctagcgccactagagtgggtaacaccgtgcctttcggcgccggggctgctgtcggtggaggagggggaagttcctccagctcggaagatgttaagagacactccagtgcaagctttgagaatgtgtggttgagaccgggtgaactcgggggtgccccaaaagagcccgcaaaactttgtggtgccgctgggggcctcgagaatggacttaattatatcgacctcgacttggtgaaggattttaagcaatgtccccaagagtgcacgccagagcctcaacccccaccgcccccccctcctcatcaaccgctcggctctggcgaatcttctagcacgcgccgatccagtgaagatttaagcgcatatgcctcaattagtttccagaagcagcctgaggaccgccaatag

SEQ ID NO: 15546 - DNA, 588 bp, Artificial Sequence
  Description of Artificial Sequence: Synthetic coding sequence
atgggcaaaatctcatccctccctactcagttatttaagtgttgtttctgcgactttttgaaagtgaagatgcatactatgtccagttctcacctgttttacttggcgctgtgtctgcttactttcaccagttccgcaactgctggaccagagactctgtgtggagctgagctggtagacgctctgcagttcgtgtgtggagaccgggggttttattttaacaaacccactggatacggttcttcatcgcgtcgggccccccagacagggattgtggatgagtgctgttttcggagctgcgacctgcgaaggctggaaatgtattgcgcacccttaaagccagctaaatccgcgcggtccgtccgcgcgcagcgacacacagacatgcccaagacgcagaaataccagcccccttcaaccaataagaacaccaagtcccagagaaggaagggttggcctaagacacatcctggcggcgaacagaaggagggcaccgaagcatcgctgcaaatccggggaaaaaagaaggagcaaagacgggaaatagggtctcggaatgccgagtgtagaggtaaaaagggaaagtag

SEQ ID NO: 15547 - DNA, 462 bp, Artificial Sequence
  Description of Artificial Sequence: Synthetic coding sequence
atgggcaaaattagctcgttgccaacacagctcttcaagtgctgtttctgcgactttcttaaggttaagatgcacactatgtcatcctctcacctgttctacctagccttgtgcctgcttacattcaccagttccgccaccgccgggccggaaaccctgtgcggagctgagctggtggacgctctccaatttgtgtgcggagatcgtggattttattttaacaagccaacgggctatggttctagtagccggagagccccacaaaccgggattgtcgacgagtgctgcttcagatcctgcgatctgagacggctcgagatgtactgcgctccactgaaaccggcaaaatctgcacgaagtgtcagagctcagcgccataccgatatgccgaaaacccagaaggaagtgcatcttaaaaatgctagccgcggctctgcaggcaacaaaaactatagaatgtag

SEQ ID NO: 15548 - DNA, 477 bp, Artificial Sequence
  Description of Artificial Sequence: Synthetic coding sequence
atggggaagatttcctccctcccaacccagctgtttaagtgctgtttttgcgatttcctgaaggtgaagatgcacaccatgtcctcctctcacctgttttacctcgccctgtgcctcctaactttcacatcctccgcaactgccgggcccgagacgctctgtggagctgaattggtggacgcccttcagtttgtatgtggggatcgcggcttctactttaataagccaaccggctacggatcttcgagtagacgagcaccacaaaccggaatcgtcgatgagtgctgtttccgatcatgtgatctccgcagactggagatgtattgcgcacctctcaagccagccaagtccgcaaggtcggtgcgcgcccagcggcacaccgacatgcctaagacacagaaatatcagcccccctcaacaaataaaaacactaaaagtcaacgtcgcaaaggcagcactttcgaagagcgcaaatag

SEQ ID NO: 15549 - DNA, 420 bp, Artificial Sequence
  Description of Artificial Sequence: Synthetic coding sequence
ttgaaggtgaaaatgcacaccatgagctcttcacacctcttctatctcgccctgtgcctgctcaccttcacgagttctgccaccgccggaccagaaaccctgtgcggcgcggagctcgtggatgcactgcagttcgtttgcggcgacagagggttctattttaataaaccaaccggatacgggtcttcctcccgaagagctccgcagacaggcatcgtggacgagtgctgtttccgatcatgtgatttacgacggctggagatgtactgcgcaccgctgaagcctgccaagtccgctagatctgtacgtgcccagcgccacacagacatgccaaaaacccagaagtatcagccgccatccacgaataagaacaccaaaagccagaggagaaagggcagcacattcgaagagcggaagtag

SEQ ID NO: 15550 - DNA, 414 bp, Artificial Sequence
  Description of Artificial Sequence: Synthetic coding sequence
atgattacgccgacagtaaaaatgcatactatgagctctagccatttgttctaccttgccctttgtctgctgaccttcacttcctctgcaaccgctggccctgagaccctttgcggcgcggagctcgtggacgccttgcagtttgtgtgtggcgaccggggattttacttcaacaagcctacaggatatggatcttcttctagacgcgcgcctcagaccggcattgtagacgagtgctgctttaggtcgtgcgatctgcggaggctggagatgtattgtgccccgctaaagccagccaaaagcgcacgaagcgtgcgagctcagaggcataccgatatgcctaaaacccaaaaagaggtgcacttgaaaaatgcatctcggggaagcgcaggcaataaaaactataggatgtag

SEQ ID NO: 15551 - DNA, 477 bp, Artificial Sequence
  Description of Artificial Sequence: Synthetic coding sequence
atgggtaaaatcagcagcctccccacacagctctttaagtgttgtttttgtgacttcttaaaggtgaaaatgcacaccatgtcatctagtcatcttttctacctagccctttgcttactcacctttacaagcagcgccactgctggtccggagaccctgtgtggcgctgagctagtcgacgcactgcagttcgtctgcggggataggggcttttactttaacaaacctaccggatacggatcttcttctcggcgtgcgccccaaactgggatcgttgacgaatgttgttttcgaagttgtgatctgagacgcttagagatgtattgtgcgcccctcaagcctgctaagtctgctcggagcgtgcgtgcccagcgccacactgacatgccgaagacacagaagtaccaacccccctctaccaacaagaacaccaaaagccagcggaggaaaggcagcacctttgaagagagaaaatag

SEQ ID NO: 15552 - DNA, 4104 bp, Artificial Sequence
  Description of Artificial Sequence: Synthetic coding sequence
atgaaatcagggtccggtggcgggtccccaaccagtctgtggggcctactgtttctcagtgctgcgttgtccttgtggccaacatcgggcgaaatttgcggtccaggaattgacattagaaacgattatcaacaactcaaacgcctggagaactgcaccgtgattgagggataccttcacatcctactgatcagcaaggctgaagactatagatcttatcgctttccaaagctgaccgtgataactgaatatctccttttgtttagggtggctggcttggaaagcctcggcgatctgttccctaatctgaccgtgattcggggctggaagctgttttacaactatgcactggtgatcttcgagatgactaatttaaaagacatagggctttacaacttacggaacataactcgtggcgcgatcaggatcgagaagaatgccgacctgtgctacttgtctactgtcgactggtcgttgatcttagacgcagtctctaacaattacatagttggcaacaaaccgccaaaggagtgcggcgacctctgccccggaactatggaggagaagccgatgtgtgagaaaacaacgatcaacaatgagtataactacagatgttggaccaccaataggtgtcagaagatgtgtccttctacatgcggtaaacgcgcctgcacagagaacaatgaatgctgtcatccagaatgtctgggctcctgctccgctcccgataacgacacagcttgtgttgcatgtcgacactattactacgcaggggtgtgcgtgcccgcctgcccccccaacacctatcggttcgagggctggaggtgtgtggatcgtgacttctgtgccaatatacttagtgccgagtcaagtgactccgagggtttcgtgatccacgatggtgaatgcatgcaagagtgcccctccggcttcatccggaacgggagtcagagcatgtactgtatcccctgcgagggcccctgccccaaagtgtgcgaggaagaaaagaagactaagactatagactcagttacaagcgctcagatgctccaggggtgtaccatttttaaagggaacctgttaatcaacattcggcggggaaataacattgcttccgagttggaaaactttatggggctcatcgaggtcgtgacaggctatgtgaaaatcaggcacagccatgctctcgtgtctttgagcttcttgaagaatctgcggttaatactcggtgaagagcaacttgaaggaaactactcattctacgtgctcgacaaccagaacctccagcagctgtgggactgggatcatcgtaatctcacaatcaaggcaggcaagatgtatttcgcctttaatcccaagctgtgcgtatccgagatctacagaatggaggaggtcaccggaactaagggccgccaatccaaaggtgacatcaacacaaggaataacggcgagcgagcctcttgtgagtccgacgtgctacattttactagcaccactacatctaaaaatcgcataattattacttggcatcgatatcggcctcccgattatcgcgatctgatctcctttacggtttattataaggaggccccatttaagaatgtcacagagtacgatggccaggatgcttgtggcagtaactcctggaatatggtagatgtagacttgcctcctaacaaagacgtggagcccgggatcctcctgcatgggctcaagccatggacccagtacgccgtttacgtcaaagctgtaacccttacaatggttgaaaatgatcacattagaggggctaagagcgagatactatacattcgcactaacgcctcagtaccatccatcccactggacgttctgtctgcttccaattcaagctcccagctgattgtgaagtggaaccctccctccttacccaacggcaacctatcctattatattgtaagatggcaaagacagcctcaagacggttatctttaccgtcataactactgttcaaaagacaagatacccataaggaagtacgcagacggtactatagatatagaggaggtgaccgaaaatccaaagacagaagtctgcggaggtgaaaagggcccttgctgtgcttgcccgaaaacggaggctgaaaagcaggctgaaaaggaggaggctgaataccgaaaggtcttcgaaaactttctccataattcaatttttgtgccccgtcccgaaagaaagagacgggacgtcatgcaagtagccaatacaacaatgtcctcccggtcacgaaacactacagcggcggacacctataatataaccgaccccgaggagctggagaccgagtatcccttcttcgaaagccgcgtcgataataaggagagaacagtaatttccaatttacgcccgtttaccctgtatagaatcgatattcactcatgtaaccacgaggcagagaagctggggtgttccgcctccaatttcgtctttgcacggacaatgcccgcggaaggcgccgacgacattccgggtcccgtgacttgggaacctagaccggagaattcaatttttctgaaatggcctgagccagagaaccctaacgggcttatcctgatgtacgagattaagtacggttcacaggttgaggaccagagggagtgtgtgagtaggcaggagtataggaagtacggaggagccaagttgaacaggcttaatccagggaactacacagctaggatccaggctacaagtctaagcgggaacggatcttggactgacccggttttcttctacgtgcaagcaaagactgggtacgagaattttatccacttaattatcgctctgccagtggccgtcctgctcatcgtgggcggcctggtgatcatgctgtatgtgttccaccgtaagcgaaacaacagtcgcttgggcaacggggtcttgtacgcttcagtcaacccagaatactttagtgccgcggatgtgtatgtccccgacgagtgggaggtggccagggagaaaatcacaatgtcccgggaactaggccagggtagcttcgggatggtttatgagggcgtcgctaagggggtggtaaaggacgagccagaaactcgagtcgccattaagacagtcaatgaggccgctagcatgcgggagcgcattgagtttctcaatgaagcctccgtcatgaaagagttcaattgtcatcacgtagtgagactgcttggggtggtgtcccaggggcaacctaccctcgtcatcatggagctgatgacgcggggagacctcaaatcctacctgcgctccctgcggccagagatggagaacaatccagtattagctcccccatccttgtctaagatgatacagatggctggggagatcgccgacgggatggcctacctgaacgccaacaagttcgtgcacagggacctggctgccaggaactgtatggtggcagaggacttcactgttaaaatcggtgactttggcatgaccagagacatttatgagactgattattaccgaaagggtggtaagggccttctgcccgtcaggtggatgtctcccgagtccctcaaggacggagtcttcaccacctatagcgatgtctggagtttcggagtagtgctgtgggaaatcgctacccttgcagagcaaccataccagggcctgagtaacgagcaagtcctcaggtttgtgatggagggcggactactggacaaacctgacaattgcccagacatgctcttcgagctgatgaggatgtgttggcagtataaccctaagatgaggccatcttttctcgaaatcatttcatccatcaaggaggaaatggagcccggcttccgcgaagtgtccttttactactctgaagagaataaattacccgaaccggaggagcttgacctcgagcctgagaacatggaatcagtcccgctggacccgagcgcttcatccagctcactgccgctgcccgataggcatagcggtcacaaagccgagaatggccccggacccggcgttcttgttttgcgggcaagctttgacgaacgtcagccttacgcccacatgaacggcggtcggaagaacgaaagggctttacccctccctcagagcagcacatgctag

SEQ ID NO: 15553 - DNA, 543 bp, Artificial Sequence
  Description of Artificial Sequence: Synthetic coding sequence
atggggattcccatgggaaaaagcatgcttgtgcttcttacctttttggcctttgcatcttgttgcattgccgcataccggccaagcgaaactctctgtggcggcgagctggttgatactctccagttcgtgtgtggtgacagagggttctattttagtaggccagcctccagggtgtctaggagatccagaggcattgtcgaagagtgttgcttccggtcgtgcgacctcgcgttgctggagacctattgcgccactccagctaagagcgagcgcgacgtgagtactccccctacagttctcccagacaactttccccgctatcctgttggcaaattctttcagtacgacacatggaaacaatctacacagaggctcagaaggggattgcctgcactgctgagagcacggcgtggacacgtattggccaaggagctggaggccttcagggaagctaagcgacaccggccactgatcgccctgcccacccaggacccagcccatggcggagcgcccccagagatggcgtcgaataggaagtag

SEQ ID NO: 15554 - DNA, 543 bp, Artificial Sequence
  Description of Artificial Sequence: Synthetic coding sequence
atggggattccgatgggcaagtccatgctcgtattgcttaccttcctggcatttgcaagctgctgcatagcagcttacagaccctccgaaaccctctgtggtggggagttggtggacactttgcagttcgtgtgtggcgaccgagggttctattttagtcgaccggctagccgggtttccaggcggagcagaggcatcgtggaggagtgctgctttcggtcctgtgatctcgccctgctcgagacatactgtgcgactcctgcaaaatctgaaagagacgttagtacccctcccaccgtactgccagataatttcccccgataccccgtgggaaaattctttcagtatgatacctggaagcaatccacccagcgcctgcgcaggggcctgcctgccctgctacgcgcaagaagagggcacgtactggccaaagagctggaggcattccgtgaggcaaaacggcaccggcccctcatagccctgcccacacaggaccctgcccacggtggcgccccccccgaaatggcctccaataggaagtag

SEQ ID NO: 15555 - DNA, 552 bp, Artificial Sequence
  Description of Artificial Sequence: Synthetic coding sequence
atgggcataccaatgggcaaatctatgcttgtgctgctgacttttctcgcctttgcatcttgctgtatcgcggcgtacaggccctctgagactctctgtggtggcgaattagtcgacacgctgcagtttgtgtgtggcgacagaggattctacttcagattgccagggaggcccgcttcccgggtgtcacggcgcagcagaggcatcgtcgaggagtgctgcttccgctcctgcgacctcgccttgcttgagacttactgcgccactcccgccaagagcgagagggacgtgtccactccaccgacagttttaccagacaattttcctcgctatcccgtcggaaaatttttccagtacgacacctggaagcagagtacccaaaggctccgcagaggtctccccgcccttctccgtgcgcggcggggccacgtcctggctaaagagttggaggcattcagagaggctaagcgccaccgacccctgatcgccctccccacccaggatcctgcacatggaggggcaccgcctgagatggcttctaacaggaaatag

SEQ ID NO: 15556 - DNA, 552 bp, Artificial Sequence
  Description of Artificial Sequence: Synthetic coding sequence
atggggattccaatgggcaagagtatgctggttctgctgaccttcttagctttcgcttcatgctgtatcgccgcgtatcgcccctctgagacactctgtggcggagagctggtagacacactgcagttcgtgtgcggagatagaggcttctatttccggctccctggccggcccgcttctagggtcagtcgacggtcccggggaattgtagaggaatgctgctttcgcagttgcgacctcgcgctgctggagacctattgcgctacaccagccaaatccgagagagacgttagtactccacccacagtgttgccagataacttcccacggtatcctgtcgggaagtttttccagtatgacacctggaagcagagcacccagcgtttgagaaggggtctgccagctctcctgcgtgcccgacgggggcatgtgcttgctaaagagctagaagccttcagggaggccaagcgccacaggcccctaatagccctccccacacaggatccggcgcatggaggagccccccctgaaatggcttcaaacagaaaatag

SEQ ID NO: 15557 - DNA, 543 bp, Artificial Sequence
  Description of Artificial Sequence: Synthetic coding sequence
atgggcattcctatgggaaaatcgatgctggtgctgctgacattccttgcgtttgcttcttgttgtatcgctgcgtaccggccttcggaaactctgtgcggtggtgagctggttgacactttacagttcgtatgcggcgatcgcgggttttattttagcaggccggcctccagggtgtctagacgctccagaggcatagtggaggagtgttgcttccgctcttgcgatctggcactcttggagacctactgtgcaaccccggctaaatcggagagagacgtgagcacaccccctacagtattgcccgacaatttcccaaggtatccagtcggaaaattcttccagtacgacacctggaagcagagcacgcagaggctgagacgcggccttcctgccctactaagagcacgccgcgggcacgtgttagccaaagagttggaagcattcagagaggccaagcggcacagaccactgattgccctgccaacccaggaccccgcacatggtggcgcaccacctgagatggcctccaatcgaaagtag

SEQ ID NO: 15558 - DNA, 552 bp, Artificial Sequence
  Description of Artificial Sequence: Synthetic coding sequence
atgggcatcccgatgggcaaaagcatgctggtgttactgacattcctggcgttcgcaagctgctgtatagcagcgtaccggcctagcgaaacactgtgcggtggagagcttgtagatacattgcagtttgtgtgcggagataggggcttttacttcagattgccggggagaccagcatccagggtatctcgtaggtcacgtgggatcgttgaggaatgctgctttaggagctgtgatcttgcactgctagagacctattgcgccaccccagctaaatccgagcgtgacgtaagcactcccccgacagttttgccagacaatttccctagataccccgttggaaagtttttccagtatgatacatggaagcaatccacccaacgcctgaggagaggattgcccgctctgctcagggcaagacggggccacgtcttagcgaaagaactggaggccttccgcgaggcaaagcggcatagacctctgattgcactgcccacacaagatcctgcccatgggggcgccccccccgagatggcgtctaatcggaagtag

SEQ ID NO: 15559 - DNA, 543 bp, Artificial Sequence
  Description of Artificial Sequence: Synthetic coding sequence
atgggaatcccaatggggaagtctatgctagttctgttgacattcctggcatttgcctcttgctgtatcgccgcctacagaccttccgaaacactctgtgggggagagctggtggacaccctgcagtttgtgtgtggggatcgaggcttttatttctcccgcccggcatctcgggtttcccgtagaagccgcggaatcgttgaggagtgctgttttcgctcctgtgaccttgcacttctggagacctactgtgctactcctgccaagtcagagagggacgttagtaccccacctactgttctgcccgacaactttccacggtacccagtgggaaagttttttcagtacgatacctggaaacagagtacccagcgcttacggcgcggactgcccgctctcctgcgggcacggagggggcacgtgctggccaaggagctggaggcattcagggaggccaaaaggcaccgacccttgatcgcactgcctactcaagacccagcacatggcggagctccaccagagatggcctcaaatagaaagtag

SEQ ID NO: 15560 - DNA, 552 bp, Artificial Sequence
  Description of Artificial Sequence: Synthetic coding sequence
atgggcattcccatggggaaatccatgctagtcctgttgaccttcttagcattcgcttcttgctgtatcgccgcctatcgtccgagcgagaccctgtgtgggggagagctggttgacactcttcagttcgtttgtggggatcgcggtttttatttccgcctgccggggcggcccgcctccagagtgtcgcgcaggtcacgggggatcgtggaggagtgctgcttccgaagctgtgatctcgctcttttagaaacctattgtgcaacccctgcaaagagcgagcgcgacgttagcactcccccaacagtcctccccgacaattttcctagatatcctgtgggcaaattctttcagtatgatacctggaagcagtcgactcagcgcctgcgccgcggcctgcccgccctgttacgtgctaggagagggcacgtgctggcgaaagagttggaagccttcagggaagcaaagcgccacaggcctctcatcgcccttccaactcaggaccctgcccacggaggcgccccacctgaaatggcctccaatcgtaagtag

SEQ ID NO: 15561 - DNA, 543 bp, Artificial Sequence
  Description of Artificial Sequence: Synthetic coding sequence
atggggatccctatgggcaaaagcatgttagtgctgcttaccttcttggcatttgcaagctgctgcatcgcggcgtatcgcccctcagagacgttatgcggaggtgaactggttgatacgcttcagttcgtttgcggagataggggcttctattttagccggcccgcctcccgggtctcacgacgatctagaggcatagtcgaggagtgctgttttcgctcatgtgacctcgcactcctcgaaacgtattgtgccactccagccaagagtgagagggacgtgagcacccctccgaccgttctgccagacaattttccacgatacccagtggggaagttctttcagtacgatacatggaaacaatcaacacagcgtctgagacgcgggctgccagctctcctgagagccaggagagggcatgtgctcgctaaagaactcgaggcatttagagaggctaagaggcatcgtcctcttatcgcactgcccacacaagaccctgcacatgggggggcaccacccgaaatggctagtaatcgcaaatag

SEQ ID NO: 15562 - DNA, 543 bp, Artificial Sequence
  Description of Artificial Sequence: Synthetic coding sequence
atggggatccctatggggaaatctatgttggtgttgctaaccttcctagccttcgccagctgctgcatagctgcctatcgaccgtctgaaacactgtgcgggggcgaactagtggatacccttcagttcgtgtgtggggataggggattttatttttctcgacccgctagtagagtcagccggaggtcacgtggcatagtcgaggaatgttgctttcgttcctgtgacctcgccctgctcgaaacatattgcgccacgccagccaaatccgagcgcgatgtgtctacacctcccacagttcttcctgataatttccctcgataccccgtgggcaaattcttccagtatgacacttggaaacagagcacacagcgcctacggagaggcctcccggccttactgagagcccgcagggggcacgtgctcgctaaagaattggaggcgttccgggaggcgaagcgccatcggcctctgattgcgctgcccacacaggatccagcccatgggggtgcaccaccagaaatggcctctaatagaaagtag

SEQ ID NO: 15563 - DNA, 711 bp, Artificial Sequence
  Description of Artificial Sequence: Synthetic coding sequence
atggtctccccagacccgcaaattattgtggttgcccctgagacggaactggctagcatgcaggtgcagcgcaccgaggacggcgtgacaattattcagatcttctgggtcggccgcaaaggcgaactactgcgcaggactcctgtgagtagtgcgatgcagactcctatgggtatcccgatgggcaagagcatgctcgtactgctgacgtttttagcatttgcgtcttgttgtatcgccgcttatcggcccagtgagacactgtgcggaggtgagcttgttgacacccttcagttcgtttgcggggacaggggcttctattttagccggccagcttcccgagtgagtcgccggtcccggggtattgtggaagaatgctgcttccgcagctgcgacctcgcacttctcgagacatattgtgcaactccagctaagagtgagcgtgacgtgagcactcctcccaccgtcttgcccgataatttccctcgctaccctgtgggaaagttctttcagtacgatacctggaaacagtcaacccagaggctgagacgtgggttgcctgcactgctcagggctagacggggccatgttctcgccaaggagcttgaggcttttcgcgaggccaagcggcacagaccactcattgcactccctacccaagatccggcccacggcggcgcaccccccgagatggcctctaatcgcaaatag

SEQ ID NO: 15564 - DNA, 876 bp, Artificial Sequence
  Description of Artificial Sequence: Synthetic coding sequence
atgcagagagctcgtcccactctgtgggctgctgcccttacgttgttggtcctgctaaggggaccccccgttgcaagagctggcgcgagcagcgccggcctcggaccagtcgtcagatgtgaaccttgcgacgcacgggccctggcccagtgtgctccaccgcctgccgtgtgcgcagaactggtcagggagcccggttgtggctgttgtcttacttgcgctctgtccgaagggcagccctgtggcatttacacagagagatgtggtagtggcctgagatgccagccctccccagatgaggctcgccctctgcaagcccttttggatgggcgtggactgtgcgtcaatgcctctgccgtgtcgagactgagagcatatctgctgcctgctccccccgcgccagggaatgccagcgaatccgaagaggataggtccgcgggttctgtggaatcaccttcggtgtcttctacccaccgggtgtccgaccccaagttccaccctcttcattccaagataattatcattaagaagggccacgccaaggacagtcaaagatataaggtggactacgagtcccagtcgacagatacacagaacttctcttctgagagcaagcgcgagactgagtatggaccatgcagaagagagatggaggataccctgaaccatctgaaatttctgaacgtgttgtcccctcgaggagtacatattccaaactgcgacaagaagggcttctataagaagaagcagtgtcggccaagcaaaggccgaaagcggggattttgctggtgcgttgacaaatatgggcaacccctccctggatacaccaccaaaggaaaggaggacgttcactgctatagcatgcagtctaaatag

SEQ ID NO: 15565 - DNA, 894 bp, Artificial Sequence
  Description of Artificial Sequence: Synthetic coding sequence
atgcagcgtgccagaccaactctgtgggcggcagctctgactttgctggtgcttctgcgcggaccccccgtggctagagcaggagccagctcagccgggctgggcccagtggtgaggtgcgagccctgtgacgcacgcgccctagctcagtgcgccccacctcccgccgtgtgtgctgaactggtgagggaacccggttgcggttgctgtttaacttgtgcgctcagcgaggggcagccttgtgggatctataccgaacgctgtgggagtgggctacggtgtcagccctctcctgatgaggccaggcctctgcaggctctcctcgatggaagaggtctctgtgtgaacgcgtcggcggtgtcgcgcttgagagcttaccttctgcctgctccaccagcccctggggaacctcctgcccccggaaatgcatctgaatctgaagaggatcggtccgctggctccgttgagtcccccagcgtcagctcaacccatagagttagtgatcccaagttccacccgctgcactcaaaaattatcattatcaagaagggacatgccaaagacagccagcggtacaaggtggattatgaatctcagagcactgacacccagaactttagcagcgaatctaagagagaaacagagtacgggccttgccggcgcgagatggaggacactcttaatcatctcaaattcctgaatgtgttgtcccctcgaggcgtacacatccccaactgtgataaaaaaggtttctacaagaagaagcagtgtaggcccagcaagggacgcaaacggggcttctgctggtgtgttgacaaatacggccaaccccttccaggctacacaaccaaagggaaggaggacgtacactgttactcaatgcaatctaagtag

SEQ ID NO: 15566 - DNA, 585 bp, Artificial Sequence
  Description of Artificial Sequence: Synthetic coding sequence
atgcagcgcgccagacccttgcaggcactattggatggaagaggactttgcgtcaatgctagtgctgtgagtagactgcgggcctacttactgccggccccccccgcgcccggtaatgctagtgaatctgaggaagaccgcagtgcgggctccgtagagagtccttccgtaagttctacacaccgggtgtcagatcccaagtttcatcctctgcacagtaaaattatcattattaagaaaggccacgcgaaagactcccagagatataaagtcgattacgagtcccagagcactgatacccagaactttagctctgagtccaaacgagagaccgagtatggcccatgcaggcgggagatggaggacactctgaatcatctgaaattcctaaatgtgctgtcaccgcgcggcgtgcacatacctaactgtgataaaaaaggattctacaagaagaagcagtgtagaccttccaaaggccgaaagaggggattctgctggtgtgtagataagtatggccagccgctgcctggatatacaactaaaggaaaagaggacgtgcattgttactcaatgcagagcaagtag

SEQ ID NO: 15567 - DNA, 462 bp, Artificial Sequence
  Description of Artificial Sequence: Synthetic coding sequence
taaagcgaggaggatagatctgcaggaagcgttgagagtccttctgtgtcctcaacgcacagagtgagcgacccaaagtttcaccccttgcactccaagattattattattaagaaagggcatgctaaagactcacaacgttataaggttgactacgaatcccagtcaactgacactcagaatttttcaagcgagtcaaaacgtgagaccgaatatggcccttgcaggcgtgaaatggaagacacacttaatcacctgaaatttttaaacgtcttgagtcccagaggagtgcatatccccaactgcgataagaagggcttctataagaagaagcagtgtcgtcccagtaagggcagaaagcggggattctgctggtgcgttgataagtacggacagccgttacccgggtacactaccaagggaaaagaggatgtccattgctactccatgcagtccaaatag

SEQ ID NO: 15568 - DNA, 432 bp, Artificial Sequence
  Description of Artificial Sequence: Synthetic coding sequence
tgagagtcccctagcgtgtcctccactcaccgggtgtcagaccccaagttccatcctttgcactccaaaattataatcataaagaaaggacatgccaaagatagccagagatataaagtggattatgagtctcagtcgaccgacacacaaaatttttctagcgaaagtaagagggagactgaatatggaccatgtaggagagaaatggaagatacactgaaccacctcaagttcctgaatgtgctctcacccaggggggtccacattccaaactgcgacaagaagggcttctataaaaagaaacagtgcaggccgtccaaaggcaggaagagagggttttgttggtgtgtggataagtatggccagcctctgccggggtacaccactaagggcaaagaggatgtgcattgctatagtatgcaatccaaatag

SEQ ID NO: 15569 - DNA, 792 bp, Artificial Sequence
  Description of Artificial Sequence: Synthetic coding sequence
atgcagagggcacgtcccaccctctgggcagcctgtgagccatgtgacgcacgggcacttgcacagtgcgcaccgcccccggccgtttgcgccgaacttgtgagagaaccgggatgtggctgctgcctgacctgcgccctgtccgaaggacagccatgcgggatctatacggaacgttgtgggtcaggacttcggtgtcagccgtctcccgacgaagccagaccgctacaagcattattggatggaagggggttgtgcgtgaacgcctccgcagtgtctcgcttaagggcatacttgcttcctgccccccccgctccggggaacgccagtgagtccgaagaggacaggtctgccgggtctgtcgaatcaccatctgtgtccagcactcacagggtaagtgatcctaagttccacccccttcactctaagatcattattattaagaagggacacgctaaggattcacagaggtacaaggtagattatgagagccaaagtacggatacacagaacttctcctcggagagtaagcgtgagacggagtacggtccctgtcgccgggaaatggaggacaccttaaatcatctcaaattccttaatgtcctgtctcccagaggagtgcatatccccaactgcgataagaagggcttttataaaaagaaacaatgccgtccaagcaaaggacgtaagcgaggcttttgctggtgtgtggacaaatacggccagcctctccccgggtacaccacaaaaggtaaggaagatgttcattgctatagcatgcagagcaaatag

SEQ ID NO: 15570 - DNA, 834 bp, Artificial Sequence
  Description of Artificial Sequence: Synthetic coding sequence
atgagagccctgcgacttggggcggaagatcaacctctcccagcttggattccccagctgcgtgccgtctattgccgtcctatccccgccaggcctgcatgtcaggccgcgtgtcctggctgtagacggcatgccgccggggccacccatgccctgggccggtgcgccgacagcgccggggctgcgccgagggctgccggcggggccggttggagggagctggggggactcggcagccgaggtgctctgcgggccgtacgccatcttcaccgggcacttctggacgggcgaggcctctgtgtgaatgcctcagccgtgtcacgcctccgcgcctacctgctgccagctcccccggcgcccgggaacgcatcagagagtgaagaggatcgtagcgctggttctgtggaaagtccctctgtctcatccacccatcgagtttctgacccaaagtttcatcctctacatagtaagataatcatcatcaagaaaggccacgccaaagactcacagcgctataaagtcgattacgagagtcagtctactgatacacagaactttagctcagagagtaagcgggagacagaatatggaccctgccggagagagatggaagatacattaaaccatctgaaatttcttaatgtcctatctcctcgaggggtccacattcctaactgtgataagaaaggattttacaagaagaagcagtgtaggccttcgaaagggcgcaagcgcggtttctgttggtgcgttgataagtacggacagcccctgcctgggtacacgacaaagggtaaagaggatgtacattgttattcaatgcagagcaagtag

SEQ ID NO: 15571 - DNA, 570 bp, Artificial Sequence
  Description of Artificial Sequence: Synthetic coding sequence
atgcaacgcgcccgccccactctgtgggccgctgcattgacattattagacggcagaggcctgtgcgcctaccttctgcctgcaccacccgcccccgggaatgccagcgaatccgaggaagatcgatcagcagggagcgtggagtctcccagtgtctcctccacccatagggtgtccgaccccaagttccatccattgcattcaaagatcattattattaagaagggacacgccaaggattcacagaggtataaggtcgattacgaatcacaatccacggatacccagaacttcagtagcgaaagcaaacgggaaactgaatacggaccttgtcggcgggagatggaggataccctgaatcacctcaaattcctaaacgtactaagtcccaggggagtccacatccctaactgcgacaaaaagggattttacaaaaagaagcagtgccgaccttccaaaggaaggaagagaggcttttgttggtgtgttgacaagtacgggcaaccgctgcctggttataccacgaaggggaaagaggatgtacactgttacagcatgcagtcaaagtag

SEQ ID NO: 15572 - DNA, 807 bp, Artificial Sequence
  Description of Artificial Sequence: Synthetic coding sequence
atgcagcgcgcaagaccaaccctttgggcggccgccctgactctcctcgtgctgctcagaggacctcctgttgctcgggcaggggcttcatcagccggactgggtcccgtagtgcgtcgcgaacccgggtgcggatgctgcctgacatgcgccttgagcgaaggacagccctgcgggatctataccgaacgctgtggtagcggtctgagatgccagccttcacctgacgaagcccggcccctccaggccctgcttgacgggaggggactgtgtgtgaacgcctcggctgtttctcgcctgcgcgcttacctcctgccggctcccccggcgcctggaaacgctagcgagtcagaggaggacagatccgccggctccgtggaatctccttccgtcagcagcacccatcgggtatccgatcctaagttccacccccttcactccaagattatcattattaaaaaggggcacgccaaggactcacagagatataaggtggactatgaatcccaatctaccgacacacagaatttctcttccgagagtaaaagggagactgagtatggcccctgccgtagagagatggaggacacactgaatcacctcaagttcctcaacgtcctcagcccacggggagtgcatatcccgaactgcgacaaaaaaggtttctacaagaagaagcagtgcagaccaagcaagggcagaaagcgcgggttttgctggtgcgtagataaatacggacagcctctcccgggatatacaaccaaagggaaggaagacgtgcactgctactccatgcagagtaaatag

SEQ ID NO: 15573 - DNA, 978 bp, Artificial Sequence
  Description of Artificial Sequence: Synthetic coding sequence
atgcttcctcgagtcggctgtcccgccctgcccctgcctccccccccacttcttcccctgctattgctgctgctcggagctagcggagggggaggtggcgcacgcgcggaagtcctgtttaggtgtccaccctgtacacctgaaaggctggccgcctgtggcccgcctcctgtggctccgccagccgccgtagcagccgtggcgggtggcgctaggatgccttgtgcagaactggtgcgggagccaggctgtgggtgctgttctgtgtgcgcccggctggaaggagaggcgtgtggcgtgtataccccacgctgtggccaaggcctgcgatgctacccgcaccccggctccgagcttccactgcaggcactggtgatgggagagggaacttgcgagaagcgacgagacgctgagtacggtgcatctcccgaacaagtggccgataatggggatgatcattcggaaggagggctggtggagaatcatgttgacagtactatgaacatgctcgggggaggtggaagcgcaggtcggaaaccactgaagagcggaatgaaggagctcgccgtctttagggaaaaagtcacagagcagcaccgccagatgggcaaaggaggcaaacatcacctggggctagaagaacccaaaaaactaaggcctccccctgcccgcactccttgccagcaggaactggaccaggtcctcgagcggatatccaccatgcggctcccagacgagagaggacccctagaacacctgtattctctgcacatccctaactgtgataaacatggcctgtacaatctgaaacagtgcaaaatgagcctgaacggacagaggggggaatgctggtgcgtcaaccccaacactggcaagttgattcagggagcccctaccattcgtggcgatcctgagtgtcacctcttttataatgaacaacaggaagccagaggcgtgcacacacaacgaatgcaatag

SEQ ID NO: 15574 - DNA, 3099 bp, Artificial Sequence
  Description of Artificial Sequence: Synthetic coding sequence
atggcctgggaggccagacgggagcctgggccccggagggcagcagtgagggaaacagtgatgcttctgctgtgcctgggcgtccctaccggccgaccctataatgttgacacggaaagcgctctgctctaccagggtccccataatactctgttcggctattcagttgtcttgcattcccacggtgcaaatcggtggttgctcgtgggcgccccgacagccaattggctagcgaacgcatccgtgatcaacccaggagctatctaccgatgtcgcattggaaagaatcctggacagacatgcgaacagctgcaactcggctctcctaacggcgagccctgtgggaagacatgcttagaggaaagggacaaccagtggctcggggtgacacttagccgccagcccggagaaaacggatccattgtgacttgcggacaccggtggaaaaacatattttacatcaagaacgagaataagctgcctacagggggatgctacggtgtgccaccggacctgaggactgaactgtctaagcgcatcgcgccctgctaccaggactatgtcaagaagtttggagagaacttcgcctcgtgccaagctggcatctcctcattctataccaaggatctcatagtgatgggcgcccccggtagcagctattggactgggtcactttttgtctataatatcacaacaaataaatataaagctttcttggacaagcagaatcaggtgaagttcggatcatacctcggatactccgtgggagccggtcacttccggagtcagcacactactgaggttgttggaggagccccccagcacgagcagatagggaaggcctacattttctccatcgacgagaaggagctcaacattctccacgagatgaaagggaagaagctcgggtcgtatttcggggcctctgtctgtgccgtagacctgaacgcggacgggttttccgatcttctggtcggcgcccccatgcagtcaaccattcgggaggaagggagggtttttgtgtacattaatagcggaagtggcgctgtgatgaacgcaatggaaactaacctcgttgggagcgacaaatatgctgcgagattcggtgagtccattgtgaatctgggagatatcgacaacgacgggttcgaggatgtggccattggggcccctcaagaggatgatttgcaaggtgccatctacatctataacggtcgggcggacggaatcagtagcaccttcagtcagagaattgagggcctccagatttcgaaaagcctgagcatgtttgggcagagcatctcagggcagatcgacgcggataacaatggctacgtcgatgtggccgtaggagcttttcggtcagatagcgccgttctgttacgcactcggccggtcgtgattgttgatgcctcattgtctcaccccgaatcggtgaatcgcactaaatttgactgcgtggagaacgggtggccctccgtgtgcatcgacttgaccctgtgtttctcttacaagggcaaggaggtcccagggtatatcgtcttattttacaatatgagcctcgacgttaaccgtaaggcagaatcaccaccccgattttacttttcatccaatggtacttctgatgtgatcacagggagcattcaagtctcaagcagagaggcgaactgcaggacacatcaggcattcatgcgcaaagacgtccgcgacattctgactccaattcagattgaggctgcctatcacttgggccctcatgtgatatcaaaaagaagcactgaggaattcccacctctgcagcccatcctccagcagaagaaagagaaagacatcatgaaaaaaaccattaactttgctcgcttctgtgcccatgaaaactgctcagctgatttacaggtatctgctaaaatcgggtttctgaagccccatgagaataaaacctatctcgccgtgggcagcatgaaaacactcatgttgaatgtgagcctgtttaatgcgggagatgacgcatacgaaaccacattgcacgttaagttacctgtgggtctttatttcattaaaattctggagctggaggagaagcagattaactgtgaagtcaccgataacagtggtgtggtgcagctcgactgcagcatcgggtacatttatgttgaccacctgagcaggatcgacatttcatttctgcttgacgtctcgagtctatcacgggctgaggaagatctgtctattaccgttcacgccacatgtgagaatgaggaagagatggataacctgaaacactctcgcgtgactgtcgcaatccctctgaagtacgaagtgaagttaacggtccacgggttcgtcaacccaacatcatttgtgtatgggtctaatgacgaaaacgagccggaaacttgtatggtggagaaaatgaacctgactttccacgtgattaatactggcaactccatggctccgaacgtcagcgttgaaattatggtacctaactcgttttctccccaaacggataaactcttcaacatattggatgtacagacaacgacaggagaatgtcacttcgagaactatcaaagagtgtgcgcccttgagcagcagaaaagcgccatgcagacgctgaaaggaatcgtgagattcctgtcaaaaaccgataaaagactgctctattgtatcaaggctgacccgcactgtttgaatttcttgtgtaattttggaaagatggagtctggcaaggaggcgtccgttcatatccagctggaaggcaggcccagcatactggaaatggacgagacgagtgctctgaaattcgagattcgggcgaccggcttccccgaacctaacccaagagttatcgaactgaacaaggatgaaaacgtcgctcacgtgctcctcgaaggcctgcaccatcagagacccaaacggtattttacgatagtgattatttcctcatcgctgctgcttggcctcatagtgctcctgttgatttcctatgttatgtggaaagccgggtttttcaaacgacagtacaagagtatcctgcaggaggaaaatagacgcgacagttggtcctatatcaatagcaaatcaaatgatgactag

SEQ ID NO: 15575 - DNA, 1854 bp, Artificial Sequence
  Description of Artificial Sequence: Synthetic coding sequence
atggcttgggaagcaaggcgagaacccggtccaagacgcgctgcagtcagggaaacagtcatgctccttctgtgtctcggagtaccaactggccggccctacaacgtggacaccgagtcagcactgctgtatcagggcccccacaacactctttttggctattctgtggtgctacactcccacggagccaataggtggctgctcgttggagcacctacggctaactggcttgctaatgcttcggtgattaatccaggtgctatttacaggtgccgaatcggtaagaaccctgggcagacgtgcgaacagctccagctcggatctccgaacggagaaccatgtggcaagacatgtctggaggaacgcgacaaccagtggttgggggtaactctctccagacagcccggtgaaaacggttccatcgtgacttgcggacataggtggaaaaatattttctatatcaaaaatgaaaacaaacttcccactggcggatgttatggcgtccctcccgaccttaggacagaactgagtaagagaatcgctccatgttaccaggattatgtcaaaaagtttggagagaattttgcaagttgccaggccggcatcagttctttttacaccaaagatctaatagtgatgggagccccgggttccagttattggacgggttccctttttgtatataacatcacaactaataaatataaggcctttctggacaaacagaaccaggtcaagtttggaagctacctcggatactccgtgggagcggggcacttccgtagccagcatacaaccgaggtagtgggtggtgccccacagcatgagcagatcggaaaagcttacatttttagtatagatgagaaggagctcaacattttacatgaaatgaagggaaaaaaattgggaagctatttcggagcatctgtctgtgcagtggatttgaatgcggatgggttcagcgaccttttggtcggagcccccatgcagtccaccatccgcgaggaagggagagtattcgtttatattaatagtggttcaggggcagtgatgaatgcaatggagacaaacctggtcggttcagacaaatatgcggccaggttcggggaaagtatagtcaatttgggggacatagacaacgatgggttcgaggacgtggcaatcggggctccccaagaagacgacctccaaggagcgatctacatctacaacgggcgtgcagacgggatttccagcacattttcccaaagaatcgagggcttacaaatcagtaagtccttgtcaatgttcgggcagtccatcagcgggcagatcgacgctgataataatggctacgtggacgttgcagttggtgctttcaggtccgactctgctgtgctgttaaggacccggcccgtggtgattgtagatgcctccctgagccatcctgaatccgtcaaccgaactaagttcgattgcgtggaaaatggctggccctcagtctgcattgatcttaccctttgtttctcatacaagggaaaggaggtccctgggtacatcgtgctgttctacaatatgtccctagatgtcaacaggaaggcagagtcccctccaaggttttactttagtagtaatggcacatccgatgtgatcactggatccattcaggtatcaagtagggaggccaactgtagaacacaccaggcgttcatgcgaaaggacgtgagagacatcctgaccccgatccagatcgaagccgcataccacctcggcccccatgtcatcagtaagcgttccaccgaggagttcccgccgctgcaaccaatcctgcagcaaaaaaaggaaaaggatataatgaaaaagacgaagaagtag

SEQ ID NO: 15576 - DNA, 3150 bp, Artificial Sequence
  Description of Artificial Sequence: Synthetic coding sequence
atgggatcgaggactccagaaagtcctctgcacgccgttcagctgcggtggggacctcggaggagacctccactactcccgcttctgcttctactacttccacctccgccaagagtgggcgggtttaacctcgatgccgaggcccccgccgttctgagtggacctcccgggtcgttctttgggttctctgtggaattctaccgacccggtacggatggtgtgagtgtgctcgtcggggcccccaaagctaataccagccaacctggggtacttcagggcggcgccgtctacctgtgcccttggggcgcgtctccaacccagtgcactccaatcgagtttgactccaaggggagtagactgctggaaagtagtctctcgtcatcagaaggggaggaacctgtcgagtataaatctttacaatggttcggcgccaccgttagggcacacgggtcctctatactggcgtgtgccccactgtattcctggcgcaccgaaaaggaacctctgtcggaccccgtggggacgtgctacttgagtaccgataacttcactaggatcctggagtacgcaccatgcagatctgatttcagttgggctgctggtcagggatactgccagggcggattttctgcagaatttacaaagactggaagggtggtactgggcggcccaggatcctatttctggcaagggcagatcttgtcagccacccaggaacagatcgctgagtcctactatcccgaatatttgatcaatttggtgcaaggccagcttcaaacccgacaggcctctagtatctacgacgatagttacttggggtacagtgtggctgtgggcgagttctcgggagatgatacggaagattttgttgcaggcgttcctaagggcaatctcacctacggctacgtgactatcttgaatggctctgacattcgtagcctgtataattttagtggtgagcagatggccagctacttcgggtacgcggtggccgcgacagacgtgaacggcgatggcctagatgacctactggtaggtgccccactccttatggatagaacacccgacggtagaccccaggaagtcggtagggtctacgtgtatttgcaacatcccgcggggatcgagcctacgccaacgcttacattgacggggcacgacgaattcggacgattcggctcatcactgactccgctcggcgatcttgatcaagacggttataatgacgtggcaattggcgcccctttcggaggcgagacacagcagggagtcgtgttcgtgtttcctggaggcccaggcgggctcggatctaagccttcccaagtacttcaacccttgtgggccgcaagccatactcccgattttttcggttctgcgctcaggggaggtagggatctcgacggaaatggataccccgacctgattgtgggctcctttggcgttgataaggccgtggtttacagagggcggcccatcgttagtgcaagcgccagcttgacaatcttcccagccatgttcaaccccgaggaacgcagttgttctcttgagggcaatcccgtggcgtgcatcaatctctcattctgtcttaacgcaagcgggaaacacgtggccgatagcataggattcacagttgagttgcagctcgactggcaaaaacaaaaagggggagtcaggcgcgctttgtttctggctagtcgccaggctacactgacccagacccttctaatccaaaacggagcacgcgaggactgtcgcgagatgaagatctacctgcggaacgaatcagagttcagggacaagctgagtccaatccatattgctctgaacttttccctggacccgcaagcccctgtcgactcccacggccttagacctgccctgcattaccaaagcaagagtcgaatagaagataaggcgcaaatcctactcgactgcggcgaggataacatctgcgttccagacctccagctggaggtcttcggcgaacagaatcatgtttacctcggtgataaaaacgccctgaatctcacctttcatgcccagaacgtcggcgaaggcggtgcatacgaggcagagctcagagttacagctccccctgaggctgaatactccggcctagtccgccatccggggaacttttcatcactgtcatgcgattactttgcggttaaccagtctagactgctcgtgtgcgatctcggcaaccctatgaaggcaggggcttcactgtgggggggacttaggttcaccgtgcctcacctgcgcgacactaagaagacaatacaattcgactttcagattctgagcaagaatctaaataattctcaaagcgatgtcgtctctttcagactcagtgttgaggcccaggcccaggtcacactgaatggggtgtctaagcctgaggcggtcctctttcccgtcagcgattggcaccctagggatcagccacaaaaagaagaggacctaggcccagccgtacaccacgtctatgagctcatcaatcaaggcccttcctccatcagtcagggcgtgcttgagctgtcctgcccacaggctttggagggccagcaattactgtacgtgacgagggtgaccggcctgaattgtacaacaaaccatcctatcaaccccaaagggctggagcttgaccccgagggcagtttgcatcatcaacaaaaaagggaggccccaagccgctcctccgcgtcatccggaccccagattcttaaatgtcctgaggcggagtgttttaggctgcgatgcgagcttgggcctttacatcagcaggaatcccagtctctgcagctgcacttccgggtgtgggcaaaaacctttcttcagagagaacatcagcctttttctctgcagtgtgaagccgtctataaggcgctgaaaatgccctaccggatccttccgcgtcagcttccccagaaggagaggcaagtggccacagcagtccagtggactaaagcagaagggtcctatggagtacccttgtggatcattatcctggcaattctctttggattactgcttctgggtttgctgatttacatcttgtataagctcgggttcttcaagaggagtctcccttatggcactgcaatggagaaggctcagctcaaaccgccagcaacgagcgacgcgtag

SEQ ID NO: 15577 - DNA, 3393 bp, Artificial Sequence
  Description of Artificial Sequence: Synthetic coding sequence
atggccgccgccggccagctgtgtttgctgtatctgtccgccggattgctcagccggctgggggctgcttttaaccttgacactcgagaagacaatgtcataaggaagtacggggaccccggcagcttatttggctttagcctggcaatgcattggcagctccagcccgaggataaacggctgcttctagtgggcgccccccgcgctgaggctttaccgctgcagcgcgcaaaccggacaggaggcctctatagttgtgatataaccgcccgcggtccgtgtacacgcattgagtttgacaatgacgcagaccctacatccgaatccaaagaggatcagtggatgggtgtaaccgttcagtctcaggggcccggggggaaggtcgtgacctgcgcgcataggtatgaaaagcggcagcatgtgaatactaagcaggagtccagagatatttttggacggtgttatgtgctctctcagaaccttcgcatcgaagatgatatggatgggggcgactggtctttttgcgacgggcggctccggggccatgagaaattcggctcctgccagcagggggtcgccgctacctttacaaaggacttccactatatcgtgtttggcgcaccggggacttacaactggaaaggcatcgtccgggtggaacaaaaaaataatactttcttcgacatgaacatcttcgaagacgggccttacgaagtcgggggagaaactgagcacgacgaatcactggtaccagtgccagccaatagctacctgggcctcctcttcttaacctcggtgagttatactgatccagaccaattcgtatataagactcgtccaccacgggaacagccagatacctttcccgacgtgatgatgaacagctatttaggatttagtctagactccggtaagggcattgtgtccaaagatgagatcacgttcgtctccggcgcccctcgggccaatcattctggtgccgtagttcttttaaaaagagacatgaagagcgcccacctattgcctgaacacatattcgatggtgagggtctggcctcaagttttgggtacgatgtggctgtcgtcgacctgaataaggacggatggcaggacattgtgataggcgctccgcagtattttgacagggatggtgaagttggcggggcagtgtacgtatacatgaatcaacaggggcgatggaataatgtgaaaccgattcggttgaacggtacaaaagactccatgttcggcattgctgtcaaaaatatcggcgatatcaatcaggacgggtatcccgacattgctgtaggcgctccttacgacgatctcggcaaagtgttcatatatcacggctctgcaaacggcatcaatacaaagcccactcaggttctgaaaggaatatcgccctatttcggctacagtattgccggaaacatggacttggacagaaactcctaccctgacgtcgccgtcgggagtctaagcgactcagtgactattttcagaagtcggccagtgatcaacatccagaagaccataactgtgacgcctaatcgaattgacctccggcagaaaacagcctgtggcgccccttcgggtatctgtctgcaggtaaagtcatgctttgaatatactgctaacccagctgggtacaatcccagcattagcattgtgggtaccctcgaagccgagaaagaacggcgcaaatcagggctgtcctcgagagtacagttcaggaaccagggatctgagccgaagtatacccaggaacttacacttaaacgccagaagcagaaggtatgcatggaggagaccctgtggttacaggacaatatcagagacaaactgaggccaatccctatcaccgcttctgtcgaaattcaggagccatcctctcgtaggcgggtgaacagcctgcccgaggtgctgcccatactaaatagcgatgagcccaagacagctcacatcgacgtgcactttttaaaagagggatgcggagatgacaacgtgtgcaactccaaccttaagttggaatataagttttgtactcgcgaaggcaaccaggacaagtttagctacctcccaatccagaaaggagtgccagagctggtcctgaaagaccagaaggatatcgccctggagattaccgtaacgaactctcctagtaatcccagaaaccctaccaaagacggtgatgatgcgcatgaggctaaactgattgcaacattccctgacaccctgacatattcagcgtatagagagttaagagcttttccggagaagcagctgagttgtgtggcgaaccagaacggttcccaagctgactgtgaactagggaatccctttaagcggaatagcaacgtaacattctacctcgtgctgagtactactgaggttacctttgatacacctgatctcgatatcaatttgaaactggagacaacctcgaaccaagataatttagctcctataacagccaaggctaaggtggtcattgaactgctcctctctgtgtcaggcgtggcgaaaccttctcaggtgtactttggcggcactgtagtcggagaacaagcaatgaaaagtgaagacgaggtgggatcactcatcgagtacgagttccgagtgataaacctgggcaaacctctcacaaatctgggcaccgccaccctgaatatccaatggccgaaagaaatctccaacggtaaatggctgctatacctagtgaaggtagaatcaaagggacttgagaaggtcacctgtgagccacagaaagagattaatagcttgaaccttaccgaatcacataactcccgaaagaagcgagaaattaccgagaagcagatagacgacaacaggaagttctccttgttcgctgagcgtaaatatcaaaccctgaactgtagtgtgaacgtgaattgcgttaacatacgttgcccccttcggggcctggatagtaaagcctctctaatccttcgtagcagattatggaactccacgtttctggaggagtattccaaactcaattaccttgatatcctgatgagagctttcatcgatgtgacagccgcggcggaaaatatcagactccctaatgccgggacccaggtgagggtgactgtttttccctctaaaacggttgctcaatattccggcgtgccctggtggatcattcttgtcgccattctggcagggattttgatgttggctttgctggtgtttattctgtggaaatgtgggtttttcaaaaggagtaggtacgacgactccgtgccacgctaccatgcagtgcggataaggaaagaggagagggagatcaaagatgaaaagtacattgacaatctagagaagaagcagtggataaccaaatggaacgagaacgaaagttactcctag

SEQ ID NO: 15578 - DNA, 3222 bp, Artificial Sequence
  Description of Artificial Sequence: Synthetic coding sequence
atggcagctgctggtcagctgtgcctgctgtatctgagcgcaggcctgctttcccgcctgggggccgcgtttaatctggacactcgggaagacaatgtaattcggaagtatggcgatcccgggtccctgttcggcttctccttggcaatgcactggcaactccagccagaggacaaacgacttctactggtgggcgcaccgagggcagaggctctaccgcttcaacgggctaaccgaacaggcggactatattcctgcgacatcacagctcggggaccctgtacccggattgaatttgacaatgacgcagatcccacgagcgagtccaaggaagaccagtggatgggggtgacagttcagtcacaggggcccggtggtaaagtggtgacttgcgcacaccgctatgaaaaacggcagcatgtgaataccaaacaagagagccgcgacatttttggtcgatgctacgtgttaagccagaatctgcggatcgaggatgacatggacggaggggactggagtttttgcgacggccgcttacggggccatgagaagtttggatcctgtcagcaaggcgtggcagcaacttttacaaaggacttccattacattgtctttggagcacctggcacctataactggaagggaattgtccgggtagaacagaaaaacaacaccttcttcgacatgaatatctttgaggacggcccctacgaggtgggtggggaaaccgagcacgacgagtccctggtcccagtgcctgccaattcatacctcggatttagtctcgacagtggtaagggtatcgtttctaaggacgaaattacttttgttagcggagccccccgggcgaaccacagcggggctgtggtgttgctgaagcgcgacatgaaatccgcccacctgttacctgagcacatttttgatggcgaaggactcgcttctagctttggttatgacgttgcagtggtggacttgaacaaggatggatggcaagatatagtgataggcgcgccgcagtactttgatcgggatggagaggtgggcggcgcggtgtacgtctacatgaaccaacagggcaggtggaataacgtcaagcccatccgactgaatgggaccaaagactccatgtttggaatagcagttaagaacattggagacattaaccaggatggataccccgacatagctgtgggcgcaccctacgatgacctggggaaagtgttcatttaccatggcagcgcgaacggcattaataccaaaccgacccaggttctgaagggtatctctccctactttggttattctattgccggcaacatggacctggaccgaaactcttacccagacgtggccgtcgggtcattgtcggattctgtaactattttccgcagtcggccagtgataaatattcagaaaacaattactgtaaccccgaacaggatagacctgcggcagaaaacagcctgcggagctccctcaggcatatgtctgcaggtgaagtcatgttttgagtacacagcgaatccggccggatataacccatccatatccattgttggaacacttgaggctgagaaagagagaaggaagtcaggactttcttccagggtccagtttaggaaccaggggtccgagccaaaatatacacaggagcttacgctgaaacggcagaagcagaaggtgtgtatggaagagaccctctggttgcaagataacatccgggataagctccgccccattccaattactgcaagcgtcgagatccaggaaccctcttcaagaaggagggtgaactccctccctgaagtgctcccaatcctgaactccgatgagccaaaaacagcacatatcgacgtgcacttcctcaaggagggttgtggcgacgataatgtttgtaactccaatctaaaactggagtataaattctgcacccgggaaggtaaccaggacaaattctcttatctcccgattcagaagggagtacctgagctcgttctaaaggatcagaaggacattgccctggagatcactgtcactaatagcccatccaaccctcgcaaccccactaaggacggcgacgacgctcacgaagcaaaactaatcgcaacattccccgacacactgacgtactctgcctatagggaactcagggcctttccagagaagcaacttagctgtgtggcaaaccagaacggtagccaggcagactgcgagctagggaatccatttaagcggaattccaatgtgaccttctatctcgtcttgtcgaccactgaggtgacctttgatactcctgacctcgacataaatttaaaactcgagactacaagtaaccaggataacctagctcccataactgcaaaggccaaagtcgtcatcgagcttttactgagtgtctctggcgtcgcaaaaccgagtcaggtttacttcggtggaaccgtcgtaggcgagcaggccatgaaatcagaggacgaggttggctccctgatagaatacgagttcagggtgattaacctgggaaagcctctgactaacctgggcactgctacccttaatatccaatggccaaaggagatcagtaatggaaaatggctgctgtaccttgtgaaagtggagtctaaaggactggagaaagtgacctgcgaaccccagaaggaaatcaatagcctcaacttgactgaatcccataactccagaaaaaaacgagagatcacagagaagcagattgatgacaacaggaagttctccctttttgccgagaggaaataccaaacgcttaactgcagcgttaatgtaaactgtgtaaacattcggtgccccttgaggggcctggacagtaaagcttccttaatccttcgatccaggctgtggaactcaaccttcctcgaagagtacagcaagctgaactatctggacatcctcatgcgggcctttatcgacgtcacagccgcagccgagaatatcaggttacctaatgcaggtacccaggtaagggtgaccgtgtttcctagcaagaccgtagctcaatattctggggtcccctggtggatcatactggttgccatcctcgcaggaatcctgatgctggcactgctcgtgttcattctctggaaatgtgggttctttaaaaggaataagaaagatcactacgatgccacataccacaaagctgagattcacgcccagccgagtgataaagagcgcttgacatcagacgcctag

SEQ ID NO: 15579 - DNA, 3207 bp, Artificial Sequence
  Description of Artificial Sequence: Synthetic coding sequence
atggccgcagcaggacagctgtgtctgctctacctgagtgcagggctgctctccaggttaggtgcagcattcaacctcgatacaagagaagataatgtgatccgaaagtacggcgatcccggtagcctatttggcttctcgcttgcaatgcactggcagctgcaacccgaagataagcggctgctgttggtaggtgctccccgggccgaggctttacctttgcagcgcgccaaccgcactggaggcctgtactcttgtgatataacagctcgtggtccctgcactcgcatcgaattcgacaatgacgcagaccctacaagtgaaagtaaggaagatcagtggatgggcgtgacagtgcagtcccagggtcccggcgggaaggtggtgacctgcgcccaccgttacgagaagcgccagcatgtgaatacaaaacaggagagtagagatatttttggacgttgttacgtgttatcacaaaatttgcggatcgaagatgatatggacggaggggattggtccttctgcgatgggcggctccgcggccacgaaaaattcgggagttgccaacagggggtggctgcaacctttacgaaggatttccactacattgttttcggggcccccggaacctataattggaaaggactgctgtttttgacctccgtgtcctacacggatcccgatcagtttgtctacaaaactaggccccctagagagcagcctgacaccttccctgacgtgatgatgaacagttatcttggcttctctctggattccggaaagggcatagtgtcaaaagacgaaattaccttcgttagtggcgctccacgtgctaatcactcaggagctgtggtcttactgaagagagacatgaaatccgcccatttgctgcccgagcatatcttcgatggagaaggactcgcttcttcttttgggtacgatgtggctgtggtcgacttgaataaagacgggtggcaggacatcgttataggggctccacaatacttcgacagggatggggaggtgggaggcgccgtgtatgtctacatgaatcaacagggtaggtggaataacgttaagccgataagattgaatgggacaaaggattctatgttcggcatcgcggttaagaacataggggacatcaatcaggacgggtatcctgacatagcagtgggcgcgccctacgatgacctgggaaaagtattcatctaccatgggtccgcaaatgggattaacacaaaacctacccaagttctgaagggtataagcccttatttcggctactcaattgccggcaacatggatcttgacagaaactcataccccgacgtcgccgtggggagcttgagcgactcagtcaccatcttcaggagtagaccagtcatcaacatacaaaaaactattacagtaactcctaaccgcattgatctgagacagaagaccgcctgtggagccccatccggaatctgcctccaggtgaagtcttgttttgagtataccgccaacccagccggctacaacccgtccatttcaattgtgggcactttggaagccgagaaagagaggagaaagagcggcctgagttctagggtgcagtttcggaatcaaggatccgaaccgaagtacacccaggagctgactctgaaaagacaaaagcaaaaagtttgcatggaagaaacactgtggttgcaggataacatccgcgataagctgagacctatccctatcactgccagtgtcgaaatccaggagccatcttccaggagacgtgtgaactcgctccccgaggtgctcccgatccttaactctgacgagcccaagactgctcacatagacgtgcatttcctcaaggagggatgcggtgatgacaatgtgtgcaactccaacctaaaactggaatataaattctgtaccagagagggcaaccaagacaaattcagctatttgcctatacaaaagggagttcctgagctcgtcctgaaggatcagaaagacatcgctctcgagattactgtgactaatagtccaagtaacccccgcaatcccaccaaagatggcgacgacgctcacgaagctaaacttattgccacctttccggataccttaacctactcagcctaccgggagctgcgggcctttccagagaagcaattgtcgtgtgtggctaaccagaacggcagccaagctgactgcgaattaggcaatccctttaagcgtaactctaacgttaccttctacctggttttgtccaccacagaggtaacattcgatacacctgacctcgatattaatttaaagctggagacaacttccaaccaagataatcttgccccaataaccgccaaggctaaggttgtgatcgagctgctgctaagcgttagcggggtggccaagccctctcaggtgtattttggaggaaccgtcgtgggagaacaggcaatgaaatcagaagatgaggtcggatcgttgatcgagtatgaattcagggtgattaaccttggtaaaccattgaccaatctgggtacagctacgcttaacatacagtggcccaaagagatatcaaatgggaaatggctgctgtatttagtgaaggtagagtctaagggtcttgaaaaggtcacttgcgaacctcaaaaagagattaatagtttaaatctgactgaaagccataactctaggaagaaaagggagattacagagaaacaaatcgacgataaccggaagttttcgctgttcgcagaacggaaataccagaccctgaattgttcagtgaacgtcaattgtgtaaatattcggtgcccactgaggggccttgactccaaggcctcacttattcttcgatcacgattgtggaactctactttcctggaagagtactccaaactgaattacctggatatcctcatgagggcattcatcgatgtgaccgcggcggctgagaatatccggctcccaaacgcaggcactcaagtacgtgttactgtttttccttccaagacagtcgcccagtattccggggtcccatggtggatcattctcgtggcaatcctcgctggaatcctcatgctggccctgctggtcttcatcctgtggaagtgtggcttctttaaaaggaacaagaaagaccactatgacgcaacgtaccacaaggccgagattcacgcccagccatccgataaggagcggttgacaagcgatgcatag

SEQ ID NO: 15580 - DNA, 3339 bp, Artificial Sequence
  Description of Artificial Sequence: Synthetic coding sequence
atggcggcagccgggcagctatgtctgctgtatctgtccgccggactgctcagccggctcggtgccgccttcaatctggacaccagagaggacaatgtgataagaaaatacggagaccccggatccctgttcggcttttcactcgcgatgcactggcagctgcaaccagaagacaagcgcctattactggtgggcgctccccgggcagaggcgcttcccctgcaacgagctaacagaacaggcggactttattcatgcgacatcacagctcgcggtccttgcacacggattgaattcgacaatgacgccgacccaacatcagagtctaaggaagaccagtggatgggggtcaccgtgcagagccagggtccaggcggcaaggtggttacctgcgcccaccgatatgagaagcgccaacatgtaaacaccaagcaggagtcccgtgacatcttcgggcgctgctatgtgctgagccaaaatctgcgcattgaggatgatatggacggcggagactggtcattctgcgacggaagactgcggggacatgagaagttcggctcctgtcagcaaggagtggctgccacctttacaaaggactttcactacattgtgttcggagctccagggacatacaattggaagggtatcgtccgagtggagcagaagaataacaccttcttcgatatgaacattttcgaggacggcccatatgaggtgggtggcgagacagagcatgacgaatcacttgtgccagtgccggccaattcgtaccttggactcctctttctgacatccgtgtcatatactgatccagatcaatttgtgtacaaaacacgtccccccagggaacaaccagacaccttccctgacgtcatgatgaatagttacctgggcttctcactggatagcggcaagggcatagtgtcaaaggacgaaatcaccttcgtttccggcgcgccacgtgccaatcattctggcgccgtcgtgttgctcaaacgggacatgaaatcggctcaccttctgcccgagcacatcttcgacggcgagggactggcctcctcgtttggatatgatgtggccgtggtagacctgaacaaggatggatggcaggatattgttattggcgcgccgcagtactttgatcgggacggagaagtcggaggagcagtgtacgtctatatgaaccagcaggggcggtggaacaacgtcaagcccattagactgaatgggacaaaggactcgatgttcggcatcgctgttaaaaatattggagatataaatcaggatggctaccccgacatcgctgtgggagctccatacgatgatttaggcaaggtgttcatctaccacggtagcgcaaacggcatcaataccaagccaactcaggttctcaaaggaatttccccttacttcggttactcaatcgcgggaaacatggaccttgacagaaactcttatcctgatgtggccgtcggcagtctcagcgactctgtgacaatttttaggagcaggcctgtaattaatatccaaaagaccatcacagttactcccaatcgcattgatctcagacagaaaactgcctgcggcgccccctctggaatctgcctacaggtgaagtcttgcttcgagtatacggcaaaccccgccggatacaatccaagcatttccattgttgggaccctggaggctgaaaaggagaggaggaagagtggcctgtcttctagggtccagttccggaaccagggatcagaaccaaagtacacccaggagctgactctgaaaagacagaagcaaaaggtgtgcatggaagaaactctttggttacaggacaacatcagagataagctccgtcctatccctattacagcgtccgtggaaatacaagaaccctcctctcggagaagggtgaattctctccccgaggttcttcctattctgaactcagatgaaccaaagacagcccacattgacgtgcactttctgaaagaaggctgtggcgacgataacgtctgcaactccaacctgaagctcgaatataaattctgtacaagagagggaaaccaggacaaatttagttatctgccaatacagaagggagtccctgagctcgtgctaaaagatcagaaggacattgcactggaaataacagttacaaattcgccttccaacccaagaaacccaactaaggacggcgacgatgctcacgaggccaaactgattgctacgtttcccgatactctgacctattctgcttacagggagctaagggcattcccagaaaaacaattgagttgcgtggctaatcagaacggcagccaagccgactgcgagctgggcaaccctttcaagcggaactctaatgtcaccttctacctggttctgagtaccactgaggtgacatttgatacccccgacttggacattaatttgaagttagaaacaacatcaaaccaagataatctggcacccataaccgccaaggcgaaggtcgtgatcgaactcctgctgtctgtatccggggtggcaaagccttctcaagtttatttcggagggaccgtcgttggtgaacaggccatgaagagcgaggacgaagtcggaagtctgatcgagtatgagtttagggtgataaatttggggaagccactgacaaacctgggtactgccactctgaatatccagtggccaaaggagattagtaatgggaaatggttgctctaccttgttaaggtagagtctaagggactcgagaaagttacatgtgagccgcagaaggagataaacagtcttaatctcaccgaatcccacaattcccggaaaaagagggagatcacagagaaacagatcgacgataacagaaagttctcactgttcgcagaacgcaagtaccagacactaaattgcagtgttaacgtgaattgcgtgaatatacgctgtccacttcgcggcctggatagcaaggcctctctgattctgagaagccgcctgtggaacagtaccttcctggaggagtactccaagcttaactacctggacatattaatgagagcatttattgacgtgactgctgctgcagaaaatatcaggttacctaacgccggcactcaggttcgcgtcacagtgttccccagcaagaccgtcgctcagtatagtggcgtgccatggtggatcattctggtggctatcctagcaggaatcttgatgctcgctcttctggtgttcatcctttggaaatgcggtttcttcaaaaggaacaaaaaagatcattacgacgccacttaccataaagcagaaattcacgcccagccaagtgacaaggaacgactcacttccgacgcctag

SEQ ID NO: 15581 - DNA, 3276 bp, Artificial Sequence
  Description of Artificial Sequence: Synthetic coding sequence
atggccgcagccggccagctctgtctcttatacctttccgcggggctcctctcccggctcggggcagctttcaaccttgacacccgcgaggacaatgtaatcaggaagtacggagatcctggatccctgtttggtttctccctggccatgcattggcaactccagcccgaagataaacgcctgctgctggtgggcgccccccgcgccgaggccctgccattgcagcgtgctaatcggacaggtggattgtatagctgcgacatcactgcccgtgggccatgtacccgcatcgagttcgacaacgacgccgacccaacctctgagagcaaggaagaccagtggatgggggtcaccgtgcagtcacagggccccgggggcaaagttgtgacctgcgctcatcggtacgagaagagacagcatgtcaatacaaaacaggaaagccgggatatttttggaagatgctacgtgctgtcacagaacttgcgaatcgaggacgacatggacggcggagactggtcgttttgcgacggacggttacgcggccatgagaagttcggctcctgccaacagggcgtggccgctacctttaccaaagattttcactatattgttttcggcgcacctggcacctacaattggaaaggaattgtacgcgtggaacagaagaataatactttcttcgatatgaacatttttgaagacggaccctacgaggtaggcggcgagacagagcatgacgaaagtctggttcctgtaccagccaacagttatttagggttcagtctcgacagcgggaaaggcatcgtgtctaaagacgagataacattcgtctcgggagctccccgtgcaaaccactctggagcggtagttctcctgaaacgcgatatgaagtcagcccacctcctgcctgagcacatattcgatggcgaggggttggccagtagtttcgggtatgatgtggccgtggtggacttaaataaggatggatggcaagatatcgtgataggtgctcctcagtattttgaccgcgatggggaagtcggcggcgccgtctacgtctacatgaatcagcaggggaggtggaacaatgttaagcccatcagactaaatggaaccaaggacagcatgttcggaattgctgtgaaaaacatcggcgatatcaatcaagatggctaccctgacatcgcagttggcgcaccttacgacgatttggggaaagtcttcatatatcatggtagtgcaaatgggatcaatacaaaacccacccaggtcctgaaaggaattagcccttatttcggttattcgattgccggcaacatggatctggaccgaaactcatacccggacgtggccgtgggctccctcagcgactccgtcacaattttccgctctaggcctgttatcaatatccagaagacgatcactgtcaccccaaaccggatagaccttagacagaagacggcttgcggcgctccttccggaatatgcctgcaggtcaaatcctgttttgagtatactgccaatcccgcgggttataatccgtctatttctattgtggggacgcttgaggctgagaaggaacgaaggaaatccggcctatcctctcgtgttcagtttagaaatcagggtagcgagcccaaatatacacaggagctaacgctgaaacgacagaaacagaaagtttgcatggaggaaaccctctggctccaagacaacatacgggataaactaagaccgattcctatcactgcatctgtggaaatacaggaaccctcatctcgcagacgagttaactcccttccagaagtgttgccgattctgaatagcgacgaacccaagaccgcccacatagacgtgcattttcttaaagaggggtgcggtgacgataatgtgtgcaactcgaacctcaagctggagtacaaattttgtactcgggaaggaaaccaagataaattttcctacctccccatccagaaaggtgtgcctgaactggtgctgaaggaccagaaggacatcgccctcgaaattactgtgacaaacagcccgagtaaccccagaaacccaactaaagacggcgacgatgcccacgaggccaaactcatcgccacgtttccagacaccctgacgtacagcgcctacagagagctacgggccttccctgagaaacaattgtcctgtgttgccaatcagaacggaagccaggccgactgcgaactcggaaatccatttaagaggaacagcaacgtgactttctatctggttctctccacaacggaagtaacatttgacacacctgaccttgatatcaaccttaaactggagaccacaagcaaccaagataacctcgcccccatcacggccaaggcaaaggtcgtcattgagctgctgctctctgtgtccggtgttgccaagccgagccaggtgtacttcggtgggactgtagttggggagcaagccatgaaatcagaagatgaggtgggcagcctcatcgagtacgagtttcgggttatcaacctagggaaaccgcttacaaatcttgggacagctaccctaaatattcagtggccaaaagagatcagcaacggtaagtggctgctctacctcgtaaaagtcgaaagcaagggtctcgagaaagtaacctgtgagccacagaaggaaatcaactctttgaatctgacagagagccataattcacgaaagaaaagggagatcacagagaaacagatcgatgacaacagaaagttttcacttttcgctgaaagaaaatatcagacattaaactgcagcgttaacgtcaattgtgtgaatatccggtgtccactacgcggcttagactcaaaagcttccctcattctgcgctctaggttgtggaacagcactttcctagaagagtattccaaactgaactacttggatatcctgatgagggcttttatagacgtcaccgccgcagccgagaatattaggttaccaaatgccggcacccaggtcagggttaccgttttcccgagcaagacggtcgcccaatatagcggggtgccgtggtggataatccttgttgccatattggctggtatcctaatgctggccttactcgtctttattctgtggaagtgtggcttctttaaaaggtccagatatgatgattcggtgccacggtaccacgcagtcaggatcagaaaagaagagcgcgaaatcaaggatgaaaagtatattgataacctggaaaagaagcagtggatcacaaaatggaatgagaatgagagttactcttag

SEQ ID NO: 15582 - DNA, 2865 bp, Artificial Sequence
  Description of Artificial Sequence: Synthetic coding sequence
atgggcgtgactgtccagtcacaaggaccaggcgggaaggtggtcacatgtgcgcatcgatatgagaaacggcagcacgttaacacaaaacaagagtctcgcgatatcttcggccgctgttacgtcttgagtcagaatctgcgtatcgaggacgatatggacgggggcgactggagcttctgcgatgggcggttgaggggccatgagaagtttgggagctgccagcagggggtggccgccacttttacaaaggatttccattacatcgtgttcggagccccaggcacgtacaattggaaggggctcttattcctcacaagtgtgagctataccgacccagaccaattcgtttacaagacccggccaccgcgggagcagcctgatacattccctgacgtaatgatgaatagctatctggggttctctctggattcagggaaaggaatagtgtccaaggacgagattacctttgtgagtggcgcaccccgagccaaccattccggagcagtggttctcctgaaacgtgatatgaaaagcgcccatcttctgcccgaacacatcttcgacggtgagggcctggcgtcttccttcgggtacgacgtcgccgtagtagacttgaataaggacggttggcaggatatcgttattggggcaccacagtacttcgacagggatggcgaggtgggaggcgcagtctacgtgtacatgaatcagcagggcaggtggaacaacgtcaaacccatccgattgaatggaacaaaagatagcatgttcggtattgcggtaaaaaatattggcgacattaatcaagatggctatccagacattgctgtgggggccccctatgacgatctgggcaaggtgttcatctatcacgggagtgctaacggcattaataccaaaccgacgcaggtcctgaagggcatttctccatacttcggttactccattgccggaaatatggatttggatcgcaatagctacccagacgtggcagtgggtagcttgtcagattctgtgacaatctttagatcaagaccggtgataaatattcagaaaacaatcacagtgacccctaatcgcattgacctacgtcagaaaacagcatgtggcgcaccaagcggtatttgtctgcaagtgaaatcctgctttgaatatacggccaaccccgcaggttacaacccttctatatctattgtcgggacactggaagcagagaaggagcgtcggaagtctgggctgtcatcaagggttcagtttcgcaatcagggcagcgagccaaagtatactcaggagctcaccttgaagagacagaagcagaaggtttgcatggaggaaacactttggctgcaggataatatccgggacaagctccgccccattcctatcactgcctccgtagaaattcaggaaccttcaagcagacggcgtgtgaattcactccctgaggttctgccaatcctgaattctgatgagcctaaaactgcgcacattgatgtgcactttctgaaggaagggtgtggggatgataatgtttgcaacagcaaccttaagctggagtataagttttgcacgcgggaaggaaaccaggacaagttttcgtatctaccaatccagaagggggtgcctgagttagtcctgaaagatcagaaggacattgcgctggaaataaccgtaacgaattccccgagtaatccccgtaatcctacaaaagatggagatgacgctcatgaagcgaagctcatcgccacatttcccgatacccttacatacagtgcctatagggagctcagggcttttccggaaaagcagctgtcctgtgttgccaaccagaacggctctcaggccgactgcgaactcggaaaccctttcaaacgtaatagcaacgtaactttttacctggtactgtccacaaccgaagtcacatttgacacaccggacttagacataaacttgaaactggaaaccacaagtaatcaggacaacctagctccaatcaccgctaaggcaaaagtggtcattgaattgttattgagcgttagcggcgtagccaaaccaagtcaagtgtacttcggtggtaccgtggtgggagaacaggctatgaaatccgaagacgaagtggggagtctgatcgagtacgagttccgagtgatcaatctgggaaaaccgctgaccaatcttggaaccgcaacactgaatatccaatggcccaaagaaataagtaatggcaaatggttactctatctcgttaaggtagagtcaaaaggtcttgagaaggtgacctgcgaaccccaaaaagaaatcaattccctgaatttgaccgagagccacaactcgcggaagaaacgtgagatcaccgagaagcaaatcgacgacaaccggaagttttccttattcgcagaacgcaagtatcagacactaaattgcagcgtcaatgttaattgcgtcaacataagatgcccactgagagggctggactctaaagcctccctgatcttacgatctagactttggaactctacattcctcgaagaatacagcaaactcaactatttggatatccttatgcgggcatttatagatgtgacggctgcggccgaaaatatcagactccctaacgcaggtacgcaggtcagagttacggtttttccaagcaaaaccgtggcccagtactccggcgttccttggtggatcattcttgtagcaatcctggccggaattctcatgctggccctcctcgtgttcatcttatggaagtgtggattctttaaacgaaataagaaggatcactatgacgctacctaccacaaggctgagatccacgcacagccaagtgacaaggaacgtctaacatctgatgcctag

SEQ ID NO: 15583 - DNA, 3393 bp, Artificial Sequence
  Description of Artificial Sequence: Synthetic coding sequence
atggcagctgcagggcagctgtgtttactgtatctgagcgccggcctgctatcaagactgggggctgctttcaatctggatacccgggaggataacgtgattcggaagtacggcgatcctgggtcattgttcggattcagccttgccatgcactggcagctccaacccgaggacaaaagactcctcttggttggcgcccctcgtgccgaagcactcccactgcagcgggccaacagaaccgggggcttgtatagctgcgacatcacagccagaggcccctgcacaaggattgaattcgataatgacgcagatcctacatccgagtccaaggaggatcaatggatgggcgtcacggttcagagccagggccccggcggaaaggtcgttacctgtgctcacagatacgaaaagcggcaacacgttaataccaaacaggagagcagagatatctttgggcggtgttacgtactatcccagaacctgaggatagaagatgacatggacggaggcgattggtccttttgcgacggtaggctgcggggacacgagaagttcggatcctgccagcaaggggttgccgccacatttaccaaagacttccactacatcgtctttggtgcccctggaacctacaactggaaagggatcgtgcgagtggagcagaaaaataatactttcttcgacatgaatatcttcgaggacggaccctacgaggttgggggcgaaacagaacatgacgaatcacttgtacctgtcccagcgaacagctatctaggcctactgttcctgacctcagtgtcctacaccgatccagaccagttcgtctataaaacgaggcctccgcgcgagcagccagataccttccccgacgtgatgatgaacagttacttgggcttctctcttgacagcggaaaaggcatagtgtctaaggacgaaatcacctttgtctctggagccccacgggcaaaccactctggcgccgtggttctcctgaagagagacatgaagtccgcacacctcctccccgagcatatctttgatggggaagggcttgcatcgtctttcggctatgacgtcgctgtagtcgacctgaataaggatggttggcaggatatcgttatcggagctcctcaatattttgacagggacggcgaggtgggaggtgcggtctatgtttatatgaaccagcaggggcggtggaataatgtcaaacccatccggctgaacggaacgaaggacagcatgttcgggattgccgtgaaaaacattggggacattaatcaggacggatatcccgacatagccgtgggtgcaccatacgacgacctcggtaaagtgtttatatatcacgggtccgctaacgggatcaacaccaaacccacacaagtgctcaaaggaatctccccatattttggctatagcatagccgggaatatggacttagaccgtaatagctatcctgatgtggccgtgggtagcctgtcggattcagtaactatattcagaagtcgcccagtgatcaatatccagaagaccattaccgtaacccctaaccgcatcgacctgagacagaagacagcctgcggggctccaagcggtatttgtttgcaggttaagagttgtttcgagtatacagctaatccagcagggtacaatcctagcatttctattgtggggactctagaagctgagaaggaacggcgaaagtcaggactttcatctcgggttcagttcagaaatcaggggtctgaacccaagtatacccaggagctcacattgaagaggcagaaacagaaggtgtgcatggaggagacactgtggctgcaggataacattagggataaactccgcccaattcctattacagcatcggtcgagattcaggaaccctcctcaagaagaagagttaacagtctcccagaagtgttacccattctgaactcggacgaaccaaagacagcgcacatcgatgtgcacttccttaaagaaggttgcggagatgataatgtgtgtaacagcaatctcaagctcgagtacaagttttgcacaagagaagggaaccaggacaagttttcgtatctgccaatccagaagggcgttcctgagctcgtgctaaaagatcagaaagatatagcgctggagattacagttaccaattcaccctctaatccacgcaaccctaccaaggacggcgacgacgctcacgaggccaagctcatagccacattccccgacactctgacgtactccgcataccgggaactgagagccttcccagagaagcagttgtcctgtgtcgccaaccagaatggaagtcaagccgactgcgaattgggcaaccctttcaaacgcaacagtaatgtcactttttaccttgtgctgtccaccaccgaggtcactttcgacacccctgatctcgatattaatctgaagctcgagacgacctccaaccaggacaacctagcgcccattactgccaaggctaaggtcgtgatagagttgctcctctcagtgagtggggttgcgaagccttcccaggtgtactttggcggtactgttgtaggcgaacaggcaatgaaatccgaggatgaggtaggaagcctgatcgagtatgaatttagggttattaacctcggcaaacccctcacgaacctcggcacagccacactgaacattcagtggcctaaagagatatcaaatggaaagtggttgctgtatctcgtgaaggttgaatctaaggggctggagaaagtgacgtgcgagccacaaaaagagattaattcattaaatttaacagaatcccacaattcccggaagaaacgggagatcaccgagaagcagatcgacgacaataggaaattttccttgttcgctgagcgcaagtaccagactcttaactgtagcgtgaatgtaaattgtgtgaacatccggtgccctctccgcggcctagattctaaggcgtccctcatcctgagatctagactgtggaattcgactttcttagaggagtactctaagcttaactatctggacatcctcatgcgggccttcatcgacgttaccgctgccgccgagaatatccgccttccaaatgctggaactcaggtgcgcgttacagtattcccatccaaaactgtcgcccagtattcaggggtgccctggtggatcatcttggtagccattctggcaggcatcctgatgctggccctcttagtcttcatcctgtggaagtgtggattctttaaacgatcaaggtatgacgacagcgtgccgcgataccacgcggtgcgcattcggaaagaggaacgggaaattaaagacgagaaatacatcgataacctggagaaaaaacagtggatcacaaaatggaacgagaacgaaagctactcatag

SEQ ID NO: 15584 - DNA, 3261 bp, Artificial Sequence
  Description of Artificial Sequence: Synthetic coding sequence
atggctgccgcaggccaattatgcctgctttatctcagcgcaggtcttctgagcaggctgggagctgcctttaacctggatacaagagaagacaatgtgataagaaaatatggagacccgggttcactgtttggattctctcttgcgatgcattggcaactacagcccgaagacaaacggttattgctagttggggcgcccagagccgaagccctgcctttgcagcgggctaatagaaccggcggactctatagctgcgatatcacagcccggggtccttgcacccggatagagtttgacaacgacgctgatccaacatcggaatccaaagaggaccagtggatgggcgtcacagtccaatcccaaggaccagggggaaaggttgtcacatgcgcccataggtacgagaagaggcagcacgtgaacacaaaacaggagagtcgggatatctttggcaggtgttatgtgctcagccaaaacttgcggatcgaggacgacatggacggtggtgattggagcttctgcgacggacggttgaggggacacgagaaatttgggagctgtcagcaaggcgttgcggctacctttacaaaggattttcattacattgtgtttggagcgcccgggacgtacaactggaagggactcctgttcttaacttctgtgtcttacacggatcctgaccagttcgtctacaaaactcgaccacctcgcgaacagcccgatacatttccagatgttatgatgaattcatacttgggattctctctggacagcggcaagggcatcgtttcgaaagacgaaatcacgttcgtctccggtgctcctcgggccaatcatagtggggccgtcgtgcttctcaagcgcgacatgaaatctgcgcatctcctcccggagcacatcttcgatggggaggggctggcgtcctcctttggttatgatgttgctgttgtcgacctgaacaaggacggatggcaagacatcgtgatcggcgctcctcaatacttcgacagggacggagaggtcggtggggccgtctatgtgtatatgaatcaacagggaagatggaacaatgtcaaacccatccgcctgaatggtaccaaagactcaatgttcggtatcgcggtcaaaaacatcggggatattaaccaggatggttacccggacatagcggtaggagcgccttatgacgacctaggtaaggtgttcatataccatggctctgcaaacggaattaacactaaacctacacaagtattaaaggggatttctccctactttgggtattcaattgccgggaacatggacctggatcggaactcctaccctgatgtggccgtcggttctctttctgacagcgtgaccattttcaggtctagacccgtgattaatattcagaagacaatcaccgtcaccccaaacaggattgatctccggcaaaaaaccgcctgtggagccccaagcggtatttgtctgcaggtcaagagctgttttgagtataccgctaatccagctgggtataacccttccatttcgattgtgggcacgcttgaggcagagaaagaacgccggaagtcagggctgtctagccgggtccagtttcgcaatcaggggtccgagccaaagtatactcaggagcttactctgaaacgccagaagcagaaggtctgcatggaggagacgctctggctgcaggataatatcagggacaaactgcggcctatccccatcaccgcatcagtagaaattcaggagccttcatccaggcgcagggttaattctctgccagaggtgctgcctattctgaactccgatgaaccgaagaccgcccacatcgacgtccacttcttgaaggaaggatgcggcgacgataacgtatgtaactcaaacctgaaactggaatataagttttgcactagggaagggaatcaggataagttcagctacctgccaatacagaagggtgtccccgagctggtcctgaaggaccagaaggatatcgcactcgagattaccgtaacaaattcccccagcaacccacgcaacccgaccaaggatggtgatgatgcccacgaagcgaagctgatcgcaacctttccagacacgttgacttatagcgcgtacagagagctgagggcatttccagagaagcagttgtcttgtgtggccaaccagaacgggagccaggctgattgcgagctgggaaacccctttaagagaaacagcaatgtgaccttttacctcgtcctcagtacaactgaagtgacttttgataccccagacctcgacatcaatctgaagctcgaaaccacaagtaatcaggacaatttggcgccgataactgcaaaagccaaggtagtgatcgagctactactgtctgtctccggggtggcaaaaccgagtcaggtctatttcggggggaccgtcgtaggcgaacaggccatgaagtcagaggacgaagttggatcactgatagaatatgaattccgcgtcattaacctcggtaaacccctgaccaacctgggcacagccaccttgaatatccagtggcccaaggagatttccaacggtaagtggctgctgtatctggtcaaggtcgaatccaaaggacttgaaaaagtcacctgcgaaccacagaaggaaatcaactcactgaacctgaccgagtcccacaactctcggaaaaagcgggagattacggagaagcagatcgacgacaacagaaagttcagcctgtttgcagagaggaagtatcagacactgaactgctccgtgaacgtcaactgcgtaaatatccgatgtcctctgcgcgggctggattcaaaggccagccttatactgcgcagccgcctgtggaatagcaccttcttggaggagtattcaaaactgaattacctggacattctgatgcgtgcatttatcgatgtgaccgccgcagccgagaacattagactgcccaatgctggaacccaggtgcgggttacggtgttcccatctaagacagttgcccaatactctggcgtgccctggtggatcatcttagttgctatcctggccggcattttaatgctagctctgcttgtgttcattctatggaagtgtgggttcttcaagcgtagtcggtatgacgactccgtgcctagatatcatgctgtaaggattaggaaggaggagagagagataaaagatgagaagtacatcgacaacctcgagaagaagcagtggataacaaagtggaatgagaacgagtcttatagttag

SEQ ID NO: 15585 - DNA, 3414 bp, Artificial Sequence
  Description of Artificial Sequence: Synthetic coding sequence
atggcgggagctcggtctagagacccgtggggagcctcagggatttgctatctgttcgggagtctcctggtcgaattactcttcagcagagcggtagctttcaatctggatgtcatgggcgccttgcgcaaagaaggtgagcctggatctctatttgggttttcggtggcactccaccgccagctgcaaccaaggccgcaatcctggctgctggtgggtgctcctcaggcgctggccctgccaggtcagcaggctaacagaactggcggcctttttgcttgcccactgtcactggaagagactgactgttaccgtgtggatatcgatcagggagccgacatgcagaaggagagcaaggagaatcaatggctcggtgtgtccgtgaggagtcaaggccctggaggcaaaatcgtcacctgcgctcaccgatacgaggcccggcaacgcgttgatcagatcctggaaacccgggacatgataggcaggtgcttcgtgctgtcgcaggatctcgctatccgggacgagttagacgggggggagtggaaattttgtgaaggccgaccccaggggcacgaacagttcggcttttgtcaacagggaaccgctgccgcgtttagtccagactcccactacttgctatttggcgctcctgggacttataactggaagggcctcctattcgtaaccaatatcgactcctccgaccccgatcagttggtgtacaaaacactcgaccccgctgacaggcttcccggcccagccggagatctagcgctgaattcttatttaggtttttctattgactcggggaaaggcctggtgagagccgaagagctgagttttgtcgcgggagctccaagggctaaccataagggagccgtcgtgatcttacggaaggactctgctagcagattggtaccagaagtgatgctgagcggggaacggctaacaagcggcttcgggtatagcctggccgtggctgatctgaatagcgatgggtggcctgatctgatcgttggtgctccctacttcttcgaacgtcaggaggagcttggaggagctgtctacgtgtacctgaaccaagggggtcattgggccggaattagccctctgaggctgtgtggcagcccggattcaatgtttgggatttccctcgcagttctgggcgatctgaaccaggatggatttccggatatagccgtgggggctccgttcgatggcgacggcaaggtatttatctaccacggcagttccctaggcgttgtggccaagccctcccaagtccttgagggagaggcagtgggcattaagtcttttgggtactctctctctggtagcctggacatggacggcaaccagtatccagacctgttggtggggtccctggcggacaccgccgttttgtttagagcaaggccaatcttacacgttagtcatgaagtatctatcgcgccaagatcgatcgacctggaacaacccaattgtgccggggggcactccgtatgtgtggatctaagagtatgtttctcttacattgcggtccctagctcttactcccccaccgtagctctagactatgtgttggacgctgataccgacagacgcctacggggacaggtgccacgggttacattcctttcccgaaatcttgaagagcctaagcaccaggcatctggcactgtatggctgaaacaccaacacgacagggtttgtggcgatgccatgttccagttacaggaaaacgtaaaggataagcttcgggcgattgtggtgaccctctcttatagcctgcagacgccacggctccggcgccaggcgccaggccaagggttgccccccgtcgctcccatcctcaacgcccatcagccttctactcagagggctgagatacacttcctgaaacagggctgcggcgaagataagatttgtcagtccaacctgcagcttgtgcgcgcccggttctgcacaagagtatcagacactgaatttcagccgctgcctatggatgttgatgggaccaccgcactatttgctctgtctggccagcccgtgatagggctcgagctgatggtgacaaatctgccaagcgatcctgcccagccacaggctgatggggatgatgcgcatgaggcgcagttgctggtcatgctgcccgacagtcttcactatagcggcgtcagagcgctcgaccccgcagagaaacctctgtgtctctccaacgaaaacgccagccacgtcgaatgcgagcttgggaatcccatgaaacgcggggcccaggtcacgttttacttaatattgagcacatccggcataagcatcgagaccacagaattggaagttgaactcttgttagccacaattagtgagcaagaactccaccctgtcagcgcgcgtgcaagagtgtttattgaattgcctctatctattgctggcatggctatcccccaacagctgttcttttccggcgtggtgaggggagagagggctatgcagtccgagcgtgatgttggctccaaagtgaagtacgaagtgacagtcagtaatcaaggccaaagcctgcgcacattgggaagcgcatttttgaatataatgtggccacatgaaatcgccaatgggaaatggcttctttacccaatgcaggttgagttagagggtgggcaaggccccggacagaaaggcttgtgctcacccagacccaatatcctccatctagatgtagattctagagatcgtaggcgcagagagcttgaaccaccggaacagcaagagcccggcgaaagacaagaaccatccatgagttggtggccagtcagttcagccgaaaagaagaagaacataacccttgattgtgctaggggaactgccaattgcgtcgtgttctcctgtcctctctacagttttgacagggccgccgtgctgcacgtttggggccgcctgtggaattcaacttttctagaggagtattccgctgtgaagagcttagaggtgattgttcgtgctaatatcactgtgaagtcctctattaagaatctgatgcttagagacgcgtcaaccgtgattccggttatggtatatctggatcccatggctgtagtagctgagggggttccttggtgggtgattttacttgccgtactcgctggacttctcgtccttgcccttctggtgttactcctgtggaagatgggcttttttaagagggccaaacacccggaggccaccgtccctcagtaccatgcagtcaaaatacctcgcgaggacagacagcaattcaaggaggagaagaccggaacaatcctccgcaacaactggggctccccgagaagagaaggcccagatgcccaccccatcctggccgctgacgggcaccccgagcttggccccgatggccaccctggcccggggactgcgtag

SEQ ID NO: 15586 - DNA, 3489 bp, Artificial Sequence
  Description of Artificial Sequence: Synthetic coding sequence
atggccggtgctcgcagtcgcgatccttggggcgcatctggaatctgctacctcttcggatctctcctggttgaacttctctttagtcgggcagttgcttttaatctggacgtaatgggggccctgaggaaggagggcgagcctggttccctgtttggtttttctgtggcgctccacaggcagctgcagcctcgtccccagtcctggttgctcgtgggagctccccaggccctcgcactgcccggacagcaggcaaatcggacggggggcctatttgcttgtcctctgtccctggaggaaactgactgttatagagtggatatcgaccagggtgccgacatgcagaaggaatctaaagagaaccagtggctgggagtctccgttagaagtcagggcccaggcggcaaaattgtcacgtgtgctcaccggtacgaggcgagacagagagtcgaccaaatactggagactcgggatatgatcggccggtgtttcgtcctctcccaggacctggccattcgggacgaactggacgggggtgagtggaaattttgtgaaggcaggccgcagggccatgagcagtttggcttttgtcaacaggggactgctgccgcttttagccctgattctcattacctgctctttggcgcccctggcacttacaactggaagggaactgccagagtagaactttgtgcccagggctccgcggatctcgcccatctggacgacggtccgtacgaggccggaggggaaaaggaacaggatcctcgactgataccggtgccagctaacagctactttgggctgctctttgtgaccaacattgactctagtgaccctgatcagcttgtgtataagactcttgacccagcagacagactccctggacccgctggcgatttagcgttgaattcctacctggggttcagcatcgattcaggaaagggtttggtgcgggccgaggagctgtcctttgtggctggagcgcctcgggctaatcacaagggcgctgtagtcatattaagaaaggattctgcgtcccggttggtcccagaggttatgctgtctggcgagaggcttaccagcggattcggttactccctcgcagtcgccgacctgaacagcgacggctggcccgacttaatcgtcggagccccttacttttttgagcggcaggaggagctggggggggcagtctacgtttacctgaaccaagggggccactgggccgggatatcacctcttcggctgtgtggttcaccggattccatgtttgggataagccttgcagtgctgggagatttgaatcaggatgggttccccgacatcgccgtgggagccccctttgatggcgatggcaaggtgttcatctaccatggatcttctcttggcgttgtcgccaagccatcccaggtgctcgagggcgaagcagtcggaatcaaatctttcggttatagtctgagcgggtcattagacatggacgggaaccaatatccggatctcctggtagggagcctggccgacaccgccgtgctgtttagagcccgtccaatattgcacgttagtcatgaagtaagcattgccccaagatccattgacctagagcagcccaattgtgcggggggccactctgtatgtgttgacctccgagtgtgctttagttatatcgctgtgccgagttcttactctccaaccgtggcccttgactatgtgttggatgccgacaccgatcgcagactgcgcggccaagtgcctcgcgtgacctttctcagtcgcaacctcgaagaacctaaacaccaggcaagcggaactgtttggctgaagcaccagcacgaccgcgtctgcggggatgccatgtttcaactccaggaaaatgtcaaggataagttgagggcaattgtggtcactctgtcttactcactacaaactccacgactcagacgccaggctccaggtcaaggtctgccacctgtcgcccccattctcaatgctcatcaaccctccacccagcgtgccgagatacatttcctgaagcagggatgcggcgaagataaaatttgccagagtaatctgcaactggttcgggcccgcttttgtacacgggtctccgacacggagtttcagcccttgcccatggacgtagacgggacaaccgcactttttgccctttccggccagcctgtgattggcctcgagttaatggtgacaaaccttcccagcgaccccgctcaaccccaggccgacggggacgatgctcacgaagctcaacttctggtgatgttacccgactccttacactattccggggtccgtgccctcgatccagcagaaaaaccgctctgcctgtccaatgaaaatgcttcccacgtagagtgcgaactgggcaatcccatgaagaggggtgcacaggttaccttttacctgatcctttctacctccgggatttctatcgagaccaccgaactcgaagtggagctgttgctggctacaataagcgagcaggaactccacccagtgagtgccagagccagggtgttcatcgagctcccactgtccattgccgggatggccatcccacagcagctgttctttagtggagtggtgaggggagaaagggctatgcagtccgaaagagatgtaggctctaaggtcaaatatgaggtgacagtttccaatcaggggcagtccctcaggacactaggctccgcgtttctgaacatcatgtggcctcacgagatcgccaatggcaaatggctcttgtatcccatgcaggtggaactcgagggaggtcagggacctgggcagaagggcttgtgcagtccgaggccgaacattctgcacttagatgtggattcgagagaccgaaggcggagggaacttgaacctccggaacagcaagagcccggcgaaaggcaggagccatccatgtcctggtggccagtatcctcggcagagaagaagaagaatatcacgctggattgcgcaagaggcacagcaaattgtgtagtgttttcttgccctttgtatagtttcgatagagctgcagtgctgcacgtatggggccgactatggaacagcacatttctcgaagaatactctgccgtcaaaagcctagaagtaattgtgcgcgcgaacatcactgttaagtcttccatcaagaacctgatgttgagggacgcctcaaccgtgatcccggttatggtgtacctcgaccctatggcggtcgttgcagagggggtaccttggtgggtgatcctcctggcagtgttggctggtctcctggtcctcgccctgctcgtgctcctgctgtggaagtgcgggttctttcatcgcagctcacagtcctcctctttccccactaactaccatagggcatgccttgccgtacaaccttctgctatggaggttggcggtccaggcaccgttggatgggacagctctaatggcaggtcaacaccaagacccccctgtccctctaccatgcgttag

SEQ ID NO: 15587 - DNA, 2976 bp, Artificial Sequence
  Description of Artificial Sequence: Synthetic coding sequence
atggctggagctcgcagtcgggacccttggggcgcgtccggaatctgctacctttttggctccttgctggttgagctactgttcagcagggctgtcgcttttaatctcgatgtgatgggagctcttcgcaaagagggcgagcctgggtcactgttcggattctccgtcgcactgcaccggcaactgcagccaagacctcaatcctggctcctcgtcggtgctccacaggcgcttgctctgcctggacagcaggcaaaccgtaccggcggcttgtttgcctgtccccttagcctggaagaaactgattgttacagggtggatattgaccaaggagccgatatgcagaaggagtctaaggaaaaccagtggttgggagtgagcgtccgaagccagggccctggcggaaagatagtcacctgcgctcatagatacgaggctagacagcgagtggatcagattctggaaacaagggatatgatcggccggtgttttgtcctatcccaggacctggccattagagatgaacttgacgggggcgagtggaagttctgcgagggccgtcctcagggccacgagcagtttggcttctgccagcagggcactgcagcggctttctctcccgatagtcattatcttctgttcggagcccctgggacttacaattggaaggggaccgcacgagttgagttgtgcgctcagggatccgctgatctggctcacttggatgacggaccctacgaggcaggcggggaaaaggagcaagaccctcgacttatacctgtgccagcgaattcctactttggactcctcttcgtgaccaacatcgactccagtgaccccgatcagctggtctacaagacccttgacccagctgataggctcccaggccccgctggagatcttgccctgaatagctacctggggttttccattgatagtgggaagggccttgttagagccgaagaactgagctttgtagccggtgctccccgcgctaaccacaagggggctgtagttatactacggaaggattctgcaagcagactcgtgccggaggtcatgctgagtggcgaaaggctgacatcgggctttggatactctctagctgtggcagatctcaactctgatggatggcctgacctcatcgttggagcaccatatttcttcgagcggcaagaggagttgggtggggctgtgtacgtgtacctcaaccagggaggacactgggcagggatatcaccactccggctgtgtgggagtcctgatagcatgttcggtatctctctggccgtcctaggcgatcttaatcaggatgggtttcctgacattgcagtgggcgccccttttgacggggacgggaaggtgttcatctatcacggctctagcctgggagtggtggcgaagccctcccaggtgttggaaggcgaggcggtggggataaagagcttcgggtattccttatccggatccctggacatggatggaaaccaataccctgacctcctggtggggtccctggcagataccgctgtccttttccgtgcacgaccgattctccacgtgtcccatgaagtgtccatcgctcccaggagcatagacctggagcagcccaactgcgcgggcggtcatagtgtttgtgtagacctgcgcgtgtgcttctcctacatagcagtgccaagttcatactcccctaccgttgctctggactatgtgctggacgctgacaccgaccgccggctgcgagggcaagtgccacgggttacatttctcagccgcaacttagaggagccaaagcatcaggctctcgatccggcggaaaagccgttgtgtttgtccaacgagaatgcaagtcacgtcgagtgcgaacttgggaatccaatgaagcgtggggctcaggtaaccttctatctcattctgtccaccagcgggatcagcattgagactacggagcttgaagtggagctcttgctcgccaccattagcgagcaggagcttcaccctgtgtccgcccgagcccgggtatttatagaactgccccttagcattgccggaatggccatccctcagcagctgtttttctccggtgttgtgagaggagagcgcgctatgcagtccgagagagatgtcggctcgaaagtcaaatacgaagtcaccgtgagcaaccaggggcaatcgcttcggactctcgggagcgcgtttctgaatataatgtggccccatgagatcgcaaacggcaagtggctcctgtacccaatgcaggtggaattggagggcgggcagggccccgggcagaagggcctgtgttcccctaggccaaatatccttcatctggacgtcgatagtagggacaggagacgccgggagctcgaacctcccgagcaacaggagccaggtgaacggcaggagcctagcatgtcatggtggcctgtcagtagcgccgagaagaagaagaatataacactggactgcgcacgtggaacggcaaactgcgtcgtgttctcttgccccctgtattcttttgaccgcgctgctgtcttgcacgtctggggccgtctatggaattccacattcctcgaagaatattctgcagtcaaatccctggaagtaatcgtgagggcaaacatcacagtcaagagctcaatcaaaaacctgatgctgcgggacgcctcaacagtcatcccagtaatggtgtatctggacccaatggctgtggtcgccgagggcgtgccatggtgggtgattttgttggctgtgttagcaggtctgctcgtcttggcactgcttgttctgctgctctggaagtgtggcttcttccaccgctcctctcaaagcagctcatttcccactaactatcatcgcgcctgtttagctgtacaaccaagtgcaatggaggttggcggccctggcaccgttggctgggacagcagtaacggtcgctccactccaaggccgccctgccctagcaccatgcggtag

SEQ ID NO: 15588 - DNA, 3357 bp, Artificial Sequence
  Description of Artificial Sequence: Synthetic coding sequence
atggccggagctagatctcgggacccttggggcgcttccggaatttgctatcttttcggaagtctgctggttgaactcctttttagcagggcggtggcatttaatctggatgttatgggagcactcaggaaagagggggaacccgggtctctgtttggcttcagcgtagccctgcaccgccagttacagccccggccccagtcctggcttctggtgggcgccccacaagccttggctttacccggccagcaggcgaacagaaccggaggcctctttgcctgtcccctatctcttgaggagacagactgctaccgcgtcgacatagatcagggtgccgatatgcagaaagaaagcaaagaaaatcagtggctgggtgtttctgtgaggagtcagggtcctggaggtaaaatcgtaacttgtgcccatagatacgaggcccgtcaacgtgtggaccagattttagagacccgggatatgatcggtcgatgctttgtcctctcccaggatttggctatcagagacgagctggatggtggagagtggaaattctgtgagggtcgtccccaggggcacgaacagttcggattctgccagcagggcacggcagctgccttctcaccagattcccattacctcctcttcggcgcgccgggtacgtataactggaagggccttctttttgttaccaatattgatagttcggatcccgaccagttagtttataaaacacttgacccagccgatcgcctgcccggccccgcaggtgacttagccctcaactcctatctgggtttctctatcgactcagggaaggggctggtgcgggctgaggagctttccttcgtggccggcgcaccaagagccaatcataaaggggccgtggttattttgaggaaggattcggcctcacggctcgttcctgaagtgatgctgagtggggagcgcttaacgtcgggctttgggtactccctcgccgtggccgacctgaattctgatggttggcctgacctcatagtgggcgccccttacttctttgagcgacaggaagagttaggtggcgcggtgtacgtgtacttgaaccaggggggccattgggcaggcatttcacccctccgactgtgcgggagccctgatagtatgttcggcatctccctcgccgtcctcggggatctcaatcaggatggatttccagacatcgccgtgggcgcaccgtttgacggggatggcaaggtgtttatttatcacggaagtagcttgggcgtcgtcgccaagccatcccaggtcctggaaggggaggcggttggtatcaaaagttttgggtactcactgtcgggttcactcgatatggacggcaaccaatatcccgacttactggttggctcacttgctgacacggccgttctgttccgggcacgcccaatactccacgtgtctcatgaggtgagcatagcgccccgctcaatcgacctggaacagcccaattgtgcaggcggacattccgtgtgtgtggatctcagagtctgcttcagctacatcgctgtgccaagctcctactccccaacggtggcattggactacgtcctggacgcggacaccgatagaaggcttagaggccaggttcctagagtcacctttttatctcggaatctcgaggaacctaaacaccaggccagcgggacagtctggctgaagcatcagcatgatcgggtgtgtggtgatgccatgttccagctacaggagaatgtaaaggacaagcttcgtgcgattgtagtgacactctcatactcccttcagaccccccggctgcggaggcaggctccgggtcagggccttcctcccgttgcacctatcctgaatgctcaccaaccaagcactcagagggcagaaatccacttcctcaagcagggctgtggtgaggacaaaatatgccagtctaaccttcaactggtcagggcaaggttctgtacgcgagtgagcgacaccgagttccaacctctgcccatggacgttgacggcacaacagcactgttcgccctgtccggccagccggttattggcctggaactaatggtcaccaatctgccttctgacccagcgcagccccaagccgatggtgatgacgctcatgaggctcaactgctcgtcatgctgccggactctcttcactatagcggggtgagggcccttgaccctgccgaaaagccactgtgcctttccaatgagaacgcttctcacgtggagtgcgaactggggaatcctatgaagcgcggcgcccaggtgaccttttatttgatactttcaacctcaggcatctccatcgaaactacggaactggaggtggaattgcttctggcaactatatctgagcaggagctacatcctgtgagcgcgagagctcgggtgttcattgagctgccactgagcattgcaggaatggccatccctcagcagctatttttctccggggtggtcagaggcgaacgcgctatgcagtcagaaagggacgtggggtccaaggtgaagtacgaggttactgttagcaatcagggacagtctttaaggactctgggatcagccttcctgaacatcatgtggccccatgaaatagccaatgggaagtggcttctctatccgatgcaagtggaactggaaggcgggcagggccccggccagaagggtttgtgcagcccacggcctaacatcttgcatctcgacgttgattctagagacaggcggcgaagagagctcgaaccgccagaacagcaggaaccaggggaacggcaagaaccaagtatgtcatggtggcccgtgagctccgcagagaagaagaagaatatcactctcgactgtgctcggggcacagctaactgtgtcgtgttcagctgccccctgtacagctttgaccgcgcagccgtgcttcatgtctgggggagattgtggaactcgacttttctggaggagtactctgcagttaagtccctcgaggtgattgttcgtgctaatattaccgtgaagagttcgatcaaaaacttaatgctgcgtgacgcctctaccgtgattcctgtcatggtgtacctggacccaatggctgttgtggccgaaggagtcccatggtgggttatcctgcttgccgttctggctggccttttggtgctggctctgctggtgctcttactctggaaatgcggatttttccatcggtcatctcagtccagctcattccctacaaactaccaccgcgcctgcctggctgtacaaccttctgctatggaggtggggggaccgggcacagttggctgggacagctctaatgggagaagtaccccccgtccaccctgtccaagcacgatgcgatag

SEQ ID NO: 15589 - DNA, 3369 bp, Artificial Sequence
  Description of Artificial Sequence: Synthetic coding sequence
atggccggtgccaggagtcgcgatccatggggagctagcggcatatgctacctgttcggtagccttcttgtggagttgctgttcagtagagccgtggctttcaatttggacgtgatgggggctctgcggaaggagggcgaacctggatcactctttggtttcagcgtggcgttgcataggcagttacagcccaggcctcaatcttggctactggtcggagctccgcaggcattagcgctcccaggacagcaagccaatcggacgggtggtctgttcgcatgcccactgagcctggaggaaacagattgttacagagttgatatcgatcagggagccgatatgcagaaggagagtaaggaaaaccaatggttgggagtctccgtgcgttcacagggaccaggaggaaagatagtcacctgtgcccaccgctatgaagctagacagcgcgtcgaccaaattctggaaacccgagacatgatcggccgctgctttgtgctgtcccaggatctggcaattagagatgagctagatggcggggagtggaaattctgtgagggccgcccccagggtcatgagcagtttggattttgccagcagggcacagccgccgccttcagcccagacagccactacttgctcttcggcgcacctggaacgtacaactggaaagggactgcccgcgttgaactttgtgcgcaggggtcagccgacctggcacatctcgatgacggaccctacgaggctggaggcgaaaaggagcaggatcctaggttgatccctgtgccggccaacagctacttcgggttttcgattgattcaggaaagggactcgtgcgtgcagaagagttaagcttcgtagcgggagcccctcgggccaaccacaaaggagccgtcgtgattctgagaaaagactcagcttctaggctcgtgccagaagtcatgctatccggagaacgcctcacttccgggttcgggtactcactggctgtagctgatttaaactctgacggctggcccgacctgatcgtaggtgcgccatacttcttcgagagacaggaagagctgggaggagctgtgtacgtttacctcaaccagggcgggcactgggcgggaataagccctctcaggctgtgcggctcccccgacagcatgtttggaatttccctggccgttctcggagatctgaaccaggatggctttcctgacatcgccgtcggcgctccttttgatggggacggcaaggtcttcatttaccatggaagcagccttggggtcgtggcgaagccaagccaggtgttagaaggagaggccgttggtatcaagtcctttggttactccctgagcggctcactcgacatggacggtaaccagtaccccgacctgctcgttggaagtctggctgacactgctgtgctcttccgtgctcgccccattctccacgtgtcgcatgaggtgagcatcgctccccggtctattgatctggaacaacccaattgtgctggaggccattcagtgtgtgtggacctgagggtgtgctttagctacattgccgtaccttcttcatattcccctactgttgcactcgactacgttttagatgctgatactgatcgcagacttcgaggccaagtcccaagggttacctttctgagtcggaatcttgaggagcctaagcatcaggcgtcagggaccgtctggctcaagcaccagcacgacagggtgtgcggcgacgctatgtttcagctgcaggagaacgttaaggataagcttagagcgatagtcgttactctgtcttatagcctgcagactcccaggctgagaaggcaagcccctggtcaggggctgccacctgtggctccaatcctcaacgcccaccaaccatctacccaaagggcagagatccactttttaaagcaggggtgcggcgaggataagatttgccagtctaacttgcagctggtgcgcgccagattttgtacaagagtgagcgacaccgaattccagccactgcctatggacgtcgacggcaccaccgcacttttcgccctgtctgggcagcctgtgatcggtctggagctgatggtgactaacctgcccagcgacccagcacagcctcaggccgacggcgatgatgcacacgaagcgcagcttctcgtcatgctgcctgactcactccattactctggggtacgcgccctggatcccgccgagaaacctctgtgtcttagtaacgaaaatgcttcacacgtggagtgcgagctaggaaacccgatgaagcgaggagcccaagttacattttacttaatcttatccacttctgggatctccatcgaaaccacagagctggaggtggagcttctcctggctacgattagtgagcaggaactacatcctgtgagcgcacgcgccagagtctttattgagctgcccctcagtatcgccgggatggcaatcccccagcagttgttttttagtggagttgttaggggtgaacgtgcaatgcagagcgaacgtgacgttggctcgaaggtgaagtacgaggtaactgtgagcaatcaggggcaatcactccgcacccttgggtctgcctttcttaatattatgtggccccacgaaattgctaacgggaagtggctgctttatcccatgcaagttgagctcgagggaggccagggtcccggacaaaaaggtttatgcagccctagacccaacatcttgcacctggacgtagattcacgcgatcggcgccgcagggagttggaacccccagagcagcaggagcccggcgagaggcaggaaccctccatgagttggtggccggtgtccagtgcggaaaagaagaaaaatataactttagattgcgctaggggtaccgctaattgtgttgttttttcctgtcccctttactcttttgatagggcagctgtgctgcacgtatggggcaggctgtggaactctacctttctggaggagtactctgccgtgaagtctctggaagtcatcgtccgggcaaatatcacagtgaaatccagtattaagaacttaatgcttcgggacgcatctactgtgattcctgttatggtgtatctggatcctatggctgttgtggcagaaggagtcccctggtgggtgatacttctggcagtcctcgctggcctgctcgtgttagcactgctggtgctccttctgtggaaatgcggattcttccaccgatcctcccagtcctcgagttttcccaccaactaccatcgcgcttgcctcgccgtccagcccagcgcaatggaggtcggaggcccaggcaccgtgggatgggatagttccaacgggcgctccaccccacggcctccctgtccatctaccatgcgttag

SEQ ID NO: 15590 - DNA, 3135 bp, Artificial Sequence
  Description of Artificial Sequence: Synthetic coding sequence
atggctccctttgcgaccccgatggttcaggctctcaccacaacaagaattcagcgacaggccgagggtttccagtgctggcgagagtgcggcactcgccgttctcctttcgagggcaaggaaacttgtgctcatcgctacgaggccaggcagagagtagaccagatccttgagacaagggacatgattgggcgatgtttcgttcttagccaggacctggctatcagagatgagctcgatggcggcgagtggaagttttgtgagggccgcccccaaggccatgagcagttcggtttttgccaacagggcacagccgctgcgttcagtcctgatagccactatctcctctttggcgccccgggaacatataattggaagggaacagccagagttgaactgtgcgcccaaggttctgcagacctggcgcatttagacgatggcccctatgaggccggaggagaaaaggagcaggacccaagactcattccagttccagctaacagttactttgggtttagtattgacagtggcaagggtctggtccgcgccgaggagctgtcctttgtggccggcgcacccagggcaaatcataaaggcgccgtggtcatcctgcgcaaagatagtgccagccgcctggtccctgaagtgatgctgtctggagaacggctgacttctggattcggctactcccttgccgtggcagacttgaactcagatggctggcctgatctgattgtgggcgcaccttacttctttgaaagacaggaggagcttggaggtgctgtgtatgtttatctgaaccagggaggccactgggccggaatctcgccgttacgactctgcggcagcccggactctatgttcggaatttcgttagccgtgctgggcgacctcaaccaggacggatttccagacattgccgttggagcacccttcgacggggatgggaaagtgtttatctatcatggtagctcgcttggggtcgtggcaaaaccctctcaggtgctggagggggaggctgtcgggatcaagtccttcggatactctctgtcgggcagtttagacatggatggcaaccagtaccctgatctcctggtcgggagcctcgccgacacggccgtgctcttccgtgctcggcccatcctccacgtttctcatgaggtgtcaatcgcacctagaagcatcgacctggaacagcccaattgcgcaggaggacactctgtctgtgtggatctgagggtgtgcttttcttacattgccgttccgtcctcctacagccctaccgtcgccctcgactatgtgctggatgccgatactgaccggagactgaggggacaggtaccacgggttacctttctctcccggaacctggaggagcccaagcaccaggcaagtggtacagtgtggcttaagcaccaacacgaccgcgtttgtggcgacgcgatgttccagctacaggagaatgtgaaggacaagctgagagccatcgtggtcacactgtcctatagccttcagactcctcggctgcgaaggcaggcacccggccagggcctgccccctgtggctcccatacttaatgcacaccagcctagcacccagagggcagaaattcactttctgaagcagggctgcggcgaggataagatctgtcagagcaacttgcagttggtgagggcccggttctgtacaagagtgagcgacactgaatttcaaccactgcctatggacgtcgatggaaccaccgcattattcgccctgtctggtcagcctgttatcggtctagagctgatggtaaccaacctcccctccgatcccgctcagccacaggccgacggagacgatgcccacgaggcccagttattagtaatgcttcccgattctttgcactactctggagtccgggcattagaccccgccgagaaacctctatgtttgagcaacgagaatgccagtcatgtcgagtgcgaacttggcaaccccatgaaacgcggggcacaggtcaccttttatctcatcttgagcacatccggcatcagcatcgaaaccaccgagcttgaggtggagctcttactggcgacgatatctgagcaggaacttcacccagttagcgccagagccagggtgttcattgagttgccactttcaattgctggaatggccatcccccagcagctgttcttcagcggtgtcgtgagaggagagagagctatgcagagcgaacgcgacgtggggagcaaggtgaagtatgaggtaactgtgtctaatcagggccagtccctgagaaccctgggctcagcctttcttaacattatgtggcctcatgaaatcgccaacgggaagtggttgctgtatcccatgcaggttgagctagaaggcggccagggccccgggcagaaggggctttgtagcccccgtcctaatattttacacctcgacgtcgattcacgtgaccggagacggagagagctggagccgccggaacaacaggagcccggggagcgacaggaacccagtatgtcttggtggcctgtctctagtgctgagaagaaaaaaaatatcactctggactgcgcccgaggcactgctaattgtgttgtctttagttgtccactgtattccttcgaccgggctgcagttttacatgtgtgggggcggctgtggaactccactttcctggaagaatacagcgctgtcaagagcctggaggttatagtgagagccaacattaccgtgaagtcttccattaagaatcttatgctgcgcgacgcgagtactgtgattcccgtgatggtttacctcgatcctatggccgtggtcgctgagggcgtcccatggtgggttattctgttggccgtgctcgccggattgctggtgctcgccctgttggtactattgctgtggaaaatgggcttttttaaacgggcgaaacaccctgaagcaacagtgccccagtaccatgctgtcaagattccaagggaagacagacagcagttcaaggaggagaaaacgggaaccattctgaggaacaattggggatctcctcggagagaggggccagacgctcaccctatcctggctgcagatgggcaccctgagctggggcccgatggccatccaggccctggaaccgcctag

SEQ ID NO: 15591 - DNA, 3426 bp, Artificial Sequence
  Description of Artificial Sequence: Synthetic coding sequence
atggctggcgctcggtcgcgcgatccctggggcgcctccgggatatgttacttgttcggcagtttacttgtggagctgctcttcagtagggccgtggctttcaatttagacgtaatgggcgccctgcgtaaggaaggcgagcccggatccctattcgggttttccgttgcgctgcacagacagctccagccccggccccagagctggctgctagtgggggccccccaagcactggcattgccaggacagcaggccaaccgcacgggcggcctcttcgcctgtccactgtctttagaggagactgattgctacagagtggacatcgaccaaggcgcagatatgcaaaaagagtcaaaggaaaatcaatggttaggcgtcagcgtcaggagccaggggcccggcggtaagatcgtaacatgtgcccatagatacgaggccaggcagcgtgtggatcagatcctggaaacgcgcgatatgatcggacggtgcttcgtcctgtctcaggacctggcaattcgagacgagctcgacggaggggaatggaagttctgcgaaggcagacctcagggacacgaacagttcggcttttgtcagcagggaacagccgcggcgttctctcccgatagccactaccttctatttggggccccaggtacgtacaactggaagggcactgcccgtgtcgaactctgcgctcaaggcagtgctgatctggcgcacctggatgacggaccttatgaggccgggggagaaaaggaacaagacccacggctaattccggtccccgctaactcttacttcgggttcagcattgacagcggaaaaggactggttcgcgcagaggaactgagctttgttgcgggagcaccaagggctaatcacaaaggggccgttgtgatcctgagaaaggattctgcatccaggctggtccccgaagtcatgctgagcggtgagcgtttaacatcaggctttggctacagcctggctgttgcagacttaaattccgacgggtggcccgacctgatcgtgggtgcgccatactttttcgaaaggcaggaggagttaggcggagctgtctatgtctacctgaaccagggagggcattgggcaggtatttcccctctcaggctgtgcggatctccagattctatgttcggtatcagcctcgccgtactgggtgacttaaatcaggacggctttcctgacattgcggttggcgcacccttcgacggcgacggtaaggtgtttatttaccacggctccagcttaggagtggtagccaaaccttctcaggtattggagggagaggcagttggcattaagagtttcggatattcactgtccggtagtttggatatggatgggaatcagtatcccgatctcctggtagggagtcttgctgacactgccgtactgtttagagccaggcccatcctacatgtgtcacacgaagtgagtatagcccccaggtctattgaccttgaacagcctaactgtgctggggggcatagtgtgtgtgtggatctgagggtgtgtttctcttacatcgccgtgcctagttcttactctcctactgtggcgctcgactacgttcttgatgctgacactgaccgacggctgcgtgggcaggtgccgcgggtgacgttcttgagccgcaaccttgaagagcccaaacatcaggcatctggaacagtgtggctgaaacatcagcacgatcgtgtgtgcggcgatgcaatgtttcagctccaggagaatgtgaaagataagctacgggcaattgttgttacacttagctacagcctacaaactccgagactgagaagacaggctccaggccagggcctgccgcccgtggcccctatcctcaatgcccaccagcccagcacccagcgggccgagatccatttcctcaaacaaggctgtggggaggacaaaatctgccagtcaaacttacaattggttcgagcccggttctgcactagggtctccgacactgaatttcagcccttgcctatggacgtggacggcactaccgccctgttcgccctttctgggcagcccgtcattggtttagaattgatggtgacaaacctgccctctgatcctgctcagccacaggctgatggggacgatgctcatgaagcccagctgctggtaatgctgccagattccctgcactactctggtgtgagggctctggaccctgccgagaaaccactttgtctgagcaatgaaaacgcctctcatgtggagtgcgaactcggaaaccccatgaagcgtggcgcacaggtgactttctatcttattttgtccacatccggaatctccattgaaactaccgaactggaagttgaactgctcctggccaccatcagtgaacaagagcttcaccccgtgagcgcgcgcgcgagggtttttattgaacttccactgagtatagcagggatggctatcccgcaacagctgttttttagcggggtcgtgaggggggagagagctatgcagtcagaacgcgacgtcggttcaaaggtcaagtatgaggtaacagtgtccaatcagggtcagtctctgcgcacactgggatctgctttccttaacattatgtggccacacgagattgccaacggaaagtggctgctgtatccgatgcaggtcgaactcgagggcgggcagggtccagggcaaaagggcctgtgttctccccgccccaacattttacatttggacgttgactctcgagaccggcgacgcagagaacttgagccacccgagcagcaggagccaggtgaacgtcaagaaccgagcatgagctggtggcctgtttcttcagccgaaaagaagaaaaatatcaccctagactgtgcacgagggaccgcaaattgtgtggtgtttagctgtcccctttattctttcgacagagccgccgtgttgcacgtctggggccgactgtggaactctacctttctagaggagtatagcgccgttaaatctttagaagtgatagtaagggctaacatcaccgttaaatcaagcatcaagaacctgatgttgcgggatgcgtccaccgtcataccggttatggtgtacctggatccaatggccgtagtcgccgaaggcgtcccttggtgggttattcttctcgcagtgctggccggtctgttggttctggcattgctggtcctcctgctttggaaaatggggttcttcaagagggctaagcaccccgaggcaacagttccacaataccatgccgttaagataccacgtgaggacagacagcagtttaaagaagagaaaacaggaactatccttcggaacaattggggttcaccccgccgagagggccccgacgcacatccaattctggccgctgatgggcatcccgaacttgggccagacggccacccaggacccgggacagcttag

SEQ ID NO: 15592 - DNA, 3546 bp, Artificial Sequence
  Description of Artificial Sequence: Synthetic coding sequence
atggccggggctagatctagggatccttggggggcatcggggatttgctacttgttcgggtctctgctcgtcgagttgttattttcacgtgccgtggctttcaacctagatgtcatgggcgccctgagaaaagagggagagccaggatccctgttcgggttcagtgttgctctgcaccgtcagctccagccaaggccacagagttggcttctggtgggagcaccacaggcactagctttacccggccagcaggctaatcgaacgggcggcctgttcgcctgccccctatccttggaggaaactgattgctaccgcgtggacatagatcagggggccgacatgcagaaagaatccaaggaaaaccagtggttgggtgtgagcgtgcgcagccagggccctggaggtaagattgtgacatgtgctcacaggtatgaagcgcgtcagcgcgttgaccagatattggaaaccagggacatgatcgggaggtgcttcgttttgtcccaggacttagcgataagggatgagctcgatggcggcgagtggaagttctgcgaaggcaggccgcagggccatgagcagtttggcttctgtcagcaggggacagctgcagccttctccccggactctcattatctcctttttggagcccctggtacctataactggaaagggactgccagagtagagctttgcgcccagggatcagctgaccttgcacacctggatgacgggccatatgaagccggaggcgagaaagagcaggatcctagattgatcccagtccccgcaaacagctattttggacttctcttcgtaactaacatagactccagcgacccagatcagttagtttacaagactctagatccggctgacagattgcctggacccgccggcgatttggcgttgaattcctatctgggctttagcattgacagtggcaagggattagttcgcgccgaagagctctccttcgtggccggcgccccacgtgcaaaccacaagggtgctgtggtcattttgaggaaagatagcgcctccaggctggtgcctgaggtcatgctttctggtgagcggctcactagtgggtttggctactctcttgccgtagccgatcttaatagcgacggctggccagacctaatcgtgggtgctccctacttttttgaacggcaggaagaattaggaggagcagtgtatgtgtatctgaatcagggtggacactgggcagggataagccccctgcgcctttgtgggtcccccgattctatgtttgggattagtctggcagtcctcggcgacctgaatcaagacggattccccgacattgctgtcggggcgccttttgatggggacggtaaggtttttatttatcatggatcttctcttggagtggtcgcaaagccttcccaggtcctggagggagaagccgttggtattaagtctttcggatacagtctatccggatcacttgatatggatgggaaccagtatcccgacctactggtagggagtcttgccgacactgccgtgctgtttcgcgctaggcccatcctgcatgttagtcatgaggtgagtatagcacctcgctccatagacctcgagcagccaaactgcgccggtgggcacagcgtatgtgttgacttgcgtgtatgctttagttatatcgcagtgcccagctcatacagtcctacagtcgccctcgactatgtgctcgacgccgatacagatagacggctcaggggccaggtccccagagtcacgttcttgtcgcggaacctggaggagcctaagcaccaggcctcaggaaccgtgtggctaaaacaccagcacgacagggtgtgtggcgatgccatgtttcagctacaggagaacgtaaaggataagctgcgcgccattgtggtcaccctgtcctactccctgcagacacctcgcctccgcagacaggccccgggccaggggctcccccctgttgcacctattcttaacgctcatcagccttccactcagcgagctgagatccacttcctgaagcaaggttgtggggaggataagatctgccagagcaatctgcaactagtcagggcgcgcttctgtacacgagtctctgatacagaatttcagccactgccgatggatgtggacggcacaacggctctgttcgcgctctcgggccaacccgttatcgggctagagctcatggttacaaacctcccttccgaccccgcccagccacaggcggacggggacgatgctcacgaggcccagctgttggtaatgttgcctgatagcctgcattacagcggcgtgagagccttggacccagcagagaagcccttgtgtttgagtaacgagaacgctagtcacgtcgagtgcgaattaggaaatcctatgaagaggggtgcccaggttacattctatttgattctctccacatcaggcattagtattgagacaacagagctcgaagtcgaactcttgctggcgaccattagcgagcaagagttgcacccggtgtcagcacgcgccagagtcttcatcgagctacctctcagcatcgcaggcatggctataccacagcagcttttctttagtggagtcgtgcgaggagaacgggctatgcagtctgagcgagacgtggggagtaaagtgaagtatgaggtgactgtgagtaatcaggggcaaagtctacgcacactaggatctgcgtttctgaatatcatgtggccccatgagattgccaacggaaagtggctgttgtacccgatgcaggtggaacttgagggaggccagggtcctgggcagaagggtctgtgttcacctcgacccaacatccttcacctggatgtggattcccgtgacaggcgcaggcgggaactcgagcccccagaacagcaggagcctggtgagcgacaggagccaagcatgagctggtggccagttagttccgctgagaaaaagaaaaacattaccctggattgtgctcgcggtacagccaactgcgtggttttttcctgtccgctgtacagcttcgaccgggccgcggtgctgcacgtttggggcaggctatggaactcgacctttctggaggagtactcagctgttaagagcctggaggtgatcgtcagagctaacatcacggtgaagtcctccatcaaaaatctgatgttgcgcgacgcttcaaccgtgattccagtgatggtctaccttgatccaatggccgtcgtcgcagagggagtgccctggtgggtgatactcctcgcagtgctggcaggtctcctagttctggcactgctcgtgcttctgttgtggaagatgggattcttcaaacgagctaaacatcccgaagcaaccgtgccccaatatcatgccgtcaaaatcccccgagaggaccgccagcagttcaaggaggaaaaaactggcaccattctgagaaacaattggggctcaccccgccgcgagggccccgacgctcatcccatccttgcagctgacggtcacccagagttgggtcccgacggtcaccctggccctgggacggcatag

SEQ ID NO: 15593 - DNA, 3147 bp, Artificial Sequence
  Description of Artificial Sequence: Synthetic coding sequence
atggcctttcctccacgtagaaggcttcggttgggtccaaggggtttacccttgctgctgtcaggactgctgctgcccttgtgccgtgcctttaacctggatgtagattcgccggccgagtatagtggtccggaaggctcttatttcggttttgctgtcgacttcttcgttccctccgcctcgtcacggatgtttctgttagtaggcgcccctaaggccaacacgactcaacctgggatcgtggagggaggccaggtgctgaaatgtgattggtcttcaacacgacggtgtcaacccatagagtttgatgccacggggaacagagattacgccaaggatgacccccttgaattcaaaagccaccagtggtttggcgcttctgtgcgttcaaagcaggacaagattctagcatgtgcaccgctctaccattggaggacggagatgaaacaggagagagagcccgtgggtacctgttttctccaagatgggacaaagaccgtagaatatgctccatgtcggagtcaggacatagatgccgacggccagggcttttgccagggtggattctcaatcgacttcaccaaagccgaccgcgtgctgctgggcgggcctggctccttctactggcagggacagctcatcagcgatcaagtcgctgagatcgtcagtaaatatgacccgaatgtttattctatcaaatacaacaatcagttggcaacgcggacagcccaagcgatattcgatgatagctacttaggttatagtgtagccgtgggcgactttaacggggacggtatcgacgattttgttagtggggtgccacgagcagctcggactttaggtatggtgtacatctacgatggcaaaaacatgtcaagtttgtacaactttacgggcgaacaaatggctgcctattttgggttctccgttgctgctacagacattaatggggacgactacgccgacgtgttcataggtgcccctctgttcatggacaggggatctgacggcaagctccaggaagtgggacaggttagtgtatcactgcagcgcgccagcggggacttccaaactactaaattgaatggctttgaagtgttcgcccggttcgggtctgccattgctccactgggggacctcgatcaggacggctttaacgatatcgctattgctgctccctatggaggtgaggacaagaagggaatcgtgtacatttttaacggccggtcaacaggcttgaatgccgtccctagccagatcctggaaggtcagtgggctgccaggtccatgcccccgtccttcgggtattcgatgaagggagctacagatattgataaaaacggctatcctgacttaatcgtcggagcgttcggggtcgatcgagctatcctgtaccgagctcgcccagtgatcacggttaacgctggactggaggtttatcccagcattcttaaccaggacaataaaacatgcagtctacctggcactgctctgaaagtgtcctgcttcaatgtgcgattctgccttaaggcagacggtaagggcgttctcccaagaaaactcaatttccaggtcgaactgttactggataagttaaaacagaaaggggctatccgcagggctctgtttctgtactcgagaagccccagtcactccaagaacatgaccatctcaagaggcggtttgatgcaatgtgaagagttgatcgcatacctccgcgatgaaagcgagtttcgcgataagcttacacctattacaatctttatggaatatcgcctcgattaccggactgccgcagatactaccggcctccagcctattcttaatcaattcactcctgccaacatttctagacaggcgcacatactcctcgactgtggggaagataacgtgtgcaagccaaagttagaggtgtcagtggattccgaccagaaaaagatatacataggagacgataacccactaacattgattgtgaaggctcagaaccaaggggaaggggcctacgaggccgaattgatcgtgtccattcccttacaggccgactttataggcgtggtacggaataatgaagctctggccagattgagttgtgcctttaagaccgaaaatcagactagacaggtggtatgtgatctcggcaatccgatgaaagccggaacccaactgctggcagggttacgctttagtgtgcaccagcagagtgagatggatacctcagtgaagttcgacctgcagattcagtcaagcaaccttttcgacaaagtctcaccagtcgttagccataaagtggatctcgcagttttagctgcagtcgagattcgcggagtttcatctccggaccacgtgttcctgcctatccctaactgggagcataaggaaaatccggagacagaagaagacgtcggtcctgtagtgcagcacatttacgagctgaggaacaacggacctagctccttttccaaggccatgctacacctgcagtggccctacaaatacaataacaacaccctgctatacatcctgcactatgatatcgacgggccaatgaactgcacaagcgatatggagatcaacccgcttcggatcaaaatctctagccttcaaacaaccgagaagaacgacacagtggcaggacagggggagcgtgaccacttaataacaaagagagatctagcgctgtccgaaggagacattcacactcttgggtgtggcgtggctcagtgtcttaaaattgtgtgtcaggtaggacgactggatcggggtaaatcagcgattctctatgttaaaagcttgctttggactgaaactttcatgaacaaggaaaatcagaaccattcttactccctcaaatctagtgcctctttcaatgtgatagaattcccttacaaaaatctaccaatcgaggatatcacaaactctactttggttaccactaatgttacctgggggatccagcccgctcctatgcctgtgcctgtgtgggtgataatactggcggtgctggcaggcttattactgttggcagtgctcgtgtttgtaatgtatcggatggggttcttcaaaagagtcaggcccccacaggaggagcaggagagggaacagcttcagccccacgaaaacggagaggggaactctgagacctag

SEQ ID NO: 15594 - DNA, 3039 bp, Artificial Sequence
  Description of Artificial Sequence: Synthetic coding sequence
atggcttttccaccacgacgacggttgcgtctcggaccacggggtcttcccctgctgctgagcgggctgttactgccgctttgtcgggcttttaatctagacgtcgactcccctgcggagtattctggcccagagggaagttattttgggttcgctgtggatttttttgtgccgtcagcctctagccggatgtttctgctggtcggggccccaaaagccaatacgactcagcccggaatcgtggaggggggacaggtcctcaaatgtgactggagtagcacacggcgctgtcagcctatagagttcgatgctaccggaaaccgtgactatgctaaagacgacccactagagttcaagtcgcaccagtggtttggcgctagcgtgagatccaagcaggacaagattctggcctgtgcaccgctttatcactggcggaccgagatgaagcaggagcgcgagccagtgggcacctgcttcctccaggacggtacaaagaccgtggagtacgccccctgtagatctcgacagctgataagcgaccaggttgctgaaatcgtgagtaaatacgacccaaatgtctattctatcaagtacaacaaccaacttgcgaccaggaccgcccaggcaatttttgacgacagctatttggggtattccgttgcagttggtgattttaacggagatgggatcgatgactttgtttctggagtccctcgcgcggctcggacacttggaatggtctacatatacgacggaaagaatatgtcttcgctgtacaacttcacaggcgagcagatggctgcttatttcgggttctcagtagccgctaccgatataaacggggacgattacgcagatgtgttcatcggcgcccccctattcatggatagggggtcagacggaaaactacaggaggtgggccaagtctcggtctcccttcagagagcttccggagactttcagacaactaagctcaatggattcgaggtctttgcccgatttggtagcgccatagctcctttgggagacttagatcaggatggatttaatgacatcgccatcgcagctccctacggcggtgaggataagaagggcatcgtgtacatttttaacggacgatcgaccggcctgaatgccgtgccctcacaaatccttgaaggacagtgggcagcaaggagtatgccaccttctttcggatattcaatgaagggtgctaccgatatagacaaaaatggatatccagacctcatcgtcggtgcctttggagtggatagagccatcctctatcgcgcccgcccggtcataaccgttaacgcaggactcgaggtgtaccctagcatcctaaaccaggacaacaaaacctgctcgttacctggaactgctcttaaggtctcttgttttaatgtgcgattttgccttaaagccgatgggaagggagttcttcccagaaaacttaatttccaagtggaactgctgctcgacaagttgaagcagaagggagctattaggcgggctctgttcctgtactcacgctcaccctctcacagtaaaaacatgacaattagcagggggggactcatgcaatgcgaagaactgatcgcgtatttaagggacgagtccgagtttcgcgacaaactgacacctattactattttcatggagtacaggttggattatagaaccgccgctgacaccactggccttcagccaattttgaatcagtttacacccgccaatataagtcgccaagcccacatcctgctcgactgcggggaggataatgtgtgtaagccaaaactggaagtgtcagttgactcagatcagaagaagatctatattggagatgataatccccttactcttattgtcaaggcccaaaatcaaggcgaaggtgcttacgaggccgaactgattgtcagtatcccactgcaggcagatttcatcggagttgttcgcaacaatgaggcgctcgcccgattgagttgcgcctttaaaactgagaatcaaaccagacaggtagtctgtgacctcggcaatcctatgaaagctggtacacagctgcttgccgggctgcgattcagtgtgcaccaacaaagtgaaatggacacctctgtgaaattcgatctacaaatacaaagctctaatctgtttgacaaagttagtcctgtagtgagtcataaagtcgatctcgccgtgctggccgccgtggagatccgcggcgtgtcctcccccgatcacgtcttcctgccaatccctaactgggaacacaaggaaaatccggagaccgaggaagacgtggggcccgtagttcagcatatatatgagctgagaaataacggcccctcatcattctctaaggcgatgttgcaccttcagtggccatacaaatataacaataatacgttgttgtatattctccactacgatatcgacggcccgatgaactgtaccagcgacatggagatcaatcctcttcgcataaaaatatcctctctgcagacaacagagaaaaacgatactgtggccggccagggggaaagagaccatctgatcacgaagcgcgacttggcactgagcgaaggggatatccacacactcggctgtggggtagcccagtgcctgaagatagtgtgtcaggtcggaaggctcgacagagggaagagtgccatcttgtacgttaaatctctgctgtggactgagacattcatgaataaggagaaccaaaatcattcttacagtctgaagtcctcagcgtcctttaatgtgatcgagtttccgtacaagaatctcccgatcgaggatattaccaatagcaccctggtcacaactaacgttacttggggcatccagcccgcgcccatgcctgtgccagtctgggtgatcatactggcggtgctggcggggctgctactattggctgtgctcgtctttgtgatgtaccgcatggggttttttaaaagagtccggccccctcaggaggaacaggaaagagagcagctgcagccccacgaaaacggtgaaggcaactcagagacctag

SEQ ID NO: 15595 - DNA, 3009 bp, Artificial Sequence
  Description of Artificial Sequence: Synthetic coding sequence
atgctgttaggaaccctcctgttaatcctgtatatcctgatgctttgtagaatgttcctgctggtcggcgctcccaaagcaaatactactcagcctggaattgtggaagggggccaggtgcttaaatgcgattggtcgtctaccaggaggtgtcagcccatcgagttcgatgcaactgggaatagggattacgccaaagatgaccccctagaatttaaatcccatcagtggtttggcgcgtccgtccgctctaaacaggacaagatattggcctgcgcaccactataccactggcggacagaaatgaaacaagagcgcgagcctgtcggaacctgtttcctccaagacgggacaaagacagtcgaatatgcaccgtgccgctcgcaggacatcgacgccgatggtcagggtttctgccaaggagggttcagtattgattttacaaaagctgaccgcgttctgctcggcggtcccggaagtttttactggcagggccagctgatctccgaccaggtggcagaaatagttagcaaatatgatccaaacgtttatagtattaagtataataatcaactggcgacacgaactgcacaagctatattcgatgacagctacctaggctacagcgtggccgttggcgattttaacggagacggaattgatgattttgtgtcaggcgtccctcgagccgcacgcacgctgggaatggtgtatatatacgacgggaagaacatgtcatctctttataattttacaggcgagcagatggctgcgtactttggattttctgttgcagcaacagacatcaacggcgatgattatgccgatgtgttcatcggcgctcctctcttcatggacaggggatcagatggcaagctgcaagaggtgggccaagtgtctgtctccctgcagagggctagcggcgactttcagactactaaacttaatgggttcgaggtgtttgcgagatttggctctgcaattgcccccctgggtgacctggaccaggatggattcaatgatattgctatagctgccccttacggcggggaggacaaaaaaggaatagtgtacatttttaacggacggtccaccggtctgaacgccgtgccctcacaaattctggaaggccagtgggcagcccgctcaatgcctccctcttttggatacagtatgaagggcgcaactgatatcgacaaaaacgggtacccggatctgatagtgggcgcattcggagtggatagggcgatactttaccgggcccgaccagtcattacggtgaacgctggactggaagtgtatccttccatactgaaccaagacaacaagacctgttccttgcctggaacggcattaaaagtgtcttgttttaatgtcaggttctgcttgaaggccgatggcaaaggggtccttcccagaaagctgaacttccaggtcgagttgctgctggacaagttaaaacagaaaggtgccatcagacgagcattattcctatatagccgctctccctcccactctaagaacatgaccatcagcaggggtggtcttatgcagtgtgaagaactgattgcgtacttgcgagatgaatccgaattcagagacaagcttacacccatcactatttttatggagtaccggttagactataggacggcagcggacacaacgggattacaacctatccttaatcaattcacgccggcaaatatatctcggcaggcccatattctccttgactgcggcgaggacaacgtgtgtaagccaaagcttgaggtgagcgttgattccgaccagaagaagatttacattggcgatgataacccactcaccctaatcgttaaagcacagaatcagggagagggggcttatgaagccgaactcatagtcagcatccctctccaagctgatttcattggcgtggtccgaaataacgaggccctggcccgactgtcttgcgcgtttaagacagagaatcagactcgccaggtcgtgtgcgacctgggcaatcctatgaaggctggaacccagctcctggccgggttacgattcagcgtccatcagcagtcagagatggatacgagcgtcaaatttgacctgcagattcagagctctaatctcttcgacaaagtctcccctgtggtgtcccataaggtggacctagccgttttagcagctgtggaaatccggggggtcagctcccccgaccacgtttttctgcccattccaaattgggagcacaaagaaaatcccgaaaccgaggaggatgtgggccccgtagtgcagcatatttacgaactgagaaacaacggacccagtagcttttccaaagcgatgttgcacctccagtggccttacaaatacaataataatacactgctgtacatactgcactatgatattgatgggccaatgaattgtacttctgacatggagatcaatccacttcgaattaagatctcaagcttgcaaacaactgagaagaacgacaccgtggccggacagggtgagagggatcacctcattactaaacgggatttggccttgagcgagggcgacattcacaccctcggatgcggggttgcacaatgcttgaaaatcgtctgtcaagtcgggcgcctggatcgtggtaagtccgccattctctacgttaaatcgctcttatggactgagacatttatgaataaggaaaatcagaatcacagctacagcctcaagagttcagcttccttcaacgtcatagagtttccatacaagaacttgcccatcgaggatattacaaactctaccttagtgacaaccaatgttacttgggggattcagcccgcacccatgccggtgcccgtgtgggtgatcatcctggcagtcctggccggacttctcctgttggctgtcctagtgttcgtgatgtacaggatgggatttttcaaacgggtccgacccccgcaggaagagcaggaacgcgagcagctacagccgcacgagaatggagaaggcaacagcgagacctag

SEQ ID NO: 15596 - DNA, 1449 bp, Artificial Sequence
  Description of Artificial Sequence: Synthetic coding sequence
atggcgtttcctcctcgccggcggctgcgcctgggcccgagagggcttcctcttctgcttagtgggttgcttctgcccctctgccgggcatttaatcttgatgttgattctcccgcagagtattccggacccgaaggtagctatttcggtttcgcagtcgacttcttcgtgccgtcagcatcctctaggatgttcttattggtcggcgcccccaaagctaacactacacaacccggtatcgttgagggaggccaggtcctgaaatgcgattggtcctcgacaagacgttgtcagcctattgagtttgatgccactgggaacagggactacgccaaggatgatccattggagtttaagagccaccagtggtttggagcaagcgtacgctctaagcaggataaaattttagcctgtgcccccctatatcattggcgcaccgaaatgaagcaagaacgcgagcccgtgggcacttgcttcctgcaggacgggacaaaaacagtagaatatgccccatgccgctctcaggacatcgatgctgatggacaggggttctgtcagggaggcttctctatcgattttacaaaggccgaccgtgtgctcctaggaggacctggctcgttttactggcagggccagctgatttctgaccaggtggcagagatcgtttctaagtacgacccaaacgtgtatagcataaagtacaataatcagcttgcaacgcggaccgcccaagcaattttcgacgattcctatttggggtacagcgtggcggtcggcgactttaacggcgatgggatagacgactttgtgagcggcgtgcctagggccgctagaacactggggatggtgtatatatatgacggcaaaaatatgtcatccctgtataacttcacgggcgagcaaatggccgcgtacttcggcttttcagtcgccgccacagacatcaatggcgacgactacgccgatgtgttcattggagcccccttgttcatggaccgtggatcggatgggaagttacaggaggtggggcaggtgagcgtgtctctgcagcgcgcctccggggattttcagacgaccaagctgaacgggttcgaggtgtttgcccgattcggcagtgctatagcccctctgggggaccttgaccaagatggctttaacgatattgcaatcgccgccccatacgggggggaggataagaagggtatcgtgtatatattcaatggacgcagtactggtctaaacgcggtgccctcccagatcctggagggccagtgggccgcgaggagtatgcccccctcgtttgggtattctatgaaaggcgctaccgacatagataaaaatgggtacccggacctgattgtcggagcatttggagtggatcgtgcaattctgtacagggctagaccagttattccaattttcgtgcaattgcaccacgtggtgcactag

SEQ ID NO: 15597 - DNA, 2397 bp, Artificial Sequence
  Description of Artificial Sequence: Synthetic coding sequence
atgaacctgcaaccaatcttctggattggactgatatcatccgtatgttgtgtgtttgcccagacggacgagaatagatgcctaaaagctaacgctaaatcatgcggggagtgcattcaggctgggccaaactgtggctggtgcactaattctacctttctccaggagggaatgcctactagtgccaggtgcgacgatctggaagcgctgaagaaaaaaggctgtccaccagacgatattgagaatcccaggggatccaaggatatcaaaaagaacaaaaatgttacaaacagatcaaagggtacagcggagaagcttaaaccagaagacattacgcaaatccagccccagcagctggtcttgcgcttaaggagcggggaaccgcagacattcaccctgaagttcaagagggcggaagattaccctatagacctctattacctgatggacttgagctattctatgaaggatgacctggaaaatgtaaagtcgctggggactgacctcatgaacgaaatgcgccgtattacgtccgacttcagaatcgggttcgggtccttcgttgaaaagaccgtgatgccctacattagcaccacgcccgcaaaattaaggaatccatgcacatcagaacaaaattgcaccagtcctttttcctataaaaacgtgctttccctgaccaataaaggagaggtcttcaacgagctggtgggtaagcagagaattagcggtaatctcgacagccccgagggcgggttcgatgcaattatgcaagtcgcggtatgcggcagcttaattggatggagaaacgttactagactgctggtgttctcaacagatgcaggcttccactttgctggggacggaaaacttggcggcatcgtgcttccaaatgacggacagtgccacctcgagaacaacatgtacaccatgtctcactattatgactatcctagtatcgcacacctggtgcagaaactatctgaaaacaacatccagacaatctttgccgtaaccgaagagttccagcccgtttacaaagagttgaagaatctgatacctaagagcgccgtaggaacgttgagcgccaactcttctaacgtcatccagcttatcattgacgcttataattcactgagctcagaagtcatcctggagaacgggaagctgtctgaaggagtaaccataagctacaaaagttattgtaagaatggagttaacggtacaggagaaaacgggcggaagtgcagtaatatatcgattggcgacgaggttcagttcgagatcagcataacgagtaacaaatgcccaaagaaagattccgatagctttaagatcaggccattggggtttactgaggaggttgaggtgatcctgcagtacatctgtgaatgcgaatgccagtcggagggcatccccgagagtcctaaatgtcacgagggcaatgggacctttgagtgtggtgcttgtaggtgcaatgagggccgcgtgggccgacattgtgaatgctctaccgacgaagtgaacagcgaagatatggacgcatattgtaggaaagagaacagtagcgaaatttgttctaacaatggagaatgcgtatgtgggcagtgtgtatgtagaaaaagggacaacactaatgagatctattcagggaagttttgcgaatgtgataactttaactgcgaccggtcaaatggcctgatatgtgggggaaatggagtttgcaagtgtcgcgtgtgcgaatgcaaccctaactatactggcagtgcatgtgactgctcgctggatacttctacttgcgaggctagcaacggacaaatctgtaatggccgcggtatttgcgaatgcggagtttgcaaatgtacagatcctaagttccagggtcagacatgtgagatgtgccagacatgtctgggagtttgcgccgagcataaggagtgtgtgcagtgtagggcgttcaacaagggagaaaagaaagacacttgtacccaggaatgcagttacttcaacatcaccaaggtggagagcagagataagctgcctcagccggtccaaccggatcctgtttctcactgcaaagagaaggacgtggatgattgctggttttattttacctatagtgtcaatggcaacaacgaagtcatggtgcatgttgtggagaatcccgagtgtccgaccgggccagacataattccgatagttgcgggcgtcgtagctggaattgtgctgatcggactggcactgctcttgatctggaagttgcttatgattatccatgatcgaagggaatttgctaaatttgaaaaggaaaagatgaacgcgaaatgggacacaggggagaacccaatttataaaagcgcagtgacaacagtcgtgaatccaaagtacgaaggaaaatag

SEQ ID NO: 15598 - DNA, 2478 bp, Artificial Sequence
  Description of Artificial Sequence: Synthetic coding sequence
atgaacctgcagccaattttttggataggtctgataagcagcgtgtgttgcgtttttgcccaaaccgatgagaatcggtgcctcaaggctaacgcaaagagttgtggggaatgcatccaggccggaccaaattgtggctggtgtaccaacagcaccttcctccaagagggtatgcctacatcagccaggtgcgacgacctggaggccctcaaaaaaaaaggctgcccacccgatgacatcgaaaaccctaggggatctaaggatattaagaaaaacaagaacgtgacaaaccgctctaaaggtaccgccgaaaaacttaaacccgaggacataacccagatacagcctcagcagctggtcttgaggctgcgcagcggggaaccccaaacctttacgctgaaatttaaacgggcagaggattatccaatcgatctgtactatttgatggacctatcttattccatgaaggacgacctcgagaatgtgaaatcactaggcaccgaccttatgaacgagatgcgccggattacgtctgacttcagaatcgggttcggcagcttcgtagaaaagacggtgatgccttacatctccacaactcctgctaagctgcgcaatccctgcacctcagagcaaaattgtacgtctccatttagctacaaaaacgttctttctctcaccaacaaaggcgaggtgtttaatgaactggtcggtaagcagcgcatctcaggcaacctcgactccccagaaggcggatttgatgccataatgcaagttgccgtgtgcggtagtctcattggatggcgcaacgtgacgcggctgttggtcttttccacggacgcaggatttcactttgcgggggacggcaaactggggggcattgtcttgcctaacgatggtcagtgccaccttgaaaacaatatgtacactatgtcacactattacgactatcccagtatagcccacttggtacagaagctgtccgagaataacatccagaccatttttgcagtgacagaagaattccagccggtgtataaggagttgaagaatctgatccccaagagcgccgtaggcacactttcggcaaactcatccaacgtgatccagctcatcatcgacgcctacaacagcctgtcatcagaggtcatactggaaaatggaaaactctccgaaggggtgactatttcctacaagagctactgcaaaaacggcgtaaatggtaccggggagaacggccggaagtgtagcaatatctcaattggcgatgaggtgcaatttgagattagcatcacttctaataagtgcccgaagaaagactcagacagttttaaaatccgcccgctggggtttactgaagaggtggaagtcatcttgcaatatatctgtgagtgtgagtgtcagtctgagggcatccccgaatcaccaaagtgccacgagggtaacgggacgtttgagtgcggggcctgcaggtgtaacgaaggcagagttggccgacactgtgaatgctctacagatgaggttaactccgaggatatggacgcgtattgccgaaaagagaattccagcgagatatgcagcaataacggagagtgtgtgtgtggccagtgcgtctgccgtaagagggataacactaacgaaatctactctgggaagttctgtgaatgcgacaactttaactgcgacaggagcaatgggctgatatgcggagggaacggcgtgtgcaaatgccgagtgtgcgagtgcaatcctaattatactggcagtgcttgcgactgttcattggacacgtcaacgtgtgaggcgagcaatgggcaaatctgcaatgggcgcggcatttgcgagtgtggcgtctgtaagtgtacagaccccaagttccaaggccagacttgtgaaatgtgccagacttgtctcggcgtatgtgccgagcataaagagtgcgttcagtgccgcgccttcaataagggtgagaaaaaggatacatgcacacaggagtgttcctactttaatatcactaaagttgagagtagggataaactccctcagcctgtgcagcctgaccctgtgtctcactgcaaagaaaaagatgtcgatgattgctggttctacttcacctatagtgtgaatggaaataacgaggtcatggtccacgtggtggagaaccccgagtgcccaactgggcctgacattattcccattgtggctggagtggtcgctggcatcgtacttattggcctcgctttactcttgatctggaagttgctgatgattattcacgatagaagagaattcgcaaaatttgagaaggagaaaatgaacgccaagtgggatacttcactcagcgtggctcagccgggcgttcagtggtgtgacatttctagtctccagccgctgacctcaagatttcagcaattcagctgcctcagccttccttcgacctgggactacagagtgaagatactgttcatcagggttccctag

SEQ ID NO: 15599 - DNA, 2397 bp, Artificial Sequence
  Description of Artificial Sequence: Synthetic coding sequence
atgaatctgcagcccatattttggatcgggctcatcagctctgtgtgctgtgtgttcgctcagacagatgagaacaggtgcctcaaagctaacgcaaaaagctgcggagagtgtattcaggcaggccccaactgcggctggtgcacaaatagcacctttctgcaggaggggatgccgacttctgcccgttgtgacgacttagaggctttgaaaaaaaaggggtgcccgccagacgacattgagaacccaaggggctccaaggatattaagaagaacaaaaacgtgaccaatcggagtaaggggacggcagagaaattaaagcctgaggatattacacagatccagccacagcaactcgtcctccggctgcggtcgggcgagccccagacttttacgttgaagtttaagcgagccgaggattaccctatcgatctctactatctcatggatttaagttatagcatgaaagacgatttggagaacgttaagagtctagggacagatctgatgaatgagatgcggcggataacatctgatttcaggatcgggttcggctcgttcgtggaaaagacggtcatgccttatatctcgacaacacctgctaagttgaggaacccttgtacatcagagcagaactgtacatcccccttcagttacaagaatgtgttgtctctaacgaataagggggaagtcttcaatgagttggtcggaaagcagagaataagcggcaatcttgactcgcccgaaggtggctttgatgcaatcatgcaagtggccgtgtgcggtagcctcatcggttggcgcaacgtgacacgattgctggtcttctctactgatgcagggtttcactttgccggtgacgggaagcttgggggcattgtgctccccaatgacggccagtgccacctggaaaataatatgtacactatgtcacattattacgactacccttctatagcccaccttgtccaaaagctgtctgagaacaatattcagacaatttttgccgtgacggaggaatttcagcctgtctataaggagctgaaaaaccttattcctaagagtgccgttggcactctttcggctaattccagcaacgtcatccaactgataatagatgcctacaatagcttgagtagtgaagtcattctggagaacggaaagctgtcagaaggagtcactatttcctacaagtcctattgcaaaaacggagtgaacgggactggggaaaatggcagaaaatgctccaacatcagcatcggggacgaggtccagttcgaaattagcattacttccaataaatgcccaaaaaaggatagcgacagctttaagattagaccgttgggatttaccgaggaggtggaagtgattctgcagtacatttgcgagtgcgagtgtcagagcgaaggcatacccgaaagtccaaaatgtcacgagggcaatggaacttttgaatgcggcgcctgcagatgcaacgagggacgggtcggcaggcactgcgagtgtagcactgatgaggtgaatagtgaggatatggacgcatattgtcgcaaagagaactccagcgaaatctgcagcaacaatggggaatgcgtctgcgggcagtgtgtgtgccggaagcgggataacaccaatgaaatttactccggaaagttttgcgagtgtgataattttaattgcgaccgttcaaacgggttaatctgcggaggtaacggagtttgcaagtgcagagtgtgtgagtgtaaccccaactacactggctcggcctgtgactgctcactggataccagtacctgtgaggcatctaacggccaaatctgcaatggccggggcatctgtgagtgcggcgtttgtaaatgtacggaccccaaatttcaaggacagacatgcgaaatgtgccagacctgcctcggcgtgtgtgcggagcacaaggaatgtgttcagtgtcgtgctttcaataagggtgaaaaaaaagacacatgtacgcaagaatgcagctatttcaatatcacaaaggtggaaagccgggacaaattgccacagccagtgcagccagaccctgtgagtcattgcaaagagaaggacgtggatgactgctggttctacttcacctacagcgttaacgggaacaatgaagtgatggtgcacgtcgtggagaaccccgagtgtcctaccggtcctgatatcatacctatcgtcgctggcgtcgtggctggaattgttctgattggtttggctcttctgctcatctggaaactactcatgattatacacgaccgacgcgagttcgccaagtttgagaaggagaagatgaatgcgaagtgggataccggggaaaaccccatatacaaatcggcagtgaccacagtagtgaaccccaaatatgaaggcaaatag

SEQ ID NO: 15600 - DNA, 150 bp, Artificial Sequence
  Description of Artificial Sequence: Synthetic coding sequence
atgaacctacagcccattttctggataggcctcattagctccgtctgttgcgtcttcgcacaaacagatgagaaccgctgtctaaaagccaacgccaaaagctgcggcgagtgtattcaagccggacccaattgcgggtggtgcacttag

SEQ ID NO: 15601 - DNA, 270 bp, Artificial Sequence
  Description of Artificial Sequence: Synthetic coding sequence
atgaacctacagcctatattttggattgggctgattagcagcgtatgctgcgtctttgcccagacggacgagaatcggtgtctgaaagctaatgcaaagtcgtgtggggagtgcatccaggctggtcctaactgcgggtggtgtactaattctacgttccttcaggagggtatgcctacctcagcccgctgtgatgatctggaagctctgaagaaaaagggttgtccacctgacgacatcgaaaatcctcgtggatccaaagacatttag

SEQ ID NO: 15602 - DNA, 2406 bp, Artificial Sequence
  Description of Artificial Sequence: Synthetic coding sequence
atgaatctccaacccattttttggatcggtcttatatccagcgtgtgttgcgtctttgcccagaccgacgaaaaccgctgcctgaaggctaatgccaagagttgtggcgaatgtatccaggctggccccaattgcggttggtgcaccaacagtaccttcctgcaggaaggcatgcccacatccgctagatgcgacgatctcgaggccctgaagaaaaagggatgtccccctgacgacatcgaaaatcctcgcggatccaaagatattaaaaaaaataagaacgtcactaataggtcaaaaggcactgccgaaaaactgaagccagaggatatcacccaaatccaaccacaacagttggtgctaaggctccggagcggggaacctcagacattcacactgaagtttaaacgggctgaagattatccaatagacctttattacctcatggacctgtcctatagcatgaaggacgatctggagaacgtgaagagcttgggcaccgacctcatgaacgagatgcggcgcataactagcgacttcaggatcggcttcggctccttcgtggagaagacagtcatgccttacatatctaccacacccgccaaacttcgcaacccttgcacttccgagcaaaactgtaccagtccatttagttacaagaacgtgctatccctgaccaataaaggagaagtgtttaacgagctggttggtaagcagcgcatctcgggaaatctggattccccggaggggggttttgatgccatcatgcaggttgctgtatgtggctcattgatcggttggcggaatgtgacacgacttttagttttttctaccgacgccggcttccacttcgccggcgacggtaaactcggaggcatagtgctcccaaatgacggacagtgccacctggagaacaacatgtacacaatgagtcactattatgattacccatcgattgcacacctcgtgcagaaattatccgagaataatattcaaacaatcttcgcagtcacagaggagttccagcccgtatacaaagaactgaagaacctaatacctaaaagtgcggtgggaactctatccgccaattcaagcaacgtcattcagcttataatagatgcttacaatagcctttcaagcgaggtgatcctggaaaatgggaaactctctgagggtgttaccatcagttacaagtcttactgcaagaatggcgtgaacgggacaggcgaaaacggcaggaaatgctccaatatttcgattggcgacgaggttcagtttgagatctctatcacaagcaacaaatgtcctaaaaaggatagcgattcattcaagatacgaccactgggtttcacagaggaagtcgaggtcattcttcagtacatatgtgaatgtgagtgccagtcagaaggaataccggaatcaccgaagtgtcatgaagggaatgggaccttcgagtgcggggcatgtaggtgcaatgaaggaagggtgggaagacactgcgaatgctccaccgacgaggtgaacagcgaggatatggacgcttattgtagaaaagagaattcttccgagatctgtagtaacaacggggaatgcgtgtgtggccagtgtgtatgccgcaaaagagataatacaaacgagatctatagtggcaagttctgtgagtgtgacaatttcaattgcgaccggagcaatggccttatttgcggcggcaacggagtgtgtaagtgtcgggtttgcgaatgcaatccgaactacaccgggagtgcctgcgactgctccttagatacttctacatgtgaggcatctaacggacagatttgcaacgggaggggaatttgcgagtgtggagtgtgcaagtgcacagatcctaagtttcagggacagacgtgcgagatgtgccagacttgtctgggcgtctgtgctgagcacaaggagtgtgtccagtgcagagccttcaataaaggcgaaaaaaaagatacgtgcacccaggagtgcagctattttaacatcacaaaggtggagtccagagacaaactccctcagcccgtgcagcccgacccagtgtctcattgtaaagaaaaggatgtcgacgattgttggttttacttcacatactccgtaaacggcaataacgaggtgatggttcacgtagtcgagaatcctgagtgtcctaccggaccagacattatcccaatcgtcgccggagtcgtggcaggtatcgtgctcattggcctcgccctcctgcttatctggaagctgctgatgatcattcatgaccgtagagagttcgccaaatttgagaaagaaaagatgaacgcaaaatgggatactcaggaaaacccaatttataagagtcctatcaataactttaagaacccgaactacggaaggaaggccggcctttag

SEQ ID NO: 15603 - DNA, 411 bp, Artificial Sequence
  Description of Artificial Sequence: Synthetic coding sequence
atgaacctccaacccattttctggatcggcttgatttcgtcggtatgttgcgtctttgcacagactgacgaaaatcgttgcctgaaagccaatgcaaagtcatgtggggagtgtatccaggcaggacctaattgcggctggtgcaccaattcaacattcctgcaggaggggatgcctaccagtgcaagatgtgacgacttagaggctcttaaaaaaaagggatgccccccagacgatatagaaaatccgagaggatcaaaggatattaagaaaaacaaaaatgtgactaatcggtcgaagggtaccgccgagaaacttaaaccggaggatatcactcaaatacagcctcagcagctggtcctccgcctgaggagcggcgagccccagacgttcaccctaaagtttaaatag

SEQ ID NO: 15604 - DNA, 378 bp, Artificial Sequence
  Description of Artificial Sequence: Synthetic coding sequence
atgaacctgcagccgatcttctggatcgggctgatcagttccgtgtgctgcgtgttcgcccagaccgacgaaaaccgctgcttgaaggccaacgccaagtcctgcggcgagtgcatccaggcaggacccaattgcggttggtgcacaaactccaccttcctccaggagggtatgcccacctctgccaggtgtgacgacctcgaagcgcttaaaaaaaagggttgtccgccagacgacatcgaaaacccccgggggagcaaggacatcaagaagaataagaatgtgaccaaccgctcgaagggcacagctgagaagttgaaacctgaagatatcactcagattcagccacagcaactggtgctcaggttacggtcttag

SEQ ID NO: 15605 - DNA, 492 bp, Artificial Sequence
  Description of Artificial Sequence: Synthetic coding sequence
atgaacctgcagcccattttctggataggtctgataagtagtgtttgttgtgtattcgcccaaaccgacgaaaataggtgcctgaaagctaacgccaaatcatgcggggagtgcattcaagccggcccaaactgcggatggtgtacaaactccacctttctgcaggaaggcatgcctacatccgccagatgtgacgatctggaagctctgaagaagaaaggatgtccacctgatgatatagagaatccacggggctccaaggatataaaaaagaacaagaatgtcacaaatcggtccaaaggaactgcagagaaattgaagccagaggacatcacacagattcaaccacagcaattggtgcttaggttgcgaagtggagagccacaaacttttacgctgaagtttaagagagcggaagactatcccattgacctgtactatctcatggatctgagctacagcatgaaggatgacctagaaaacgttaagtag

SEQ ID NO: 15606 - DNA, 459 bp, Artificial Sequence
  Description of Artificial Sequence: Synthetic coding sequence
atgaacttgcagcccatcttctggatcggtctgatttcttctgtatgctgcgttttcgcgcagacagatgagaaccgatgtctaaaagccaatgccaagtcctgtggtgagtgcatccaggccggacccaactgtggatggtgcacaaacagtgtttctaagaccttcctgcaggaggggatgcccacctctgcccggtgcgatgatctcgaggccctgaagaaaaagggatgtccgccagatgatatagagaacccacgggggtcaaaggatattaagaagaataagaacgtgactaataggagtaaaggtacagctgaaaaacttaagcccgaagacatcacacagatacagccccagcagctggtgcttaggttgaggagcggagaaccccaaaccttcacccttaagttcaaaagggctgaggactaccccatcgatctctattacctcatgtag

SEQ ID NO: 15607 - DNA, 315 bp, Artificial Sequence
  Description of Artificial Sequence: Synthetic coding sequence
atgaatcttcaacctattttttggattggactcatctccagtgtctgctgtgtgtttgcccaaaccgacgagaatcggtgtctaaaagcaaatgcaaagtcttgcggcgagtgtattcaggccgggcctaattgcggatggtgtaccaactctacattcctccaggagggtatgcccaccagcgccaggtgtgatgatcttgaggcattgaagaagaaaggctgcccgccagacgatatcgaaaaccctcgagggtccaaggatatcaagaagaataaaaatgttaccaaccgcagtaagggcacagccgaatag

SEQ ID NO: 15608 - DNA, 432 bp, Artificial Sequence
  Description of Artificial Sequence: Synthetic coding sequence
atgaacctgcagccaatcttctggattgggctcattagcagtgtctgttgcgtcttcgcacagaccgatgagaaccggtgtctgaaagccaacgctaagtcctgtggcgagtgcattcaggcaggacccaactgtgggtggtgcactaactccacctttcttcaagagggaatgcctacgtcagcgagatgcgatgacctggaggccctaaagaagaagggatgccctccggatgacatagagaacccccgcgggagcaaggacattaaaaagaacaagaatgtgaccaaccggtccaaaggtacagctgagaaactcaagccggaggacataacccagatccagccacagcagctggtgctccggctcaggtcaggggagccacagaccttcacattaaaattcaagcgcgctgaggactacccgatatag

SEQ ID NO: 15609 - DNA, 2310 bp, Artificial Sequence
  Description of Artificial Sequence: Synthetic coding sequence
atgctgggtctccggcctcccctcctggccctggtgggcttgctgtcgcttgggtgtgtgctctcccaggagtgtactaagtttaaagtgagttcttgccgggagtgtatcgagagcggccctgggtgcacctggtgccagaaattgaactttacaggaccaggggatccagattcaattcgatgtgacactcggccccagttattgatgcggggctgcgccgccgacgacatcatggaccctacttctctggccgaaacacaggaggaccacaatggaggccagaaacagctctccccacagaaggtcaccctgtaccttagaccaggacaggctgcagcctttaatgtgacgttccgtagagccaaaggctatcctattgatctgtattacctgatggatttaagctactccatgttggatgatcttaggaacgtcaagaagctggggggcgatctactcagagcactcaacgagattaccgagagcgggagaattgggttcggctcctttgtcgacaaaacagtgctgcctttcgtcaatacgcatcctgacaagctcagaaacccatgccctaacaaggaaaaagaatgtcagcctccctttgctttccggcacgtactaaagctgacaaacaactctaaccaatttcagacagaagtggggaaacagctgatcagcggtaacttggacgcccccgaaggtggcctcgatgctatgatgcaggtagcagcctgccctgaggagatcggctggaggaatgtaacccgcctgttggtgttcgccactgatgacggctttcacttcgccggggacggcaaacttggagcaatcttgacaccaaatgatggacgctgccacctcgaagacaatttgtacaagcgcagcaacgagttcgattatccaagcgtgggccagctcgcccacaaattggctgaaaacaatattcagcccatttttgccgtgacatctcgcatggttaagacctatgaaaaactaacagagatcattcctaagagcgccgtgggggaactctctgaggactcctccaacgtggtacagcttataaaaaacgcatacaacaagctcagctcacgagtgtttttggatcacaacgcattaccggatacattaaaagtaacctacgattcattttgctcaaatggtgtcacacaccgcaatcagcctaggggcgattgcgatggggttcagattaacgtgcctattactttccaggtgaaagttaccgcaactgaatgcatccaggaacaaagctttgttattagagccttgggtttcacggatatagtaacggtccaggttctcccacagtgcgagtgtcgttgccgcgaccagagcagggatcgttccttgtgtcatgggaaaggcttccttgagtgtggcatatgccgctgcgacaccggttatatcggcaagaactgtgagtgtcagacacagggccgctctagccaggagctggaggggagctgcagaaaggacaacaactccatcatttgtagtggattaggagactgcgtgtgcggccagtgcctctgtcatacatcagatgtgcctgggaagttgatctatggacagtactgtgagtgcgacaccatcaactgcgagcggtacaacggccaggtatgcggtggccctggacggggtctctgcttttgtggcaagtgtcgatgccatccgggttttgaagggtccgcctgtcagtgtgaacgaaccaccgaaggctgccttaaccctcgtcgcgtcgagtgttccgggcgcggccgatgtcggtgcaacgtctgcgagtgccactcgggataccagctgcccctgtgtcaggaatgcccaggatgcccgtctccatgcggcaaatacatttcctgtgccgagtgcctgaaattcgagaaggggccttttggcaaaaactgcagcgccgcgtgtcccggattacaattgtccaacaacccagtaaaggggaggacctgtaaagagagagattccgagggctgctgggtagcatacaccctggaacagcaggacggaatggatagataccttatatacgtggacgaatctagagagtgtgttgctggacctaacattgccgctattgtgggaggcactgtggcgggcatcgtcctcatcgggatcctgttgcttgttatttggaaggccttgatacatttatctgacctgagggagtatcgcagattcgaaaaagaaaagctgaagtctcagtggaataatgacaacccattgtttaagagcgccactactacagtgatgaatccgaaatttgcagaaagttag

SEQ ID NO: 15610 - DNA, 969 bp, Artificial Sequence
  Description of Artificial Sequence: Synthetic coding sequence
ggccgcctcggcaaagatctggccacgggagtcctcagccaggaatgcacaaaattcaaagtttcctcttgtagagagtgcattgagtcaggacccggctgcacctggtgccaaaagctcaatttcaccggacccggtgacccagacagcatacgctgcgacacgcgcccccaactgctgatgagagggtgtgcagccgacgacatcatggatcccacctccttggccgagactcaggaagatcacaatggaggacagaagcaattatctcctcagaaggtgacgctctacctgcgccccggccaggcagccgcattcaacgtaactttcaggagagccaaagggtatccgatcgatctctactatcttatggacctgtcatattccatgctggatgatttgaggaacgtgaagaaactgggcggagacctgctgcgggccttgaatgagatcactgaatctgggcgcataggctttggcagttttgtggacaaaactgtccttcccttcgtgaatacccacccagataaattgagaaacccttgccccaacaaagaaaaagaatgtcagccccccttcgcctttagacacgtgttgaaactgacgaataatagtaatcagtttcagacagaagtcggtaaacagctgatttccggcaacctagacgcgccagaaggagggctcgatgccatgatgcaggtggccgcttgccccgaggaaatcggctggagaaatgtaacaagattgctcgtattcgcaaccgatgacggctttcacttcgcgggagatggaaaattaggggcaatcctcacccccaatgacggcagatgtcacttggaagataacctgtacaagcgctctaacgagtttgactatccttccgtggggcaacttgcccataaacttgcagagaataacattcagcccattttcgccgttacctcgagaatggtgaagacatacgagtag

SEQ ID NO: 15611 - DNA, 2310 bp, Artificial Sequence
  Description of Artificial Sequence: Synthetic coding sequence
atgctggggctgagacctcctttgctcgctttagtcggcttgttaagcctgggttgcgtgctttcacaagaatgcacaaagtttaaggttagctcatgccgcgagtgcattgagtcgggccctggctgcacctggtgtcaaaagctaaacttcaccggaccaggcgacccagactccattaggtgcgacacccgacctcaactgctcatgcggggatgcgcggccgacgacatcatggatccgacttctctggccgagacacaggaggatcacaacggagggcagaaacaactgtctccgcagaaagtgacactgtatctccggcctgggcaggctgccgctttcaacgtcacattccgacgcgccaaaggatatccgatcgacctgtactatctgatggacttatcgtactcaatgcttgacgatctgagaaacgtgaaaaagctcgggggggacctgttgcgcgccctgaatgaaattacagagagcggacgcatcgggtttgggagctttgtggacaaaacagtgctgccattcgtgaacacacaccctgataaactgcggaacccttgcccaaataaggagaaggagtgccaacccccttttgctttcagacatgtcctgaaacttaccaacaacagtaatcagtttcaaacagaggtcggcaagcaactgattagcggtaatcttgacgctccagagggcggactggacgctatgatgcaggtggccgcctgcccggaggagattggatggcggaatgtcaccagactcttagtgtttgcaaccgacgacgggttccactttgccggagacggtaaacttggggccattttaacccccaacgatggtcggtgccaccttgaagacaacctgtacaaacgttcgaacgaattcgattacccatctgtggggcagctcgctcataagctggccgaaaacaacattcagcccatcttcgccgtgacaagcagaatggtgaaaacttacgaaaaattgacagagatcatacccaagagtgctgtcggggagttgagtgaggatagctcaaatgtcgttcaactgatcaaaaatgcctacaacaagctcagctctagggtgtttctcgatcacaatgccctgccggacacattaaaggtgacttatgattcgttttgctcaaatggggtcacccaccgcaaccagccccggggtgattgtgatggcgtgcagattaatgttccgataacttttcaggtgaaggtcacggcaacggagtgtattcaggagcagtccttcgtgatccgggccctaggcttcaccgacattgtgactgtacaggtactcccacagtgcgaatgccgatgccgcgaccagtcacgggataggagcctctgtcatggtaagggtttcctggagtgtggaatttgtcgctgcgatactgggtacatcggcaagaactgtgagtgccagactcaaggcaggagcagtcaggagttagaggggtcctgcagaaaggacaataatagcattatctgttctggcttaggggattgtgtgtgtgggcagtgtttatgccatacttcagacgtgcctggcaagctgatctacggccagtattgtgagtgcgacaccatcaattgcgaaaggtacaatgggcaggtatgtggcggacccggccgtggattgtgcttttgcggaaagtgccggtgccatcctgggttcgaaggttccgcgtgtcaatgcgagcggaccactgagggctgtctcaatcccagaagggtggaatgcagcggtaggggccgctgcaggtgcaacgtgtgtgaatgtcatagcggctaccagctgccattgtgtcaggaatgccctggatgcccgagtccatgtggtaagtacatctcctgcgctgaatgcctaaagtttgagaaaggcccattcgggaagaactgctcggctgcctgccccgggcttcagttgtctaacaatcctgtgaaggggcggacttgcaaggaaagggactccgaggggtgttgggtggcctacactctggaacagcaagacggaatggatcgttacttaatttatgtggacgaatcacgggaatgtgtcgccggaccaaatatcgccgccatcgtgggaggcacggtcgcgggcatcgtgctcatcggcatactactcctagtgatatggaaagcccttattcacctttccgatctgcgagaatatagaagatttgaaaaagagaaactgaagtctcagtggaacaacgacaatccgctgttcaagtccgctacaacaaccgtgatgaatccaaagttcgctgagtcttag

SEQ ID NO: 15612 - DNA, 2310 bp, Artificial Sequence
  Description of Artificial Sequence: Synthetic coding sequence
atgcttggattaagacctcctctcctggccctggtgggcctgctgtctttgggctgtgtgctgtcccaagagtgcactaagttcaaggtcagtagctgcagggagtgtatcgaatctggccctggctgtacttggtgccaaaaattgaactttacaggtccaggggatcccgactcaatcaggtgcgacaccagaccccaactgctcatgaggggatgtgccgcggacgatataatggaccccacttctctggccgaaactcaagaggaccacaatggaggacagaaacagctcagtccccagaaggtgacactttacctgcgcccaggacaggctgctgcattcaatgtgaccttcaggagggcaaagggttaccccatcgacctgtattacctcatggacctctcctattctatgctggatgatcttcgaaacgtaaagaagttgggaggggacttactgcgagctctgaatgagatcactgaaagtgggcgtatcggattcgggagctttgtcgataagaccgtgttgccgttcgtgaatacacaccccgataagcttagaaacccttgtcccaataaagagaaggaatgtcagccacctttcgccttcagacacgtgctgaagttaacaaacaatagtaatcagttccagacagaagttggtaaacagctgattagcggtaatctggacgcaccggagggcggcctggacgccatgatgcaggtggccgcctgcccagaggagatcggatggaggaacgtcacgcgcctgctcgtattcgcgaccgatgacggatttcattttgccggagacgggaaactcggcgcaattctgacaccgaatgatggccgatgtcatctcgaagacaatctgtacaaaaggagcaacgagttcgactacccatctgttgggcagctggcccataaactggctgagaataacattcagcctatctttgcagtcaccagtagaatggtgaagacttatgaaaaactgaccgagatcattcccaagtcagcagtgggggaactttcagaggacagcagtaatgtggtgcagttaatcaagaacgcgtacaacaaattgagctcccgggtgttcctggaccacaatgctcttccagataccctcaaagtcacctacgactccttctgttcgaacggggttactcatagaaaccaaccacgcggcgactgtgatggcgtccagattaacgtcccaatcactttccaagtgaaagtgactgctaccgaatgcatacaggaacagtctttcgtgatcagagcgctggggtttaccgacatcgttaccgtgcaggtgttgcctcaatgcgaatgccggtgcagggatcagtcacgagacaggtcactgtgccacgggaagggtttcctggagtgcggcatttgccggtgtgataccgggtacattgggaagaactgtgaatgccagacccagggccgatcttcccaggagctggagggttcatgtcgcaaagacaacaactcgataatctgctctggtttaggggactgcgtgtgtggccagtgcctctgccacacgtctgatgtccccgggaaactgatatatggtcagtactgcgaatgcgataccatcaactgtgaacgatataatggccaggtgtgcggtgggccaggtcgaggactgtgtttttgtggcaaatgtcgatgtcatcctggctttgagggctcggcatgccagtgtgagcgaacgaccgaagggtgcctgaacccacgccgtgtggaatgctcgggccggggcaggtgtcgatgcaacgtgtgtgagtgccacagtggatatcagctccctctgtgtcaagagtgtcccggctgtcccagtccttgtggaaaatacatctcatgcgctgagtgcctcaagtttgagaagggtcctttcggcaagaattgttccgcagcttgccccggcctgcagctgagcaataatccagtcaaaggccgtacgtgtaaggaaagagactcagagggctgttgggtcgcttataccttggaacagcaggacggaatggatcggtacctcatttacgtggatgaatcccgcgagtgcgtggctggtccgaacattgctgccatcgtgggcggcaccgttgctggaattgtactgatcgggatcctgctgctagtcatatggaaggcactcatacatctttccgatctgcgcgaataccgcagatttgagaaggaaaaactgaaatctcagtggaataatgataacccattattcaaatccgcaactactactgtcatgaaccctaagttcgctgagagttag

SEQ ID NO: 15613 - DNA, 2310 bp, Artificial Sequence
  Description of Artificial Sequence: Synthetic coding sequence
atgctcggcctgcggcctccattgctcgccctcgtcggtctcctttccttagggtgcgtcttgtcacaagagtgcaccaaatttaaggtatcttcttgtagggagtgcatagaaagcggcccaggttgcacttggtgccaaaagcttaactttacaggacctggcgaccccgatagtatcaggtgtgacactcggccacaactgttgatgcgcggttgtgctgcggatgatatcatggatccaacctccctggccgagacacaagaggaccataacggaggccaaaaacagttgtcaccccagaaagtcaccctgtatctcaggccaggacaggctgccgcctttaacgtgaccttccgtagagccaagggatacccaattgacctttattacctcatggatctgtcttatagtatgctggacgacctgcgaaatgtgaagaagctgggcggcgatttgctccgagccctcaatgagataacagaatccgggagaatagggtttgggagttttgtggataagactgtgttgccattcgtgaatacacaccccgacaagctgcggaatccctgtccaaacaaggaaaaagagtgtcagcctcctttcgcctttcgacacgtgcttaaactgaccaacaactccaatcagtttcagacggaggttggtaagcaactgatcagtgggaatctagacgccccagaaggcggactggacgcaatgatgcaagtcgccgcctgcccagaagaaatcggatggaggaacgtgactcgactgctggtttttgcaactgatgacgggttccacttcgccggtgacgggaagctgggcgccatattgactcctaacgatggcaggtgtcacctggaggacaacctctataagagatcaaatgaatttgactacccctcagttgggcaactggctcataagctcgccgagaacaatatccagcccatcttcgccgttacctcccgcatggtaaagacttacgagaagctgacagagataattcctaaatccgcggtaggcgagttgtccgaggactcttccaacgtcgtgcagcttatcaagaatgcctataacaagttgtccagtagggtgttcctggatcacaacgccctcccagacaccctgaaagtcacctacgattcattttgcagtaacggggtgacccatcggaatcagccacgcggggactgcgacggagtgcagatcaacgtccctattacatttcaggtgaaagtaacagcaactgagtgtattcaggaacaaagcttcgtgatcagggcgctgggatttaccgacatcgtaaccgtgcaggtgctcccgcagtgcgagtgccgctgtcgggatcagtctagagacaggtcactgtgccatggaaagggctttctcgagtgtggcatttgccgctgtgatactggttatataggtaagaactgcgagtgtcagacacagggaaggtcttcccaggagctggagggctcctgccgtaaggacaataatagcataatttgttccggtttgggtgattgtgtatgtgggcagtgtctttgtcacacttccgacgtgccaggtaagcttatttatggacagtattgtgagtgtgatacaatcaattgcgaacgctataacggccaggtgtgtgggggtcccggcaggggcctctgtttctgtgggaaatgccgctgtcatcctggcttcgagggtagcgcctgccagtgcgaacggacaactgagggatgtttaaaccctcgacgcgtcgagtgtagcggtagaggccggtgtcggtgcaatgtttgtgaatgccattcgggatatcagctcccattgtgtcaggagtgccccggttgccccagcccctgtggcaagtatatcagttgcgccgagtgcctgaagttcgagaaggggccctttggcaaaaactgctcagccgcatgccctggccttcagctctctaacaaccccgttaagggccgcacatgtaaagagagagattccgaaggctgctgggtcgcttacaccctcgagcaacaggatgggatggacaggtatctgatctatgtggacgagagccgtgagtgcgttgccggacccaacatcgctgcaatcgtggggggaaccgttgccgggattgtactgatcggtattctccttctggtgatctggaaggctcttatacatctttccgatctgagagaatatcgcaggttcgagaaggagaaattgaagtcccagtggaacaatgacaacccactcttcaagagcgccactactactgtgatgaacccaaagtttgccgaatcctag

SEQ ID NO: 15614 - DNA, 2310 bp, Artificial Sequence
  Description of Artificial Sequence: Synthetic coding sequence
atgctcggcctgagacctccactcctcgcacttgtcggcctgctgtccctagggtgtgtgctgagccaggagtgtaccaagtttaaggtgtccagttgtcgggaatgcattgagtccggacccggatgcacctggtgccagaagctgaactttactggaccaggagaccccgactccatcagatgtgatacacggcctcagctgctgatgagaggatgtgcggctgacgacattatggatccaacgtccctggctgagactcaggaggaccacaatgggggacagaaacaactctccccccagaaggttacactctatcttaggcctggccaagcggctgccttcaacgtgacatttcggagagcaaaaggttatcccatcgacttatactatctgatggatttgtcctatagcatgctcgacgacctccgaaatgtcaagaagctcggcggagatctccttcgcgcactcaacgaaattactgagtccgggagaatcggctttggttctttcgtagacaaaacagttctgccttttgtgaacacccatcccgataaattaagaaacccttgtcctaataaggagaaggaatgccagcctccattcgcttttagacacgtcctcaaactaactaacaactccaatcaattccagactgaagttggaaaacaactcataagcggaaatctggatgctcctgagggaggcttggatgctatgatgcaagtagccgcctgtccagaggagattggatggcgaaacgttacaagacttcttgtatttgctaccgacgatggattccatttcgcaggtgatggcaaactgggggcaatcctgactccaaacgacgggaggtgtcatcttgaagataacctgtacaagagaagtaatgaattcgattacccaagtgtgggacaattggcgcacaaactggcagagaataatatccagccgatttttgcagtgacaagtagaatggttaaaacttacgagaagctgacagagattatccctaaaagcgctgtcggggagctgtcggaggatagtagcaacgtggtccagttaatcaaaaacgcttacaacaaactgagttcccgagtgttccttgatcataacgcattgccagacacactgaaagtcacttacgatagcttctgcagtaacggggtcacccatcggaaccagccaagaggtgattgtgatggcgtgcaaattaatgtgccaattacttttcaggttaaggttacagctacagagtgtatacaagaacagtcctttgtgattagggccctaggcttcacagacatagtgacggtacaagtcctgccccagtgcgagtgcaggtgtagggatcaaagtagggatagatccctgtgccacggaaagggctttctggagtgcggcatctgccgctgtgacacaggatatataggcaagaactgcgagtgccagacacagggcaggtcctctcaagagctcgaagggtcttgtagaaaggacaacaatagcattatatgctcggggctcggggattgcgtgtgcggccagtgcctgtgccatacatctgatgtccccggcaagttgatatacggccagtactgtgagtgtgacactatcaactgcgaaaggtataatggccaggtgtgtgggggcccaggtaggggcctttgcttctgcggaaagtgcagatgccaccctggttttgagggatcagcctgtcagtgtgaacgaaccaccgaggggtgcctgaacccaagacgggtggagtgttccggcaggggcagatgtcgttgtaacgtatgtgaatgtcacagcggctaccagctgcccctgtgccaagaatgtcctggctgtcccagtccatgtgggaagtatattagctgcgcagaatgccttaaattcgagaaaggccccttcgggaaaaattgcagcgcagcatgtcccgggctacagctgagcaacaaccctgtcaaaggacgcacatgtaaggaacgggattcagagggatgttgggttgcttacacgctcgaacagcaggacgggatggaccgttacctgatctatgtggatgagtcccgcgagtgcgttgccggaccaaatatcgctgcaatcgttggcggaactgtcgccggaatagtgttaattggaattttgctgctcgtgatatggaaagcattaatccatctgagcgacctacgagagtatcggcggttcgagaaggaaaagctcaaatcacaatggaacaacgataacccgctctttaaatctgcaaccaccaccgtgatgaatcctaaatttgccgaaagctag

SEQ ID NO: 15615 - DNA, 363 bp, Artificial Sequence
  Description of Artificial Sequence: Synthetic coding sequence
atgcttgggctgagaccccccctgctggcgctagttggactgcttagtctgggatgtgtgctctctcaggaatgtactaagtttaaagtgtcctcctgtcgagagtgcattgagagcgggcccggatgcacatggtgtcaaaagcttaactttaccggccccggagaccccgatagtatcaggtgcgacacccggcctcaactactgatgagaggatgcgctgcggatgacatcatggacccgacctctctggctgagactcaagaggaccataacggagggcagaagcaactgtcacctcagaaagtgaccctgtacctgcggcccggacaagctgccgctttcaatgtgacattcaggtag

SEQ ID NO: 15616 - DNA, 213 bp, Artificial Sequence
  Description of Artificial Sequence: Synthetic coding sequence
atgctaggattgcgcccacctctgcttgcactcgtcggtctgctcagcctgggatgcgtcctctcgcaagaatgcactaagtttaaagtgtcttcctgtcgcgaatgtatcgagagtggccccggctgcacctggtgtcaaaaactaaacttcacgggccccggagatccagacagcatccgatgcgatacacgaccacagctactgatgtag

SEQ ID NO: 15617 - DNA, 150 bp, Artificial Sequence
  Description of Artificial Sequence: Synthetic coding sequence
atgctgggcctgcggccgcccctcttggcgctggtaggtttgctctccctgggatgcgtgctgtcacaagagtgtactaagttcaaagtgtcctcttgccgagagtgcatagagagcggccctgggtgcacctggtgtcaaaaactctag

SEQ ID NO: 15618 - DNA, 483 bp, Artificial Sequence
  Description of Artificial Sequence: Synthetic coding sequence
atgctgggtctgcgaccaccactgctcgccctagtgggcttgctgtcacttggctgcgttctctctcaggaatgcacgaaattcaaggtttcctcgtgcagagagtgtatcgagtcgggaccgggatgtacttggtgccagaagctcaattttacgggccccggcgatcctgattccatacgctgcgatacacgaccccagttgctgatgcgagggtgcgccgcggatgacataatggatcccacatcgctcgctgagactcaggaagaccacaatggtggtcagaagcagcttagcccccaaaaggtaactttgtaccttcggccagggcaagctgccgcctttaacgtaacctttcggcgcgccaaggggtaccctatcgatttgtactacttgatggacctctcttactccatgcttgacgatctgcgaaatgtcaaaaaacttggaggcgatttgcttcgcgccttaaacgagatctag

SEQ ID NO: 15619 - DNA, 501 bp, Artificial Sequence
  Description of Artificial Sequence: Synthetic coding sequence
atgctggggctgcgaccaccactgctggccctggttggcctcctgtcacttgggtgtgttctctctcaggagtgtacgaagttcaaagtttccagttgtagagagtgcatcgaatccgggccagggtgtacctggtgtcagaaattaaactttacaggacccggcgaccccgacagcatccggtgcgacacccggcctcagctgctaatgaggggatgtgccgccgatgatatcatggatcccaccagcctggccgaaacccaggaagaccataatggcggccaaaagcaattgtcccctcagaaagtcacgctttatctccgtcccggccaggccgccgccttcaacgtgaccttcaggagggcgaagggctacccaattgacctttactatctgatggatttgtcgtactcaatgctcgatgatcttagaaatgtgaaaaagctgggcggagatttactgagggcactgaacgagattacagagtcaggaagaatctag

SEQ ID NO: 15620 - DNA, 1137 bp, Artificial Sequence
  Description of Artificial Sequence: Synthetic coding sequence
atgctgggactgcgaccaccactcctcgctctggtgggcctcttgtcgctaggatgtgtccttagccaagaatgtacaaagtttaaggtgagttcttgccgcgagtgtatagagtctggccctggttgtacctggtgtcagaaactcaacttcaccgggcctggcgaccctgacagcattcgctgcgatactcgcccccagctattaatgcgcggttgcgcagcggatgatattatggacccgacgtctctggccgagacacaggaggatcacaacgggggccaaaaacaactcagtccgcaaaaggtaaccctgtacctcaggccgggctttggatctttcgttgataagaccgtgctcccttttgtgaatacacatccagacaagctgcgaaatccttgtcctaataaggaaaaggaatgtcagccccccttcgcattcagacacgtattgaaactgacaaacaacagtaaccagtttcagacagaagtggggaaacaactgatcagtggcaaccttgatgcccctgagggaggcttagatgccatgatgcaggtggccgcatgccccgaagagatcggatggaggaacgtgacacggctgcttgtctttgcaaccgatgacgggttccactttgctggcgacgggaaacttggagctattcttactccaaatgacggcagatgtcacttggaggacaacctctacaaaaggtccaacgagtttgactacccatctgtcggccaactggcgcataaactggccgagaacaacattcagccaatattcgccgtaacctcccgtatggtcaaaacatacgagaagctgaccgaaattatccctaagtcagcggtaggtgagctcagcgaggatagcagcaacgtggtccagttaattaagaacgcttataacaaactctcatctcgggtctttctggaccacaatgcactgccagacaccttgaaggtcacctatgacagtttttgctctaatggagtgacccaccgaaatcagcctagaggtgattgcgacggagtccagataaatgtgccaatcacatttcaggttaaagtaactgccaccgaatgtatacaagagcaaagcttcgttatcggtcgctgggcttctcgcacttag

SEQ ID NO: 15621 - DNA, 2367 bp, Artificial Sequence
  Description of Artificial Sequence: Synthetic coding sequence
atgcgagcacgaccccgccccagacccctctgggccacagtgttagcgctgggagcgctggccggtgtcggggtggggggaccaaacatatgtacaacccggggggtcagttcttgtcagcaatgtcttgctgtttcgcctatgtgcgcctggtgtagtgacgaggctctgcccctgggatctccgagatgcgacctcaaggagaacttattgaaggataactgcgcacctgagagtatcgagtttcctgtgtccgaagcacgagtcctggaggatcggccacttagtgataaaggctcaggcgacagctcacaagtgacacaggtttccccccaacgcatcgcccttcgcctgcgtcccgacgattctaagaactttagcatccaggttcggcaggtagaggattaccccgttgatatttattacctgatggaccttagttactccatgaaagacgacctgtggagtatccagaacctgggtactaaacttgccacccagatgcggaagctgacaagtaatctgcgaattggatttggagcatttgtcgataaaccagtgtccccctacatgtatatttcgccacccgaagctcttgagaacccctgttacgacatgaagaccacgtgcttgcctatgttcggatacaaacacgtgctgaccctaactgaccaggtcaccaggttcaatgaagaagttaagaaacagagcgtgtctcgaaaccgcgatgcaccagagggcggattcgacgccatcatgcaggccacagtatgcgacgagaaaataggctggaggaatgacgccagtcacctcctcgtctttaccacagacgctaaaacccacatagcccttgatggacgcctggccggtatcgtccagcctaacgatggtcagtgtcacgtcgggtctgacaatcactatagcgcttccaccactatggattatccctcccttggcctgatgactgagaagctgtcccagaaaaatatcaatttgattttcgctgttaccgaaaacgtggtgaatctctatcagaactatagtgagttgattccagggaccacagtcggtgtcttatcgatggactcaagtaatgttttgcagctgatagtggacgcgtatgggaagatacggtcgaaagttgaactggaggtgcgggatctccctgaggaactttctttgtctttcaatgcaacttgcctaaacaatgaggtgatccctgggctcaagagctgcatgggtttgaaaatcggcgataccgtaagcttcagcattgaggcaaaggtaagggggtgcccccaagagaaggagaaatcatttacaattaaacccgttggattcaaggactctctgatcgtgcaagtaaccttcgactgtgactgcgcttgccaggctcaagccgaaccaaattctcaccgctgcaacaatggaaacggtacgtttgaatgtggagtttgccgatgtggtccaggatggctagggagccagtgcgagtgcagcgaggaggattaccgaccctctcaacaggacgagtgctctcctagggaggggcagcctgtgtgttcacaacgaggagagtgcctatgtggccagtgcgtgtgtcactcaagcgattttggtaagattacggggaagtactgtgaatgcgacgacttttcatgcgtgcggtataagggcgaaatgtgctccggccacggccaatgtagctgtggcgactgcttgtgcgatagcgactggacaggctattattgcaactgtaccaccagaaccgacacttgcatgagctcaaacggccttttatgctccggcaggggtaagtgtgaatgcggcagctgtgtttgtatccagcctggtagctacggcgacacctgtgagaaatgtcccacttgtccggacgcttgtaccttcaaaaaggagtgcgtggagtgcaagaagtttgacagaggcgcactgcatgacgaaaatacatgcaatcgttactgcagagatgagatcgagagcgtaaaggagctgaaggataccggtaaagacgcggttaactgtacttacaaaaacgaggatgattgcgtcgtcaggtttcagtactatgaggattcatctggtaaatctatcctgtacgtggtggaagagcctgaatgcccgaaggggcccgacattctcgtggtgctgctgtcagtgatgggtgctatcctcctgatcgggctggccgcacttttaatctggaaactcctgatcacaatccatgatcgaaaggaattcgcaaagttcgaggaagagagagctagagcgaagtgggatacagctaacaaccccctttacaaagaagcaacgtcgacatttaccaatataacttatcgcggcacatag

SEQ ID NO: 15622 - DNA, 2256 bp, Artificial Sequence
  Description of Artificial Sequence: Synthetic coding sequence
atgtgtgcctggtgctcagatgaggcgctgcccctggggagtccaaggtgtgatctgaaggagaacctgctcaaggataattgtgccccagaatctatcgagttccccgtgtcagaggcccgtgttctggaggacaggccactgagcgataagggaagcggggactcttctcaggtgacccaggtaagtccccaaagaatcgcccttcggctgcgacccgatgacagcaaaaacttctcaattcaggtgaggcaggtagaggactacccagtggacatttattatctcatggacctgtcttattccatgaaagatgatttatggagcatccagaaccttggtacgaagcttgccacacagatgcgtaaattgacctctaacctcagaattggattcggtgcattcgtcgacaaacctgtatcaccatacatgtacatttctcctccagaggccctggaaaacccttgctatgacatgaagaccacttgcctgcccatgttcggatataagcacgtactgacgcttaccgaccaggtcactaggtttaacgaggaagtcaaaaaacagtcagtgagccggaatagggatgcccccgaaggcggcttcgatgctatcatgcaagccactgtttgcgacgagaaaattggttggaggaacgacgcatcacacttgctggtgtttaccaccgacgccaagacacatattgcactggacggacgattggctggaatagtgcagcccaacgatggtcagtgtcacgtcggctccgacaatcactacagcgctagcaccaccatggactacccaagcttagggctcatgaccgagaagctcagccaaaagaacataaacctcatctttgcagtgactgagaacgtcgtgaatttataccagaattattccgagctgatccctggtaccactgttggggtgctgtccatggacagtagtaacgtgctgcagctgatagtcgatgcttatggaaagattcgctcaaaagtggaattggaggtccgcgatctgccagaggagctctctctgagctttaacgctacctgccttaacaacgaagttattccaggattgaaatcatgtatgggcctaaaaatcggagacactgttagcttctccattgaagctaaagttaggggctgtccccaagagaaggaaaagagtttcacaatcaaacctgtgggcttcaaggatagcctgattgttcaagtgacatttgactgcgactgcgcttgccaagcccaggccgaacccaactctcataggtgcaataatggtaacgggaccttcgagtgtggtgtgtgtcggtgtggccccggttggctcggcagccaatgcgagtgcagtgaggaggactatcgtccctcccagcaggacgaatgcagtccacgggaggggcaacctgtgtgcagtcagagaggggaatgtctctgcggacagtgcgtgtgccattcaagcgactttggcaagattaccggcaaatattgcgaatgtgacgacttctcctgtgtcaggtataagggtgaaatgtgttccggtcatggccaatgctcctgcggagattgtctgtgcgactcagactggacaggctactattgtaattgtacgactcgcacggacacctgtatgtcctcaaatggactgctgtgctccggaagaggaaagtgtgagtgcggcagctgtgtatgtatccaaccaggctcttatggagatacgtgcgagaagtgcccgacctgcccggacgcgtgtacctttaaaaaagaatgtgtggagtgtaaaaagttcgataggggtgctctgcacgacgagaatacctgtaatcgttattgtcgcgacgaaattgagtctgtcaaggagctcaaggacacaggaaaggacgccgtcaattgcacttacaaaaacgaggacgattgtgtggtgagattccagtattatgaggattctagtggaaagagcatactgtacgtggtggaagagcccgagtgtcccaaggggccagatatcctggtggttctgctctcagtcatgggtgctatcttgctgatcggtcttgctgcattattaatttggaaactgcttataactatccacgataggaaagagttcgcgaagttcgaggaagagcgagccagggcaaagtgggatactgaaattctgttgtattactgctcctttatactggtgcaccagtctctggagagtctgcgtactgaatttacttctaagcagaaggatggtaattag

SEQ ID NO: 15623 - DNA, 2367 bp, Artificial Sequence
  Description of Artificial Sequence: Synthetic coding sequence
atgcgggctcggccacggccacgaccactgtgggcgactgttctggctctcggagcccttgccggcgtgggggtgggtggccctaatatatgcaccacgcgtggggtttcttcctgccagcagtgcctggcagtaagtccgatgtgcgcttggtgctcggacgaggcgttacctttagggtccccacgctgcgacctgaaggagaatttattgaaggacaattgcgctccagagagcatcgagtttccagtcagcgaggctagggtattagaggaccgacccttaagtgataagggatccggggattctagtcaggtgacccaagtgtctccacagcgcattgccttgcggcttaggcccgatgactccaagaacttctctattcaagtgaggcaggtggaagattaccccgtcgacatctactatttgatggacctgtcatactcaatgaaggacgatctttggtccattcagaacctgggaaccaaacttgccacccagatgcggaaattaacctccaacctaagaatcggattcggtgcattcgtcgataagccagtaagcccgtacatgtatatttcaccaccagaagcactggaaaatccgtgctatgacatgaagacgacatgtctgcccatgttcggatataagcacgtcctgactctgaccgaccaggtaacccggtttaacgaggaggtaaagaaacagagcgtgagtagaaatcgagacgcgcccgagggaggattcgacgccatcatgcaggccaccgtgtgtgacgaaaagatcgggtggaggaacgatgcctcacacctactggttttcacaacggacgcaaaaacccacattgcgctggatggcaggctggcaggcattgtgcaacccaacgatggccagtgtcatgtcggtagtgacaatcattattctgcatctaccactatggactatcctagtcttggactcatgacagagaaattatcccagaaaaatatcaacttgattttcgctgtcaccgagaacgttgtaaatctctatcagaactacagcgaactcatacccggaacaacagtgggtgtgctaagcatggactcaagcaatgttttgcagttgattgtcgatgcttacggcaagattcgcagtaaagttgaactggaggtgagagatctccccgaggagttgagtctcagttttaacgctacatgcctgaacaacgaagtcattcccggtctcaagtcttgtatgggactcaagattggagataccgtttctttttccattgaagctaaagtgcgcggctgtcctcaagagaaagaaaaaagtttcaccattaagcccgtcggtttcaaggatagcctcatcgtccaggttaccttcgactgcgactgtgcatgccaggcccaggcagaacctaattctcaccggtgtaacaacggaaatggcacatttgagtgcggcgtttgtcggtgcggccccggttggttgggtagtcagtgcgagtgtagtgaagaggactatcggccatctcaacaggatgagtgttcaccccgggaaggtcagccagtgtgtagtcaacgcggggaatgtctttgcgggcaatgtgtatgccactctagtgatttcggcaaaattacaggaaaatactgcgagtgcgatgacttctcttgtgtgcgctataagggagagatgtgttcagggcacggccagtgctcctgtggtgactgtctctgtgattccgactggaccggatattattgcaattgtacgacaagaactgacacatgtatgagtagcaatggcctcctttgctccggtagagggaagtgcgaatgcggaagttgcgtttgtatccaacctggaagctacggcgacacatgtgagaagtgccccacctgtccagacgcttgtacctttaaaaaggagtgcgttgaatgtaaaaaattcgaccggggcgcacttcacgacgagaatacatgtaatcgctattgccgcgatgagatcgagtcagtgaaagaactcaaggacaccggtaaagacgccgttaattgcacttacaagaatgaagacgactgcgtcgttagattccagtactacgaggattcatcgggaaaatccatcctgtatgtggttgaggagcctgagtgccctaaagggccagacatcttggtcgtactgctctctgtgatgggcgccatacttctcattggcctcgccgctcttctgatatggaagcttctcatcaccattcacgacaggaaagagttcgcaaagttcgaagaagagcgtgctagagcaaagtgggatactgctaacaacccattatataaagaggcaacttcaacgttcacgaatataacctacaggggaacatag

SEQ ID NO: 15624 - DNA, 1359 bp, Artificial Sequence
  Description of Artificial Sequence: Synthetic coding sequence
atggacgacatttttacccagtgcagggaaggaaatgctgtcgcagtgaggctgtggcttgacaatacggaaaacgatctgaatcaaggagatgatcatggtttttcccctctgcactgggcctgcagggagggtaggtccgcagtcgtcgaaatgctcatcatgagaggtgctagaattaatgtgatgaatagaggtgatgacacaccactccacttggcagccagccacgggcaccgcgacatagtgcaaaaactgctgcagtacaaagcggatatcaatgctgtgaacgagcatggtaatgtccccttgcactacgcctgtttctgggggcaggaccaagtggcagaggacttagtggccaacggcgcccttgtctcaatctgcaacaaatacggagaaatgccggttgacaaggcaaaagcacctttgagggaactgctgagagagcgggcggaaaagatgggtcagaacctgaaccgaattccctacaaagataccttctggaaaggcaccacgcgcaccaggcctcggaatggaactttgaataagcactctggaatagactttaaacagctgaatttcttgaccaaattgaatgaaaatcactcgggcgagctctggaaaggacggtggcagggcaatgatattgtcgtgaaggtgctgaaggtcagggattggagtacccgcaagagccgggattttaacgaagagtgcccaagactgagaatcttctcccatcctaatgtgcttccagttttgggtgcgtgtcagtcccctcccgcaccacatccaaccctgatcacccactggatgccgtacggcagcctgtacaacgtgctgcacgagggcaccaattttgtcgtcgaccagagccaagccgtcaaattcgccctggatatggctcggggcatggccttcctccatacgctcgagcctctgattcctaggcatgctctgaatagccgttccgtcatgatcgatgaagatatgacagctcgcataagtatggccgacgtgaagttcagttttcagtgccccggtagaatgtacgctcctgcgtgggtagcacccgaagccttacagaaaaaacccgaggacacgaataggcgctccgcagacatgtggagctttgctgtgctgctgtgggagctagttacgagggaggtgccctttgcagatctgagcaacatggagattggcatgaaggtagcgctagaagggctgcggcctacgataccccccggcatatctccccacgtttgtaagctaatgaagatttgcatgaacgaggatccagccaagagacctaaatttgatatgattgtaccaattctggaaaaaatgcaggataagtag

SEQ ID NO: 15625 - DNA, 1359 bp, Artificial Sequence
  Description of Artificial Sequence: Synthetic coding sequence
atggatgacatattcacacagtgtcgggaaggtaatgccgtcgcggtgagactgtggctggataataccgagaacgatttgaaccagggcgacgatcacgggttctcgcctttgcactgggcctgtagagagggacggagtgccgttgttgaaatgctgattatgcggggcgcgcgcattaacgtgatgaaccgtggcgacgacacccccctccacttggcagcttcccatggacatcgggacatcgtgcagaaattgttacaatataaggcagacattaacgcagtgaatgagcatggcaacgtccctctgcactacgcttgcttttggggccaggaccaggtggctgaggatctcgtggctaacggtgcgctggttagcatctgtaataagtacggtgaaatgcccgtagacaaagccaaggcccctctgagggagcttctgcgagagcgagcagagaagatggggcagaatctcaaccgtattccgtataaggacactttctggaaaggcacaaccaggacacgaccaagaaatggcactctgaataagcactccgggatcgatttcaaacaacttaattttctgactaaactgaacgaaaatcattctggcgagctgtggaagggacggtggcaggggaacgacatcgtggtcaaggttctgaaagtcagggactggtccaccagaaagagccgcgatttcaacgaagaatgtcctcgactccggatattttcccaccccaacgtgctgcctgtgctcggcgcatgccagtccccccctgcgcctcatcccacgctgatcacccactggatgccgtacggttccctgtataacgtcctgcacgaagggactaacttcgttgtggatcagtcgcaggctgtgaagtttgctcttgacatggcccggggcatggctttcctccatactctcgaacctttgataccaagacacgccctgaactcccggtcggttatgattgacgaagatatgacggctcgtatcagcatggcagacgtgaaattttcctttcaatgtcctgggaggatgtatgctcctgcttgggtggcccccgaggccctacagaagaagcctgaggatacaaacaggcgcagcgctgacatgtggagttttgccgtcttgctctgggaactggtgacacgagaggtgccattcgctgatctgtccaacatggagatcggcatgaaggtagccctggagggactgcgacccacaattcctcccgggatctctccccacgtgtgtaaactgatgaagatctgtatgaatgaggacccagctaaacggcctaaattcgacatgatcgtgcctattttagaaaagatgcaggataaatag

SEQ ID NO: 15626 - DNA, 1359 bp, Artificial Sequence
  Description of Artificial Sequence: Synthetic coding sequence
atggacgacatctttactcagtgtagggaggggaatgctgtcgctgtgcggctgtggctcgacaataccgagaatgacctcaatcagggtgatgaccatggcttcagcccccttcactgggcgtgtcgcgagggcaggagcgcagtcgtggaaatgctgatcatgaggggggccaggatcaatgtcatgaataggggcgacgatacccccctgcatctcgccgcatcgcatggccacagggacatagtccaaaaactcctgcagtataaggccgacatcaacgcggtgaatgagcatggaaacgtccccctacactatgcgtgtttctggggccaggaccaggtggcagaggacctggttgctaacggtgctctcgtttcaatctgcaataaatacggggagatgcctgtcgataaagccaaagcccctctacgcgaactcctgcgagaaagggcagagaagatggggcagaatctgaaccggattccctataaggacaccttctggaaaggaacaacccgcaccagacctcggaatgggacactgaacaagcactcgggcatcgatttcaagcaactgaatttcttaacaaaattgaatgaaaaccatagcggtgaactctggaaagggcgctggcagggaaacgatatcgtggtcaaagtgttgaaggtacgggactggagcaccaggaagagccgggatttcaacgaagagtgcccgcggctgcggattttcagccatcctaacgtgctgccagtgctaggggcctgtcagtctccacctgcaccgcatcccactcttataacacattggatgccctacgggagtttatacaatgtgcttcacgaagggacaaactttgtcgttgatcagtcccaggccgttaaattcgctctcgacatggcgcggggcatggcctttctgcatacgctggaaccccttattccgagacatgcccttaatagtcggtctgtaatgattgacgaggacatgactgcccgtatctcaatggccgacgtcaagttctctttccagtgccccggtcggatgtatgctcccgcctgggtcgcccctgaggccttacagaagaaaccagaagataccaacaggaggtccgctgatatgtggtcctttgcagttctgctctgggagttggtgacaagagaggtaccttttgcagacctaagtaacatggaaatcgggatgaaagtggcactggaaggtcttaggccgacaataccccccgggatatcgcctcacgtgtgtaagctgatgaagatatgtatgaatgaagacccagcaaaaaggcccaaattcgatatgatagtacctattctggaaaagatgcaggacaaatag

SEQ ID NO: 15627 - DNA, 957 bp, Artificial Sequence
  Description of Artificial Sequence: Synthetic coding sequence
atgcctgtggataaagccaaagcccccttgcgagaactcctgcgtgaacgtgcagagaagatggggcagaatctcaatagaatcccatataaggacacattctggaaaggaacaacacgaaccagacctcgcaacggaaccctaaataagcactctggtatcgattttaagcagcttaacttcttgactaagctgaacgaaaatcattctggagagctttggaagggccgttggcagggcaatgacatcgtggtgaaggttctgaaagtcagagattggtctacgcgcaaaagcagggatttcaacgaagaatgtcccagactgcgcatattcagccatcccaacgtgcttccagtgcttggcgcatgccagtccccccctgctccccacccaactttgattacccattggatgccatatggctctctgtacaatgtcttacacgagggaaccaacttcgtggttgatcaaagtcaggctgtaaaattcgcccttgatatggcacgaggcatggccttcctgcataccctggaaccgctaattcctcgccacgccctaaattcaaggagcgtgatgatcgacgaggacatgacagcacgaatttccatggctgacgtgaagttcagcttccaatgtcctgggcgcatgtatgcaccagcctgggttgcgcctgaggccctgcagaagaaaccagaagacacaaacaggaggtcagccgacatgtggtcttttgccgtcctactgtgggagcttgtgacaagggaggtgcctttcgccgatcttagcaatatggagattgggatgaaggtggccttggagggcttgcggcccactatcccacctggaatttccccacacgtctgcaaattgatgaagatttgtatgaacgaggatcctgccaagagaccaaagtttgacatgatcgtccctattttggaaaagatgcaggataagtag

SEQ ID NO: 15628 - DNA, 978 bp, Artificial Sequence
  Description of Artificial Sequence: Synthetic coding sequence
atgcctattacaaggatgcgcatgcgcccttggctcgagatgcagatcaatagcaatcaaatccccggcttgatttggattaataaggaggaaatgattttccagatcccatggaagcacgccgccaaacacgggtgggacattaataaggatgcttgcctgttccgctcgtgggccattcacaccggccgctataaagccggcgagaaggaacctgaccccaagacttggaaggctaatttccgatgcgctatgaacagcctcccggatatcgaggaggtaaaagaccagtcccggaataaggggtcctctgctgtgagggtgtatagaatgctgccacctctgactaagaaccagcgcaaggaaaggaagagcaagtcaagccgggacgcgaagtctaaggcaaagagaaagtcctgtggcgactcatcacctgacaccttttccgacgggctctcctcgagcaccctgcccgacgaccatagttcctataccgtgccgggctacatgcaggatctggaagtcgagcaggcgctgaccccagccctgtcgccatgcgcagtgagcagtaccctgcccgattggcatatccctgtggaagtagtgcccgactcaacttccgacctctacaatttccaggtgagccctatgccaagcacttcagaggccacaactgatgaggacgaggaaggcaaacttccagaagacattatgaagctactggagcagtcagaatggcagcctactaacgtggatggtaaaggatacctgcttaacgagcccggagtccagcctacctccgtttacggcgacttctcttgcaaggaggagcccgagatcgatagccctggtggcgatatcggtttgtcactacagagagtattcacggacttaaaaaatatggatgcaacatggctcgattccctgctgacaccagtgaggctgccatcaattcaggccattccctgtgctccctag

SEQ ID NO: 15629 - DNA, 978 bp, Artificial Sequence
  Description of Artificial Sequence: Synthetic coding sequence
atgccaataactagaatgaggatgagaccctggctggagatgcagattaactccaatcagatccctgggttaatctggattaacaaggaagaaatgatttttcagatcccatggaagcacgctgccaaacacggatgggatattaataaggacgcttgtctattccgcagttgggctatccacacgggacgttacaaagccggcgagaaagagcccgatccaaaaacctggaaggcaaactttcgctgcgcaatgaatagcctccctgacatagaggaggttaaggaccaaagccgaaataagggaagctccgcagttcgcgtctatcgaatgctaccaccactgaccaagaatcaacggaaagaacggaaatctaaatcttctagagacgccaaatcgaaggccaaaagaaagtcttgtggtgactccagtcctgataccttcagtgacggcctcagtagctccactctaccggacgaccacagttcatacacggtacccggctatatgcaggacctagaggtggagcaagccctgacacccgcactgtccccctgcgctgtgagtagtacccttcccgattggcacatccccgtggaggtagtccccgacagcacatctgacctttacaactttcaagtctcccctatgccctcgacctctgaggcaaccacagatgaggacgaagaagggaaactacccgaggacattatgaaactgctggagcagagtgaatggcaacccactaacgtcgacggcaaaggctacctgttaaatgagccaggcgtccagccgacatcggtgtatggagactttagctgtaaggaggagcccgaaattgactccccagggggggacatcgggttgagcctccagcgagtgttcaccgatctgaagaacatggacgcaacctggctggactcactgttaacaccggtcagactgcccagcatccaagccatcccatgcgctccgtag

SEQ ID NO: 15630 - DNA, 579 bp, Artificial Sequence
  Description of Artificial Sequence: Synthetic coding sequence
atgcctatcacaaggatgagaatgcggccatggttggaaatgcagataaacagcaaccagattccggggctcatttggattaacaaagaggagatgatctttcaaatcccatggaagcatgctgcaaaacatggatgggatattaacaaagacgcctgcctgtttcgcagctgggccatccacacgggtcgatataaagcaggcgaaaaagagcctgacccaaaaacatggaaagccaactttcgctgtgctatgaactctctgcccgacatcgaggaggtcaaggatcaaagtaggaataaaggctcatcagctgtgagggtgtaccggatgctgcccccactgactaaaaaccagaggaaagagagaaaatcaaagtcgtcaagggacgctaaatctaaggcgaagaggaagtcatgcggtgattcctctcccgacacgttctccgacggactgagcagctctacattgcctgatgaccatagtagctatacagtgcccgggtatatgcaggatttggaggtcgaacaggcactgacacctgccctcagtccatgcgcggtctcatccactctgtag

SEQ ID NO: 15631 - DNA, 1356 bp, Artificial Sequence
  Description of Artificial Sequence: Synthetic coding sequence
atgaatcttgaaggcggcgggcgcggtggagagttcggaatgtctgctgtgtcctgcgggaatggaaaactgaggcagtggcttatcgatcagatcgatagcgggaaataccctgggctggtgtgggaaaacgaagaaaagtcaatttttcgcattccgtggaaacatgccggcaaacaggattacaatcgcgaggaagacgctgcactgtttaaagcatgggctttgttcaaggggaagtttagagaaggtatcgacaagcccgaccctcctacatggaagacccggctgaggtgtgctctgaacaagtccaacgattttgaagaactggttgaacgctcacagctggacatcagtgatccttacaaagtttataggatcgtgccggaaggcgccaaaaaaggagcaaagcagctcactctagaggacccacagatgtccatgtctcacccctacacaatgaccactccttacccctctcttcctgcccagcaagtgcacaattacatgatgcctccactcgaccgcagctggcgcgattatgtgcccgatcagccacatcccgagattccgtatcaatgccctatgaccttcgggccgagaggacaccactggcagggaccagcttgcgaaaatggttgtcaggtgaccgggactttctatgcgtgcgcacctcctgaatcccaggcccccggagtgccgacggagcccagtattcgttctgctgaggctctggcatttagtgactgccgactacacatctgtctatattatcgggagatcctagtcaaagagctaactacaagctccccggaggggtgtcggatcagccacggccacacatatgacgcctctaacctggaccaagtgctttttccctacccagaagacaacggacagaggaagaatatagaaaagctactttctcacctcgagcgaggggtggtattgtggatggcccctgatggtctgtacgctaaacggctttgtcagagcaggatctactgggatggacccttggccctgtgcaacgacagaccaaacaagctcgagcgggaccagacgtgcaaactcttcgacacgcagcaatttctttctgagctccaggcgttcgcccatcacgggagatcattaccacgttttcaggtcaccctgtgctttggagaggaattccctgaccctcagcgccagcgcaaattgattactgcgcatgtagagccactcctggccagacagttgtactattttgctcagcagaactcagggcactttctgagggggtacgaccttcctgagcacattagcaacccagaagattatcaccggtccatccggcactcatctatccaggaatag

SEQ ID NO: 15632 - DNA, 1443 bp, Artificial Sequence
  Description of Artificial Sequence: Synthetic coding sequence
ttgggccctaccgccgccctttcctccgaaagtcgggctcgggccgctcaggcgggtggcggacccagagctcgggcgcgcactcgcggcatgaacctggagggcggaggtcgtgggggagaattcgggatgtcagctgtcagctgcgggaacgggaagctgcggcaatggcttatcgaccagatcgactccggcaaataccctggcctggtttgggagaacgaggaaaaaagtatcttccgcataccctggaaacatgccgggaaacaggactataatagggaggaggatgcagccctgttcaaggcttgggccttattcaagggaaagttccgagagggaatcgataagccggaccccccgacctggaagacacgcttgcggtgtgcacttaacaagtcgaatgatttcgaagaattggtcgagagaagccaactggatatatctgatccatataaagtatacaggattgtgcccgaaggagctaagaaaggggcaaagcaattaaccctcgaggaccctcaaatgtccatgtcccacccctacaccatgacaactccctatccatccctccccgcccaggtgcataactacatgatgccacccctcgaccgatcgtggcgtgattacgtgcccgatcagcctcacccagaaataccatatcagtgcccaatgacttttgggcctcggggtcaccattggcaggggcctgcttgcgaaaacggctgccaggttacaggtactttctacgcttgcgctccccccgaatctcaggcaccaggagttccaaccgagccaagcatacggtccgcagaagccctcgcattcagcgattgccggctgcatatatgcctttattatagagaaatacttgttaaagagctcaccacttcctctcccgaggggtgtagaattagccacggacacacgtatgatgcaagcaatctggaccaggtgctcttcccttatcctgaggataacggccaacggaaaaacatagagaagctgctgagtcatctcgagagaggcgttgtactctggatggcgccagatggtctctacgcgaaaaggctgtgccaatctaggatatactgggatggaccccttgcgctctgtaatgacaggccaaacaagctagagcgcgaccagacttgtaaactgtttgacacccagcagttcctgtctgagctgcaagcctttgcacaccatggaagatctttgccaaggtttcaggtaactttatgctttggcgaggagttccctgatccccagcggcagagaaagctgattaccgcccacgtcgaaccactgcttgcaaggcagctatattacttcgcacagcagaactccgggcactttctaaggggctacgacctccccgaacacatttctaaccctgaggactatcaccgtagcatccgacattcttctattcaagaatag

SEQ ID NO: 15633 - DNA, 1497 bp, Artificial Sequence
  Description of Artificial Sequence: Synthetic coding sequence
atgaatcaaagcatccctgtggcaccaaccccgcctagacgggtgcggctcaagccttggctagtggcccaagtcaacagctgccaatacccaggactccagtgggtgaatggcgaaaagaagcttttctgtataccatggcggcatgcaacccgccacggaccctctcaggatggagacaataccatttttaaggcctgggccaaggagaccggcaagtataccgaaggcgtagacgaggctgatccagccaaatggaaagcaaacctccgctgcgccctgaacaaaagtcgggattttagactgatctacgacggtccacgggacatgccaccacaaccttacaaaatttatgaagtgtgtagcaatggaccagcccccactgactcccaacctccagaagattactcctttggtgccggggaagaggaggaagaagaggaagaactgcaaagaatgctcccgtctctgagccttacggaggacgtgaaatggccacctaccctgcagcccccgacactcaggcctcctacgctgcagccccctacacttcagcctcccgtggttctcgggccacccgcccccgatcctagtcccctcgctccccctcccggaaatcctgcgggattccgggagttactctcggaagtgctcgagcccggtccgttgcctgcgtcactaccgcccgctggtgagcagttactgccagacttgctgatcagcccccacatgttacccctcaccgacctcgaaatcaaatttcaatatcgagggagacccccgcgcgctctcactatcagtaatccacatggctgccgcctgttctactcccagctggaggcgactcaggaacaggtggaactattcggcccaatctctcttgagcaggtccggttcccttcccctgaagacatcccgtctgacaaacagaggttctatacaaatcagctgcttgatgtcctggatcgcggactcatcttacagttacagggccaggatctctacgctatccgcctgtgccagtgcaaggttttctggtccggcccttgtgcatcagctcatgattcctgccctaatcccatccagagagaggtaaaaactaaattgttcagtctggaacatttcctgaatgaactgatcctcttccagaagggccagacgaacactccgccaccattcgagatcttcttctgctttggagaagaatggcctgataggaagcctcgcgagaaaaaacttatcactgtccaggttgttccagtggcggccaggctcttactggaaatgttttccggggagctgagctggtccgccgacagtatccgcttgcaaatatcaaatcctgatttaaaagaccgcatggtggaacagtttaaagaattgcaccatatctggcaatcccagcagcgactccaacctgttgcccaggcaccccctggcgccggtctcggtgtaggacagggcccttggccaatgcatcccgctggcatgcagtag

SEQ ID NO: 15634 - DNA, 1545 bp, Artificial Sequence
  Description of Artificial Sequence: Synthetic coding sequence
atgaaccaatccatcccagttgcccctactcctcctaggagagtgaggctgaagccatggttggttgcccaggtgaattcttgccagtacccaggcctgcagtgggtcaacggcgaaaaaaagttgttctgcattccctggaggcacgccacacggcacggcccgtcccaggacggcgacaatacgattttcaaagcttgggctaaagagacagggaaatacacagagggcgttgacgaagccgatccggccaaatggaaggccaacctgcgatgcgcattgaataagtcaagagattttcggcttatttacgatggaccccgggatatgccgcctcagccatataagatttatgaagtgtgctcaaatggacccgcccctactgacagtcagccccctgaagactactccttcggagcaggcgaagaggaggaggaggaggaggaactccaacggatgcttccatcactgtctctcaccgacgccgtgcagtctggtccacacatgactccctattctctcctgaaggaggacgtaaaatggccccccacgctccagcccccaacccttagaccgcctacgcttcagccaccgactctgcagcccccagtagtgctgggcccaccagctccagacccatccccgctggccccacctccaggcaacccagccgggttccgagaactgctgtcggaggtgctcgaaccaggcccactgccggctagtctgccaccagctggcgagcagctactcccggacctgcttatatctcctcatatgctgccacttacagatttagagatcaaattccagtatcgggggaggccaccacgggctttaaccatttcaaacccgcatggatgcaggctgttttactcccagctggaggcgacgcaggaacaggttgaattgttcggacctatttcattagaacaggtgcgtttccctagtccagaggacatccctagcgataagcagaggttttacacaaatcaactccttgatgtgctggaccgcggcctgatccttcagctgcaggggcaagacctgtatgcaataaggctatgtcagtgtaaggtgttttggtccggaccttgcgccagcgcccacgatagctgtccgaatccaatccagcgggaagttaaaacaaagttgtttagtttggaacactttcttaacgagctgatcctatttcaaaaagggcaaaccaatacaccacctcccttcgagatattcttctgttttggggaggagtggcctgacaggaagccacgggagaagaagctgatcacagtacaggtcgttcctgttgcagcacgcttgcttctggagatgttctccggtgagttatcttggtctgccgactccataaggcttcagatctccaatcctgaccttaaagacaggatggttgagcagtttaaggaacttcaccacatctggcagtcacagcagaggctccaacctgtagcccaggctccacccggggcaggtctgggagtgggccaggggccatggcctatgcatcccgctggcatgcagtag

SEQ ID NO: 15635 - DNA, 1497 bp, Artificial Sequence
  Description of Artificial Sequence: Synthetic coding sequence
atgaatcagtccatcccagttgcccctactcccccacggagagtccggctgaaaccttggctggttgcccaggtgaattcttgtcagtacccaggactccaatgggtgaacggcgagaagaagctattttgcatcccttggcgacacgctaccaggcatgggcccagtcaggatggggacaatacaattttcaaagcgtgggccaaggagaccggtaagtacactgagggagtcgacgaggctgatcccgcaaagtggaaggccaaccttcggtgtgctttaaataaatcaagggacttcaggctgatttacgatgggcctcgcgatatgcccccccagccctacaagatctatgaggtctgcagtaacggtccagctccaactgactcccagcctcccgaggactactctttcggcgctggtgaggaggaggaagaagaggaagaactgcaaagaatgttgccttcgctttcacttaccgaagacgtgaaatggccaccaacactgcagcccccaacgctgaggcccccaaccctgcaacctccgacgctccagccgcccgtggtgcttggcccccccgctcccgaccctagccctttagctcccccacctggtaacccggccgggtttcgggaactactcagcgaagtcctggagcctggcccactgcctgcgtccttaccacctgccggagaacaactgctccctgatctcttaatctccccacatatgctccctttgaccgatctggaaattaaatttcaatatcggggacgacccccaagagcattgactatttcgaaccctcacggctgtcgcttgttttattcccaactggaggccacccaggagcaggtcgagctcttcgggccaataagtctggaacaggtacgcttccccagccctgaggatattccttcagacaaacagcgcttttataccaaccaactgctagacgtcctggacagaggtctcattctgcagctgcaaggccaggacctctatgccatcagactgtgccaatgtaaagtgttttggtccggcccttgcgcaagtgctcacgacagctgtcccaaccctattcagcgagaagtcaaaaccaaattgttcagcttggaacactttttgaacgaattgatccttttccagaagggccagaccaacaccccccccccctttgaaatctttttctgtttcggagaggagtggcccgatcgcaagccacgcgagaagaagctcatcactgtgcaggttgtcccagtagcggcaaggttgctgctggagatgttctccggcgagttgagctggagtgccgatagcattcgactccagatatccaatcccgatctcaaagatcggatggtggagcagttcaaggagttgcaccatatctggcaatcacagcagagacttcagccagttgcccaggcgcctccaggggctgggttgggagtagggcagggcccttggcccatgcaccctgccggaatgcagtag

SEQ ID NO: 15636 - DNA, 1467 bp, Artificial Sequence
  Description of Artificial Sequence: Synthetic coding sequence
atgaaccagtctatcccagtcgccccaaccccgcctaggagggtgcggcttaaaccttggcttgtcgctcaggtcaatagttgccagtacccaggccttcagtgggtgaacggcgaaaagaaattgttttgcatcccatggcgccacgccacgcgtcatggcccatctcaggacggggataatactatcttcaaagcttgggctaaagaaaccgggaaatacacagagggcgtagatgaggcggatcccgccaagtggaaggccaacctacgatgtgcattgaacaagtctcgagacttcaggctgatatatgacggtccacgagacatgcccccacagccttataagatctatgaggtttgctcaaacgggcctgctcctaccgactcccaacccccagaagattactcttttggcgcaggggaggaggaagaggaagaagaagagctgcagcgcatgctcccttcactgtccctaaccgaggacgtaaagtggccgcccactttacaaccacccaccctacaaccacccgtggttctgggaccccctgcccccgatccgagccccctcgcccctccaccagggaaccctgccggtttcagagagttactatcagaagtgttggagcctgggcccctgccagctagtctgccccctgcgggcgagcagctcttgccagatttactgatttcaccccacatgctccctctgaccgatctggagataaagttccagtatcgcggcaggcctcctcgcgccctgaccatttctaaccctcacggctgtcgtttgttttacagtcagctggaagcaacacaggaacaggtcgagctgttcggacccatttctctggagcaagtccggttccctagcccagaggacatccctagtgacaagcagaggttttacactaatcaacttctggacgtcctagataggggactgattctgcagctgcagggccaggacctctatgctataagattgtgtcaatgcaaggtcttttggagcggtccatgcgcctcagcccacgattcctgcccgaatcccatacagcgcgaggtcaagactaaactgttttcactggaacattttctaaacgagttgattctgttccagaagggccagacgaacacaccaccgccttttgagatattcttttgctttggcgaagaatggccagacagaaagccaagagagaaaaagcttatcacagtgcaggtcgtgccggtggccgcccgcctgctcttagagatgttttcaggcgagctttcctggtccgcagactctatcaggctgcagattagcaatccggatctgaaagatcggatggttgaacagttcaaggagctgcatcatatctggcagtctcagcagaggctacagccagtggcacaggctccgccgggggcagggctaggagtcggacagggcccatggcctatgcacccagctggaatgcagtag

SEQ ID NO: 15637 - DNA, 684 bp, Artificial Sequence
  Description of Artificial Sequence: Synthetic coding sequence
atgaatcagagcatccctgttgctcctacaccgccccgccgggtgagactcaaaccatggctggtggcccaagtcaattcctgccagtaccccgggttgcagtgggtcaatggagaaaaaaagctgttttgcatcccctggagacatgccacccggcacggacctagccaggacggcgacaacaccatctttaaagcttgggctaaagagacaggaaaatataccgagggagtggatgaagctgaccctgccaagtggaaagccaatctccggtgtgcccttaacaagtctagagatttccgtctgatctacgatgggcctcgtgacatgccgcctcaaccctacaagatctacgaggtctgctcaaatggaccagcgccgaccgacagtcagccacccgaggattattctttcggggctggcgaagaggaagaagaggaggaagagagaatgtcttccggcagacctctgtgctctcggcccttgtgtggacggttgctatgtagccggcctctatgctctagaccctggtgctgggttcccctactccagacacctgctccatggctgctgcctttggctactctcttggcctccggatccttctcacttcgaagctggagtttgggcccctgcctgcccgcatgtcccctccaggcgaattcaagttgccaaacatgctag

SEQ ID NO: 15638 - DNA, 474 bp, Artificial Sequence
  Description of Artificial Sequence: Synthetic coding sequence
atgaatcagtctattcctgtagcacccactcccccccgtagagtgcggcttaagccctggcttgtggcccaggtgaattcttgtcaatatccaggactgcaatgggtgaatggggagaagaaactattctgtataccctggaggcacgccacacgccacggcccgtctcaggatggggacaacaccatattcaaggcttgggccaaagagaccggcaagtacacagagggagtggacgaagctgaccctgctaaatggaaggccaatctcagatgcgcactgaacaaatcccgagattttcgcctcatttatgacggcccacgggatatgccaccccagccatataagatttacgaggtgtgcagcaacggaccagctccaacggattcccagcctccagaagactacagcttcggcgctggggaagaggaggaagaggaggaggaaatgcagtgttctctcgcgcccacctag

SEQ ID NO: 15639 - DNA, 321 bp, Artificial Sequence
  Description of Artificial Sequence: Synthetic coding sequence
atgaatcagagcatccctgtcgctcccacccctcccagacgggtaagactcaagccctggttagtggcccaggtcaacagctgtcagtacccaggcctgcagtgggtcaacggggaaaaaaagctgttctgcattccctggcggcacgctacccgccacggcccctcacaggacggagataacacgattttcaaggcttgggctaaggagactggtaagtataccgagggagtagacgaggctgacccagccaaatggaaagccaacctgaggtgcgccctgaataagtcccgggacttccggttaatttatgatggttag

SEQ ID NO: 15640 - DNA, 180 bp, Artificial Sequence
  Description of Artificial Sequence: Synthetic coding sequence
atgaaccagtctatcccggttgcccccacaccccctcgcagagtccgtttaaagccctggctggtcgctcaggtgaactcctgccagtaccctggcttgcagtgggtcaatggtgaaaaaaaactgttctgtataccatggcgacatgctacccgccatggtccttctcaagacggatag

SEQ ID NO: 15641 - DNA, 1497 bp, Artificial Sequence
  Description of Artificial Sequence: Synthetic coding sequence
atgaatcagagcatcccggtcgcgcccacaccaccccgccgagtccgactgaagccatggttagtcgcccaggtgaatagctgtcagtatccaggcttgcaatgggtgaacggggaaaagaaattattctgcattccttggagacacgcaactcgtcatggccccagccaggacggcgataatacgatattcaaagcgtgggctaaggaaacggggaagtatacagagggagtcgacgaggcggatccagcaaaatggaaagccaatctgaggtgtgctctgaataagagtcgggactttcgccttatctacgatggaccaagggacatgccacctcagccttataaaatttatgaggtctgctctaacgggccagctcctacagacagtcagccacccgaggattatagtttcggagcgggagaggaggaagaggaggaagaagagttgcagagaatgttgccctctctcagccttacggaggacgtgaagtggcctccgacgctgcaacctcccacactgcgcccacctacgttgcagccaccaactctgcagccgcccgtggttcttggacccccagctcctgacccaagtcctctggcaccaccaccagggaaccctgccggcttcagagaattgctgtcagaggtgctggagcccggccccctgcctgcaagcctgccacccgcaggggagcagttgctgcccgatctgttgatcagcccgcatatgctccccctgactgatcttgaaatcaaatttcagtatagaggccggccaccacgcgcactgacaatcagtaacccccacggctgtcgccttttttatagtcagctcgaagccacccaggaacaggtagaacttttcgggcctatcagcctggaacaggtgagatttccatcgcctgaggacattccctctgataagcagcgattttacacgaatcagcttctggacgtgctagaccgcgggctgattctgcagctgcagggacaggacctgtatgcaatacgcttgtgtcagtgcaaggtcttctggtccgggccgtgtgctagcgcccatgactcctgtcccaaccccattcaacgtgaggtgaagacaaagcttttctcccttgagcacttcttaaatgagctaattttgtttcaaaaagggcagactaacaccccacccccttttgagatctttttttgctttggggaggaatggcccgatcggaaacccagggaaaaaaagctgataacagtgcaagtggtccccgtcgccgcccggctattactggagatgttcagtggcgaacttagctggtcagctgattctatccgcttgcagatcagcaacccagatctgaaggaccggatggtggagcagtttaaggagcttcatcacatttggcagtcccagcagaggctgcaacccgtagctcaggcacctccgggcgctggccttggagtggggcaggggccctggccgatgcatccagctggcatgcaatag

SEQ ID NO: 15642 - DNA, 426 bp, Artificial Sequence
  Description of Artificial Sequence: Synthetic coding sequence
atgaaccagtcaatcccggtggctccaacaccaccaagacgcgtccggttgaaaccatggcttgtggcccaggttaactcttgccaatatcctgggctccaatgggtgaatggggagaagaaactcttctgcatcccatggcgtcatgcaacccggcacggacccagtcaggacggagacaacactatctttaaggcctgggcaaaggagaccgggaaatacactgaaggggtggatgaggctgatcctgcaaagtggaaggctaacctgaggtgcgctctaaacaagagccgggattttagactgatctatgacggacctcgcgatatgccacctcaaccgtataagatttacgaagtgtgtagtaacggccctgcaccaacagattcccaacccccagaggattattcttttggagcgggctag

SEQ ID NO: 15643 - DNA, 459 bp, Artificial Sequence
  Description of Artificial Sequence: Synthetic coding sequence
atgaaccaaagcatcccagtggctcctaccccccctcgccgggtgcggcttaaaccctggttggtcgctcaggtgaatagttgccagtacccgggccttcaatgggtcaacggcgaaaaaaagcttttctgtataccatggaggcatgccacgaggcacggcccgtctcaagatggagataacacaatctttaaagcttgggccaaggagaccggcaagtacacagaaggggttgatgaagccgatcctgccaagtggaaggcaaacctccgatgcgccctgaataagtctcgggatttccgcctaatatatgacggaccacgggatatgcctccacagccatataagatctatgaagtatgtagtaacggccctgctcctacagacagccagccaccagaggactactccttcggagctggagaagaggaggaggaggaggaggaggtgagtgtgtag
